United States Patent 7,482,117 (GENETIC POLYMORPHISMS ASSOCIATED WITH MYOCARDIAL INFARCTION, METHODS OF DETECTION AND USES THEREOF) - sequence listing, part 15

SEQ ID NO: 52252 - DNA, 201 bp, Homo sapiens
ctcaccgctcatgcttctgggtcatccagccctgtcccaggttctccttgtagaagcgctgggaggagatgatggtgcctgttgtccagtagagcatgacrttggtcagcaggtcgtccagggagaacttcctgggaacgcagaacacaaagccccactctcagtgccacatgcagttgtgtgacaaagggcagccagaaa

SEQ ID NO: 52253 - DNA, 201 bp, Homo sapiens
cccagtaacaaacagcaggattgtggacacacacagtggagccctgatatgctgcagctggacagtgggagctgagcaggcagggcacccccccccccgcccgccggccaggactccaggccttcggtgttcagtcttgccatggcatcagtcattggttttgtatagggagcagagaaggttatttaatctggttagtca

SEQ ID NO: 52254 - DNA, 201 bp, Homo sapiens
agcgattcaccagccttggcctcccaaagtgctgggattacaggagtgagccatggtgcccggccaggggtggatttttattgcagtaagttttgggggtkggggaggggggacacataagagccagagggccctggagagcatgggtttgtgggaagtgtctgcactgcacaggccagggcggcagccgctgtggacaga

SEQ ID NO: 52255 - DNA, 201 bp, Homo sapiens
atcccagtaacaaacagcaggattgtggacacacacagtggagccctgatatgctgcagctggacagtgggagctgagcaggcagggcacccccccccccrcccgccggccaggactccaggccttcggtgttcagtcttgccatggcatcagtcattggttttgtatagggagcagagaaggttatttaatctggttagt

SEQ ID NO: 52256 - DNA, 201 bp, Homo sapiens
acagctccgtgagagaaagtcatcactcgcatttcctggcgaaggaagccaaggcacagagtggttaggctgcttgtctgaactgcgtggtgctgagaccytaactccagagcctgctcacataatccctgagccacactgcctctggtttcagccaggggctgtgtcatttcctttgtgctccagggtagaggtaaacag

SEQ ID NO: 52257 - DNA, 201 bp, Homo sapiens
tctccttgacggggtacagcagctccacatccctctcagtgaggccaagaaacctcccgaaacgctgtcccaggaggagggtcagggtagagaagttgctyaaaaccaaagccatgttcaagtgcaggcctttcacgtggctgaaggcagagagaggggccggggtgaggctgggctggtgtcaaggacagggagagagga

SEQ ID NO: 52258 - DNA, 201 bp, Homo sapiens
taatcccagtaacaaacagcaggattgtggacacacacagtggagccctgatatgctgcagctggacagtgggagctgagcaggcagggcacccccccccmcgcccgccggccaggactccaggccttcggtgttcagtcttgccatggcatcagtcattggttttgtatagggagcagagaaggttatttaatctggtta

SEQ ID NO: 52259 - DNA, 201 bp, Homo sapiens
ttgaaccgggaggtggaggttgcagtaagccgagattgcaccactgcactccagcctgggcgacaagagcgaaactccatctcaaaaaaaaaaaaaaaaamaaaaaaaaactattctgtataggtaatgaacgattttcaaaaatcttagatgaatcaatgagataacagccaaacactcactcaactggcatctactcaa

SEQ ID NO: 52260 - DNA, 201 bp, Homo sapiens
cttgaaccgggaggtggaggttgcagtaagccgagattgcaccactgcactccagcctgggcgacaagagcgaaactccatctcaaaaaaaaaaaaaaaaacaaaaaaaaactattctgtataggtaatgaacgattttcaaaaatcttagatgaatcaatgagataacagccaaacactcactcaactggcatctactca

SEQ ID NO: 52261 - DNA, 201 bp, Homo sapiens
cttttaagccctgagcaggcatggccacatttattacaaagtccttatagtaatgccatacacacacacacacacacacacacacacacacacacacacacattatatgtatatatacacacacatgcatacatatatattttaatagactatctaaatactgaatggtagggatcatttgagttgaatgtggtatattca

SEQ ID NO: 52262 - DNA, 201 bp, Homo sapiens
gcttttaagccctgagcaggcatggccacatttattacaaagtccttatagtaatgccatacacacacacacacacacacacacacacacacacacacacacattatatgtatatatacacacacatgcatacatatatattttaatagactatctaaatactgaatggtagggatcatttgagttgaatgtggtatattc

SEQ ID NO: 52263 - DNA, 201 bp, Homo sapiens
ccatccactacctgtccttccagaggcacatcatcttcctgttggtggtggtcagctttttgtccctgtgtgtcatcctgcctgtcaacctctcaggggayttgctgggtaatgaccctcctcacccttgtctatgttgtaatggggcagagtggcagtcctagggaaagggctcactgtggtagaccagaaccccaggag

SEQ ID NO: 52264 - DNA, 201 bp, Homo sapiens
ggaaagggtggagcaagtcacctccccatctctggggacacagggaggaggccagggtggtaggatggactgggactcttggctccacctcaggtctccayctgagggggagacaggaaacaggtgggggcctggggcctgggcatattcccaactttattctttttttttttttcttttttgagatggagtctcactgtg

SEQ ID NO: 52265 - DNA, 201 bp, Homo sapiens
agtttccttgctcgaggtcagaggcgggtaagctccatgacctgccctcaggtggaggccgctgcgctggattacactgtggtctgactgcaaagcccacrctgacatctttcacatctgcctttttatgatgcagcccttgcccccctgagctcttcccaaagcactgctttcccagcctagaagtagcgccttcaggga

SEQ ID NO: 52266 - DNA, 201 bp, Homo sapiens
taagatgcatgttttttttttttttcagaccgagtttcgctcttgtcgcccaggctggagtgcaatggcacgatctcggctcaccgcagcctccgcctccygggttcaagcaattctcctgcctcagcctccagagtagctgagattacaggcatgcgccaccatgcccagctaatatttttgtatttttagtagagacag

SEQ ID NO: 52267 - DNA, 201 bp, Homo sapiens
tccaacgggcccatccacagtccttccttcccctagtgtctggtaagtgtggggacaggaaggaggaggggtaggtggtggccttgaagtgttgggctggkgtgttccattgggtggtgccactgggggattttaaagggaagccaagaacatctgtgttccagaggtcactcttgtgacactctgttcagagtcagcagc

SEQ ID NO: 52268 - DNA, 201 bp, Homo sapiens
tcttgtgacactctgttcagagtcagcagccccatgactctggcatcacaacccccactacctccagccattgccaagtctcttagaaggttgagaaagtsacttggctgtctgtgggatgctcccatgttcttgggctttccactcattcatgcttcctgtgcttcgtgtgtgtgtgtgtgtgtgtgtgtgtgtgtgtgt

SEQ ID NO: 52269 - DNA, 201 bp, Homo sapiens
ttttttcaatggggcccatggagagaaagctaaaagattattaaaggtgattaagagccagttagttacctctcatgtggtgtagggagccaggaggcggsgggggcggggactgatgtgagtcttggttctcacctgctgccatattccattgaatctaagaagttattgttgtaagatgcatgttttttttttttttca

SEQ ID NO: 52270 - DNA, 201 bp, Homo sapiens
tgtgagggctgagaatcaaggtgaccaggcagcccctggggtcaggggcagaggaaggaggcctgtaggattggagcctccatgctggagggcacacagtscctgctggagcctggggcttcccaaattgagctggatcccaagagttcttgaagatagagatgaactttatttatttcaacatattcagtggaaatcata

SEQ ID NO: 52271 - DNA, 201 bp, Homo sapiens
caatccattaggcttgtttcctctcttttgcctcacctcttggtcagtgattgtaaacaatcaaacagcagcccacatcactttgcccagagctgccctgmgctttcatcagcttttgatctaagttttgtgatttgaccacgaagttgtcaggagattttagcaagagttccaggcatgtggtgtatattgtgaagtact

SEQ ID NO: 52272 - DNA, 201 bp, Homo sapiens
caccctcctgctctggtccttctcggccctgctcccctccattgtctactactctacactgctggagtctcactggaccaagtgagtgcccgggagccccraggccctgcccctaagaaggatatctctgaccgctcccttgtccacaccctaaccccccagctgctcaggcagtgggcacatggcaggggcctcactggg

SEQ ID NO: 52273 - DNA, 201 bp, Homo sapiens
gtattgccaagttgagttctggagccatggccctgggtgaaagtcccacaggggctggggctgcagtgggatgggtgggggcggtcgtagcctatgcttcygaacaggcatcttcctccccagacagcagggcttggggcctcacctccaccctgccaggtttctggtagacactgtgggagctgacccactttgtgctat

SEQ ID NO: 52274 - DNA, 201 bp, Homo sapiens
ggacagcactgtctccgcagcagcagcagcagcagacctatggtgccatccacaacatcagcgggactatccctggacagtgcttggcgcagagcgccacrggcagtgtggctgctgccccccaggaggcctgaggctgggtgagctgctggctgggccaggctcaggggagcctgtggggtgagaagacaggtgaagcgg

SEQ ID NO: 52275 - DNA, 201 bp, Homo sapiens
atagctatgcctgtgattactaccgtgattgcagagctctcagcctgtcgtatctttaaggcccttgggaagggtcatctcaaggggttgagacatgtgamtggagagtacggactagaatagagcagctgcagttcccaagtgtcacctcctgttcccctctggcatccctggggtttttaaagaatcagaagctgggcc

SEQ ID NO: 52276 - DNA, 201 bp, Homo sapiens
gttacttagcttctgtgcacctcccctttctgctccggaaatggagatcataattcctatctcagagaattttggaatttggataaggccagaatactcayatagctatgcctgtgattactaccgtgattgcagagctctcagcctgtcgtatctttaaggcccttgggaagggtcatctcaaggggttgagacatgtga

SEQ ID NO: 52277 - DNA, 201 bp, Homo sapiens
ctggcttatgagtgtgtgggcacctgccggcagcccccggaggccctggccttcaagtggccgtttctggggcctcgacagtgcatcgcctcggagactgmctcgctgcccatgatcgtcagcatcaaggagggaggcaggaccaggccccaggtggtcagcctgcccaacatgagggtgcagaagtgcagctgtgcctcg

SEQ ID NO: 52278 - DNA, 201 bp, Homo sapiens
cagctccctgcctgggatcccagccctgatggcaggtggtttccctctcagcaatgacctcctttggctgcacaccatctttgctgtcatttacctcttcytcactgtgggtttcatgcggcaccacactcagtccattaagtacaaagaggagaacctggtgagtgaggcgggacttagggacatgtgctgggagggact

SEQ ID NO: 52279 - DNA, 201 bp, Homo sapiens
aggagggaggcaggaccaggccccaggtggtcagcctgcccaacatgagggtgcagaagtgcagctgtgcctcggatggtgcgctcgtgccaaggaggctscagccataggcgcctagtgtagccatcgagggacttgacttgtgtgtgtttctgaagtgttcgagggtaccaggagagctggcgatgactgaactgctga

SEQ ID NO: 52280 - DNA, 201 bp, Homo sapiens
cttacatagcgttactcataatacactaatcacaacaaagcaaaggtcctatgccactgcctcccactcctactcagtccccacttgccacatgtgtgcttggtaacctgagtagcctgggcctggctgttgctacatttccttgcagcatcctgaaagatttcaatgcctgcaagtgtcagagccttcagtgcaaaggtg

SEQ ID NO: 52281 - DNA, 201 bp, Homo sapiens
tcagcctggtggcatgtgcctgtagccccagctactcaggaggctgaggtgggaggattgattgagcccagaaggttgaggctgcagtgagccatgattgygccactgtacagcagcctgggtgacagagtgagaccctgtctctaaacaaaacaaaacaaaacaaaagccctctttgtattaaatttcaaaatttccccc

SEQ ID NO: 52282 - DNA, 201 bp, Homo sapiens
ctggagaggatcacagaggaagaacgccacgtccaggaccagcccctgggaatggccttcgtcaccttccaggagaagtccatggccacctagtgagtgtrggcacatccagaccccttcttggctgactccctgttcccctccagataactcactgtccctctcgagtggagatggtactgctgacccaccatccctggg

SEQ ID NO: 52283 - DNA, 201 bp, Homo sapiens
tctacaaaaaataaaaatcagcctggtggcatgtgcctgtagccccagctactcaggaggctgaggtgggaggattgattgagcccagaaggttgaggctrcagtgagccatgattgcgccactgtacagcagcctgggtgacagagtgagaccctgtctctaaacaaaacaaaacaaaacaaaagccctctttgtattaa

SEQ ID NO: 52284 - DNA, 201 bp, Homo sapiens
aagcagtccgggaaggctcccaggaccccatgctggaggacctgaaggctgggctgaggagctgacattttattctttcttcattcctttttttgtaatcytatttttttagagacagggtcttgctctgttgcccaggctagagttcagtagtgcaataatagcttactgcggcctcaactcctggacttaaggcatctt

SEQ ID NO: 52285 - DNA, 201 bp, Homo sapiens
acctatttaattgcctcttctttatttatgtcctctctcttctttctaacagggacccgctggccagaaaggtgacagtggtcttccagggcctcctgggyctccagtaagtatatgttaacaagagtgatgttctgacagtttgcatctggaagctgccaatgatttctctgaacttataagatagacaaaaagcacatt

SEQ ID NO: 52286 - DNA, 201 bp, Homo sapiens
tgtttaaatttgagctgaatgtagaggactttaactatctttcatattacttatgaactatgtgttttaaaccatgctttaaactagtaaaaggctgtggractatcctgagccaaagaatcatttcaccatcttttctatacttcttgagttttatagtaaacacacagttaatgtgagattgttattagctaaaagaag

SEQ ID NO: 52287 - DNA, 201 bp, Homo sapiens
acttgatagaagtgagagagcaattgttgataccaatggaatcacggtttttggaacaaggattttggatgaagaagtttttgaggtaaaaataaatccarctctaagctgaatattgacaaatcagatgaactgggttaacaacagtaaaaatatcgctttatagcaatacgttataaagcaaagttgaaaactctaaag

SEQ ID NO: 52288 - DNA, 201 bp, Homo sapiens
aacatatttaagcatttgaaaataaatatttttagtcaataggtgactttcttttaatgtgacttattcagctatctcatagaattttgatttatgctttrtgttgtatgtagcttttacaaataatactttgcctccttagggatttcaaggcaagaccggccctcctgggccagggggagtggttggaccacaggtatg

SEQ ID NO: 52289 - DNA, 201 bp, Homo sapiens
tccaataggggaacgtgggcatcctggccctcctggccctcctggtgagcaaggtcttcctggtgctgcaggaaaagaaggtgcaaaggtacaacatgctycagaaaactttttttggcccaaaactttaatttatgtttaactatactcaccccttgtctacagattccatttaaatgaatgtcagaagatgtgtcagga

SEQ ID NO: 52290 - DNA, 201 bp, Homo sapiens
agcaaggtcttcctggtgctgcaggaaaagaaggtgcaaaggtacaacatgcttcagaaaactttttttggcccaaaactttaatttatgtttaactataytcaccccttgtctacagattccatttaaatgaatgtcagaagatgtgtcaggaaaatatttaatgtgcgtttattgtactccaagatattgctcaacatt

SEQ ID NO: 52291 - DNA, 201 bp, Homo sapiens
taaacgctgatgttataaaaagttgcaatgttccctaagttctttcactaaagagtcaactttaaatgcagttttcagtgtagctttcagtatacactaaygcactttctacatgaggacatattccttctaaattctcttgcaatttaattcaaaacctaaaggtattttttttccattttaaaatactttctgttttag

SEQ ID NO: 52292 - DNA, 201 bp, Homo sapiens
ggatagctacctgatagacttgtaaacattctacttctttccatatgctaatcttatttgtattgatttaacagggtgaacgaggtcctcaaggtcctccrggtcctcctggtgatgatggaatgagggtatgttaatacttcttttcttaagaaatatttaaaattaaaacataataaaacaaaatcatgttgaaatgat

SEQ ID NO: 52293 - DNA, 201 bp, Homo sapiens
attatactgtgaaagcatttatcatgagtttttatactcacaattaactataccattttatgtaaatatggagtttaaaaaatgctgagatatctccatcrttgtatacaatttttaatgattatgtttaggtatttaaaagccagaattttattagatacacttttattttctccttacttttggagaagtaatcaagca

SEQ ID NO: 52294 - DNA, 201 bp, Homo sapiens
cattgtccaaatgttctatactctcattcattttgtcaatgacagggagaagatggagaaattggaccaagaggtcttccaggtgaagctgtaagcaactyactttttatttttaagtaatatttctagtttttaggactagtgactggtgttacacatataaaaacaatgataaacccaggtaaacattgcagtcttagc

SEQ ID NO: 52295 - DNA, 201 bp, Homo sapiens
atggatgaaatacaagctccgagagacacttttgcatggattcagggattattttactgaagctatttatttttattttccacattgagcctttctgtggmgatatgtgaatattttttaatatcaaatttctgtacttttcatgcataaattttctattttcagtctagcaacatacctgaaacacttttaaacagcatc

SEQ ID NO: 52296 - DNA, 201 bp, Homo sapiens
taatgatttattacattttgctaagtatattagatacagcttgcattaatattttgaaatattttccagaatctcatgagggaaaactgtttgagggtggrtagaggtattttccaattgagaagaacaaaaatctattgtgtaatatagcccattaaaaactttttatattttcctctggcagggtccccaaggggagcc

SEQ ID NO: 52297 - DNA, 201 bp, Homo sapiens
tgctatctttctataagaaaatcgacagtctcacaattttctatgtagtcctagcaatatttaaaatgtgaatgtaggaaaatacatacttttcttttttyaaaaaaatttgagcaaacttgcagaagcccctctcttcccagggaaaaatgactcattcaatgtttagggaatgccaggactaatagccacctgcaggag

SEQ ID NO: 52298 - DNA, 201 bp, Homo sapiens
aggagatggtgggttgattccatatattggctattatgaataatattgcaataaatattggactgcagatatcccttcaacatcctgatgtcatttacttrggacatatacccagtagtagggttgatggataatataacataggagtgcaggtatctctttgacatactgattgcatttcctttgtatgtatactcagta

SEQ ID NO: 52299 - DNA, 201 bp, Homo sapiens
ttcaacatcctgatgtcatttacttaggacatatacccagtagtagggttgatggataatataacataggagtgcaggtatctctttgacatactgattgyatttcctttgtatgtatactcagtagtgcgattgatggcactagctctaattttttgaggaaattttttactattttctatatggctgtattaatttaca

SEQ ID NO: 52300 - DNA, 201 bp, Homo sapiens
taggctagatattgttgattacacatgcacatacacaatggttttgcaaaaagacaacttttcaactaaaggcatctcatttctcaaataataatgcttgytttatttatatgccagagtagtaagaggctcaaataagatatatttgtaaaactattttgaaaaataaaacccgcaacttaatatacactgttttataaa

SEQ ID NO: 52301 - DNA, 201 bp, Homo sapiens
caaaataaattactaataagtagtatagcaggtggtaataagtgtgaaagaaaaagagagcagtaaagaggttagggtgtggcagtggggtgggtagtttwaagaagtgacatcaagccaaatcccactaagaaagtgatatgtaaagaaggtaaagtgcatgccatgctgttcattaaaagactagtgttccaggagaag

SEQ ID NO: 52302 - DNA, 201 bp, Homo sapiens
gcacttccttatcagcacagacagctaattctactgtgcattttatgctgcttgtgtccttttgggtacctagtactgttgggtaacgagtaagtagtcayctgttaactggctgcttaataaatgagcctacattttttgtatgattttagctcatttttataatttaaaatacacagcatttttatgtgaatactgctt

SEQ ID NO: 52303 - DNA, 201 bp, Homo sapiens
aaagcaaagttgaaaactctaaagggtgacctagtttcttcctctgtgagtatagtggtgatgttttctattgttcagtaagagaatgaccagacaatggygaccgtaacgcctgggaaacatttacagggattggttgatttgaacacagacatgctattctcctgggaaggacaaacggcttaactcttagtagtttgt

SEQ ID NO: 52304 - DNA, 201 bp, Homo sapiens
caaagttgaaaactctaaagggtgacctagtttcttcctctgtgagtatagtggtgatgttttctattgttcagtaagagaatgaccagacaatggcgacmgtaacgcctgggaaacatttacagggattggttgatttgaacacagacatgctattctcctgggaaggacaaacggcttaactcttagtagtttgtatta

SEQ ID NO: 52305 - DNA, 201 bp, Homo sapiens
ggaggcagaggcgggcggattacctgagctcaggcattctaaaccagcttgggcaacacggcgaaaaccgatctctactaaaaatacaaaaaaaaaaaaaaattagctaggtgtggtggcgggcgcctgtagtctcagctactcgggaggctgaggcaggagaatggcgtgaacccggcaggcgagcttgcagtgagcgga

SEQ ID NO: 52306 - DNA, 201 bp, Homo sapiens
tgtaggcgtaagtactgtgttattgttaacatagtgtattattggtttgggaatttcttttacagcattacaaacatgtaacaactcttagctgtggttcraattttactttcccttcccaactcattaaggaaaatcacaaatacaaagccttgtttaataactttggatatctttacatatgtggattgataaacaaat

SEQ ID NO: 52307 - DNA, 201 bp, Homo sapiens
tttgattttattgaaatcatacaaatttattgataggtgatgtttaatgtatccttaggaacacttttttttttcttaatataaatgcatcaaactcatgytttttttatttttaatctggatttttctggtgtcttcatttctcattcatctttgtaggtagggatttcttttgatactaatttttctaacagaacataa

SEQ ID NO: 52308 - DNA, 201 bp, Homo sapiens
tcattctagggtcctgttggttttcctggagatcctggtcctcctggggaacctggccctgcagtaagtatcagggaaaaatcaagaaattattttggagkgaatgtttccaatttctgtattgttaataaagaaaaaaaaatctaataacctaagtgaactcccaaaaacagaaagaaaaagaaaacataaaaagtaatt

SEQ ID NO: 52309 - DNA, 201 bp, Homo sapiens
aattctattattaaatattactaatgttttgattttattgaaatcatacaaatttattgataggtgatgtttaatgtatccttaggaacacttttttttttcttaatataaatgcatcaaactcatgctttttttatttttaatctggatttttctggtgtcttcatttctcattcatctttgtaggtagggatttctttt

SEQ ID NO: 52310 - DNA, 201 bp, Homo sapiens
tccaatttctgtattgttaataaagaaaaaaaaatctaataacctaagtgaactcccaaaaacagaaagaaaaagaaaacataaaaagtaattgcaaatgyaggaaaatccatatagttggagactattgcaccaacactaagtgattaagctcttcatgcaacataggtacaacaattggattagattcctagactttga

SEQ ID NO: 52311 - DNA, 201 bp, Homo sapiens
actctttaggtaattctattattaaatattactaatgttttgattttattgaaatcatacaaatttattgataggtgatgtttaatgtatccttaggaacwcttttttttttcttaatataaatgcatcaaactcatgctttttttatttttaatctggatttttctggtgtcttcatttctcattcatctttgtaggtag

SEQ ID NO: 52312 - DNA, 201 bp, Homo sapiens
cacagatttatattaaattagtttcatgatgaaataaagtccagatggaagtagccacattacgtcaagagcagaatatttggatttttctcttgtttgcmgtttccaaaagctcttgaaattaaaactctttaggtaattctattattaaatattactaatgttttgattttattgaaatcatacaaatttattgatagg

SEQ ID NO: 52313 - DNA, 201 bp, Homo sapiens
taaaaactttttatattttcctctggcagggtccccaaggggagcctgggcctccaggtcaacaagggaatccaggacctcaggtaagtctaagccactgmagctcctttgaaataatggggggaagatgctatctttctataagaaaatcgacagtctcacaattttctatgtagtcctagcaatatttaaaatgtgaat

SEQ ID NO: 52314 - DNA, 201 bp, Homo sapiens
tgcgtaggctttagcagaaacttgagtgtggccctgggtctagatgccaagatctgagctctccctaatgagagtcagccctcccggaggccgatctctgmgaccaggttattccttccacacgcttagtggctttcagcttcccgagtagcaggcagcgctagattattcccttgggtgacttttcctgctaaatacagt

SEQ ID NO: 52315 - DNA, 201 bp, Homo sapiens
gtcttcctggtgctgcaggaaaagaaggtgcaaaggtacaacatgcttcagaaaactttttttggcccaaaactttaatttatgtttaactatactcaccycttgtctacagattccatttaaatgaatgtcagaagatgtgtcaggaaaatatttaatgtgcgtttattgtactccaagatattgctcaacatttatata

SEQ ID NO: 52316 - DNA, 201 bp, Homo sapiens
cctccaggtcaacaagggaatccaggacctcaggtaagtctaagccactgcagctcctttgaaataatggggggaagatgctatctttctataagaaaatmgacagtctcacaattttctatgtagtcctagcaatatttaaaatgtgaatgtaggaaaatacatacttttctttttttaaaaaaatttgagcaaacttgc

SEQ ID NO: 52317 - DNA, 201 bp, Homo sapiens
tgttctaaaattccttggggtgtatgggaatatatacagattcttataactcactatgtactatagtgagctaataatttgctgttttaaaagcatattaytgtgatttgatatctgatatatgaaataaattcttttaaaatagggtcttcctggtccacaaggtccaattggtcctcctggtgaaaaagtaagttactc

SEQ ID NO: 52318 - DNA, 201 bp, Homo sapiens
aatgggataaaactgtaattaaaaatcatagttttcataatacttggactggccacactctgcagaaattattgtattaagcaaagaaaacatctttttgractttatttatgtactttccttttacactcagattctaaccaagattatataaaatctttttagactcttacttgatatgctactttcagtgctttatgt

SEQ ID NO: 52319 - DNA, 201 bp, Homo sapiens
caaaggtaaaacagcttgatatttatagtttattaacatttcgtgaagataatattaatcacttatgattaccttacaatttgtaacatctctatattatsatgagtacttaaaaataatttcacaaggaaaatcatagagtgtgtggacgcctggagtgcagggagctcaaagagcttaggtgattatggattgcagtat

SEQ ID NO: 52320 - DNA, 201 bp, Homo sapiens
agcatcagctagactatttcattcctgtacttataaatatatcctacagtgtagttttatttaaaattattattataataaacatttgtgaaagttccatrttatttatttgagatgctatcgtttctgacttttatccactagtgtgtaccaaagcctttaattctacataaaatattttaaactatcatatcatgctag

SEQ ID NO: 52321 - DNA, 201 bp, Homo sapiens
tctatttcagggtccccctggtccacaaggtcctattggatacccgggcccccggggagtaaaggtaacgttaaattgttttcacattatttactttcaawgtgaaatgttatattcacttaatacttctaatttattccacagggagcagatggtgtcagaggtctcaagggatctaaaggtgaaaaggtaaaatttaat

SEQ ID NO: 52322 - DNA, 201 bp, Homo sapiens
atatatatatacaaacacatatgtaatataaatgtggttgtatgttgaacttaattatccattaatgtgtagttttacaaacattattattacttcttttycttatgattttacaaccatgacatttcaacttttgatatgggcaactaacagtgacccatctgtcagtcagaagtcctcgtgggtccctctgtctgtctg

SEQ ID NO: 52323 - DNA, 201 bp, Homo sapiens
catctgtcagtcagaagtcctcgtgggtccctctgtctgtctgctaaaagtcctcatgggtccgtctgtctgtgttctaaatgaagtacttcttttctggsctactgcaattttacaaattaccttgtagagattagatacatttgtcccctctagacagaggtaacacctgagtacagaccttaataaatggagtgtggt

SEQ ID NO: 52324 - DNA, 201 bp, Homo sapiens
tttgtgtatgatgtaaggtaaaggtcaatgttcactgttttctacataatcatatccagttcattcagcacatttttctgaaacgactttcttttcatgayttatattgccttggtctttaaatcagaaattaattgactaccaattagtgcacctattactgaactctctaccttattatttattcattttttttactac

SEQ ID NO: 52325 - DNA, 201 bp, Homo sapiens
aatctaaatccttacagctccctgattaaatttgtatactgtcccataaccagtcaattttgtggggtaataagttttgtttgtatgtttgacattaaaayaaatttaaattatcaaatatagctagccgtgctgattcttagaaacaaaacatattgtaacttcatttgaaagtaagtaataatttgttgaaaattcctt

SEQ ID NO: 52326 - DNA, 201 bp, Homo sapiens
ataatcatatccagttcattcagcacatttttctgaaacgactttcttttcatgatttatattgccttggtctttaaatcagaaattaattgactaccaaytagtgcacctattactgaactctctaccttattatttattcattttttttactactaccataatatcttgattactgtagttttagaaaacattttaaaa

SEQ ID NO: 52327 - DNA, 201 bp, Homo sapiens
acttggactggccacactctgcagaaattattgtattaagcaaagaaaacatctttttggactttatttatgtactttccttttacactcagattctaacsaagattatataaaatctttttagactcttacttgatatgctactttcagtgctttatgtgaagtgttttgtaggacatcatgagaataagtgaggatgat

SEQ ID NO: 52328 - DNA, 201 bp, Homo sapiens
taacccggtaagtgagtttggtcccctctaatgtggcatttatgccaaactcaccttggagcttttcttagaaagatttgaaatcctgagactctggaacrtagatggtaaatctgacttttcatcatttcatatattcgtaagcattctcaattgaattaattctttagaaattttttggcgggagaagagaaatattct

SEQ ID NO: 52329 - DNA, 201 bp, Homo sapiens
tttatgccaaactcaccttggagcttttcttagaaagatttgaaatcctgagactctggaacatagatggtaaatctgacttttcatcatttcatatattygtaagcattctcaattgaattaattctttagaaattttttggcgggagaagagaaatattctcagcaggttttgtcatgactttaacctcttcacctcca

SEQ ID NO: 52330 - DNA, 201 bp, Homo sapiens
ataaagagaatttgattcactttgttctaactataaataattttaccatctaaatttaccagctctaactataaatatctagaggaagtttaggtatctgwaatagggctgagattttccaggaaatattgacatgtggaaatgaagaaagagggttggtttccatccagattttgaaaatttatgtgggccacaaaataa

SEQ ID NO: 52331 - DNA, 201 bp, Homo sapiens
gagggggtgtgggtagggtgggaggagagaggtaaggaacagttcctacgtggcaccaccaaatattcaatggccagacctgctcggaagtctgcaacccwgtcagtacccacggagggagagcgacttcactcctcccctccgccttctccctccctctttcccccgccctttcccgaaaaggcatctggctggagcggt

SEQ ID NO: 52332 - DNA, 201 bp, Homo sapiens
gcattatcttttaattttaagctttatttaagagatttaaagagatttcattcattttaatatttaacttataaaaatataaatcaaattctaaaatgcayaatttataagagcagaattaataatgagagcagatgtgtaaaaatataaatgttttcacatataaaatctgtttcggtattcctagtttgaactttaagt

SEQ ID NO: 52333 - DNA, 201 bp, Homo sapiens
agaaaatgagttacttaaaaatgaaatttacaaattggcaagataagcctaggcaatacaataagatcctgtctttacaaataaatcaatcaatgaataarctgggcatgctggtgcatgcctgtagtcccagctacacaggaggctgaggcaggatgatcatgtaagcccaggagtcccaggctgcagtgaggtatgatt

SEQ ID NO: 52334 - DNA, 201 bp, Homo sapiens
tccacagggagcagatggtgtcagaggtctcaagggatctaaaggtgaaaaggtaaaatttaattgtttagatggtattaatttctgtgtattatgttaayatttaaatttattcaacagacattttatttcttgaatatatgagtgattactacatactacgcaatgctagtataattttgtattctttatcctcacaac

SEQ ID NO: 52335 - DNA, 201 bp, Homo sapiens
gacgagttagtggatgcagcacaccaacatggcacatgtatacatatgtaactaacctgcacattgtgcacatgtaccctaaaacttaaagtataataataaaaaaaaggaataaaaagagacaattttaaggaccttgttggccatctactcattactccaaaatcatgcaacatgctcacaaaaagtgttgaaaatatt

SEQ ID NO: 52336 - DNA, 201 bp, Homo sapiens
tacaataagatcctgtctttacaaataaatcaatcaatgaataagctgggcatgctggtgcatgcctgtagtcccagctacacaggaggctgaggcaggaygatcatgtaagcccaggagtcccaggctgcagtgaggtatgattgtaccactcaactccagcctgggtgacagattgagaccccatctcaaaaaataaaa

SEQ ID NO: 52337 - DNA, 201 bp, Homo sapiens
tgtactacctaagtctttactcatttaagtttttatacaaagatttaaggattttaatttttgtggagatagtgtagtatcaattgtcttttagatgttayatttccataggttccataataaacatgagcatgcacgcgtgcacacacacacacacacatgcacacacacgtgttagtatttatacacaggacattagaa

SEQ ID NO: 52338 - DNA, 201 bp, Homo sapiens
ataaacaaattgaaaaaatatcatatttgctgaagttagaacattaaaactatgggctgtttactgtatacattccctttgatgaactgtccataaaaggaacaaacaaagaagtcctgctgccttaaataaacgtgtcaattgtattgtgactatattattctaattagtttaaaacgcgattaaatttgcccaccagga

SEQ ID NO: 52339 - DNA, 201 bp, Homo sapiens
ataaatcaatcaatgaataagctgggcatgctggtgcatgcctgtagtcccagctacacaggaggctgaggcaggatgatcatgtaagcccaggagtcccrggctgcagtgaggtatgattgtaccactcaactccagcctgggtgacagattgagaccccatctcaaaaaataaaaagtagcaagataagttatttaatt

SEQ ID NO: 52340 - DNA, 201 bp, Homo sapiens
agatggttttccaggattcaaaggtgacatgggtctaaaaggtgacagagtaagtatagagaaaatgtacaccagtacacaaaatttaatatatatatatwttttttcctttgcttatctttaaatatagtaagcatatgataaataaaatgtttgtactacctaagtctttactcatttaagtttttatacaaagattta

SEQ ID NO: 52341 - DNA, 201 bp, Homo sapiens
taaacaaattgaaaaaatatcatatttgctgaagttagaacattaaaactatgggctgtttactgtatacattccctttgatgaactgtccataaaaggaacaaacaaagaagtcctgctgccttaaataaacgtgtcaattgtattgtgactatattattctaattagtttaaaacgcgattaaatttgcccaccaggaa

SEQ ID NO: 52342 - DNA, 201 bp, Homo sapiens
aaatactcctactttttattctttgtaaaacattgttgtagcaattttgggtcattttcatttctacacacatgttagaataagcttattaacttctacargaagttgtggttttaatggggatttcatttaacctacagatcataatgaagacaattgaaatttttaaaaatcatggagttttctatttcctgtacataa

SEQ ID NO: 52343 - DNA, 201 bp, Homo sapiens
ctggtgcatgcctgtagtcccagctacacaggaggctgaggcaggatgatcatgtaagcccaggagtcccaggctgcagtgaggtatgattgtaccactcractccagcctgggtgacagattgagaccccatctcaaaaaataaaaagtagcaagataagttatttaatttgagcctcatcatgatcataataaaaccaa

SEQ ID NO: 52344 - DNA, 201 bp, Homo sapiens
aaacaaattgaaaaaatatcatatttgctgaagttagaacattaaaactatgggctgtttactgtatacattccctttgatgaactgtccataaaaggaacaaacaaagaagtcctgctgccttaaataaacgtgtcaattgtattgtgactatattattctaattagtttaaaacgcgattaaatttgcccaccaggaaa

SEQ ID NO: 52345 - DNA, 201 bp, Homo sapiens
gtctatattaatgaggaatactagtctatgaatctctgtatttataatgtctttgtcaggttttgatagggttatactggcttcataaactcatctgtgcrgtgatctctccttatctattttctgaaaactttcttatattactgatgttatttccttcttgaatactggatagaattaaccagtgaaaatttcagggcc

SEQ ID NO: 52346 - DNA, 201 bp, Homo sapiens
tttatatttcattgtcctaaatgttgctagctatcatttattttatttgctttaaagaactctttggtgtaatactacttccctacatatgagatactctrcataatcattgtaatgatacatctctatttatactgatattggcatattattattttatttatgggatgagactcaaacttatatggcttatccttttag

SEQ ID NO: 52347 - DNA, 201 bp, Homo sapiens
caagttatctgagtagcatcattattattatttcaaagttacaggatctttgcttttctgtttctcttctataatgcaaatcctatttcaaactataccayatttgttcatggtgaaatgattcactgacattgtatactaatgacatcttctttcttccttatataaagagcatgctggattttaaatttgatatattaa

SEQ ID NO: 52348 - DNA, 201 bp, Homo sapiens
ttatttccttcttgaatactggatagaattaaccagtgaaaatttcagggccctgagttttctttttagaattgttttaacatattcaatttctttactcratacaggttaattcggtttttctgtttcttcttgtgttgatcatgttaagttttatttttcaagaaatttttctagttcaactaagttgttggatttgtt

SEQ ID NO: 52349 - DNA, 201 bp, Homo sapiens
tttatttatgggatgagactcaaacttatatggcttatccttttagcaaatgtatttcataatgatgttctgtaagatttaaaaattaggcaaagctgccrgggtgtggaggctcgcacatgtaatcccaacactttgggagaccaaggcgggtggatcacctcaggtcgggagttcgagaccagcctgatcaacatggag

SEQ ID NO: 52350 - DNA, 201 bp, Homo sapiens
tcacagggcaattggggccactactgttttctaatggtatctttatttcaggggtatttttcacactgaatatcctcacattaaacatagaatgtgaatgrgttttacttgtctctcagcaatacaaatttgaatcaatatttacaaacatttctctttccaaaaatatatttaatttataataaaacttgtctctgaaaa

SEQ ID NO: 52351 - DNA, 201 bp, Homo sapiens
atactggatagaattaaccagtgaaaatttcagggccctgagttttctttttagaattgttttaacatattcaatttctttactcaatacaggttaattcrgtttttctgtttcttcttgtgttgatcatgttaagttttatttttcaagaaatttttctagttcaactaagttgttggatttgttcatataaagctgttt

SEQ ID NO: 52352 - DNA, 201 bp, Homo sapiens
tcaaacttatatggcttatccttttagcaaatgtatttcataatgatgttctgtaagatttaaaaattaggcaaagctgccagggtgtggaggctcgcacmtgtaatcccaacactttgggagaccaaggcgggtggatcacctcaggtcgggagttcgagaccagcctgatcaacatggagaaaacccgtctctaccaaa

SEQ ID NO: 52353 - DNA, 201 bp, Homo sapiens
acatgaagcatccttttttagtacatttagtgttgctataaaagaatacctgaggctgggtaatttataaagaaaagaggtttatctagctcacagttctkcaggctctacaggaagcatgatgccaacatctgcttctggtgagggcctcaggctgctcccactcatgctggaaggagaagcagagggggtgtgtgcagt

SEQ ID NO: 52354 - DNA, 201 bp, Homo sapiens
ctagcctctcaaagtatagggttattacttcgagatttgcttttttcccagtataaaaatttaaaattacacatttctctctaaacacagttttagctgcrtaacacaattttactatgtcatttttgatggttatttagttaaaataattttcaatttctttttttattttatttccagcccactaattatacagtgatg

SEQ ID NO: 52355 - DNA, 201 bp, Homo sapiens
tttaaaaattaggcaaagctgccagggtgtggaggctcgcacatgtaatcccaacactttgggagaccaaggcgggtggatcacctcaggtcgggagttckagaccagcctgatcaacatggagaaaacccgtctctaccaaatatacaaaattacccaggcatggtggtgcatgcctgtaatcctagctactcgggaggc

SEQ ID NO: 52356 - DNA, 201 bp, Homo sapiens
atgatctcaatccatttagatttattgaggtttgatatatggtctaacatgtagtctatctcagttaatgtaataatgcccttaaaaagaaagtgcattgkgaaattgttcgatgcagacttttataaatgtcacttagatctttccttatatttcttatttttttgtctacttgttctatcagttgttgaggagtgttaa

SEQ ID NO: 52357 - DNA, 201 bp, Homo sapiens
ttaggcaaagctgccagggtgtggaggctcgcacatgtaatcccaacactttgggagaccaaggcgggtggatcacctcaggtcgggagttcgagaccagmctgatcaacatggagaaaacccgtctctaccaaatatacaaaattacccaggcatggtggtgcatgcctgtaatcctagctactcgggaggctgaggcag

SEQ ID NO: 52358 - DNA, 201 bp, Homo sapiens
cattgtatgtcttatttatgggatatttttatgtccatgtccatcttaatgtcttttcaggtttaaaatgcaggttgaatttttatgtaaattatgaatgyctattaccactaggacaccttgttagattctttcacatgggaatcttcagcagttgtatctttggccatacttttggagtcattatttgaaagtaaaatc

SEQ ID NO: 52359 - DNA, 201 bp, Homo sapiens
ttttttaacttatatgggtgctttagcaactcagggtacaaataaaggcaccactaattttccttcctccctccctccttcttttcttcctttcttccttycttcctttctctctctttcctttttttttaatttttattttattattattatactttaagttttagggtacatgtgcacaacctgtaggtttgttacata

SEQ ID NO: 52360 - DNA, 201 bp, Homo sapiens
cctgcctcagcctcctgagtagctgggactacaggcgcctgccaacacgcccggctaattttttgtatttttagtagagacggggtttcaccgtgttagcygggatggtcttggtctcctgacctcgtgatcctcccgcctcggcctcccaaagtgctgggattataggcgtgagccaccgtgcccggccaattgctgttg

SEQ ID NO: 52361 - DNA, 201 bp, Homo sapiens
ctatacttgatacaaatttgggcaaaaagtgagaataaaagacttgccctttaaaataattccttactaggtgacttagttgctttatatatatatatatwtatatttttcttatggtagagatttttgagtgtcattatccagtaatagttaagtgtggagtgattaatcaaaatggcaaatcatacatatagcactcgt

SEQ ID NO: 52362 - DNA, 201 bp, Homo sapiens
tttgaatttgccccaaaacagccctattttcttttggtatgttgtggtttctcattgttgttttaatttgcaattctctaatgacatatgatgttgaacayattttcataggcttactttccatctgtatatcttccttgttgaggtgttcaacatatttgtgcatttttaagtcagattgttagcttttttattgttgaa

SEQ ID NO: 52363 - DNA, 201 bp, Homo sapiens
aaaacagccctattttcttttggtatgttgtggtttctcattgttgttttaatttgcaattctctaatgacatatgatgttgaacatattttcataggctyactttccatctgtatatcttccttgttgaggtgttcaacatatttgtgcatttttaagtcagattgttagcttttttattgttgaatattgaactttttg

SEQ ID NO: 52364 - DNA, 201 bp, Homo sapiens
tacactaaaattctaagcattttggcaactttcctttaccacagaaaacagttgagaaaaaaaaatcattaactgtatggggtgtttgaaaaaaaaaaaaactggtgagagttaatgccttggcaaattcagaattctaagtagacaggaagcataggttttcattaatcttctgattatggtagttacttcttaagaatt

SEQ ID NO: 52365 - DNA, 201 bp, Homo sapiens
tctgatgcatttttcaattacactaaaattctaagcattttggcaactttcctttaccacagaaaacagttgagaaaaaaaaatcattaactgtatggggygtttgaaaaaaaaaaaaactggtgagagttaatgccttggcaaattcagaattctaagtagacaggaagcataggttttcattaatcttctgattatggt

SEQ ID NO: 52366 - DNA, 201 bp, Homo sapiens
tggatgacatatattttatgtatacatatagtatgacttttattaatgtcagataatcattatgacacacttgtgtgttgtttgtttaacagttttttttwaaacaagtggcaaactgaagaaaaaaataggagagaacgtagtagtgcaaattctaataaaggtttttattttggattgtcaaagtatctgaaattacat

SEQ ID NO: 52367 - DNA, 201 bp, Homo sapiens
ataaaatctttttagactcttacttgatatgctactttcagtgctttatgtgaagtgttttgtaggacatcatgagaataagtgaggatgataaacttttrtaaatgtaataatattgtttttgagtttgtgttatctttgccaaaaataaaagagcaatctaaagtgattttgcttatctaatttagggaccaaccggtg

SEQ ID NO: 52368 - DNA, 201 bp, Homo sapiens
tcttagtcacaaatgaaggtagggaacatgtatcatttattctttaaaatgtttttctaaaaaacattaaacaatatccttgtcaaatatagaagctagaytattactcttgtagctgcacttcaaaactgtaaaattaatgatctttggatattcaatacagggagaaaaaggtccccaagggcctgcagggagagatgg

SEQ ID NO: 52369 - DNA, 201 bp, Homo sapiens
cagggagagatggagttcaaggtcctgttggtctcccagggccagctggtcctgccggctcccctggggaagacggagacaaggttggtattcattattcrtgttagtagatcctgtgaaaaagcttaatttttgtcaagaattctagataattctaatctttatgattaggcgccaggtgaaaggttacctttttcaaag

SEQ ID NO: 52370 - DNA, 201 bp, Homo sapiens
ctcttcagcacccaaggctgctcaagctcaggaacctcagatagatgaggtgaggagcacaagaccagagaaggtcttcgtatttcagtgatatggacatmgcagtgcagtttttgaacttatacttatttattccattttaattaagctatgctttgtattttaattgtgttgtaatatttccaggaaaaagtgacttga

SEQ ID NO: 52371 - DNA, 201 bp, Homo sapiens
aaaaataaaccacatctcgctttggtatatgtgtactttaatatgctaactgaatctgtgtctgtttgtttttgtttttttttttttcccagggggacatycagcagtttttgatcacaggtgatcccaaggcagcatatgactactgtgagcattatagtccagactgtgactcttcagcacccaaggctgctcaagctc

SEQ ID NO: 52372 - DNA, 201 bp, Homo sapiens
tacagtgtatgctgttatgaaaatattgaaaagttatgaaaacatgaaaatgaaatagctgagaaaatccctttaaattggctgattctctctctagggarttcctggtcctgctggtcccttaggtccacctggtcctccaggcttaccagtaagtacaagacaaaataaccttataaggtagggttaagttacaaatat

SEQ ID NO: 52373 - DNA, 201 bp, Homo sapiens
aataaaataaacttaaggacttaattaatggagttttacttttttgtaacttgaaatgcctttttgggaaaaaaaaaaaggcttggttgatacctttattwtatgtctctacttgtattgttttttgaggagtgaacacttggataaggtcatggtgttaaaagatacgttgttgccgggcgcggtggctcacgcctgtaa

SEQ ID NO: 52374 - DNA, 201 bp, Homo sapiens
atacttgatacaaatttgggcaaaaagtgagaataaaagacttgccctttaaaataattccttactaggtgacttagttgctttatatatatatatatatatatttttcttatggtagagatttttgagtgtcattatccagtaatagttaagtgtggagtgattaatcaaaatggcaaatcatacatatagcactcgtat

SEQ ID NO: 52375 - DNA, 201 bp, Homo sapiens
cagaaaaagatcagctttagatcttcacatctttctttaacagcattaataatgagaataagataagctttaagtaaattggagaagaaaaaaatagtaawaggaaagaaaaccctatgaatgtctgacagaacatatagtatgtgtctaacatgttaagatcaagacataattgtatccatttaaaaaataccagatttc

SEQ ID NO: 52376 - DNA, 201 bp, Homo sapiens
acttgatacaaatttgggcaaaaagtgagaataaaagacttgccctttaaaataattccttactaggtgacttagttgctttatatatatatatatatatatttttcttatggtagagatttttgagtgtcattatccagtaatagttaagtgtggagtgattaatcaaaatggcaaatcatacatatagcactcgtatgt

SEQ ID NO: 52377 - DNA, 201 bp, Homo sapiens
aatattgaactttttgtatgttttggataacagtcctttatcaggtatgtcttttgcaaacacatgcacctgctgtgtggtgtattttctgattctcttgwtattgtcttttcagaatagaagttttaaattttaataaagcctagattatcaataaattctttcatggaatatatctttggtgttgtgtctgaagagtca

SEQ ID NO: 52378 - DNA, 201 bp, Homo sapiens
aaaagagaaatgtgttatcaaaggaaggattattttcatttaaaaactaaaaaaaaatttgtactgttattgttggcccatgccttcagactggagttcasagtacagtcttctcattacaaagctacatactctttaacctgtagacaatcttttttttttttttttttttgagacagagtctcactctgctctgttgcc

SEQ ID NO: 52379 - DNA, 201 bp, Homo sapiens
ctgaacaatttaaggtttgtatttagatatttttttgcatgtggctgtccagttgttccagcactattagttgaaaagattatcattgctccattgtattycatttgctccttttgtcaaagatcagtttagtatatttatatggatctttttctaggatctttattctattccattgatctacttatcagttcttccacc

SEQ ID NO: 52380 - DNA, 201 bp, Homo sapiens
caccgaagcctcaaactcatgggttcaagtgaccctcctcccttagcctctcaagtagctgggacagcaggtgcacaccaccaattattctagtttttgcttttttttttttttttgtagacaaaatgtctcactgtgttacccaggctggttgcaaattcctaggttcaagcggtcctcccacctcaggctctcaaattg

SEQ ID NO: 52381 - DNA, 201 bp, Homo sapiens
ctatacctctgtgtggagtaattatcagattccattgtggtatcctgataaggctgatgttactcagtgtgtttattctcaggtgattgcactgataagaycttgtaataaatcctctgtcttttgtggaattaattaaactcttgtcgtctaaaataatatatgatactgatgcatttaaatatgtttacccataaaagg

SEQ ID NO: 52382 - DNA, 201 bp, Homo sapiens
tttcttgtcttactgcatcaactaggactcccagtatgatgtagaaatgcaatattaacagaggacatccttgccttctttctgatcagtttgagaaaatktccttctgttcctagttttcagaacatgttttaaaatcatgaatgaatgctgtattttgtcaaatgctttcctgcatctatgatatgataatttatttat

SEQ ID NO: 52383 - DNA, 201 bp, Homo sapiens
caccaagataagcaatttgagcttttaaaatattaaaagttcataaccagtggacttatataattcaaatatttcaaatgaagtggcagcatgaaaaacakttggaagtataaaggtagaaagaattcgattcctttccttctcagtataaaggtcaaagctgacacccctataaaaaaaaaggttaacaagagaaaaata

SEQ ID NO: 52384 - DNA, 201 bp, Homo sapiens
gctacaaattggtttctatatgttgtcttttcacaggaagataaatagggcaactgtttagaactctagtgtatatttataaaatataaacgaactcttcrataggactagagtgaattcatctaaatattaatgagattaggaatctgattaagatatggtgtgtttctctatagggtattatgggtcctccaggtctac

SEQ ID NO: 52385 - DNA, 201 bp, Homo sapiens
aaatattaaaagttcataaccagtggacttatataattcaaatatttcaaatgaagtggcagcatgaaaaacagttggaagtataaaggtagaaagaattygattcctttccttctcagtataaaggtcaaagctgacacccctataaaaaaaaaggttaacaagagaaaaatattaaaaatgtatttgattatagttcaa

SEQ ID NO: 52386 - DNA, 201 bp, Homo sapiens
ggtcctccaggtctacaaggccccactggaccccctggtgaccctggcgatagggtaagtgaatggacatgatatctcattacaaatgcatgtcatacagrcttaaataattaaaatgtattctacaagtataacatgttatcttactgcgtgtgggaggggtaaaggcagcatgaattcagtgctgcacaacattttagt

SEQ ID NO: 52387 - DNA, 201 bp, Homo sapiens
acctgtctttaatgagtgtatttaaatcattcatatttaaggcaattatatatatagttagaataatattcaccatatatgttattatgttccatttattrccctgggctcaggtgatccttccagtaccaccatgcctggctgattcttttctatttttttgtagagatagggtctcactgtgttgcccaggcttgtctc

SEQ ID NO: 52388 - DNA, 201 bp, Homo sapiens
gaggcaggagaatggtgtgaacctgggaggcagagcttgcagtgagccgagatcgcgccgctgggctccagcctaggcgacagagctagactccgtctcaaaaaaaaaaaaaaaaaaaaaaaaaaaaatggagccatttagaaaaaataggtatttatttgatatgaaccttttgtcttctgctttatctgaacttttaca

SEQ ID NO: 52389 - DNA, 201 bp, Homo sapiens
atttattaatttttgaatttacttgcttccctgacaagtatgacatggctatgtagaaatgtctccttatattgaaagcttatggacatataccttatatstatgagtcacatacttatcaacagatgtatatattacatatttaatattttctatattcatatccatatcttggatttctggacagcatagtcacaccta

SEQ ID NO: 52390 - DNA, 201 bp, Homo sapiens
aggcaggagaatggtgtgaacctgggaggcagagcttgcagtgagccgagatcgcgccgctgggctccagcctaggcgacagagctagactccgtctcaaaaaaaaaaaaaaaaaaaaaaaaaaaaatggagccatttagaaaaaataggtatttatttgatatgaaccttttgtcttctgctttatctgaacttttacat

SEQ ID NO: 52391 - DNA, 201 bp, Homo sapiens
attctcattaattttagaatagatggataaataatttatattttaaatatttgttttttgtataaattttttctgctatttacagaacgtattattctgamagttaaaatcttatctgtattgtacatagtagacacttgcagcaaaactattgtattcaaatttaaatcaagtactttgccttctaattatttagtctgt

SEQ ID NO: 52392 - DNA, 201 bp, Homo sapiens
gttttttatctacagcatttatttttgattctttgttacagttatcatctttctgcttacattagccattctgttcctgcctgttgtctacttttttattraagttcttagcacgggaatcatagtttgaaaaattcctagaatgataattccaacctttctgccatatctgactctggtttgatgcttattcagtctctt

SEQ ID NO: 52393 - DNA, 201 bp, Homo sapiens
ggcaggagaatggtgtgaacctgggaggcagagcttgcagtgagccgagatcgcgccgctgggctccagcctaggcgacagagctagactccgtctcaaaaaaaaaaaaaaaaaaaaaaaaaaaaatggagccatttagaaaaaataggtatttatttgatatgaaccttttgtcttctgctttatctgaacttttacatg

SEQ ID NO: 52394 - DNA, 201 bp, Homo sapiens
tcgcacctgtaatcccagcactttgggaggccaaggcgggcggatcacctaaggttgggagttcgagaccagcctgaccaacatggagaaaccccgtttcwactaaaaatagaaaattcgccgggtgtggtggcacatgcctgtaatcccagctactcgggaggctgaggcaggagaatggcttgaacccgggatgtggag

SEQ ID NO: 52395 - DNA, 201 bp, Homo sapiens
gcagcatgtgctcacatcatgactgtgtcacatttcaataattctcacaatattttaaactttttattattattataagtatggtttatgagaccccaaarcaattacaactgtaacattaaagatccctgatcacagatcaccatagcagttataaaaatgaaaagatttgaaatgtcatgagaattaccaaaataagtt

SEQ ID NO: 52396 - DNA, 201 bp, Homo sapiens
gcaggagaatggtgtgaacctgggaggcagagcttgcagtgagccgagatcgcgccgctgggctccagcctaggcgacagagctagactccgtctcaaaaaaaaaaaaaaaaaaaaaaaaaaaaatggagccatttagaaaaaataggtatttatttgatatgaaccttttgtcttctgctttatctgaacttttacatgg

SEQ ID NO: 52397 - DNA, 201 bp, Homo sapiens
aactggctcaactgaccagctattctcaaattctctcctccttgaggctctctattgcctgagacacagcaatattgaaattaggtcatttagtaaccccmcaatgacctatgtgtgttcaagggaaaggaagagtcacaggttcaagtgttcaagagtcacttgagatcaaaagctagaaatgattaagcttagtgagga

SEQ ID NO: 52398 - DNA, 201 bp, Homo sapiens
caaacactgcattttctcactcaggtgggaattgaataataagaacacatggacacaggaaggggaacgtcacacaccggggactgttgtggggtgggggkaggggggagggatagcattaggagatatacctaatgctaaatgaggagttagtgggtgcagcacaccaatatggcacacgtctacatacgtaacaaacct

SEQ ID NO: 52399 - DNA, 201 bp, Homo sapiens
agaccatcctggctaacactgtgaaaccccgtctctactaaaaatacaaaaaattagccgggcgtggtggcgggcgcctggagtcccagctactcaggagrctgaggcaggagagtggcgtgaacctgggaggcggggcttgcagcgagccgagatcgcgccactgcactccagcctgggcaacagagcaagactccgtct

SEQ ID NO: 52400 - DNA, 201 bp, Homo sapiens
taacttcatttgaaagtaagtaataatttgttgaaaattccttaatagataataattcagaaaattatttccgttattagacagcttttacttcacttggyatacaggatcaaatcaaagtcagttatgatccagaagcaaagaaaataagcaaaacaaacaatagtatattggagcagataatgggcattcagtctactt

SEQ ID NO: 52401 - DNA, 201 bp, Homo sapiens
gagcagaagaatgatctaatttgacttacgttttactaataatattaatattggagatcagaggaagcattatagagtgctgatatgtgccatgtactaargtctttatacattgttaactcatttagttttattgattcctttaagaaagtaatgttaacaaactaattttcctggtaagggaactgaggctcagagagt

SEQ ID NO: 52402 - DNA, 201 bp, Homo sapiens
aaatctaaatccttacagctccctgattaaatttgtatactgtcccataaccagtcaattttgtggggtaataagttttgtttgtatgtttgacattaaawtaaatttaaattatcaaatatagctagccgtgctgattcttagaaacaaaacatattgtaacttcatttgaaagtaagtaataatttgttgaaaattcct

SEQ ID NO: 52403 - DNA, 201 bp, Homo sapiens
actcaggaagtcaggcttgcactgcgctcttttgcaaatcatgtcgaattctgaattatgtattgtggttgtttcctttcacttatggagcagctaaatakaaattaatgcttattaaatttactcaatattttatcactgaatccagacctctaaaaacagctttatccaaaatagcacatttggttatagctataagaa

SEQ ID NO: 52404 - DNA, 201 bp, Homo sapiens
aggtaagatgatcctgtcattgtttactccatcatttctacctacttctcaccaggttttctggtggatgtaaaacaaagtatttttttctttttttctaygtaagaacttgggtacaatgtttatccataaagatcattttatttttaaatgagcagctgaacttgaaatcattttatcatgtatgattaattctcctga

SEQ ID NO: 52405 - DNA, 201 bp, Homo sapiens
tcaggaccacagagaaactctcaagtctcagttttactgagactttacaactttaggcttttacaactaatttacattattatcctataaacaaattagayataatagcacgttgtgtttctttttttgactgttagcaaactccatgctaaggttttaatctatatttggtaaatgtagaaaatattttgaattcatctt

SEQ ID NO: 52406 - DNA, 201 bp, Homo sapiens
atattttgccttcctctgttctttgtgaatgttttttaaggtaaaatagagatcatattgcaaaatataaattttaagtgtttaaatcactttaaaaaatatgtaaagatcatggtaagatatttccatcaaattatatttcactaattatgataatcacattcttttagtcctccaatcattggatatgacaacttatgc

SEQ ID NO: 52407 - DNA, 201 bp, Homo sapiens
attggattgatcctaaccaaggttgctcaggagattccttcaaagtttactgtaatttcacatctggtggtgagacttgcatttatccagacaaaaaatckgagggagtaagtaccaatctgttttggtggtgaatgttgacagttcctgccatgttttgcaatattgaactaaacaggaaaattatactgtcatattttc

SEQ ID NO: 52408 - DNA, 201 bp, Homo sapiens
gtcccctataacccttagtatgcctatacccggttgtctttccccttttcctttagagctgataaagacaacaaaaaggaaatgactcaatcttcactacrtagaatgtacaggatctatctcaaatttttctctttgtctcattttgtataatctaatttgtgtcattttaaaacgattttaagcactctttattttctt

SEQ ID NO: 52409 - DNA, 201 bp, Homo sapiens
ctggagtgtgcagtggcataatcttggctcactgcaacctctgcctcctgggttcaaaggatcctcctactttagcctcccaagtagctgggactacaggsatgcgccaccatgcccggcaaatttttttgcattttttctagagttggggtttcaccatgttgcccagtctggtctcaaactcctgagctcaagcaatct

SEQ ID NO: 52410 - DNA, 201 bp, Homo sapiens
caggagaatggtgtgaacctgggaggcagagcttgcagtgagccgagatcgcgccgctgggctccagcctaggcgacagagctagactccgtctcaaaaaaaaaaaaaaaaaaaaaaaaaaaaatggagccatttagaaaaaataggtatttatttgatatgaaccttttgtcttctgctttatctgaacttttacatgga

SEQ ID NO: 52411 - DNA, 201 bp, Homo sapiens
agtgtgcagtggcataatcttggctcactgcaacctctgcctcctgggttcaaaggatcctcctactttagcctcccaagtagctgggactacagggatgygccaccatgcccggcaaatttttttgcattttttctagagttggggtttcaccatgttgcccagtctggtctcaaactcctgagctcaagcaatctgccc

SEQ ID NO: 52412 - DNA, 201 bp, Homo sapiens
aggagaatggtgtgaacctgggaggcagagcttgcagtgagccgagatcgcgccgctgggctccagcctaggcgacagagctagactccgtctcaaaaaaaaaaaaaaaaaaaaaaaaaaaaatggagccatttagaaaaaataggtatttatttgatatgaaccttttgtcttctgctttatctgaacttttacatggaa

SEQ ID NO: 52413 - DNA, 201 bp, Homo sapiens
tttaaatagtatatgtagttagttaaatatgaaggcctatgtaatatttatagtgaaactacatttgacctattattagctgtacacttttattttaaaayatgtatatcgatccccacgaaaagtatatattgacacattatggtgtactgctactgaagaaaaagataatgagaattttaaacctttaatctgacatag

SEQ ID NO: 52414 - DNA, 201 bp, Homo sapiens
tgtcatcaatagctccgaaatttatgtactgagaagaaatgaatcctattaccagaagaaaaaaaataatatgtcacttggaatataccagacatatggawtatatcacttttctccaccaaatattacaaatgaggaaactgatctgggaaggtttacttgaagctagctaacaaaataactaaactggaaataggcctc

SEQ ID NO: 52415 - DNA, 201 bp, Homo sapiens
agtgagctgagatcactgctctccagcctgagcaacagagcaaaacttcatctcaaaaaaaaaaaaagaaagaaaagaaaaagaatatatatatatatatwtatatatatatatatatatatatgaggattcaataccaacatcaattttcatattaaattgtatttattatgaaactcaagactctttttaattacaaaa

SEQ ID NO: 52416 - DNA, 201 bp, Homo sapiens
ggcacagatgataacataatatttattgtttaattgagaaataaaagatgaaggtaaaggtatcatacagtatctaacaagtacaggtatggttgaatgaraaagattataataatgatgaaatgatgataatttaagtatttgcattttaaaatcacacacatggtagttaacaatgttgactctggagtcagacagccc

SEQ ID NO: 52417 - DNA, 201 bp, Homo sapiens
ttcctcagtgaatgctgtcttaagatgaaatttacctaaatgtacaataaatgagaatcaagactcttctatttatgtagtatatctgattgaataataaygttcgatgctgtcactgaaatcaaaaaatgacacaaaagtgtcttatagaaaatattaaactgtttcctattttaaaaattccccaagtgattcatatgt

SEQ ID NO: 52418 - DNA, 201 bp, Homo sapiens; identical to SEQ ID NO: 15106

SEQ ID NO: 52419 - DNA, 201 bp, Homo sapiens
atgtatttttattttctttctattacatttttcctcatgtgtttgatttatagaataatgactttaagactcctgaaactggaacttatttttagaaaaaktataactagaagtctgccacttaaaggtttgttttcctttaattgactccaaacactggaataaaatatcttatatttgtatatactttacagtttataa

SEQ ID NO: 52420 - DNA, 201 bp, Homo sapiens
tgtcttaagatgaaatttacctaaatgtacaataaatgagaatcaagactcttctatttatgtagtatatctgattgaataataatgttcgatgctgtcaytgaaatcaaaaaatgacacaaaagtgtcttatagaaaatattaaactgtttcctattttaaaaattccccaagtgattcatatgtaatattatagaatca

SEQ ID NO: 52421 - DNA, 201 bp, Homo sapiens
aaatatgtgtctcatatcttatttatttgtgtataataatctgaataaccagtctataagtatttgagaggaggtttattttcctcctattcatagtgtcrgcatgatactttgcctccataaatatttattgaattaattgatagatgaatgattggtaaacagtcaaagacaaatattctcaaagtaacctggctgtta

SEQ ID NO: 52422 - DNA, 201 bp, Homo sapiens; identical to SEQ ID NO: 15108

SEQ ID NO: 52423 - DNA, 201 bp, Homo sapiens
tcttcttgattacgatcattctcgttggtgtgaaatgttatctcattgtggttgtaatttgcattttcctaatcactacttttgttgaacatcttttcacrtgcttattggccatttctataacttctttgataaaatagctgttaaactcttttggttaatattctaattggattatttatcttaatattgagttgtaag

SEQ ID NO: 52424 - DNA, 201 bp, Homo sapiens
tcaacagatattgcatgttcaaggcacaaactgactatattttgtagaggaaacaggttttcacatttgacaccaaaacataatttttgtttcagaatttraaaaaataaaggtatgctgattatattatatatatgcatactttaaaagtcctctccgaattacatactttataaagtagccgatttagatttaaagaga

SEQ ID NO: 52425 - DNA, 201 bp, Homo sapiens; identical to SEQ ID NO: 15109

SEQ ID NO: 52426 - DNA, 201 bp, Homo sapiens
tttcacatttgacaccaaaacataatttttgtttcagaatttgaaaaaataaaggtatgctgattatattatatatatgcatactttaaaagtcctctccraattacatactttataaagtagccgatttagatttaaagagacttcaattctctaaagaatgaatgtatcattcattgttatagaggattgcaacagagc

SEQ ID NO: 52427 - DNA, 201 bp, Homo sapiens
gattgcaacagagcaaaaataagggactatttttaaaagacctgttatttctgggatagtaccactttatataaaattaaaataataaatatatagaaatrcaattaccaattatttatttttattctctgacaggtattttctctgagggacttagaacaggcaccaaaaaaaaaggatgatgctaaaaattgatatgta

SEQ ID NO: 52428 - DNA, 201 bp, Homo sapiens
tactagattattaagaggaatttgctcttaggaaaagttgttatatctgaattacctgtgccaagccagataaaatgtataatctagtttactgcatttcyggtggtaagaagagagctgttttatgtaatactgcttctgcctctgatctgaatatatccagcctgtaggttcaaaatcaatctcttaccatcaaaagga

SEQ ID NO: 52429 - DNA, 201 bp, Homo sapiens
atattccaaaaataacaattactttaaaaataaatctaaaatttactgccaagttaaatactatgaaataaaatgtaaatgtcaaattctaatgctaactytgtgaaacaggcagtgaaagtactacctaatgcaaaggccatatttgaccttcacaatgatattaattatatgaacttgtcttttgagtctaagtgttaa

SEQ ID NO: 52430 - DNA, 201 bp, Homo sapiens
cttggcttggaaatggttgtcttctccctgtgtctttacatggtctttcctctgtgtgtgtttgtgtcttactcctttcttaaaggagaccagtcagattsaatcaggaccatactagtggcttcgtttaaccttaattaccttcttaaagaccctgtctccaaatacagtcacaatgtgaggtattgggaattaggattt

SEQ ID NO: 52431 - DNA, 201 bp, Homo sapiens
tttaaaagtactataaacatacatgatgcatatatagatatatatttatattatatataatatatatttatatacataagtatcatatatatatatatatatatatatacgatagcaacttttttgtttttcagcaatagattcacttgattcattataatttgtatataattaagtatggcattctagaatttctatccc

SEQ ID NO: 52432 - DNA, 201 bp, Homo sapiens
catagaatgtacaggatctatctcaaatttttctctttgtctcattttgtataatctaatttgtgtcattttaaaacgattttaagcactctttattttcytagtcttactgaaaatgaattatatgtatataaaaatactgtttatattgtaaattttcacctactcactaacttttctgttcctttgcaacaggtaaga

SEQ ID NO: 52433 - DNA, 201 bp, Homo sapiens
atttaaaagtactataaacatacatgatgcatatatagatatatatttatattatatataatatatatttatatacataagtatcatatatatatatatatatatatatacgatagcaacttttttgtttttcagcaatagattcacttgattcattataatttgtatataattaagtatggcattctagaatttctatcc

SEQ ID NO: 52434 - DNA, 201 bp, Homo sapiens
tatttaaaagtactataaacatacatgatgcatatatagatatatatttatattatatataatatatatttatatacataagtatcatatatatatatatwtatatatatacgatagcaacttttttgtttttcagcaatagattcacttgattcattataatttgtatataattaagtatggcattctagaatttctatc

SEQ ID NO: 52435 - DNA, 201 bp, Homo sapiens
tgcgcaatacaagggctgtgtgggaagtagttatgtctgtgattatatggtttccctcattttttcctttgaattatggttcaaatgcaatctctgatgcrtttttcaattacactaaaattctaagcattttggcaactttcctttaccacagaaaacagttgagaaaaaaaaatcattaactgtatggggtgtttgaaa

SEQ ID NO: 52436 - DNA, 201 bp, Homo sapiens
tatatattatttgtacgggactgagcaaatggttgggtgttcataaattcccagatcaaattaatatttagttattataactaaaaataaacaatataatmttatacaaaacataaattttatttgtaaatgtaggtgtaagattttatcacatgtggtcaacatttgcatagtaggtattttaacaaatgttagtatctg

SEQ ID NO: 52437 - DNA, 201 bp, Homo sapiens
ttcagttggtggtgttggagaaaaggtaaatatgttagtgacacacagtttgaaacagcatgaattaagaactgtaataatattgggtagtagtttaagtscttctagtatgtgtgtttctaagccttttacatagttatatgattcacatgtcatctagtagttgcaaaaattaaagttaaaatgattttgcaatattgt

SEQ ID NO: 52438 - DNA, 201 bp, Homo sapiens
ttgataccaatggaatcacggtttttggaacaaggattttggatgaagaagtttttgaggtaaaaataaatccaactctaagctgaatattgacaaatcaratgaactgggttaacaacagtaaaaatatcgctttatagcaatacgttataaagcaaagttgaaaactctaaagggtgacctagtttcttcctctgtgag

SEQ ID NO: 52439 - DNA, 201 bp, Homo sapiens
ttcataaaatttaagttaattaactaaaatagataatatattatatttttctgacatttttgataaatataccaaatacatcctatgataaattgtgatawctcctaaatatttcctgtgatttaatttctgagttcactcatatattaattgcttagtagcaattgatgttacataactctctgagtccagtataaaata

SEQ ID NO: 52440 - DNA, 201 bp, Homo sapiens
ttttctgacatttttgataaatataccaaatacatcctatgataaattgtgatatctcctaaatatttcctgtgatttaatttctgagttcactcatataytaattgcttagtagcaattgatgttacataactctctgagtccagtataaaataacaagacacaaaataaatattagttaaagggaggaactttgaagac

SEQ ID NO: 52441 - DNA, 201 bp, Homo sapiens
gtacttactaatattattgagggaaataatacaatctttacctctttaatgatatgaatcaatatatttctggcctatattgctttcctttttgttctctragcttcagtttattgtggtattcaaaaactaatttgctaatttaaaaaaagacctatctaagattataagcaggctaaaacctagcatacctttgacatg

SEQ ID NO: 52442 - DNA, 201 bp, Homo sapiens
tgccaattattattgattcttgaaacttggtttggtttcaatgatgcagtctgatagtctgcaggtataggagagatacagttcaaaaataaataaaagtyactgtcttaagtgataaactgaccttactccagaaatgactgttagttattattctacttcttagacttaagagattgaccctccaattttttcctttta

SEQ ID NO: 52443 - DNA, 201 bp, Homo sapiens
aagacctatctaagattataagcaggctaaaacctagcatacctttgacatgttaaatttagttttaatttatctttacatggcatttcctccaaataatwtatttaaaagttatttaaatggttattacttatgaattgaagccagtgactcaggataagaatttcattcatagtatatgtacacgttaaagctttttaa

SEQ ID NO: 52444 - DNA, 201 bp, Homo sapiens
taagtaccaatctgttttggtggtgaatgttgacagttcctgccatgttttgcaatattgaactaaacaggaaaattatactgtcatattttcatttatcwgcttttcttacaaaataattagagtacttcatttgcataaacatgaataagcaccaaattgatgcacagagttaacaaatacttctcttctttatttttt

SEQ ID NO: 52445 - DNA, 201 bp, Homo sapiens
agtaaatggctttgccatcctaccattgcttacttgagaaactgcagaattgctctacgttcctctgttaacactttgctccatatttccttatcattctygtctcactccatcatcagcatccagtcagtttccaaatctcacagatatattttttactaatatatgtactgtctgttccatctattccattcctagtat

SEQ ID NO: 52446 - DNA, 201 bp, Homo sapiens
ttccttatcattctcgtctcactccatcatcagcatccagtcagtttccaaatctcacagatatattttttactaatatatgtactgtctgttccatctaytccattcctagtatggctgacttggcttcaattctcaacacttttattgaaatcaactcctaattgatttatctgactccaaactggctgcttccaaatt

SEQ ID NO: 52447 - DNA, 201 bp, Homo sapiens
ctgtagttcaataaggtatatagtcaatcgttacagtgttattttccagatcttacaaaaaattgctctcttagaataaaaaactttaaatgttaatattwaaagtttagatcttgtgagattcagagtagaattgaaagccttgtggaattgtgcagtcaccagttgttagattaaaatttaagagagaagatcattttt

SEQ ID NO: 52448 - DNA, 201 bp, Homo sapiens
aagatcatttttcaattataattgagcactgattcaacatctgcattaactgttttagttatatctaaatttcttctgccttttttgtgatcctattaagktccaaacacataatccatctacaagtcacattattcaatcagatggaattgaacaagacagtatcacaggctggtttttcattgctcattctctagaggc

SEQ ID NO: 52449 - DNA, 201 bp, Homo sapiens
tagtgagatgctggctatttcatgataacaaggatttaaatcaagtttggttgagagtctctgtgtaatacaagctgaatttttaaaaggttaaaaaaagrtgtttatataagatttttaaaagagaatgctagcactagaaattatagaaattgctaatcaatcttaccttctcaataaatgaggaaactaagacacaaa

SEQ ID NO: 52450 - DNA, 201 bp, Homo sapiens
tcctaggcttatcttattattatggtgccctggggcctaatattaatgtacacatcatgcagctaaaccacagaaaataccaggtcattgggtgaataacytgactgccttcaaggagaaataaaaagaggttctggtaaaaggtgatgttagaatccagatagctcttcagcctgcacttaagttcagtggtagagacca

SEQ ID NO: 52451 - DNA, 201 bp, Homo sapiens
catttggtaaaactttgctgaatgaagtgagggcgttgttgacattgctaatgacttgattgtccataacctaaccacctgagatgtgatatatagctatrtgtatcacctactctcaatgtctatggaagtatcttgaaccaatttctgctgatattattgtgatttcctgagactatcagtctctattttggttctagg

SEQ ID NO: 52452 - DNA, 201 bp, Homo sapiens
cactactgggtacataacgaaatgaaggcagaaataaagatattcttagaaaccaacaagaaaaaagacacaacataccagaatctctaggacacattcamagcagtgtgtagagggaaatttatagcactaaaagcccacaagagaaagcaggaaagatccaaaattgacaccctaacatcacaattaaaagaactagag

SEQ ID NO: 52453 - DNA, 201 bp, Homo sapiens
tgtttacagagtgtcttaaaacatgtcatacgattaacataaaacactgtaaaatgccttctgggaaaaaataggactgtaagttttttattgaatttttycagtttctttctagtatattttatgactattaaacacctgaaataagaatttatattggaaaagttggcaggattccatttagtcaagttaggactgtaa

SEQ ID NO: 52454 - DNA, 201 bp, Homo sapiens
gggatcaattcaacaagaagagctaactatcctaagtatatatgcacccaatacaggagcacccagattcataaaggaagtccttagtgacctacaaagakacttagactcccacacaataataatgggagactttaacaccccactgtcaacattagacagatcaacgagacagaaggttaacaaggatacccaggaatt

SEQ ID NO: 52455 - DNA, 201 bp, Homo sapiens
tttgattaatttgctaaatataaggcagatttaaatacctttatgtaaggctttaattgaggctggggttgaattgttaatgaatgatatgtattattttrtgtgctttttctaagctctctcaaatgcattatgtatttgaagaaacttacatccatcaaatataagcttgtcatgtttacttccaaatgccatagtttc

SEQ ID NO: 52456 - DNA, 201 bp, Homo sapiens
caggatttcatttccagcgaatcaaagcttcataagtgaaggagaaataaaatactttacagacaagcaaatgctgagagattttgtcaccaccaggcctrccctacaagagctcctgaaggaagcactaaacatgtaaaggaaaaatcggtatcagccactgcaaaaacatgccaaattgtaaagaccatcaaggctagg

SEQ ID NO: 52457 - DNA, 201 bp, Homo sapiens
ccttaatcttggttttgtggaccattaaaggaggaggatgccttgtatgctaaagatgccagttttactcaataactttaccttttttagctgtgaaaatktttatggcactattgaatctaaatatttatagttcattcaatctgtaacaatgagcttgtttacagagtgtcttaaaacatgtcatacgattaacataaa

SEQ ID NO: 52458 - DNA, 201 bp, Homo sapiens
tcaccaaagttgaaatgaaggaaaaaatgttaagggcagccagagagaaaggtcgggttacccacaaagggaagcccatcagattaacagctgatctctcrgcagaaactctacaagccagaagagagtgggggccaatattcaacattcttaaagaaaagaattttcagcccaggatttcatttccagcgaatcaaagct

SEQ ID NO: 52459 - DNA, 201 bp, Homo sapiens
aactccaagaaacataattgtcagattcaccaaagttgaaatgaaggaaaaaatgttaagggcagccagagagaaaggtcgggttacccacaaagggaagmccatcagattaacagctgatctctcggcagaaactctacaagccagaagagagtgggggccaatattcaacattcttaaagaaaagaattttcagcccag

SEQ ID NO: 52460 - DNA, 201 bp, Homo sapiens
ccaaagtaaaaaaatgaacaaaaaaagttagcatatgtgcattatttgtttggttttaaaagtatgctattacttatataatttgattttgataaaaaaaatagtgagatccttttgcaatgcatgtgacattcacaagaacatcatctgtgtagacagtttctatttagttttcttacattttatttgctttcactctat

SEQ ID NO: 52461 - DNA, 201 bp, Homo sapiens
ttttaaaacgattttaagcactctttattttcttagtcttactgaaaatgaattatatgtatataaaaatactgtttatattgtaaattttcacctactcrctaacttttctgttcctttgcaacaggtaagaatttcatcatggccaaaggagaaaccaggaagttggtttagtgaatttaagaggggaaaactggtatg

SEQ ID NO: 52462 - DNA, 201 bp, Homo sapiens
tgggatcaaatgatgaggagatgtcctatgacaataatccttttatcaaaacactgtatgatggttgtgcggtgagtataagttctgcttgtctcccttcwcagagatgataggcagcatgtcaccgtttcagtcggtccttagccagatttttctcatgaaatggacgtcagttgttattaacatttgttgcttaatctt

SEQ ID NO: 52463 - DNA, 201 bp, Homo sapiens
acttggctaatactataacccaattaaatcatgatttccatacatttgggatcaccttacatgtttactaattctcttctgaatttaccattaggcaaacrtcgttgatgattttcaagaatacaactatggaacaatggaaagttaccagacagaagctcctaggcatgtttctgggacaaatgaggtaatacgtataga

SEQ ID NO: 52464 - DNA, 201 bp, Homo sapiens
tctttgataaaatagctgttaaactcttttggttaatattctaattggattatttatcttaatattgagttgtaagagcagacatatcagatttaagtggttttgaaagtacttttttctgtggatgttttagacatagctgcacagcactattggaaaatgtcctattagttatgttaggttctaaaggttatttttaat

SEQ ID NO: 52465 - DNA, 201 bp, Homo sapiens
aagctcctaggcatgtttctgggacaaatgaggtaatacgtatagacagtattaaatcacagtcccactttttaaatatgtaatttattttgatatacttyactctggaagaatctataatttctcaaacatctgatgtttttattcttttactaaagtaagagaaacaatagcaatggttcactattactaaaagcagtt

SEQ ID NO: 52466 - DNA, 201 bp, Homo sapiens
tttagacatagctgcacagcactattggaaaatgtcctattagttatgttaggttctaaaggttatttttaatatttagatcagggagtttaatctgggtcactcatattttagattagtgcattaaaaatatactatatttattttgtattgcacttgacacatgcacctattaaattttctaccatgattttatcatgt

SEQ ID NO: 52467 - DNA, 201 bp, Homo sapiens
aacccctggaagttgcgattttttttttttttactgcctctataattttgacttttccaggatgtattagttgcagtcatacagtatgcagccttttcagwttagcccctttcgccaagtaatatgcatttaaggttcttctatgtattctctttttttttttttttcttttttttttgagatggagtctggctctgtctc

SEQ ID NO: 52468 - DNA, 201 bp, Homo sapiens
tttttttactgcctctataattttgacttttccaggatgtattagttgcagtcatacagtatgcagccttttcagtttagcccctttcgccaagtaatatkcatttaaggttcttctatgtattctctttttttttttttttcttttttttttgagatggagtctggctctgtctcccaggctgagtgcagtggcgcaacc

SEQ ID NO: 52469 - DNA, 201 bp, Homo sapiens
agtatttctgcaagtatttagatttcagagaaaagatatatgtctgctaatacatgtgcatgtctatccacaaaatctagtctgaatttaaaaacgcttaktttttaatttattcctcttcaccaataaaaaagcttaatcaatatgttctactaattttgttatagaaatgagaaaaatgtgtgtaactggactaagata

SEQ ID NO: 52470 - DNA, 201 bp, Homo sapiens
acaacttaaaaacaatgtcttatatcttgtgataagggttaaataccagaacagaaactaaattatgttacctaagagaattaattctgcatcctttttctttttttttttttacatgtgcttaagttttgttaatcatagggttggccttacgaatggatttgctgcaggatttagatgttatctagttagatgcataac

SEQ ID NO: 52471 - DNA, 201 bp, Homo sapiens
taaaattagtaggtattaggcaatattagagatgctcctacttaaaaataatttacaaaaaaactcagaaactaattttattatcagttatttatattatytcatgacatgtaaaaataaatattttcaagtttagaagtactaataatacttatgatgattttaaatatggttgtctagatgaatattttctacttctgc

SEQ ID NO: 52472 - DNA, 201 bp, Homo sapiens
tgaattaaaaacgattaaataaaatgagtaaaaaacttgcataaatatagcacaatctgagatatcagtggagatatttctgaagtccacaaaatttatcrtgaagatgaataaacataatatttcatttatgtcagcacaatttttattagtggatgtgtgtttttgagtcatttttgtgatgtaatgttgctcattttt

SEQ ID NO: 52473 - DNA, 201 bp, Homo sapiens
gattaacaggtagttggcaataagaatttaaatgtcaaaatatggatcaaaaggggatcagcttaaaacactaaaaagaagatttaaaatgagatgcccawaaggagacttgaaaggctcaaacattaatctgatcatctaggatacctgtgtgactgtccaggaaagacctgaggagaaggccctgctatttcaaatatg

SEQ ID NO: 52474 - DNA, 201 bp, Homo sapiens
tatttcaaatatggttgactttgaggatctacctagcaaaaagtgagagctaagacagtgttgtaaactgtaggagtgttgaaagtgtttgccaaggcacwcagaaagtctcttgggatactaattggttccattcaattccaagatttaaggaaatctcactctaatcatttactgatcattaacctaaccagagacctc

SEQ ID NO: 52475 - DNA, 201 bp, Homo sapiens
aatcagtgtacttgaagacaaatcagttgatattatctacaatgagaataagggggaaaaatacattaaaaaaagttgacagcctcagtgcgggacaccamcgaacattccaaaataggcataataggagtcccagaaaaagtaagggcagaaaacatatttaacaaagtaatgactgaacacttctcaaagttgatgaaa

SEQ ID NO: 52476 - DNA, 201 bp, Homo sapiens
taggcataataggagtcccagaaaaagtaagggcagaaaacatatttaacaaagtaatgactgaacacttctcaaagttgatgaaacaccttaatctacayggtcaagactctcaacaacttaatctgataaacttgtaaaatctacatccagatacatcataatcaaacatcaaaaaacaaagactgtgagagaatcttc

SEQ ID NO: 52477 - DNA, 201 bp, Homo sapiens
gtaagggcagaaaacatatttaacaaagtaatgactgaacacttctcaaagttgatgaaacaccttaatctacatggtcaagactctcaacaacttaatcygataaacttgtaaaatctacatccagatacatcataatcaaacatcaaaaaacaaagactgtgagagaatcttcaaaacttcaagagtgaagtgactgat

SEQ ID NO: 52478 - DNA, 201 bp, Homo sapiens
taaaaattttatagccagcaaaactgactctcaaacgcaaaggaaacagccaggtgcagtggcatgcacttatagacccagctaattaggaggctgaagtyggaagatagctggagtccaggatttcaataccagctttgggcaacataataagacaccactcttaaaacaaagaaaaattaagacattcccatatttaaa

SEQ ID NO: 52479 - DNA, 201 bp, Homo sapiens
caatcttgaagacattatgataaatgaaagaagccaattgaaaaaggccacatgttgtatggttgaatttaggtgaaatgcccaatttttacaaggggccrggaaaagggaaggatagagagtgactgccactggttgcagggtaacttttaggtgtcatgaaatttttctgcaattagtagtgatggttggacaaggctg

SEQ ID NO: 52480 - DNA, 201 bp, Homo sapiens
aggaagtattattgacataattcttacttttaagtattaattaatatttattccttactcttcttgagaattgtacagtgatattttatatttcattgtcytaaatgttgctagctatcatttattttatttgctttaaagaactctttggtgtaatactacttccctacatatgagatactctacataatcattgtaatg

SEQ ID NO: 52481 - DNA, 201 bp, Homo sapiens
tcggattcaggtttattctactagtaaggaattatgagaaaaaaaggtatcagtttttatctatgtctctgaggaagtattattgacataattcttacttktaagtattaattaatatttattccttactcttcttgagaattgtacagtgatattttatatttcattgtcctaaatgttgctagctatcatttattttat

SEQ ID NO: 52482 - DNA, 201 bp, Homo sapiens
cctcatcatgatcataataaaaccaaatattcacatgataagtcggattcaggtttattctactagtaaggaattatgagaaaaaaaggtatcagtttttrtctatgtctctgaggaagtattattgacataattcttacttttaagtattaattaatatttattccttactcttcttgagaattgtacagtgatatttta

SEQ ID NO: 52483 - DNA, 201 bp, Homo sapiens
agacaggtgatttctgcatttccaactgaggtaccgggttcatctcactggggtgtgccagacagtgggtgcaggacagtgggtgcagtgcaccatgcatragccgaagcaaggcgaggcatcaccttacccgggaagcacaaggggtcagggaattccctttcctagtcaaagaaaggggtgacagatggcacctggaaa

SEQ ID NO: 52484 - DNA, 201 bp, Homo sapiens
aatgtgattctttacacacacacacacacacacacacacacacacacaatctaaatgtatctttacttgtgtatttcatagaccattatgtaattacattyatagcacagaaaattgaaacagctatgccttatatagactttatatatatatatataaaattatatatatgcaaaccaaagtaaaaaaatgaacaaaaaa

SEQ ID NO: 52485 - DNA, 201 bp, Homo sapiens
agtgattctcctgcctcatagtccagagtatctgggattacaggcatgcaccaccatgcctggctaattttgtaattttagtagagacaaggttttaccaygttggcgaggctggtctcgaactcccgacctcaggcaatccatccacctcggcctcccaaagtgctgagattacagacatgagccaccgtgcctgacctg

SEQ ID NO: 52486 - DNA, 201 bp, Homo sapiens
tgacatgtgaccttaagacattagaccaatattatttaccatacttttccaataaatgtgattctttacacacacacacacacacacacacacacacacacaatctaaatgtatctttacttgtgtatttcatagaccattatgtaattacattcatagcacagaaaattgaaacagctatgccttatatagactttatat

SEQ ID NO: 52487 - DNA, 201 bp, Homo sapiens
tcgtgccaccgcactccagcctgggcaacagagcaagactctgtctcaaaaaaaaaaaaaaaaaaaaaagccaacgttttctgtgaaattttataaagacycaatttttcatttttattttaaagtaatgatttttggaatgtttctttcttaaaagattttaaattcaaattgcatttgaaaggcagcaaaattttagga

SEQ ID NO: 52488 - DNA, 201 bp, Homo sapiens
atgtggcaaacttcatcattgccttattttaagaaattgatacagcaacctcaaacctcagcaaccaccaccctaagcagttatagacacagaggtgagaycctccaccagcaaaaatattacagtttgctgaaggttcaaataatcgttagtattttttagcagtaaagtatttttatattaagatacatacatttattt

SEQ ID NO: 52489 - DNA, 201 bp, Homo sapiens
attgacatgtgaccttaagacattagaccaatattatttaccatacttttccaataaatgtgattctttacacacacacacacacacacacacacacacacacaatctaaatgtatctttacttgtgtatttcatagaccattatgtaattacattcatagcacagaaaattgaaacagctatgccttatatagactttat

SEQ ID NO: 52490 - DNA, 201 bp, Homo sapiens
actctgtctcaaaaaaaaaaaaaaaaaaaaaagccaacgttttctgtgaaattttataaagactcaatttttcatttttattttaaagtaatgatttttgraatgtttctttcttaaaagattttaaattcaaattgcatttgaaaggcagcaaaattttaggaagcaaaaacatgacattttaataaatcaggaaaatag

SEQ ID NO: 52491 - DNA, 201 bp, Homo sapiens
ggaggagaagtttgtttcaaaatgagtttgaagcattcaagatgtcagtagggaagtcaatgccgatgcggcagaaatagcaagagaactagaattggaartggagctcaaggatgtaactgaactgctgtaacctcatgataaaacttgaacagatgagttgcttcttatggataaggaaataaagtgtttttttctgag

SEQ ID NO: 52492 - DNA, 201 bp, Homo sapiens
acattgacatgtgaccttaagacattagaccaatattatttaccatacttttccaataaatgtgattctttacacacacacacacacacacacacacacacacacaatctaaatgtatctttacttgtgtatttcatagaccattatgtaattacattcatagcacagaaaattgaaacagctatgccttatatagacttt

SEQ ID NO: 52493 - DNA, 201 bp, Homo sapiens
tgattaagcttagtgaggaaggaatgttgaaagctgagataagccaaaggccaggccttttgtgccctgtgaatccaagagttatgaatgcaaaggaaaawatttttaaagaaattaaaagtactactctagtgaacatatgaatggtaaggaagcaaaacagtcttattgctgatatggagaaagtttgagtagtctaat

SEQ ID NO: 52494 - DNA, 201 bp, Homo sapiens
aacagaacataatagttggatctatatatttactctaaaaatttcatataaatttcctaacaataattccttttaagcttattgagctttttacttatttrgtattactattacattactgtctttatatatgcacagtttttaaaatgtgttgacttttaaaattagccttttgctcacattttatttgttctttaccat

SEQ ID NO: 52495 - DNA, 201 bp, Homo sapiens
acacattgacatgtgaccttaagacattagaccaatattatttaccatacttttccaataaatgtgattctttacacacacacacacacacacacacacacacacacaatctaaatgtatctttacttgtgtatttcatagaccattatgtaattacattcatagcacagaaaattgaaacagctatgccttatatagact

SEQ ID NO: 52496 - DNA, 201 bp, Homo sapiens
gaatgttatacctttatacccttccttttactttgtatgtgtttttatatttaaagtgtgtctcttgtagacaacatgtaattgagccttggtttttttttgatccactctgacaacctgtctttaatgagtgtatttaaatcattcatatttaaggcaattatatatatagttagaataatattcaccatatatgttatt

SEQ ID NO: 52497 - DNA, 201 bp, Homo sapiens
aacacattgacatgtgaccttaagacattagaccaatattatttaccatacttttccaataaatgtgattctttacacacacacacacacacacacacacacacacacaatctaaatgtatctttacttgtgtatttcatagaccattatgtaattacattcatagcacagaaaattgaaacagctatgccttatatagac

SEQ ID NO: 52498 - DNA, 201 bp, Homo sapiens
tgcactaaaaatctttctttctctacctaatcttcctttctctacctattcatccttctctccctgattaacccctggaagttgcgattttttttttttttactgcctctataattttgacttttccaggatgtattagttgcagtcatacagtatgcagccttttcagtttagcccctttcgccaagtaatatgcattta

SEQ ID NO: 52499 - DNA, 201 bp, Homo sapiens
atgcatttaaggttcttctatgtattctctttttttttttttttcttttttttttgagatggagtctggctctgtctcccaggctgagtgcagtggcgcarcctaggctcactgcaagctccgcctcccgggttcacaccattctcctgcctcagcctcccaaatagctgggactacaggcacccaccaccacgcctggct

SEQ ID NO: 52500 - DNA, 201 bp, Homo sapiens
taacacattgacatgtgaccttaagacattagaccaatattatttaccatacttttccaataaatgtgattctttacacacacacacacacacacacacacacacacacaatctaaatgtatctttacttgtgtatttcatagaccattatgtaattacattcatagcacagaaaattgaaacagctatgccttatataga

SEQ ID NO: 52501 - DNA, 201 bp, Homo sapiens
aggttcttctatgtattctctttttttttttttttcttttttttttgagatggagtctggctctgtctcccaggctgagtgcagtggcgcaacctaggctyactgcaagctccgcctcccgggttcacaccattctcctgcctcagcctcccaaatagctgggactacaggcacccaccaccacgcctggctaattttttt

SEQ ID NO: 52502 - DNA, 201 bp, Homo sapiens
actaacacattgacatgtgaccttaagacattagaccaatattatttaccatacttttccaataaatgtgattctttacacacacacacacacacacacacacacacacacaatctaaatgtatctttacttgtgtatttcatagaccattatgtaattacattcatagcacagaaaattgaaacagctatgccttatata

SEQ ID NO: 52503 - DNA, 201 bp, Homo sapiens
ccattctcctgcctcagcctcccaaatagctgggactacaggcacccaccaccacgcctggctaattttttttgtgtttttagtaaagacaggttttcacygtgttagccacgatggtcttgatctcctgacctcgtgatccacccgcctcagcccccaaagtgctgggattacaggcatgagccaccgcgcctggccctc

SEQ ID NO: 52504 - DNA, 201 bp, Homo sapiens
tatggtgtgtttctctatagggtattatgggtcctccaggtctacaaggccccactggaccccctggtgaccctggcgatagggtaagtgaatggacatgwtatctcattacaaatgcatgtcatacagacttaaataattaaaatgtattctacaagtataacatgttatcttactgcgtgtgggaggggtaaaggcagc

SEQ ID NO: 52505 - DNA, 201 bp, Homo sapiens
aaggctgtggctgtactaagcccactgtattgtaaattttaaaagaatggattttatatgtgaattaattaaatccattataattgattttatatgtgaayggtgtgaacagctcaataactgttatttttaaagaagagaaatgtaagcatagaaatataaatttttgaaccttaaaaataaatcctaattctaagggtg

SEQ ID NO: 52506 - DNA, 201 bp, Homo sapiens
aggctgtggctgtactaagcccactgtattgtaaattttaaaagaatggattttatatgtgaattaattaaatccattataattgattttatatgtgaacrgtgtgaacagctcaataactgttatttttaaagaagagaaatgtaagcatagaaatataaatttttgaaccttaaaaataaatcctaattctaagggtga

SEQ ID NO: 52507 - DNA, 201 bp, Homo sapiens
tggcacttcttacactatttgattatatcttttcaagttattaattttattccaccttatgctagagtttaaatattcttaaccactaatttgcactctcyaaagtgcaaagattatatcaaatatgtgtttctacacccacaggttcaatattttgtgtataatactttctcaataagtatctgttaataaaaaaatgaa

SEQ ID NO: 52508 - DNA, 201 bp, Homo sapiens
ttatatcttttcaagttattaattttattccaccttatgctagagtttaaatattcttaaccactaatttgcactctccaaagtgcaaagattatatcaartatgtgtttctacacccacaggttcaatattttgtgtataatactttctcaataagtatctgttaataaaaaaatgaatattgtggtataaatgtagaat

SEQ ID NO: 52509 - DNA, 201 bp, Homo sapiens
gtcgggagttttatgaatcagatttatgtgctcaaacttacagggaattgaatgctcaagttaaatggctatcagcccagatattactctaggcctgagtrtaattctgaattaatatggtcatgacacacagatttatattaaattagtttcatgatgaaataaagtccagatggaagtagccacattacgtcaagagca

SEQ ID NO: 52510 - DNA, 201 bp, Homo sapiens
attactctaggcctgagtgtaattctgaattaatatggtcatgacacacagatttatattaaattagtttcatgatgaaataaagtccagatggaagtagycacattacgtcaagagcagaatatttggatttttctcttgtttgcagtttccaaaagctcttgaaattaaaactctttaggtaattctattattaaatat

SEQ ID NO: 52511 - DNA, 201 bp, Homo sapiens
tccctaggcctttggcaatgcatacaaatgagaaagtgacattagaactatcttaaagttttcaggctgtgttgaacaattagagggtttttaaaaaaaawtttctcataggaaaatttaaaagcatgtgaaatggaaggaatttaagcctcagttgggagcaaaactatatttttggattttttttttttggattttgaa

SEQ ID NO: 52512 - DNA, 201 bp, Homo sapiens
atgcatacaaatgagaaagtgacattagaactatcttaaagttttcaggctgtgttgaacaattagagggtttttaaaaaaaattttctcataggaaaatktaaaagcatgtgaaatggaaggaatttaagcctcagttgggagcaaaactatatttttggattttttttttttggattttgaatttttaagacttagagt

SEQ ID NO: 52513 - DNA, 201 bp, Homo sapiens
tggatttaagtctgcatcttattatttgtattttctttgtactctctgttttctgattctttgttcttcctttcctgcctccagtctttttttttttttttggtgctgagggtttatttgaatattttgtagtattccattttgttttacttattggatttttgctatttttttatttaagaaatactttttataataatt

SEQ ID NO: 52514 - DNA, 201 bp, Homo sapiens
ttaaggagttttaagagtatataaaactttatcctgcataaagattttttgtctgatatatgtttgcaaatattttttccagtatgtgacttgcctttttwttgttttcttattggtgtctttccaagtgtaaatgcttttaattttgataaagtttaatttatcaattttgttgttatgtttgacactctttgtgttcta

SEQ ID NO: 52515 - DNA, 201 bp, Homo sapiens
aaaatgagctgatgtatgtacagtctttaagatactagtataaatatatatatatatatatacaaacacatatgtaatataaatgtggttgtatgttgaacttaattatccattaatgtgtagttttacaaacattattattacttctttttcttatgattttacaaccatgacatttcaacttttgatatgggcaactaa

SEQ ID NO: 52516 - DNA, 201 bp, Homo sapiens
gtataaattttttctgctatttacagaacgtattattctgaaagttaaaatcttatctgtattgtacatagtagacacttgcagcaaaactattgtattcmaatttaaatcaagtactttgccttctaattatttagtctgttttactgattatattaggataatagtttttcttcatgtattttatcgaagattttatta

SEQ ID NO: 52517 - DNA, 201 bp, Homo sapiens
aaaaatgagctgatgtatgtacagtctttaagatactagtataaatatatatatatatatatacaaacacatatgtaatataaatgtggttgtatgttgaacttaattatccattaatgtgtagttttacaaacattattattacttctttttcttatgattttacaaccatgacatttcaacttttgatatgggcaacta

SEQ ID NO: 52518 - DNA, 201 bp, Homo sapiens
atcttagggcaagcaagatactttttaaaccgcaggttgcctcagtattccacaaggtgcttcaactattagagagagtattttctcttgtagaaattctwggaaataacaaagtattatttttttctcactagcgtgatagcaagctaagatatttcaaatatttttgtctaaaaaatcttcaaatacactagaatatac

SEQ ID NO: 52519 - DNA, 201 bp, Homo sapiens
actcttacttgatatgctactttcagtgctttatgtgaagtgttttgtaggacatcatgagaataagtgaggatgataaacttttgtaaatgtaataataytgtttttgagtttgtgttatctttgccaaaaataaaagagcaatctaaagtgattttgcttatctaatttagggaccaaccggtgagactggtccaatag

SEQ ID NO: 52520 - DNA, 201 bp, Homo sapiens
gaaaatcaaaggagaagatacattcagcaagttccatgttaggaatgttgaagagagagcatgatatacaactggaaatttctagtaggcacttactgagmgagttttagggctcatactgattagaggtttataaatagttgggaatggaggagttcatcagcatagagatggcaattgtggtgatggaggttgttgaga

SEQ ID NO: 52521 - DNA, 201 bp, Homo sapiens
aaaaaatgagctgatgtatgtacagtctttaagatactagtataaatatatatatatatatatacaaacacatatgtaatataaatgtggttgtatgttgaacttaattatccattaatgtgtagttttacaaacattattattacttctttttcttatgattttacaaccatgacatttcaacttttgatatgggcaact

SEQ ID NO: 52522 - DNA, 201 bp, Homo sapiens
aatattcaaccttctctatataattactctatatcagtttcaaatgggaaatataacagaatcttcctcataaggatttatagaaaaaaaatgagctgatrtatgtacagtctttaagatactagtataaatatatatatatatatatacaaacacatatgtaatataaatgtggttgtatgttgaacttaattatccatt

SEQ ID NO: 52523 - DNA, 201 bp, Homo sapiens
tattggattctgtttatacttttgaatatatgaactgatagaattttctgactataggagtgtgtagtatgagaaaaagagaataattaagaatgcctctmaggctaaatgttaatttggtattttgaatattatatatgacaccatgattatgacatatcattatcatagcctacattaattaaacaaaaatatcaagtt

SEQ ID NO: 52524 - DNA, 201 bp, Homo sapiens
ggggcgtctgagctcatgaggtcatagaaggataggggaccctcctgtgaagcagaataatggcttcagcttttactgtgagtattgtatttgatagttttaagaatgcagatccttgatctgacttagatttttaaaaggtggctctggatgcataagagtagaagcagaggccagttaggagtctagctgtgagagatg

SEQ ID NO: 52525 - DNA, 201 bp, Homo sapiens
gtgaagttcctccactcctggagcttaaatatgcgaagtgctgatagttctttgaacgaaaataaatcaagataagagatgtagagtgtactattttagayaggacagtttaatatgaatgaatcctcaaagtaaaacatgaggtttcactcatgtttttttgagtgaggttgcattgagcaaaatcacaaaggaagtgag

SEQ ID NO: 52526 - DNA, 201 bp, Homo sapiens
cacagcagttgtagcaatgaacaacccaggtgaagttcctccactcctggagcttaaatatgcgaagtgctgatagttctttgaacgaaaataaatcaagrtaagagatgtagagtgtactattttagataggacagtttaatatgaatgaatcctcaaagtaaaacatgaggtttcactcatgtttttttgagtgaggtt

SEQ ID NO: 52527 - DNA, 201 bp, Homo sapiens
ataagtcagatgtaattcttatcttcgcttgtataggtaagttggtttttttcccctctgggttcttttaatatttttaaatttatcttagattttctgatatttgaaaatgatattcccagatttttggtctgatatttgaatattatacttctggaattttggtttgatgtctgacattaatttgggcaaattctcagt

SEQ ID NO: 52528 - DNA, 201 bp, Homo sapiens
tgaatatttcattcaacagataaatggccatggtgcatatggagagaaaggacagaaaggagaaccagcagtggttgagcctgtaagtagtagtgtgaatrcactttaaaggttggtaaaattgcttatgagccacgattatgttaaattattatgtatgttcgtgttttaccaatgataatcttgatgtccagatgtttg

SEQ ID NO: 52529 - DNA, 201 bp, Homo sapiens
tgccttattttaagaaattgatacagcaacctcaaacctcagcaaccaccaccctaagcagttatagacacagaggtgagaccctccaccagcaaaaataytacagtttgctgaaggttcaaataatcgttagtattttttagcagtaaagtatttttatattaagatacatacatttattttacactgaatgtttttgta

SEQ ID NO: 52530 - DNA, 201 bp, Homo sapiens
ttaataatgaattctgttgcactgatattttccatgacttaatgttagtttttgtttaaaaaacagggtaaaattttaagaacctaacaggaaggcaaatrtgagagtgtaaagataaattactgggatattttatttacctgtttcacagttatcatgtacttcattctttttattctctcatgattcaccaaatatgtt

SEQ ID NO: 52531 - DNA, 201 bp, Homo sapiens
acaaggattttgtgctctttttgatcttaggaaagtctaaaggaaattaggaatttcttaatacattttagattttattttcccattggttacagtatttyaatacagtatatacttatttcatattctttgtattccctttccctcctcccctctttcccgtctctcaatagatatgaaaatcctttcatacttaggaag

SEQ ID NO: 52532 - DNA, 201 bp, Homo sapiens
ttctcgtgatactaactactattctgctcataggaaatgtgctttgtcactcctatgttattatactctgtataagacagtataatacttctatgtaatamaaaaataactcatcaataacattaatttcttatctcttaacatttacactatgtaaaagttaagatggttctcactttgtgaatagtattttgccactaa

SEQ ID NO: 52533 - DNA, 201 bp, Homo sapiens
tcatcttatttctctgaaccaataactgtgatttttatttgacagtagccgttttgaagaatgatgtccatttcacttttgcttagccttcctttcatctrtgatctatatttccctcctcgtttatttatgttttccattccatctttcaccacattttacagaaaaagaaatccaatttcaaaaagaagatgaggacag

SEQ ID NO: 52534 - DNA, 201 bp, Homo sapiens
tcttatttctctgaaccaataactgtgatttttatttgacagtagccgttttgaagaatgatgtccatttcacttttgcttagccttcctttcatctatgmtctatatttccctcctcgtttatttatgttttccattccatctttcaccacattttacagaaaaagaaatccaatttcaaaaagaagatgaggacagtgg

SEQ ID NO: 52535 - DNA, 201 bp, Homo sapiens
ttccctcctcgtttatttatgttttccattccatctttcaccacattttacagaaaaagaaatccaatttcaaaaagaagatgaggacagtggctactaamtcaaaggaaaaatccaaaaagtttacaccccccaaatctgaaaaattttcatccaagaagaagaaaagttatcaagcatcagcaaaagccaaactagggg

SEQ ID NO: 52536 - DNA, 201 bp, Homo sapiens
tcatgaagaatacaattcagtttaactttgttaaatatctggtatacattttggtataattttatcaggaaatgaatataagaaatgtaatttagttttargaaaatttatgtaaaatgtctctcaattaggcaaatagatttatgtgaaaacacaaaattgtgaataataaatgtttagggtgagaatggattttaactt

SEQ ID NO: 52537 - DNA, 201 bp, Homo sapiens
attcatccagcattttagttcagagctatgattatagcaatattctcaccatagatattatgcagtctctgtagacagcatatactccttatctaagaatmcaaaaaaaattacggttattggacatttaattttagtgaaaaattactcatcatttatctacatattttcattcacaagattgtgtaatactattatcta

SEQ ID NO: 52538 - DNA, 201 bp, Homo sapiens
aaattacggttattggacatttaattttagtgaaaaattactcatcatttatctacatattttcattcacaagattgtgtaatactattatctaatattaytctatcatctagatttactatggaatagaaaatgagttacttaaaaatgaaatttacaaattggcaagataagcctaggcaatacaataagatcctgtct

SEQ ID NO: 52539 - DNA, 201 bp, Homo sapiens
gaagcaatatgcagtgaaactgcattgtttgatattaagaactaatcgaaaactcttaagcttttaaagaaacaacagaaagaatacgtttgtaaattgggtcattacaatgcctctttaaagtgggcatgtatggctacggactagacaaagacaaaaaatacaaactttaggccaaaattagcacttaaataaatgttt

SEQ ID NO: 52540 - DNA, 201 bp, Homo sapiens
ctatttttggaatatataactgttcacttacagtcctctaacatctattacatttatactttttgacaggcattgttcaaagaactttagttatattaaayatgactaaaacctgatgacaaactatttctgtctctattatgacaggcattgttgaaataactttagatgtatcatagtaaacatgacaaaaacctgatg

SEQ ID NO: 52541 - DNA, 201 bp, Homo sapiens
aaggattttgtgctctttttgatcttaggaaagtctaaaggaaattaggaatttcttaatacattttagattttattttcccattggttacagtattttaatacagtatatacttatttcatattctttgtattccctttccctcctcccctctttcccgtctctcaatagatatgaaaatcctttcatacttaggaagac

SEQ ID NO: 52542 - DNA, 201 bp, Homo sapiens
tgaatgtttataaatcatatataggaaactttaaattccagatgcacatatgcctatgtacacacacacacacacacacacacacacacacacagacacasacacacacacacacacagacaccccttctgtgttgcttaaccataatttgattccagatttgagatattttgaatttgagaatgttgttatggtttatat

SEQ ID NO: 52543 - DNA, 201 bp, Homo sapiens
ttgagatacatatgaatgtttataaatcatatataggaaactttaaattccagatgcacatatgcctatgtacacacacacacacacacacacacacacasacacagacacagacacacacacacacacagacaccccttctgtgttgcttaaccataatttgattccagatttgagatattttgaatttgagaatgttgt

SEQ ID NO: 52544 - DNA, 201 bp, Homo sapiens
gattgagtcccagctttcaattattttaggcatatatgtgggagtggaattgctgggtcatatggcacttctgtatgagtctacttaaatgaaaattctcraatgagtaactagagacagaaagtatataagaggttgtcagggggtaggaggttgaaggagtgaagagttattgcataatggtgatgaagtttgagttga

SEQ ID NO: 52545 - DNA, 201 bp, Homo sapiens
tgattgagtcccagctttcaattattttaggcatatatgtgggagtggaattgctgggtcatatggcacttctgtatgagtctacttaaatgaaaattctygaatgagtaactagagacagaaagtatataagaggttgtcagggggtaggaggttgaaggagtgaagagttattgcataatggtgatgaagtttgagttg

SEQ ID NO: 52546 - DNA, 201 bp, Homo sapiens
atggtgttaaaagatacgttgttgccgggcgcggtggctcacgcctgtaatcccagcactttgggaggccgaggcgggcggatcaggaagtcaggagatcragaccatcctggctaacactgtgaaaccccgtctctactaaaaatacaaaaaattagccgggcgtggtggcgggcgcctggagtcccagctactcaggag

SEQ ID NO: 52547 - DNA, 201 bp, Homo sapiens
ttttttgaggagtgaacacttggataaggtcatggtgttaaaagatacgttgttgccgggcgcggtggctcacgcctgtaatcccagcactttgggaggcygaggcgggcggatcaggaagtcaggagatcgagaccatcctggctaacactgtgaaaccccgtctctactaaaaatacaaaaaattagccgggcgtggtg

SEQ ID NO: 52548 - DNA, 201 bp, Homo sapiens
attaaaataataaatatatagaaatgcaattaccaattatttatttttattctctgacaggtattttctctgagggacttagaacaggcaccaaaaaaaaaggatgatgctaaaaattgatatgtaaaaagctgatacccaaatatctggtattgtgttggaggaataaacgtgtcagttcaactgttaactctttatgaa

SEQ ID NO: 52549 - DNA, 201 bp, Homo sapiens
attcattatttagttcacttgaaataaaataaacttaaggacttaattaatggagttttacttttttgtaacttgaaatgcctttttgggaaaaaaaaaaaggcttggttgatacctttattttatgtctctacttgtattgttttttgaggagtgaacacttggataaggtcatggtgttaaaagatacgttgttgccgg

SEQ ID NO: 52550 - DNA, 201 bp, Homo sapiens
aataatgttttcttaaattgttggtacagataattactataaaagcagtatccatgtgattattttcaaaaatctatatatatgaggttttttaaaaaagmaaactagttaaaagcattacatcttttttgaaactcagttaaaaaaaattaaaaaacctaatcagattcaaatgatctcatcagtgttcataagacccag

SEQ ID NO: 52551 - DNA, 201 bp, Homo sapiens
aaaaactttctttatgaaagctgaaatttcatatagttttcatgtgtcacaaaatattgtccttttatttttcaacatttaaaatgtacaattattcttayatcatgtaccatataaaaataggcagcaaggaggtctatgggaggtctatacccacaggcacagatttccccaccatcattcgaaggcattgttacaaaa

SEQ ID NO: 52552 - DNA, 201 bp, Homo sapiens
gacacacctgtgcaactttagggctatacattgtaattggtgtctgactttttgcttttttgtatctctaaaaaatgttttcatatggtaccaatccttcytccactgtttgctttaattttagttaccatatcatagaagggtctatgtgataaaagaaggcaaaagcagtcttgaataatcagaccacttctgccagat

SEQ ID NO: 52553 - DNA, 201 bp, Homo sapiens
agtacatagaaagattttggcttttatataatacagagtttaaaataactttacagggaactaaatttcttcaatctgaagttcagctatcttttttttttgttaactttccatgctctctatccaaactgaacaatattttctgttacacaaatttacatgagaaaatatccaatgtacaaatgaagggacctgagcagg

SEQ ID NO: 52554 - DNA, 201 bp, Homo sapiens
tttagtgagatgctggctatttcatgataacaaggatttaaatcaagtttggttgagagtctctgtgtaatacaagctgaatttttaaaaggttaaaaaaaggtgtttatataagatttttaaaagagaatgctagcactagaaattatagaaattgctaatcaatcttaccttctcaataaatgaggaaactaagacaca

SEQ ID NO: 52555 - DNA, 201 bp, Homo sapiens
ctttatagaagttattctctaaaaggtatttgtatagttttaaacaaagttatgcagtagcaaagtgagaaatgtatttgcataacataattggtaaaaaattaatattttttcggttttttattttcttcaatttgtgactaaaatagaaccacatggttgttcatgttaagttatccttaaaatacagcaaagcaaaca

SEQ ID NO: 52556 - DNA, 201 bp, Homo sapiens
actatgcatctatttggggacagttgtagaaattggggggaagagctagatctaaaacacagtgaagtcaatgcactaactataactgaattaggcaatarcagtttgaaattttaggaaaaatattcttcaaatacttatttacaatttctagcatgtatgtgtgtataattgcagagaaaataatcagtgccagaattg

SEQ ID NO: 52557 - DNA, 201 bp, Homo sapiens
tcatagtgaccacactatgattatcttaagatagatgagtttatgtaagggttttaagtaagagttagacttagctataatgaagcactaaaaaaaaaaaatctaattgaatcactttttactaattaaaattacatttaacctttggcagttaagccaatactgtatcttgtaaaaggctgatcaaactgggaactttgg

SEQ ID NO: 52558 - DNA, 201 bp, Homo sapiens
ttaaaataagagtgatgtttaaaagcatatttttggattaccacgtgatgtagtgttgagagaaaacagaagcctggactcaagtcttaatggagaattakaatgggtgtaagttctgaaagcatctaataagagagaaaaatagtccatgaggttgtttgtttgtgtgtgtgtgtgtgtgtgtgtgtatgtgtgtgtgtg

SEQ ID NO: 52559 - DNA, 201 bp, Homo sapiens
tgatggatgaaatacaagctccgagagacacttttgcatggattcagggattattttactgaagctatttatttttattttccacattgagcctttctgtrgcgatatgtgaatattttttaatatcaaatttctgtacttttcatgcataaattttctattttcagtctagcaacatacctgaaacacttttaaacagca

SEQ ID NO: 52560 - DNA, 201 bp, Homo sapiens
aaaatttttcgtttaaatcataaaacttcaatataattttggttgttcattcaaatggtgtgttcactcttgtctttatgatgtttttctttggtcactaycagtatatattctctttaaattatgtatttaaacatgttcctacttcttaaatgaaatatgttagatgatgatactgtcacatgcttcagcacttcctta

SEQ ID NO: 52561 - DNA, 201 bp, Homo sapiens
tagatgatgatactgtcacatgcttcagcacttccttactaatttatactctctaaagaatatctgtggacattattttctaagttctttttttttaattwttttttccctttaagtgttcatgtatttgctctctgatagaaacataaattgggggagtacagagatatgtccttcaagttttttttttcacctagtatg

SEQ ID NO: 52562 - DNA, 201 bp, Homo sapiens
gggtccctccattctatcttcattcctttcttctaattattgggttaaaaaaataaaaataaaaacacttttcagagtaggcagcgcaatgagtccactgkttccacgtctgccatacgaagcagatttttgcacaaggataaggttaccgctgccagcccaggactccagcggtgtggccgatcaggcgctggcctcctc

SEQ ID NO: 52563 - DNA, 201 bp, Homo sapiens
cctagtatggaagtttatacattatccccagcaatttcattctaacagaccagtctggttctattttgtgatccatcagtctgatgcttttagggttggayttactgcctacattaacacataacggaaagaagatttttattagaattgatggaatcccaaactgaagagttaccatagtcctatgagatgaatttttct

SEQ ID NO: 52564 - DNA, 201 bp, Homo sapiens
acacataacggaaagaagatttttattagaattgatggaatcccaaactgaagagttaccatagtcctatgagatgaatttttctaactaaaaagaaaacwctagaatgaaaagagaaaaagcttgtagtaataattgtagtatttaatgcataattcatttttatatgcagtgaaacaaaacaccaacaaacaggtgata

SEQ ID NO: 52565 - DNA, 201 bp, Homo sapiens
atgaatttttctaactaaaaagaaaactctagaatgaaaagagaaaaagcttgtagtaataattgtagtatttaatgcataattcatttttatatgcagtraaacaaaacaccaacaaacaggtgatagcactgatactccagatccatgctgtaaaattatgacaagaaattgtgtacagaaaaccggctgcatatgttt

SEQ ID NO: 52566 - DNA, 201 bp, Homo sapiens
tgagtataggttaaatataagaccatgccaaatcaaacaaaagacatggggatgtttagctaattctatcattttttaaggaaagatttagttattaacgtaaatggaatgttagaagtggtgaaataaagaacggttacaaggagagatgaatgtttccagtagttgtgcagattgtgggccaagagatacataatggag

SEQ ID NO: 52567 - DNA, 201 bp, Homo sapiens
tatgattatgagaaattttgtatacatatatttaccaaaattaacagtattactatgttctacatgtatacaaattggtcactcattcccatatgttataratacttattttaaaatttttcgtttaaatcataaaacttcaatataattttggttgttcattcaaatggtgtgttcactcttgtctttatgatgtttttc

SEQ ID NO: 52568 - DNA, 201 bp, Homo sapiens
agtggtcatttacagctcttaagcctctgccattgcccaatcacattcagtacagagagcatcctgggcaggatggtgaaaatggcatgactttctcttgaaaaaaaaaaaaaaaattcctggcatgctagagttctttgagtatgcaagataacagtttgaatctctttccagggttaggtctcatattcacaagtaccc

SEQ ID NO: 52569 - DNA, 201 bp, Homo sapiens
tgtaaataataaactgattcaggtagtttataatggtaatatactctcagatatcccaatatccaacactgattgcatgcacattatgataaacaattatytattcattaggcaaataaatattaatataatttctaatcttgaaaagcattattttaaaaataaaactattcataaacataagttgcatgtgaattatga

SEQ ID NO: 52570 - DNA, 201 bp, Homo sapiens
gatatcccaatatccaacactgattgcatgcacattatgataaacaattatttattcattaggcaaataaatattaatataatttctaatcttgaaaagcrttattttaaaaataaaactattcataaacataagttgcatgtgaattatgaataaattataatttatttttgtaacccacaccttattttccaggaacat

SEQ ID NO: 52571 - DNA, 201 bp, Homo sapiens
gcacattatgataaacaattatttattcattaggcaaataaatattaatataatttctaatcttgaaaagcattattttaaaaataaaactattcataaayataagttgcatgtgaattatgaataaattataatttatttttgtaacccacaccttattttccaggaacataaatgtgtaagacaaaagcacagtatcag

SEQ ID NO: 52572 - DNA, 201 bp, Homo sapiens
taggttcaaaatcaatctcttaccatcaaaaggagaaaggtactcaaaaatatgaggaaaacactttttaatgataatgtatttacaatataaatgttgtmttacatctatattaaaaaagtagaagctattacttttgtttttaatgataactatgatttatttattctggctcaagagccttcgcttcgaaaatttggt

SEQ ID NO: 52573 - DNA, 201 bp, Homo sapiens
ataaatgtgtaagacaaaagcacagtatcagtggaatttctttccttttttaaaaattgatgcttaactttgtaaaactatatcccacattctgaatcctrgagtaacttcagctctttagttggagaagctattaaaacattaagaaaagtaatgttgaaaggattctttaatgaaacccttagtgaatatgacagtgag

SEQ ID NO: 52574 - DNA, 201 bp, Homo sapiens
tattctggctcaagagccttcgcttcgaaaatttggtaaatagtaatgtttaattgtatcatggtataatttaacattttaatacaatttaactaatgtcwtatgtttttacaatccaagagcaattttttgtactaacttatcatagcctgtgcttttatttttggtaaaaatatttcataaaatttaagttaattaact

SEQ ID NO: 52575 - DNA, 201 bp, Homo sapiens
atatcatgctagattatgtaaataataaactgattcaggtagtttataatggtaatatactctcagatatcccaatatccaacactgattgcatgcacatkatgataaacaattatttattcattaggcaaataaatattaatataatttctaatcttgaaaagcattattttaaaaataaaactattcataaacataagt

SEQ ID NO: 52576 - DNA, 201 bp, Homo sapiens
attttaatacaatttaactaatgtcatatgtttttacaatccaagagcaattttttgtactaacttatcatagcctgtgcttttatttttggtaaaaatakttcataaaatttaagttaattaactaaaatagataatatattatatttttctgacatttttgataaatataccaaatacatcctatgataaattgtgata

SEQ ID NO: 52577 - DNA, 201 bp, Homo sapiens
cattaaaataaatttaaattatcaaatatagctagccgtgctgattcttagaaacaaaacatattgtaacttcatttgaaagtaagtaataatttgttgaraattccttaatagataataattcagaaaattatttccgttattagacagcttttacttcacttggtatacaggatcaaatcaaagtcagttatgatccag

SEQ ID NO: 52578 - DNA, 201 bp, Homo sapiens
gtaataatttgttgaaaattccttaatagataataattcagaaaattatttccgttattagacagcttttacttcacttggtatacaggatcaaatcaaartcagttatgatccagaagcaaagaaaataagcaaaacaaacaatagtatattggagcagataatgggcattcagtctactttttacttggttattcttaa

SEQ ID NO: 52579 - DNA, 201 bp, Homo sapiens
gttagacaattatacgtaaacagtcataagtaccacatatcaatatgtgtgtgaagcatacatatttgaaaacaaggcattaaaattagattgtcaatggktacattaatattcattttcttttttttatttgactactctgaatcctataaaactgtaatttagaaacagttctcatgattaaagtaggtgtcttgtaga

SEQ ID NO: 52580 - DNA, 201 bp, Homo sapiens
ttttcatatattttggacaaatgaatattaatatattattctaaaaatgaaactttgtagtaaaaagctcatactttttttgaagcagaatatattttaawttttttatcacctcaagcatttatcattagaaagcacatacataaattctaagattatttaaacctatctttttaccacatatcatttcactcatttaat

SEQ ID NO: 52581 - DNA, 201 bp, Homo sapiens
gagtggccacattttgcaagggccttgttgcagtgtcataccatggtggaaggacaaggagcagacttgaaagagcaagacatcaaattcacagcctcagttttttttttttttttttagacagagttttgcttttatttcccaggctggagcacaatcgtgcaatctcggctcactgcaagttctgcctcccgggttcaa

SEQ ID NO: 52582 - DNA, 201 bp, Homo sapiens
gggcacattccattctgactgcttgttttatggcgagtacttacgatgtgaatataatgtgtagttttttcatagctttaattagtcttgacttgtgataygtaatctcaatgaaaatgctacttggtcttcatgaggtgaggatgggcagataaatcatcttcaaaatgccatttatggcaatttaatgagcctttcaac

SEQ ID NO: 52583 - DNA, 201 bp, Homo sapiens; identical to SEQ ID NO: 15105

SEQ ID NO: 52584 - DNA, 201 bp, Homo sapiens
tgttctcttcgtgagtcatacaggctgaaacataaaacagtaaaactcagtgaaaaaagatatggctactgtaacactgaagcttggtcactatcattaartctgtgtgcaaacaacatgcttgagaaatgcaataaagtattttgttgactgggatactattcataggtggagtttattataggatctgaggctatactt

SEQ ID NO: 52585 - DNA, 201 bp, Homo sapiens
attatggttactagttaaggttatcgactctagagccaaactcctgggttcagaaacaatcactaccacttacttggtggatgactttaggaacattaccttttttttttttttggctttaagttcttcatttataaaatgggaatattgctagcctctatccagtgatatttctaaagtttaagtgagttcaattgggat

SEQ ID NO: 52586 - DNA, 201 bp, Homo sapiens
aggcatttagtaaatgtttattgaacattgtggttactgaaggtccaaaacatgtttgacactggagactcacaggttaattaggcaggattcttgtgttmggccatttagcagaaggaaaacaacctatgatctagaaaatgcaggacggcatattgttgcaataataattattcagtgaaggccacaagatggagaggt

SEQ ID NO: 52587 - DNA, 201 bp, Homo sapiens
agcctcccgagtagctgggataataggcacccacaaccatgcctggctaatttttctatttttagtagagacagggtttcaccatgttggccaggctggtstcgaactccttacctcagatgatccacctgcctcagcctcccaaactgctgggattacaggcatgagccactgtgcctggcccacttttagattttactg

SEQ ID NO: 52588 - DNA, 201 bp, Homo sapiens
cctgcctcagcctcccaaactgctgggattacaggcatgagccactgtgcctggcccacttttagattttactggtaaaacaaaaacctcaaaatactccrcagcactttgaatgagtaattgctcaattaattttattgaacacatgaatgactatttcttagtaatttaatttttttttcttgaacttaagagataata

SEQ ID NO: 52589 - DNA, 201 bp, Homo sapiens
attccttttgcttaaatatgaaatttgaaagatgtcctttgaagttttaatgtatatattattattagcatattgattccacctcaagagattacccataraatttatacattttttatctttgggttgaggtacaatgaatgtctaataatagatagttataggaatgatattgagaaaatcattactaatgatgtcatc

SEQ ID NO: 52590 - DNA, 201 bp, Homo sapiens
tttattttttacttgaaaaagtacatatttcacatggtaaaaaacttgtttataaacatgaattcaacatatatttacatttgtatatgtgtataggtgtmcacacacacactcacacacactacaaatgtgtacttagatcaccgtatggaactgaagattgacaaatagcacataagggttgggcatggtggctcacgc

SEQ ID NO: 52591 - DNA, 201 bp, Homo sapiens
gatctgtttcaggttcaaagggttatttataactgctctcgatatcataccaatttctatttccagctgatgaaaataaaaactgattttgtttggcaaaytcatctttagatgtagtttataatgttaagagagattattagcttagataaattaatattcattatctttaacttcatgaataatatttatggaaaggat

SEQ ID NO: 52592 - DNA, 201 bp, Homo sapiens
gaaagtgaatttgacaatttcattgtggtctttttgtctgagatttaacagggcaggatgattgtttattcttatacaaaagagaatgtaactaaattcayataaatttgactctgaggattagtaattttctccttattagaagattattattaagcatatctacacttaaaactgcatgtgcttgtatgaaaataactt

SEQ ID NO: 52593 - DNA, 201 bp, Homo sapiens
gacactttattcttaactgaaaagccatataaccatgttctatttctaactttacattcatttaatcaaaattatcaatattatggttacaaattaaaccrtagtgttttaaatatataaatttacttagaagccttaaaaataaagcaacattaatcattactattttcaactccgtattttcaaaactaaactaggtct

SEQ ID NO: 52594 - DNA, 201 bp, Homo sapiens
aatcattactattttcaactccgtattttcaaaactaaactaggtctgtgactagttataggattctctaattcatacctactctgtttttgttttggggttttttttttgttattatttagggacctcctggcttacctggtctcaaaggtgaccctggctccaagggtgaaaaggtgagaataaaagaatgtgttatta

SEQ ID NO: 52595 - DNA, 201 bp, Homo sapiens
gttaaaggtaaaacacaggtaattattagcgttcctatacaaactggtatctaacatcttcatgtttataatatgtttatctgaaaaatatacatttagtytagtgatttataaggagatttacttttaactggtgttatttaagcaaaagatgtagatgatttagataattcaatgttatatactcctaaaaaccatgta

SEQ ID NO: 52596 - DNA, 201 bp, Homo sapiens
tcattgctcaaaaattatttgctttactgtaagattcctttgtaaagtttttgttgccctggtgttttgggaaaaaaatgcatattttatttatcaatttmaatgtaatgaacaaagtttcaagaaataattacttagaatgaaaaattgactcctactgcattttgagttaaaatggagcaaattttatagaggaatatt

SEQ ID NO: 52597 - DNA, 201 bp, Homo sapiens
agatggtacctgccttgcttgatgaagctgactgacattttgaggatttcctttgcaaagggtttctgagtgttccaccaatgtcccctataacccttagwatgcctatacccggttgtctttccccttttcctttagagctgataaagacaacaaaaaggaaatgactcaatcttcactacatagaatgtacaggatcta

SEQ ID NO: 52598 - DNA, 201 bp, Homo sapiens
caagaataaatctataattaaacacatgtctttttccctgatctccactgtgagattccttgagtaatattttgtcccctgtagtcatagcacatttctakctggctctttccaacaccttttttctttcattatttttgttgatttctacaaacatattaattaaaaaaaactaatagctttatcgaagtgtaatttaaa

SEQ ID NO: 52599 - DNA, 201 bp, Homo sapiens
acagtaaagctcccctagcctccagagaaatgtggaaaaacagaaaatgttgtttcttacacagataactcgagttccctattgtgaagacttatataccytttgctgttcttcacaaagcagaacaataaatgcagatctataagattctaaatattctaaccagcagggagtaattcaggttgcttccaatcagtgcct

SEQ ID NO: 52600 - DNA, 201 bp, Homo sapiens
tttcctccaaataatatatttaaaagttatttaaatggttattacttatgaattgaagccagtgactcaggataagaatttcattcatagtatatgtacamgttaaagctttttaaaattatttttatctttttaatattttttttttctctataagggaccacaaggaaaaccaggacttgctggacttcctggtgctga

SEQ ID NO: 52601 - DNA, 201 bp, Homo sapiens
aaacattttataagtggacattttgtctttattggtattcatgtaataaatctcattcttcctagtaaatggtgtggacaatagaggcacagaaactcctkaaggcaaaacaagtagctttatgtgtgactaatggttttgggagaaaagttaagtttctgagtaaagagtgggtagtaagggcaggagaaaaaacaactt

SEQ ID NO: 52602 - DNA, 201 bp, Homo sapiens
atgaggttagtaataaaaataaattgagccagtaattaaacattgatctctctaaaatacctttcatcatatcacttccatattgcaaaatctttaatgarctcacggtggcttttgtggaaactcatttggcactccaagccagaacctccccagaatctcatattttttttcatttcctccttaaccattagctccagg

SEQ ID NO: 52603 - DNA, 201 bp, Homo sapiens
cagatttctttagtcacctgagttatgctgatttaatataaattacttagaagtagaaaatatttaagtcaaaatcaccaaaatatatccatatttaatayaatcatcagcaaaataagtttctgaacaatttagcttaaaataattaaatgtctgaaaacgatttaagatacttattttacataactcttttgtattgaa

SEQ ID NO: 52604 - DNA, 201 bp, Homo sapiens
aaaggatttttgtttggtatggatatggttacccactttctaaccaatataaatcacttctgtgataaaatttttatgcatcatgatgaatttatgcagcwtgtgtaaaaatatctgaaaacatgagtaaaaattgtaattcatcctcaatatttgtttatgtctttcctaagtctattaatctgaaaatatatcattatt

SEQ ID NO: 52605 - DNA, 201 bp, Homo sapiens
gtattttaggagaaggaatcatgaaacgaaggcataatcggtaattctttgtaattggaacaagaaatatcctagtatatctggaagttttaacatggaagacatttgatgcataacggcttttgatttcctttctattatcctaagggtttaaattaccacttgattttttaaaattaatacacctttcacactattacc

SEQ ID NO: 52606 - DNA, 201 bp, Homo sapiens
aatttcaatttatgttttttagtttaaagcttccactacttgtagacttataaaatatagaattacatttatgttttttaattagtttcattgaaattagwatatacacaagaaaatcaaaaggatagaccaggaaggaaatggaattcatataacatttttattcatagtattggttttctttttaaggaagaaggaaat

SEQ ID NO: 52607 - DNA, 201 bp, Homo sapiens
tttggtcatctcatatatataaatcacgttcatatagttattttgggtataaaaaagatatcttagactacttttaattttatatcagtaattttagaaaytagactatgttctctctttttaaaaaatattcccatggctaggaatacgtgcatatttttcatgtgtattatatatggagtaaatggtaataatataaac

SEQ ID NO: 52608 - DNA, 201 bp, Homo sapiens
atactgaaggcatgcaagcagatgcagatgataatattcttgattactcggatggaatggaagaaatatttggttccctcaattccctgaaacaagacatygagcatatgaaatttccaatgggtactcagaccaatccagcccgaacttgtaaagacctgcaactcagccatcctgacttcccagatggtatgtaaataa

SEQ ID NO: 52609 - DNA, 201 bp, Homo sapiens
gaatattaatctagcacttttcatttggaaaaaaaataaaatataaaccagactggcttgcagaattgagtgggcttcatttaatggtttatgttagcacyatacattgttaataaaacccaccattttacagtatggttagggaatgtgcatttccaaagggctggccatgtctccccagccaagcctgtcatcactgct

SEQ ID NO: 52610 - DNA, 201 bp, Homo sapiens
ttagatataattattcctcaccatgaatttgctatgtttccttctagaggcattcattgagacccagattatgcctagctgggcagtggccagaggaattyagaccacaaagtacagagagcataaggtggtaataactctattcacccaagatgctttgcctgaaaggaccctttcacagcagtgagaaggtctgagttg

SEQ ID NO: 52611 - DNA, 201 bp, Homo sapiens; identical to SEQ ID NO: 15104

SEQ ID NO: 52612 - DNA, 201 bp, Homo sapiens
aataattagagtacttcatttgcataaacatgaataagcaccaaattgatgcacagagttaacaaatacttctcttctttattttttacccagatgtattmtttctgcacctgcttgctcactaaaattctatggatttccatgacacagcacagctgaatctcaaattttagtgccactaaagtgttcttctgcccaatt

SEQ ID NO: 52613 - DNA, 201 bp, Homo sapiens
agcggacgactggagggcttcaagtgcatggtttgacctttgacttggggttttctacattggcatgcttctgaggtttgcatctcttctcgcctgattcytcccttggggtgggctgcccacaagtgcagtgggctgccagcacttgggaggggccacacacacattttgtttcctggagctgtgcgcatgctcacttga

SEQ ID NO: 52614 - DNA, 201 bp, Homo sapiens
tatataacattagtcttgttgcaatgatttattgatttgtgattttgtcccacctttcttttaaatgaaacattttagataaattttaaatttcattttarctaattgtcattttacattgtgcacacttggatctaacatactaaatggtagttttcatatattttggacaaatgaatattaatatattattctaaaaat

SEQ ID NO: 52615 - DNA, 201 bp, Homo sapiens
ctgaaaacacacttttcattccattcagttgtcctagaaaacatttttcatcttgcttagtctcctatgggagagcacttgtctctgaggatatcatcagrttagacaaaaggcaccaaggcacacaccttttcctcttctctttgcatcatctccttttggctctaatgctgactcaattgttgtgggagctagtctcta

SEQ ID NO: 52616 - DNA, 201 bp, Homo sapiens
taaaagagtttttagattttcattcttcttaggtaatttaaaagctaaaagatgttataaggggtttgtttcttgcgtggattatgtaattcttaaccagkgtcataattttgattcactacaaaatcaccgcctaaaaccaatctgactattctattggcaaagagattgaaattatgtttcaggaatcaaccagagttt

SEQ ID NO: 52617 - DNA, 201 bp, Homo sapiens
tataatattgagtcattctagcatatgttctttaacattatgagatagtacattagttgagttccctttgatttttgataaattattttaaaataacctcrtaaaaattttagcactgttctatcctctctttttaaattacaatttatagaaagatgatgagctattttaatccattctagtcactttgtaaacaaaatt

SEQ ID NO: 52618 - DNA, 201 bp, Homo sapiens
gccagctgttacacagaaaggtgggtgaaggttatgttaacagtggcaaatccatatggtatactaagggttataggagtgaaagtttattaaaaagtttyagaacagaaatgaaagaaagtaaagtacacttggaagagggtcaagcggacgactggagggcttcaagtgcatggtttgacctttgacttggggttttct

SEQ ID NO: 52619 - DNA, 201 bp, Homo sapiens
gtatatttttataaacattcttataattattttaagctgtatattagattattgtttaggaacataaagtttagtgacgtatataacctcagtattgtacsatttatgtttgtatgtattgttgagaactgcttggctcatgtaatattgtttcattgtcaaagaaacccatttgactcatttttttatcagactttttca

SEQ ID NO: 52620 - DNA, 201 bp, Homo sapiens
tgagaaatgtatttgcataacataattggtaaaaaattaatattttttcggttttttattttcttcaatttgtgactaaaatagaaccacatggttgttcrtgttaagttatccttaaaatacagcaaagcaaacatctcttttcaaatttatgggttggctttctagctaagaaaattgtataaagagtcacctttcttt

SEQ ID NO: 52621 - DNA, 201 bp, Homo sapiens
atatgattcacatgtcatctagtagttgcaaaaattaaagttaaaatgattttgcaatattgtgttttggttgccaattattatattgaatgagtgcaggyattatgttctttaagcaggaacctcacaattacggtgtccttaatatccacatttataagctgagaaagctgagccctagaggattcctgtaatttcatc

SEQ ID NO: 52622 - DNA, 201 bp, Homo sapiens
aagaaagtaacaaataactgcctttacattgacctaatctataatctaggtgaacatcttaaccttttttttttcaaatttaagtgtatatgttacagctkaactcagatatttttattaccaaaaataagacaatttataaagatgatatgagacagttgctaataaattacaactgagactattttcctgctataattt

SEQ ID NO: 52623 - DNA, 201 bp, Homo sapiens
atctgtgctatattattgtatagataaagggtgagaaatcatctaacttattcacctacctcaatatctccaccaagttcatcatagaagaatctatgacrtttatatatttataaacttatcctatagcataaattttgtagctaatgaaaagctaaaccaactctaatttcttataacaaaaacataaccagtaataat

SEQ ID NO: 52624 - DNA, 201 bp, Homo sapiens; identical to SEQ ID NO: 15103

SEQ ID NO: 52625 - DNA, 201 bp, Homo sapiens
tagcagaagaaatttttttgacatttgaccttgtgtgttatagttgtgaacctgtatttaactttttctgtaagagaatttgactatgtatatcttaactrtaatggtaaagatgtattatttatactggaggggctgggtgtggtgtcttacccctgtaatcccagaactttgggcagccatggcgggcagatcacctga

SEQ ID NO: 52626 - DNA, 201 bp, Homo sapiens
aaagtgttcttctgcccaattaccacatcagagacctcacagctgcatattacacccaaaatatctaattttataaagaattaaacttttatatacaagtmttttctgcacttacatattttttaaatatttagtttctttaaacaaattctttaatttttacctaacattattaccagtacactgagttctgtcttcaaa

SEQ ID NO: 52627 - DNA, 201 bp, Homo sapiens
aatcacaactttgagataggagtttctggcatcagtattttataaaaagttttccaagttaattttactgcactgtcaggagagaaaatctttgttttacratgaaattaaataattattcttatttctaattctagcatatagaacctaagagttgacatagaaaaagctaaaaatacctatcaacaaaaaatacttcta

SEQ ID NO: 52628 - DNA, 201 bp, Homo sapiens
aacaaattgaaaaaatatcatatttgctgaagttagaacattaaaactatgggctgtttactgtatacattccctttgatgaactgtccataaaaggaacaaacaaagaagtcctgctgccttaaataaacgtgtcaattgtattgtgactatattattctaattagtttaaaacgcgattaaatttgcccaccaggaaat

SEQ ID NO: 52629 - DNA, 201 bp, Homo sapiens
ttttaaaatattaaaagttcataaccagtggacttatataattcaaatatttcaaatgaagtggcagcatgaaaaacagttggaagtataaaggtagaaakaattcgattcctttccttctcagtataaaggtcaaagctgacacccctataaaaaaaaaggttaacaagagaaaaatattaaaaatgtatttgattatag

SEQ ID NO: 52630 - DNA, 201 bp, Homo sapiens
actcagacacctcctattgggctctaccgccaagatttggaataaaatttcaacatgaggtttggaggggagaaatatccatattatagcaataatcaatrattattttttcatccaaaattaaagattacatgatattgtgaaattgtaagcaattggtaaatttttctttagatataaatgtcaaatacaattagaaaa

SEQ ID NO: 52631 - DNA, 201 bp, Homo sapiens
gactaacatatataacatatctacacaaatctgtgctatattattgtatagataaagggtgagaaatcatctaacttattcacctacctcaatatctccaycaagttcatcatagaagaatctatgacgtttatatatttataaacttatcctatagcataaattttgtagctaatgaaaagctaaaccaactctaatttc

SEQ ID NO: 52632 - DNA, 201 bp, Homo sapiens
tgaaaatgaaatagctgagaaaatccctttaaattggctgattctctctctagggaattcctggtcctgctggtcccttaggtccacctggtcctccaggyttaccagtaagtacaagacaaaataaccttataaggtagggttaagttacaaatataacagagacacaaatgctccagatttttatctgtgcttttgcat

SEQ ID NO: 52633 - DNA, 201 bp, Homo sapiens
taatatatggagacaacattttatatctagcctatttctacttgtaattaggtagagcttattcatcgtgactggggtataggagggaatctttccccttwatgactttctaagttaatttaatgggcatttgaatgtaaacatacttagtgcatgttttcctaacattaaggtaaatgtttctgttgaaagagatacttt

SEQ ID NO: 52634 - DNA, 201 bp, Homo sapiens
agcttattcatcgtgactggggtataggagggaatctttccccttaatgactttctaagttaatttaatgggcatttgaatgtaaacatacttagtgcatrttttcctaacattaaggtaaatgtttctgttgaaagagatactttttctttgcaaataattttgcattattttttcatgccgctcttatctaaaatataa

SEQ ID NO: 52635 - DNA, 201 bp, Homo sapiens
tttaatttggggatactaaattagatgcactctatcctaaaagggtgtgaaaacctggacaaaaaataaggaatgtaattttaaatttatggtgtttttgraaacttaattatgtttaagttgcagtgtatgctatttaagaaaatggtgttaaagtgaaatatttatttaaactgtgttaaaatatacatgcatgtttaa

SEQ ID NO: 52636 - DNA, 201 bp, Homo sapiens
aaacatacttagtgcatgttttcctaacattaaggtaaatgtttctgttgaaagagatactttttctttgcaaataattttgcattattttttcatgccgytcttatctaaaatataagaaaagttagtcacatctcacagttatccctcctgaaactagagatttttttaaaatatcagctggcagtttttcataatggt

SEQ ID NO: 52637 - DNA, 201 bp, Homo sapiens
aagaaaaagagtctgccttcttgaatttaaaatcaagttagccaattacctaatagttctggctcataatgacatatgcttctttaataagaagcaatatrcagtgaaactgcattgtttgatattaagaactaatcgaaaactcttaagcttttaaagaaacaacagaaagaatacgtttgtaaattgggtcattacaat

SEQ ID NO: 52638 - DNA, 201 bp, Homo sapiens
agggagaaaaaggtccccaagggcctgcagggagagatggagttcaaggtcctgttggtctcccagggccagctggtcctgccggctcccctggggaagayggagacaaggttggtattcattattcgtgttagtagatcctgtgaaaaagcttaatttttgtcaagaattctagataattctaatctttatgattaggcg

SEQ ID NO: 52639 - DNA, 201 bp, Homo sapiens
ttagccaattacctaatagttctggctcataatgacatatgcttctttaataagaagcaatatgcagtgaaactgcattgtttgatattaagaactaatcraaaactcttaagcttttaaagaaacaacagaaagaatacgtttgtaaattgggtcattacaatgcctctttaaagtgggcatgtatggctacggactaga

SEQ ID NO: 52640 - DNA, 201 bp, Homo sapiens
ctggaataagggttttaatttctttatggccagctgttacacagaaaggtgggtgaaggttatgttaacagtggcaaatccatatggtatactaagggttrtaggagtgaaagtttattaaaaagttttagaacagaaatgaaagaaagtaaagtacacttggaagagggtcaagcggacgactggagggcttcaagtgca

SEQ ID NO: 52641 - DNA, 201 bp, Homo sapiens
gtgatttataaggagatttacttttaactggtgttatttaagcaaaagatgtagatgatttagataattcaatgttatatactcctaaaaaccatgtaagmtatatcaaaggtttacagtggttatctctacttggtaaaatcttagatgattttttttatttccttgtatttttttcctgggaattctaatttgtttcag

SEQ ID NO: 52642 - DNA, 201 bp, Homo sapiens
tatacaaactggtatctaacatcttcatgtttataatatgtttatctgaaaaatatacatttagtttagtgatttataaggagatttacttttaactggtrttatttaagcaaaagatgtagatgatttagataattcaatgttatatactcctaaaaaccatgtaagatatatcaaaggtttacagtggttatctctact

SEQ ID NO: 52643 - DNA, 201 bp, Homo sapiens
tgtatattgtaatatgattactaacttcatgttaatgtgaatacttacattaatatgattattattttagattaatatgaatatatggatatgtgtaaatrgcataactgatgtatatttgatctatcagtttggcaatgatttggtgaacagaatattaagaactgggatagcttggggcaaaaatgtatctttaattga

SEQ ID NO: 52644 - DNA, 201 bp, Homo sapiens
ctacgtctctgaattcgtcatacagtttcatccctcaaaagttttgtttaagatgctttttatgtttaatgctattttacctccatccccttcattaggcyaactcctatttgcttttaacaaatcatcaagatttttccaagaaccgtttcatgaaaatgttcattctcattgagatacctgtatgttgcaagttaatgg

SEQ ID NO: 52645 - DNA, 201 bp, Homo sapiens
ttgtctgttaaatgggattttattaaattatgacaagatcatttttggatgattacagctaacacaaatgtactttgcttgtaataactatcacagaatgratactgtgtatacacacatgtgtatattgtaatatgattactaacttcatgttaatgtgaatacttacattaatatgattattattttagattaatatga

SEQ ID NO: 52646 - DNA, 201 bp, Homo sapiens
attaggacttcaacattacaaatttttgtgggatacaattcaacccatgacaatatgataactatttgatatagctctgctcgtaatgtaaattcaagtckggttgcattgattttaagtttgttaatttataatgatttaagtcacacatatttgaagcaaactaatgtgtacatattttttaaagtttaatgttttata

SEQ ID NO: 52647 - DNA, 201 bp, Homo sapiens
atttaagtaatcaaatctacatgccaagacttaaattttaattgatttcactcttcaaatataaataccttaattgtatattatagtcttgtttttattawtttttcaagagaatcatatactattttgtcacattaatgaaaccaacttattttatgccgtaaagatacatttttacttgactctaggaataatgacaaa

SEQ ID NO: 52648 - DNA, 201 bp, Homo sapiens
caaaagtgctgattttataggaaacattatatcatttaagtaatcaaatctacatgccaagacttaaattttaattgatttcactcttcaaatataaatamcttaattgtatattatagtcttgtttttattattttttcaagagaatcatatactattttgtcacattaatgaaaccaacttattttatgccgtaaagat

SEQ ID NO: 52649 - DNA, 201 bp, Homo sapiens
tctggaagctgccaatgatttctctgaacttataagatagacaaaaagcacattctgccaaaagtgctgattttataggaaacattatatcatttaagtawtcaaatctacatgccaagacttaaattttaattgatttcactcttcaaatataaataccttaattgtatattatagtcttgtttttattattttttcaag

SEQ ID NO: 52650 - DNA, 201 bp, Homo sapiens
atgtgaaaattccaaattttcatatattactacattctatctgtatagaaccctcagaattctgatattcactcagaagacagtatatagacaattttttsatgggccctttcctaatcatatttatctcattaaagacatctgatactttgaaaattttcaaatgcgaatcttacaacttgatgtctgatagcatagaaa

SEQ ID NO: 52651 - DNA, 201 bp, Homo sapiens
ccattatatgggccagcaaatctcaaatatttttgccttaggacccttgcatactcggaaaggtttttaggagcccaaaaagcttttgtctatgtgggttrctatcatatgaatgaaagctgatatatttaaaatatttatgtattgatttatttataattaagaataataagcccaaagcacttttaataaaaactagct

SEQ ID NO: 52652 - DNA, 201 bp, Homo sapiens
ttatttttaaatcttcaaatgccttttaaagactgcagagtctctgaagagtagaaattatttcatattaaatgagatgcctattaaaataatgagttttstgttatttattcaacttatattataggagatcattattggtttagagattcctcaaatggaacacttaaaatgatatttttagaaagcattttgttttgt

SEQ ID NO: 52653 - DNA, 201 bp, Homo sapiens
ataatttcagcatagcagagtgagtatatgaattgatttggggatgacaaaaatccgattttgaatcccagcatatagcttaatattcaaccttctctatwtaattactctatatcagtttcaaatgggaaatataacagaatcttcctcataaggatttatagaaaaaaaatgagctgatgtatgtacagtctttaagat

SEQ ID NO: 52654 - DNA, 201 bp, Homo sapiens
acccaaaacttatatataaacctataactatcacataaaaatattatatgttaaaactattaaactgttgtgtgaagctattttgacataataatgttgaygctattgatattataaactttcaaaatattttcagtcatatttactaattttaaaatcatgataatataatgcagcaaatttttattctttattataaca

SEQ ID NO: 52655 - DNA, 201 bp, Homo sapiens
ttcccagatgtatgtagaggggagaaaatatgcaaatagtgaaaaatgtgctggaattcagtgctatatcttctcaaggttccattatagcaaccatatgkagaaagcatatggttatactaaaataactattcagaaaataaacagactgaataacaaaatatctatttttatgtttttaaatgtgaaaataaaaatttt

SEQ ID NO: 52656 - DNA, 201 bp, Homo sapiens
tgtatgcatgcacacatacatacactgagtatatttaatcagtaaacatttaaaataaattagtgattatgattaacattaacatgctaaaattagtcattatctatgttaaaaagtatctctcttgaagatagtatctattgtctattaaaatatagtatgtagttaagtattctacaaaataaatactatttatgtatc

SEQ ID NO: 52657 - DNA, 201 bp, Homo sapiens
aaattatcaatattatggttacaaattaaaccatagtgttttaaatatataaatttacttagaagccttaaaaataaagcaacattaatcattactatttkcaactccgtattttcaaaactaaactaggtctgtgactagttataggattctctaattcatacctactctgtttttgttttggggttttttttttgttat

SEQ ID NO: 52658 - DNA, 201 bp, Homo sapiens
gtatgcatgcacacatacatacactgagtatatttaatcagtaaacatttaaaataaattagtgattatgattaacattaacatgctaaaattagtcattatctatgttaaaaagtatctctcttgaagatagtatctattgtctattaaaatatagtatgtagttaagtattctacaaaataaatactatttatgtatct

SEQ ID NO: 52659 - DNA, 201 bp, Homo sapiens
taataccaatactacattacctctgcagttatatcattctataattttatatatttgtgaagttttctatttctgtgattaagtaaagtatgatgattgtraggccattatttataactctgctatagcacatgaaagagtaacataatgaaatagtctttcttgtatgattatgagaaattttgtatacatatatttacc

SEQ ID NO: 52660 - DNA, 201 bp, Homo sapiens
cagtgaaggagctagtttagaattggaagaatctgacttaaaaaaaagaaaacatgaattgttgaatattggttcaaataaaaggtacttagagtagagayaaggccatagcagaataaatggagaaaagggtcttattttcaatatggaatagaactggtaggtcttggggactgttaggatatgagaggtaatgggagg

SEQ ID NO: 52661 - DNA, 201 bp, Homo sapiens
tatgcatgcacacatacatacactgagtatatttaatcagtaaacatttaaaataaattagtgattatgattaacattaacatgctaaaattagtcattatctatgttaaaaagtatctctcttgaagatagtatctattgtctattaaaatatagtatgtagttaagtattctacaaaataaatactatttatgtatctg

SEQ ID NO: 52662 - DNA, 201 bp, Homo sapiens
acggagacaaggttggtattcattattcgtgttagtagatcctgtgaaaaagcttaatttttgtcaagaattctagataattctaatctttatgattaggygccaggtgaaaggttacctttttcaaagtttcacacacattttcatatgctcaaaagttttatttaagaggttcagaattagtatctgttccataaaata

SEQ ID NO: 52663 - DNA, 201 bp, Homo sapiens
atgcatgcacacatacatacactgagtatatttaatcagtaaacatttaaaataaattagtgattatgattaacattaacatgctaaaattagtcattatctatgttaaaaagtatctctcttgaagatagtatctattgtctattaaaatatagtatgtagttaagtattctacaaaataaatactatttatgtatctgt

SEQ ID NO: 52664 - DNA, 201 bp, Homo sapiens
agaagcagggaacccagggcctcctggggaagcaggtgtaggcgtaagtactgtgttattgttaacatagtgtattattggtttgggaatttcttttacarcattacaaacatgtaacaactcttagctgtggttcgaattttactttcccttcccaactcattaaggaaaatcacaaatacaaagccttgtttaataact

SEQ ID NO: 52665 - DNA, 201 bp, Homo sapiens
ctataccagcatcaaaaactacttaattgaattagtaagtagtgcttatattaattttaaactatatctattaatatgtcattatatgataacgcatatamataattcatcttcagaagttctacctatataaattaataatgcaatgttggttgccaatgaataaagaacataaagtgcaatatggagcatcagccatac

SEQ ID NO: 52666 - DNA, 201 bp, Homo sapiens
ataacaaaatgttaaataaaatatctgatagcattattttttaaacaataaaaacttaaaagataggatgggatactgaattagagtttatttctttaatsctacatttaagttatctgtagacaagggtgatatgggtagcattccacaatgattaaaaaggtttaaataaaaaagcatttgcttttcaccagattaaat

SEQ ID NO: 52667 - DNA, 201 bp, Homo sapiens
tagttgtacaatattgtgagtgtaattaatgctactgaattgtacacttaaaaaatctaaaatggcaaatttaatgttatatgtattgatcacaattaaarataataatagtacaatataccaaaaaccactgtttgcttttaagtgggtgttttgtatggtatgtgaattataacccgataaagctgtttatacaaatgg

SEQ ID NO: 52668 - DNA, 201 bp, Homo sapiens
cattctaacatatacaaatagaggttgttatttaaatacaaaccaaacagtgtattaaaattttgtctattttttttcctgtggttatcaaagatctattractgttcaaaagtttattgagttttttcaaaaatgttactaaaaatatcataaacttttaaattcatgtaacataaaaatgtttgagtaactggatatat

SEQ ID NO: 52669 - DNA, 201 bp, Homo sapiens
gtgtgtttttgtgttttgttttgtttactttctctagcgacagggtgttcctctgtcacccatgcaggagtgcagtggtgtgatcttagctcaccgaagcytcaaactcatgggttcaagtgaccctcctcccttagcctctcaagtagctgggacagcaggtgcacaccaccaattattctagtttttgctttttttttt

SEQ ID NO: 52670 - DNA, 201 bp, Homo sapiens
tgacatatctaggttatcgtggccctaatttcataagtcacatataaatcatttttttagcatcagtttcacttccaacagcatctgttgcctgcgtagtktcacttgtataatttcacaaggactgtattttgtgttgtcttcaaaattgtagtacaacaatttggcttgttagtgtggtgtgtttttgtgttttgtttt

SEQ ID NO: 52671 - DNA, 201 bp, Homo sapiens
ccgaaagagaaaaatagaaaatatgtatagttagaataacatttttatatgcagagttgatgtttttgatctgtttcaggttcaaagggttatttataacygctctcgatatcataccaatttctatttccagctgatgaaaataaaaactgattttgtttggcaaactcatctttagatgtagtttataatgttaagaga

SEQ ID NO: 52672 - DNA, 201 bp, Homo sapiens
caaatcaagaatcattaaatgaatgaaataatgataaatatgttgaaaaccaatcaattttatattcttagtggaaagtaactaaatttgacctcattcaygcatgtgtgtcatcaataaaccttatgcaagttgttgactattaaagcaaatggaagagatcaacaagtacaattatacttagaaaagttagagtgttaa

SEQ ID NO: 52673 - DNA, 201 bp, Homo sapiens
aacaattagcactagtagcaccaaatcaagaatcattaaatgaatgaaataatgataaatatgttgaaaaccaatcaattttatattcttagtggaaagtwactaaatttgacctcattcatgcatgtgtgtcatcaataaaccttatgcaagttgttgactattaaagcaaatggaagagatcaacaagtacaattatac

SEQ ID NO: 52674 - DNA, 201 bp, Homo sapiens
ttattcctcaccatgaatttgctatgtttccttctagaggcattcattgagacccagattatgcctagctgggcagtggccagaggaattcagaccacaamgtacagagagcataaggtggtaataactctattcacccaagatgctttgcctgaaaggaccctttcacagcagtgagaaggtctgagttgtgaccagaaa

SEQ ID NO: 52675 - DNA, 201 bp, Homo sapiens
ctttaggaacattaccttttttttttttttggctttaagttcttcatttataaaatgggaatattgctagcctctatccagtgatatttctaaagtttaartgagttcaattgggatatggatatcttctaccccatggggttcttaagttaattaaatgaattgcttgtaaatcacttttatatcaacaattagcactag

SEQ ID NO: 52676 - DNA, 201 bp, Homo sapiens
ccaccacgctacaatacaatggcccatctgtgaggtcagagagactaactttacttttaaacagagactaatttctagccactcatgtattagaaaaactrtaaaatgaatgtcagactgcttagtcatttccttctcaaaataattgacctaaagtttagaaaagggcaagaaaggcaaacctttaggcacagtaagaga

SEQ ID NO: 52677 - DNA, 201 bp, Homo sapiens
tcataactgcccagagtcagagcctggaaggaaaaaataccttgccttaatgtcactctaaaatttgccagagattttttcttgttatttcagattttccrgtaaatattttgacctttctgcagatgaaataaaaagcaccatgctggagatttccttcagctaatattaaaaataaaaccttctgacataccacctgat

SEQ ID NO: 52678 - DNA, 201 bp, Homo sapiens
tttaacaaagatgccacagcatctttggtatgcaaagcatacctaccaaatatttcataagttttaaagagattatttaaactttcactgaagaatttaamgatcacttatttagtaactagataaaagttatcaaattttggtagatttcaagcaggagatgatcagttctgcccattatctcatcagcttaggaaaagg

SEQ ID NO: 52679 - DNA, 201 bp, Homo sapiens
tgagcatctgtgttaaaaagatgccattttgaaaataacatttttattttaaaaaaattttgaatgaaggtgtctatgttagcattatttcataagttatmacgtggataattttgtgggaattctgtaaatataatgtaaaaaagatattcttcatatatttaagtatatcatttatttaataagttcatggtgaaacac

SEQ ID NO: 52680 - DNA, 201 bp, Homo sapiens
gctagagaggtcagaggaggtaagaaaaaatggatttggggaggtgggagattgccgtcggtcctactgcttctgcgcccctccccccactttacccttcytccccgctcttcaagaaaaaaaaaaaaaagcaattcccttaaatacaatccagattgtagctgctaccaggttggaattggaaactggagaaagagatga

SEQ ID NO: 52681 - DNA, 201 bp, Homo sapiens
atctgtatagaaccctcagaattctgatattcactcagaagacagtatatagacaattttttcatgggccctttcctaatcatatttatctcattaaagamatctgatactttgaaaattttcaaatgcgaatcttacaacttgatgtctgatagcatagaaatctatcttgaagattcacaacattacaaatgagagtgt

SEQ ID NO: 52682 - DNA, 201 bp, Homo sapiens
catttcaaactataatccaaatgtttgtagggcttttttttttttttgagacaagcactgtacttcagtatgaggcaaacatactttatgtatgtcttcartttgtcaaatgaatatgaaaagacacatattcaaggtcaatatttaataatattaataactttcaaagcctcatcaatacaattacatccatgacattct

SEQ ID NO: 52683 - DNA, 201 bp, Homo sapiens
aattattgacattagcctttgtaagagccaggattcaggcctgagttttgttggtaattagtgatatcataactagagaagggaaaagggaatgccttgcytccccatcctctttcagttatcccagccaaggacaacaactccagcatgctcattccattttctattagccaaaattagctatttagaataactaagggg

SEQ ID NO: 52684 - DNA, 201 bp, Homo sapiens
ctatgtttcatacataattttgtaatatccttcattgataatttggaaattattgatttcctgggtaaggtcctcaaagtgttgacacaattctttatgcratattaatatcataggaaaatactttcagattgggaagatataaagcctgcaatggcagatgagacatttccaaaattctaatttttgctttaaagtttg

SEQ ID NO: 52685 - DNA, 201 bp, Homo sapiens
ttccatttattaaaatttagcacaattcattgtacccatgagttgtatgggtacaatgagtcaaggaaattttgttttcaccatttataaactgctaagcrttgtagaaaatacttggtagtgaattagggcacacagaccttgagtccatggtttttaacttaaaaatatacaagtcatacagcaataaaattatattgc

SEQ ID NO: 52686 - DNA, 201 bp, Homo sapiens
agaattacagagttccatgttttaatttagtatatataggaattatcttcttattctatagaatattattaggcaaccattctaacatatacaaatagagkttgttatttaaatacaaaccaaacagtgtattaaaattttgtctattttttttcctgtggttatcaaagatctattgactgttcaaaagtttattgagtt

SEQ ID NO: 52687 - DNA, 201 bp, Homo sapiens
atattctcatcattaaataatattcacattttacttacagtagtttagaggtaatcacaattttgtttgtagaaagatgtgtagaaattaatctgtcttgwcgatgtttattatattctttagggtgatccaggtcctcaaggtatctcagggaaagatggaccagcaggattacgtggtttcccaggggaaagaggtctt

SEQ ID NO: 52688 - DNA, 201 bp, Homo sapiens
tatgcacttttttgaaagaattatcaaaaaaatttttgaattcccattaaaaatcaatcttacatggagtgtttcttatttgatgtaaattaataaacagwatttataatgaaaagtgtaatcatattatactaataaggttgtcacaatatatcaaattcagttatctatccattgtgttaaaaaattaaaatcactaat

SEQ ID NO: 52689 - DNA, 201 bp, Homo sapiens
ttgttaattgaataatatagggaaattgtccactttaatacttagagaattccaaattcagttatgaattaaaaaacataagtatacctaataatagtctraaataccattgttacacaagggctaatttatattaacactattcttgctctttcctgatattcacagttttggtttgagaagcaggcttcagaaactaaa

SEQ ID NO: 52690 - DNA, 201 bp, Homo sapiens
tgtttatgcttctatttttctctctagtgggcggcatcttaactgaatgctgatgaggtgatttgtctatcactttcatttactttacaaatgctcctcaraatatgaaacatccagtgaaaataactgataaaacatttattttggtgttctcatctgtgtgagggattaggggaatactttctattctcattgctccag

SEQ ID NO: 52691 - DNA, 201 bp, Homo sapiens
aagccttctatctttacaatcacatgtatattttatccctaggagttgtggaagttaacatgcagaaagtatatgagaggagccagatagctggtacagartatatgtccaatatttcaaaattgtgcggtatagcagtctttgctgttttcctgtgactcctattatgtgaccatccccccatgattctgactttatttt

SEQ ID NO: 52692 - DNA, 201 bp, Homo sapiens
tgcaaagtttgtatgtgtcccaattatgtagcttatgcactatatccttactatatgactctaatctgcaaaaagaacaaatataatatttaattctaatrtatccattcaagtgttctatctattcatttataagtatatttagcatctattctctttatttataatccatttagtctgaaacataggtcgttattatga

SEQ ID NO: 52693 - DNA, 201 bp, Homo sapiens
aatgttaattgaaatatgtatagttacatgtagaataacattaaatgtacttttatttatttggcttcaactgtgtatttgagaattattacttactttgwtatatgcaactgaacatcacagtagatattctttgagataaaataggataaacaattttgaaaagaaatacaccaaagactaaatagcactgtaagttgg

SEQ ID NO: 52694 - DNA, 201 bp, Homo sapiens
tagaagtacttataaaataagatttgatttcttataaattatattctatcattcatttattataaaacatatttaatttgtttataagtacttgatgagamttgaatttgtcaatgatacaaaaaacataagcataaaagcataaaacccataagcacaatcttatatattatgcatattgctttatttaatcaaaacatt

SEQ ID NO: 52695 - DNA, 201 bp, Homo sapiens
gtaaaaaaaaaataatatatacataatatatattatatattatatatacaaggtattatatttgaaaatttcatgcataaactgatctacttttttcagtrcatttaataaaataataaaagtattttctcatcactaatgtgctcccatattttactttctaacagggggaagcaggtgcagaaggtcctcctggaaaaa

SEQ ID NO: 52696 - DNA, 201 bp, Homo sapiens
aaaaggtgctaaggtaaaaaaaaaataatatatacataatatatattatatattatatatacaaggtattatatttgaaaatttcatgcataaactgatcwacttttttcagtgcatttaataaaataataaaagtattttctcatcactaatgtgctcccatattttactttctaacagggggaagcaggtgcagaaggt

SEQ ID NO: 52697 - DNA, 201 bp, Homo sapiens
tacataaaatgggttttgattttcgttattatgttttaaaccaaatagtgatagaaaactacaatttattcatctgttacaaactaaagtttagtgtttgwaaacaagtgctcattaacattacttttatatgtgatacatattttacaataaatcttatgtctatagggtcctcctggagctgcaggtgcagagggaaga

SEQ ID NO: 52698 - DNA, 201 bp, Homo sapiens
tgctttcttatattgatgtgaagtgattgttgtatacttaatttgtgctgtttttcagtattctaagaggaagtttgtacataaaatgggttttgattttygttattatgttttaaaccaaatagtgatagaaaactacaatttattcatctgttacaaactaaagtttagtgtttgtaaacaagtgctcattaacattac

SEQ ID NO: 52699 - DNA, 201 bp, Homo sapiens
tatcagtatttaacacactcagggtggcgattttaattcatcagcatttctttaaaaactttatttttactgctttcttatattgatgtgaagtgattgtwgtatacttaatttgtgctgtttttcagtattctaagaggaagtttgtacataaaatgggttttgattttcgttattatgttttaaaccaaatagtgatag

SEQ ID NO: 52700 - DNA, 201 bp, Homo sapiens
cttttggatggcatctaaagtgtaatttttttttcaattttacttctaatattaggatttaaaaagtgatatttgctttcattttacctatttatgtgaaytgcatagttctcaaaaatgaaaatactgtgtctgttgaccatcataatttaaaatattgtgtttctttagttgttatgtgatcctgtaagaatgcatgaa

SEQ ID NO: 52701 - DNA, 201 bp, Homo sapiens
tgtacttatgcttttggatggcatctaaagtgtaatttttttttcaattttacttctaatattaggatttaaaaagtgatatttgctttcattttacctayttatgtgaactgcatagttctcaaaaatgaaaatactgtgtctgttgaccatcataatttaaaatattgtgtttctttagttgttatgtgatcctgtaag

SEQ ID NO: 52702 - DNA, 201 bp, Homo sapiens
agaagaaatttgtcttaaaatttaattctgaatttctttgcatatctaggtttacttactcattgagaaaagttaagtaactcatgatcccttgttttatrtttagactggggtaaatgaaataactgtatcaaaaagatttactctggttgaagggataaaatctaaatattgtgccagttacatcactaatttaaaata

SEQ ID NO: 52703 - DNA, 201 bp, Homo sapiens
tggcctcagatggtgggatgctatataatgtggttagtagaacaatgcagtcacaatagctggctttcaacccagctacaccagttattacctgtattacrttgggcaaattgtgtattttctgtttctcagaggacctaacacccaccctagtgttgggttgaacataagataaatcatgtaacacaataaaaaaaaaaa

SEQ ID NO: 52704 - DNA, 201 bp, Homo sapiens
atgagatgatattggggatcagaatctgtggctggagttggaaaagggaggaggaagtttcacaactaccatgcacatttctcaaaaataattttccctcrttatcagcacataaatttttatagcaatattttaggttactccaaaggactgattaaactcctatttaattccttttataatgttttagggtgaagatgg

SEQ ID NO: 52705 - DNA, 201 bp, Homo sapiens
tttgttgttgttgatgttttttaatcaagaatagtataatttctaatagattacaaatttctaacatcagctttgattctggctgaatgtatacccatttytaattggaaaatttatttccagtcactgacaatgaagaataaaaaaaccagtatcttttagtcacattgcattttgtctaaatatatttaacctgttctt

SEQ ID NO: 52706 - DNA, 201 bp, Homo sapiens
agattggttgatgtaactgacttaaagggaaaaaggaatcctgcaagccacaaaggaatgaatcattcattttgttatattttgagttatattttcattaygaatactctgacctatccttgtcacttgtcaaaatatttggcatgaaccacaatatctgggctcagaatagctttttttttcttgtgaacatgatttcat

SEQ ID NO: 52707 - DNA, 201 bp, Homo sapiens
gctgtagtttgaaatttttacttcatttacatctattattttagaagtacttataaaataagatttgatttcttataaattatattctatcattcatttaytataaaacatatttaatttgtttataagtacttgatgagacttgaatttgtcaatgatacaaaaaacataagcataaaagcataaaacccataagcacaa

SEQ ID NO: 52708 - DNA, 201 bp, Homo sapiens
gggtttggatgattggaaatatttgcttctgctgctgtcaggaggtaaaaggagatatcttgcttcttacggttcccaaggaaataaatcctcattatgartaatagaagctcatagtcacggaatgcctggagaggctgtagtttgaaatttttacttcatttacatctattattttagaagtacttataaaataagatt

SEQ ID NO: 52709 - DNA, 201 bp, Homo sapiens
tacatatatttaccaaaattaacagtattactatgttctacatgtatacaaattggtcactcattcccatatgttatagatacttattttaaaatttttcrtttaaatcataaaacttcaatataattttggttgttcattcaaatggtgtgttcactcttgtctttatgatgtttttctttggtcactatcagtatatat

SEQ ID NO: 52710 - DNA, 201 bp, Homo sapiens
tcccagggtgcacctggactgaaaggaggggaaggtccccagggcccaccaggtccagttgtaagtatgatgataataaatagccagacaatcatggttgygaattacagctcttctttcattactctcatgctgtgattccacagtgtgtgggagagaaaataaacacatgtcaatcaaatcagtcaatgcctagttccc

SEQ ID NO: 52711 - DNA, 201 bp, Homo sapiens
aatatttaatgtgcgtttattgtactccaagatattgctcaacatttatataagaccgttagctccgttgaccataaaatctttaatatatatgtaacgtwaaatgtaggtagtgggtagttcattttaatgcatatggcattccacccaatattctcatcattaaataatattcacattttacttacagtagtttagagg

SEQ ID NO: 52712 - DNA, 201 bp, Homo sapiens
ggatctttgcttttctgtttctcttctataatgcaaatcctatttcaaactataccacatttgttcatggtgaaatgattcactgacattgtatactaatracatcttctttcttccttatataaagagcatgctggattttaaatttgatatattaatagtagcagttttacaaatttttttgcggagagtgagaggtac

SEQ ID NO: 52713 - DNA, 201 bp, Homo sapiens
tgagaaattacagcaattgtataattaaagaaatttaaacctagaaatgtatacccaaattgggacaggtgtataccttatccaagataaatagttaagamtatgttgcatttttaggaaaaaaatatttatacttcataagcaagtgcaggaacacattctcctgtttaacaaccttagcatctaaaaattttctctttg

SEQ ID NO: 52714 - DNA, 201 bp, Homo sapiens
ttattatttcaaagttacaggatctttgcttttctgtttctcttctataatgcaaatcctatttcaaactataccacatttgttcatggtgaaatgattcrctgacattgtatactaatgacatcttctttcttccttatataaagagcatgctggattttaaatttgatatattaatagtagcagttttacaaatttttt

SEQ ID NO: 52715 - DNA, 201 bp, Homo sapiens
cctgaggcaagggaaatacgatgttattttatagagtgtgtaaacatgactacttacttgtgctgaaggcttctttttaactgcttatcagttttagttaraacattatatatactttctcagtaattagaaagcttcctccaaaaatactttcatttttcctgtttaaaacaactttataactattttctgtgagaaaat

SEQ ID NO: 52716 - DNA, 201 bp, Homo sapiens
gtggctggagttggaaaagggaggaggaagtttcacaactaccatgcacatttctcaaaaataattttccctcgttatcagcacataaatttttatagcartattttaggttactccaaaggactgattaaactcctatttaattccttttataatgttttagggtgaagatggttttccaggattcaaaggtgacatggg

SEQ ID NO: 52717 - DNA, 201 bp, Homo sapiens
actatttctctctgttatccaagttttgatgcaccgggaattgaattaggaacaaatcaccaaaaagggggaaatactcatttgtgaagtgctaaagaagyaatatttttcacaaaaacgaaaatacaaacctttgcaaatattattttacaaatgattgatgcaaatgaaatatatttaaatgtaaaatattcagaaaag

SEQ ID NO: 52718 - DNA, 201 bp, Homo sapiens
aaacctgaagaagtcactgagcaagccatgatgttgtgaagtagcataacggattttaattagagttgttaatttacagggcacccaggatgtcaatacasatgacttaagggagcaaagatggttctggcaccaccaagaacctttctcctgaagtaactagccaacctggaaaaagtctccctcagttggaagaaagct

SEQ ID NO: 52719 - DNA, 201 bp, Homo sapiens
ggtaaattaagtcatctagttcactgaacctagaaatttgtgaacttgtagaaaagcctatgtaaattgaatttatataaaaaatttgtatctttattttwataaatatgattataaaattactgtgttgatattaaatatcttatgtgcataattacacaaattgcatcatgaacacaatataatgaattattactgtta

SEQ ID NO: 52720 - DNA, 201 bp, Homo sapiens
agagtgctgtagatctgttgaatttctcccaacatcacacagaccagggtcagaagaaatgaatggcaagtgattcctggctagagattatgtgtactatmatgaaggcagaagagaatatatctgccttatttacaggaaaccttatacaaaaggattgacttttagagtttaaggctagcaagggaattcaaattaagg

SEQ ID NO: 52721 - DNA, 201 bp, Homo sapiens
aatagagtttacatacaactcatttattatgcaatataagaatattccctagattagtttttgaatatatacttactcacagctcaaaaatgccacttttrtttatataaagctcaaatttcacaatttccttaattatatttttggcaatgtctctccaaattatttctatcaactaactttaagatacccaataattac

SEQ ID NO: 52722 - DNA, 201 bp, Homo sapiens
tggcccatagagagtttgctccagatcagaaagctagtggttccagtgctagagagggaaagatcatacacttaattgacacacttatttatggcatactrtgtgccagtaactactcaaactgctggagatcattgaaaaaagaaaaaaaaagaaaaatcaaaaacctctacctttgtgaagttgatcattatctatttt

SEQ ID NO: 52723 - DNA, 201 bp, Homo sapiens
ttatacctgttgttttgatattcatttattaatgtattaaatatgccatataattttctggatcttagtttacttttctgtaaaattttacttctacaatkatttgagattttatatctatttttggaatatataactgttcacttacagtcctctaacatctattacatttatactttttgacaggcattgttcaaagaa

SEQ ID NO: 52724 - DNA, 201 bp, Homo sapiens
ggcctgagtgtaattctgaattaatatggtcatgacacacagatttatattaaattagtttcatgatgaaataaagtccagatggaagtagccacattacrtcaagagcagaatatttggatttttctcttgtttgcagtttccaaaagctcttgaaattaaaactctttaggtaattctattattaaatattactaatgt

SEQ ID NO: 52725 - DNA, 201 bp, Homo sapiens
tttatacctgttgttttgatattcatttattaatgtattaaatatgccatataattttctggatcttagtttacttttctgtaaaattttacttctacaaytatttgagattttatatctatttttggaatatataactgttcacttacagtcctctaacatctattacatttatactttttgacaggcattgttcaaaga

SEQ ID NO: 52726 - DNA, 201 bp, Homo sapiens
gagagaagatcatttttcaattataattgagcactgattcaacatctgcattaactgttttagttatatctaaatttcttctgccttttttgtgatcctaktaaggtccaaacacataatccatctacaagtcacattattcaatcagatggaattgaacaagacagtatcacaggctggtttttcattgctcattctcta

SEQ ID NO: 52727 - DNA, 201 bp, Homo sapiens
ctacccttcttttaacagggtattttatacctgttgttttgatattcatttattaatgtattaaatatgccatataattttctggatcttagtttactttyctgtaaaattttacttctacaattatttgagattttatatctatttttggaatatataactgttcacttacagtcctctaacatctattacatttatact

SEQ ID NO: 52728 - DNA, 201 bp, Homo sapiens
tgaaatagtctttcttgtatgattatgagaaattttgtatacatatatttaccaaaattaacagtattactatgttctacatgtatacaaattggtcactyattcccatatgttatagatacttattttaaaatttttcgtttaaatcataaaacttcaatataattttggttgttcattcaaatggtgtgttcactcttg

SEQ ID NO: 52729 - DNA, 201 bp, Homo sapiens
ttacctttttataaccttttaattaattaaatttatttgatgcaatagagccatattggtagttatgctttagtaagaatccttgtttaacattgataacmtagaaagtataagataaacgtacagttttttcatagtgttttatccaacttttggcattttctgtagtacttggtaagcagatgttgaattagaagtaca

SEQ ID NO: 52730 - DNA, 201 bp, Homo sapiens
gacaaaatttgggagatggactaacatttgttgaattcttgctagcatctaagcactctgctattttacataataaaaaactaaatcactaatacaacatrtaattactgaagctctgaaattgcaagatgtagtcatttgaatatttgaaatgtacagaacaagtggagtaaacaaattgaagttttaagaaaacaaatc

SEQ ID NO: 52731 - DNA, 201 bp, Homo sapiens
gttttctatttctgtgattaagtaaagtatgatgattgtaaggccattatttataactctgctatagcacatgaaagagtaacataatgaaatagtctttyttgtatgattatgagaaattttgtatacatatatttaccaaaattaacagtattactatgttctacatgtatacaaattggtcactcattcccatatgtt

SEQ ID NO: 52732 - DNA, 201 bp, Homo sapiens
tcatggtgctggtggatggaaagtccaagatagtggggccacatctggtaaagaacttcttggcacatcatcccatggtagatggagaaagacagggctagagagagagagagagagagagagagagagagagagagagtaaaaagaaaacaaattccctttgttttaatgaacccactaatgcaataacggtattgatta

SEQ ID NO: 52733 - DNA, 201 bp, Homo sapiens
gttatctgagtagcatcattattattatttcaaagttacaggatctttgcttttctgtttctcttctataatgcaaatcctatttcaaactataccacatwtgttcatggtgaaatgattcactgacattgtatactaatgacatcttctttcttccttatataaagagcatgctggattttaaatttgatatattaatag

SEQ ID NO: 52734 - DNA, 201 bp, Homo sapiens
agccattgatcgtgcatgcattttgtctgtaagaggtatcagaagcataataaatgcctacacttgagaagcatgcattctagtaggagagacaagaaggrgtatttctttcactgataaacaaagtgatttttatactatgtttctctaacaagtgaaacattagagcatgaaataaaaataccccatttctctagtatg

SEQ ID NO: 52735 - DNA, 201 bp, Homo sapiens
attaagtctatcctgtaatttttgagctcataaataatacattcatttgaagtattttatggtcagtcattttaataagggacatttaaattaattaaaawggctaaataattaaatggagtagaacaatttaacaaaaattagcacaactgtgagttttgtttttagagcaccactgattctctcatgcatttggttttg

SEQ ID NO: 52736 - DNA, 201 bp, Homo sapiens
gcgatggccctcctggccctccaggtgaaagagtacgtatgatacagccacataatataaaatgaaaattagtatttctgcaagtatttagatttcagagraaagatatatgtctgctaatacatgtgcatgtctatccacaaaatctagtctgaatttaaaaacgcttattttttaatttattcctcttcaccaataaaa

SEQ ID NO: 52737 - DNA, 201 bp, Homo sapiens
acttctagaattgagtataacgtattgtttcctttacttgaaaaaatttgagagataaaatgccattttttatgagtttgtatttattttgcattcttggtttttttttgtttgtttgttttgttttgttttttgttttttgagacggtctcgctcggagtgcagtggcgccatctcagctcactgcaacctccgcctccc

SEQ ID NO: 52738 - DNA, 201 bp, Homo sapiens
aatttccacctcacaattgctgagaccactagtgtgactgattttgagtggaaacatggtaaatgaatgtattgttttacttaaatgattacttgaacaaratgttatatttttgtgcattttgaattgtggggcattagcaacagactttcatagctaaaccctactagttacagagatttatttattagtccactgggc

SEQ ID NO: 52739 - DNA, 201 bp, Homo sapiens
attcactgctttcaaattgggaatagggccaaatagttacctcctgtgagtaggtaatactctacacctggctattccaactgtacatgcctgagaatacwgcttcaagacttctaagatttcacagtacatgtgaccccgagaggttggtaaaaattcagattcctggacctcactgccagagagtctgtttcagtttca

SEQ ID NO: 52740 - DNA, 201 bp, Homo sapiens
aaacatacaggaaaacatgttataaaaaacagcttagcagtgcatccttcaggttattattttgactatcagctgccatagggcatcacatacaattttaytgacctgctttaatagcatcatgtaggaaatacaaattgctagcatcttaccttcctgataagtgtgtaatattcactgctttcaaattgggaatagggc

SEQ ID NO: 52741 - DNA, 201 bp, Homo sapiens
ttttttttttttaataaaggcgtgctttttctttttctcctagggcccacgaggtttgctgggtccaaggggaactccaggagctccagggcagcctgtawgtattgctggaaacattgaagattttctagggaaagcttgttgccaaccttttagaggccataaaagccctcagtagagagccaagagtttattgccttg

SEQ ID NO: 52742 - DNA, 201 bp, Homo sapiens
tcattgccacgtgataacactgtcttaggcttgctatacagctttgtcttacaattttttcattgagtttccccaaaaatacttccttgagtagcaggggmtaaatataatgcttttgaacccttctaaaataagatttacggcatctgtgatttaaaaataatacaggcataatttaaatattttctggctgtactcagg

SEQ ID NO: 52743 - DNA, 201 bp, Homo sapiens
tggtattcaggcccaacttcaagagattttaattttaatctgggcttgacacaatatcaatatgttttaaaacatccccagataattatcatattcattgkttgagagacacggggcattatgtgttgcgtcaaaaagatttgcaaccattacatttatatttcaatataatattaggcaacattgaaatttgacttcatg

SEQ ID NO: 52744 - DNA, 201 bp, Homo sapiens
atcagttcatacatagaaagctactttattatgaacatttcaattactaggttgagaaaaatggaaaaattaattccattaagccttttattgaaatatayatatatatataaatacaaaaatagatacaagaaatatacttcaggaaataggatgttagttgatatgattgtttttattgtcaatagcagcattttaagg

SEQ ID NO: 52745 - DNA, 201 bp, Homo sapiens
tgtctatgatttaatctggagcttccacttctaacaaaaataattatatcacatataacattgagatttaaacatagaagaaaaacagcataatgtttctwgaatgaatgtttctgttttgtagcttttcacagataaaagccaggattatttctgaaaaaattatattcccgatttcacatccactttaagggaatagtg

SEQ ID NO: 52746 - DNA, 201 bp, Homo sapiens
tccagtaaatagaatagctatttagtaaattgatttttaattgatgtaagatgtagccaaatacatatgaacaagcatgccctttgtttggattttttggmaaaatataacatttttgtagccagatttttaaaaaagctatcctcctgatataagtttaagtattataatctgtattcctttaaaaaattagaatcattt

SEQ ID NO: 52747 - DNA, 201 bp, Homo sapiens
aatgatgtacatttttcatattgaatttagtgtatcaagataatttatttttcaaaaataaaaattgatttagtgtctttggatttgtctggcattagttygggttcatcttttgttctcatctgcagggtcctcgaggttcaagaggtgcaagaggtcccactgggaaacctgggccaaaggtatcacctgtactttttc

SEQ ID NO: 52748 - DNA, 201 bp, Homo sapiens
taaatgaatacgaatgaatgaatgaatgaatgatgttcttgcatgactactcagtctcagcaccaggctcataatttactgtgatatactgcatattgaamttgaactgtctttgctagggagtagctggcaaaccaggccctcggggtcagcgtggtccaacggtaggtgccttgatttaaaatgatgtacatttttcat

SEQ ID NO: 52749 - DNA, 201 bp, Homo sapiens
acagattccatagatttgtatatggatataaattttcaggagccaccattcaattcgctgcatcactcaaatctcatttttggctatttgaaatatacatrttttaagcataaaaaatatggttttcaaaatgcatatttacctcggtgtactaatttttctcaaacctatcataaaactttgttaaggatgcacttgatg

SEQ ID NO: 52750 - DNA, 201 bp, Homo sapiens
aatcatctaatgtgacagttcttatcgggtttcatactttgcaacttctacagtttcacactttgaaaaaacattgctaattgtaaattaatgagcaatgktatagtgatttggcagcaaaagaaaaagatcaggggaaaacaaggccttatggggcgtttaaaccctttcccttaaaatgctcaaggccagtggttaaaa

SEQ ID NO: 52751 - DNA, 201 bp, Homo sapiens
aagaaaatatatgatataggtattagatagagagtgtgaatagtcaaaaagaaaattcctcatgtccttatgaatcatctaatgtgacagttcttatcggktttcatactttgcaacttctacagtttcacactttgaaaaaacattgctaattgtaaattaatgagcaatgttatagtgatttggcagcaaaagaaaaag

SEQ ID NO: 52752 - DNA, 201 bp, Homo sapiens
atgaatgaagtgtgccacctctttgctcataatcttccagtggcatttcatttcatttgtaaagttattccaatagtctgcaggaccttatgtgacccatrccacaccctctgcctctcctgttagagtttatcagtgtctcctctccatgttgctacctgtggattgttggttcacaaggtgtccctcacttgaatatat

SEQ ID NO: 52753 - DNA, 201 bp, Homo sapiens
gtaattatgtttttctctagggaggaggtaatgaagacgttgtcaatagcaagttcagtggtcatttacagctcttaagcctctgccattgcccaatcacrttcagtacagagagcatcctgggcaggatggtgaaaatggcatgactttctcttgaaaaaaaaaaaaaaaattcctggcatgctagagttctttgagtat

SEQ ID NO: 52754 - DNA, 201 bp, Homo sapiens
cataactagaaaagcaagtctatttctttcaagtagcacctggccaaaagaacaaatgaatgaatgaagtgtgccacctctttgctcataatcttccagtrgcatttcatttcatttgtaaagttattccaatagtctgcaggaccttatgtgacccataccacaccctctgcctctcctgttagagtttatcagtgtctc

SEQ ID NO: 52755 - DNA, 201 bp, Homo sapiens
cctttcacctcaacctcccaaaacctgggattacaggtgcgcgacccagaacctagctggtaaagtaatttttgattaatgtgtaattatagattttatawgtcagtgtatttccgttaccagtttatacaggtaatatttgagacaaaattgatttttgaattataaattcagttgtagtatactttgaagttaaacgga

SEQ ID NO: 52756 - DNA, 201 bp, Homo sapiens
tcagggagaataaagggttgggaaagctgtaagatagcatatgttattcaaaagctaggtgttcacttaagttgattattctctgttgaaataaaataaayattatgtgtcaattgttgtgcttaagtaagggatatagaaacatagttgtaataaaagacttgtgttacataataaagacataaaaatattcaagggggg

SEQ ID NO: 52757 - DNA, 201 bp, Homo sapiens
tttgagagagagagtctttttttgtcgcccaggctggagtgcagtggtgcaacagggctcactgcagcctcaaactcctggacttgagcgatcctcccacytcagcttcccaagtagctgagactacaagcatgcctcaccatgtgcagctaactttttaaaaacatttatttgtaggacagggtctcactatgcttccta

SEQ ID NO: 52758 - DNA, 201 bp, Homo sapiens
gcctcacttctttttcaatttaaaagaacaatttccacctcacaattgctgagaccactagtgtgactgattttgagtggaaacatggtaaatgaatgtaytgttttacttaaatgattacttgaacaagatgttatatttttgtgcattttgaattgtggggcattagcaacagactttcatagctaaaccctactagtt

SEQ ID NO: 52759 - DNA, 201 bp, Homo sapiens
tttcatatattttggacaaatgaatattaatatattattctaaaaatgaaactttgtagtaaaaagctcatactttttttgaagcagaatatattttaaawtttttatcacctcaagcatttatcattagaaagcacatacataaattctaagattatttaaacctatctttttaccacatatcatttcactcatttaata

SEQ ID NO: 52760 - DNA, 201 bp, Homo sapiens
aagggggctctggtaggttccaaagtatccatttaaatgtcctattaataaatttccaagagaaaatgccttaatttggtcatctcatatatataaatcaygttcatatagttattttgggtataaaaaagatatcttagactacttttaattttatatcagtaattttagaaactagactatgttctctctttttaaaaa

SEQ ID NO: 52761 - DNA, 201 bp, Homo sapiens
tgcaaaagtctgaaaagacatctcaaaaggctaatcttatgttctacgtagtgatgttatttacaggagtaattggggaagttataaacattgtaactttyggaacaatggctggtaattttttactatgactacattttagtggaattcacacccctctcataattctaaccttgtggctttgtattagtttttataaag

SEQ ID NO: 52762 - DNA, 201 bp, Homo sapiens
gatgggtttatcttgcctgctgcccagacagggcctatttatccagacaggggaattgcaaactctttctctatgcatacagttagctgaataggagactrgagttttattattactcaaattagcctccacaaaaatttggaggatagggttttttaaagatagtttggtgagcaggaggctaggaaatgagaactgctg

SEQ ID NO: 52763 - DNA, 201 bp, Homo sapiens
taggtctcatattcacaagtacccagtatttggtattttctggactttaatataccttgctaaactcacactgaggcatttagtaaatgtttattgaacaytgtggttactgaaggtccaaaacatgtttgacactggagactcacaggttaattaggcaggattcttgtgttcggccatttagcagaaggaaaacaacct

SEQ ID NO: 52764 - DNA, 201 bp, Homo sapiens
ttacgagatagaagaaaatggaaaatattttatatataatgatgttaattgttaaccaaaggtgatatagcaagttagtactctaattatgactaaaattmtctcttttttagccttagatttgtcgcttaagtctggagcaacacagctcaataaattaggtggcatagatgaattccacttttatacatcttctaaaac

SEQ ID NO: 52765 - DNA, 201 bp, Homo sapiens
ctctctcctgccttttctgtcattgcaatcattcattttacttatacataagcatatatgcagtgaaatccattattgctattattattttgaaaaaactyataccttagatcaattaataataataaaaaatattttaccttcacttattcattctctgaatagtttatgtagatttaagcttctcacttatataatttt

SEQ ID NO: 52766 - DNA, 201 bp, Homo sapiens
ctcctaattccaaatgtatggctgtgtgttaaatgtttcaattgaatacatcattatattattttaaaatattatttaaaaatttttaaaccagcactctsataatgtgcatcattttagcatctggaaaattagcagaaaagaattttttccattattttgtttttatttttattttttacttttttgagagagagagtc

SEQ ID NO: 52767 - DNA, 201 bp, Homo sapiens
caattgaaatttttaaaaatcatggagttttctatttcctgtacataatataactccatttattttggtcttgtttaatttttttttacaatgttttctarttttcagggtaaatgtcttggacatcttttatttaattttttcctaagtatttttttttagtgctagagtaaatgaatttgtttctaatgtcatatttga

SEQ ID NO: 52768 - DNA, 201 bp, Homo sapiens
gactctaagctcctaattccaaatgtatggctgtgtgttaaatgtttcaattgaatacatcattatattattttaaaatattatttaaaaatttttaaacsagcactctcataatgtgcatcattttagcatctggaaaattagcagaaaagaattttttccattattttgtttttatttttattttttacttttttgaga

SEQ ID NO: 52769 - DNA, 201 bp, Homo sapiens
caattcagttcttacttagtataatgatcttaagaattacccatgtttattgtatttaatattattattattattattattattattattttgctgagtargattttaacacatagctacaccaaaattttttcatccattcaccctattagtgggcatttgtgttacttccaggttatggcatctataaagccactataa

SEQ ID NO: 52770 - DNA, 201 bp, Homo sapiens
cctgtaaatccatgggctggttcctagggaggctctagatctggcatctagcaacagactacagggcttagatataattattcctcaccatgaatttgctrtgtttccttctagaggcattcattgagacccagattatgcctagctgggcagtggccagaggaattcagaccacaaagtacagagagcataaggtggtaa

SEQ ID NO: 52771 - DNA, 201 bp, Homo sapiens
ctgggacttttacaaatggaattatactgggtgcactcattttaacttaactcgttttaactcgttttttttcccttgttattaatagtatgtcgaattaygttgattggtttttcaaatatttaaaaacaacttttcaatctttagaggtctatagactgtactggtgatgtagtatgttgtcttatttatattacatac

SEQ ID NO: 52772 - DNA, 201 bp, Homo sapiens
gttgtagaaattggggggaagagctagatctaaaacacagtgaagtcaatgcactaactataactgaattaggcaatagcagtttgaaattttaggaaaartattcttcaaatacttatttacaatttctagcatgtatgtgtgtataattgcagagaaaataatcagtgccagaattgtaagtctgggagtcatttaaaa

SEQ ID NO: 52773 - DNA, 201 bp, Homo sapiens
  misc_feature (1)...(201): n = A,T,C or G, or insertion/deletion polymorphism (see Tables 1-2)
aattttataaaaatttatttttcatttatttctttttctttcaaaacgtcattctagggtcctgttggttttcctggagatcctggtcctcctggggaacntggccctgcagtaagtatcagggaaaaatcaagaaattattttggagtgaatgtttccaatttctgtattgttaataaagaaaaaaaaatctaataacct

SEQ ID NO: 52774 - DNA, 201 bp, Homo sapiens
ggtcctatacttttacttgagacagttaaaacgtgacatacttgttgagctcaactgccataataatttagatgcaaaaatattggtatttaagcacactstgatgtttttaaagaacaatcatgacattcatcatgagtgaacattcattccataagtatttatctattagccaccgcttggctggcagtctgtagagca

SEQ ID NO: 52775 - DNA, 201 bp, Homo sapiens
gctttttatgtttaatgctattttacctccatccccttcattaggctaactcctatttgcttttaacaaatcatcaagatttttccaagaaccgtttcatraaaatgttcattctcattgagatacctgtatgttgcaagttaatggagacaagaatgaactataagaaatttggaatctagatgattttatggaacaaaa

SEQ ID NO: 52776 - DNA, 201 bp, Homo sapiens
agtattaatttttttcatttgtatattccttcaataacaatttattaaatgcttactgtgtgctaggtaggtcctatacttttacttgagacagttaaaamgtgacatacttgttgagctcaactgccataataatttagatgcaaaaatattggtatttaagcacactctgatgtttttaaagaacaatcatgacattca

SEQ ID NO: 52777 - DNA, 201 bp, Homo sapiens
gtgacctttattatatctccatttttagaaattacattggaatatagttggctgtctctcgcattaggctgtgagttaccagtattattttggttactcamaatacggtgcctgaagcacagtaatcatctcacacttacccatttgaattattatgaatacctaatattggaataaattttatatagcattacttaatac

SEQ ID NO: 52778 - DNA, 201 bp, Homo sapiens
ttcattttctttatttttttcacttttcccagggtgcacctggactgaaaggaggggaaggtccccagggcccaccaggtccagttgtaagtatgatgatrataaatagccagacaatcatggttgtgaattacagctcttctttcattactctcatgctgtgattccacagtgtgtgggagagaaaataaacacatgtca

SEQ ID NO: 52779 - DNA, 201 bp, Homo sapiens
ttacacatcaatggaaagtggatagactattgaaaaaattctgctgggagaaatgattttctatatggaaaaagattaaatatacctcatctagctcattkaacagaattcagttctaattgatttataatcataaatgtcaaaggtaaactttgaaatattttaccaaaaattatttgagagtaattttttgacctccag

SEQ ID NO: 52780 - DNA, 201 bp, Homo sapiens
catagtggcgggcgcctgtagtcccagctacttgggaggctgaggcaggagaatggtgtgaacctgggaggcagagcttgcagtgagccgagatcgcgcckctgggctccagcctaggcgacagagctagactccgtctcaaaaaaaaaaaaaaaaaaaaaaaaaaaaatggagccatttagaaaaaataggtatttattt

SEQ ID NO: 52781 - DNA, 201 bp, Homo sapiens
tagcatcaaaacatataaacaaccataaatactttttcttcattgcagggtatggcaggtgtagatggccccccaggaccaaaagggaacatggtatgtarcaaatagtgataaaataactcatatttgaatataagccctaagaaaccattttttgttgttaaatctaaaatataatgatttattacattttgctaagta

SEQ ID NO: 52782 - DNA, 201 bp, Homo sapiens
actagcaggtagtgtttactatgaatgtatccttaaagtaaaacatgaaaaaataaaaataaaaaaatggagaatgttcaataaatatttttaattgattwtcaaacagaagttatatttacatatatcacagtagtaaaatattatcttgataatatgttgaatacagttaatacctagtagtattaatttttttcattt

SEQ ID NO: 52783 - DNA, 201 bp, Homo sapiens
gagactgctagttcctacccattttttttctaatcttattattttcagtctgaccagatgttgtagggaataaaatattcagttctttcgaaacttctccyaatattttctatctacttctccagctgttaaaagtaacttaactctcatgggtaagaaatttacctatattcacacaattatgtggaatgaataacccac

SEQ ID NO: 52784 - DNA, 201 bp, Homo sapiens
ggctaccatgatatctgttgtgttgtcaacaactattacaaatttaattaccacatgtgaaattgcagggatgtaagggaggaaaattttgattttctatytcaaaatttatttctagaagtccagtcttcaactagtattcccaccaaattaagagtctttctgtttttagggaaaagcaatacatggccatagggtcct

SEQ ID NO: 52785 - DNA, 201 bp, Homo sapiens
tgctaaggttttaatctatatttggtaaatgtagaaaatattttgaattcatcttattattcacaccttatttttccttaatcctgctttcctaactgaaraaaaaaaaacaaaaacatcaatttattgcagcccagcccacatcctattcaaaactagcaggtagtgtttactatgaatgtatccttaaagtaaaacatg

SEQ ID NO: 52786 - DNA, 201 bp, Homo sapiens
ttgatttataaaggccatgtagaaatttcaaaaataccacagtgatctaggaataaagtagaaattggaaattggaaatttctaactctttggccttttcytctcaggtggaactttcccagaagacttttcaatactatttacagtaaaaccaaaaaaaggaattcagtctttccttttatctatatataatgagcatgg

SEQ ID NO: 52787 - DNA, 201 bp, Homo sapiens
agcagctaaatagaaattaatgcttattaaatttactcaatattttatcactgaatccagacctctaaaaacagctttatccaaaatagcacatttggttrtagctataagaaggaagtagcagtgatcattgacactcattatatttttgtcaggaccacagagaaactctcaagtctcagttttactgagactttacaa

SEQ ID NO: 52788 - DNA, 201 bp, Homo sapiens
catgcctgtttaatgcttgccagatataaattagcactttttaataggacacagttttaaataaagagaatttgattcactttgttctaactataaataaktttaccatctaaatttaccagctctaactataaatatctagaggaagtttaggtatctgaaatagggctgagattttccaggaaatattgacatgtggaa

SEQ ID NO: 52789 - DNA, 201 bp, Homo sapiens
caacagaaagaatacgtttgtaaattgggtcattacaatgcctctttaaagtgggcatgtatggctacggactagacaaagacaaaaaatacaaactttasgccaaaattagcacttaaataaatgttttaagagtggtggttatgtgtttgatatttactggtatcataatcctgttgcctaaaccaaatttaatttcac

SEQ ID NO: 52790 - DNA, 201 bp, Homo sapiens
ttttgactttttgatagttgccattcatactggagtggggtaatagctcattgcagttttgatttacatattcctaatgattaacgatgttgagcattttyttcatatacccgttagccatttgtatgtcttcttcaagatatgtttattcagacatcttgtccatttttaattggattacttgtttttttctattgagtt

SEQ ID NO: 52791 - DNA, 201 bp, Homo sapiens
tctatatggctgtattaatttacattttcaccaatagtatgaaacagttcctttttctctacatctgcaccaacacttatcttttgactttttgatagttrccattcatactggagtggggtaatagctcattgcagttttgatttacatattcctaatgattaacgatgttgagcatttttttcatatacccgttagcca

SEQ ID NO: 52792 - DNA, 201 bp, Homo sapiens
tccagactttaggatagtgattatcaaatgttattttgtaaaaaattttgtgtgtatcctaatgcaaagaatttctgaacccattttttttattttgaaamcttggttcagcacatttgaaaaaaagcctagaaataacttcaagaaacactagtttagggattgtattctgccaattcattataatacagggagaaattt

SEQ ID NO: 52793 - DNA, 201 bp, Homo sapiens
ctcatggtgctggtggatggaaagtccaagatagtggggccacatctggtaaagaacttcttggcacatcatcccatggtagatggagaaagacagggctrgagagagagagagagagagagagagagagagagagagagtaaaaagaaaacaaattccctttgttttaatgaacccactaatgcaataacggtattgatt

SEQ ID NO: 52794 - DNA, 201 bp, Homo sapiens
tgttgagagaaaacagaagcctggactcaagtcttaatggagaattataatgggtgtaagttctgaaagcatctaataagagagaaaaatagtccatgagkttgtttgtttgtgtgtgtgtgtgtgtgtgtgtgtatgtgtgtgtgtgtgtatctccagaggcatgccatcaaacagaacaagacataaacaagttccctt

SEQ ID NO: 52795 - DNA, 201 bp, Homo sapiens
gttgagagaaaacagaagcctggactcaagtcttaatggagaattataatgggtgtaagttctgaaagcatctaataagagagaaaaatagtccatgaggttgtttgtttgtgtgtgtgtgtgtgtgtgtgtgtatgtgtgtgtgtgtgtatctccagaggcatgccatcaaacagaacaagacataaacaagttcccttt

SEQ ID NO: 52796 - DNA, 201 bp, Homo sapiens; identical to SEQ ID NO: 15107

SEQ ID NO: 52797 - DNA, 201 bp, Homo sapiens
acttttgttactactaaaactacttttagtatttctttactaattagtatttttatcaggttagataatgtgcaattatatggtaaaatgcaattctttcwtatatcagacaccaaataccttgtggtcaccaaagtaatgtaatgaaaataacaaaaaatttgataattgccagtcttaattcaacacaatcacatttct

SEQ ID NO: 52798 - DNA, 201 bp, Homo sapiens
aatattttataaattataattgagatacatatgaatgtttataaatcatatataggaaactttaaattccagatgcacatatgcctatgtacacacacacrcacacacacacacacacacacacagacacagacacacacacacacacagacaccccttctgtgttgcttaaccataatttgattccagatttgagatatt

SEQ ID NO: 52799 - DNA, 201 bp, Homo sapiens
ttcaaggaatgtggaaatcatctgagagtcagtggggttctttgaaggaatttaaacatcagagtgacatgagacatggatttttggaagcttaatcaagytggtggaatgaagattgatgggaaaaagtatggaacccagttaagtggctattttagtagcacattgggctctgatattctattctcccgtttaataaac

SEQ ID NO: 52800 - DNA, 201 bp, Homo sapiens
gagagaaaacagaagcctggactcaagtcttaatggagaattataatgggtgtaagttctgaaagcatctaataagagagaaaaatagtccatgaggttgtttgtttgtgtgtgtgtgtgtgtgtgtgtgtatgtgtgtgtgtgtgtatctccagaggcatgccatcaaacagaacaagacataaacaagttcccttttgt

SEQ ID NO: 52801 - DNA, 201 bp, Homo sapiens
gagaaaacagaagcctggactcaagtcttaatggagaattataatgggtgtaagttctgaaagcatctaataagagagaaaaatagtccatgaggttgttkgtttgtgtgtgtgtgtgtgtgtgtgtgtatgtgtgtgtgtgtgtatctccagaggcatgccatcaaacagaacaagacataaacaagttcccttttgtgg

SEQ ID NO: 52802 - DNA, 201 bp, Homo sapiens
cagaagcctggactcaagtcttaatggagaattataatgggtgtaagttctgaaagcatctaataagagagaaaaatagtccatgaggttgtttgtttgtgtgtgtgtgtgtgtgtgtgtgtatgtgtgtgtgtgtgtatctccagaggcatgccatcaaacagaacaagacataaacaagttcccttttgtgggatgtaa

SEQ ID NO: 52803 - DNA, 201 bp, Homo sapiens
gaagcctggactcaagtcttaatggagaattataatgggtgtaagttctgaaagcatctaataagagagaaaaatagtccatgaggttgtttgtttgtgtgtgtgtgtgtgtgtgtgtgtatgtgtgtgtgtgtgtatctccagaggcatgccatcaaacagaacaagacataaacaagttcccttttgtgggatgtaaaa

SEQ ID NO: 52804 - DNA, 201 bp, Homo sapiens
tggagtgcagtggtgcaacagggctcactgcagcctcaaactcctggacttgagcgatcctcccacctcagcttcccaagtagctgagactacaagcatgyctcaccatgtgcagctaactttttaaaaacatttatttgtaggacagggtctcactatgcttcctaggctgatcttaaactcctgggcccaacctttcac

SEQ ID NO: 52805 - DNA, 201 bp, Homo sapiens
aaatgaaatatgttagatgatgatactgtcacatgcttcagcacttccttactaatttatactctctaaagaatatctgtggacattattttctaagttctttttttttaatttttttttccctttaagtgttcatgtatttgctctctgatagaaacataaattgggggagtacagagatatgtccttcaagtttttttt

SEQ ID NO: 52806 - DNA, 201 bp, Homo sapiens
gttagatgatgatactgtcacatgcttcagcacttccttactaatttatactctctaaagaatatctgtggacattattttctaagttctttttttttaatttttttttccctttaagtgttcatgtatttgctctctgatagaaacataaattgggggagtacagagatatgtccttcaagttttttttttcacctagta

SEQ ID NO: 52807 - DNA, 201 bp, Homo sapiens
agatgatgatactgtcacatgcttcagcacttccttactaatttatactctctaaagaatatctgtggacattattttctaagttctttttttttaatttwtttttccctttaagtgttcatgtatttgctctctgatagaaacataaattgggggagtacagagatatgtccttcaagttttttttttcacctagtatgg

SEQ ID NO: 52808 - DNA, 201 bp, Homo sapiens
ttcaccaaagttgaaatgaaggaaaaaatgttaagggcagccagagagaaaggtcgggttaccctcaaagggaagcccatcagactaacagcggatctctyggcagaagccctacaagccagaagagagtgggggccaatattcaacatcttaaagaaaagaattttcaacccagaacttcatatccagccaaactaacct

SEQ ID NO: 52809 - DNA, 201 bp, Homo sapiens
atccagccaaactaaccttcataagtgaaggagaaataaaatcctttacagacaagcaaatgctgagagattttgtcaccaccaggcctgccctaaaagarctcctgaaggcagtgctaaacatggaaaggaacaaccggcaccagccactgcaaaatcaggccaaaatgtaaagaccatcgagactaggaagaaagtgca

SEQ ID NO: 52810 - DNA, 201 bp, Homo sapiens
ttgttattattactaaaagttattacacttttgttactactaaaactacttttagtatttctttactaattagtatttttatcaggttagataatgtgcarttatatggtaaaatgcaattctttcttatatcagacaccaaataccttgtggtcaccaaagtaatgtaatgaaaataacaaaaaatttgataattgccag

SEQ ID NO: 52811 - DNA, 201 bp, Homo sapiens
ttaaaaatactcattgttatatcagatcgttgttcaattctggttttttattgtttgcttatttttcagctgctccagttgatgtactaaaagcactagaktttcacaattctccagagggaatatcaaaaacaacgggattttgcacaaacagaaagaattctaaaggctcagatactgcttacagagtttcaaagcaag

SEQ ID NO: 52812 - DNA, 201 bp, Homo sapiens
ttacagagtttcaaagcaagcacaactcagtgccccaacaaaacagttatttccaggtatattcactttattattattattgttattattactaaaagttrttacacttttgttactactaaaactacttttagtatttctttactaattagtatttttatcaggttagataatgtgcaattatatggtaaaatgcaattc

SEQ ID NO: 52813 - DNA, 201 bp, Homo sapiens
ccatgtctccttgggcaagcatggctggtttccttgaactctttactctctttgtatctgtgctaccatatctgctgtttctttccttctcttcttcactraggaactcctatttatccctagggactcagcttaaaagggctaggtagtagatattttagttgttgtgagcacacagtctctgttgcagctacgcaactc

SEQ ID NO: 52814 - DNA, 201 bp, Homo sapiens
gaatcatgtattttatgtagagttgacttttgaccaacataagagtaagaggagccaactccctgtgcattgaaaatccatgtataacttttggctccccyaagacttcattactaatgcctaccattcatgggaagccttattgacaaaataaacagttgattaatacatattttgtatgttatatatattttatgctgt

SEQ ID NO: 52815 - DNA, 201 bp, Homo sapiens
gaaagcataaaatgaatggaaactatctgcaccttcctctcaatttttctgtaaacctaaaactggtctaaaaaaaaaagttgattcaagtcatccttctmccctaaccttccaatggtttttaaatctcatttagaataaaatccagtctccctgaacattccacaggacctatacagcttgttatcagtgtatcctcac

SEQ ID NO: 52816 - DNA, 201 bp, Homo sapiens
aagtggtgtagcagttcacaggattcaaaccaggattctcattaattttagaatagatggataaataatttatattttaaatatttgttttttgtataaattttttctgctatttacagaacgtattattctgaaagttaaaatcttatctgtattgtacatagtagacacttgcagcaaaactattgtattcaaatttaa

SEQ ID NO: 52817 - DNA, 201 bp, Homo sapiens
ctcaataaattaggtattgatgggacgtatttcaaaataataagagctatctatgacaaacccacagccaatatcatactgaatgggcaaaaactggaagyattccctttgaaaacgggcacaagacagggatgccttctctcaccactcctattcaacatagtgttgaaagttctggccagggcagttaggcaggagaag

SEQ ID NO: 52818 - DNA, 201 bp, Homo sapiens
gataccatctcacaccagttagaatggcaatcattaaaaagtcaggaaacaacaggtgctggagaggatgtggagaaataggaacacttttacactgttgrtgggactgtacactagttcaaccattgtggaagtcagtgtggcgattcctcagggatctagaactagaaataccatttgacccagctatcccattactgg

SEQ ID NO: 52819 - DNA, 201 bp, Homo sapiens
ctatcccattactgggtatatatgcaaaggattagaaatcatgctgctgtacatgcacacgtatgtttattgtagcactattgacaacagcaaagacttgraaccaacccaaatgtccaacaatgatagactggattaataaaatgtggcacatatacaccatgaaatactatgcagccataaaaaatgatgagttcatgt

SEQ ID NO: 52820 - DNA, 201 bp, Homo sapiens
tatgcaaaggattagaaatcatgctgctgtacatgcacacgtatgtttattgtagcactattgacaacagcaaagacttggaaccaacccaaatgtccaamaatgatagactggattaataaaatgtggcacatatacaccatgaaatactatgcagccataaaaaatgatgagttcatgtcctttgtagggacatggatg

SEQ ID NO: 52821 - DNA, 201 bp, Homo sapiens
ttggtcccatggtaagtttttatttttggtgtttgatgggtatgtgttatatgcatggcagtcactggtttgtaaagtattatgtgttctttcattactatgtatatattattgaggtgtatataagcaactgacatgatttagttatatattagtctttagctctggattttgatttggagcaggtagagaataggtaat

SEQ ID NO: 52822 - DNA, 201 bp, Homo sapiens
tggtcccatggtaagtttttatttttggtgtttgatgggtatgtgttatatgcatggcagtcactggtttgtaaagtattatgtgttctttcattactatgtatatattattgaggtgtatataagcaactgacatgatttagttatatattagtctttagctctggattttgatttggagcaggtagagaataggtaata

SEQ ID NO: 52823 - DNA, 201 bp, Homo sapiens
aggtgatttaaagtataaaggagaaggatgtgggtaggctataaataaatactatagccttttatatcaagaactggagcatccacagattttgatatagkaagttgggttggggtcctggaaccaatcacccctagataccaagagaagactgtatagtgtctcactgaattgacaaaggagcacagtggtgagtcaggt

SEQ ID NO: 52824 - DNA, 201 bp, Homo sapiens
atgcaaatgtttttctctggaattagtatccatcaaggatttttagaggggctaggcagtgtttaaaagaaaattgcctgactggggtggggatgttgttractgctgaaacttgctaggagagttgtaaagtgacagaggcaaataaaattataaatgactagatatatatgaggacaaagccatacaggaaaaaaaaat

SEQ ID NO: 52825 - DNA, 201 bp, Homo sapiens
ttaacaattgctcattgtttttagggtgtatggtctcagaagatgcaagtatgtatagaggaaaataagtaaaattttaaattgggaaccaaaagttctgkgttattattctagtttttctagttactttttctgagcctcatttgaagtctgtaaaataaagaaaattccctaaaaaaatttaaaggtatttttcagcta

SEQ ID NO: 52826 - DNA, 201 bp, Homo sapiens
ctgaaggacccaaaggtcgagcaggcccaactggagacccaggtccttcaggtcaagcaggagaaaaggttggtaaatgactttaaattcactggtactcytgcagctgatgtttcattatcatttaaatttctttcaataactggtgtcagaaattgagttcttactacattaaagataaaatgtttcattatcatttta

SEQ ID NO: 52827 - DNA, 201 bp, Homo sapiens
ttaggcaacattataacattagaaatatgttcaaagcaacaattttcttattcacgtgaagaaatataatgaaggtaaataatgacaaaaatctgcaaatmttccttttgagtgtacaatatgtgattctaatatttaaaaaaaattgaaatcattatttaagcttaattcaacttaaaatattactttgattattatata

SEQ ID NO: 52828 - DNA, 201 bp, Homo sapiens
tgatttttgtttcttaagattaatatatgaggtcatgatctctattttgattatttgagatgaccaattgtttattgtcagcatttttttaagtcttaaarttctctttcagtggaaattattcaaatagaattttaaagtaatcatgtcattgattgattaattgtagctctggatagcattggtaggctgtcaactcct

SEQ ID NO: 52829 - DNA, 201 bp, Homo sapiens
ttagcagggtcagtgcatacttcgatatcaacacataactaggttgtcccagttgattcctaccattggatcctctgacagtcagtgaactggggccatgytgttttttctggaatagccaaccctactgtcaaatcacttggggttctcaacagtaattagtacatttaagtcacactttatatggagctatggtcatgt

SEQ ID NO: 52830 - DNA, 201 bp, Homo sapiens
gagcattccaggaagtgatgtgaaggcctttatgaagggaggatgacaccataagggacttgaagaaaggacttgaaaaatggcagtatgtctggagaagmagcagtggggataaaacgtgagatggtgctggggaagaaggcgggggacacataacacaagatcataaagatagatttttctgcatagcatggaaacatg

SEQ ID NO: 52831 - DNA, 201 bp, Homo sapiens
acttcttgagttttatagtaaacacacagttaatgtgagattgttattagctaaaagaagtgtaataagaatattgatatagggaggagccaagatggccraatgggaacagctccagtctacagctcccagcgtgagcgatgcagaagacaggtgatttctgcatttccaactgaggtaccgggttcatctcactggggt

SEQ ID NO: 52832 - DNA, 201 bp, Homo sapiens
gagtgtacaatatgtgattctaatatttaaaaaaaattgaaatcattatttaagcttaattcaacttaaaatattactttgattattatatattttaactktagggaaaacttggagttccaggattaccaggatatccaggaagacaaggtccaaaggtaaaacagcttgatatttatagtttattaacatttcgtgaag

SEQ ID NO: 52833 - DNA, 201 bp, Homo sapiens
acttttccttatatctccaggtgagccctaataccaaatacatgctcagtatgtacaaggttctgtcatatgcactttcatagagaatcttatttaattgwgacagttttcctggaagtaagctgatatcaaaatactgattttacccatgagataactgaaaaacagagaagtgaaagattttgcctaaagtcacacagc

SEQ ID NO: 52834 - DNA, 201 bp, Homo sapiens
gtcctcgaggttcaagaggtgcaagaggtcccactgggaaacctgggccaaaggtatcacctgtactttttctgtttggatgttactgtagattttttttmcaggcagatgctatgagaaagaattcaaactgatttttcttttcttttcttggtgccagggcacttcaggtggcgatggccctcctggccctccaggtga

SEQ ID NO: 52835 - DNA, 201 bp, Homo sapiens
atactgcatattgaaattgaactgtctttgctagggagtagctggcaaaccaggccctcggggtcagcgtggtccaacggtaggtgccttgatttaaaatsatgtacatttttcatattgaatttagtgtatcaagataatttatttttcaaaaataaaaattgatttagtgtctttggatttgtctggcattagttcggg

SEQ ID NO: 52836 - DNA, 201 bp, Homo sapiens
tacatgtgcatgtctatccacaaaatctagtctgaatttaaaaacgcttattttttaatttattcctcttcaccaataaaaaagcttaatcaatatgttcwactaattttgttatagaaatgagaaaaatgtgtgtaactggactaagatatcactcttatagtcaagacaaaaatagatattttttaaattttaaataca

SEQ ID NO: 52837 - DNA, 201 bp, Homo sapiens
tgtccttttgggtacctagtactgttgggtaacgagtaagtagtcatctgttaactggctgcttaataaatgagcctacattttttgtatgattttagctyatttttataatttaaaatacacagcatttttatgtgaatactgctttggcaaccactgtttctttgaagcttacaaaagaattacttgtcttttttaggt

SEQ ID NO: 52838 - DNA, 201 bp, Homo sapiens
aaaggtaattattgccctaccatgtgaaatattgaaatggcaagttttgaattttaatgaaaactgaaataagtttaacatattaaacatatttaagcatwtgaaaataaatatttttagtcaataggtgactttcttttaatgtgacttattcagctatctcatagaattttgatttatgctttgtgttgtatgtagctt

SEQ ID NO: 52839 - DNA, 201 bp, Homo sapiens
ggagtgaaccttagactgtgtgaggtagttggctttccttcctcactcagattttcacatagactccctgaaaggatgactgccagaaagagcagtagctkgctaataagaactctagtgcattttcatacttggtgctcttaggtagctctgcacagaaagaaaaaaatgtaaatattgaagtggtgtctgtctttcctt

SEQ ID NO: 52840 - DNA, 201 bp, Homo sapiens
ggtttttggaacaaggattttggatgaagaagtttttgaggtaaaaataaatccaactctaagctgaatattgacaaatcagatgaactgggttaacaacrgtaaaaatatcgctttatagcaatacgttataaagcaaagttgaaaactctaaagggtgacctagtttcttcctctgtgagtatagtggtgatgttttct

SEQ ID NO: 52841 - DNA, 201 bp, Homo sapiens
ctccctattcatagaacttgagtgcacagagtatcaggggaagcttccttcctctgtttgactggtaaactgacatccgggcttaaaggagtgaaccttaractgtgtgaggtagttggctttccttcctcactcagattttcacatagactccctgaaaggatgactgccagaaagagcagtagcttgctaataagaact

SEQ ID NO: 52842 - DNA, 201 bp, Homo sapiens
ttgggtacctagtactgttgggtaacgagtaagtagtcatctgttaactggctgcttaataaatgagcctacattttttgtatgattttagctcatttttrtaatttaaaatacacagcatttttatgtgaatactgctttggcaaccactgtttctttgaagcttacaaaagaattacttgtcttttttaggtggcatcg

SEQ ID NO: 52843 - DNA, 201 bp, Homo sapiens
gagaggcccacctggcccaatgggtctaactggaagaccaggtcctgtggtaggttaccccaacaaagataatatatgttaaaattttcaaattagcagtwccctgtgcaacttcttccagggattgtgcatatctatggttggtgacaatagggtatgttttcatgcttgctgttgtttccattaaaaaaatccttctca

SEQ ID NO: 52844 - DNA, 201 bp, Homo sapiens
tgtgtatcacctactctcaatgtctatggaagtatcttgaaccaatttctgctgatattattgtgatttcctgagactatcagtctctattttggttctargccaacctatgacctctaccctaagcactctcccactttgttatttctgaaagtaaaaatcctctttgcttgagatttagatattgtctccctctagaaa

SEQ ID NO: 52845 - DNA, 201 bp, Homo sapiens
ggtgggcaaagatagttataatcctgcctcgtagtgattatggtctacttgaggagacagtaattaatcaaatagtggtacaagtaaatataaaactacarctatgctagatgctttgaaggagaggtgtatggttcctggagaatacaaaacagaagtttagtaaagtcgaagaaaacttccctgagaaagtaccaattg

SEQ ID NO: 52846 - DNA, 201 bp, Homo sapiens
tagtccctttgcaaaaaagagcagcttgtgtaaaactcctcatcgtgttctaaaattccttggggtgtatgggaatatatacagattcttataactcactrtgtactatagtgagctaataatttgctgttttaaaagcatattactgtgatttgatatctgatatatgaaataaattcttttaaaatagggtcttcctgg

SEQ ID NO: 52847 - DNA, 201 bp, Homo sapiens
aatgttcttaagaaacataaggatgagaaaatatatttagtattcattaaatgtaagtgaatcatcataaagattttccttatcatcatcatcatcttcaygttgaggaggaggaggaagacaaggggctgatcttttctcagggatggcagaggcagaagaagtggaaggggaggcaggagacgcagacacacctgtgca

SEQ ID NO: 52848 - DNA, 201 bp, Homo sapiens
ctcagcttaaaagggctaggtagtagatattttagttgttgtgagcacacagtctctgttgcagctacgcaactctgttgcagtacaaaagcagctatggrcaatatataaatgaacgggtgtgactatgttccaataaaaactttctttatgaaagctgaaatttcatatagttttcatgtgtcacaaaatattgtcctt

SEQ ID NO: 52849 - DNA, 201 bp, Homo sapiens
attagagatgaaacaatcaaagtattatgagatgtttcatcagtaatctatatggatggtgaaggcaacaagggagaaaggatcaaagacttgggatcaawctgatcagtgaaagggtggtggtgtttaagaggtcaatagactacaataaaaagtacatattaggacctaaaaaaatttaatttcgacactagatagcct

SEQ ID NO: 52850 - DNA, 201 bp, Homo sapiens
agcagcttgtgtaaaactcctcatcgtgttctaaaattccttggggtgtatgggaatatatacagattcttataactcactatgtactatagtgagctaayaatttgctgttttaaaagcatattactgtgatttgatatctgatatatgaaataaattcttttaaaatagggtcttcctggtccacaaggtccaattggt

SEQ ID NO: 52851 - DNA, 201 bp, Homo sapiens
gggaaaaagtatggaacccagttaagtggctattttagtagcacattgggctctgatattctattctcccgtttaataaacctataggtattcaataaagracaggaaaatataattgaacaaaacattgtgctgaattggatacatctgaattgcatacacatggtttgtgccagcagttggcaacatagagataattaa

SEQ ID NO: 52852 - DNA, 201 bp, Homo sapiens
caatgttcagtatgaaacgtgttttcagtctttatttagaagtttggtggtgtatttgtgatcagaaatagactgtaggaacttaactctggtttatatcmgtgagcctatggtcaaattggtttcattaaagttgatttgctcaatgtagaagtttccaagagcctatcgaggatattaagtgaggacttactgtacatt

SEQ ID NO: 52853 - DNA, 201 bp, Homo sapiens
tgcttacagagtttcaaagcaagcacaactcagtgccccaacaaaacagttatttccaggtatattcactttattattattattgttattattactaaaasttattacacttttgttactactaaaactacttttagtatttctttactaattagtatttttatcaggttagataatgtgcaattatatggtaaaatgcaa

SEQ ID NO: 52854 - DNA, 201 bp, Homo sapiens
acgcgtgcaggtttgttgcctgggcatattgcatgaagtttggggtacaactgatcccatcacccaggtactgagcatagcacccaatagtttttcaaccsttgcccccttccctccctccctcctgtagtagtccccagcgcctattgttgccatctttatgtccatgtgtaaccaatgtttagctcccacttacaagtg

SEQ ID NO: 52855 - DNA, 201 bp, Homo sapiens
gaggagaggagattaaataaccatctaaccacatcagcaagcagaatgggggatgtacctccaagaacagcatggtgagggcactaagctgagagcctgcrgagatgagatctgtcctgcatccaaatcactgtgtgcacatgagaaagtcactggtcctttctgattcccagcttccattcagtaaatggccagtttaga

SEQ ID NO: 52856 - DNA, 201 bp, Homo sapiens
ccagttccatttaccaactgtcaaaagcttaggctttgattctgagcctgtttcctcaactgctgttctaaagattaaataggctaatattcataaggcawctgggacagtggcttgtgtgtatagcaaccattatataagtgaattatctactgagcaccacagcacttcttcactccatggtgtggtgaccagaatgga

SEQ ID NO: 52857 - DNA, 201 bp, Homo sapiens
cttccatgagtcattaaggagtcccacaggctgagagggtctcaaaaggacactgtccctgagctgccatcagcagagaaaggaaaaaacaggctgtgttsactgggaaatctgaggagcagggaggatggggccccctgtctccatctgcccacacctcagtttgtaatctttctctcccttgttccccagattcctcac

SEQ ID NO: 52858 - DNA, 201 bp, Homo sapiens
atgttggctgggctcgtctcaaactcctggcctcaaatgatctgcctgcctcagcctcccaaagttctgggattataggcgtgagccacccaccagacccrgcccaagattttccattctaaccaagcatctagccactcacagaaggtctttgaggtcttgaaggggaaaaaaacatgctatgtgcaggttaattgcata

SEQ ID NO: 52859 - DNA, 201 bp, Homo sapiens
cctcaatgatcatttctcaacaattcctcaccgcaggagcctctgaagctcccaccaggccagctctcctcccacaacagcttcccacagcatgaagatcyccgtggctgccattcccttcttcctcctcatcaccatcgccctagggaccaagactgaatcctcctcacgtgagtgcaatgccttgtcttccttccaacc

SEQ ID NO: 52860 - DNA, 201 bp, Homo sapiens
acagatcctgaatgtccaggccccacgtggcctgttctaaggcctgagatggaattggatacaggacacatccagccttgagatcttttgctaagtgtgasacagtgcccccagccctgtgctcatgttcatgcctagggaaaggcttctatcaaaagagttgaacttcttcccactggggatggaagaccatttcctccc

SEQ ID NO: 52861 - DNA, 201 bp, Homo sapiens
caaaaccttttcttcaagcaatatcttccacagaggcccaatatgtaaaacagaaaaaatgggttgagtagggtacaagacaccactctcaaatgcagcarggcctccacaatagtccctgaggcccccagagctccagggagctcagtgtaaaaaccactgatgcagtccaagggcctcatttacagaggagggaacagg

SEQ ID NO: 52862 - DNA, 201 bp, Homo sapiens
gagctgccatcagcagagaaaggaaaaaacaggctgtgttgactgggaaatctgaggagcagggaggatggggccccctgtctccatctgcccacacctcrgtttgtaatctttctctcccttgttccccagattcctcaccaagaaggggcggcaagtctgtgccaaacccagtggtccgggagttcaggattgcatgaa

SEQ ID NO: 52863 - DNA, 201 bp, Homo sapiens
aataggaataagaatgatgcttgggtgcaaaaagtcatatctaattcattgctaagtctccacatttttatgcaacatcggagcaaaaagaggaggacatktatactagaggcaaccaacctgggactcaagtatccccaggccctagttggactggccagtgactgaagggaccaacataagattgaaccacagcattta

SEQ ID NO: 52864 - DNA, 201 bp, Homo sapiens
tgggtcccttctcccctgattcttcccttggggtaggaagcactagcacaatgccctacttgggaggggagcatatgcagtgtgtttactggagctgtacrcatgctcacttgaggtgttcttccctttactgatggaatgcccccagaaggtcctagatgagttaaactccaccattttgcctcttgacgcgcatgcatg

SEQ ID NO: 52865 - DNA, 201 bp, Homo sapiens
atatgcatcaaagatgtatttaactcattagtgagagaactattaaaataattcaaagatcatttgagtaacagagatttgtatagtttactggggatgaygttctgaaataagtttgttaaattagagcacacattaatatcctgtggatagggcaataaaaaaacctgtaacctctgggattatcttttttaatagaca

SEQ ID NO: 52866 - DNA, 201 bp, Homo sapiens
gagatctttcacctccttggttacatgtattactacgtttgtgtgtgtgtgtgtgtgtgtgtgtggctattgtaaatgagattgcattcttgatttggcaytcagcttgaatgctattggtgtataaaaatgctactggtttttgcacattgattttgtgtcctgaaactttactgaagttgtttatcagttccaggagac

SEQ ID NO: 52867 - DNA, 201 bp, Homo sapiens
ttatttacatttcccaagagaaggaggtacaccgtgacacacggggccccaagggaagcatccagggcaggagtcacgggcaggagtcacgggcaggagtyacaaacaggagggaagggacaacctatgccagaacctttattggggtttctcgggggaaagcaaggcagcacagagcatacactttagggctgggtagtc

SEQ ID NO: 52868 - DNA, 201 bp, Homo sapiens
tatccttggtggggccaaggaagactatttcaatcaaacacagcaatttttctgtagcaaacacatgaatatttctgctaactgggatgaataaataccayaatagactcacttcacttaaggggatactgtgccaccataaacgctgataaaacctctctgtttccagagccctataataaaaaattattccagaaatgt

SEQ ID NO: 52869 - DNA, 201 bp, Homo sapiens
ttgggtcccttctcccctgattcttcccttggggtaggaagcactagcacaatgccctacttgggaggggagcatatgcagtgtgtttactggagctgtaygcatgctcacttgaggtgttcttccctttactgatggaatgcccccagaaggtcctagatgagttaaactccaccattttgcctcttgacgcgcatgcat

SEQ ID NO: 52870 - DNA, 201 bp, Homo sapiens
aaagcaaacactctcctttgctccatgggtgccagggcaggcatccccaactcaggcttggccaacctatgctccctttcagagatctgagcctggaacargtgttgcagagaagcagaaaaagagaggactcacaccagttgactcttgtggcatgattttggatgtggcattggagctggtctctctaggattctacct

SEQ ID NO: 52871 - DNA, 201 bp, Homo sapiens
atggaacttatttaaaaagcaccagcagggtatagacctggctctgtctgcagcctttggaccctggcggggaaaggtacacagatgactggtcccatttrgggccaattatttcccttttcacagcaaaaattatctgattttttcccttagctgatattttagctggaacaaaagaactgtaattaaattgtaaatttg

SEQ ID NO: 52872 - DNA, 201 bp, Homo sapiens
ctggaacaagtgttgcagagaagcagaaaaagagaggactcacaccagttgactcttgtggcatgattttggatgtggcattggagctggtctctctaggmttctacctcggcctcccaggttcaagcaattctcctgcctcagcctccctactagctgggattacgtgcctgccaccagacctgactaatttctgtattt

SEQ ID NO: 52873 - DNA, 201 bp, Homo sapiens
aacccaacctcaatggcttagattaaatgctaccataaaaccttcccccttcatcccagccagaaggacccacctccatttctctggaatcttgaaacatrtatttattgccactcaaaaagatttttattgagtggctgctttaggttatgcattgtgctaggcattaggaaaaccatgaaaaccaaacaaagtagacta

SEQ ID NO: 52874 - DNA, 201 bp, Homo sapiens
tcaaaaagatttttattgagtggctgctttaggttatgcattgtgctaggcattaggaaaaccatgaaaaccaaacaaagtagactattgcccttcaagamtatgtcagtccagggccgggcacggtagctcacgcctgtaatcccagcactttgggaggccaaggtgggcagatctcctgaggtcaggagttcaagacca

SEQ ID NO: 52875 - DNA, 201 bp, Homo sapiens; identical to SEQ ID NO: 15205

SEQ ID NO: 52876 - DNA, 201 bp, Homo sapiens
caagatttttttttttttttttttttttgagatggagtttcactctgtctcccaggctggagtgcagtggtgcgatctcggatcactgaaagctctgcctmccaggttcaatgaattatccttcctcagcctccagagtagttgggattaaggcatgcgccaccaagcccagctgatttttgtgtctttttagtagaggcg

SEQ ID NO: 52877 - DNA, 201 bp, Homo sapiens
cccccttccctccctccctcctgtagtagtccccagcgcctattgttgccatctttatgtccatgtgtaaccaatgtttagctcccacttacaagtgaaarcatgtggtatttggttttctgttcctgcattaattcagttaagataatggcctccaactttatccatgttgctccaaaggacatgatttcattcttttta

SEQ ID NO: 52878 - DNA, 201 bp, Homo sapiens
cggtttcatggtaactacttcattcttcgagacagtcttcaaggaccttctaacttcctattccaacttgcagaaatgctttctggacctgccaaaataataataataataataataataataagtcatactgggatttcttctcatcacacacctgagttcattccaccatgacacgtagcccaaaacttcctcttcctc

SEQ ID NO: 52879 - DNA, 201 bp, Homo sapiens
cttgttgcccaggctggtcttgaactcctgggctcaagtaatcctcctgcctcggcttcccaaaatgttgagattacaggtgtgagccaccacacctggcstctggcatacattttgatccagttatgaccttttatgtctctctcactgctccactgaatgctgttgaattcagaagctttgagttgaaagcagctcact

SEQ ID NO: 52880 - DNA, 201 bp, Homo sapiens
tttttagtagagacagggtttcgccttgttggtcaggctggtctcaaactcctaacctcagatgatccacccacctcggcctcccaaagtactggaattamcggcatgagccactgcactcagcctctacctacttttcaagccttcctgatactacctaaaatctttgcagtaaagtcctttttgcttaatcaaccagag

SEQ ID NO: 52881 - DNA, 201 bp, Homo sapiens
gaaggacccacctccatttctctggaatcttgaaacatgtatttattgccactcaaaaagatttttattgagtggctgctttaggttatgcattgtgctargcattaggaaaaccatgaaaaccaaacaaagtagactattgcccttcaagaatatgtcagtccagggccgggcacggtagctcacgcctgtaatcccagc

SEQ ID NO: 52882 - DNA, 201 bp, Homo sapiens
ttttaagttatttgagaaatcaccaaactgcttttcacagtggctgaactaatttacattcccaccaacagtgtatatctgttccctttttctctacagcrtcaccagcatgttatttttttgactttttactaatagccattctgactggtgtgagacagtaactcattttgggtttgatttgcatttctctgatgatta

SEQ ID NO: 52883 - DNA, 201 bp, Homo sapiens
gggaccttaccacccctcagagtgctgcttcacctacactacctacaagatcccgcgtcagcggattatggattactatgagaccaacagccagtgctccragcccggaattgtgtaggtggtacacacacatcacactggggggagagggagccagcagggcctcctggagggaagcagggagtggtggtggaatgggga

SEQ ID NO: 52884 - DNA, 201 bp, Homo sapiens
tttccatttgttcatgtcatctatgatttctttcagcagtgttttgtaattttcattgtagagatctttcacctccttggttacatgtattactacgtttktgtgtgtgtgtgtgtgtgtgtgtggctattgtaaatgagattgcattcttgatttggcactcagcttgaatgctattggtgtataaaaatgctactggtt

SEQ ID NO: 52885 - DNA, 201 bp, Homo sapiens
ttgttgtgtctggtaatgaaagtaatgcatctaataaagagtattcaattttttaactttgcttgagttttaagaggaaataaactaatataaaactgaarcaactgctgagccccaacatgattaaatacaaattcaccttatatctcatcttctcccttctactgaaatagctaatcttcaaagggttggctacaattt

SEQ ID NO: 52886 - DNA, 201 bp, Homo sapiens
gtagttctgaacagtaagtgatcagatacggcatacatttaaaagcagccagcaggtgcaggtctgcactatgggatccattgtccctgtttacagaatgrgaggagaatgagagggtcctgagggtggtgaatatctccaagggagatcaggacagggtagggggaccccctccatagatgccttctctgttcccctctg

SEQ ID NO: 52887 - DNA, 201 bp, Homo sapiens
ctgtttccagagccctataataaaaaattattccagaaatgtgtagaaaaacttgtagactgtgtcacatcatgtagacattccattaactgaaccgtgtkaggttcagttgcttttagtatttcagagtcaatacaaagttttcatgtctacattttcaaaaggtctctgaaaagtctcagggccctaatggaataaatg

SEQ ID NO: 52888 - DNA, 201 bp, Homo sapiens
gcagccagcaggtgcaggtctgcactatgggatccattgtccctgtttacagaatgggaggagaatgagagggtcctgagggtggtgaatatctccaaggragatcaggacagggtagggggaccccctccatagatgccttctctgttcccctctggctgccccaagagcctgctcctttggagaagaaggtgctctctg

SEQ ID NO: 52889 - DNA, 201 bp, Homo sapiens
gggaaattttcttggtcctgctgtggcccaccctgagtgccctcagacacatggcaaaaccctggggagggtctgaagcagggagaggccagcaagtgctrgccgaggaggagaaacatgtcttcagaggcttgtgccttctcaccctccactgtgctttcgaggagaaagatttgccctcagatgacgctttctcttgct

SEQ ID NO: 52890 - DNA, 201 bp, Homo sapiens
agagcgtctgggcagtgtggatgccaaagggccacttatgaaggtgttgggtcatggcaactcaacagaaatgagggatgaaaaccaagactttccattctttttttttttttttttttagatggagtctcactctgtcacccaggctggagtgcaggggtgccatcttggctcactacaacctccacctcctgggttcaa

SEQ ID NO: 52891 - DNA, 201 bp, Homo sapiens
cttcctggatcctcctcttcttataaatacaagggcagagctggtatcccggggagccaggaagcagtgagcccaggagtcctcggccagccctgcctgcycaccaggaggatgaaggtctccgtggctgccctctcctgcctcatgcttgttgctgtccttggatcccaggcccagttcacaaatggtgagtccagtgag

SEQ ID NO: 52892 - DNA, 201 bp, Homo sapiens
ggaggatgagcaatggggtgggtggagatgttgaaacatactgctgccacccagtgatttccttccctgtactgtttctttcagatgcagagacagagttmatgatgtcaaagcttccactggaaaatccagtagttctgaacagtaagtgatcagatacggcatacatttaaaagcagccagcaggtgcaggtctgcact

SEQ ID NO: 52893 - DNA, 201 bp, Homo sapiens
agacgtggtggtgtgcacctgtaatcccagctactcgggaggctgaggcaggaaacttgcttgaaactggaaggcagaggttgcagtgagccgagatcatsccactgcactccagcctgggtgacagagtgagactctgtctcaaaaaaaataaaaaataaaaaagaatatgtcagtttatagagaagactgaaaatagga

SEQ ID NO: 52894 - DNA, 201 bp, Homo sapiens
cttacagagggactgtgtgggaggggggaacagtgctctttgggagagtcaatcaggccagtgcagtgggttcaggcttcaagaaagagaaaatggcccacccaaagcatggatcagcaagatggtgctctcaagatgtcccaagctttgccactcactggaggcaaaggggtcaagctacaaaaagatttgcactctgaa

SEQ ID NO: 52895 - DNA, 201 bp, Homo sapiens
ttgtccttgaccagaagttatccagggcactgcccaattctctctctggtccactgtcccctccaagaggttcccacagcaaatatccttttttattttgaaaactgtgcttgtagctttatcctggggcaaatgccctacctgactatcctgaatgggaactagcaaggtcatagcttattcactcaatgcaaatgtctt

SEQ ID NO: 52896 - DNA, 201 bp, Homo sapiens
tctgaacagtaagtgatcagatacggcatacatttaaaagcagccagcaggtgcaggtctgcactatgggatccattgtccctgtttacagaatgggaggrgaatgagagggtcctgagggtggtgaatatctccaagggagatcaggacagggtagggggaccccctccatagatgccttctctgttcccctctggctgc

SEQ ID NO: 52897 - DNA, 201 bp, Homo sapiens
ggagtgcagtggcacaatcttggctcattcaccttggctcaacctcctgggctcaagtgattctcccacctcaggcccttgagtagctgggactacaggcrtgcaccactccacacccagctaattttgtttatttttttagagacatggtctcacttgttgcccaggctggtcttgaactcctgggctcaagtaatcctc

SEQ ID NO: 52898 - DNA, 201 bp, Homo sapiens; identical to SEQ ID NO: 15203

SEQ ID NO: 52899 - DNA, 201 bp, Homo sapiens
ctcggccagccctgcctgcccaccaggaggatgaaggtctccgtggctgccctctcctgcctcatgcttgttgctgtccttggatcccaggcccagttcayaaatggtgagtccagtgagctttctcccaggtgaccaggtccatggtaactcaagctctgggacggagacatgttgtgactactctccagcccagacatg

SEQ ID NO: 52900 - DNA, 201 bp, Homo sapiens
gaatcttaatttgtggaggtgaatgtcaacgcaaagaggtcaatgacattgaaaaaagaatgtattatttacatttcccaagagaaggaggtacaccgtgmcacacggggccccaagggaagcatccagggcaggagtcacgggcaggagtcacgggcaggagtcacaaacaggagggaagggacaacctatgccagaacc

SEQ ID NO: 52901 - DNA, 201 bp, Homo sapiens
aggacctggtgacgggggtggggaggacaaagacgtgtacctgccctaggctgccccagccattcttttcgcttttgtttttttgtttgtttgcttgttgkgttttgttttgttttgttttgtttgtgatggagtttcgctcttgttgcccaggttggagcgcagtgtcgcgatctcggctcaccacaacctccgcctccc

SEQ ID NO: 52902 - DNA, 201 bp, Homo sapiens
cacgcctcctgccctgctcctgtgcccacaccggatgccagagagtttctgtgtgtgggcagaggactgcagggcgctcacgcttgctgtgaagtaaggcrtttgaaggtgaggctaagccttgacttggtgaggatgaggaagaaggcagaggggagtaaagaggtgggattgaggcagcggttggacgatttggggtgc

SEQ ID NO: 52903 - DNA, 201 bp, Homo sapiens
ggccgggcaggtggcggatgccctggtggacctgaccggcggcctggcagaaagatggaacctgaagggcgtagcaggaagcggaggccagcaggacaggmcaggccgctgggagcacaggacttgtcggcagctgctccacctgaaggaccagtgtctgatcagctgctgcgtgctcagccccagagcaggtgaggcacg

SEQ ID NO: 52904 - DNA, 201 bp, Homo sapiens
gaggactgcactctgtccctctgctgcaggggggggtgccttggcctcgccagaaggctccatcagggaggttcgccctgctctgtgctctcctgaccccyggactccatggagtcagatcaccacgtttagaataaagagacaaatgtgccagctcacaggaggacggggctggctggcagcctctgcctcagatctctc

SEQ ID NO: 52905 - DNA, 201 bp, Homo sapiens
aggtgtccatgtgggaactgaggccaccgggaacctgctgccagcgccctcccatgtttgtcttcttggcagcgccatcagggcagtggccaagaacaccrcccccggggcagccctgcctgcgggggagtgggggaccgtgcagctacggggttcttggagagtcggccagacggcggggggcagcaggaactttgcctc

SEQ ID NO: 52906 - DNA, 201 bp, Homo sapiens
atccaggcagggcaggtttccagaggaggtggtgagtggggaggaagggagaagtttggagaggacaggaggccgaggttgagaccagcgggggtgggtcragccctggcttgggaacgcagggggctgatggactcaggagtgagaggaggggaggcccaggctggctggccacagcagcccctcgggtgtgaggaagtc

SEQ ID NO: 52907 - DNA, 201 bp, Homo sapiens
ggccttcacagtgaccatcgcaaccaggattgacaggtggggctctgggacttgggggcggccagctggaggctggggtgctggagtcttagtgctcgccygtccccccacgtctcctgcctgcccctcaccctcaagcccctatctgtcctggcagaccagggctgtcctgcctacctggggacccttccttgctggtct

SEQ ID NO: 52908 - DNA, 201 bp, Homo sapiens
gtagctttttatgtgactggctacacagccctgtcaggactaagtgggaagaagtaagcttgttctcaagggtggtgtcctcagtttgtgaccttcccctrctgtcctcttccagagggacgtggcccttctctcccctgaccagtcctttccactagtgcgaggcaggaagaggtggcaccgagtcaaagcccactgtct

SEQ ID NO: 52909 - DNA, 201 bp, Homo sapiens
cagctggaggctggggtgctggagtcttagtgctcgcctgtccccccacgtctcctgcctgcccctcaccctcaagcccctatctgtcctggcagaccagrgctgtcctgcctacctggggacccttccttgctggtctgagcctggaaggagagtctagtgggaggtgggccaggagcacacagccacttgtgtgacaag

SEQ ID NO: 52910 - DNA, 201 bp, Homo sapiens; identical to SEQ ID NO: 15297

SEQ ID NO: 52911 - DNA, 201 bp, Homo sapiens
gcagaggcctgtgtgtccttgtcagtttgggactccatggtgcccttcctgcctgtgcctgcgccattcctcatgcaggtgcccgggagctgggggagttycatgccttcattgtctcggacctgcgggagctccagggtcaggcgggccagtgcatcctgctgctgcggatccagaacccctggggccggcggtgctggc

SEQ ID NO: 52912 - DNA, 201 bp, Homo sapiens
ggcgcacactccatgcctggttagttttttcaagttttgaatgcttaggggtcttagtatgtggttgcctaggctggcctcagtgatcctcctgccttggyctcccaaagcactaagattgcaggcatgaccgccaaccccagctctaatcccttttaaattccattcgcttcctgagtccctttgtgcctggggagaccc

SEQ ID NO: 52913 - DNA, 201 bp, Homo sapiens
ctgtcccaggagctgggaggagggtgggcttgtgggaggggctggctctgtctgtggccgtagctgctgcttagaccctgccagggttcatgaggccaccrtggcgggaggccagcgaggagccgtgtcccacagctgatgcctggtgttttctcactagagaggctgctctgccatacgcgggcgctgcctggggcctgg

SEQ ID NO: 52914 - DNA, 201 bp, Homo sapiens
ggctcctccaacactggggattataattcgacatgagatttgggcaggaacacaaattcaaaccatagcacccagtgagcctgatttgggccttgctgccsgatcacgaccatctctggagtcctggtgtctgttcccactgggacctgtgccgctgtccccctctccacgccctggccacgccaagccaccctcctgact

SEQ ID NO: 52915 - DNA, 201 bp, Homo sapiens
taccattgcccagcttgaagtttcctatagtttatctataggtgatctttatcacgttgaggaagttctcttctctttctagtttgccgagagtttctatyattcatggatgttgcattttgtcaaatatttttctgcatccattgagataaatatatacattttaccatttattctattaattgatgttctaatgctaaa

SEQ ID NO: 52916 - DNA, 201 bp, Homo sapiens
gtctgggttctaggactggctctgccgggacacatgtgactctgccacgggccccaccagtctcccccctccttgggctgttgcacggggttgacgtctgytggtgctcccagacccggctctgacctgagactgcaggtctttctgccttgccgtgtgcctcattggccaaaggaaagcaacagagtctgcagccagggc

SEQ ID NO: 52917 - DNA, 201 bp, Homo sapiens
tttaccattgcccagcttgaagtttcctatagtttatctataggtgatctttatcacgttgaggaagttctcttctctttctagtttgccgagagtttctmttattcatggatgttgcattttgtcaaatatttttctgcatccattgagataaatatatacattttaccatttattctattaattgatgttctaatgcta

SEQ ID NO: 52918 - DNA, 201 bp, Homo sapiens
ggccgtaaagtggcagagccaggaccgcaccaggtgcctggtgcccagcctgcactcccccgatgctgggtcagaatgcttacccctgaaggagccctgcrgtggacgctgtgggtgcaagcagctggcccagtgtcggggcgccaggctcccagcagcaggaggggctgctgttcctgtggtgacgtgttgcttgcagcc

SEQ ID NO: 52919 - DNA, 201 bp, Homo sapiens
ctttttcttctgccttaggattttctttttcttctttctcctccttctcttcctcctcctcctcctcctcttctttcttctttcttcttcttcttctcttytttgtttttaaattgagacaggggctcactctgttgcccaggctggagtacagtgatgcaatcttaactcactgtagtctcaaactcctgggctcaagtg

SEQ ID NO: 52920 - DNA, 201 bp, Homo sapiens
gaggttcgccctgctctgtgctctcctgacccccggactccatggagtcagatcaccacgtttagaataaagagacaaatgtgccagctcacaggaggacrgggctggctggcagcctctgcctcagatctctcctcagctagctcgctggttttcttacaggttttgaatataagtttgcaaaaagttattaaacctgtt

SEQ ID NO: 52921 - DNA, 201 bp, Homo sapiens
gcagagctgtgccgcagccggatctcctgctgtgttgggggaaggcaggagagttccaaggcagaggctgaggactgcactctgtccctctgctgcagggrggggtgccttggcctcgccagaaggctccatcagggaggttcgccctgctctgtgctctcctgacccccggactccatggagtcagatcaccacgtttag

SEQ ID NO: 52922 - DNA, 201 bp, Homo sapiens
ccgggcaggtggcggatgccctggtggacctgaccggcggcctggcagaaagatggaacctgaagggcgtagcaggaagcggaggccagcaggacaggccrggccgctgggagcacaggacttgtcggcagctgctccacctgaaggaccagtgtctgatcagctgctgcgtgctcagccccagagcaggtgaggcacgtg

SEQ ID NO: 52923 - DNA, 201 bp, Homo sapiens
ctgggttccccctgcccaggcccagtttggttctcttcagcgtggagagatgattctgtcccaggagccgggaggagggtgatgattctgtcccaggagcygggaggagggtgggcttgtgggaggggctggctctgtctgtggccgtagctgctgcttagaccctgccagggttcatgaggccaccgtggcgggaggcca

SEQ ID NO: 52924 - DNA, 201 bp, Homo sapiens
cccaggccttggtttccccacctgtgcagcatggatttggggctgagggtacaaagactggcacccacctgagccgttggaacaggcctgcccctggtccygaggaggactctgctctcccggttctccccttgcccatgtggaagggggctcatcccccagcatgggtgcttcctgcctggtgtccatctctgtgtgagt

SEQ ID NO: 52925 - DNA, 201 bp, Homo sapiens
ctcccgccaggctcctggggcaccgccaccactcccgccaggctcctggggcaccgccggccactcccgccaggctcctggggcaccgccgcccactccckccaggctcctggggcaccgccgccactcccgccaggctcctggggcaccgccgccactcctgccagcctcctgcggcacagctgccactccctattaacc

SEQ ID NO: 52926 - DNA, 201 bp, Homo sapiens
ttttcctgctttctgggccagtggccacaggccacccagtgacatttctctctcagcgtctgctggggtggactctgcagcggctgcagccagcctggatsggctcctcgcacagctctgcttgagggtgaaggccatctagaaaccctcagtcccctctcagcctcagagctgatagcgctgcctgaccatcagcaagct

SEQ ID NO: 52927 - DNA, 201 bp, Homo sapiens
tggctcagcctccccaggcagactaccccatggcatccctggacaaggctgcccccaagaacgctgcccacagcccagccatgggccttcccttggggctmccgccccggctcacacctgctggccagcgtatttactccttgctggctgcaccctctcagcagtggctgtgtagaccataaccctgggaacacctgcggg

SEQ ID NO: 52928 - DNA, 201 bp, Homo sapiens
ctgggaaaagagagggctccagggtggccgctgcccagaaggccctgtgctgcagagctgcttcgggtgtgggaggggctgcagagctggggcacggggtygctggcaggaactcagggctctctgggtcccctccaggcttccccccagcctgccggcaagttgacactaccagttctcgggaggggcttctgctgagat

SEQ ID NO: 52929 - DNA, 201 bp, Homo sapiens
ggggtgggccgcgtctgtgcaggctcagaagcttcctaagaggctggagagtggaaccttcaggcaccacgcactgcctcctccctgcccacggtcctggkttctccagatggggccttggccttggctaggtgttgatcaggagctgggagtgctgcgccccgcccaacttctccaaactccagccagggcacctcagtg

SEQ ID NO: 52930 - DNA, 201 bp, Homo sapiens
gctgggagcacaggacttgtcggcagctgctccacctgaaggaccagtgtctgatcagctgctgcgtgctcagccccagagcaggtgaggcacgtggccarcatgggagggctgcagccagcgtgccccccactgccaggcctcaggcacactgtagctttttatgtgactggctacacagccctgtcaggactaagtggg

SEQ ID NO: 52931 - DNA, 201 bp, Homo sapiens
cctggtcactggatgttgctgacacttcactcggtcagagccctagcacccaaggggggccagggcctgacgggggtggagcgaggggtgggccgcgtctstgcaggctcagaagcttcctaagaggctggagagtggaaccttcaggcaccacgcactgcctcctccctgcccacggtcctggtttctccagatggggcc

SEQ ID NO: 52932 - DNA, 201 bp, Homo sapiens
tccatagcttccacgcctcctgccctgctcctgtgcccacaccggatgccagagagtttctgtgtgtgggcagaggactgcagggcgctcacgcttgctgygaagtaaggcgtttgaaggtgaggctaagccttgacttggtgaggatgaggaagaaggcagaggggagtaaagaggtgggattgaggcagcggttggacg

SEQ ID NO: 52933 - DNA, 201 bp, Homo sapiens
gtcctccttattttatcggccccagcaagaaagatgcttctttatatttgttgtggaatggttgggacaggcagactcattgtgtagtcgttggggaggartgaggctaccccagcataccaacacttgtgtatcacggtgcttgctggctcaggggaccaggaccctcaccatgagtcataattgaatagccttccctct

SEQ ID NO: 52934 - DNA, 201 bp, Homo sapiens
tctgggctgcagagcccccttcagttctgagggtctggcagctcattctgtgagtcaggctgacaggccaggtgcagagattcttcttttgggcctgtggwttgcccactccctgctttcccttcccttgttccaaagcccagcgtggagtcgttctccacagagaacatgtgtgccgtcctccttattttatcggcccca

SEQ ID NO: 52935 - DNA, 201 bp, Homo sapiens
gtgctgcagagctgcttcgggtgtgggaggggctgcagagctggggcacggggtcgctggcaggaactcagggctctctgggtcccctccaggcttccccscagcctgccggcaagttgacactaccagttctcgggaggggcttctgctgagatgaggtttcttccaggggtgaagggtggagccaggtagatgcagcgg

SEQ ID NO: 52936 - DNA, 201 bp, Homo sapiens
cttagttggcagcttcctcctccttctctctattcccctcctaggtctcttgccctgtgcagcttcctgcagactggacttgcaaagtccagcctgtatgrctggagttcccatgcctgccaatctcctgtcgactgcgagtcagctccgatacttcaccagattcaggtgagagttttggttttttgacaagcccacttc

SEQ ID NO: 52937 - DNA, 201 bp, Homo sapiens
gggcacggggtcgctggcaggaactcagggctctctgggtcccctccaggcttccccccagcctgccggcaagttgacactaccagttctcgggaggggcytctgctgagatgaggtttcttccaggggtgaagggtggagccaggtagatgcagcggtagcatctgagctcctgtcccagctccaggaaggggagttctg

SEQ ID NO: 52938 - DNA, 201 bp, Homo sapiens
atcggagtgaccaccctcagccctcctggacccctctgccggctccacctgagcgctgccctcgctggcagccctgccttgctctgctgccattccgtaakccctgcaggcaggccccttggcgcccttcagccgtgttcatgattgtctcctggcctctgctgtttagaggtctaatgccctccgcccccggcgagccaa

SEQ ID NO: 52939 - DNA, 201 bp, Homo sapiens
cgcctacgcctaccctccaccagccacagcagttgtggcatctctaccctgcccagcaaaagtggaagtgttgcctgtgccgctaggaacctccaggtttrctccacctccaggggccttgccagggtgtcaaacctgtgtctcgggacactgctgttaggtctccagcttccctatcaggcgcctcagcacccagtccta

SEQ ID NO: 52940 - DNA, 201 bp, Homo sapiens
ggagccaggacgcacccccactgctgctgcaggagccgctgctgagctgcgtgccacatcgctacgcccaggaggtgagccggctctgcctcctgcctgcrggcacctacaaggttgtgccctccacctacctgccggacacagagggggccttcacagtgaccatcgcaaccaggattgacaggtggggctctgggactt

SEQ ID NO: 52941 - DNA, 201 bp, Homo sapiens
gaggggttgaggcccccttctcccctgcctgacgacgacggcggcaggaactcgaccggcgccggacagctcgcaacttgccttaccaagcgtaaatctcrgttcctcccaactacccgcggccacggcctccgcagcagagcgccggaagcagagacgcgtttcgggaggaaggtgcatgctgggagcggcggcgcatgc

SEQ ID NO: 52942 - DNA, 201 bp, Homo sapiens
agggccccacctgggctggccaggcccttatgttgagcatcccttcccccaggccctcaggagccactgtccccgaggcaggccctgaaggtggcggccamaccctcctgctgggcagctctgcccaaaggccacagccaggacctgcttcccgcgtcccaggctactgcctgagaggaggcctcgaaagcgcagggttcc

SEQ ID NO: 52943 - DNA, 201 bp, Homo sapiens
gcagggccccacctgggctggccaggcccttatgttgagcatcccttcccccaggccctcaggagccactgtccccgaggcaggccctgaaggtggcggcmacaccctcctgctgggcagctctgcccaaaggccacagccaggacctgcttcccgcgtcccaggctactgcctgagaggaggcctcgaaagcgcagggtt

SEQ ID NO: 52944 - DNA, 201 bp, Homo sapiens
ctaccagctggaaccatgttcctgggtgtggaaaacgctccctccgaagcctgcggagagccctgaggccttgtgcttccttctgatgggaggttccagaygcagttggaggggatgtctggcagggctctaacccccagccaacctaaacatttctggtgcagaaggccccggcctggtgttgtttgtccctggctgcct

SEQ ID NO: 52945 - DNA, 201 bp, Homo sapiens
gagttgcgcagagggaggaaccccaggttcacgtggactgggagccttggatctggacggctcctctgcctccagccagggttcacctgcgcagtgtcctrggattgtttatttccccaggcctctctccctcgtccctcacaccaaatgctgtgatgagagctgtagtgtcactgaacggtgcagaagacagttccagac

SEQ ID NO: 52946 - DNA, 201 bp, Homo sapiens
tgggggattgctggttcctgtgtgcctgcgccgcgctgcagaagagcaggcacctcctggaccaggtgcggggccccttccctgtgtttgtcctggagccrgtttctttttgcgtttctccagcctgctgagtaccaggaggccttgcgaaagcagagctgtgccgcagccggatctcctgctgtgttgggggaaggcagg

SEQ ID NO: 52947 - DNA, 201 bp, Homo sapiens
ggatgtctggcagggctctaacccccagccaacctaaacatttctggtgcagaaggccccggcctggtgttgtttgtccctggctgcctcctgctctgacrccatcagcatcctgttgccaaggtcatggatcagtgcggtgctcttcagggtgtccggccagctggggtctctgtcctgtattccggcagaggccccagg

SEQ ID NO: 52948 - DNA, 201 bp, Homo sapiens
ccactgtccccgaggcaggccctgaaggtggcggccacaccctcctgctgggcagctctgcccaaaggccacagccaggacctgcttcccgcgtcccaggstactgcctgagaggaggcctcgaaagcgcagggttccgtgactttagaggccatggttggcacccatcatcgccccagtgtagattggctccactcgacc

SEQ ID NO: 52949 - DNA, 201 bp, Homo sapiens
aagagcaggcacctcctggaccaggtgcggggccccttccctgtgtttgtcctggagccggtttctttttgcgtttctccagcctgctgagtaccaggagsccttgcgaaagcagagctgtgccgcagccggatctcctgctgtgttgggggaaggcaggagagttccaaggcagaggctgaggactgcactctgtccctc

SEQ ID NO: 52950 - DNA, 201 bp, Homo sapiens
catcagcatcctgttgccaaggtcatggatcagtgcggtgctcttcagggtgtccggccagctggggtctctgtcctgtattccggcagaggccccaggaraaacagcaaatgcctttgtccattccatacaaatttcatataaatgtgagcagcttctgatcttccgtggcgtattcgtccagttgatggccaaccctgg

SEQ ID NO: 52951 - DNA, 201 bp, Homo sapiens
gcctttccatggggtccagggctgtggggtccctggcggtactgtgggcctgcagagcggggcatgtgggctgaagaccgtctccccaccatggtgggaarggacaaagggtggccctggcagatccggacgggcaggactgggtgtgtcccatgagagcacctccttcctggcctttcctgtggactttgtcccacacca

SEQ ID NO: 52952 - DNA, 201 bp, Homo sapiens
ctgaggctgcgtcccattccctggctgcactcggggtggggtgtgagaaggggcgagtgccaccgctgcccgggccccccatctgtctttgcaggtctccrtcatggcagtgatgaaaacctaacagggtggccccctgtgccagctcaggtgactggagcccgagggcctgacaggttcccagcagctgggccggccagc

SEQ ID NO: 52953 - DNA, 201 bp, Homo sapiens
tcttagttggcagcttcctcctccttctctctattcccctcctaggtctcttgccctgtgcagcttcctgcagactggacttgcaaagtccagcctgtatsgctggagttcccatgcctgccaatctcctgtcgactgcgagtcagctccgatacttcaccagattcaggtgagagttttggttttttgacaagcccactt

SEQ ID NO: 52954 - DNA, 201 bp, Homo sapiens
gcagtggctccacaggatgcatacgaggtccccgcggtcccggccgacatacctgttgggttcttagttggcagcttcctcctccttctctctattccccycctaggtctcttgccctgtgcagcttcctgcagactggacttgcaaagtccagcctgtatggctggagttcccatgcctgccaatctcctgtcgactgcg

SEQ ID NO: 52955 - DNA, 201 bp, Homo sapiens
gtggctccctcggtgtggtcctcaagttttgcaatgagaggtctgttaatttcatgtgggtgatgcagccctgtgcaggcgccgacatccaggtgtgccgwagagttctctgcgacatccaggtgtgccgtagagttctctgcgacatccaggtgtgccgtagagttctctgcgacatccaggtgtgccgtagagttctct

SEQ ID NO: 52956 - DNA, 201 bp, Homo sapiens
gtcccaacctcgacagcagtggctccacaggatgcatacgaggtccccgcggtcccggccgacatacctgttgggttcttagttggcagcttcctcctccktctctctattcccctcctaggtctcttgccctgtgcagcttcctgcagactggacttgcaaagtccagcctgtatggctggagttcccatgcctgccaat

SEQ ID NO: 52957 - DNA, 201 bp, Homo sapiens
aggctttgccaagagaaacactctctagatttctggcagttgcagatgcatctgtgcagcatgtttgagaactggtgctgtgccaggcatcgtgcacagaygggtacggacgatgactgaggcctagagaaggggatgacttacccagcaccagacccggatggcagccgagtcaggccccgtgtgcttgctcctggagat

SEQ ID NO: 52958 - DNA, 201 bp, Homo sapiens
gagctctgaggaaaacacatgccagggccagtgggagcccttggggcgggctgggcagtcacaggtgttaaagcccctgatgatgtgacaggcctccaggygggggccccactgccggcaccttctggcaagggtggccaggccttggtgaggaggcgagtccagtgtccaggcctggcagcccctcctcagagaaggggc

SEQ ID NO: 52959 - DNA, 201 bp, Homo sapiens
agcagagctgtgccgcagccggatctcctgctgtgttgggggaaggcaggagagttccaaggcagaggctgaggactgcactctgtccctctgctgcaggsgggggtgccttggcctcgccagaaggctccatcagggaggttcgccctgctctgtgctctcctgacccccggactccatggagtcagatcaccacgttta

SEQ ID NO: 52960 - DNA, 201 bp, Homo sapiens
tgattggattgatcacatagatgactatgaggaggactgacatatttcaatctatgaacgtggtatacccatccatttacttatttttaattttttaaaawttttttttttttttgagacaggatctcactctgtttgtccaggctgaagtccagtggcaggatttcagctcactgcagcctcaacctcctgggctcaggt

SEQ ID NO: 52961 - DNA, 201 bp, Homo sapiens
catgaggtgaggagatcgagaccgtcctggctagcacagtgaaaccccgtctctactaaaaaaaaaaattagccgggtgtggtggcgggcgcctgtagtcycagctactcgggaggccgaggcaggagaatggcgtgaacccgggaggcggagcttgaagtgagtggagatcacgccactgcactccagcctgggcgacag

SEQ ID NO: 52962 - DNA, 201 bp, Homo sapiens
aaatgtgagcagcttctgatcttccgtggcgtattcgtccagttgatggccaaccctgggtacctggacctccaggacctgctgcactgggctgcccctcrgctgtgtgtgcactcgccacgtggccctccaggaatcccatcccacggggccacactgaaccaaatggagagagcagggccaccaccctctctccgcatg

SEQ ID NO: 52963 - DNA, 201 bp, Homo sapiens
gttgatggccaaccctgggtacctggacctccaggacctgctgcactgggctgcccctcggctgtgtgtgcactcgccacgtggccctccaggaatcccaycccacggggccacactgaaccaaatggagagagcagggccaccaccctctctccgcatgccacggctgctctgggacccgggcaggaggggacagtcttg

SEQ ID NO: 52964 - DNA, 201 bp, Homo sapiens
tctcagctcattgcaatctctgcctcccaggctcaggtgctcctcccgccttagcctcctgagtagctgggattacaggcatgcacccccatgcgtggctrattttttttttttttactttttgtaaagatggggtcttgctatgttgcccaggctggtctcaaacttctgggctcaagccaacctcccaccttggcctcc

SEQ ID NO: 52965 - DNA, 201 bp, Homo sapiens; identical to SEQ ID NO: 15234

SEQ ID NO: 52966 - DNA, 201 bp, Homo sapiens
acggctgctctgggacccgggcaggaggggacagtcttggccttccagtgtccctcttggccttcccacggccatctctaccccaaggatgcagcagagakatcggtcgctccccaggtgtcaatcccagtcacaggctcagagaccgggacatggccccgggtgggtctgtaggccctgtgggctcatgtgagctggtcc

SEQ ID NO: 52967 - DNA, 201 bp, Homo sapiens
gctcatgtgagctggtcctgggcaggactccattattaactgcctgtgatgtgtcccactgtcatggagccctggtgactcttggggaccagcatcagctyggggcctgtgtgctcagtggttcccagatgcctggatattctcttcctggtgcacatagtccccggggaggtccttgtcatgcacacttgctgatgtggg

SEQ ID NO: 52968 - DNA, 201 bp, Homo sapiens
gcaggactccattattaactgcctgtgatgtgtcccactgtcatggagccctggtgactcttggggaccagcatcagctcggggcctgtgtgctcagtggytcccagatgcctggatattctcttcctggtgcacatagtccccggggaggtccttgtcatgcacacttgctgatgtggggagtgtccttcatcttgcagg

SEQ ID NO: 52969 - DNA, 201 bp, Homo sapiens
agtgtgggcccaactggggctctatcggagtgaccaccctcagccctcctggacccctctgccggctccacctgagcgctgccctcgctggcagccctgcsttgctctgctgccattccgtaagccctgcaggcaggccccttggcgcccttcagccgtgttcatgattgtctcctggcctctgctgtttagaggtctaat

SEQ ID NO: 52970 - DNA, 201 bp, Homo sapiens
ctctatcggagtgaccaccctcagccctcctggacccctctgccggctccacctgagcgctgccctcgctggcagccctgccttgctctgctgccattccrtaagccctgcaggcaggccccttggcgcccttcagccgtgttcatgattgtctcctggcctctgctgtttagaggtctaatgccctccgcccccggcgag

SEQ ID NO: 52971 - DNA, 201 bp, Homo sapiens
tgctgccattccgtaagccctgcaggcaggccccttggcgcccttcagccgtgttcatgattgtctcctggcctctgctgtttagaggtctaatgccctcygcccccggcgagccaaacccagtgatggtggttcctgccaccagcttcctgtggcaccgctgccactcccgccaggctcctggggcaccgccaccactcc

SEQ ID NO: 52972 - DNA, 201 bp, Homo sapiens
gagagccagcgaaggcactgccaaggctgtggcgaagaaggacatctcggaaacgggtgttagaaccggagttgcgcagagggaggaaccccaggttcacrtggactgggagccttggatctggacggctcctctgcctccagccagggttcacctgcgcagtgtcctaggattgtttatttccccaggcctctctccctc

SEQ ID NO: 52973 - DNA, 201 bp, Homo sapiens; identical to SEQ ID NO: 15232

SEQ ID NO: 52974 - DNA, 201 bp, Homo sapiens
gcagtgctgctggctctccgaggccacaggcccttccaaggcaggatttgggcactttccctctgtggttggcaggtgtccatgtgggaactgaggccacygggaacctgctgccagcgccctcccatgtttgtcttcttggcagcgccatcagggcagtggccaagaacaccacccccggggcagccctgcctgcggggg

SEQ ID NO: 52975 - DNA, 201 bp, Homo sapiens
ccgctgccactcccgccaggctcctggggcaccgccaccactcccgccaggctcctggggcaccgccggccactcccgccaggctcctggggcaccgccgsccactccctccaggctcctggggcaccgccgccactcccgccaggctcctggggcaccgccgccactcctgccagcctcctgcggcacagctgccactcc

SEQ ID NO: 52976 - DNA, 201 bp, Homo sapiens
tctcctgacctcgtgatctgcctgtctcggccacccaaagtgctggggttacaggcatgagccactgcacccggcctgtctttttgtttttttgagatgargtctcactgtgtcacccaggctagtgtgcagtggcatgaactctgctcactacaacctccacttcccaggttcaagtgattctcatgcctcagcctcctg

SEQ ID NO: 52977 - DNA, 201 bp, Homo sapiens
caactgcagaagctgagcaatcagcctcatcagtggcaattcctggaactccaacctcaactgtaacatgagctgtggcagaccttcagtaaccccagacraggagtgaggcagagcctgatagctcagggaccagctgggatgctcagtaaacaagagctccagaagatacgcggaacaggagaaggtgaagtgtgggga

SEQ ID NO: 52978 - DNA, 201 bp, Homo sapiens
agagtccaggaccaaaccctgaggagccccaacattttagggacccaaatgcaggacagtagagatgaaaggagaggccagcgaaggagcaaaacaaggargcgtgtgtcatggaggccacacgaggaagtggctttgtggttacttctgggacattggcagaaggatgtttcagggcaaagtgcaagggggcctcaaaga

SEQ ID NO: 52979 - DNA, 201 bp, Homo sapiens
ggatttccctatgttggttaggctggtctcgaactcctgaccccaaatgatccacccacctcggcctcacaaagttctggggttacaggcatgagacaccrtgcctggccaatagtctttgtcttttaactggattgtttacctcagtcacatttaatgtaatggttgatatggttgggtttgaacctaccatctgctatt

SEQ ID NO: 52980 - DNA, 201 bp, Homo sapiens
tgatggactcaggagtgagaggaggggaggcccaggctggctggccacagcagcccctcgggtgtgaggaagtccacagtcactgagctcagccagcagcmccttgtccacttaccctgactcagaatgactgtgtcccaaggttcattctctgcagacatgtgtcccctggaatgcaggggccctgacgaggaaggcact

SEQ ID NO: 52981 - DNA, 201 bp, Homo sapiens
agtcgtgaatacaggcctgagggtgaccttccattgggctcgtggtcccaacctcgacagcagtggctccacaggatgcatacgaggtccccgcggtcccrgccgacatacctgttgggttcttagttggcagcttcctcctccttctctctattcccctcctaggtctcttgccctgtgcagcttcctgcagactggact

SEQ ID NO: 52982 - DNA, 201 bp, Homo sapiens
tttgacgagctcaccgttggctacccggtcacggaggccggccacctgcagagcctctacacaggtagtgccccgaggggctgtgctgggcacgtgctctrcctgccgaagtgaggaggctgggcaggtgcctgggttccccctgcccaggcccagtttggttctcttcagcgtggagagatgattctgtcccaggagccg

SEQ ID NO: 52983 - DNA, 201 bp, Homo sapiens
cggtcacggaggccggccacctgcagagcctctacacaggtagtgccccgaggggctgtgctgggcacgtgctctgcctgccgaagtgaggaggctgggcwggtgcctgggttccccctgcccaggcccagtttggttctcttcagcgtggagagatgattctgtcccaggagccgggaggagggtgatgattctgtccca

SEQ ID NO: 52984 - DNA, 201 bp, Homo sapiens
agggcagggggagctgaggctgcgtcccattccctggctgcactcggggtggggtgtgagaaggggcgagtgccaccgctgcccgggccccccatctgtcyttgcaggtctccgtcatggcagtgatgaaaacctaacagggtggccccctgtgccagctcaggtgactggagcccgagggcctgacaggttcccagcagc

SEQ ID NO: 52985 - DNA, 201 bp, Homo sapiens
ttttccttctgtttgcctcttgcctgcactattgcagtcgtgaatacaggcctgagggtgaccttccattgggctcgtggtcccaacctcgacagcagtgrctccacaggatgcatacgaggtccccgcggtcccggccgacatacctgttgggttcttagttggcagcttcctcctccttctctctattcccctcctagg

SEQ ID NO: 52986 - DNA, 201 bp, Homo sapiens
acctcaggcaggtggtttctgcctgggacgtgaggtgcccttgactcttcctgtgagagccccgggcggtgccttgaagggcagggggagctgaggctgcrtcccattccctggctgcactcggggtggggtgtgagaaggggcgagtgccaccgctgcccgggccccccatctgtctttgcaggtctccgtcatggcagt

SEQ ID NO: 52987 - DNA, 201 bp, Homo sapiens
gttgcccccctgggcctccatgcctccagtgggcttctagccagggcactatctgaatgtcctacctctagcaggctttgccaagagaaacactctctagrtttctggcagttgcagatgcatctgtgcagcatgtttgagaactggtgctgtgccaggcatcgtgcacagatgggtacggacgatgactgaggcctagag

SEQ ID NO: 52988 - DNA, 201 bp, Homo sapiens
tgtgtgtgtatgtatatgcctgtgcttgtgtgtgtgtgtgtgtacacatacacgtggacaggcgagggagaagctgtattgcaccaccacccaggcccttsgagcccaagtgcagtctccccagggctcacgaggccccagcacgctgccctcctgctcagatggtgcccaaaagccccttgccgagtcctctctaagcct

SEQ ID NO: 52989 - DNA, 201 bp, Homo sapiens
ggccaggccgctgggagcacaggacttgtcggcagctgctccacctgaaggaccagtgtctgatcagctgctgcgtgctcagccccagagcaggtgaggcrcgtggccagcatgggagggctgcagccagcgtgccccccactgccaggcctcaggcacactgtagctttttatgtgactggctacacagccctgtcagga

SEQ ID NO: 52990 - DNA, 201 bp, Homo sapiens
attcccctgatgttggatattaagatctctctggttttatataattataagcagtatcaatgaacatctttatcatttttttcatacttaggattattttwaaaatatgggttaaagaatatgaatatcacagtaaactgaaacaagttgtcataggccttggtctgggtcccccataagcagaccctgagatgaggttca

SEQ ID NO: 52991 - DNA, 201 bp, Homo sapiens
atattctgtataacttaaatctttttaattttatggaggcttaatttatggcctagcagatggactattttggaaaatgttcaatgtgcacctgaaaagawtatatattctgctgttgttgggcatagtgttctataaacatcagtttggataagatgattggtgttgctcagggctatcatattcttactaatttttggt

SEQ ID NO: 52992 - DNA, 201 bp, Homo sapiens
gcaagaaagatgcttctttatatttgttgtggaatggttgggacaggcagactcattgtgtagtcgttggggaggaatgaggctaccccagcataccaacrcttgtgtatcacggtgcttgctggctcaggggaccaggaccctcaccatgagtcataattgaatagccttccctcttagaatgcatttgtcttcttgcca

SEQ ID NO: 52993 - DNA, 201 bp, Homo sapiens
ttagagaacatattctgtataacttaaatctttttaattttatggaggcttaatttatggcctagcagatggactattttggaaaatgttcaatgtgcacytgaaaagaatatatattctgctgttgttgggcatagtgttctataaacatcagtttggataagatgattggtgttgctcagggctatcatattcttacta

SEQ ID NO: 52994 - DNA, 201 bp, Homo sapiens
aaagcccagcgtggagtcgttctccacagagaacatgtgtgccgtcctccttattttatcggccccagcaagaaagatgcttctttatatttgttgtggartggttgggacaggcagactcattgtgtagtcgttggggaggaatgaggctaccccagcataccaacacttgtgtatcacggtgcttgctggctcagggga

SEQ ID NO: 52995 - DNA, 201 bp, Homo sapiens
tcgactgcgagtcagctccgatacttcaccagattcaggtgagagttttggttttttgacaagcccacttcatcagcagggcatgcatttctgccaggggkctcatgatatctggtggtctctttgtgaggccagcagccaccaatgatcacgaatgtggcaggaagctgccaagagaccccccagtgggtgattcctgcc

SEQ ID NO: 52996 - DNA, 201 bp, Homo sapiens
gacagagcctgggggtgacctagagttgggctttgctctcacgtcttcaggtggagctgtcctggaggcaggtggatctgtcctggaggcaggtggatacrgagcagggataggctagaggcattcttctgggaggcggagcatattagatggtttacagtccacagcctgggagagtgtctcgggggagtatcagtaaag

SEQ ID NO: 52997 - DNA, 201 bp, Homo sapiens
tttttgtttttaaattgagacaggggctcactctgttgcccaggctggagtacagtgatgcaatcttaactcactgtagtctcaaactcctgggctcaagygatcctcccacctcagcttcccaagtagccaggactacaggtgtgcaccatcatgcctggctaatttttatatgttttgtagagattgggtcttgctatg

SEQ ID NO: 52998 - DNA, 201 bp, Homo sapiens
gtgaagccctgcacatggctgcttcatcaggggaagggtcttttctgctttggaggaaaggctttggcaggcaggctgacctgggagtctccggagctctyggctctctgtagcatcctggggagctcagaccatggctgcagggctctggccatagcttgcaggccatctggttagtgctgccccccaaacccggccatt

SEQ ID NO: 52999 - DNA, 201 bp, Homo sapiens
caaggcacccagaactctccggaatgcttgaaggcagggcctggcctttccatggggtccagggctgtggggtccctggcggtactgtgggcctgcagagyggggcatgtgggctgaagaccgtctccccaccatggtgggaagggacaaagggtggccctggcagatccggacgggcaggactgggtgtgtcccatgaga

SEQ ID NO: 53000 - DNA, 201 bp, Homo sapiens
ttgcacctgcctgagttccttggtggggcccctctttgagttcctttgggctgctgtaacaaagcaccatagcctgggcagctcgtaaacagtggaaatgygttgctctttgttctggaggctgcaagtccaagattgaggcactggaagacctggtgcctggtgaggacctgcttcctggtccagagacagcaccttctc

SEQ ID NO: 53001 - DNA, 201 bp, Homo sapiens
agtgatgaaagggctggatgatgtggtcagttttggacaagttgcatttaaagtgcttctgaggcatccaagaggagatacctggtagacatttctttacraggtccagagctcagggcagtgtccggggctggagctggctctaggggtgaagggcagaggggtgactgttgaatgaatgggaacaaggtagtctgtgga

SEQ ID NO: 53002 - DNA, 201 bp, Homo sapiens
tgccctccgcccccggcgagccaaacccagtgatggtggttcctgccaccagcttcctgtggcaccgctgccactcccgccaggctcctggggcaccgccrccactcccgccaggctcctggggcaccgccggccactcccgccaggctcctggggcaccgccgcccactccctccaggctcctggggcaccgccgccact

SEQ ID NO: 53003 - DNA, 201 bp, Homo sapiens
tatcggtcgctccccaggtgtcaatcccagtcacaggctcagagaccgggacatggccccgggtgggtctgtaggccctgtgggctcatgtgagctggtcytgggcaggactccattattaactgcctgtgatgtgtcccactgtcatggagccctggtgactcttggggaccagcatcagctcggggcctgtgtgctcag

SEQ ID NO: 53004 - DNA, 201 bp, Homo sapiens; identical to SEQ ID NO: 15302

SEQ ID NO: 53005 - DNA, 201 bp, Homo sapiens
caccccctcccaggcccccagaatggcttcctcaccagcccgttcttgtattccggcttcccatcaatcatccgcatgttctggattctgcaggagaggaygcaggggcatgagagaccgaaagggcaccctcccacccacctccaggcccaggctgcacactcaccgggtcttggcaatgtccacaggcatggaggcagc

SEQ ID NO: 53006 - DNA, 201 bp, Homo sapiens
agggtttccccgtgttggtcaggctggtctcgaactcctgacttcaggtgatccgcccgcctcagcctcccaaagttctgggattacaggcatgagccacrcgcccggccctggagaggtttttaaaagatggcagaaggctgtttggaggagtccacccccatctcccctgtgtaaaaggaaagcggaagagagaaccac

SEQ ID NO: 53007 - DNA, 201 bp, Homo sapiens
tgtttctggaagcgaagctgcagggggaagggggctggggcctggggggatgcttccaggggatgcagggggatccactcaaggctcccttgcccacaggycctcatgcctctcctcctcttgctgctcctgctgccaagccccttacacccccaccccatctgtgaggtctccaaagtggccagccacctagaagtgaac

SEQ ID NO: 53008 - DNA, 201 bp, Homo sapiens
tgatctgggcatcggtggcattcttgggcgagtggctggaggaaacacaccgggcctgggatttgagtttttctggccctgtcagctgctgtggcatgacmgatttatacagcatttgcaaaaaaccagcggctgctttttctttaacaatttttcttaaaaactccagttcctattctccagcttctttgtccagtctcc

SEQ ID NO: 53009 - DNA, 201 bp, Homo sapiens; identical to SEQ ID NO: 15304

SEQ ID NO: 53010 - DNA, 201 bp, Homo sapiens
agagaaggacggagtcgagtggcaccctagaagacgctctgtgccttcggaggtctttctgcctgcctgtaagccggggttggtgctggggcaggagaggrgtctgagggaggggaaagagccaaggacctggagctagtagttttaagttctgcaggcaagggtgggagatgggagtagggaggacaggaggtgtggatg

SEQ ID NO: 53011 - DNA, 201 bp, Homo sapiens; identical to SEQ ID NO: 15305

SEQ ID NO: 53012 - DNA, 201 bp, Homo sapiens; identical to SEQ ID NO: 15306

SEQ ID NO: 53013 - DNA, 201 bp, Homo sapiens; identical to SEQ ID NO: 15309

SEQ ID NO: 53014 - DNA, 201 bp, Homo sapiens; identical to SEQ ID NO: 15308

SEQ ID NO: 53015 - DNA, 201 bp, Homo sapiens; identical to SEQ ID NO: 15307

SEQ ID NO: 53016 - DNA, 201 bp, Homo sapiens; identical to SEQ ID NO: 15310

SEQ ID NO: 53017 - DNA, 201 bp, Homo sapiens
gtgtctggatgttacaaatatgggtggttttattttctttttccctgtttagcattttctagttttccactattattgtatattatctgtataataaaaartaattttagggttgggagtgatggctcatgcctgtaatcctagcactttgggaggccgaggcgggtggatcaccagaggtagggagttcgagaccagcct

SEQ ID NO: 53018 - DNA, 201 bp, Homo sapiens; identical to SEQ ID NO: 15312

SEQ ID NO: 53019 - DNA, 201 bp, Homo sapiens
aagggtgggagatgggagtagggaggacaggaggtgtggatgctgtttctggaagcgaagctgcagggggaagggggctggggcctggggggatgcttccwggggatgcagggggatccactcaaggctcccttgcccacaggtcctcatgcctctcctcctcttgctgctcctgctgccaagccccttacacccccaccc

SEQ ID NO: 53020 - DNA, 201 bp, Homo sapiens; identical to SEQ ID NO: 15313

SEQ ID NO: 53021 - DNA, 201 bp, Homo sapiens; identical to SEQ ID NO: 15314

SEQ ID NO: 53022 - DNA, 201 bp, Homo sapiens; identical to SEQ ID NO: 15315

SEQ ID NO: 53023 - DNA, 201 bp, Homo sapiens; identical to SEQ ID NO: 15316

SEQ ID NO: 53024 - DNA, 201 bp, Homo sapiens; identical to SEQ ID NO: 15317

SEQ ID NO: 53025 - DNA, 201 bp, Homo sapiens
atacaaaattagttgggcgtggtggcgtatgcctgtaatcccagctacttgggaggctgaggcaggagaatcacatgaacccaggaggcggaggtcgccakgagccgagatcactccattgaactccagcctgggcaacaagagcgaaaaaagagatcaagaccatcctggccaacatggtgaaatgccctctctactaaa

SEQ ID NO: 53026 - DNA, 201 bp, Homo sapiens; identical to SEQ ID NO: 15318

SEQ ID NO: 53027 - DNA, 201 bp, Homo sapiens; identical to SEQ ID NO: 15319

SEQ ID NO: 53028 - DNA, 201 bp, Homo sapiens
gaggccagagttttactgttactcaaatcagtctccctgagcattcagggattggaatttttaagaacaacttggtgggtgggggaaagccagtgagccgrgagtgctgattgatcaggtcagagatgaaaatatgggaagctgaagctgtcctcttgtgctgagtcagttcctgggtgggggccacaagatcagatgagc

SEQ ID NO: 53029 - DNA, 201 bp, Homo sapiens
cagatgctggagaactaggccagggagatggacccagagctgagagggagaccatcacctgtgccatgggacagaacctgggaacatgtagggtggggagkatgagcaccaacataccctgctggtcaaagtaccctaggacaaaggggcaaatggtgggcatggaaaaactgaagcccgagcctgcccacagctatgcct

SEQ ID NO: 53030 - DNA, 201 bp, Homo sapiens
tcagaatgcaggttcgggatgcgacaacctggacagcggggagcgaaagcgtgaccgggctgcactggcagcctgacctgggacttggagcagggttgggragggaatcctacgtgcgtgcgcagcgaaagggcgggactgagaggggctggcctagggagaggctacactggcagtctccgtgtgtccccgccctctctc

SEQ ID NO: 53031 - DNA, 201 bp, Homo sapiens
cctgggagttgtagttcatcaagcggaccgaggaggcgaggctgcgctgagcatcctgggaatcgtagtgctcgctacacggtgccctctgcgcaggcgcwcaccgagagccacttccggaacaagcgtcgcgtttctgaggagaaactcttggtgagaattcccagagtgataatggctacctacagcctggcgaacgag

SEQ ID NO: 53032 - DNA, 201 bp, Homo sapiens; identical to SEQ ID NO: 15322

SEQ ID NO: 53033 - DNA, 201 bp, Homo sapiens
gaacccaggaggtggaggttgcagtgagccaagattgcagcactgcactccagcctgggtgacaaagcaagactgtctcaaaaaaaaaaaaaaaaaaaaaagccgggcttggtggtgagtaccggtaaccccagctacttggaaggctgaggcaggagaatcgcttgaacccaggaggcggaggttgttgtacttagccga

SEQ ID NO: 53034 - DNA, 201 bp, Homo sapiens
tgccttccttctatttgcctattggggtcttcctctcccccagctttggggctgctcaccaaggtgtcagcttcgcttcaaagctgtgcctgtgacacacrtggcaggttcgagcacgaagggaagcaaaggtgaagcctggccggggaccccatgtccgcattggggttttggctaacttcacacctagccttgggacca

SEQ ID NO: 53035 - DNA, 201 bp, Homo sapiens
ggaggggccaggcaggaggggagagaagttcccttttgcccccattgcccacctgtaaccggggcagagacctcagccacgtatccttgagagcaaacccrgagttaaatcctgcagacagagaggagggagaagctggctcccacggtgggcttctctcccaccttccccacatgcctaaccctgagacccaggctttta

SEQ ID NO: 53036 - DNA, 201 bp, Homo sapiens
ctcgttcgccaggctgtaggtagccattatcactctgggaattctcaccaagagtttctcctcagaaacgcgacgcttgttccggaagtggctctcggtgwgcgcctgcgcagagggcaccgtgtagcgagcactacgattcccaggatgctcagcgcagcctcgcctcctcggtccgcttgatgaactacaactcccagg

SEQ ID NO: 53037 - DNA, 201 bp, Homo sapiens
catacttttttttttttgagatggagtttcgctcttgttgcccaggctggagtgcagttgtgcaatcttggctcactgcaacctccacctcctgggttcargcgattctgcctcagcctcccatgtagctgggattacaggcacatgacaccatgcctggctaattttgtatttttagtagagactgggtttctccatgtt

SEQ ID NO: 53038 - DNA, 201 bp, Homo sapiens
tcccccaccccccatttattgccattagatcatatcctttttgtccaatcatacttttttttttttgagatggagtttcgctcttgttgcccaggctggartgcagttgtgcaatcttggctcactgcaacctccacctcctgggttcaagcgattctgcctcagcctcccatgtagctgggattacaggcacatgacacc

SEQ ID NO: 53039 - DNA, 201 bp, Homo sapiens
aagaatttcttccgactccccgccatcggttcagttcatgaatcgtctccggaaacacctgagagcttaccatcggtgtctatactacacgaggtaatttyacctgcctctgcgagggcagcgcctgggcggcccctccttgcaggtgcctccaggaccctctctggtccagcctgaactccttcccggctcaccgagccc

SEQ ID NO: 53040 - DNA, 201 bp, Homo sapiens
ttgtttttgttttttgttttttagagacggactctatgttgcccaggctgttatggaactcctgagtcaagtgatcctcccaccttggcctctgaaggtgygaggattataggcgtcacctaccacatccagcctacacgtatttgttaatatctaacataggactaaccagccactgccctctcttaggcccctcattta

SEQ ID NO: 53041 - DNA, 201 bp, Homo sapiens
atctcagagctcatctctcaatttctttatcctttccagatctgccggttcattatatacctgtggcacctgactctaatacctgagccaagaatggaagyttgtgagggtaaactgtggcttattcttacaaaaagtgtaataaaggagactgacccctgacaacatggtaggcactgtatacatacttgtttttgtttt

SEQ ID NO: 53042 - DNA, 201 bp, Homo sapiens; identical to SEQ ID NO: 15323

SEQ ID NO: 53043 - DNA, 201 bp, Homo sapiens
gatagtcctgattcctcatttctttcctttccagaatgtggacatgcttactcggggattgtggcccaccagaagcatttacttcctaccagccccccaayttctcaggcctcagagggggcatcttcagatatccacacccctgcccagatgctcctgtccaccttgcagtccactcagcgccccaccctcccagtagga

SEQ ID NO: 53044 - DNA, 201 bp, Homo sapiens; identical to SEQ ID NO: 15325

SEQ ID NO: 53045 - DNA, 201 bp, Homo sapiens
ggcaccaagccaagataatccttgtaacaattccatgggccttctccgtatccctcatgaggacacggaagcttcaagaagtaaagtggtttgtttaaggycacactgcagttagtggtggagctgggaagcaagtaagtgtttgaatccctgtcccccaatccctgcacgctctcagggacccagacactcaggcctcgg

SEQ ID NO: 53046 - DNA, 201 bp, Homo sapiens; identical to SEQ ID NO: 15326

SEQ ID NO: 53047 - DNA, 201 bp, Homo sapiens
accaaaaacaccccggggtggatgtgggggcacaggaggcatcagggcagtcccgtctccctggagaagctggtaggggtctcctgagaggatgaaagaargaggggcctggggtcagggagacccccacctgacccatctctttcttccttccaaaggggctgtattccctgagacagccgcagtaagaggaatgggggt

SEQ ID NO: 53048 - DNA, 201 bp, Homo sapiens
ctctggaatgaggaaggagccggggaaggaaagaaggcgccgcagctaagcccaggtctctcctccgcaggttccagctcctttcctggagcgtgtgtggrggcaacaaggacccatgggttcaggaattgatgagctgtcttgatctcaaaggtgagacttttccactgctcttcaggctctgcctccagggcttagcag

SEQ ID NO: 53049 - DNA, 201 bp, Homo sapiens; identical to SEQ ID NO: 15328

SEQ ID NO: 53050 - DNA, 201 bp, Homo sapiens
agcacggctatgggggagtccaagctgaggccccgccatgtgtagtaatcctgccatgagcctggcaggagagggttgctagaggacctggccctggaccsccaccccctctagtctaacaaacctcttcttcacagccacccaggctctggttctccagtccctggccctacccctagcttccacagggcccctccagct

SEQ ID NO: 53051 - DNA, 201 bp, Homo sapiens
gaggtgagggccagtcattcaattcacaaattttcactgagcacctactgtgggccaggtcatagtgttgatgtcttcatctgattccctagttcaagctmtcatcccccaaacactgtccttgatctcagagctcatctctcaatttctttatcctttccagatctgccggttcattatatacctgtggcacctgactct

SEQ ID NO: 53052 - DNA, 201 bp, Homo sapiens
cgcaccaccgcgaagaaggctgagggatggcgtgttgcctcgggggtgtctggagaagcccgggcctggaatcagcatgctgagctgggtccaatagccaygagtgaggccccgagaggccaggaaggcctctttgttgaaggtttcactggtcacctctggagaaggagaaggggaggagttgaggtgctgggctagaac

SEQ ID NO: 53053 - DNA, 201 bp, Homo sapiens
tgggtccaccgagaggctgtcatggggctgtggattggatgccagggaacagcggagtggggaccctgggcctgggaatgggtgccgaccacctccgtccygcgcaggcaatggcaacgagggcagcgtcactggaagttgttattgtggtaaaagaatttcttccgactccccgccatcggttcagttcatgaatcgtct

SEQ ID NO: 53054 - DNA, 201 bp, Homo sapiens
gccttcaactgcaggaccctgttcccagacatctaattcccagtctcaaagacctggtcccagtttcccccaaccattctgacctccttatggtacctgcrgtgtaggtaaaaggcagggttgccagttctcctgcccgctccatgaaggctgcaagccttgggcaccaaaatcggtgactcacatcatctgggcaccgct

SEQ ID NO: 53055 - DNA, 201 bp, Homo sapiens
ctgcgggccacagtctggcagttgggcctgaggctggggagaaccagaagcagccggaaaaaaatgctggtcccacagccaggacatcagccacagtgccrgtcctgtgcctcctggccatcatcttcatcctcaccgcagccctttcctatgtgctgtgcaagaggaggagggggcagtcaccgcagtcctctccaggta

SEQ ID NO: 53056 - DNA, 201 bp, Homo sapiens
gggacgcctggctccgggcgggattatggatgttgtcgggggcgtgatgatgtgtgggttgagcctggcgctctgaccctgggtccaccgagaggctgtcmtggggctgtggattggatgccagggaacagcggagtggggaccctgggcctgggaatgggtgccgaccacctccgtcccgcgcaggcaatggcaacgagg

SEQ ID NO: 53057 - DNA, 201 bp, Homo sapiens
ctgacccctgacaacatggtaggcactgtatacatacttgtttttgttttttgttttttagagacggactctatgttgcccaggctgttatggaactcctragtcaagtgatcctcccaccttggcctctgaaggtgcgaggattataggcgtcacctaccacatccagcctacacgtatttgttaatatctaacatagga

SEQ ID NO: 53058 - DNA, 201 bp, Homo sapiens
cgaaagccattgagacaccagctggacgtcacgcgccggagcatgtctgggagtcagagcgaggtggctccatccccgcagagtccgcggagccccgagaygggacgggacttgcggcccgggtcccgcgtgctcctgctcctgcttctgctcctgctggtgtacctgactcagccaggttagccgggggcggggcagggg

SEQ ID NO: 53059 - DNA, 201 bp, Homo sapiens; identical to SEQ ID NO: 15332

SEQ ID NO: 53060 - DNA, 201 bp, Homo sapiens; identical to SEQ ID NO: 15333

SEQ ID NO: 53061 - DNA, 201 bp, Homo sapiens; identical to SEQ ID NO: 15335

SEQ ID NO: 53062 - DNA, 201 bp, Homo sapiens; identical to SEQ ID NO: 15334

SEQ ID NO: 53063 - DNA, 201 bp, Homo sapiens
tagaaaggagtcaccatttagatgccattaagaaaattcatgattgaggccaggcactgtggctcatgcctgtaatcctagcactttgggaggctgaggcrggcggatcacctgaggtcaggagttcgagaccagcttggccaacatggtgaaaccccgtctttttttttcctgagacagagtctcactgagtggcccagt

SEQ ID NO: 53064 - DNA, 201 bp, Homo sapiens
taggtaccctggggaacccctggtcgttgacggaagcacagcgttcaagggcggcagagctcaggtactggaggacacatgggccgcgccgggtctagccrcgggacatccccagaccccagcacggcctcccaggccgaccttccagaagccggcccactgccttccccgggtcccagcccagaaaagcggagaccttcc

SEQ ID NO: 53065 - DNA, 201 bp, Homo sapiens
agtttagtcacttaacattatataggaatcctctgaaattctcagagatctgacagtctagcagtgcgctcacagtagggcttgaacactgctagtaaaamaaaagccatattcctaccttagatctagtatttagccagaaaaacaagtgatgcccataagaaccaaccagagaacagtatctggtactagagtttgaaa

SEQ ID NO: 53066 - DNA, 201 bp, Homo sapiens
caggttgtgcgggggcgggaacgaggcgatgctgtctttggaggccctgagaaactgaggttgcacaggagcgcggctctgtcctcgaaacggcctcagtygggtccctcctactaagtctggcctgggtccggcctgcacaggaggaggagtttgatcatgacgttgcagaggacttggggctcctgcagttcgtgaggc

SEQ ID NO: 53067 - DNA, 201 bp, Homo sapiens
ccgtaaggatgatctacctccaaatatgagattccatgaggagaagaggctggactttgaatggacactgaaggcagggtgagaaaaaggctagacctcgragtgaaataagggctgggagggccaagaatgatgatagacggtgagggactgagggatcagctgatgagttaagcctcaatacctgtcctagggctctgg

SEQ ID NO: 53068 - DNA, 201 bp, Homo sapiens
agagaagcaaagtgaaagtaggaaggagatgtaaaggtgactcagaagtcaggtgaggggaccacatggaacaggagggggtgggtgacccgtgagagcasacagctaagggaagaaaacataggatgctggagagctggtttggttggaataacacggaagacacccgtgaaagacaagaagcacactggcccgcaggag

SEQ ID NO: 53069 - DNA, 201 bp, Homo sapiens
actttatttttttatttttatttatttatttatttatttttgagatagagtctgatctggaggctggaaggcggggctaaaactcccactcacttacctcyaccaacaactaggccaccaagtcatttctgaggactggctcaagaaagcagatttaacttacactggcctagcccaggccaccagatgcatccacggaga

SEQ ID NO: 53070 - DNA, 201 bp, Homo sapiens
gtggccttcccgtgctaccgctgggtgcagggcgaggacatcctgagcctgcccgagggcaccggtgagcaggcggcgtcggggaaggaggcacaaggtcycgggaactgctgcggggctaggagggcagagttaaggacggtcggagcagacttagaggatgtatgggcccagggcaggtgaaatgtagggatcccaggg

SEQ ID NO: 53071 - DNA, 201 bp, Homo sapiens
tcctgccctcagaccccccacttgcctggctcctggcaaagtcctgggtccgaaattcagatttccaactgcacgagatccagtatcacttgctgaacackcacctggtggctgaggtcatcgctgtcgccaccatgcggtgcctcccaggactgcaccccatcttcaaggtacttattaatctattaaatcacatatccc

SEQ ID NO: 53072 - DNA, 201 bp, Homo sapiens
gggagggccaagaatgatgatagacggtgagggactgagggatcagctgatgagttaagcctcaatacctgtcctagggctctggagatggccctcaaacrtgtttacaccctcctgagctcctggaactgcctagaagactttgatcagatcttctggggccagaagagtgccctggctggtcagtggttccccgaggtc

SEQ ID NO: 53073 - DNA, 201 bp, Homo sapiens
tgcaggcctggtgtcgggagatcacggaggtggggctgtgccaggcccaggaccgaggtaagatccattctagagacagaagaagctcctgggagactctsccagggcgccttcccagccctgcccttctggggacaggaccccagcctctcatcacgcctcccttcctccctccacacgggaaagcatgtgtatcccatt

SEQ ID NO: 53074 - DNA, 201 bp, Homo sapiens
tctcagagatctgacagtctagcagtgcgctcacagtagggcttgaacactgctagtaaaacaaaagccatattcctaccttagatctagtatttagccaraaaaacaagtgatgcccataagaaccaaccagagaacagtatctggtactagagtttgaaatcacaagggacagcctataacagtatagtattgatgaag

SEQ ID NO: 53075 - DNA, 201 bp, Homo sapiens
gagctgggctcgcggcgggagggcgggaggctgggggcgaggtgacagcgcgacctcgcggactgggacttccacgaagctgggacgaggtgggcaagatyagggacagggtccgcagctgggatcccgggctgggctcaaccccatctccctttcccgcccctggtcccggcagcccccagctccttctcccagtgaccc

SEQ ID NO: 53076 - DNA, 201 bp, Homo sapiens
tggccaccggggcctggctcttctccgggtcgtacaaccgcgtgcagctttggctggtcgggacgcgcggggaggcggagctggagctgcagctgcggccsgcgcggggcgaggtcagcgcggggagcgaggggagctagggcagcggggaccccgggcccaggcccgggccgagctgggctcgcggcgggagggcgggag

SEQ ID NO: 53077 - DNA, 201 bp, Homo sapiens
agcccggactgggacgtggacgctgagagcgggcgcttggactcggtcacagacacggaccctctctagcacagggacagacattagtttccctttgtgcstggcacagcacagagtcggtgttaataaatgatcgttgggtgagggaatgaatgacagataaaaatacagacaggcccatagcccagactcctgtttcac

SEQ ID NO: 53078 - DNA, 201 bp, Homo sapiens
ttcctgggctcaagcgatcctcctgcctcagcctcccaagtaacctggattgcaggcacatgccgccacacccagctagttcttgcaattattattattarggactgtttatccttaggcatcctttctcctcatgtggactttggcctttccgtgacatttggcatctttcatgaatcttctgaaaagcttcaggttaat

SEQ ID NO: 53079 - DNA, 201 bp, Homo sapiens
tcccgggttcacgccattctcctgcctcagcctcccgagtacctgggactacaggtgcccgccaccacacctggctaacttttcgtatttttagtagagasggggtttcaccgtgttagccaggatggtctcgatctcctgacctcgtgatccgcccatcttggcctccccaagtgctgggactacaggcgtgagccaccg

SEQ ID NO: 53080 - DNA, 201 bp, Homo sapiens
tcctagcagtttgggctactacaacaaaacactagctgggcacagtggctcacgcttgtaatcccagcactttgggaggctgaggtgggtggatcacgagstcaggagttcgagaccagcctggccaacatagtgaaacccgtctctactaaaaatacaaaaattagccaggcgtcgtggcacgcacctgtaatcccagct

SEQ ID NO: 53081 - DNA, 201 bp, Homo sapiens
gaagcgatcctctaacctcagccttcagagtagctgggactacaggtgtgcaccaccatgcctggctaattttttttattttttgtagagacagggtttcrctatgtggcccaagctagtctcaaattcctgggctcaagcgatcctcctgcctcagcctcccaagtaacctggattgcaggcacatgccgccacacccag

SEQ ID NO: 53082 - DNA, 201 bp, Homo sapiens
tcctagttcagtcctctccgtgtctccactcaccacagtaatgccatgccccagcggacagctgagttgctggcagatgcacacaagggtcaagcctgcasatgtcttaacagtggcctatgcaggctctgactttggattgctggggtcttagtcctgaaccccggcctcaataatttccagatgtcctcacatgttcca

SEQ ID NO: 53083 - DNA, 201 bp, Homo sapiens
ggcctgctgggactcccaggtgctctctatgcccatgatgctttacggctctgggagatcattgccaggtgagtaaggaggagctgagaaatggtggggcsgggggggggggggctctggcctgaggccagcatggggcaaaagcaagaaggtccagaaaggagaagcagagaactcaatcctggggagagatgaggaaaa

SEQ ID NO: 53084 - DNA, 201 bp, Homo sapiens
tacctctccttcccctgcctggcactgttctctccttagtagtgtggtgagaacggacagagagaatccaaactgagtcagaggaaggctgcagtactgcrttgccccttggtgcagtcctgtgctggaaaaatacagaaataaaatatgtaggggaagaaactatgaggagctcccagcaggaaggggaaaatagaatgg

SEQ ID NO: 53085 - DNA, 201 bp, Homo sapiens
gcccccacccaccaccaaggaagatgtgacgatggccacagtgatggggtcactacctgatgtccggcaggcctgtcttcaaatggccatctcatggcatytgagtcgccgccagccagacatggtgagaggggactctcgggagagggaaatgacagttggaaaggaaacatcagagtgaggggctgggctctaggtgcg

SEQ ID NO: 53086 - DNA, 201 bp, Homo sapiens
agaagccggcccactgccttccccgggtcccagcccagaaaagcggagaccttcccctccgtttggaagatggactcatcccctacttcctcctggctccmcagaagacctggagacctcgggaagtgttctcatctatgttcgctccaacccgggggctcaggcccacctcgatcccgccttcccgggaggtccaggaag

SEQ ID NO: 53087 - DNA, 201 bp, Homo sapiens
acagaaagaggaatagaggtcagaggcgggggctttctgccctcaagtgccttttccccctgggcaggtatgtggaggggatcgtccacctcttctaccaragggatgacatagtgaagggggaccctgagctgcaggcctggtgtcgggagatcacggaggtggggctgtgccaggcccaggaccgaggtaagatccatt

SEQ ID NO: 53088 - DNA, 201 bp, Homo sapiens
gtgagttccatatatattgctgggagaaggcaaaataagacctgtgcttgcttaagaaaatgttcttaaaatcttgatgatactttatatacagggaacttggcagagggagcacaaaaatgatacaagcttacaaaccagagtaattgtcagaaacagtaaagttagaagaaaccagagtcagcaaaaatgaggtgtttg

SEQ ID NO: 53089 - DNA, 201 bp, Homo sapiens
gaagagtgccctggctggtcagtggttccccgaggtctccataatcccttaatggcccctctggatgactcatcacactccacagtcccccgtaactcttygcaagaagagaccttatcatatctggtcaactcagagaggccttgagaatgaaaacgcagaagctgggttcagggagggttatatacctgaacccctggg

SEQ ID NO: 53090 - DNA, 201 bp, Homo sapiens
tggaagatggactcatcccctacttcctcctggctccccagaagacctggagacctcgggaagtgttctcatctatgttcgctccaacccgggggctcagrcccacctcgatcccgccttcccgggaggtccaggaaggtcccgccgcacccaccccgttggcctcaccctggctcgggcccctttatcatcctgcagcta

SEQ ID NO: 53091 - DNA, 201 bp, Homo sapiens
ccaattgaggagtcagctaagtagaaacagaccaaaaggcaaggaagaacagccagcaagccgctcatacctgcccaacagtaaggtggatagagatgtaygttagcatggtaatgacaggaatgaaaaggaaagaatctaaaacgtagtgaagggaggaaatggtagctgcagcgtgcctgggtgcaagagagagaaaag

SEQ ID NO: 53092 - DNA, 201 bp, Homo sapiens; identical to SEQ ID NO: 15338

SEQ ID NO: 53093 - DNA, 201 bp, Homo sapiens
tgatgaagaatgtttctacccaattgaggagtcagctaagtagaaacagaccaaaaggcaaggaagaacagccagcaagccgctcatacctgcccaacagyaaggtggatagagatgtatgttagcatggtaatgacaggaatgaaaaggaaagaatctaaaacgtagtgaagggaggaaatggtagctgcagcgtgcctg

SEQ ID NO: 53094 - DNA, 201 bp, Homo sapiens
ggaggcggagctggagctgcagctgcggccggcgcggggcgaggtcagcgcggggagcgaggggagctagggcagcggggaccccgggcccaggcccgggycgagctgggctcgcggcgggagggcgggaggctgggggcgaggtgacagcgcgacctcgcggactgggacttccacgaagctgggacgaggtgggcaaga

SEQ ID NO: 53095 - DNA, 201 bp, Homo sapiens
gcctcccaggactgcaccccatcttcaaggtacttattaatctattaaatcacatatccctcagaccccagagagaggaacagccccatatcaaaagataytgcagcagcaaaaactctttgtagcaatttgtgagtgaagaggagactgtctcaatatcttgagatgttgattttaattaagtttattaagtttagtcac

SEQ ID NO: 53096 - DNA, 201 bp, Homo sapiens
tcttacttagtcatctctgtttccccaagaatgctgactataatgtcatatacggaatgggagttcaataatttctctttctcccagattcagcctcccarccccagctctccaaccccaacactgttcctgccctcagaccccccacttgcctggctcctggcaaagtcctgggtccgaaattcagatttccaactgcac

SEQ ID NO: 53097 - DNA, 201 bp, Homo sapiens
tttgtagagatggggtttcgccatattgcccaggctggtcttgaacttctgggctcaagtaatctgcctgcctcggcctcccaaagtgctgggattacagstgtgagccactgcacctggccttctctcactattcttaacagtcaggtgacaagaactgtcaataatcttacacctcctacttctccttcacattccacc

SEQ ID NO: 53098 - DNA, 201 bp, Homo sapiens
tttttgtagagatggggtttcgccatattgcccaggctggtcttgaacttctgggctcaagtaatctgcctgcctcggcctcccaaagtgctgggattacrgctgtgagccactgcacctggccttctctcactattcttaacagtcaggtgacaagaactgtcaataatcttacacctcctacttctccttcacattcca

SEQ ID NO: 53099 - DNA, 201 bp, Homo sapiens
ccggtgagcaggcggcgtcggggaaggaggcacaaggtcccgggaactgctgcggggctaggagggcagagttaaggacggtcggagcagacttagaggakgtatgggcccagggcaggtgaaatgtagggatcccagggtgctggacagaaaacgggaaggagttatgaattcccaaagttttacacaggctaagagagg

SEQ ID NO: 53100 - DNA, 201 bp, Homo sapiens
tgctgacactaccagttcaggactacactttcagaatcactatctcatctctcagtggcctctggctctgaaccctcgccatctcttgaatatcttttctygcaatttcttttttttttttgagacagaatctcactgtgtcactcaggctggaatacagttgtgtgatcttggctcactgcaacctgcgcctcctgggtt

SEQ ID NO: 53101 - DNA, 201 bp, Homo sapiens
caacctctgctcccagggacccaacccccagctcttggctcccaaaccccatcctcactcagtgagacttgtcttcatgtcactatttgcctgtaccctcrtctcccctgcctcatccaactagaattactttttcaagagtcaaaatggcctcttggagttctcatcctgtatccaatggtcctcacacttcagtgtgca

SEQ ID NO: 53102 - DNA, 201 bp, Homo sapiens
ctgccaccacatccacacacaagacatctaccctcaccagactgtttcttcactttaagatgagaggaactggaccaggggctctagttctcccaacaggrctccggtactgatgcaggagaatggcaagaagctagactaaatctcttgccctttgccccggccccctgggggtagactttgaactctaaaaatggatac

SEQ ID NO: 53103 - DNA, 201 bp, Homo sapiens
agtggactgagataacctttgtgggagcccctctcagctgtgacactggaaatccatgacttattccccacattataacgcagacacttgtaattctgtcygggaataggattacgcattcctaaattatttatttattttttaatttttaaatagagacaggctcttgctctgtcacctgactaccagcaatcctcctgc

SEQ ID NO: 53104 - DNA, 201 bp, Homo sapiens
ccccagcctctcatcacgcctcccttcctccctccacacgggaaagcatgtgtatcccattcccacctcctccgactcaggacaattctagagacccaagractgtcctcctcagagaccctggccatcaacccctagtcccactacaccccagtcacagatgcccctgaactgccatatcctggggccccccaggccata

SEQ ID NO: 53105 - DNA, 201 bp, Homo sapiens
atgcctggctaattttttttattttttgtagagacagggtttcactatgtggcccaagctagtctcaaattcctgggctcaagcgatcctcctgcctcagyctcccaagtaacctggattgcaggcacatgccgccacacccagctagttcttgcaattattattattaaggactgtttatccttaggcatcctttctcct

SEQ ID NO: 53106 - DNA, 201 bp, Homo sapiens
ccatggaaatcaacacccgggcccggacccaactcatctcagatggaggaatttttgataaggtgaggagggtacggggcatgggactgcctcatccatcyctccatgatctgccactttcaggatccaagatcaactatgtgtgaatgtcctcactcttaacctatgaacctgtcccttttatacccatgtctttttttt

SEQ ID NO: 53107 - DNA, 201 bp, Homo sapiens
tgaatggaatcttggatttcattcatctcatgctgtctcctgcttccccatcctctgctccacacgaacaagtgaagcctctattcacacttacaattccktttcctagttcagtcctctccgtgtctccactcaccacagtaatgccatgccccagcggacagctgagttgctggcagatgcacacaagggtcaagcctg

SEQ ID NO: 53108 - DNA, 201 bp, Homo sapiens
caccccccaccacacccggctaattttttatattttttttagtagagatggagtttcaccgtattagccaggatggtctcgatctcctgacctcgtgatcygccctccttggcctctcaaagtgctgggattacaggcttgagccaccacgcccggcccaaatagtgaatttttaaccatgggtaatgagtaaaagagaga

SEQ ID NO: 53109 - DNA, 201 bp, Homo sapiens
tcggaaggaggcggctggttggctgtgggatgcatagcctgtgggcgggctccacaccccccctcccatttttgctatcccccctctccccttctgacagygcgaagtggacggagacggaaatagagatgctgagggctgctgtgaagcgatttggggacgatcttaatcacatcagctgtgtcatcaaggaacggacag

SEQ ID NO: 53110 - DNA, 201 bp, Homo sapiens
aggagacgaggaggaatgaggatggcaaatagtgaatttttttttttttttttttgagatggagtcttgctttgttgcccaggctggagtgcagtggcgcsatcttggctcactgcaacctccacctcctgggttcacgccattctcctgcctcagcctcccgagtagctgggactacaggcaccccccaccacacccggc

SEQ ID NO: 53111 - DNA, 201 bp, Homo sapiens
cgcaggagacgaggaggaatgaggatggcaaatagtgaatttttttttttttttttttgagatggagtcttgctttgttgcccaggctggagtgcagtggygcgatcttggctcactgcaacctccacctcctgggttcacgccattctcctgcctcagcctcccgagtagctgggactacaggcaccccccaccacaccc

SEQ ID NO: 53112 - DNA, 201 bp, Homo sapiens
ctctgtgggactgggtttcccgggcgagagactgaatcccttctcccatctctggcatccggcccccgtggagagggctgaggctggggggctgttccgtytctccacccttcgctgtgtcccgtatctcaataaagagaatctgctctcttcagccctgtgtctgtgcttgagtgggggcgagcacggggctgagactag

SEQ ID NO: 53113 - DNA, 201 bp, Homo sapiens
cgtgaaagacaagaagcacactggcccgcaggagacgaggaggaatgaggatggcaaatagtgaatttttttttttttttttttgagatggagtcttgctytgttgcccaggctggagtgcagtggcgcgatcttggctcactgcaacctccacctcctgggttcacgccattctcctgcctcagcctcccgagtagctgg

SEQ ID NO: 53114 - DNA, 201 bp, Homo sapiens
acgcagaagctgggttcagggagggttatatacctgaacccctggggtagattttggagaagggatatgcaggctgtggtacatatatcctcctttcaccrcccaccaaagagaaggttcgccagtgctggcaggatgatgagttgttcagctaccagttcctcaatggtgccaaccccatgctgttgagacgctcgacct

SEQ ID NO: 53115 - DNA, 201 bp, Homo sapiens
ctggaactgcctagaagactttgatcagatcttctggggccagaagagtgccctggctggtcagtggttccccgaggtctccataatcccttaatggcccstctggatgactcatcacactccacagtcccccgtaactctttgcaagaagagaccttatcatatctggtcaactcagagaggccttgagaatgaaaacgc

SEQ ID NO: 53116 - DNA, 201 bp, Homo sapiens
ggccctggagcctgcgcggaggtggccttcccgtgctaccgctgggtgcagggcgaggacatcctgagcctgcccgagggcaccggtgagcaggcggcgtyggggaaggaggcacaaggtcccgggaactgctgcggggctaggagggcagagttaaggacggtcggagcagacttagaggatgtatgggcccagggcagg

SEQ ID NO: 53117 - DNA, 201 bp, Homo sapiens
tccagctcagctgcttccctactttgtcactagttttttagaatccccttgaggactgaaagaatagaattgtcacagttggtcagaagttcctaaaatgytgtggtaatccttccaagaatgtgaatttaggttgcctgagatgctgttattgtatttgatgatggaagtcccctggttatttatataaatgtttgagga

SEQ ID NO: 53118 - DNA, 201 bp, Homo sapiens
cagctaagggaagaaaacataggatgctggagagctggtttggttggaataacacggaagacacccgtgaaagacaagaagcacactggcccgcaggagaygaggaggaatgaggatggcaaatagtgaatttttttttttttttttttgagatggagtcttgctttgttgcccaggctggagtgcagtggcgcgatcttg

SEQ ID NO: 53119 - DNA, 201 bp, Homo sapiens
tagggccccggcgcgtttccccgctccagcccctcctctatttaaagactccctgcaccgtgtcacccaggtcgcgtcccacccttgccggcgccctctgygggactgggtttcccgggcgagagactgaatcccttctcccatctctggcatccggcccccgtggagagggctgaggctggggggctgttccgtctctcc

SEQ ID NO: 53120 - DNA, 201 bp, Homo sapiens
ggctgctagtcagtttgggctactataacaaaacactggccaggcgcggtggctcacgcctgtaatctcagaactttgggaggccaaggggggcgggaatyacctgaggtcaggagttcgagaccagcctggccaacatggtaaaaccccatctctaccaaaaatacaaaaattagccaggcatggtggtgcgtgcctgta

SEQ ID NO: 53121 - DNA, 201 bp, Homo sapiens
ttctgtctcaggtgcctctggggcaccacaaagaaaaatatttctcaggccccaagcccaaagctgtgctaaaccaattccgaacagatttggaaaagctrgaaaaggagattacagcccggaatgagcaacttgactggccctatgaatatctgaagcccagctgcatagagaacagtgtcaccatctgagccctagagt

SEQ ID NO: 53122 - DNA, 201 bp, Homo sapiens
ttcagctaccagttcctcaatggtgccaaccccatgctgttgagacgctcgacctctctgccctccaggctagtgctgccctcggggatggaagagcttcrggctcaactggagaaagaacttcaggtacctctccttcccctgcctggcactgttctctccttagtagtgtggtgagaacggacagagagaatccaaact

SEQ ID NO: 53123 - DNA, 201 bp, Homo sapiens
ctgggactcccaggtgctctctatgcccatgatgctttacggctctgggagatcattgccaggtgagtaaggaggagctgagaaatggtggggccgggggsgggggggctctggcctgaggccagcatggggcaaaagcaagaaggtccagaaaggagaagcagagaactcaatcctggggagagatgaggaaaagtgagg

SEQ ID NO: 53124 - DNA, 201 bp, Homo sapiens
ggcaggatgatgagttgttcagctaccagttcctcaatggtgccaaccccatgctgttgagacgctcgacctctctgccctccaggctagtgctgccctcrgggatggaagagcttcaggctcaactggagaaagaacttcaggtacctctccttcccctgcctggcactgttctctccttagtagtgtggtgagaacgga

SEQ ID NO: 53125 - DNA, 201 bp, Homo sapiens
gggcctgctgggactcccaggtgctctctatgcccatgatgctttacggctctgggagatcattgccaggtgagtaaggaggagctgagaaatggtggggycgggggggggggggctctggcctgaggccagcatggggcaaaagcaagaaggtccagaaaggagaagcagagaactcaatcctggggagagatgaggaaa

SEQ ID NO: 53126 - DNA, 201 bp, Homo sapiens
caagaaatggtggcaaacaggaggtttttatctacaggcaaaggatgagggctgaaataagagaaagcaggagtgcaaagttggcaaagatgggataaacrtgtctggtggataatcaaatgaggcaaagccagagataaaagcaacagtgcatggctgaaaacatggaatacggctaaccacagggagatgaggacaaga

SEQ ID NO: 53127 - DNA, 201 bp, Homo sapiens
catagacaagatggagaccagtctgatgaatggaatcttggatttcattcatctcatgctgtctcctgcttccccatcctctgctccacacgaacaagtgmagcctctattcacacttacaattccttttcctagttcagtcctctccgtgtctccactcaccacagtaatgccatgccccagcggacagctgagttgctg

SEQ ID NO: 53128 - DNA, 201 bp, Homo sapiens
tcactcagtgagacttgtcttcatgtcactatttgcctgtaccctcgtctcccctgcctcatccaactagaattactttttcaagagtcaaaatggcctcytggagttctcatcctgtatccaatggtcctcacacttcagtgtgcatcagaatcacctgaatgcctgttgaaatgcagatttctggatcccatgaccaga

SEQ ID NO: 53129 - DNA, 201 bp, Homo sapiens
actgaggacaagcctaggcaaaatgtgtgcgtatgcatgtgtgtgctgtatgcggtggcaggggtagtaggggaagctctctggaatatttggcagaggaygtgagatttgaatagggaatgaaagagcatttgctgagctgataggagccaaaaccagagcgcagaccattcgggaatgatcagaaaggggcctggccat

SEQ ID NO: 53130 - DNA, 201 bp, Homo sapiens
atagagatgctgagggctgctgtgaagcgatttggggacgatcttaatcacatcagctgtgtcatcaaggaacggacagtgtgagggagggtggctgccaraaaagggcgggtgggcagccttcttcctccttacccaaggttccatcgtcctcagaactcctttccagctcagctgcttccctactttgtcactagtttt

SEQ ID NO: 53131 - DNA, 201 bp, Homo sapiens
actccgggcgtctgagacccaaagagcaggttgtgcgggggcgggaacgaggcgatgctgtctttggaggccctgagaaactgaggttgcacaggagcgcrgctctgtcctcgaaacggcctcagtcgggtccctcctactaagtctggcctgggtccggcctgcacaggaggaggagtttgatcatgacgttgcagagga

SEQ ID NO: 53132 - DNA, 201 bp, Homo sapiens
tgctgtgaagcgatttggggacgatcttaatcacatcagctgtgtcatcaaggaacggacagtgtgagggagggtggctgccagaaaagggcgggtgggcmgccttcttcctccttacccaaggttccatcgtcctcagaactcctttccagctcagctgcttccctactttgtcactagttttttagaatccccttgagg

SEQ ID NO: 53133 - DNA, 201 bp, Homo sapiens
gccttcccgggaggtccaggaaggtcccgccgcacccaccccgttggcctcaccctggctcgggcccctttatcatcctgcagctacgctccgaccaggargcacagccagtccccacagccggctctaccgctctgctcgcaggtttgggctagtctggggcggggacttgggagcgcctaaaacttgcgaggagggcgg

SEQ ID NO: 53134 - DNA, 201 bp, Homo sapiens
tcatcccctacttcctcctggctccccagaagacctggagacctcgggaagtgttctcatctatgttcgctccaacccgggggctcaggcccacctcgatyccgccttcccgggaggtccaggaaggtcccgccgcacccaccccgttggcctcaccctggctcgggcccctttatcatcctgcagctacgctccgaccag

SEQ ID NO: 53135 - DNA, 201 bp, Homo sapiens
ctaaaattgttgcaggccactttgagaacattttagctgacaacagtgtgaacgaccagaccaaaatccttgtggttaatgctgcctactttgttggcaartggatgaagaaattttctgaatcagaaacaaaagaatgtcctttcagagtcaacaaggtatgtggggcagcatgtagcagtaaaaggagcccaattatag

SEQ ID NO: 53136 - DNA, 201 bp, Homo sapiens
gagtcttgctctgtcccccaggctggagtgcagtggcatgatctcagctcactgcaagctccgcctcctgggttcatgccattctccttcctcagcctccygagtagctgggactacaggtgcctgccacgacgcttggctaattttttgtatttttagtagagacgggctttcactgtgttagccaggatggtctcgatc

SEQ ID NO: 53137 - DNA, 201 bp, Homo sapiens
tgtctgtacgtatgcatgtaactcacagccccttcctgcccgaacatgttggaggccttttggaagctgtgcagacaacagcaacttcagcctgaatcatytctttcaattgtggacaagctgccaagaggcttgagtaggagaggagtgccgccgaggcggggcggggcggggcgtggagctgggctggcagtgggcgtg

SEQ ID NO: 53138 - DNA, 201 bp, Homo sapiens
ttggaaatgattttttttttttttttgagatggagtcttgctctgtcccccaggctggagtgcagtggcatgatctcagctcactgcaagctccgcctccygggttcatgccattctccttcctcagcctcccgagtagctgggactacaggtgcctgccacgacgcttggctaattttttgtatttttagtagagacggg

SEQ ID NO: 53139 - DNA, 201 bp, Homo sapiens
gataactgtgactccaggtaagcaaggtggggtagcagggctggtgacttccttttttcagggaaattcataaatatcgttatttgagctgatttgagatrgtgaacaaaatggacttaggtccattttggggctgttttcaaagacgggctgttgggttgagtactgtcgcctctcatcccccatgttggcagtatttcc

SEQ ID NO: 53140 - DNA, 201 bp, Homo sapiens
gttcacatcctttgcccacttgttgatggggttgtttgattttttcttgtaaatttgtttgagttctttgtagattctggatattagccctttgtcagatragtagattgcaaaaattttctcccattctgtaggttgcctgttcactctgatggtagtttcttttgctgtgcagaagctctttagtttaattagatccca

SEQ ID NO: 53141 - DNA, 201 bp, Homo sapiens
tccatggtgtatatgggccacgttttcttaatccagtctatcattattggacatttgggttggttccaagtctttgctattgtgaatagtgttccaataarcatacgtgtgcatgtgtctttatagcagcatgatttataatcctttgagtatacacccactaatgggatggctgggttaaatggtatttctagttctaga

SEQ ID NO: 53142 - DNA, 201 bp, Homo sapiens
catccagtctccagcttgctcctttggttgccattatgttttagccaccactttattaactgaattataattcctgtccttcttcttctttggtgcattaytctctctgttttttttctttccattttatgctttgatctttcagccattatccagctgtcttggattttacctttcgttcttaaaacgccctccaataaa

SEQ ID NO: 53143 - DNA, 201 bp, Homo sapiens
tttttttgtaaaggtgggatctcactgtgttgtccaggctggtcttgaaatcctggcctcaagcaatcctcagcctcagcctcctgaagtgctaggattayaggcatgagccaccacacctggccttcacaatttacgttacggttcactctttgtgttgtacatttatgagattttaatacgtacacatatatgcttcaa

SEQ ID NO: 53144 - DNA, 201 bp, Homo sapiens
acgtagacaaatctctgaatctttctacagtaagttgtttaaagcaagtagcaagacttaactttttacaaggagtggcattttcatgctgttagacctayaactttttttcagtgaaattcctttctaggatgttcacttgtgatttgaggctttaaataaataaatcctagtggagaggttgagtatagtgggaatcaa

SEQ ID NO: 53145 - DNA, 201 bp, Homo sapiens
ggacccatggttctttctggggcctttcctccttaatattaacaacagccaaaatttatttggcacttacagtgttctagggactgtgctaagttgcctaygtgcattatctcatttaattcttacagcaggctgatgagttagagactgttaccacactcttgtttaccagtgagggagctgaggcacagaggggtgggt

SEQ ID NO: 53146 - DNA, 201 bp, Homo sapiens
gagaggattgccgtacgcatgtctgtacgtatgcatgtaactcacagccccttcctgcccgaacatgttggaggccttttggaagctgtgcagacaacagyaacttcagcctgaatcatttctttcaattgtggacaagctgccaagaggcttgagtaggagaggagtgccgccgaggcggggcggggcggggcgtggagc

SEQ ID NO: 53147 - DNA, 201 bp, Homo sapiens
ctccaggtaagcaaggtggggtagcagggctggtgacttccttttttcagggaaattcataaatatcgttatttgagctgatttgagatagtgaacaaaayggacttaggtccattttggggctgttttcaaagacgggctgttgggttgagtactgtcgcctctcatcccccatgttggcagtatttccagctcccaacc

SEQ ID NO: 53148 - DNA, 201 bp, Homo sapiens
gttcatctacttgcaactgcattcttctaagcggaaattattctcccttcagttttctgggtttcagcataactttaaacaagttacacatttcagatgcrtattcttggacttataaattgtaatagctgcttgtagtttcttactcatatgctgtacactttttcttatggcttcatttaagcatatcatactaaaaac

SEQ ID NO: 53149 - DNA, 201 bp, Homo sapiens
aatgaaacattcaatacaaagaaattcactgacttctacatgaggtttcaattcatatagtgttaccaattttgaaagtgtacatatagcagttgatattyaataatccttttgttagaagagaataacaatgcaatagcttgactacagactctgattttatgaactgcatgtttttcaggagttcatcagctctacgaa

SEQ ID NO: 53150 - DNA, 201 bp, Homo sapiens
ggttctgttaccatctttttcatcccctacatctcccgggaggttttcgataatgggttccaaacctcagtccctgtcagttagtgtaagtgttcgatgarttccttcatgggtggagatgaagcctgtctgaggaaaggagtctccaaaggaaatgagtcagcaggtttatatctttgcttcctaacgccttgaattgtg

SEQ ID NO: 53151 - DNA, 201 bp, Homo sapiens
gcctgtctgaggaaaggagtctccaaaggaaatgagtcagcaggtttatatctttgcttcctaacgccttgaattgtgccacttcaatccctctgggttgyggattgactttggggctatgcagtctcagcgatttgggccattctggtgtggctgagtctggctgtaagtttactgcttggcaacagtgggctgggtcag

SEQ ID NO: 53152 - DNA, 201 bp, Homo sapiens
tgataaagatatctatccatatatatctatattagtatatatgttgtattatattttctggggtagatagtctttatttggtcctcttttcagaagatatgtcgtctcaacatgtgtttcagaaaataaagtacctgtagtcagtgccgataagtgaaattgatgacagtttttggaggccacaactatgtgcacattcag

SEQ ID NO: 53153 - DNA, 201 bp, Homo sapiens
gataaagatatctatccatatatatctatattagtatatatgttgtattatattttctggggtagatagtctttatttggtcctcttttcagaagatatgtcgtctcaacatgtgtttcagaaaataaagtacctgtagtcagtgccgataagtgaaattgatgacagtttttggaggccacaactatgtgcacattcaga

SEQ ID NO: 53154 - DNA, 201 bp, Homo sapiens
ataaagatatctatccatatatatctatattagtatatatgttgtattatattttctggggtagatagtctttatttggtcctcttttcagaagatatgtcgtctcaacatgtgtttcagaaaataaagtacctgtagtcagtgccgataagtgaaattgatgacagtttttggaggccacaactatgtgcacattcagaa

SEQ ID NO: 53155 - DNA, 201 bp, Homo sapiens
taataatctgacactgtgtcaagagcaaatttgtgtatatatatatatgtacatatatatttatgtgtttgcctatatatgtgtatatatgtgcatgtgtrtatatatgtatggggtatatatatatagtatgtatatataagtgtgtatatataggtgtgtgtatatgtatatgtatgtatatgtatgtatgcatatata

SEQ ID NO: 53156 - DNA, 201 bp, Homo sapiens
acctaggttcaaatccagacactggtacttactaactgatatttggacacaaagcttcaatttactgaactgtaaaatgaggcacatgttacctgatttartttttaaaattgtattatattgtgttttatttcaataggttttggggaacaggtggtttttggttacatggataagctctttagtggttacttctgagat

SEQ ID NO: 53157 - DNA, 201 bp, Homo sapiens
ccatgctggtcgttcctctgatagccccggggtccaagaagctcctaggttctttctccggctcagtgcttcccccaggcgtctccctcgtcggactcctsgtccctcccttaaaattgccggtgagtcgtcttccttgctggaaaagaattagggttatgatgattttgagggcaaatcagtgactttgtccccctcccc

SEQ ID NO: 53158 - DNA, 201 bp, Homo sapiens
cattgctctaaggaatcatacaaacaccactacggtacccattgttgtaatatttaaaaatctgtatttgaaacacacagacaatattctagactacatgmagtttccctctgtacttcagtaacacagagttgatttagttcctgtttggatggtcagaatttcaaggtttccaaatcgaaaagctagactaccagcttt

SEQ ID NO: 53159 - DNA, 201 bp, Homo sapiens
cactggcatctagtaggtcagcgatgctgctaagcatcctgcagtgcccaggacagccccacaaagactcatccagcctgaatgtcaatagtgctgaggtygaggagccttactttacgggaactaggcaggaggagtctgtatgcccaaggacgttggtcattatcacgtgtccacttcagtacagcactactcagaggc

SEQ ID NO: 53160 - DNA, 201 bp, Homo sapiens
cattctaggttcaatagaatttcttttctattagctcataagcatttaaaaaggcaacaccttcttgtattcatatgtgtccagaaagtatggcccataaragttatttaggtaaggatgaagaatttacacttgggacttgaagcagcttcactcctgtgaagaggagatgtatcttgacatcaagccacatctctgaac

SEQ ID NO: 53161 - DNA, 201 bp, Homo sapiens
tatgtgggtttgcagtagaatttactttcaagtcagctccaccaggaatagtttaaagatctcataggcatctgtaaagaataacaaacgttgcctatatktacagccatacagtcttatttttaaggtttgatctatgcaaatacagtattatatatacttcatgtaatgtgtaacatgtagattataaagtatatgaat

SEQ ID NO: 53162 - DNA, 201 bp, Homo sapiens
ccgtgcccagccagtttttgaaattaggcattttattaggaaaagccgtataaatggttatgtgggtttgcagtagaatttactttcaagtcagctccacyaggaatagtttaaagatctcataggcatctgtaaagaataacaaacgttgcctatatttacagccatacagtcttatttttaaggtttgatctatgcaaa

SEQ ID NO: 53163 - DNA, 201 bp, Homo sapiens; identical to SEQ ID NO: 15415

SEQ ID NO: 53164 - DNA, 201 bp, Homo sapiens
caacagttgcattgctttgtatgtatcccttcactgctcactccactgtcctgttcctctttcttcctccccagtggtaaccattattctgaatttacaakttcttcattctactgacaagaatactgaggcctggagagattgagtgatttgctcaaggccacagaatctgtttatgtcacatttgggactaaaaaccaa

SEQ ID NO: 53165 - DNA, 201 bp, Homo sapiens
atcctgaatccacccttgtttatatatcatccttgaaagtgacttatcatcgctgagtctcagcttcctcattcataaagtaggaagaaatatatataatrtgtatcaaatagcttgtatactgcctgacacagaataggcattcagaatggtagctgtgctttccttcttatttctcttcctttcttccctgctccttca

SEQ ID NO: 53166 - DNA, 201 bp, Homo sapiens
aacactgaaaattttggtcatcttatctgggacagtcttaattcagtgatttttcaaccaggggaaattctgccccctaggggacattttcattgtcacarctggggtactgtcatctagtggatagtctggggggttttgtctaggatgaggaggaagatgaaagagggtcggtttggaaaggaagaattcagtgcattc

SEQ ID NO: 53167 - DNA, 201 bp, Homo sapiens
aagactgagataatatatgtgaaattctgccataaagaaagtgattacgtattttcattcaagagcacaggctttggagtcagaaagagctggctttgaaycctgaatccacccttgtttatatatcatccttgaaagtgacttatcatcgctgagtctcagcttcctcattcataaagtaggaagaaatatatataatgt

SEQ ID NO: 53168 - DNA, 201 bp, Homo sapiens
gttgagaagacgttaaagatgctttagaaactaactgctcccttgtccttgcttccaggcccgcaatggatgccctgcaactagcaaattcggcttttgcygttgatctgttcaaacaactatgtgaaaaggagccactgggcaatgtcctcttctctccaatctgtctctccacctctctgtcacttgctcaagtgggtg

SEQ ID NO: 53169 - DNA, 201 bp, Homo sapiens; identical to SEQ ID NO: 15366

SEQ ID NO: 53170 - DNA, 201 bp, Homo sapiens
atcattggttattccaggaacccatctctcaagcagcagctcttctcctatgcgattctgggctttgccctgtctgaggccatggggctcttctgtttgayggtcgccttccttatcctcttcgccatgtgaagctctgtgggggtcacctgcctgtccctgctgctgcggctgcacaccattcttggtgctgggctgtgc

SEQ ID NO: 53171 - DNA, 201 bp, Homo sapiens; identical to SEQ ID NO: 15368

SEQ ID NO: 53172 - DNA, 201 bp, Homo sapiens
ctaaaggtgacactgcaaatgaaattggacaggtaagccccaaaaccttgtttctactttaagtgggaatacagttattagaacccataggcagtgcctayggaaaaaaggaatgtagactttgtggccagaattggtcaagattcagaactgtgccattccaggactctcttaatcttttttttttttttttttttttgt

SEQ ID NO: 53173 - DNA, 201 bp, Homo sapiens
aattaattttccttcaggaaatcagtcatctctggagcagagacaggaggccaggtgttaataggagcaaagagaagaaaaggcctgggcagtgcttggasataaaagacctgaacgatcagacccttccatgggctccctttaagaagagcagggagagaccaagggctaaagttgggagactgagaaaatgcagcccac

SEQ ID NO: 53174 - DNA, 201 bp, Homo sapiens
ttgtttaaatagaattcttatagtgttggcagaatgcagttgagaagacgttaaagatgctttagaaactaactgctcccttgtccttgcttccaggccckcaatggatgccctgcaactagcaaattcggcttttgccgttgatctgttcaaacaactatgtgaaaaggagccactgggcaatgtcctcttctctccaat

SEQ ID NO: 53175 - DNA, 201 bp, Homo sapiens
ctaggcagagctggacacacagaggacctcacatgccttcagacatttgcctggaagtttcttcacaactgatcttacttttgaatttacagaaagttccytgtttcttctgagatcaattactttgtttaaatagaattcttatagtgttggcagaatgcagttgagaagacgttaaagatgctttagaaactaactgct

SEQ ID NO: 53176 - DNA, 201 bp, Homo sapiens
agctctgctggagagaggtattggggaaggttcagcttagtatttgaagataccagatgcaagtttactggagtattatccttgcaggcttgatatgaagyttgaaatttctccccaaagagatttagttaacaggcaaatatcccatgggaggtatatgtcaataggttatacaacattactgtcagtcttttacaactt

SEQ ID NO: 53177 - DNA, 201 bp, Homo sapiens
tatctgttaacctccaaagtagtatgttttcctataattctgtttttggttacacatagagttgaagtcttccattatttatcagccaaatattcagtgasaaactacaagctggggtagaaaatgagacttagtttctgccttgactgtattctagttggggtgggaagtggaaagacaatcactagataatatttctaa

SEQ ID NO: 53178 - DNA, 201 bp, Homo sapiens
aggttcttcattttgaaaatgtcaaagatgtaccctttggatttcaaacagtaacatcggatgtaaacaaacttagttccttttactcactgaaactaatmaagcggctctacgtagacaaatctctgaatctttctacagtaagttgtttaaagcaagtagcaagacttaactttttacaaggagtggcattttcatgct

SEQ ID NO: 53179 - DNA, 201 bp, Homo sapiens
gccactgcactccagcctgggtgacaaagtgagactccatctcaaaaaaaaaaaaaaaaaaaaaaaagaaatgggtaaagtacctcttttgtaaatgagaycaaggaactgagactggaaatttgacccattttattggaaaacccagacatctatatgatgatgtgatgtggtctccgtgggtgggatctgacttgtgtt

SEQ ID NO: 53180 - DNA, 201 bp, Homo sapiens
gtgtatatataggtgtatgtatatatgtatgtgtatctgtatatatataggtgtaggtatatatgtatgtgtgtctgtatatatacatgtgggtatatatrtgtgtgtgtgtgcgcgcgtgtgtgtatatatatatatatatatatttatgcatgtgtaaattgaaaagtaagcagtccaaattttcccttttacagacag

SEQ ID NO: 53181 - DNA, 201 bp, Homo sapiens
gtgtatgtatatatgtatgtgtatctgtatatatataggtgtaggtatatatgtatgtgtgtctgtatatatacatgtgggtatatatgtgtgtgtgtgtgcgcgcgtgtgtgtatatatatatatatatatatttatgcatgtgtaaattgaaaagtaagcagtccaaattttcccttttacagacagacaccaaaccag

SEQ ID NO: 53182 - DNA, 201 bp, Homo sapiens
tttagggtttctttctggctatggttgattatctagctttgtaaagttcttagaccttcaaatgagacaattttcctgattgttccgttttaagtcctcakgtacttttacataataggtgaatgttcttctaattctatttcattattactcttatgctaatcattctaggttcaatagaatttcttttctattagctca

SEQ ID NO: 53183 - DNA, 201 bp, Homo sapiens
tgtatgtatatatgtatgtgtatctgtatatatataggtgtaggtatatatgtatgtgtgtctgtatatatacatgtgggtatatatgtgtgtgtgtgtgcgcgcgtgtgtgtatatatatatatatatatatttatgcatgtgtaaattgaaaagtaagcagtccaaattttcccttttacagacagacaccaaaccagt

SEQ ID NO: 53184 - DNA, 201 bp, Homo sapiens
ttcaaatgagacaattttcctgattgttccgttttaagtcctcatgtacttttacataataggtgaatgttcttctaattctatttcattattactcttaygctaatcattctaggttcaatagaatttcttttctattagctcataagcatttaaaaaggcaacaccttcttgtattcatatgtgtccagaaagtatggc

SEQ ID NO: 53185 - DNA, 201 bp, Homo sapiens
tataaattgtaatagctgcttgtagtttcttactcatatgctgtacactttttcttatggcttcatttaagcatatcatactaaaaaccaacatgccaggytattccagagacttgtaaccagatcctcagagctgggggctcttagacatatttcagcccagccccctcattctgtagatgaggagcagaactcacagag

SEQ ID NO: 53186 - DNA, 201 bp, Homo sapiens
tatgtatatatgtatgtgtatctgtatatatataggtgtaggtatatatgtatgtgtgtctgtatatatacatgtgggtatatatgtgtgtgtgtgtgcgygcgtgtgtgtatatatatatatatatatatttatgcatgtgtaaattgaaaagtaagcagtccaaattttcccttttacagacagacaccaaaccagtgc

SEQ ID NO: 53187 - DNA, 201 bp, Homo sapiens
ccttcttgtattcatatgtgtccagaaagtatggcccataagagttatttaggtaaggatgaagaatttacacttgggacttgaagcagcttcactcctgygaagaggagatgtatcttgacatcaagccacatctctgaactgcgcaactccactatccctacccaatctcccattcctcatttctcatctaccattaga

SEQ ID NO: 53188 - DNA, 201 bp, Homo sapiens
tgtatatatgtatgtgtatctgtatatatataggtgtaggtatatatgtatgtgtgtctgtatatatacatgtgggtatatatgtgtgtgtgtgtgcgcgygtgtgtgtatatatatatatatatatatttatgcatgtgtaaattgaaaagtaagcagtccaaattttcccttttacagacagacaccaaaccagtgcag

SEQ ID NO: 53189 - DNA, 201 bp, Homo sapiens
cacagcatggccattatgagttatggagcgaggagggtgtcatcttatgctgacattacatgttgtggtgttgcaaggcagaaaagatgctggactattgsttggaacaataaaaaaaaaaaaggaaaaaaatacaatgatttaagccctccaaatgatagtatcctggttttaaatggcttacaatattattacaagaat

SEQ ID NO: 53190 - DNA, 201 bp, Homo sapiens
gtatgtgtatctgtatatatataggtgtaggtatatatgtatgtgtgtctgtatatatacatgtgggtatatatgtgtgtgtgtgtgcgcgcgtgtgtgtrtatatatatatatatatatttatgcatgtgtaaattgaaaagtaagcagtccaaattttcccttttacagacagacaccaaaccagtgcagatgatgaac

SEQ ID NO: 53191 - DNA, 201 bp, Homo sapiens
gcgaggagggtgtcatcttatgctgacattacatgttgtggtgttgcaaggcagaaaagatgctggactattggttggaacaataaaaaaaaaaaaggaamaaaatacaatgatttaagccctccaaatgatagtatcctggttttaaatggcttacaatattattacaagaataattaacagtttgaatccatataatat

SEQ ID NO: 53192 - DNA, 201 bp, Homo sapiens
cctcctaggcagttaaggcactacgttgctacgcactgccaggtccactatcatgtgacctgatgtcaagcatcctctctcttgctctttctttttttttwaaattagtagatgttatttttagagtagatctatgcctacagaaaaataagcagaaagtacaaggagttcccatatactccccttcccgtcccaggccta

SEQ ID NO: 53193 - DNA, 201 bp, Homo sapiens
tttttctttccattttatgctttgatctttcagccattatccagctgtcttggattttacctttcgttcttaaaacgccctccaataaacatcaattattttcttcttcttcttctttttttatttcaataatttatttttcttttttttaattatacattaagttttagggtacatgtgcacaatgtgcaggtttgttac

SEQ ID NO: 53194 - DNA, 201 bp, Homo sapiens
ttttctttccattttatgctttgatctttcagccattatccagctgtcttggattttacctttcgttcttaaaacgccctccaataaacatcaattattttcttcttcttcttctttttttatttcaataatttatttttcttttttttaattatacattaagttttagggtacatgtgcacaatgtgcaggtttgttaca

SEQ ID NO: 53195 - DNA, 201 bp, Homo sapiens; identical to SEQ ID NO: 15416

SEQ ID NO: 53196 - DNA, 201 bp, Homo sapiens
tttctttccattttatgctttgatctttcagccattatccagctgtcttggattttacctttcgttcttaaaacgccctccaataaacatcaattattttcttcttcttcttctttttttatttcaataatttatttttcttttttttaattatacattaagttttagggtacatgtgcacaatgtgcaggtttgttacat

SEQ ID NO: 53197 - DNA, 201 bp, Homo sapiens; identical to SEQ ID NO: 15418

SEQ ID NO: 53198 - DNA, 201 bp, Homo sapiens
ggcattccctaaggactggttataccaaatacttgagagatgtttttcaccatgtctttccatctttaaaatgaggcaggccaggctaaatgatatctacratactctgacacagtaaaaacgtagttttttttttttttttcttgagatggagtcttgctttgtcacccaggatggagtgcagtggcacgatcttggctc

SEQ ID NO: 53199 - DNA, 201 bp, Homo sapiens
ggctgagtctggctgtaagtttactgcttggcaacagtgggctgggtcagtggtcaagatcaggcttctaaagagacaggagcagctatgatgcttcagarcaaagcagacgcccccctgccatgggaaattaaagcaattactaatagctgtattgtactttcttgcccacaaagcacttttcatatacattgattcact

SEQ ID NO: 53200 - DNA, 201 bp, Homo sapiens
agttccttttactcactgaaactaatcaagcggctctacgtagacaaatctctgaatctttctacagtaagttgtttaaagcaagtagcaagacttaactytttacaaggagtggcattttcatgctgttagacctacaactttttttcagtgaaattcctttctaggatgttcacttgtgatttgaggctttaaataaat

SEQ ID NO: 53201 - DNA, 201 bp, Homo sapiens
catagagtgacccttctggctcctttgattagtgattggctctcctccatagcaagggctggcaaagggttcctaactctgtttaagtgaaatctgaaacrggttgccaatggtgcctctcttcaagaccccagagccagcctggaaggaacaccatgaaaatgttgcaatagtcaatgagtagaatgtggacttttgtgt

SEQ ID NO: 53202 - DNA, 201 bp, Homo sapiens
tgctttccttcttatttctcttcctttcttccctgctccttcattctcctctgctgacctctttggtagatctggttgtgtcaaggtagaaggagagaaargagtccttctgaaatttgatggttggaaccatcaggccttacatggtgtgactccatgaagtggtaaatactcagtgaatatgcatgtgaatttcagatg

SEQ ID NO: 53203 - DNA, 201 bp, Homo sapiens
tatcacgtgtccacttcagtacagcactactcagaggcaatgctttttgggtaacggatttttctcttaacaggttcttcattttgaaaatgtcaaagatrtaccctttggatttcaaacagtaacatcggatgtaaacaaacttagttccttttactcactgaaactaatcaagcggctctacgtagacaaatctctgaa

SEQ ID NO: 53204 - DNA, 201 bp, Homo sapiens
ttgcaggttcatggattacttctctataaaaaatatgtatttaccaaaaattttgtgacattccttctcccatctcttccttgacctgcattgtaaatagsttcttcttgttctgagattcaatattgaatttttcctatgctattgacaataaaatattattgaactacatgtcttgttttttttttcctattaagttag

SEQ ID NO: 53205 - DNA, 201 bp, Homo sapiens
agccttactttacgggaactaggcaggaggagtctgtatgcccaaggacgttggtcattatcacgtgtccacttcagtacagcactactcagaggcaatgytttttgggtaacggatttttctcttaacaggttcttcattttgaaaatgtcaaagatgtaccctttggatttcaaacagtaacatcggatgtaaacaaac

SEQ ID NO: 53206 - DNA, 201 bp, Homo sapiens; identical to SEQ ID NO: 15373
  misc_feature (1)...(201): n = A,T,C or G, or insertion/deletion polymorphism (see Tables 1-2)

SEQ ID NO: 53207 - DNA, 201 bp, Homo sapiens
tttctgaatcagaaacaaaagaatgtcctttcagagtcaacaaggtatgtggggcagcatgtagcagtaaaaggagcccaattatagatgtgaaaaatgayagggacagagtggggcataaatccattccaatgaggaacctgagggcacggccggcaaagtgcctttcctgagatgaacagctggaaggtaagtggtaca

SEQ ID NO: 53208 - DNA, 201 bp, Homo sapiens
aattaaatactaatatgaataatatatatattaaaaaacattttctaaagtgaaaaaatgtaatgagaagagtgatattgtttttcatttttgcaaatctccttaatatttggcttaatagaagggatgtcatatagcctctggaaaactccgctgtctattagagattgagaatgataatgtcttagtattatcatgaga

SEQ ID NO: 53209 - DNA, 201 bp, Homo sapiens
tgcacacattcttctgatgtttctcaaaatcagtaagaaaaataataactatgaattcacaattttcatcagtcacaaattagttttgttggctgggctgrtcagatggggatctccacaggcagctctggttatataagtttagccattgctctaaggaatcatacaaacaccactacggtacccattgttgtaatattt

SEQ ID NO: 53210 - DNA, 201 bp, Homo sapiens
atgtgtctttatagcagcatgatttataatcctttgagtatacacccactaatgggatggctgggttaaatggtatttctagttctagatccttgaggaaytgccacactgacttccacagtggttgaacttgtttacggtcccaccaacagtgtaaaagtgttcctatttctccatatcctttccagcacctcttgtttc

SEQ ID NO: 53211 - DNA, 201 bp, Homo sapiens
ctttagtttaattagatcccatttgtcaattttggctttcaattattttcttcttaaagtatagaactaaagaaaatgaccttttgagttttggaaatgattttttttttttttttgagatggagtcttgctctgtcccccaggctggagtgcagtggcatgatctcagctcactgcaagctccgcctcctgggttcatgc

SEQ ID NO: 53212 - DNA, 201 bp, Homo sapiens
gataagctatccgtgttgcaggttcatggattacttctctataaaaaatatgtatttaccaaaaattttgtgacattccttctcccatctcttccttgacmtgcattgtaaataggttcttcttgttctgagattcaatattgaatttttcctatgctattgacaataaaatattattgaactacatgtcttgtttttttt

SEQ ID NO: 53213 - DNA, 201 bp, Homo sapiens
cgcccagccgcatctctctcattttttaaaacagctaaaatggatgcattcactacctatgaccctagggcatggctcagagttagttcaaattcccattaaaaaaaaaaagtaactttagctttaatttaattttctaaatctgatgccattcctagtacatgaatattctggatttcctcgtagagaaattacaataag

SEQ ID NO: 53214 - DNA, 201 bp, Homo sapiens; identical to SEQ ID NO: 15361

SEQ ID NO: 53215 - DNA, 201 bp, Homo sapiens; identical to SEQ ID NO: 15362

SEQ ID NO: 53216 - DNA, 201 bp, Homo sapiens; identical to SEQ ID NO: 15363

SEQ ID NO: 53217 - DNA, 201 bp, Homo sapiens; identical to SEQ ID NO: 15364

SEQ ID NO: 53218 - DNA, 201 bp, Homo sapiens; identical to SEQ ID NO: 15365

SEQ ID NO: 53219 - DNA, 201 bp, Homo sapiens
gggtctcctgagtcacataccaaaaacttctgggccatctttgatgttccacccagactgctttgaagctgggcttatcataacaccttatgttttcaatygagccaggtcttttacagttggaaataaataaaaataatttcttttcatttttgtccttcagattgaaaaacaactcaactcagagtcactgtcacagtg

SEQ ID NO: 53220 - DNA, 201 bp, Homo sapiens
tggggaggaggaggacacagctgggtggctgctgggtctcctgagtcacataccaaaaacttctgggccatctttgatgttccacccagactgctttgaarctgggcttatcataacaccttatgttttcaattgagccaggtcttttacagttggaaataaataaaaataatttcttttcatttttgtccttcagattga

SEQ ID NO: 53221 - DNA, 201 bp, Homo sapiens
agatcctggaaactcagcctttatgaacagaattaataaaagtttgaaatgtcattgatctctcagtgtttcacttgataaagcaataaaatgctattcayagctgcatgaggctacacccttcttttgaatgcagatgctattacttctcctttgttttctttgaattgctttgtccaccctagaactttttgagtgaca

SEQ ID NO: 53222 - DNA, 201 bp, Homo sapiens
ttagtagagacgggctttcactgtgttagccaggatggtctcgatctcctgacctcgtgatccacccacctcggcttcccaaagtgctgggattgcaggcrtgagccactgcgcccagccgcatctctctcattttttaaaacagctaaaatggatgcattcactacctatgaccctagggcatggctcagagttagttca

SEQ ID NO: 53223 - DNA, 201 bp, Homo sapiens
aaaagggacataggcaacatatgtaaaagaaaaaccggctggacgcggtggctcacgcctgtaatcccagcactttgggaggccaaggcgggcggatcacraggtcaggagatcgagaccatcctggctaacacggtgaaaccctgtctctactaaaaatacaaaaaattagccgggcgtggtggcgggcgcctgtagtcc

SEQ ID NO: 53224 - DNA, 201 bp, Homo sapiens
tttcactgggagaagacaatgatgactgttactgctccttaccaactcaaaatatccatgggagctgagggatgggtaggaggtcctcctaacttcctgartttagcttcccaactgcagtggtcttctcaaagctgactgcagagacaggattgaccctgcacacaagaggtctgtctgagattctagagacatagctta

SEQ ID NO: 53225 - DNA, 201 bp, Homo sapiens
ccgaatctagtcatgaaagaatgaagcctaggcagtcgctgctgtctagggagggatacacttccggggcaagggagacccacttcctgcgagaatgactrgcgcccccagctactctgtctctgtactgactgaggaagttctaacaggacagtaactgcaggatgagaacatgggaagaacagggtctctggagtcatt

SEQ ID NO: 53226 - DNA, 201 bp, Homo sapiens
ccttttgttagaagagaataacaatgcaatagcttgactacagactctgattttatgaactgcatgtttttcaggagttcatcagctctacgaagagaccstatgcaaaggaattggaaactgttgacttcaaagataaattggaagaaacgaaaggtcagatcaacaactcaattaaggatctcacagatggcaagtacc

SEQ ID NO: 53227 - DNA, 201 bp, Homo sapiens
ctgacaaattttacaaatttgttaaggaaaaagggacataggcaacatatgtaaaagaaaaaccggctggacgcggtggctcacgcctgtaatcccagcaytttgggaggccaaggcgggcggatcacgaggtcaggagatcgagaccatcctggctaacacggtgaaaccctgtctctactaaaaatacaaaaaattagc

SEQ ID NO: 53228 - DNA, 201 bp, Homo sapiens
agcctttatgaacagaattaataaaagtttgaaatgtcattgatctctcagtgtttcacttgataaagcaataaaatgctattcacagctgcatgaggctmcacccttcttttgaatgcagatgctattacttctcctttgttttctttgaattgctttgtccaccctagaactttttgagtgacattactaaaccttttc

SEQ ID NO: 53229 - DNA, 201 bp, Homo sapiens; identical to SEQ ID NO: 15453

SEQ ID NO: 53230 - DNA, 201 bp, Homo sapiens
accacccagcacccagcaggtgcctcacagacatatgcattctgaacaaggtgtggggtctcttccagcagctgtcagctgtcccttttcccctttctctstagttcacagtacagagccagttgtccaggagaatggggacgaagctggggaggggagagaggctaaagattgtgaccccggctctccaaggaggtgtga

SEQ ID NO: 53231 - DNA, 201 bp, Homo sapiens
acgtaacacatagctgcaggccaggcgcagtggctcacacctgtaatcccagcactttgggaggccaaggcaggcagatcactgaggccaggagttcaacrccaacctggccaatgtggtaaaatcctgtctctacaaaaaaatatacaaaaattagccaggcatagtggcgcacacctgtagtccagctacttgggaggc

SEQ ID NO: 53232 - DNA, 201 bp, Homo sapiens
cctttctctctagttcacagtacagagccagttgtccaggagaatggggacgaagctggggaggggagagaggctaaagattgtgaccccggctctccaasgaggtgtgacatcatcatcatctctggccggaaagaaaagtgtgaggctgccaaggaagctctggaggtatgtgtccatgtgcccccctccaccccccgc

SEQ ID NO: 53233 - DNA, 201 bp, Homo sapiens
ggtgcagatacactcgaacttaccctaacctgggagtcagggcaaccttccccaagcatgtgatgtttaagctcatgctgttttaatggatgagttggtgytgctgggcaggaataagcaaagatggtgtttctgccagaatgtcttggaaaaatatgctccttcagaacctacaaatattcttgttttcttttattctct

SEQ ID NO: 53234 - DNA, 201 bp, Homo sapiens
aaaaaaaaaaaaaaaagaaagaaagaaataggccgggcgcggtggcttatgcctgtaattccagcactttgggagacaggcgggtggatcacggtgtcagragtttgagaccagcctggccaacaatgtgaaaccctgtgtctactaagaatacaaaaatcagccaggtgtggtggcgcacgcctgtagtcccagctactc

SEQ ID NO: 53235 - DNA, 201 bp, Homo sapiens
caaattgggttcaaatgatccttctgcctcagtctcctgagtaactaggattacaggcacaggctaattgtttttattttttatttttttaagaaatgagktctcactttgttgcccaggctggtctcaaacttttggcctcaagtgatccttctgccttggcctcccaaagtgctaggattataggcatgagtcaccatg

SEQ ID NO: 53236 - DNA, 201 bp, Homo sapiens
gtgcctctttcttagccagtaacaccaagtgctaattaccattgctttgtagtatgctttgctaattttagttgaatcccagcttttttttttttttttttgcaaaattttctagcctggttttatgtttaggtgaatttttaggagaatccttgttagagttaaaaaaatatcctactgggatgttgtgttactttccca

SEQ ID NO: 53237 - DNA, 201 bp, Homo sapiens
ctttggtttaagggaattttgagactggtttaatcttctagccagaccactcaaactttctccttatcagcgataaggctgtttcgctctcttaccatttrtgtgttcactggagtagcacttttccttcagccttttttctttgcattcacagcttggctatttggtgcaagaggcctagcttttggcgtgtcttagctt

SEQ ID NO: 53238 - DNA, 201 bp, Homo sapiens
cgttttttttctgaatgtcatttttagacatgtccctttattcatggtgggtattttcttagaacaaggacattctcttacataattctagcacatttatyggaatcggatttaacattatataacagtagtatctaatatgttgtcggtattcaaatttgccagtttttctccttcagaaacacctacttccccatccta

SEQ ID NO: 53239 - DNA, 201 bp, Homo sapiens
tctgtctggtctcctgctcatttatttacatcacacacctcctgggttctgtcttagtgataattattgttgtgtctgttttgtgacacttattgttgtgstgtctattttggtacacacgcggtgtcccagtgtggcctgtaggagcccctccagctgtcttctgtgtcctgttcacacgcctcttcacttctggggctc

SEQ ID NO: 53240 - DNA, 201 bp, Homo sapiens
gaatggtcagtgttatctgccatccctctcctatattgatgtttatttccaaattagggtgtttagttttcctttctttttttttttttttttttttttttgagacggagccaggctggagttcagtggtgccatcttggctcactgcaacctctgcctcctgggttcaagtagtgattctcctgcctcagcctcccgagt

SEQ ID NO: 53241 - DNA, 201 bp, Homo sapiens
aatttgggttttgactttgaactggaatggtcagtgttatctgccatccctctcctatattgatgtttatttccaaattagggtgtttagttttcctttcyttttttttttttttttttttttttgagacggagccaggctggagttcagtggtgccatcttggctcactgcaacctctgcctcctgggttcaagtagtga

SEQ ID NO: 53242 - DNA, 201 bp, Homo sapiens
gattgtgaccccggctctccaaggaggtgtgacatcatcatcatctctggccggaaagaaaagtgtgaggctgccaaggaagctctggaggtatgtgtccrtgtgcccccctccaccccccgccaaggcccagtcagcaggcacctggggagacgcgtggcctggatgggatggacggttgcccaagcggcagtggcagtg

SEQ ID NO: 53243 - DNA, 201 bp, Homo sapiens
aactcctgggctcaaatgatccttttgcctccgcctcctgagtagctgggaagcatactacaggcactgtacctggctaattaaattttttttttttttttgtagagatgggagttgtggggggtctcactctgttttgctatattgcccaagctgatcttgaacttccgacctcaagcagtcctcccacctcggcctccc

SEQ ID NO: 53244 - DNA, 201 bp, Homo sapiens
tcacaactcattgcagcttctaactcctgagctcaagtaatcctcctgcttctgccgagtagctaggactatagggtgcctggctaatttttattttttttgtcaaaatggaggtttgctatgttgcccaggctggtcttgtactcctggactcaagtccttctgcttcagcctcccaaagtgcaaagtgctgggattaca

SEQ ID NO: 53245 - DNA, 201 bp, Homo sapiens
ttcagtctttctgcttttggccatagacaatacagttaaatacctgtttttctgtccttggctggctgattctaacactgtcatttctgggtggttttctrttttcttttcctcgttatgggttttccccctattctttgcatttctggtgtttcttaatgagggtgtttttgtattcctctgaatattattttgtgtttg

SEQ ID NO: 53246 - DNA, 201 bp, Homo sapiens
agcaggttaagtgctgcctctctcctgttgcttgttttctgtaatatgtcacctttcttggcatgattcctttgtccagtcttccagcgtcctgttgtatrgtgtgggtgggctggggactgcataaatgagttggagcagtgatgttcttggccttgctctgtcctgtgagagaggaccctgcaccatctggggctcctg

SEQ ID NO: 53247 - DNA, 201 bp, Homo sapiens; identical to SEQ ID NO: 15452

SEQ ID NO: 53248 - DNA, 201 bp, Homo sapiens
ggcttatgcctgtaatacatacacatgcactttgtaatcccagcattctgggaagctgaggcagggggatcactggagcctaggagtttgagaccagcctrggcaacaaagtgagacccccatctctacaaaatatagaaaaaagttagctggacctggtggtgtgcctttgtggtcccagctactcaggagactgaggtg

SEQ ID NO: 53249 - DNA, 201 bp, Homo sapiens
atggcgtgaacccgggaggcggaactttgcagtgagccgagatcacgccactgcactccagcctgggcgacagagcgagactccatctcaaaaaaaaaaamaaaaacaaataaacaactttgtattcattgcttcctatatactagtcatcacgctatttatttctagcagtggttatcaccagggtgatttttgttaccc

SEQ ID NO: 53250 - DNA, 201 bp, Homo sapiens
accataaaagagcttacttccctcttttcagaattgtttccctcctctgtaactggtgtccccagtccaaagattctacttccctttgcagacagaaaagygatacctttttgccaggataggagagggactgtgcaggttggctctgtgtggctgtgcagagttgtggggtgcatcttagggatcttcgtgccttttaaa

SEQ ID NO: 53251 - DNA, 201 bp, Homo sapiens
ctctttggtcctgtttatttgcaactcatgttcttcaacgctgggcatttttttgatttattgctttgatttcttcctatttgctttctctctctctctctagaattctactcttggactttctggattggcactcataattttcttaaggtttctttttcccccctctaaaatttttgtttttgtttttatcttttaaat

SEQ ID NO: 53252 - DNA, 201 bp, Homo sapiens
gatttcatcgcacaatcattgggcagaagggtgaacggatccgtgaaattcgtgacaaattcccagaggtaaagtttcccagagacattctgtaactctayaggagtgatccaagtcacacttcaggaatatttgatatttgggatatatgtccttcctcatacttgaacttagtctccccatgatttgttctaggtcatc

SEQ ID NO: 53253 - DNA, 201 bp, Homo sapiens
ggtctagtgtgagagacttatttgtagaagagtaattacattatggtgtgataagtgcaatgatagaaatatgtgtaaggtgtggacataggaaataggcwgtggttacctgttggaaagtcttcctacagaatgtggtccttgaactgcggtttaaaagacgagtaagagtttttccaggtggtgctgagtggacaggaa

SEQ ID NO: 53254 - DNA, 201 bp, Homo sapiens
acactcgaacttaccctaacctgggagtcagggcaaccttccccaagcatgtgatgtttaagctcatgctgttttaatggatgagttggtgctgctgggcrggaataagcaaagatggtgtttctgccagaatgtcttggaaaaatatgctccttcagaacctacaaatattcttgttttcttttattctcttcttgctat

SEQ ID NO: 53255 - DNA, 201 bp, Homo sapiens
taaccagagaggattgtatgttcttaggtttcataagtatcttaagaaacatgtcatttagtaattatggtgaaataacttcatgatactttggcgggccrggtgcggtggctcatgaggtcaggagatcgagaccatcctggctaacatggtgaaaccccgactctactaaaaatacaaaaaattagccgggcttggtgg

SEQ ID NO: 53256 - DNA, 201 bp, Homo sapiens
tcgccatattggccaggctggtctcgaactcttgacctcaggtatctgcctgcctcagcctcccaaagtgctgggattacaggcacgagccaccgtgcccrgcctatttgaatcttttgaaatgatcaaattatctttgcccctcatgctgttaatgtggcgagtaactttactctgtttttctaatattgtaccccccca

SEQ ID NO: 53257 - DNA, 201 bp, Homo sapiens
tccatggttcttagctctttcattcgttccatctctcgattttttttctaaaatgtcacctttatgtctcttatgcttttttattgtctcaatcttagttytgtctcccgaagttcttgagtctaatcctacttctaatccatccttccttctttttgagctttgggcttttagcctctctaccatttgtgctgatctgtg

SEQ ID NO: 53258 - DNA, 201 bp, Homo sapiens
ccttgtccctcctcagttcttctccataaagcaacgggagggaccctgcaccatcaagcagaatgcctcctgctgaaaagcctgtgttgacttttactacrgggtgggatgggtgatcctcttcactgtccccctctggtgtgtgcaccaggctccgcccccatccacctcctccgctttcctgcctgtacacccttagtt

SEQ ID NO: 53259 - DNA, 201 bp, Homo sapiens
cgttacgttattgggcagaaaggaagtgggatccgcaagatgatggatgagtttgaggtagacccctttcccgggaggccatgtcacaggagtggcctgtygcatcctctcccgagtgccagtgtcctttctcaacttcctgttgactctgcctcctcctgctcggactgggcactgacttcccttcacggcgggtggcct

SEQ ID NO: 53260 - DNA, 201 bp, Homo sapiens
ggtacacacgcggtgtcccagtgtggcctgtaggagcccctccagctgtcttctgtgtcctgttcacacgcctcttcacttctggggctctcgctttctgrcataaggagctggcacaggtttaccttggccttgccctttctgtctcccctagacctctcaccccccttcccactgcctctcctgggtggggctgcgtgc

SEQ ID NO: 53261 - DNA, 201 bp, Homo sapiens; identical to SEQ ID NO: 15460

SEQ ID NO: 53262 - DNA, 201 bp, Homo sapiens
gtagggaccaaactagaaaacaggtcctacataaatcaaatcatttttattttccccaaatgagtatgttatttagtccatttctaactggaatccctaayggtgtggcttttttcttaaaggattggataaaatgagctttaagttcacatggaaagattaaatgccaatgctgaggatagaaaagagcaggcacttacc

SEQ ID NO: 53263 - DNA, 201 bp, Homo sapiens
aagccgtcctgatcccaagggacagggcagggaaggtgagtagtggtccgagagtcccttgtggcacctcatgggcatcggtcaaagccgtcatgaccccraggatgtgccaggagtcagggcctctcctcctacgtgggcctgaaggggctgctgtaattcaggagggtaggcttgggatgaagggtctggaatttctgt

SEQ ID NO: 53264 - DNA, 201 bp, Homo sapiens
gtgctgcagacaggagcaggggttctggaacttggagcagactgtgctggggtgctggtttgctaagggggttggctttccactcctcccgtgagcacgtygagtctggtgaatggggtggagctcgtgaacctcacatggtgtcagtgtacccctgcgtggactctgggttgtctcctgcagccaggtcatacctgtagc

SEQ ID NO: 53265 - DNA, 201 bp, Homo sapiens
aaattttttttcttttttttttttttgagacagagtcccgctctgtcgcccaggctggagtgcagtggtgcgatctcggctcactgcacgctccgcctccygggttcacgccattctcctgcctcagcctcccgagtagctgggactacaggtgcccgccaccacgcccggctaatttttgtatttttagtagagacgggg

SEQ ID NO: 53266 - DNA, 201 bp, Homo sapiens
actctttggtcctgtttatttgcaactcatgttcttcaacgctgggcatttttttgatttattgctttgatttcttcctatttgctttctctctctctctctagaattctactcttggactttctggattggcactcataattttcttaaggtttctttttcccccctctaaaatttttgtttttgtttttatcttttaaa

SEQ ID NO: 53267 - DNA, 201 bp, Homo sapiens
tgttttcatccatcgtcttgcctactctttggtcctgtttatttgcaactcatgttcttcaacgctgggcatttttttgatttattgctttgatttcttcytatttgctttctctctctctctctagaattctactcttggactttctggattggcactcataattttcttaaggtttctttttcccccctctaaaatttt

SEQ ID NO: 53268 - DNA, 201 bp, Homo sapiens
ctttagcgctgtcctgcccagttatgtcattggcagaatgttgttggtctgtgtcctaaatgtgtttccttttgtgttcctaagtaaacagaatcaaagaycagtacaaggtgtccgtgcgcatccctcctgacagtgagaagagcaatttgatccgcatcgagggggacccacagggcgtgcagcaggccaagcgagagc

SEQ ID NO: 53269 - DNA, 201 bp, Homo sapiens
ttgggcatgggcggtcatctctcgatgacatcccacatgtccgggcacagacacccagggcatcctagctgggtgagtaataggttctgaaacaaccagargctggtcgaagtcctggaataatcgtgggtggaggaaacttcatcttgaagaaggcatctttcaggggagatgcaggggcagtctccaacaattcctgac

SEQ ID NO: 53270 - DNA, 201 bp, Homo sapiens; identical to SEQ ID NO: 15472

SEQ ID NO: 53271 - DNA, 201 bp, Homo sapiens
actttgtatagcttcatataaggaccagtctgccttccttaactccttacctggaggataataaaccaggaactctggcagccttgtctatgtcaagcaarttactttaccaccttggtacagctatacgagttttaaaattccatccgtgctctgtctcattctttatgcaactcaagaggaccaggccttgtaaaagtt

SEQ ID NO: 53272 - DNA, 201 bp, Homo sapiens
ttacatcctcctgcctgctggaagaggccacttttccttttccctttggtgcagtggttggattagagctgcttggccagtgggtgaattgtcacttttgraaatccatctaagccctccccaaataacccacagaggccatgttgaaggcatgcccaagggcagcattctctatatttccgtcagacctgctaggttagc

SEQ ID NO: 53273 - DNA, 201 bp, Homo sapiens
cctggccagtatggcgaaaccccatctctactaaaaatacaaaaaaattagccaggcgtggcggtgggtgcttgcaatctcagctacttgggaggctgagrcaggagaatcacttgaacccgggaggcagaggttgcagtgagccaagatcatgccattgcactccagcctgtgcaacaggagcaaaactctgtctcaaaa

SEQ ID NO: 53274 - DNA, 201 bp, Homo sapiens
ggcagcattctctatatttccgtcagacctgctaggttagccaatcagtgttggtagtactcatgccttctgaacgtggaaactgctgatctggaactcaytgaagagtaaaaacattctagatttgtgcccaagtaaaacaacatggggagggatacttttttgagacagggtctcactctgtcacccaggctggagtgc

SEQ ID NO: 53275 - DNA, 201 bp, Homo sapiens
ctggtatttcctgtgttaatgataatggtttcatgtttaatgtctaggaccactgttaacacctccaccctgcactattctttttcagggttttcttgttyatttttgttggttctgtgttacaacctttataatcaactgtttgaaattgtattaatattttaaagttaattgggatgatcgccatctacttaaaccttc

SEQ ID NO: 53276 - DNA, 201 bp, Homo sapiens
ctcgactccctttatacccttaaaagaaacagtggcagttatcacttagtaaacacaatggatgcagaagtgacaagtccttcccggagggtggagacccygagagtagggattccgttccgcccagtcctgcgtatccaccgtgggctcagaggccacacaccggttcttttgcgtgtatacatctatgtagagatggag

SEQ ID NO: 53277 - DNA, 201 bp, Homo sapiens
ctgtgttaatgataatggtttcatgtttaatgtctaggaccactgttaacacctccaccctgcactattctttttcagggttttcttgttcatttttgttkgttctgtgttacaacctttataatcaactgtttgaaattgtattaatattttaaagttaattgggatgatcgccatctacttaaaccttctgttagctat

SEQ ID NO: 53278 - DNA, 201 bp, Homo sapiens
tctttttcagggttttcttgttcatttttgttggttctgtgttacaacctttataatcaactgtttgaaattgtattaatattttaaagttaattgggatratcgccatctacttaaaccttctgttagctattttaaggagtgttttctaatttcgaatgcacatactccaccttgtgttgggcttatgtcttgctattt

SEQ ID NO: 53279 - DNA, 201 bp, Homo sapiens
atcaactgtttgaaattgtattaatattttaaagttaattgggatgatcgccatctacttaaaccttctgttagctattttaaggagtgttttctaatttygaatgcacatactccaccttgtgttgggcttatgtcttgctattttcttgtccttttttcttttttccttttttctattagaaacacatcttttggccag

SEQ ID NO: 53280 - DNA, 201 bp, Homo sapiens
tttccccagaaatgtttgagcctgccacgtgtgccatgtttgtgtttgtggtagaggagatgctttcatgattgagaagaagacgcattttatactctttycccctaatgtaaatttattcattaaacacaaaagatttgtaataaaatattttttccttaagattgttatataaagtttactaatgagaaaaactccctt

SEQ ID NO: 53281 - DNA, 201 bp, Homo sapiens
tggggtgtctgcttcctaggcgtgtccagcacagctttgcccacagtgggagactagcaagccttggtggccacagttgtgctggtttccagaaacagcaraccccctggcagcagagcccctccacgcccctcgctcccactgtggatgtgccgcccagggttttccgctgcttccccttccccttccccttcttcctcc

SEQ ID NO: 53282 - DNA, 201 bp, Homo sapiens; identical to SEQ ID NO: 15449

SEQ ID NO: 53283 - DNA, 201 bp, Homo sapiens; identical to SEQ ID NO: 15450

SEQ ID NO: 53284 - DNA, 201 bp, Homo sapiens
tcgtggccctggggctcctgtggagacacccacaatgtccacaccacaacccagggatgaggccaggcagggaaaacgcaggtgcagagaagagctctgayttgaccaagatgacacagcaggaagtgacggcaccgacccctcaccacgtgctcgaattaggcaaagcacagggtcggggcctcatgccatggatgggag

SEQ ID NO: 53285 - DNA, 201 bp, Homo sapiens
ggcatcatctccatgattcaggcttctcgtgtatatgtgtgtgtgtaaaatttttgttttgccaacttgccaagcttgccttcactgttactagagcttcrttataatagagaggttttctaaacaggtcatctgcagacagtggtatttgtctccttgcttcattctgtctctttagatggcctattggacagtctttga

SEQ ID NO: 53286 - DNA, 201 bp, Homo sapiens
gagcagactgtgctggggtgctggtttgctaagggggttggctttccactcctcccgtgagcacgttgagtctggtgaatggggtggagctcgtgaacctyacatggtgtcagtgtacccctgcgtggactctgggttgtctcctgcagccaggtcatacctgtagcctttggccatgggtgttcaggggctgtggctgcc

SEQ ID NO: 53287 - DNA, 201 bp, Homo sapiens; identical to SEQ ID NO: 15473

SEQ ID NO: 53288 - DNA, 201 bp, Homo sapiens
acaccacaccggtttattgtgtgccagctcgggttaagtgctgtctatgtatatgctcatggtaacacaaaaggcattaatatcaactttttataggagargagacaggcccaggaaatcaagatctgtaattatttcttctttttgttatcttggcccttaacttttagaagttcacacatttaaacattccatcttgac

SEQ ID NO: 53289 - DNA, 201 bp, Homo sapiens
tttgtcttgttttctgtctttctgtttctgatattgctttgttgacctttgtactgtggatgcccttgaaaactggtgtatttttctgaattaactggcckgtttgacatggtcaacttccgtgttagcttaaagaacagcagaataaatgtctgtagatgtctgtaccatccttctggcctttaaccagagaggattgta

SEQ ID NO: 53290 - DNA, 201 bp, Homo sapiens
cactcgaacttaccctaacctgggagtcagggcaaccttccccaagcatgtgatgtttaagctcatgctgttttaatggatgagttggtgctgctgggcargaataagcaaagatggtgtttctgccagaatgtcttggaaaaatatgctccttcagaacctacaaatattcttgttttcttttattctcttcttgctata

SEQ ID NO: 53291 - DNA, 201 bp, Homo sapiens
ttgcagagagagaccgctggctttttgtagcaactgtcatgatgcattttgtaagcattaagaggtgtgtggtgagcaaattgacagaataaccaaggtcrctgttaggagaacgatcctggtgttgatctatgcctggagcctgggtcaggcaggtggcaggttccatggtccccccacccctgcggttaggggtggtgt

SEQ ID NO: 53292 - DNA, 201 bp, Homo sapiens
gcatgccaccacagccaattaatttttgtatttttagaagagacggggtttcaccatgttggccaggcttgtctcaaattcctgggctcaggtgatctgcycaccttggcctcccaaggtgctgggattaaaagtgtgagccaccacacccagcagggggattctgttgaagaggcagtgatatgtcagccaaggtcgcta

SEQ ID NO: 53293 - DNA, 201 bp, Homo sapiens
aggcgggtggacacttgaggtcaggagttcgagaccagcctgaccaacatggtgaaaccctgtctctactaaaaatacaaaaattagcctggcatggtggygcgcgcctgtaatcccagctgctcaagaggctgaggcatgagaatcgcttgaacccaggaggcggaggttgcagtgagccgagattgtagcactgcactc

SEQ ID NO: 53294 - DNA, 201 bp, Homo sapiens
ctcctgaagccgtgtcctctctctgcacaggctcctgacatgagcagctctgaggaatttcccagctttggggctcaggtggctcccaagaccctcccttkgggccccaaacgataatgatcaaaaagaacagaaccctctccagcctgctgacccaaacccaaccacacaatggtttgtctcaatctgacccagcggctg

SEQ ID NO: 53295 - DNA, 201 bp, Homo sapiens
catcctctgctggaaaggcgagaccctttaatccagtctactggatgctcccccattgccatgaaccgccttctcagctccggacccatgtgtcgtaaggrcaagattattgtcacggtacgagtagtcttctccagttgagtggggtgttcctgttactgtcattgcttttcccattttagacacatgcctcactcctgt

SEQ ID NO: 53296 - DNA, 201 bp, Homo sapiens; identical to SEQ ID NO: 15447

SEQ ID NO: 53297 - DNA, 201 bp, Homo sapiens; identical to SEQ ID NO: 15448

SEQ ID NO: 53298 - DNA, 201 bp, Homo sapiens
cacctccacgggggaggccagtggggaagggctgtcacctcttccccatctgcatgagttctggaactctgtcctgttggctgcttgcttccagctccccscaatctccatcgcagcgggttcctcctgtcttttctacagtgtcataaaacatcctgcccctaccctctcccaaaggtcaattttaattctcaccaagtt

SEQ ID NO: 53299 - DNA, 201 bp, Homo sapiens
ccagtggggaagggctgtcacctcttccccatctgcatgagttctggaactctgtcctgttggctgcttgcttccagctccccccaatctccatcgcagcrggttcctcctgtcttttctacagtgtcataaaacatcctgcccctaccctctcccaaaggtcaattttaattctcaccaagttttgcacatctctgtatg

SEQ ID NO: 53300 - DNA, 201 bp, Homo sapiens
gaaaaggacgctgctcgcagggctcaggaggggccactcccctaaggaccaccagatgtccttccaggcgtcactgctgcagctggctggccttgggaacygtgaagggtgtccagtgggagctgagctggggagagggttgggggcagggacaagtcagactagggccaggagcaggccatggccacgaggcacagtggg

SEQ ID NO: 53301 - DNA, 201 bp, Homo sapiens
gaatctagggaagttcttcaggatcccagcatcccagcgacatctggctggaggtgagatgcaggcagtgccaggacgcagtcagcatccaggggtcttgmtgtggaactagccaagagcatggcacctttctctttttcataaaaaagtgacaaagttggacttccgtgtaaatttgcagtttctctcaaaaccaaatca

SEQ ID NO: 53302 - DNA, 201 bp, Homo sapiens
tggatgggggtaggttcgctgtcagagactgggagtctctggcctcctctagctctcacactcagggtgctgggcctggtgacctcctggggccttttccyatcactatgaattagaagagaggggtggggggagttgtccttggagcatttgatggttcttgtttgtctgtttttaagcactaaaacccttaaaagtgtt

SEQ ID NO: 53303 - DNA, 201 bp, Homo sapiens
gactctagaggacttaaaaattgacgtagcaaggcttgctttcaagggactcaccccgttaggggagtggggctcacaatgtctgagctgatgtttaccarggaggccatgtggatgggggtaggttcgctgtcagagactgggagtctctggcctcctctagctctcacactcagggtgctgggcctggtgacctcctgg

SEQ ID NO: 53304 - DNA, 201 bp, Homo sapiens; identical to SEQ ID NO: 15436

SEQ ID NO: 53305 - DNA, 201 bp, Homo sapiens
tagaccccaaataccatcccaagattatcgggagaaagggggcagtaattacccaaatccggttggagcatgacgtgaacatccagtttcctgataaggaygatgggaaccaggtgagagcctcggttggagcgtgtcgggggcagaggtgcttgttgacctttcctgtgacttgggagcagtaaccagatgtgcctagat

SEQ ID NO: 53306 - DNA, 201 bp, Homo sapiens
cccacctcggcctcccaaagtgctgggattacaggcatgagccactgtgcccaaccaagaatgtttttttacacctctttgtttaactgtatggctatackcacacactcgcgtgttctgaaaacaagtgcacacgtcgcgtgtgttacctttgggtggaaggtgagaaggcaagcacgtcctccattcctggatagttca

SEQ ID NO: 53307 - DNA, 201 bp, Homo sapiens
ctctcatgtccaccctgtatgctagcactcagtaggacaggcacgtggtcgttttgcaggcagtgtttgtcagatgaatgggtcctgttttctgttctctrttcattatcctgctttctcgaagaggttaaccagtttcctggttttctttggcttcagtagcccttctctctgctacctgaatttgagatgttagtgagt

SEQ ID NO: 53308 - DNA, 201 bp, Homo sapiens
gttacgttattgggcagaaaggaagtgggatccgcaagatgatggatgagtttgaggtagacccctttcccgggaggccatgtcacaggagtggcctgtcrcatcctctcccgagtgccagtgtcctttctcaacttcctgttgactctgcctcctcctgctcggactgggcactgacttcccttcacggcgggtggcctt

SEQ ID NO: 53309 - DNA, 201 bp, Homo sapiens
tctgctctcagctcccacggcctaaccatgaccatcctccctgcaggcattggttcctgtcaccattgaagtagaggtgccctttgaccttcaccgttacrttattgggcagaaaggaagtgggatccgcaagatgatggatgagtttgaggtagacccctttcccgggaggccatgtcacaggagtggcctgtcgcatcc

SEQ ID NO: 53310 - DNA, 201 bp, Homo sapiens
tctgttttagctatctctttggttttggtgtggtaggttcacatcgagttcacagagggcgaagacaagatcaccctggagggccctacagaggatgtcartgtggcccaggaacagatagaaggcatggtcaaagatttggtaaggtaccccttggaatgttgtgtgtgctggtgacaagggaggctctgagttgggcat

SEQ ID NO: 53311 - DNA, 201 bp, Homo sapiens
aaagtgatgttacgatttatggatacaataaataataaaatcaagttaacataattcatcacttcaaatactttaagttttttgtggtgaaagcatatgarattactgtcagcacttttgaaatcgacattattatttactatattcaccgtgctgtacaatatatctcataaaagaaaaccacattcctcctgtctaatt

SEQ ID NO: 53312 - DNA, 201 bp, Homo sapiens
atgttacgatttatggatacaataaataataaaatcaagttaacataattcatcacttcaaatactttaagttttttgtggtgaaagcatatgagattacygtcagcacttttgaaatcgacattattatttactatattcaccgtgctgtacaatatatctcataaaagaaaaccacattcctcctgtctaattgatgtt

SEQ ID NO: 53313 - DNA, 201 bp, Homo sapiens
tgaggcaggaatatcacttgagcccaggaagtcaaggctgcagtgagctgtgattgtatcgtgccactgcattttagcctgggtgacagagcaagaccctrtctcaaaacacatatatatggaagtacagtagtgtaaatctaacattaatttctggtttctgcccccgagaaattgcagaatgtagcttagtcagtcatg

SEQ ID NO: 53314 - DNA, 201 bp, Homo sapiens
ttttcttctcatgcagttcctaactcttgtcttctttcgtaatctaaaaaaacctgctgcccagctcccatgtcctctgcttctcttgtcttgtgttgctycacctggcacagctgcatgtccatgttcccccctcagtgcatcgcctcgttgctgcctctgcgtgtgcatgtgtttgggatggacgcacaaaaagccctc

SEQ ID NO: 53315 - DNA, 201 bp, Homo sapiens
tggacttgggcatgagcctgtctgattccagagatcatccccctgttctctgtcacatccattcatggtgtttttcactgggccttgctattgccaagacrccatgctcagtcctggggatttgggttatccaaaacagtcacacccttgatttcatggagattgtggctaatggcacaaacacatgaacaaatagggcac

SEQ ID NO: 53316 - DNA, 201 bp, Homo sapiens
agggtcagacttgacatggtgtttggacgccatgtaaaatcgaaggaagtcgacttgggctttgcttattaaacagtgcctattatggtgaaattaaacgkctgaaggaatgtggatgagtcgtaatcttaaggaacatgacgatttgcccctcagttttgcgttttatgtcctcagattcatagctacctataccctaag

SEQ ID NO: 53317 - DNA, 201 bp, Homo sapiens
gcatccaggaagcatgtcacacacagccattcaagcccctttgttttcctgagaatacagggtgttttgagtaggaaactaataaactcatactgcactcygtctatgttttacacttcagtggttatttaaaactttgattttgatagaatttcacagaatagtataaagacacatcctgtggcaccagtttcttttctc

SEQ ID NO: 53318 - DNA, 201 bp, Homo sapiens
tgtcttgtgttgcttcacctggcacagctgcatgtccatgttcccccctcagtgcatcgcctcgttgctgcctctgcgtgtgcatgtgtttgggatggacscacaaaaagccctcctcgtggtccttccagcaagctgggcttccctttactgcacagtgggcaagattcctgccttgtttcctgatgatacggcttctcc

SEQ ID NO: 53319 - DNA, 201 bp, Homo sapiens
gtgcctcgtgcccctgcctacctgcttgtgcagacctcactccctcatgggttgccgtgtccagtgtggacttcaaggcataatgtggtgggggtggaggkcttgactccaactctaaaaagccctgtctgtccccagtttgttttcaaaggcctgttctcatcagatcatcccttcctttccaggacaaacgtgctgtgg

SEQ ID NO: 53320 - DNA, 201 bp, Homo sapiens
cagtcccagtgattctcatgacatcgtttggatcgcatgagccccgtcgtagagcttcctcctccacatctcccatcactgtggggtgtcccctgtgaggsaggcagctgcagcctctggctggccagagggcaccatccaagtggccggcagttctaggagggcattcagttccccgtaccatgcttgcccccagctctg

SEQ ID NO: 53321 - DNA, 201 bp, Homo sapiens
ggctggagtgcagtggtgcagtcatggctcactacagccttggctttccagactcaagcagtcctcccaccttagccttccaagtagctgggaccacaggygcatgctaccgcaccaggctaatttttttcttcttttagttagtagagatgaggtcttgttatgttgtccaggctggtctcaaactcctcaagtgatcct

SEQ ID NO: 53322 - DNA, 201 bp, Homo sapiens
agcctctggctggccagagggcaccatccaagtggccggcagttctaggagggcattcagttccccgtaccatgcttgcccccagctctgctcatgcacckggtggtggggaggcgacctgtgggatgcgggtcggttgcctctctctcacttgctctgcatttgtgaaacaaaaggtatgccctccactctgtgttatca

SEQ ID NO: 53323 - DNA, 201 bp, Homo sapiens
tcttttcattaactgtgtaccccgaagactatgcatagtagtgtatggaggctttccttctaccttttatgctatgtgttgcttcactgcatggacacaamgtggtttcttcagcccatctgcatattgaagttgtgttactttccagattttttttttttagctttttatgtctcgctatctctgctgttgcccttctga

SEQ ID NO: 53324 - DNA, 201 bp, Homo sapiens
tttcctcccctgcagagtatctacttcagccttagtagatttccttgatctttgcctccaactctaaagagcatatttgcttgacgtctgtatttgtgtcycctacccctgtttcatgtgatgtctcttcgcttgacactgagaataggtaggaagttcctagctttctttcaccctctgccttctcagtgcaaacggatc

SEQ ID NO: 53325 - DNA, 201 bp, Homo sapiens
aggctgccaaggaagctctggaggtatgtgtccatgtgcccccctccaccccccgccaaggcccagtcagcaggcacctggggagacgcgtggcctggatkggatggacggttgcccaagcggcagtggcagtggaggtagccctcttgctcctaccgtgtgcgcacgggctgtgcttctcggctggacacagagtttggg

SEQ ID NO: 53326 - DNA, 201 bp, Homo sapiens
ctggcacagctgcatgtccatgttcccccctcagtgcatcgcctcgttgctgcctctgcgtgtgcatgtgtttgggatggacgcacaaaaagccctcctcrtggtccttccagcaagctgggcttccctttactgcacagtgggcaagattcctgccttgtttcctgatgatacggcttctccagagtttggggggcctgg

SEQ ID NO: 53327 - DNA, 201 bp, Homo sapiens
tttgatccgcatcgagggggacccacagggcgtgcagcaggccaagcgagagctgctggagcttgcatctcgcatggtaagtgccatggctgggccctctrgaaaggcactggccttgcgtctcttggccccctctaaggagtagcgtgttgtggtgtgcggccttagagaatggaagtcgacaaatcccacgttgcactg

SEQ ID NO: 53328 - DNA, 201 bp, Homo sapiens
ggagaggcgatggtgaaggactccagcactgtgagctgctgtcacatcactgccgtgagtgcagaattgcccagagcgtaggggtccgtgctgtctccatrtgtgttctgagccccttccttaaccagctctgatcctggcatgggacatgaactctctcttagccaaaaagtagacttgcatcgattgactgtaatttgc

SEQ ID NO: 53329 - DNA, 201 bp, Homo sapiens
ggcttgaataggttcatgtaaagtcatcaccacttcctcaaaaggaaattaacaaaaaaaaattttaattcagacgtcttgcagataacgtggcaattgtratgagaatagcacagcagagaaaataaattttgtgactctgtttttcactgatttgtagtacctggtgatacttaagtgtcctcttttccctctccaggt

SEQ ID NO: 53330 - DNA, 201 bp, Homo sapiens
agcttctgttttgtaatcaacactgtaggggaaagggccacttcactgaatatatggatcagaatgaagacattgacccctgacactctcctactcctcarttatcttcagacaaatcccagatacattattgtgccttagttcagatcttcccgttttcatgtatacatatatatagtcattgtgctcctaactcatgta

SEQ ID NO: 53331 - DNA, 201 bp, Homo sapiens
gctgtctccatgtgtgttctgagccccttccttaaccagctctgatcctggcatgggacatgaactctctcttagccaaaaagtagacttgcatcgattgmctgtaatttgcaacgtaagttagttgttggacaaatgatctatctcacttaccctcatgacaaacctctgaaggtttgtttgcaaataccagtgctctgt

SEQ ID NO: 53332 - DNA, 201 bp, Homo sapiens
agattgctgaagagtatggcggggtgatggtcagcttcccacgctctggcacacagagcgacaaagtcaccctcaagggcgccaaggactgtgtggaggcrgccaagaaacgcattcaggagatcattgaggacctggtaggcacttgggtgctcggggaggggttctcaccccccagtggccactcaccgaagccgtgta

SEQ ID NO: 53333 - DNA, 201 bp, Homo sapiens; identical to SEQ ID NO: 15469

SEQ ID NO: 53334 - DNA, 201 bp, Homo sapiens
gccgacgatgcttaagcatcttttattccctttctagatggaggcatctttgaaaagtaaagcgcctcgtgtgatacagagcttcccctcctgcagataastctcacaaacacttagcatgtgtctgtccagagtttcctgttaaaacacactttcagaggcgtgtagtgtatgaataagtgccattttcatggcacatat

SEQ ID NO: 53335 - DNA, 201 bp, Homo sapiens
tccctctcctatattgatgtttatttccaaattagggtgtttagttttcctttctttttttttttttttttttttttttgagacggagccaggctggagtwcagtggtgccatcttggctcactgcaacctctgcctcctgggttcaagtagtgattctcctgcctcagcctcccgagtagctggtactacagatgcacgc

SEQ ID NO: 53336 - DNA, 201 bp, Homo sapiens
ccagcaggacgcagctcttcctggcccttctgtcggcctctaaacacagtgcaggctgactttcttatcacagctcgtttggctggctggaccaaatgctrcttgtttctttctggagtggggaaataacttcaaccaggtgcagtcagtgtgtattcttatctcagctgcaaaagctgttctaaatgcccttctagggaa

SEQ ID NO: 53337 - DNA, 201 bp, Homo sapiens
ttccctaacctggccttgtcagtcagcctcagtctaccatctacccaggtctgcataccccgcaaaacagtatacactttgacgcttttctgcaagcacarttaccttttgggggagcccttctcttaaagcagagtaggttaatgtttgtgaatgaaacggaactttggcaggctgaggtgtctcaggtcatcagcttac

SEQ ID NO: 53338 - DNA, 201 bp, Homo sapiens
ctccatggccagaaaggggaaagaagttgtagattttgtcataacttgaggtggagcgtttacagccatgcaggggtggacccgggccctgagaaggccaygaatttcctgtccctggtggtattaagaaatgggattagattaatatctgaggttcctttcaatcctgatttggacagtactgttagatccagtgagaat

SEQ ID NO: 53339 - DNA, 201 bp, Homo sapiens
gaacaaaaaagaaataccagagaatccaaccatcatatttaattcctgttttatttaaactttgtttccaattaatgttacagtcctttttaaaaattaawttttttttattttattccttttttttagtgacaaagcctcactctgtcacccaggctggggtgcagtagcgcagtcatagctcactgcagccttgaactc

SEQ ID NO: 53340 - DNA, 201 bp, Homo sapiens
tatgttgaccttcacgaggctgctaaataaagctcatgtatattagcgccagtcactgttttgtggattttttttttttttttttttttttttttttttttgagacggagtcttgctctgtcgcccaggctggagtgtagtggcgcaatctcgcctcactgcaagctccgcctcctgggttcacgccattctcctgcctca

SEQ ID NO: 53341 - DNA, 201 bp, Homo sapiens
ttccttctgtctgaaggaaaccactcaacatctctcgtagtgtgtatccggtaatgacttctttcacattctgtatgtctgcaagtatttttttccttcaytttcgaaaagctgtttctgctgcataaaggtttctaggttggcagtttttttcctttccagacttggcttcattgccgtctcctgttgtttctgatgaga

SEQ ID NO: 53342 - DNA, 201 bp, Homo sapiens
cgctgctgcactccagcctgggccatagagccagaccttgtctcaaaaaaaaaaaaaagaaaaaagattatgatgtttgcatttaattacagttgtgattrtatatgttatatatcacatatttatatttattacatatgtttaacaaacgcggttaaataacttactgtaatttttttcctcaattgtggtaaaatatac

SEQ ID NO: 53343 - DNA, 201 bp, Homo sapiens
tggtttgttcttttttatttcaggataatattgcactgtagggatagatcatctgtttctttgtgtgtacttggtaattagtgtctttcaaggggttttctattttctccaaggtgtcaaatgtattaacatgaagttttttagaatagtcctgcattatccttttgctgtcaatactgacgtcacctctctttcacagta

SEQ ID NO: 53344 - DNA, 201 bp, Homo sapiens
gctgtgtgcctcacctgtgccaggttgcaggtgtagcacagttacaggatgctgttagaagtgtgtcgtgggcattctgctgcaggtccaaggatgttttstgttgtttgtttgttttttgggacggagtctcgctctgtcaccaggctggagtgcagtggcgtgatctcagttcactgcaacgtccacctcccaggttca

SEQ ID NO: 53345 - DNA, 201 bp, Homo sapiens
caccacagccaattaatttttgtatttttagaagagacggggtttcaccatgttggccaggcttgtctcaaattcctgggctcaggtgatctgcccaccttggcctcccaaggtgctgggattaaaagtgtgagccaccacacccagcagggggattctgttgaagaggcagtgatatgtcagccaaggtcgctatatgcc

SEQ ID NO: 53346 - DNA, 201 bp, Homo sapiens
tctttgtggagacagttatataagtaagcgtttctagggagtctttatatccaaaagtgaggcttaatctctgaagagtagactgataggaagagagtacytggagagatgatgcagtcccaccttctcatgagacaaaggaggaagcaggccaagtgaagagggtgatgtgccaagcagtgtcagcagcagatcgcacat

SEQ ID NO: 53347 - DNA, 201 bp, Homo sapiens; identical to SEQ ID NO: 15444

SEQ ID NO: 53348 - DNA, 201 bp, Homo sapiens
tggggggcctggaactcttaacttgggggtactgggttctatccagagaggttgacagcaggagggtttgcaacagcacttgtcttgcagacacagtgaartgctcagtgtgaatctgagccaacagtagatggggtctctgggcagcagcatgggccccacaaggctcttaggcgtcagtgagtgcttttgtgtggagtt

SEQ ID NO: 53349 - DNA, 201 bp, Homo sapiens
caaatgatattactgatttaattatatttactttttaaacatttgctgataagtagacgattaggtggtcttatagcattggtttaaatcagtatgtgtgyggccgggtgcagtggctcatgcctgtaatcccagcactttgggaggcctaggtgggcagatcacgaggtcaggagatcgagaccatcctggctaacacga

SEQ ID NO: 53350 - DNA, 201 bp, Homo sapiens
tatagcagccggggcccgggcgccgcgcctcggagcgtcccggcttctcccgcgcggggggcgagtaagccagcggcaggaccagcgggcgggggcccacragtgagcgcgcaacacggggctgggaggcctgggcgggcgggcggacggggcgggcgggctgccgggcgggggggtggggggtggctgctgacgtggagg

SEQ ID NO: 53351 - DNA, 201 bp, Homo sapiens; identical to SEQ ID NO: 15437

SEQ ID NO: 53352 - DNA, 201 bp, Homo sapiens
tgtcagtgttccacgaaaaaaaaaaaaacacgtctgatcctgccttctgctgcttgcagcccccacccagctcccaccatcctcaacagcacccgtggccyggctgcaggctgtgcggacctgaccccattccctgggtaaggctgggtgtgcccctacctcttcccctgtgtgggacggtcttgtccccagatacctgta

SEQ ID NO: 53353 - DNA, 201 bp, Homo sapiens
tggcagatgcgggttttcaccatgttgcccactctggtctcaaacccctaggctcaaatgatccactcatttcagcctaccaaagtgttggaattacaggygtgagccaccacgcccagccaatcctccccttttttaatgccattgattagtggggaccgtaggtttttggttctgctattgactgattatttttggtga

SEQ ID NO: 53354 - DNA, 201 bp, Homo sapiens
tcatggcagccttgacctcctgggctcaagtgatcctcctgactcagcccttcaagtagttgagactgcaggcatgcaccatcaggcccggctttttttttgtttgttttttggcagatgcgggttttcaccatgttgcccactctggtctcaaacccctaggctcaaatgatccactcatttcagcctaccaaagtgttg

SEQ ID NO: 53355 - DNA, 201 bp, Homo sapiens
tgtccaaacaaggtcacaatgttgcatttgattatagagtcctgtctctcattctttaacagtgcttactccctcctacccccttttttttttttttttttgagacaggatctcactttgttgcccaggctggagtgcagtggtgcagacacagctcatggcagccttgacctcctgggctcaagtgatcctcctgactca

SEQ ID NO: 53356 - DNA, 201 bp, Homo sapiens
tttttagtggaaaaactcactaaactaataatagaactgggacacttaccatttttgctctttgagtgaatgaacttgaaagtaataataattttttttttaagagacagagtctcaccttgttgtctaggctcttgtgcagtggctattcacaagtgtggttatagtacactgtggcctcaaactcctgggctcaggcaa

SEQ ID NO: 53357 - DNA, 201 bp, Homo sapiens
gtcgcctgtggtctctcctagatttcgatcttgtgatctctgagtggatcaggattttattttcccattctgaactttggtttgtggtcttgagtaattttagttttggaagaggagaagtctgggtttcagccggaggcttttttggtgccctccatacccggtcctgtctggtgctttaaagcacttgcgggtctcatt

SEQ ID NO: 53358 - DNA, 201 bp, Homo sapiens
gagttatattagctgttcttggtccttgatcttttgtataaattttgttgtgtaaatatgattgtatttgtaactattctaaaaatggtgtatataaatawttttttttacaattcagtgtttgcaatgcaacattataaaaattacatatagaaaacttgtataaataaaaattgtataaaatctggttgtaaaattcca

SEQ ID NO: 53359 - DNA, 201 bp, Homo sapiens
ggcacagaggtttatttaatcaccagtcatttgatacagggtgaagacctatttgaaatgggactggctggattctacatgttttctttttttttttttttggaaacagggtcttgctgtgttgtccaggctggagtgcagtggtgccatcatggctcactgctcaacccctggggctcaggtgatcctcccacctcagct

SEQ ID NO: 53360 - DNA, 201 bp, Homo sapiens
ctgagtccggtatctccattgtctaactttgcatagaggaacatacctgtgctttggtggggacgttgtgcttgtattcgtgcagtttaatgttgaattarctctttgtggagacagttatataagtaagcgtttctagggagtctttatatccaaaagtgaggcttaatctctgaagagtagactgataggaagagagta

SEQ ID NO: 53361 - DNA, 201 bp, Homo sapiens
cagtgaattttcactaactgaactcactcatataaccagcattgagataaagaagtggaacgttttatttttagagtttagagtctgatttttttttttttcctttgagacagagttttgttcttgttgcccaggctggagtgcaatggcgcgatctcggctcaccacaacctccgcctcttgggttcaagcatttctcct

SEQ ID NO: 53362 - DNA, 201 bp, Homo sapiens
taaccttgaactcctgggctcaagggatcctcctgcctcagcctctcagtagctgggactacaggtgtgtgccatcatgcatggcttttcttattttattktattgtattttttatttttttgtggagatggggtcttgctttgttgtccaagctggtctcaaactcctgggcttaagtgatcctaaagtgctgagattac

SEQ ID NO: 53363 - DNA, 201 bp, Homo sapiens
tgcccaggtttggggagagcgtgcctctgagccccaggtgagcagcctggctttcactgtgacacgaccttgagctctgcaaacccatggctgttctcccrttttcttaggccaatagcttcaccgtctcctctgtcgccgccccttcctggcttcaccgtttcatcattggcaagaaagggcagaacctggccaaaatca

SEQ ID NO: 53364 - DNA, 201 bp, Homo sapiens
ccaggtgcagtggctcacgcctataatcctagcactttgggaggctgaggcgggcagatcacctcaggtcaggagtttgagaccagcctggccagtatggygaaaccccatctctactaaaaatacaaaaaaattagccaggcgtggcggtgggtgcttgcaatctcagctacttgggaggctgaggcaggagaatcactt

SEQ ID NO: 53365 - DNA, 201 bp, Homo sapiens
ggaggcgcaaacattaaaaaggtgataacttgtccgctgcatcttgcttcttcttgccttgtcctctgtagccctgcaccattttggttttagactaggarggactcttccttacttctagccctgtgctcaactgtgtctcaactctgggagagctctagtcagcttctcatggtgatctctctccctgtagattcgtga

SEQ ID NO: 53366 - DNA, 201 bp, Homo sapiens
ggctgaggcgggcagatcacctcaggtcaggagtttgagaccagcctggccagtatggcgaaaccccatctctactaaaaatacaaaaaaattagccaggygtggcggtgggtgcttgcaatctcagctacttgggaggctgaggcaggagaatcacttgaacccgggaggcagaggttgcagtgagccaagatcatgcca

SEQ ID NO: 53367 - DNA, 201 bp, Homo sapiens
tgttaatttggtaagaatacattgactacatactctcccttactactttttattagcattcatattaatcttatttcaaatcaaggttacagcttcatgtmatttgtagagtcagataatcctagaaaggcttgtaagaaagaagtgccaacatccttcccctaatcatgtttcctcccctgcagagtatctacttcagcc

SEQ ID NO: 53368 - DNA, 201 bp, Homo sapiens
ggatctcttgaggtcaggacgagtatgagaccagcctggccaacatggtgaaacctcgtctctactaataatacaaaacttagctgggcatggtggcgggygcctgtaatcccagctactccggagactgaggcaggagaattgcttgaacccaagagccagaggttgcggtgagccaagatcgcgccaccgcactccagc

SEQ ID NO: 53369 - DNA, 201 bp, Homo sapiens
tctgagctctttagttaggcatgattctctactagagggaatgtcaggagagtgatgctggattgctaaatataaggtcctctgttttcctccctggaggrggagaaaggagcaattctctagacatgccaatataacatttccttttatttttaagtagtgtatttctttttcttttcttttctttcttttttttttttt

SEQ ID NO: 53370 - DNA, 201 bp, Homo sapiens
tgtatttctaatacagaaaatagagggaaatggaaaatacagaaaacggaagaaatagaagtgccccattattgcactgcccagattttaacaaataaaartaatagcaagaaaatccaagccatacagagaatggtaccaaatgaaaaataattgttccttcatttctcccttcccatgcccccagcagggaggagttac

SEQ ID NO: 53371 - DNA, 201 bp, Homo sapiens
atagaagtgccccattattgcactgcccagattttaacaaataaaaataatagcaagaaaatccaagccatacagagaatggtaccaaatgaaaaataatkgttccttcatttctcccttcccatgcccccagcagggaggagttactattaagtttcttatgtgcacattttaaatttgtatgtttccccctcttactta

SEQ ID NO: 53372 - DNA, 201 bp, Homo sapiens
gattgattaaaaaaaaaaatttcgcagctgggcgcaggtggctcacgcctgtaatcctagcactttgggaggccgagacaggtggatcacctgaggtcagragttcaacacaagcctggccaacatggagaaaccctgtctaccaaaaatacaaaaattagccggacatgatggtgggtgcctgtaatcccacctacttgg

SEQ ID NO: 53373 - DNA, 201 bp, Homo sapiens
caaggggaggcaccggggagtgaccgttgtccggagccaccacggtgttttggtgagtgcaggagcgagaggagggagggccttagggaggctggtgctasccctcgtggttgaccctggtgttgagaccagttctgactgccatgctgttcccgaggctgagtctagcgtctccctggtgccaaccccagggctgactgt

SEQ ID NO: 53374 - DNA, 201 bp, Homo sapiens
gtgttttggtgagtgcaggagcgagaggagggagggccttagggaggctggtgctagccctcgtggttgaccctggtgttgagaccagttctgactgccaygctgttcccgaggctgagtctagcgtctccctggtgccaaccccagggctgactgtagctctgaccaccctgataccagggctgacctaggtattccctg

SEQ ID NO: 53375 - DNA, 201 bp, Homo sapiens
ggtagaaagaggatttgggtacaattctctcaattctttggactactagactccaggcatttaattagccttttatttatttatttatttattttgagacrgagtttcactcttgttgcccaggctggagtgcaatagtgtgctcatggctcactgcaacctctgcctcccgggctcaagcaattctcctgcctcagcctc

SEQ ID NO: 53376 - DNA, 201 bp, Homo sapiens
ccccagggctgactgtagctctgaccaccctgataccagggctgacctaggtattccctgtgacccagcacactcctgcaggtgtcggcctcggccttgaygccaacactgactcctacacccggtgaggggtgggccagctcttcctgtgccccctgcctggttgagccactgagttctggaatgggggtgagaatgtgg

SEQ ID NO: 53377 - DNA, 201 bp, Homo sapiens
taggcttgggcgagctcgcagcttccagcgctttggggtcacggtcaggctgggccggtccttgggcactcggccgccgggacacctccgccgccgcctcwccgggctgccggggaagtcggggtcgtcgggatcgtcaggatcgtcggactgcgaggggtcgccgatgctggcgtcgctgctgccgctgctgttgaagaa

SEQ ID NO: 53378 - DNA, 201 bp, Homo sapiens
gaggatttgggtacaattctctcaattctttggactactagactccaggcatttaattagccttttatttatttatttatttattttgagacagagtttcrctcttgttgcccaggctggagtgcaatagtgtgctcatggctcactgcaacctctgcctcccgggctcaagcaattctcctgcctcagcctcctgaatag

SEQ ID NO: 53379 - DNA, 201 bp, Homo sapiens
cccccttctctgggtctttcgggaggattgtgaaccctcccaattctaatacaggtcagagaataaagtctctcctggagctcggtcatccttctggcaawgctctcttcttcatttactctcccctgcttagagacagcatcttcacctcaagccacggctccaggagaaaggcatccaaggtcatggtggtgctcaccg

SEQ ID NO: 53380 - DNA, 201 bp, Homo sapiens
ggttgcagtgagccaagatcatgccattgcactccagcctgggcgacagagtgagactccatctcaaaaaaaagaaaaaaaaaaaaaagaaagaaagaaakaaaccctgagaacaggacaggttagagctgggtgaaggcaagatgtgagcttcaagtcagtgaccagttaaaaagattgttaaacatttaaatacaaaat

SEQ ID NO: 53381 - DNA, 201 bp, Homo sapiens
cttttggccctttttaaagcggtgggaatggaggagagaggtttccgttgcctcctgatgtttgctcttccggcttgatctagttctctccagcctgtctrttccccttggcacaatgcggcccttgggaacactggcctcctgatgctctctccggacggcctcttgaagccctctctcttgacaagagtcctggcctgt

SEQ ID NO: 53382 - DNA, 201 bp, Homo sapiens
atttatttatttatttattttgagacagagtttcactcttgttgcccaggctggagtgcaatagtgtgctcatggctcactgcaacctctgcctcccgggytcaagcaattctcctgcctcagcctcctgaatagctgggattacaagtgcctgcaccacacctggctaattttttttttctttttttgagatggagtctc

SEQ ID NO: 53383 - DNA, 201 bp, Homo sapiens
tgcacagcctggggtggggagaagccagggttgtcgatgggggcttttctgtaagcagcttatccagaccctgttctatttgcaaatgctcctcttctctycatgctctgtcatcccagagagggctcatttccccatggtggtcacagcttactggccaaatagtggtgggagagccacaggaaacacaccaaggagggt

SEQ ID NO: 53384 - DNA, 201 bp, Homo sapiens
agaagtggcagtggtatagatgctgcagacctctgacacatcagtcacaattttcttcttgtggaaactgaaggaagccctggttttggtccaaaagcagrcattctgtaaaggagtcaggtcctgggtggggaacgaatcttttcccagcttttggccctttttaaagcggtgggaatggaggagagaggtttccgttgc

SEQ ID NO: 53385 - DNA, 201 bp, Homo sapiens
cccagagagggctcatttccccatggtggtcacagcttactggccaaatagtggtgggagagccacaggaaacacaccaaggagggttcctggaggaccgyggtgccaagctgagtcctgccagacaaatgggagtagctggcctagggcacaggggaggcagagaggggccctgcaggcagagggaacagcatgtgcaga

SEQ ID NO: 53386 - DNA, 201 bp, Homo sapiens
catttcaacaaatatttcagtttccatttggaaacaaaattcttgtttgaaaagctgactggaaacctgtgagaatgggagttccaccctcctgtggggayggaggttgaaacagcaccagaggcttcaagaccagtctcctctcatttcggggcagtaagatacatttagcttacttaaacagactgtgctggcagagca

SEQ ID NO: 53387 - DNA, 201 bp, Homo sapiens
gattcctgtaaaagagcgattttattttaattaattaatttatttatttattttgagacggagtcttgctctgtcgcccagtctggagtgcagcggtgcartctcggctcactgcaacaaaagggtggccatattgatgacaggaggtcgcttttttctgtgtgctcaaacatccagttgttcccctgaatacagaccagg

SEQ ID NO: 53388 - DNA, 201 bp, Homo sapiens
ggtcttgctatgttgaccaggctagatatgaactcttgggctcaagcgatcctcctgcctcagcctcccgagtagctgggactacaggcgcacgccactgygcccggctagtttacttctttcagaacatttgttatcagcaaatttaaacatttcaacaaatatttcagtttccatttggaaacaaaattcttgtttgaa

SEQ ID NO: 53389 - DNA, 201 bp, Homo sapiens
actcaggtatttaaaggcagttctttatcagtcacacctctttccacagtgactacagagtctcaagtataaaaaccagagttctagaaacagagtgaagrcaagttaaccatgggaaaagattaggagtaaattcccgaagtcctgttcagaaggactctcaatcactcagctcttaaagcaacctgtcagttttcctcc

SEQ ID NO: 53390 - DNA, 201 bp, Homo sapiens
gcaggcggatcacctgaggtcaggagttcgagaccagcctgaccaacgtggagaaaccccgtccctaataaaaatacaaaattagccaggcatggtggcgygtgcctgtaatcccagctactcaggaggctgagacgggagaattgcttgaacctgggaggtggaggttgcagtgagccgagatcgtgccattgcactcca

SEQ ID NO: 53391 - DNA, 201 bp, Homo sapiens
agcacacggtgtgttcacagccacaccacccttgccccaggttacgctgtggccgtgctgcacaagacctgcagcctctcctacgtcgcgggggctccacrgtacaaacatcatggggccgtgtttgagctccagaaggagggcagagaggccagcttcctgccagtgctggagggagagcaggtacctgctggggaaagc

SEQ ID NO: 53392 - DNA, 201 bp, Homo sapiens
ggtgctcaggctggatggcggctgggcggggcagcggcatcgctctccgcacccactttcttacccaagggtgatcgttgatgataatatctctaatatcyctttttttgtggttgttgtttttgagatggagttttgctctcgttgcccaggctgcaatgcaatggcaggatcttggctcaccgcaacctctgcctccgg

SEQ ID NO: 53393 - DNA, 201 bp, Homo sapiens
tgtaatcccagctactcaggaggctgagacgggagaattgcttgaacctgggaggtggaggttgcagtgagccgagatcgtgccattgcactccagcctgrgcaacaagaacgaaactccgtctcaaaaaaataaaaataagaaaaatattagctgggcatggtggtaaacacctgtagtcccagctactcgggaggctga

SEQ ID NO: 53394 - DNA, 201 bp, Homo sapiens
ccctgcccatggaactagaggggggcgggctctgactcctgaacttccaggtaggaggaccccagctttcccctggtgctcactgtatggccttgggaagktccctggccagtgagcgtgcatcctgggtggcaacggagtgggcacccaccagcccagcgagcgtgcatcctgggtggcaacggagtgggcacccaccgg

SEQ ID NO: 53395 - DNA, 201 bp, Homo sapiens
cagcctgggcaacaagaacgaaactccgtctcaaaaaaataaaaataagaaaaatattagctgggcatggtggtaaacacctgtagtcccagctactcggsaggctgaggtgggaggatcacttgaacccaggaagtggaggctgcggtgagccgtgatcattgcaccacagcaccacgctctagcctcggtgaatgtcct

SEQ ID NO: 53396 - DNA, 201 bp, Homo sapiens
agtgggtggatcacttgaggtcaggagttcgagaccagcctggctaacatggtgaaaccctgtttctattaaaaatacaaaaaattagccgggcgtggtgktgggcacctataatcccagctacttgggagactgaggcaggagaattgcttgaacccgggaggtggaggttgcagtgagccgagatcgcgccacttcact

SEQ ID NO: 53397 - DNA, 201 bp, Homo sapiens
cgagattgcgccactacactccagcctgggccacagagcaagagtctgtctcaaaagaaaaaacaagaaagaaaactttgctgtttgaagtagttacgtcrgtaattatgaacccctatccctcttgcctggagagtgtaagtcattttgaccaagagaagagtctgtttccacctgaggtagagagcttcagatacagtg

SEQ ID NO: 53398 - DNA, 201 bp, Homo sapiens
atctgaactccacccttccctggagtcctttaataaccgccttttccattgttcagtgatacacacaatagtgtagtttttggatgggtgcagtggcccawgcctgtaatcccagcactttgggaggccgaggcgggcggatcacctgaggtcaggagttcgagaccagcctggccaacatggcaaaaccccgtctctact

SEQ ID NO: 53399 - DNA, 201 bp, Homo sapiens
ctccagcctcctcctggtccaaccaacagatggttaataactagataaatccccgccagtccagctccatgcctcccgaggcaccatattctgctgcagtrccaccctccctatgtgcggccctttcttcaccagggttctgagagagaagtgagtctaatgccctaagacactgagaaagtaaaaattagcttagactgg

SEQ ID NO: 53400 - DNA, 201 bp, Homo sapiens
tcaggagttcgagaccagcctggccaacatggcaaaaccccgtctctactaaaaatacaaaaattagccaggtgtggtgatgtacacctgtaatcccagckactcgggaggctgaggcacgagaatcacttgaacccggaggtggagattggagtgagctgagattgcgccactgcactccagcctgggcaacagagcagg

SEQ ID NO: 53401 - DNA, 201 bp, Homo sapiens
ggaagtttaacgtcaggtttcagttctgtggcgagcacactctaagcagttgtgaggattttgccccacttcctgcagttatttcacctctttttcttttktgtgtgtgtgtgtgtgtgtttgtttgagacggagtcttgctctatcaccaggctggagtgcagtggtgcgatctcggctcactgcaacctccgcctccca

SEQ ID NO: 53402 - DNA, 201 bp, Homo sapiens
tctgttttttttggagatgaagtcttgctcttgtcgcccaggctggagtgcaatggcgcagtctcggctcactgcaccctccgcctcccaggttcaagcarttctcccaccatagcctcccgaagctgggactacaggcacacgctgccacgcctggctaattttttgtgtttttagtaaagacagggtttcaccatgttg

SEQ ID NO: 53403 - DNA, 201 bp, Homo sapiens
tgagacaggagaatcgcttgaacccgggacacagaagttgtagtgagccaagattgcaccactgcactccagcctgggcgacagagcaagaccccatctcaaaaaaaaaaaagaaattaataaaaataaattgctgacttaagtataattcaactctaaacatttcagcatacatatcaacaaaatgtgtttgtgcttctt

SEQ ID NO: 53404 - DNA, 201 bp, Homo sapiens
caccgtggctcacgcctgtaatctcaacacttagggaggctgaagctggaggatttcttgaggccaggagttcaagaccaccctgggcaacatagtgagacccccccaactcaaaaaaaaccaaaaactgtctgggcatggtggtgcctgcctgtagtctcagctacttgggaggctgaggcaggaggaccacttgggccc

SEQ ID NO: 53405 - DNA, 201 bp, Homo sapiens
ctgaggcgggcggatctcttgaggtcaggacgagtatgagaccagcctggccaacatggtgaaacctcgtctctactaataatacaaaacttagctgggcrtggtggcgggcgcctgtaatcccagctactccggagactgaggcaggagaattgcttgaacccaagagccagaggttgcggtgagccaagatcgcgccac

SEQ ID NO: 53406 - DNA, 201 bp, Homo sapiens
taatacaaaacttagctgggcatggtggcgggcgcctgtaatcccagctactccggagactgaggcaggagaattgcttgaacccaagagccagaggttgmggtgagccaagatcgcgccaccgcactccagcttgggcgacagagtgagactccatctcaaaaaaataaaaataaaaaataaagtcatagcaaaagttac

SEQ ID NO: 53407 - DNA, 201 bp, Homo sapiens
aaactgttacatagtaagtaaatgggtgagtgtgtcttcccgtgagagtgcgatgtcaaatgtcattccttatatcgtgtttactcagtgtatttagagaygaaaaagtcactaaaccaaaaaaaggagtgttgccaagaagttgtatagcttttcaagagtgtttatggcaaaagtcgttaattgaacagtaattgaaca

SEQ ID NO: 53408 - DNA, 201 bp, Homo sapiens
atctcagtcaggataagctcacagatgtggccatcggggcccccctggaaggttttggggcagatgatggtgccagcttcggcagtgtgtatatctacaayggacactgggacggcctctccgccagcccctcgcaggtgacccatggggccctctccttcctctcctctggggctctgacctctctcagatatgatgacc

SEQ ID NO: 53409 - DNA, 201 bp, Homo sapiens
gcaggtctcgggggttgggaatgcccagtgaaagaaagaagtcccccaggctagggggagcttccagaccagggcctcacctcagccccttcaggttgggrggaggttccagaccagggcttcacctcggccccttcaggttcgggggaggttgtggcggtacctgtctccttccctggcctataccccctccttccaccc

SEQ ID NO: 53410 - DNA, 201 bp, Homo sapiens
ccccaggctagggggagcttccagaccagggcctcacctcagccccttcaggttggggggaggttccagaccagggcttcacctcggccccttcaggttcrggggaggttgtggcggtacctgtctccttccctggcctataccccctccttccacccacctgcctcgggtccctgcttcctctctttctgtccctcgctc

SEQ ID NO: 53411 - DNA, 201 bp, Homo sapiens
atccccaagccccacatcaagcctccttgtaccccaatcccctgtggtccaccccgtccctggccctggctgcttctcagaaggccctgctctttccccaygcctcactctttcccttactctcccctgtcaagtcccacctgccctacgaggctccatccaaatgccacttcctctgggaaagcttgctccctctttcct

SEQ ID NO: 53412 - DNA, 201 bp, Homo sapiens
tccaccccgtccctggccctggctgcttctcagaaggccctgctctttccccatgcctcactctttcccttactctcccctgtcaagtcccacctgccctwcgaggctccatccaaatgccacttcctctgggaaagcttgctccctctttcctggttctagactcggggctccctggggctggatggtgcctgcgatgct

SEQ ID NO: 53413 - DNA, 201 bp, Homo sapiens
aactggaatgtggggtggggggaggcacttctgctgcctggggggtcccattttagcctttaactgtcccatggaagcctctgggcaagccaagccatgartcctttcgggggccccctgtgatgagacagcacggtcaggtgagcccctggaggctgctaagattaagccggaggccagggtggtcctgcctagtgatct

SEQ ID NO: 53414 - DNA, 201 bp, Homo sapiens
tgctgcccaggctggagcccaggctggatcttggctcaccataacttctgcctcccaggttcaagcagttctcctgcctcagcctcccgagtagctgggawtacaggcgcctgccaccacgcctggctaatttttgtatttttagtagagacagggtctcaccatattggtcaggctggtctcctgccctcaggtgatcga

SEQ ID NO: 53415 - DNA, 201 bp, Homo sapiens
ccaggctggagcccaggctggatcttggctcaccataacttctgcctcccaggttcaagcagttctcctgcctcagcctcccgagtagctgggattacagrcgcctgccaccacgcctggctaatttttgtatttttagtagagacagggtctcaccatattggtcaggctggtctcctgccctcaggtgatcgacctgcc

SEQ ID NO: 53416 - DNA, 201 bp, Homo sapiens
caggctggagcccaggctggatcttggctcaccataacttctgcctcccaggttcaagcagttctcctgcctcagcctcccgagtagctgggattacaggygcctgccaccacgcctggctaatttttgtatttttagtagagacagggtctcaccatattggtcaggctggtctcctgccctcaggtgatcgacctgcct

SEQ ID NO: 53417 - DNA, 201 bp, Homo sapiens
caggctggatcttggctcaccataacttctgcctcccaggttcaagcagttctcctgcctcagcctcccgagtagctgggattacaggcgcctgccaccasgcctggctaatttttgtatttttagtagagacagggtctcaccatattggtcaggctggtctcctgccctcaggtgatcgacctgcctcggcctcccaaa

SEQ ID NO: 53418 - DNA, 201 bp, Homo sapiens
gcatctgaggtgggctctgaaggacggggaggtccttggcaagtacaggctgggggtgagcagaggggccttctgtgcaggggggataggagggaccaagccctggggtgtgaagagtctggtttgtaggaagatggaggcgaagtgtgagtgggagcaggagattgtctcctctggtgttgctttcccttccagccccgc

SEQ ID NO: 53419 - DNA, 201 bp, Homo sapiens
tctactaaaaatacaaaaatgagccaggcatggtggtgcgcacctgtaattccagctacttgggaggctgaggcaggagaattgcttgaacccaggaggcrgaggttgcagtgagctgagatcacaccactgcactccagcctggaagacagagagagacaccgtctcaaaaaaaaaaaaaaggccaggcgcagtggctca

SEQ ID NO: 53420 - DNA, 201 bp, Homo sapiens
gaggttgcagtgagctgagatcacaccactgcactccagcctggaagacagagagagacaccgtctcaaaaaaaaaaaaaaggccaggcgcagtggctcahgcctgtaatcccagcactttaggaggccaaggtgggcagatcatgaggtcaggagatcgagaccatcctggctaacacagtgaaactccgtctctactaa

SEQ ID NO: 53421 - DNA, 201 bp, Homo sapiens
agagacaccgtctcaaaaaaaaaaaaaaggccaggcgcagtggctcacgcctgtaatcccagcactttaggaggccaaggtgggcagatcatgaggtcagragatcgagaccatcctggctaacacagtgaaactccgtctctactaaaaacacaaaaaattagctgggcatggtggcgggtgcctgtagtcccagctact

SEQ ID NO: 53422 - DNA, 201 bp, Homo sapiens
atcacactactgcactccagcctggacaacagagcaagacactacctaaaaaacaaacaaaccccacaaaataacaggaggctattaccatcaacaaggcmggacgatgatggaaggagcatctggagaagagttgctttctagaaataatttggagagtcgggcacggtggctcatgcttgtaattccagcactttggga

SEQ ID NO: 53423 - DNA, 201 bp, Homo sapiens
gtctccactaaacaaaatacaaaaaattagccaggtgtggtggcgggcgcctgtagtcccagctacgggggaggctgaggcaggagaatggtgtgaacccrggaggcggagcttgcagtgagccaagatcgcgccgctgcactccagcctgggtgacagcgagactctgtctcaaaggaaaaaaaaaaagaaaaaagaaaa

SEQ ID NO: 53424 - DNA, 201 bp, Homo sapiens
tgtctctccctagctgagctggttctgttctgtacagtaagagaggcggccccgggatctccacggtgcttccagctgtgccgtcctggggtttttctcckcagagtccctctttccctctccattctctttgttgtctctcttcctccttattttcttcttcaatctcgatccccttcccgagccctccttccctaaaga

SEQ ID NO: 53425 - DNA, 201 bp, Homo sapiens
tcactctgaggaggtgtttgagactgaaatgctccagatttgattatccagttgctcacgggcatcgcccctagaagagataatagcatctttgcataacrtgtccatgtccaaaatagatcttttggtgcaaaaaaccaaccctctgtcccaacccgttccttagctaccctcaggagggagatatactccagttacagt

SEQ ID NO: 53426 - DNA, 201 bp, Homo sapiens
actttaggaggccaaggtgggcagatcatgaggtcaggagatcgagaccatcctggctaacacagtgaaactccgtctctactaaaaacacaaaaaattakctgggcatggtggcgggtgcctgtagtcccagctactcgggaggctgaggcaggagaatggcgtgaacccgggaggcggagcttgcagtgagccgagatt

SEQ ID NO: 53427 - DNA, 201 bp, Homo sapiens
catgaggtcaggagatcgagaccatcctggctaacacagtgaaactccgtctctactaaaaacacaaaaaattagctgggcatggtggcgggtgcctgtartcccagctactcgggaggctgaggcaggagaatggcgtgaacccgggaggcggagcttgcagtgagccgagattgcgccactgcactccagcctgggcga

SEQ ID NO: 53428 - DNA, 201 bp, Homo sapiens
ggtcaggagatcgagaccatcctggctaacacagtgaaactccgtctctactaaaaacacaaaaaattagctgggcatggtggcgggtgcctgtagtcccmgctactcgggaggctgaggcaggagaatggcgtgaacccgggaggcggagcttgcagtgagccgagattgcgccactgcactccagcctgggcgacagag

SEQ ID NO: 53429 - DNA, 201 bp, Homo sapiens
tgaggcaggagaatggcgtgaacccgggaggcggagcttgcagtgagccgagattgcgccactgcactccagcctgggcgacagagcgagactccgtctcaaaaaaaaaaaaaaaatatatatatatatatatatatatttagtttccagcacacagtagtgctcaaggcctgttggcctttcttgttattagggagatga

SEQ ID NO: 53430 - DNA, 201 bp, Homo sapiens
cgtgaacccgggaggcggagcttgcagtgagccgagattgcgccactgcactccagcctgggcgacagagcgagactccgtctcaaaaaaaaaaaaaaaawatatatatatatatatatatatttagtttccagcacacagtagtgctcaaggcctgttggcctttcttgttattagggagatgaagggtgagggagagag

SEQ ID NO: 53431 - DNA, 201 bp, Homo sapiens
tctagctttttgctttactgtcatcagctttgatcaatacacgggttgttgccaagtcctcgtattttgctccttaaaataacatgtaggattttttcctygtttgcttcacctgatttattgggcgatctctttgtcttgtctagatcactgtcgtcttcctgaaagatgagaagtaccattctttgcctatcatcatta

SEQ ID NO: 53432 - DNA, 201 bp, Homo sapiens
aacccgggaggcggagcttgcagtgagccgagattgcgccactgcactccagcctgggcgacagagcgagactccgtctcaaaaaaaaaaaaaaaatatawatatatatatatatatatttagtttccagcacacagtagtgctcaaggcctgttggcctttcttgttattagggagatgaagggtgagggagagagatgg

SEQ ID NO: 53433 - DNA, 201 bp, Homo sapiens
gcgagtccagtctgaggaaacaagctgagccaggcctggcagacctgggcaccagctggctctcagggaaagcccagcaaatacagcgaactaccccaccacacacacacacacacacacacacacacacacacacacggatgcacacacacacacacggatgcacacacatggatgcacacacacacggatgcacacaca

SEQ ID NO: 53434 - DNA, 201 bp, Homo sapiens
gtccagtctgaggaaacaagctgagccaggcctggcagacctgggcaccagctggctctcagggaaagcccagcaaatacagcgaactaccccaccacacacacacacacacacacacacacacacacacacacggatgcacacacacacacacggatgcacacacatggatgcacacacacacggatgcacacacacagg

SEQ ID NO: 53435 - DNA, 201 bp, Homo sapiens
cgtcctggggtttttctcctcagagtccctctttccctctccattctctttgttgtctctcttcctccttattttcttcttcaatctcgatccccttcccragccctccttccctaaagaaggctgactcagtcctgggaatgtgctgctccgggtttggggcgggagcactcagagaccctggtcaggtgtcagaagacg

SEQ ID NO: 53436 - DNA, 201 bp, Homo sapiens
gcgtgatctcggctcactgcaacctctgcctcccaagttcaagcaattctcctgcctcagcctcccgagtagctgggattacaggcatgtatcaccatgcycggctaatttttgtacttttagtagagacggggtttcactatgttggccaggctggtcttgaacacctgacctcaggtgatctaccctcctcggcctccc

SEQ ID NO: 53437 - DNA, 201 bp, Homo sapiens
gtcttagaatgccccccaggccgggcgcggtggctcatgcctgtaatcccagcactttgggaggcagaggtaggcggatcatgaggtcaggagtttgagasaagcctggtcaacatggtaaaaccccgtctctactaaaaatacaaaaattagctgggcatggtggtgggcgcctgtaatcacagctactgggcaggctga

SEQ ID NO: 53438 - DNA, 201 bp, Homo sapiens
gcgcggtggctcatgcctgtaatcccagcactttgggaggcagaggtaggcggatcatgaggtcaggagtttgagacaagcctggtcaacatggtaaaacyccgtctctactaaaaatacaaaaattagctgggcatggtggtgggcgcctgtaatcacagctactgggcaggctgaggcaggagaatcgctcaaactcgg

SEQ ID NO: 53439 - DNA, 201 bp, Homo sapiens
attgtgattctgttggccagctggctggagttgccgtatatggggaagaacgcagttccccaagtcctggtcagccctttcatagacatttgcaggaccarttgaagactttcaaatgctctggaatccaggctaacaagcaggcacagctgtttccagcagggaattaattacagccaagaaccaacctcccagccagct

SEQ ID NO: 53440 - DNA, 201 bp, Homo sapiens
taggcaggagaatcgcttgaacccaggaggcggaggttgcaatgagccgagatcgtgccattgcactccagcctgggcgacaatagcaagactccatctcaaaaaaaaaaaaaaaaaaaaaggatgaagaggaagccaggagacaggctgaggacagagcacttcaatcaggcaaggggaggattttgtacacatgtgcac

SEQ ID NO: 53441 - DNA, 201 bp, Homo sapiens
accccatctctactaaaaatacaaaaaattagctgggcatggtgatgggcacctgttttcccagctactcaggaggctgaggcaggagaatcgcttgaacrcgggaggcggaggttgcagtgagacgaaagttgtgccactgcattccagcctgggcgacagagtgagactctgtctaaaaaaaaaagaaaaaagaaaaag

SEQ ID NO: 53442 - DNA, 201 bp, Homo sapiens
gtttaacgtcaggtttcagttctgtggcgagcacactctaagcagttgtgaggattttgccccacttcctgcagttatttcacctctttttcttttgtgtgtgtgtgtgtgtgtgtttgtttgagacggagtcttgctctatcaccaggctggagtgcagtggtgcgatctcggctcactgcaacctccgcctcccaggtt

SEQ ID NO: 53443 - DNA, 201 bp, Homo sapiens
acttcctgcagttatttcacctctttttcttttgtgtgtgtgtgtgtgtgtgtttgtttgagacggagtcttgctctatcaccaggctggagtgcagtggygcgatctcggctcactgcaacctccgcctcccaggttcaagcgagtctcctgcctcagcctcccaagcagctaggactacaggcatgcgccaccacgccc

SEQ ID NO: 53444 - DNA, 201 bp, Homo sapiens
tcctgcagttatttcacctctttttcttttgtgtgtgtgtgtgtgtgtgtttgtttgagacggagtcttgctctatcaccaggctggagtgcagtggtgcratctcggctcactgcaacctccgcctcccaggttcaagcgagtctcctgcctcagcctcccaagcagctaggactacaggcatgcgccaccacgcccagc

SEQ ID NO: 53445 - DNA, 201 bp, Homo sapiens
gtgtgtgtttgtttgagacggagtcttgctctatcaccaggctggagtgcagtggtgcgatctcggctcactgcaacctccgcctcccaggttcaagcgaktctcctgcctcagcctcccaagcagctaggactacaggcatgcgccaccacgcccagctaatttttgtatttttagtagagatagggtttcactgtgttg

SEQ ID NO: 53446 - DNA, 201 bp, Homo sapiens
tgcgatctcggctcactgcaacctccgcctcccaggttcaagcgagtctcctgcctcagcctcccaagcagctaggactacaggcatgcgccaccacgccyagctaatttttgtatttttagtagagatagggtttcactgtgttggctgggctggtcttgaactcctgacctcaggtgatccacccatgtcggcctccca

SEQ ID NO: 53447 - DNA, 201 bp, Homo sapiens
ctcggctcactgcaacctccgcctcccaggttcaagcgagtctcctgcctcagcctcccaagcagctaggactacaggcatgcgccaccacgcccagctamtttttgtatttttagtagagatagggtttcactgtgttggctgggctggtcttgaactcctgacctcaggtgatccacccatgtcggcctcccaaaatgc

SEQ ID NO: 53448 - DNA, 201 bp, Homo sapiens
ccctggcctcgtggccacttttttctcctccttcaactgcacacccccatttagacaaatgagtaaaacagtatctgtctgaaaagagaaaactctgagtwataaagagtgattttatatatatttctttggtacctccctattctcaaggcccagaacttaatactgttatgttcggttacctgtgagttcaatagggcc

SEQ ID NO: 53449 - DNA, 201 bp, Homo sapiens
gagaggcccactcctagggatgctaagattgactagtgggctcaggtggtgtcagcctaattgtaaagttagtctatcagactctcatttagaagctttacctgttgatgatcctggcctgaattaattattgtatttcattagggctcacaaaatagtttggttctattattcttcctacatttattagtaataatttat

SEQ ID NO: 53450 - DNA, 201 bp, Homo sapiens
tctaccaaaaatacaaaattgatctgggtgtggtggcacatgcctgcaatcccagctacaggggaggttgaggcaggagaatcgcttgaacctgggaggckgaggttgcagtgagccgagattgcaccactgcactccagcctgggtgacagagcgagactccatctcaaaaaacaaaaaacaaaaaaaaagaaggaaaga

SEQ ID NO: 53451 - DNA, 201 bp, Homo sapiens
gaatgctgggatgcatcacaggtatgctggaagatgtatagaattttacttctgttattctggtaactcagagtcctgttcagtcagtttccacgtcaggwtgctgtcctggttttaaagagaatgaacgcagccgaagttgaatcgaggcagtgatttcactcagtgcgttgggtctttccactcacctggccctccaga

SEQ ID NO: 53452 - DNA, 201 bp, Homo sapiens
tagatttgtccccggtcatcttaggctatttgggctaggacagtatccattatatgaatgaagcaatctcctaggccgggcaccgtggctcacggctgtamtcccatcactttgggaggctgaagtgggtggatcacttgaggtcaggagttcgagaccagcctggctaacatggtgaaaccctgtttctattaaaaatac

SEQ ID NO: 53453 - DNA, 201 bp, Homo sapiens
tgacaggcagaaaaattagtgaatgtttgctgaattgctgtgaggaaaccacgtttttgttttgttttgtttggctctttaagagaatgtcatctgctctkttaacagcctccctctccaaacattcagtgtgatgaccctcagccggttgcttctgtcctgatcatgaactgcaggattggtcaccccgtcctcaagagg

SEQ ID NO: 53454 - DNA, 201 bp, Homo sapiens
attcagtgtgatgaccctcagccggttgcttctgtcctgatcatgaactgcaggattggtcaccccgtcctcaagaggtcatctgtgagtcggtttggacygattcgctcttctcaccaccctgcagttggcgtcttctgcatcttggtctcatctcaatctctcggttccagctttgcgcttcgcttgactgcagtgtgt

SEQ ID NO: 53455 - DNA, 201 bp, Homo sapiens
tcacacacaaagtaaaactgtggtacagcctggtggaatgagccctggagttctggttctcgttcactcagctttggaatagcttgggatagctatgttayctgcaagacctctgtgttggggggtaaggtggggaacgctgctgggaagagttctcaaagggaggtgattctgcccaccagaggctgtgcctgttttgat

SEQ ID NO: 53456 - DNA, 201 bp, Homo sapiens
tacaaaattgatctgggtgtggtggcacatgcctgcaatcccagctacaggggaggttgaggcaggagaatcgcttgaacctgggaggcagaggttgcagygagccgagattgcaccactgcactccagcctgggtgacagagcgagactccatctcaaaaaacaaaaaacaaaaaaaaagaaggaaagagagagagggaa

SEQ ID NO: 53457 - DNA, 201 bp, Homo sapiens
attgatctgggtgtggtggcacatgcctgcaatcccagctacaggggaggttgaggcaggagaatcgcttgaacctgggaggcagaggttgcagtgagccragattgcaccactgcactccagcctgggtgacagagcgagactccatctcaaaaaacaaaaaacaaaaaaaaagaaggaaagagagagagggaagggagg

SEQ ID NO: 53458 - DNA, 201 bp, Homo sapiens
gtggtggcacatgcctgcaatcccagctacaggggaggttgaggcaggagaatcgcttgaacctgggaggcagaggttgcagtgagccgagattgcaccaytgcactccagcctgggtgacagagcgagactccatctcaaaaaacaaaaaacaaaaaaaaagaaggaaagagagagagggaagggagggagggagggagg

SEQ ID NO: 53459 - DNA, 201 bp, Homo sapiens
ggcacatgcctgcaatcccagctacaggggaggttgaggcaggagaatcgcttgaacctgggaggcagaggttgcagtgagccgagattgcaccactgcaytccagcctgggtgacagagcgagactccatctcaaaaaacaaaaaacaaaaaaaaagaaggaaagagagagagggaagggagggagggagggagggggga

SEQ ID NO: 53460 - DNA, 201 bp, Homo sapiens
catcagattaaagaaattcacagccgggcatggtggctcatgcctgtaatcccagcactttgggaggctgaggtgggcggatcacctgaggtcaggagttyaagaccagcctggccaacatggggaaaccctgtctctaataaaaatacaaaacttagccgggtgtggtggcacatgcctgtaatcccagctacttgggag

SEQ ID NO: 53461 - DNA, 201 bp, Homo sapiens
tttgggaggctgaggtgggcggatcacctgaggtcaggagttcaagaccagcctggccaacatggggaaaccctgtctctaataaaaatacaaaacttagscgggtgtggtggcacatgcctgtaatcccagctacttgggaggctgaggcaggagaatcgcttgaaccagggaggcggaggttgtagtgagccgagatca

SEQ ID NO: 53462 - DNA, 201 bp, Homo sapiens
gtcaccaggctggagtgcagtggcgcaatcttggctgactgcaacctccgcctcccgggttcaagtgatcctcctgcctcagcctcccgagtagctgggaytacaggtgtgcgccaccacgcccagctaatttttgcatttttagtagagatggagtttcaccatgttggccaggatagtctcaatctcttgacctcgtga

SEQ ID NO: 53463 - DNA, 201 bp, Homo sapiens
aaggaatttgttcatttcacccagattgtcaagtttactggcataaggttggatataacatcctcttacttttttttttttttttttttgagatggagtcyctctctgtcacccaggctggagtgcagtggcgcgatctcggctcactgcaagctccgcctcccgggttcacgccattctcctgcctcagcctcccgagta

SEQ ID NO: 53464 - DNA, 201 bp, Homo sapiens
cgcgatctcggctcactgcaagctccgcctcccgggttcacgccattctcctgcctcagcctcccgagtagctgggactacaggcgcccgccaccacgccyggctaattttttgtattttcagtagagacggggtttcaccgtgttagccaggacggtctcgatctcctggcctcgtgatccgcccgcctcggcctcccaa

SEQ ID NO: 53465 - DNA, 201 bp, Homo sapiens
atggcacgatctcggctcactgcaacctccacctccctggttcaagtgattctcctgtctcagcctcccaagtggttgggattacaggtggctgtcagcaygcctgcctgatttttgtgtttttagtagagatggggcttcaccatgttggccagggtggttttgaactcctgacctcaagtgatccgcctgcctcggcct

SEQ ID NO: 53466 - DNA, 201 bp, Homo sapiens
tatttatttattttttgagacgagtctcgctctgtcgcccaggctggagtgctgtggcgtgatctcggctcactgcaacctctgcctccaggttcaagcarttctctgcctcagcctcccgagtagctgggattacaggcgcccgccaccacgcccagctaatttttgtagttttagtagagatggggtttcaccatcttg

SEQ ID NO: 53467 - DNA, 201 bp, Homo sapiens
agtcactaaaccaaaaaaaggagtgttgccaagaagttgtatagcttttcaagagtgtttatggcaaaagtcgttaattgaacagtaattgaacaggtaartctgtaaactggacttcaccttgcttttttcccatgtaaatgtagattagagatgggagcagtggctcacacctgtaatcccagcacgttgaacggctga

SEQ ID NO: 53468 - DNA, 201 bp, Homo sapiens
aaatccagatggacaaaaggttcgaacataagaaattaaagaagagaccgggccttggctcacgcctgtaatcccagcactttgggaggctgaggcgggcrgatcacctgaggtcaggagttcaagaccatcctggccaacgtggtgaaaccccgtctctactaaaatacaatattagccgggcatgatggcgggtgcctg

SEQ ID NO: 53469 - DNA, 201 bp, Homo sapiens
catgggggctcacacccgtaatcccagcactttgggaggctgaggccggcagatcacttgaggtcaggagttcgagaccagcctggccaacatggtgaaamcccatctctactaaagataccaaaaaaaaaaaaatttagctgggcatggtggcaggtgcctgtaattccagctactcaggaggctgaggcaggagaatca

SEQ ID NO: 53470 - DNA, 201 bp, Homo sapiens
aaaaaggagtgttgccaagaagttgtatagcttttcaagagtgtttatggcaaaagtcgttaattgaacagtaattgaacaggtaagtctgtaaactggamttcaccttgcttttttcccatgtaaatgtagattagagatgggagcagtggctcacacctgtaatcccagcacgttgaacggctgaatcacctgaggtca

SEQ ID NO: 53471 - DNA, 201 bp, Homo sapiens
tgtatagcttttcaagagtgtttatggcaaaagtcgttaattgaacagtaattgaacaggtaagtctgtaaactggacttcaccttgcttttttcccatgyaaatgtagattagagatgggagcagtggctcacacctgtaatcccagcacgttgaacggctgaatcacctgaggtcaggagttcgagaccagcctggcca

SEQ ID NO: 53472 - DNA, 201 bp, Homo sapiens
ttcattgtagtgttttgtatttttccttttaattcagtcaatttttgcttttatattttgaaatgatgttattggataaatacagatttaaaattgtcacrtcttcttagtgaatcaaaaacaacatatttgtgtgcatatatctccttcccttccttatacagaagctagtgtcgtttatacacttgtccttcatgtagt

SEQ ID NO: 53473 - DNA, 201 bp, Homo sapiens
gactacagccttgactgtctgtctctgatggggctcagttagagccagaggttagagagtggcagctcctccaggaaaggagtcttgctcggtgggtcagrgccccaggcttgttgggaagggcggctgaggcttcgtgttgccagttctgtcagccagggcctttggactccagggctctgccattctgttcctcctcca

SEQ ID NO: 53474 - DNA, 201 bp, Homo sapiens
gtagtgttttgtatttttccttttaattcagtcaatttttgcttttatattttgaaatgatgttattggataaatacagatttaaaattgtcacgtcttcytagtgaatcaaaaacaacatatttgtgtgcatatatctccttcccttccttatacagaagctagtgtcgtttatacacttgtccttcatgtagtgatttt

SEQ ID NO: 53475 - DNA, 201 bp, Homo sapiens
ttgcttttttcccatgtaaatgtagattagagatgggagcagtggctcacacctgtaatcccagcacgttgaacggctgaatcacctgaggtcaggagttygagaccagcctggccaacacggtgaaaacctatctctactaaaaatacaaaaattagctgggggtggtggtgtgtacctgtaatcccggctacttgggag

SEQ ID NO: 53476 - DNA, 201 bp, Homo sapiens
ggcggatcatctgaagtcgggagttcgagaccagcttaaccaaaatggagaaactccgtctctactgaaaatacaaaaattggccgggtgcagtggctcaygcctgtaatcccagcactttgggaggccgaggtgggcggatcagctgaggtcaggagttcgaaactagcctgaccaacatggagaaaccccatctctact

SEQ ID NO: 53477 - DNA, 201 bp, Homo sapiens
ggcggatcagctgaggtcaggagttcgaaactagcctgaccaacatggagaaaccccatctctactaaaaatacaaaattaggccaggcgcggtggctcaygcctgtaatcccagcactttgggaggccgaggtgggcggatcacgaggtcaggagatcgagaccaacctggcttaacacggtgaaaccccctctctacta

SEQ ID NO: 53478 - DNA, 201 bp, Homo sapiens
cacgaggtcaggagatcgagaccaacctggcttaacacggtgaaaccccctctctactaaaaatacaaaaaattagccgggcaggcgcctgtagtcacagstactcaggaggctgaggcaggagaatggtgtgaacctgggaggcaaagcttgcagtgagctgagatctcgcctctgcgctccagcctgggtgacagagtg

SEQ ID NO: 53479 - DNA, 201 bp, Homo sapiens
tgactccatttccaaaaaaaaaaaaaaaacaaataaacaaacaaacaaaaaaaccaaaaattagccgggcatggtggcacatgcctgtaatcccagctacwcgggaggctgaggcaggagaatcgcttgaacctgggaggcagaggttgcggtgagccgagatcgtgccactgcactccagcctgggcaacaagagcgaaa

SEQ ID NO: 53480 - DNA, 201 bp, Homo sapiens
aaaaaaaaaaaacaaataaacaaacaaacaaaaaaaccaaaaattagccgggcatggtggcacatgcctgtaatcccagctactcgggaggctgaggcagragaatcgcttgaacctgggaggcagaggttgcggtgagccgagatcgtgccactgcactccagcctgggcaacaagagcgaaactccatcttaaaaaaat

SEQ ID NO: 53481 - DNA, 201 bp, Homo sapiens
aacaaataaacaaacaaacaaaaaaaccaaaaattagccgggcatggtggcacatgcctgtaatcccagctactcgggaggctgaggcaggagaatcgctrgaacctgggaggcagaggttgcggtgagccgagatcgtgccactgcactccagcctgggcaacaagagcgaaactccatcttaaaaaaataataataatt

SEQ ID NO: 53482 - DNA, 201 bp, Homo sapiens
aggttttggggcagatgatggtgccagcttcggcagtgtgtatatctacaatggacactgggacggcctctccgccagcccctcgcaggtgacccatgggrccctctccttcctctcctctggggctctgacctctctcagatatgatgacccaagccccaagtcggcttcagtcctaagtgctgggcaggtctcgggggt

SEQ ID NO: 53483 - DNA, 201 bp, Homo sapiens
cttacgatgctctgtgtccgaagtgttaaaaagatttcagactttccgcacggaaaggaattgtgttcactagacctcgcttttccagcatgtggaagaakggcattcagtgagctgtgtcatcgcttcagataaagaaaatgtcaccgtggctgcagagatctcctgggatcactctgaggaggtgtttgagactgaaat

SEQ ID NO: 53484 - DNA, 201 bp, Homo sapiens
cacccccatttagacaaatgagtaaaacagtatctgtctgaaaagagaaaactctgagtaataaagagtgattttatatatatttctttggtacctccctrttctcaaggcccagaacttaatactgttatgttcggttacctgtgagttcaatagggcctggaaggtcaaccctaggccagcatttataacttacttgga

SEQ ID NO: 53485 - DNA, 201 bp, Homo sapiens
ggtcaccagccccagaaccaagaggacaccagggcccctccatcgatgttcccttgtccaggatgaaatcctttgccatcctgtaggtaagtcagccccamctccagggaatgctccccaggaccccctttctagcaaaatccccctcatctaaactcaaaccattccaaccccagccctgcctcatccagcccgttcacc

SEQ ID NO: 53486 - DNA, 201 bp, Homo sapiens
tgaggcaggagtatcgtttgagcccaggaatttgaagcttcagtgagctatgattgagccactccattccggcccgggtaacagagtgagaccttgtctcaaaaaaaaaaaaaaaaaaaaaaaaaaaggaaaaatctcttacgttaaataaaatgaataagctgggtgtggtggctcatgcctgtaatctcagcactgtgg

SEQ ID NO: 53487 - DNA, 201 bp, Homo sapiens
aaaaaaggaaaaatctcttacgttaaataaaatgaataagctgggtgtggtggctcatgcctgtaatctcagcactgtgggaggctaaggtgggtggattrcttgagcccaggagtttgagaccagcctgggcaacatggtaaaaccccatctctacaaaaaatacaaaaattagcccagtgtggtggggtgcacctgtgg

SEQ ID NO: 53488 - DNA, 201 bp, Homo sapiens
agaacttaatactgttatgttcggttacctgtgagttcaatagggcctggaaggtcaaccctaggccagcatttataacttacttggaagaggccttaacrgtaaggccttaaaacagatgtgactgttgttcccctgttgaaatcttttccttgccttcccgtcttaatgtgcaaactcttctactgctatttaagatcc

SEQ ID NO: 53489 - DNA, 201 bp, Homo sapiens
gccgggcatggtggcacatgcctgtaatcccagctactcgggaggctgaggcaggagaatcgcttgaacctgggaggcagaggttgcggtgagccgagatsgtgccactgcactccagcctgggcaacaagagcgaaactccatcttaaaaaaataataataattttggaacaagatgatgatatactcttaaaacaagga

SEQ ID NO: 53490 - DNA, 201 bp, Homo sapiens
aggagaatcgcttgaacctgggaggcagaggttgcggtgagccgagatcgtgccactgcactccagcctgggcaacaagagcgaaactccatcttaaaaaaataataataattttggaacaagatgatgatatactcttaaaacaaggatgaaaatgtcttcacagtcagtccaggcaacactgggggagataaaccttct

SEQ ID NO: 53491 - DNA, 201 bp, Homo sapiens
atatcaggccgggcgcggtggctcacgcgtgtaatcccagcactttgggaggccaaggcgggcggatcacctgaggagttcaataccagcctgggcaatayggtgaaaccccacctctactaaaaatacaaaaattatccaggtgtggtggtgcgtgcctataatcccagctactcaggaggccgaggcaggagaatcgct

SEQ ID NO: 53492 - DNA, 201 bp, Homo sapiens
ggagaatcgcttgaacctgggaggcagaggttgcggtgagccgagatcgtgccactgcactccagcctgggcaacaagagcgaaactccatcttaaaaaaataataataattttggaacaagatgatgatatactcttaaaacaaggatgaaaatgtcttcacagtcagtccaggcaacactgggggagataaaccttctc

SEQ ID NO: 53493 - DNA, 201 bp, Homo sapiens
tcttggctcaccataacttctgcctcccaggttcaagcagttctcctgcctcagcctcccgagtagctgggattacaggcgcctgccaccacgcctggctratttttgtatttttagtagagacagggtctcaccatattggtcaggctggtctcctgccctcaggtgatcgacctgcctcggcctcccaaagtgttggga

SEQ ID NO: 53494 - DNA, 201 bp, Homo sapiens
gagaatcgcttgaacctgggaggcagaggttgcggtgagccgagatcgtgccactgcactccagcctgggcaacaagagcgaaactccatcttaaaaaaataataataattttggaacaagatgatgatatactcttaaaacaaggatgaaaatgtcttcacagtcagtccaggcaacactgggggagataaaccttctcc

SEQ ID NO: 53495 - DNA, 201 bp, Homo sapiens
tggactctccaggagagattcagagtaagttaggagaagggagtagtaagtatgagaagcagaggaatataggggctatttaggcaacagccagaatgccrgttttctgaaacagatggctatctttggcctgtaactggacttttccttcctttgtttcagtgtggcttttttaaaagaaaatatcaacaactgaacttg

SEQ ID NO: 53496 - DNA, 201 bp, Homo sapiens
aatgtgtagggtaccagcaaggaacacgtttttggacagattttaatattttatatttcattttattttattttattttttgagacagagtcttgctctgytgcccaggctggagcccaggctggatcttggctcaccataacttctgcctcccaggttcaagcagttctcctgcctcagcctcccgagtagctgggatta

SEQ ID NO: 53497 - DNA, 201 bp, Homo sapiens
acgtatatctatctacccatccagcaagccatcttatattttgatgcattttaaagtaaattgcacgctggatgtggtggctcacacctgtaatcccagcrctttgggaggccaaggcaggtggatcacttgaggtcaggagttcgaaaccagctcggtcaacattgtgaaaccctgtctctactaaaaatacaaaaaatt

SEQ ID NO: 53498 - DNA, 201 bp, Homo sapiens
gaaagtgccggtctgtgggtccttgctggtgtgtgtgcttctgtccccgcctcctggcctcctggctgaggggaagctgagtgggccacggcccatgtgtygcactcgcctcggctcccacacagccgcctctgctccagcaaggatgtggctcttccacactctgctctgcatagccagtaagtcctctcacccgctgct

SEQ ID NO: 53499 - DNA, 201 bp, Homo sapiens
tatctatctacccatccagcaagccatcttatattttgatgcattttaaagtaaattgcacgctggatgtggtggctcacacctgtaatcccagcactttsggaggccaaggcaggtggatcacttgaggtcaggagttcgaaaccagctcggtcaacattgtgaaaccctgtctctactaaaaatacaaaaaattagccg

SEQ ID NO: 53500 - DNA, 201 bp, Homo sapiens
tcccagctatgtgggaggctgagacaggagaatcgcttgaacccgggacacagaagttgtagtgagccaagattgcaccactgcactccagcctgggcgasagagcaagaccccatctcaaaaaaaaaaaagaaattaataaaaataaattgctgacttaagtataattcaactctaaacatttcagcatacatatcaaca

SEQ ID NO: 53501 - DNA, 201 bp, Homo sapiens
caccttggtaattcaaacacctatcaagatatagaatattttcatcattccagaaagttccttctagtcccttcccagttagtcccatcctctcaagcatttttttttttttactataggttagttttgctggttctagaacctcatataaatggagttatacaatatgatttttattgccttagcttaacaaatctgctg

SEQ ID NO: 53502 - DNA, 201 bp, Homo sapiens
cagcagtgcttacagtggctaagctggctctgaaagtagggggtgatggggacgagagctttccagtacacagccctaggtgaactgcctgctcacctccrtgaagcagagtgaagttgtgggtagtatggagggcgtgtcagacaaaaagtttttttgtttgtttgtttttgagatggagtttcattctgtcacccaggc

SEQ ID NO: 53503 - DNA, 201 bp, Homo sapiens
aggggccacaaggaacctcaggcaggctgggggccttctgtctgcggctggctcatccccacctcatcgggaaggtctggtcttcattcccaggcctccgygaggcacttctcaacttcacgctggatgtggatgtggggaagcagaggagacggctgcagtgttcagacgtaagaagctgtctgggctgcctgagggagt

SEQ ID NO: 53504 - DNA, 201 bp, Homo sapiens
tgcccagctcgtcgccgtccctgggctggccgcacacgctgaggtccgggctgaggcggccggagtcgcggctggggaagggcggaagtcggagcgggccrcagggtgtgctgcacttctgcgggggccgagctcgcagccccaggcgtcttggggtcacggttaggcttgggcgagctcgcagcttccagcgctttgggg

SEQ ID NO: 53505 - DNA, 201 bp, Homo sapiens
gagactgaaatgctccagatttgattatccagttgctcacgggcatcgcccctagaagagataatagcatctttgcataacatgtccatgtccaaaatagrtcttttggtgcaaaaaaccaaccctctgtcccaacccgttccttagctaccctcaggagggagatatactccagttacagtacaaggaactcgagggatt

SEQ ID NO: 53506 - DNA, 201 bp, Homo sapiens
tgaggcaggagaattgcttgaccccgggagacagtggttgcagtgaaccgagatcgtgccactgcactccagcctgagtgacagagaaagactccgtctcaaaaaaaaaaaaaaaaaccacaaaccttcaatatatatttcctaaaaacaaaggcattgtcttaacatagtacaataatcaaaatcaggaaattcacattg

SEQ ID NO: 53507 - DNA, 201 bp, Homo sapiens
ggtttggtggaccatcctggtgtccttggctcctcctgtcgcttcctcctgggagcaggggagagatgctcggtccagggagacttctgggaggtggaggycgctcgggacggctgaggctgcaaccagacaggcggaggtgccgatcgagatgacactgtcccttggcgttggggacccggggcagggcgaggccagaga

SEQ ID NO: 53508 - DNA, 201 bp, Homo sapiens
ccaattcctaggctggtggcctccaagggtgaggggtgcctcagtctgagagatggggagcagtggctggactttacagacctgacctgtaccagctccayccactctttcttataagtggggaaactgaggctcagagagtggtagtgatgggaatggctcacacagcacacaaagcctgaccaggttctagctctcttt

SEQ ID NO: 53509 - DNA, 201 bp, Homo sapiens
cgggctctggagaaggaggaggaggaagacaaggaggaggaggaagacgaggaggaggaggaagctggtgagaagaggcagatctgggttgctctgagtcyatcagagccaattcctaggctggtggcctccaagggtgaggggtgcctcagtctgagagatggggagcagtggctggactttacagacctgacctgtacc

SEQ ID NO: 53510 - DNA, 201 bp, Homo sapiens
tggctcaggaagcattgatcccccagactttcagagagccaaagacttcatctccaacatgatgaggaacttctatgaaaagtgttttgaggtgggcttcyctaagagctggttaacacttatctattgctgagaatcaccctacctcagaacaacaatcaccacatttgctcacaattctatgggtcacatacttgggct

SEQ ID NO: 53511 - DNA, 201 bp, Homo sapiens
atacagacacagatactaggaaacagtctgtttcccgaggacaccctgtggctgacaagtatcactgcactgagaaattttattctctaaaatcacagatsagaaaactttgggccgggaacggtggctcacacctgtaatcccagcactttgggaggccgagacgggcggatcacgaggtcaggagatcgagaccatcct

SEQ ID NO: 53512 - DNA, 201 bp, Homo sapiens
gagtgttgggtggcagctgatgctgaagttttcaatggggtggtcacggagggtgacactttggcacacactggaggaggtaggggaacgagctatgtggwtgggtgtctaagggaagagcagctgcaggtaccctgggttggaagcctgcctggtgggtggggggcagggtgaggagctagtggctgcagtggagtgggg

SEQ ID NO: 53513 - DNA, 201 bp, Homo sapiens
cctcagccttctgagtagctgggattacaggaacgtgccaccgcgcccagctaatttttgcgtttttcgtagagacagggtttcatcatgttggccaggcyggtctcgaactcctgacctcaagtgatccagccgcctcggcctcccaaagtgctgggattacaggcatgagccactggcgcgcggccagcataatgattt

SEQ ID NO: 53514 - DNA, 201 bp, Homo sapiens
aggcgaggaggcgggcgcctgtagtcccagctactcaggaggctgaggcaggagaatggcgtgaacccgggaggcggagcttgcagtgaaccgagatggcrccactgcactccagcctgggcgacagagcgagactccgtctcaaaaaaaaaaaaaaaagacaattttaaaataaagcatattaaggctcttttgttcctt

SEQ ID NO: 53515 - DNA, 201 bp, Homo sapiens
actggagagaaccaggcacgatcagagggttgggactttcagccccacacccctcttctgggagagaagggctgaaggtttagttgatcaccagcggccartgattcaatgagtcatgcctatgtaatgaggcctccataaaactcaaaaggacagggtttggggagcttctgggtagcagaacatgtggaagtttctgga

SEQ ID NO: 53516 - DNA, 201 bp, Homo sapiens
gaggctgaggcaggagaatggcgtgaacccgggaggcggagcttgcagtgaaccgagatggcgccactgcactccagcctgggcgacagagcgagactccrtctcaaaaaaaaaaaaaaaagacaattttaaaataaagcatattaaggctcttttgttccttatggaagtaacacatgttcaatatagaacatttggaaa

SEQ ID NO: 53517 - DNA, 201 bp, Homo sapiens
accaggcacgatcagagggttgggactttcagccccacacccctcttctgggagagaagggctgaaggtttagttgatcaccagcggccagtgattcaatsagtcatgcctatgtaatgaggcctccataaaactcaaaaggacagggtttggggagcttctgggtagcagaacatgtggaagtttctggagggtggcccc

SEQ ID NO: 53518 - DNA, 201 bp, Homo sapiens
ctactaaaaatacaaaaattatctgggcgtggtggtacacgcgcgtagtcccagctactcgggaggctgaggcaggagaattgcttgaacctgggaggtgsaggttgcagtgagccaagatcgtgccattgcactacagcctgggcgacagagcaagactccgtctcaaaaaaaaaaaaaaaaaaaaagggcttagcacaa

SEQ ID NO: 53519 - DNA, 201 bp, Homo sapiens
aatacaaaaattatctgggcgtggtggtacacgcgcgtagtcccagctactcgggaggctgaggcaggagaattgcttgaacctgggaggtggaggttgcrgtgagccaagatcgtgccattgcactacagcctgggcgacagagcaagactccgtctcaaaaaaaaaaaaaaaaaaaaagggcttagcacaatttctggc

SEQ ID NO: 53520 - DNA, 201 bp, Homo sapiens
agctactcgggaggctgaggcaggagaattgcttgaacctgggaggtggaggttgcagtgagccaagatcgtgccattgcactacagcctgggcgacagarcaagactccgtctcaaaaaaaaaaaaaaaaaaaaagggcttagcacaatttctggccacattaatgctcaataaacattactttacattttttaaatatc

SEQ ID NO: 53521 - DNA, 201 bp, Homo sapiens
tctgacacttccactccccgatcccagctctagagaaattctcagacacatataaaaatgtttgtgtgccgggcgcagtggctcacacctgtaatcccagmactttgggaggccgaggccggtggatcacctgaggtcaggaattcgagacctaggctggccaacctggcgaaaccccgtctccactaaagatacaaaaaa

SEQ ID NO: 53522 - DNA, 201 bp, Homo sapiens
ttttcctactagatgatgagcttgatgtaggaagctgtacttgatctccttctgtcttcagcatcataggctatactgagtatttttgcataaataagatkagatccagtacagccgaaattatcatgctttgcaaaataagttaaaaaggttcaactgctcgggagagcagggttcagaggaaggtggagtcagttctga

SEQ ID NO: 53523 - DNA, 201 bp, Homo sapiens
tagaaacagggtttcgccacgttggccaggatggtcttgaactcctgacctcaaatgatctgcccacttcggcctcccaaagtgctgggattacaggcatkagccaccgcacctggccccaaaatgacttctagtgctgtgttgttttaaagccagatctggtcaaggtttatgtattacgtattgctgttatgtctctgt

SEQ ID NO: 53524 - DNA, 201 bp, Homo sapiens
caagtgatcaagtttaatgttttacagtgatccaggtgacatttgtgaggtctcaactgaagaagtagcaatgggggtggaaaagaaagggacagatacargaaataatttaaaaaaaaagaattgtgagtgtggtggctcacatctgtcatcccaacactttgggaggctgaggcgggaggattgcttgaggccaggagt

SEQ ID NO: 53525 - DNA, 201 bp, Homo sapiens
tttccctcattcctttccccatcttctagttactaaaagatgtaactgaactgcagatccttggtgaaatatctttcaacaaatctctatatgagggactkaatgcagagaaccacagaactaaggtaattcctggctggcttctgagtagtgcccaaggaaaattgtgcctaacctttgagcacctccacagacattctg

SEQ ID NO: 53526 - DNA, 201 bp, Homo sapiens
tgggcaggcagagaagtcttgttggctctctggccccacctaagtcctgggaacttcctctggccacaacttggaagggccatacctgggtctcaggaagsacatctcctgaactttctagctgagccctgccagaagagagattagactcccgaaattgggagagcctttggaaaacaaaacctgaggatgacttctaat

SEQ ID NO: 53527 - DNA, 201 bp, Homo sapiens
tccttctgtcttcagcatcataggctatactgagtatttttgcataaataagattagatccagtacagccgaaattatcatgctttgcaaaataagttaawaaggttcaactgctcgggagagcagggttcagaggaaggtggagtcagttctgattgagggatgagcaccagaggtcttgaaggattggactctccagga

SEQ ID NO: 53528 - DNA, 201 bp, Homo sapiens
tccatgacttctactgccctctgcagaaagaccttggacttggttcactgttaaccaccaagcccctcgtcccctccccaccatcccctatgacaaccccyggagctcactgtctgtctcaggacagcccagttctcctgggtaacgtggatggtgagaatgttgaggctgtccctggaatctgccgtctccctggactgg

SEQ ID NO: 53529 - DNA, 201 bp, Homo sapiens
tttgcccagagtatgggtagaacagggagcagggaaaggaggagaaaggaaggaaggagacaggtaatggagggccccagaggccagatggaggggctcasctctctccctgggcctggggaatccacgcagcgctgactcgctgacccaggctgtctgtgcaggtgggagaagaatttaagagtgctaggactgcgaggg

SEQ ID NO: 53530 - DNA, 201 bp, Homo sapiens
gaaaggaggagaaaggaaggaaggagacaggtaatggagggccccagaggccagatggaggggctcagctctctccctgggcctggggaatccacgcagcrctgactcgctgacccaggctgtctgtgcaggtgggagaagaatttaagagtgctaggactgcgagggaactgaacctgatcgcctcagacccggatgaga

SEQ ID NO: 53531 - DNA, 201 bp, Homo sapiens
gggacaccgaggctgcgcattaggctgcacttgaggtttccggatgggggcgggacctggtcagtcacatgggccgaggggcgggtcctggttagggaccstgaggctgagtactacagcctcctgggtaggtacaaggcctgtcaggtacaccaggcacagcagccacccaggggagggcggggcctctccattaataat

SEQ ID NO: 53532 - DNA, 201 bp, Homo sapiens
agagaggccaggtgggagcacacggtgtgttcacagccacaccacccttgccccaggttacgctgtggccgtgctgcacaagacctgcagcctctcctacrtcgcgggggctccacggtacaaacatcatggggccgtgtttgagctccagaaggagggcagagaggccagcttcctgccagtgctggagggagagcaggt

SEQ ID NO: 53533 - DNA, 201 bp, Homo sapiens
agtcatgcctatgtaatgaggcctccataaaactcaaaaggacagggtttggggagcttctgggtagcagaacatgtggaagtttctggagggtggccccygagagggcatggaagctttgcccctcacccccactttgcccctcacccccactttgccttatgcatctcctcatctgtatcctttgtaatatcttttttt

SEQ ID NO: 53534 - DNA, 201 bp, Homo sapiens
ccaggctggagtgtggtggcatgctctcggctcactgcaaccactgggttcaagcgattctcctgcctcagcctccctagtagctgagattacaggcgccygccaccacgcccatctgagttttgtatttttagtagagacggggtttcaccaatgttggccaggctggtctcgaactcctgacctcgtgatccgcccgcc

SEQ ID NO: 53535 - DNA, 201 bp, Homo sapiens
tgcctcagcctccctagtagctgagattacaggcgcctgccaccacgcccatctgagttttgtatttttagtagagacggggtttcaccaatgttggccargctggtctcgaactcctgacctcgtgatccgcccgcctcggcctctcaaagtgctgggattacaggcgtgagccaaggcacctggcctgtaatatccttt

SEQ ID NO: 53536 - DNA, 201 bp, Homo sapiens
cacgcccatctgagttttgtatttttagtagagacggggtttcaccaatgttggccaggctggtctcgaactcctgacctcgtgatccgcccgcctcggcytctcaaagtgctgggattacaggcgtgagccaaggcacctggcctgtaatatcctttataataaaccagtaaatgtcggtaagtgcttctctgagttctc

SEQ ID NO: 53537 - DNA, 201 bp, Homo sapiens
ttattatgcttttgttgctactgtgtgaaaataccgttttttccccctgactgtttagagtttgcacttagaacagttggtggttttgaatgtttatcttmtctggccattttactgaactgtggttttgtttttttggagacggagtctcactctgtcgcccacgctggagtgcagtggtgtgatctctgctcactgcaa

SEQ ID NO: 53538 - DNA, 201 bp, Homo sapiens
ggccgtgctgcacaagacctgcagcctctcctacgtcgcgggggctccacggtacaaacatcatggggccgtgtttgagctccagaaggagggcagagagkccagcttcctgccagtgctggagggagagcaggtacctgctggggaaagcctccaccccttatgaccgatggggaatctggaggcccccaagggaaagga

SEQ ID NO: 53539 - DNA, 201 bp, Homo sapiens
ccgtctccactaaaaatataaaaattagccgggtgtggtggtgggcgcttgtaatcccagctacttaggagaggcaggagaatcgcttgaacccgggaggyggaggttacagtgagccaagaccgcagcattgcactccagcctgggcaacaagaatgaaactctgtctctccaaaaaaaaaaaaaaaaagaagagaaaaa

SEQ ID NO: 53540 - DNA, 201 bp, Homo sapiens
ctgggcatgggggctcacacccgtaatcccagcactttgggaggctgaggccggcagatcacttgaggtcaggagttcgagaccagcctggccaacatggkgaaaacccatctctactaaagataccaaaaaaaaaaaaatttagctgggcatggtggcaggtgcctgtaattccagctactcaggaggctgaggcaggag

SEQ ID NO: 53541 - DNA, 201 bp, Homo sapiens
caacatggtgaaaacccatctctactaaagataccaaaaaaaaaaaaatttagctgggcatggtggcaggtgcctgtaattccagctactcaggaggctgyggcaggagaatcacttgaacccaggaggcagaggttgcagtgagccaagatcatgccattgcactccagcctgggcgacagagtgagactccatctcaaa

SEQ ID NO: 53542 - DNA, 201 bp, Homo sapiens
ttaaaaaaatagagacaggggtcttgctatgttgaccaggctagatatgaactcttgggctcaagcgatcctcctgcctcagcctcccgagtagctgggaytacaggcgcacgccactgcgcccggctagtttacttctttcagaacatttgttatcagcaaatttaaacatttcaacaaatatttcagtttccatttgga

SEQ ID NO: 53543 - DNA, 201 bp, Homo sapiens
gctgaagtgttttaaagccttggtactcagaatgtggtctgaagacctgcagtgtgggtgtcccttagaatcttgttggaaatgtagtcttgggcccttasatccttcctagagtgtcacaccaagaaggacatgcctgagaggcccactcctagggatgctaagattgactagtgggctcaggtggtgtcagcctaattg

SEQ ID NO: 53544 - DNA, 201 bp, Homo sapiens
ctgcttttctgtggtgaccccctcactggcacccctgcctccagcctcctcctggtccaaccaacagatggttaataactagataaatccccgccagtccrgctccatgcctcccgaggcaccatattctgctgcagtaccaccctccctatgtgcggccctttcttcaccagggttctgagagagaagtgagtctaatgc

SEQ ID NO: 53545 - DNA, 201 bp, Homo sapiens
aataaatttgaatttgttggactgtagatttgtccccggtcatcttaggctatttgggctaggacagtatccattatatgaatgaagcaatctcctaggcygggcaccgtggctcacggctgtaatcccatcactttgggaggctgaagtgggtggatcacttgaggtcaggagttcgagaccagcctggctaacatggtg

SEQ ID NO: 53546 - DNA, 201 bp, Homo sapiens
aacctgcagttgaagaggatgcaaaaggtgactgtgacggtggctgtggaaacaggtccctcacgcccctccctcgctgcatgcctgcttttctgtggtgrccccctcactggcacccctgcctccagcctcctcctggtccaaccaacagatggttaataactagataaatccccgccagtccagctccatgcctcccga

SEQ ID NO: 53547 - DNA, 201 bp, Homo sapiens
gtgggtagtatggagggcgtgtcagacaaaaagtttttttgtttgtttgtttttgagatggagtttcattctgtcacccaggctggagtgcagtggcacartctcagctcactgcaacctccgcctcccgggttcaagtgattctccttcctcagcctcctgagtagctgggattacaggcgtgcagcactacacccggct

SEQ ID NO: 53548 - DNA, 201 bp, Homo sapiens
ctgtaaaagagcgattttattttaattaattaatttatttatttattttgagacggagtcttgctctgtcgcccagtctggagtgcagcggtgcaatctckgctcactgcaacaaaagggtggccatattgatgacaggaggtcgcttttttctgtgtgctcaaacatccagttgttcccctgaatacagaccaggcaaca

SEQ ID NO: 53549 - DNA, 201 bp, Homo sapiens
atggtggtaaacacctgtagtcccagctactcgggaggctgaggtgggaggatcacttgaacccaggaagtggaggctgcggtgagccgtgatcattgcaycacagcaccacgctctagcctcggtgaatgtcctattgtattgcgttgaggtttttacagatgaaataaactgtaacatttttatctgtaccctgtgcag

SEQ ID NO: 53550 - DNA, 201 bp, Homo sapiens
agggcgtgtcagacaaaaagtttttttgtttgtttgtttttgagatggagtttcattctgtcacccaggctggagtgcagtggcacagtctcagctcactrcaacctccgcctcccgggttcaagtgattctccttcctcagcctcctgagtagctgggattacaggcgtgcagcactacacccggctaatttttaaaata

SEQ ID NO: 53551 - DNA, 201 bp, Homo sapiens
atctgtgtgatggggatgtgtgtgactggcaaagtgagagtgctcgctgatgccgatttttaacatagtgagaaagacagtctctcctattttgccccccwccccaggccactttgaaggcctgactgggaaggtgccggggccaagagagaggccaggtgggagcacacggtgtgttcacagccacaccacccttgcccc

SEQ ID NO: 53552 - DNA, 201 bp, Homo sapiens
aaacataagaaaatttgccaggtgtgatggcacgcatctgtggtcccagttacttgggagactgaggtgggaggatcgcttgagcctgggaggtcaaggcygcagtgaaccgtgatcatgccactgtacttcaacttaggtgacagaaggagactctgtcttaaaaaaaaaattacatgagtaaattaaaaaccaaataag

SEQ ID NO: 53553 - DNA, 201 bp, Homo sapiens
agcactttgggaggccatacttcctagatctgcacatctcatctttggacatttcagatggaaaacagttttctcggtattgctaatatgtttttctgtcdatctcagctactgagagtggttctgcactctgggtccctgtgatacctcagcattctggaggaccctttcacacatccccaggaccctcttttccaggac

SEQ ID NO: 53554 - DNA, 201 bp, Homo sapiens
tcagacaaaaagtttttttgtttgtttgtttttgagatggagtttcattctgtcacccaggctggagtgcagtggcacagtctcagctcactgcaacctcygcctcccgggttcaagtgattctccttcctcagcctcctgagtagctgggattacaggcgtgcagcactacacccggctaatttttaaaatatttttggt

SEQ ID NO: 53555 - DNA, 201 bp, Homo sapiens
catgtctgattgctaggcagtttcctccgctgtggggcctgggctgctcctccactcttctgttactctcagtgagcaaattgatatgtaacgacccaaaytgggtggtccaggaagcacgcgggcaggggtgtagccttgctgaggggtgcaggagcggggctcctggtgagctgagttcctcccgggctgtagatgggg

SEQ ID NO: 53556 - DNA, 201 bp, Homo sapiens
acaaatgtagtggcttacaacaacacaggtttattattattattattattattattattattattttgcactctttcacccaggctggagtgcagtggtgmgatctcagctcactgcaacttccacctcccaggttcaagtgattctcctgcctcagcctcccgagtagctgggattacaggctttcaccactatgcccag

SEQ ID NO: 53557 - DNA, 201 bp, Homo sapiens
tattattattattattattattattattttgcactctttcacccaggctggagtgcagtggtgagatctcagctcactgcaacttccacctcccaggttcragtgattctcctgcctcagcctcccgagtagctgggattacaggctttcaccactatgcccagctaatgtttgtatttttagtagagacggggtttcacc

SEQ ID NO: 53558 - DNA, 201 bp, Homo sapiens
ggaggctgagaagcccttttaaaatcagtattcttctaagtgtggtcttctagagacaattctgaactccaattgcttatctctgaaagccttttatttatttatttattttttgagacgagtctcgctctgtcgcccaggctggagtgctgtggcgtgatctcggctcactgcaacctctgcctccaggttcaagcagtt

SEQ ID NO: 53559 - DNA, 201 bp, Homo sapiens
ggctttcaccactatgcccagctaatgtttgtatttttagtagagacggggtttcaccctgttggccaggctggtcttgaactcctgacctcaggtgatcygcctgcctcggcctcccaaagtgctgggatgacaggtgtgagacactgagcccagctgcaagtttattatcttgtagttttggaggtcagaagtctgaaa

SEQ ID NO: 53560 - DNA, 201 bp, Homo sapiens
gctgagaagcccttttaaaatcagtattcttctaagtgtggtcttctagagacaattctgaactccaattgcttatctctgaaagccttttatttatttatttattttttgagacgagtctcgctctgtcgcccaggctggagtgctgtggcgtgatctcggctcactgcaacctctgcctccaggttcaagcagttctct

SEQ ID NO: 53561 - DNA, 201 bp, Homo sapiens
agacggtatctcatttctgccccaccttcctgtgctctttagtctgtcccaacccactgtagccacatcatgacctttttttttttttttttttttttgaracagagtctcgctctgtcacccaggctggagttcagtggcgtgatctcggctcactgcaacctctgcctcctgggttcacaccattctcctgcctcaggc

SEQ ID NO: 53562 - DNA, 201 bp, Homo sapiens
taaaatcagtattcttctaagtgtggtcttctagagacaattctgaactccaattgcttatctctgaaagccttttatttatttatttattttttgagacgagtctcgctctgtcgcccaggctggagtgctgtggcgtgatctcggctcactgcaacctctgcctccaggttcaagcagttctctgcctcagcctcccga

SEQ ID NO: 53563 - DNA, 201 bp, Homo sapiens
ccacatcatgacctttttttttttttttttttttttgagacagagtctcgctctgtcacccaggctggagttcagtggcgtgatctcggctcactgcaacmtctgcctcctgggttcacaccattctcctgcctcaggctcccgagtagctgggactacaggcacccgccaccacgcccggctaattttttgtatttttag

SEQ ID NO: 53564 - DNA, 201 bp, Homo sapiens
ggaggtaggggaacgagctatgtggatgggtgtctaagggaagagcagctgcaggtaccctgggttggaagcctgcctggtgggtggggggcagggtgagragctagtggctgcagtggagtggggcggggtgtaatgagggaaggggaggaagggggaagaggccatggggcttcttaagccctcagaagggcttttgct

SEQ ID NO: 53565 - DNA, 201 bp, Homo sapiens
ggagttcagtggcgtgatctcggctcactgcaacctctgcctcctgggttcacaccattctcctgcctcaggctcccgagtagctgggactacaggcaccygccaccacgcccggctaattttttgtatttttagtagagacggggtttcaccatgttagccaggatggtctcgatctcctgacctcgtgatctgcctgcc

SEQ ID NO: 53566 - DNA, 201 bp, Homo sapiens
gggggagaagatggtaagtaggtaaattccatgttgatgagatgaacgttgaagacacagggaaggtgggaaggagtgttgggtggcagctgatgctgaagttttcaatggggtggtcacggagggtgacactttggcacacactggaggaggtaggggaacgagctatgtggatgggtgtctaagggaagagcagctgca

SEQ ID NO: 53567 - DNA, 201 bp, Homo sapiens
actgggtatggtggctcacgcctgtaattccagctactcaggaggctgaggcatgagaattgcttgaacccggggggcggaggttgcagtgagctgagacrgcaacactgcactcctgcctgggcaacagagcgaagccctttttaagaagcacttgctatgtacaaagcaggtgtgctatgaactaacactcttattcct

SEQ ID NO: 53568 - DNA, 201 bp, Homo sapiens
cgtgatctcggctcactgcaacctctgcctcctgggttcacaccattctcctgcctcaggctcccgagtagctgggactacaggcacccgccaccacgccyggctaattttttgtatttttagtagagacggggtttcaccatgttagccaggatggtctcgatctcctgacctcgtgatctgcctgcctcggcctcccaa

SEQ ID NO: 53569 - DNA, 201 bp, Homo sapiens
ggctaacacagtgaaaccccgtctctactaaaaatacaaaaaaaaaaaaaaaattagctgggcgtggtggcgggcagctgtagtcccagctactcgggagkctgaggcaggagaatggcgtgaacccgggaggcggagcttgcagtgagcggagattgcgccactgcactccagcctgggcgacagagcgagactccgtct

SEQ ID NO: 53570 - DNA, 201 bp, Homo sapiens
tctcggctcactgcaacctctgcctcctgggttcacaccattctcctgcctcaggctcccgagtagctgggactacaggcacccgccaccacgcccggctwattttttgtatttttagtagagacggggtttcaccatgttagccaggatggtctcgatctcctgacctcgtgatctgcctgcctcggcctcccaaagtgc

SEQ ID NO: 53571 - DNA, 201 bp, Homo sapiens
gggttcacaccattctcctgcctcaggctcccgagtagctgggactacaggcacccgccaccacgcccggctaattttttgtatttttagtagagacgggvtttcaccatgttagccaggatggtctcgatctcctgacctcgtgatctgcctgcctcggcctcccaaagtgctgggattacaggcgtgagccaccgcgcc

SEQ ID NO: 53572 - DNA, 201 bp, Homo sapiens
tatgaggatcatgcaagcgaatatatacaaagtatttagcacagtgctcagcgatggctgtgattgcagagttttttgttttttgttttttttctgaggcrgagtcttcctcttttgcccaggctggagtgcagtggtgtaatcttggttcactgcaacctccgcctcccaggttcaagcaattcttctgcctcagcctcc

SEQ ID NO: 53573 - DNA, 201 bp, Homo sapiens
acgtaggcgtcatctttgatgcctcttttccttcctctccaccacatcaacaagtcttagttggctctgcctccagaccagtgcaggcactgtcttcactycctggacactgctgccacagcctttcctgcttccagcccctgcgctccattctccacacagcagcagccctatcccttcactctgctgcctgaaactcct

SEQ ID NO: 53574 - DNA, 201 bp, Homo sapiens
tctgtgaccacccagtctcagtagccctcggtccttattaccgtatttttgttgttgttgttgagatggagtcttgctctgtcacccaggctggagtgccrtggcaggatgtcggctcactgcaacctccgcctcccaggtttaagcaattctcctgcctcagcctcccaagtaggtgggattacaggcgcccgccaccac

SEQ ID NO: 53575 - DNA, 201 bp, Homo sapiens
gctgagaatcaccctacctcagaacaacaatcaccacatttgctcacaattctatgggtcacatacttgggctgggctcagctggatgattcttctgtccrtcttgcctggagttaccctggagctgcaggcgtctggttgcttgactggggctggatggcctaagatgacctcacttacttgtctggaccatgtgtcttt

SEQ ID NO: 53576 - DNA, 201 bp, Homo sapiens
attagaaaatgaaccagcccaacgatacagaattcaaatattccacctcaccccaactgcgctacgaccactttatattttgacattcagcttttattccttttttttttttttttaaactgagacgaagtctcactctgtcgcccaggctggagtgcagtggtgccatctcggctcactgcaacctctgccgcccaggtt

SEQ ID NO: 53577 - DNA, 201 bp, Homo sapiens
ttgactgtctgtctctgatggggctcagttagagccagaggttagagagtggcagctcctccaggaaaggagtcttgctcggtgggtcagggccccaggcwtgttgggaagggcggctgaggcttcgtgttgccagttctgtcagccagggcctttggactccagggctctgccattctgttcctcctccagccagcctcc

SEQ ID NO: 53578 - DNA, 201 bp, Homo sapiens
ctggcttatttggaagatgcttaggacttctgactcaccacttttattgtttatttcttcttatgatgacatcaaagtagaaagtattcttgcaaggtgcrgtggctcatatttggaaatcccagcactttgggaggccaaggtgggtgaattgcttgagcccaggtggttgaggctgcagtgagccatcatggtgctgct

SEQ ID NO: 53579 - DNA, 201 bp, Homo sapiens
ttagaaaatgaaccagcccaacgatacagaattcaaatattccacctcaccccaactgcgctacgaccactttatattttgacattcagcttttattccttttttttttttttttaaactgagacgaagtctcactctgtcgcccaggctggagtgcagtggtgccatctcggctcactgcaacctctgccgcccaggttc

SEQ ID NO: 53580 - DNA, 201 bp, Homo sapiens
cggctcccacacagccgcctctgctccagcaaggatgtggctcttccacactctgctctgcatagccagtaagtcctctcacccgctgcttcgaggggctsctgtgccctcagctccagccaggtgtctgcagactacagccttgactgtctgtctctgatggggctcagttagagccagaggttagagagtggcagctcc

SEQ ID NO: 53581 - DNA, 201 bp, Homo sapiens
ccagctacttgggagactgaggcaggagaaccttgaacctaagaggcagaggttgcagagagccaagatcgagccactgcactccagcctgggcgacagarcgagactccatctcaaaaaaaaaaaaaaaaaagagagagaaagaacttgataaacccaggtgtggctgtgactcttcccttctgtctgagccagttcttt

SEQ ID NO: 53582 - DNA, 201 bp, Homo sapiens
tagaaaatgaaccagcccaacgatacagaattcaaatattccacctcaccccaactgcgctacgaccactttatattttgacattcagcttttattccttttttttttttttttaaactgagacgaagtctcactctgtcgcccaggctggagtgcagtggtgccatctcggctcactgcaacctctgccgcccaggttca

SEQ ID NO: 53583 - DNA, 201 bp, Homo sapiens
gagcctgggctgatcgggactctctgtctggttacagctgccctatgagaaggcctgcaagaataagctgttttgtgtcgcagaattacagttggccaccrccgtctctcagtgagttggacatagccgtcagtttcctcgattaaccttctcccgaacgcttgcctgggcaattccttcattaggacaccctgcacatcc

SEQ ID NO: 53584 - DNA, 201 bp, Homo sapiens
ggcagccacccccaaacctccagttcttttatttatttatttatttatgagacgaagtcacactctgtcccccaggctggagtgcagtggcgtgatctccrctcactgcaacctctgcctcccaggttcaagcaattctcctgcctcagcctcctgagtagctgggactacaggcacacgccaccatgcccggctaatttt

SEQ ID NO: 53585 - DNA, 201 bp, Homo sapiens
caggttcaagcgattctcctgcctcagcctcccgagtagttgagactacaggtggacaccaccaggcccagctaatttttaaaaaatttttaatagagacrgggatttcaccatgttggccaggctggtcttgaactcctggcctcaggtgatccgcctgcctcggcctcccaaagtgctgggatgataggcatgaaccac

SEQ ID NO: 53586 - DNA, 201 bp, Homo sapiens
tgcaacctctgcctcccaggttcaagcaattctcctgcctcagcctcctgagtagctgggactacaggcacacgccaccatgcccggctaatttttgtatytttagtagacacggggtttcaccatattgatcaggctggtctcaaagtcctgaccccagatgatccacctgcctcagcctcccaaagtgctgggattaca

SEQ ID NO: 53587 - DNA, 201 bp, Homo sapiens
tcaagaaccacgtaatggcacggaagatggagatgctgtcattgctgacgtttttcttggtaataactcaggaatgccagtgttcttggcatgcgttatcmgacctcacctgataataactaggaccgagggcctgaatgtcagttggcatcaaaaaagtgaacaactaaaaggaagaataaaaagatagaaacgaccatc

SEQ ID NO: 53588 - DNA, 201 bp, Homo sapiens
tacaggtggacaccaccaggcccagctaatttttaaaaaatttttaatagagacagggatttcaccatgttggccaggctggtcttgaactcctggcctcrggtgatccgcctgcctcggcctcccaaagtgctgggatgataggcatgaaccactgcacccggcctcattcctggtaaaggtctggtgccctctgtccta

SEQ ID NO: 53589 - DNA, 201 bp, Homo sapiens
tggaggttacagtgagctgacattgcaccactggactccagcctgggcaacagagcaagactgtttaaaaaaaaaaaatcctgccaggcacggtggctcaygcctgtaatcccaacactttgggaggctgaggtgggccgatcatgggtcaggagatcgagaccatcctagctaacacggtgaaatcccgtctctactaaa

SEQ ID NO: 53590 - DNA, 201 bp, Homo sapiens
ttaggcaggagaatcacttaaacccaggaggcagaggttgcagtgagctgagatcgcaccactgcactccagcctgggcaacagagcaagactccacctcaaaaaaaaaaaaaaaaaaaaagggatgagtgtagtggctcatgcctgtcatcccaacactttcgcaggctgaggtggaggatcacttgagcctgggaggtt

SEQ ID NO: 53591 - DNA, 201 bp, Homo sapiens
ccaggttctagctctctttttgaagggggagacaaaagcttctctcttggggccaggtgaggtggctcatgcctgtaatcccagcattttgggaggctgargtgggcggatcacttgaggtcaggagttcaagaccagcctggccaacatggtgaaaccccaactctactagaaaattcaaaaattagccaggcatggtgg

SEQ ID NO: 53592 - DNA, 201 bp, Homo sapiens
taggcaggagaatcacttaaacccaggaggcagaggttgcagtgagctgagatcgcaccactgcactccagcctgggcaacagagcaagactccacctcaaaaaaaaaaaaaaaaaaaaagggatgagtgtagtggctcatgcctgtcatcccaacactttcgcaggctgaggtggaggatcacttgagcctgggaggttg

SEQ ID NO: 53593 - DNA, 201 bp, Homo sapiens
gaggcaggagaatggtgtgaacctgggaggcaaagcttgcagtgagctgagatctcgcctctgcgctccagcctgggtgacagagtgtgactccatttccaaaaaaaaaaaaaaaacaaataaacaaacaaacaaaaaaaccaaaaattagccgggcatggtggcacatgcctgtaatcccagctactcgggaggctgagg

SEQ ID NO: 53594 - DNA, 201 bp, Homo sapiens
gagagcagagtgctcagtggacaggctggctgggttcaaatctcagctctggttttttttttttgtttttttttttgagatggagtcttgctctgtcaccsaggctggagtgcagtggcacgatctcagctcactgcaagctccgcctcccaggttcacaccattctcctgcctcagcctcccgagtagctgggactacag

SEQ ID NO: 53595 - DNA, 201 bp, Homo sapiens
acacctgtaatcccagcactttgggaggccgaggcgggtggatcacaaggtcagcagatcgagaccatcctggctaacacggtgaaaccccgtctctactraaaatacaaaaaattctccgggcgtggtggcgggcgcctgtagtcccagctacttgggaggctgaggcaggagaatggtgtgagcccgggaggcggagct

SEQ ID NO: 53596 - DNA, 201 bp, Homo sapiens
agtggacaggctggctgggttcaaatctcagctctggttttttttttttgtttttttttttgagatggagtcttgctctgtcacccaggctggagtgcagkggcacgatctcagctcactgcaagctccgcctcccaggttcacaccattctcctgcctcagcctcccgagtagctgggactacaggcggccaccaccacg

SEQ ID NO: 53597 - DNA, 201 bp, Homo sapiens
tcacctgaggtcaggagttcaagaccagcctggccaacatggtgaaaccccgtctctactcaaaatacaaagttagctgggtgtggtggcaggtgcctgtratcccagctactcgggaggctgaggcagggagaattgcttgaactcgggaggcagaggttgcagtgagctgagatcgtgctattgcactccagcctgggt

SEQ ID NO: 53598 - DNA, 201 bp, Homo sapiens
acggcagatgcagtgggacgcaggcccacagtggagcaaggcagggttgaggcatcacgtgaaaggaatcagggcagaaccatgtgtgagcgtgctcaggygaggatggagcctttctgactctgagctcttccatgtgtgtttttaaagaaaatctcctggatccagatgcacgtgtggacactggagactgctacagca

SEQ ID NO: 53599 - DNA, 201 bp, Homo sapiens
atccgggaggcagagatggcagtgagccgagatcgcgccattgcactccagcctggatgacagagcgagactccatctgaaaacaaacaaacaaacaaccraaaaaacagatgactagccatgaggaaggaacctccaaggcctggaccttgacgatatttggctaggcatcccccactcctgcccgggctgttctgccta

SEQ ID NO: 53600 - DNA, 201 bp, Homo sapiens
catttcagggccaaaatatatcctaaacccattcacttctctccatttccactgccgttgtaattcaagctaccctttcttgccagggctgttgcaataascttcggcctgcctttcttgcctctgcttttcccacattctttacaaataattcccacgtaacagctatccgtcttctaagagcagacattagattgtgcc

SEQ ID NO: 53601 - DNA, 201 bp, Homo sapiens
ggtggatcacaaggtcagcagatcgagaccatcctggctaacacggtgaaaccccgtctctactaaaaatacaaaaaattctccgggcgtggtggcgggcrcctgtagtcccagctacttgggaggctgaggcaggagaatggtgtgagcccgggaggcggagcttgcagtgagccgagatcctgccactgcactccagcc

SEQ ID NO: 53602 - DNA, 201 bp, Homo sapiens
gaggtgggaagtgcttctttggggagagctaggggcggcttcttggaggaggggggctcgggtactggtacagcttggtttagtaggaggatcagaggctstgggtcagatacacctgcgtctagtctttctctctcacacacacataaagatccctgggcagtctcacttttctcagctgtaaaacggggttcatgacac

SEQ ID NO: 53603 - DNA, 201 bp, Homo sapiens
gctgaattgctgtgaggaaaccacgtttttgttttgttttgtttggctctttaagagaatgtcatctgctcttttaacagcctccctctccaaacattcastgtgatgaccctcagccggttgcttctgtcctgatcatgaactgcaggattggtcaccccgtcctcaagaggtcatctgtgagtcggtttggaccgattc

SEQ ID NO: 53604 - DNA, 201 bp, Homo sapiens
gattggtcaccccgtcctcaagaggtcatctgtgagtcggtttggaccgattcgctcttctcaccaccctgcagttggcgtcttctgcatcttggtctcayctcaatctctcggttccagctttgcgcttcgcttgactgcagtgtgtccccagcagtgcttacagtggctaagctggctctgaaagtagggggtgatggg

SEQ ID NO: 53605 - DNA, 201 bp, Homo sapiens
tgaggcaggagaatggtgtgagcccgggaggcggagcttgcagtgagccgagatcctgccactgcactccagcctgggagacagagtgagactccatctcaaaaaaaaaaaaaagcaaaaattaaaaccttgtcagtagacagagacattttccctttgaaaattgataaattctgcttctctgtgtgagtgatgtaacat

SEQ ID NO: 53606 - DNA, 201 bp, Homo sapiens
tggtctgtggggtccacggaaccccagcctcacgcctcactgggcctctccctgctccattgcccagggggagggtggacttaaagacaattttagtggcygggcacggtggctcacgcctgtaatcccagcactttgggaggccgaggcgggcggatcacgaggtcaggagattgagaccatcctggctaacacggtgaa

SEQ ID NO: 53607 - DNA, 201 bp, Homo sapiens
caatctctcggttccagctttgcgcttcgcttgactgcagtgtgtccccagcagtgcttacagtggctaagctggctctgaaagtagggggtgatggggaygagagctttccagtacacagccctaggtgaactgcctgctcacctccgtgaagcagagtgaagttgtgggtagtatggagggcgtgtcagacaaaaagtt

SEQ ID NO: 53608 - DNA, 201 bp, Homo sapiens
agaattgcttgaacccgggaggcggaggttgcagtgagctgagatcgcaccactgcactctagcctgggtgacagagcaagactctgtctcaataaaattwaaaaaaaaaaaaagagggtttataaatataaacgtttgttttcacatgtagtttatttatttaaaaaaatagagacaggggtcttgctatgttgaccagg

SEQ ID NO: 53609 - DNA, 201 bp, Homo sapiens
gacgcatgtcctgtcaattgcagaccatccataatgtacgtgaacacaggccaggggctttctcaccacaaagaattcctcttccatgtaagtacttattwttgtaaagctgtagatggcaaagcaataccagctttgatttcctactctgattttaatttgcaggtacatggggagaacctctttggagcagaataccag

SEQ ID NO: 53610 - DNA, 201 bp, Homo sapiens
agactttgtacttgctgttcctttgcttgacactgctcttcctctaggtcctgacgtaggtggtttcttcttaaatttagctcaggtgttcttttcttttytttttttttttttttagatggagtcttgctctgtcacccgggctggagtgcagtggcacgatctctactcactgcaacctccgcctcccgggttcaagtg

SEQ ID NO: 53611 - DNA, 201 bp, Homo sapiens
tctactcaaaatacaaagttagctgggtgtggtggcaggtgcctgtaatcccagctactcgggaggctgaggcagggagaattgcttgaactcgggaggcrgaggttgcagtgagctgagatcgtgctattgcactccagcctgggtgacagagcgagactccatctatctcaataataataataataaaaataaataaat

SEQ ID NO: 53612 - DNA, 201 bp, Homo sapiens
cctctaggtcctgacgtaggtggtttcttcttaaatttagctcaggtgttcttttcttttttttttttttttttttagatggagtcttgctctgtcaccckggctggagtgcagtggcacgatctctactcactgcaacctccgcctcccgggttcaagtgattctcctgcctcagcctcccgagtagctgggattacagg

SEQ ID NO: 53613 - DNA, 201 bp, Homo sapiens
ctgggtgtggtggcaggtgcctgtaatcccagctactcgggaggctgaggcagggagaattgcttgaactcgggaggcagaggttgcagtgagctgagatsgtgctattgcactccagcctgggtgacagagcgagactccatctatctcaataataataataataaaaataaataaataaaatgagaataataatagtac

SEQ ID NO: 53614 - DNA, 201 bp, Homo sapiens
ctctaggtcctgacgtaggtggtttcttcttaaatttagctcaggtgttcttttcttttttttttttttttttttagatggagtcttgctctgtcacccgsgctggagtgcagtggcacgatctctactcactgcaacctccgcctcccgggttcaagtgattctcctgcctcagcctcccgagtagctgggattacaggc

SEQ ID NO: 53615 - DNA, 201 bp, Homo sapiens
ccagggttcagtggcagcttcaccgtggatttgccgcatagcctgagcaaggtgctcgggcctgagcttcagtttcccttctctgcagtcagcgtggggawctacctacttcacaggattgtcgcaaagactatttgagataatgcatgtaaagggcttagcacaggttctgccgggcgcggtggctcacgcctgtaatcc

SEQ ID NO: 53616 - DNA, 201 bp, Homo sapiens
tgtggtggcaggtgcctgtaatcccagctactcgggaggctgaggcagggagaattgcttgaactcgggaggcagaggttgcagtgagctgagatcgtgcyattgcactccagcctgggtgacagagcgagactccatctatctcaataataataataataaaaataaataaataaaatgagaataataatagtactcaca

SEQ ID NO: 53617 - DNA, 201 bp, Homo sapiens
caaggtgctcgggcctgagcttcagtttcccttctctgcagtcagcgtggggaactacctacttcacaggattgtcgcaaagactatttgagataatgcaygtaaagggcttagcacaggttctgccgggcgcggtggctcacgcctgtaatcccagcactttgggaggccgaggcgggcggatcatttgaggtcaggagt

SEQ ID NO: 53618 - DNA, 201 bp, Homo sapiens
cgagacagaagaatcactcgaacccaggaggcagaggttgcagtgagccaagatcgcgccactgcactccaggatgggtgacagagcgaggctccatctcaaaaaaaaaaaaaaaaaaattagccaggcgtggtggcgcatgacctctattcccagctacttgggaagctaaggcaccaggtcacttgaccttgggaggca

SEQ ID NO: 53619 - DNA, 201 bp, Homo sapiens
ctgcctcagcctcccgagtagctgggattacaggcgccggcgaccacgcccagctaatttttgtatttttagtagagagggggtttcaccatgttggccargctggtctcgaactcctgacctcaggtgatcgcccgcctcagcctcccaaagtgctgggattacaggcgtgagccaccgcacccgacctaggtgttcttt

SEQ ID NO: 53620 - DNA, 201 bp, Homo sapiens
gtggtcaagggtttccttcacacccagcacacaggagcaagtgagcccagggttcaaacaggcactggggcagagccaggtgaggagccagggttcctggstgggcagggcgggagctttgcttgaataggatgggtgggcagtggtggctcccgaagcagcctcataggccctgggacttgggccttgaccctgacagcc

SEQ ID NO: 53621 - DNA, 201 bp, Homo sapiens
gggaggcacaagttgcagtgagctgatattgagccatggcactccagcctgagcaacagagtgagacactgtctcaaaaaaaaaaaaaaaaaaaaaaaaarggcaacaatatccccaggcctccttgcgtcccagaatctccatgaagctctgatgaactgagctggtgctggagaaacaaggatggctggggcatagtcc

SEQ ID NO: 53622 - DNA, 201 bp, Homo sapiens
tatatttgacattccaagactgaatatatattttacaatataacaaataaaaatatatttggtctcaaaataaacatttggtcccattatctggcatacaygcctaaaatctctggaatctccaaagtaataaatgtctttttctttgttaatgagttgacgggggaccggcagcccccagatagcttcaaaatgggggct

SEQ ID NO: 53623 - DNA, 201 bp, Homo sapiens
caggacacctaggattcagggactcctgcctcccatccagggctctgccctacctgtggtgattcctgtaaaagagcgattttattttaattaattaattwatttatttattttgagacggagtcttgctctgtcgcccagtctggagtgcagcggtgcaatctcggctcactgcaacaaaagggtggccatattgatgac

SEQ ID NO: 53624 - DNA, 201 bp, Homo sapiens
gttttgctctcgttgcccaggctgcaatgcaatggcaggatcttggctcaccgcaacctctgcctccggggttcaagcaattctcctgcctcagcctaccsagtagctgggattacaggcatgggccacacacccggctaattttgtatttttggtagagacagggtttctccatgttggtcaggctggtcttgaactccc

SEQ ID NO: 53625 - DNA, 201 bp, Homo sapiens
ccaccatacccggctaattttgtatttttagtagagatggggtttctccatgttggtgaggctggtcttgaactcctgacctcaggtgatccgccctcctyggcctcccaaagtgctgggattacaggcgtgagccaccacgcccggctaattttgtatttttagtagagatggggtttcatcgtgttggtcaggctggtc

SEQ ID NO: 53626 - DNA, 201 bp, Homo sapiens
gctcaccgcaacctctgcctccggggttcaagcaattctcctgcctcagcctaccaagtagctgggattacaggcatgggccacacacccggctaattttrtatttttggtagagacagggtttctccatgttggtcaggctggtcttgaactcccgacctcaggtgatccacccacctcggcctcccaaagtgttgggat

SEQ ID NO: 53627 - DNA, 201 bp, Homo sapiens
ctaattttgtatttttggtagagacagggtttctccatgttggtcaggctggtcttgaactcccgacctcaggtgatccacccacctcggcctcccaaagygttgggattacaggcgtaagccacctcgcccagcatttttttttttttttccgagactgagtctcactctgttgtccaggctggagtgcaatggtgcaat

SEQ ID NO: 53628 - DNA, 201 bp, Homo sapiens
attgcagagttttttgttttttgttttttttctgaggcggagtcttcctcttttgcccaggctggagtgcagtggtgtaatcttggttcactgcaacctcygcctcccaggttcaagcaattcttctgcctcagcctcctgaggagctgggattacaggtgtctgccaccacgcccggctaatttttgtatttttagtaga

SEQ ID NO: 53629 - DNA, 201 bp, Homo sapiens
attgcactccagcctgggcaacaagaatgaaactctgtctctccaaaaaaaaaaaaaaaaagaagagaaaaatgcacacctcataagcatgcagcgcagtraacatccgcagagtgaagcactgtgtaagcagcatgcagatcaagggcacgtgagctgcggcgcctaggccccctctaagccccgcactcccttccagac

SEQ ID NO: 53630 - DNA, 201 bp, Homo sapiens
gaggcacaagttgcagtgagctgatattgagccatggcactccagcctgagcaacagagtgagacactgtctcaaaaaaaaaaaaaaaaaaaaaaaaaagscaacaatatccccaggcctccttgcgtcccagaatctccatgaagctctgatgaactgagctggtgctggagaaacaaggatggctggggcatagtccct

SEQ ID NO: 53631 - DNA, 201 bp, Homo sapiens
tgcctgggcaacagagcgaagccctttttaagaagcacttgctatgtacaaagcaggtgtgctatgaactaacactcttattcctagttccaatgaaagayggtctttggccaacgagacccacacccttcaattcaggcatggcttcgttgcagttctgtccaagtgagtactcccaagaggccagcagcggtgtgactc

SEQ ID NO: 53632 - DNA, 201 bp, Homo sapiens
ctggtggtcaggatgaatgtggacactgtccttctgagaggagcctgcttagaacccaggctctgatattgatctctagggtgctaacatttgggtcacaraaaccccactgtggtcatcaaaggaggtgtattgccaactagtcgtgctacaaaagggaattaatatgacgctgtggagggaagaaggcagctgtgggac

SEQ ID NO: 53633 - DNA, 201 bp, Homo sapiens
agtctcactctgtcgcccaggctggagtgcagtggtgccatctcggctcactgcaacctctgccgcccaggttcaagcgattctcctgcctcagcctcccragtagttgagactacaggtggacaccaccaggcccagctaatttttaaaaaatttttaatagagacagggatttcaccatgttggccaggctggtcttga

SEQ ID NO: 53634 - DNA, 201 bp, Homo sapiens
gcctgtcatcccagcactttgggaggctgaggtgggtggatcacctgaggtcaggagttcaagaccagcctggctaacatggcgaaaccccgtctctactraaaatatgaaaattagccaggtgtggtggcaggcgcctgtaatctcagctacttgggggcttaggcaggagaatcacttaaacccaggaggcagaggttg

SEQ ID NO: 53635 - DNA, 201 bp, Homo sapiens
gggcttaggcaggagaatcacttaaacccaggaggcagaggttgcagtgagctgagatcgcaccactgcactccagcctgggcaacagagcaagactccasctcaaaaaaaaaaaaaaaaaaaaagggatgagtgtagtggctcatgcctgtcatcccaacactttcgcaggctgaggtggaggatcacttgagcctggga

SEQ ID NO: 53636 - DNA, 201 bp, Homo sapiens
ctgagccatgattgttccactgtgctctagcctgggcaacagagtgagaccctgtctccaaaaaagggagaaagactcctcaagggctgacgcatgtcctstcaattgcagaccatccataatgtacgtgaacacaggccaggggctttctcaccacaaagaattcctcttccatgtaagtacttattattgtaaagctgt

SEQ ID NO: 53637 - DNA, 201 bp, Homo sapiens
ttaaataaaatgaataagctgggtgtggtggctcatgcctgtaatctcagcactgtgggaggctaaggtgggtggattgcttgagcccaggagtttgagascagcctgggcaacatggtaaaaccccatctctacaaaaaatacaaaaattagcccagtgtggtggggtgcacctgtggtctcagctactcaggagactga

SEQ ID NO: 53638 - DNA, 201 bp, Homo sapiens
agttagagccagaggttagagagtggcagctcctccaggaaaggagtcttgctcggtgggtcagggccccaggcttgttgggaagggcggctgaggcttcrtgttgccagttctgtcagccagggcctttggactccagggctctgccattctgttcctcctccagccagcctccccccgccaccgaggccctctccccat

SEQ ID NO: 53639 - DNA, 201 bp, Homo sapiens
tgggcaacatggtaaaaccccatctctacaaaaaatacaaaaattagcccagtgtggtggggtgcacctgtggtctcagctactcaggagactgaggtggraggatcacttgagcctggaaggttgaggctatagtgacccatgatcatgccattgcactccagcatgggtgacagagcgagatcctgtctcaaaaataag

SEQ ID NO: 53640 - DNA, 201 bp, Homo sapiens
gcagaataccagttgcaaatttgcgtcccaaccaaattacgaggtctccaggttgtagcagtgaagaagctgacgaggactcaggtatttaaaggcagttmtttatcagtcacacctctttccacagtgactacagagtctcaagtataaaaaccagagttctagaaacagagtgaagacaagttaaccatgggaaaagat

SEQ ID NO: 53641 - DNA, 201 bp, Homo sapiens
agagcgagatcctgtctcaaaaataagtcagtcagtcaagaactgactttggatggcacaagggaaaagaagttgaagaaaaggccaggcgcggcagctcrcgcctgtaatcccagcactttgggaggccgaggtgggtagatcatctgaggtcaggagttcgagacaagcctggccaacatggcaaaaccccatctctac

SEQ ID NO: 53642 - DNA, 201 bp, Homo sapiens
ttcaggtaagcgcggccgtcccgagaggccaggggagggcggagggcctgaagcgggtaacgagaggccaggagactgtttttcctgggttacccctgcckgccagtgccgggggctgccaggccctccctagcttcgtccctgggtctcaattgctcccgctggagcttcgcttgggccgaggtgagcgctgaaattgct

SEQ ID NO: 53643 - DNA, 201 bp, Homo sapiens
ccacgcccggctaatttttgtatttttagtagagacagggtttcaccatgttggccaggctggtcttgaactcctgacctcgtgatccacccatcttggcytcccaaagtgctgggattacaggcatgagccactatgcctggccaagaattgcagagtttttgtgccccatccctcagtgaatgatcaagtcccgtggct

SEQ ID NO: 53644 - DNA, 201 bp, Homo sapiens
ggcgcctatagtcccagcgactcgggaggctgaggcaggagaatggtgaacccgggaggcggagcttgcagtgagcggagatcgcgccactgcactccagyctgggcgacagagcgagactccgtctccaaaaaaaaaaaaagaaaaacagagcttttatctccccccacccttcattcccccaaatctatcctgccctca

SEQ ID NO: 53645 - DNA, 201 bp, Homo sapiens
gccaatataacatttccttttatttttaagtagtgtatttctttttcttttcttttctttcttttttttttttttttttgaggaagaatctcactgtgtcrcccaggctggagtccgttggtgccatctcggctcactgcaacctccacctccccagttcaagtgattcttcttcctcagcctcccgagtagctgggatta

SEQ ID NO: 53646 - DNA, 201 bp, Homo sapiens
gtgtttgagactgaaatgctccagatttgattatccagttgctcacgggcatcgcccctagaagagataatagcatctttgcataacatgtccatgtccawaatagatcttttggtgcaaaaaaccaaccctctgtcccaacccgttccttagctaccctcaggagggagatatactccagttacagtacaaggaactcga

SEQ ID NO: 53647 - DNA, 201 bp, Homo sapiens
tatagtcccagcgactcgggaggctgaggcaggagaatggtgaacccgggaggcggagcttgcagtgagcggagatcgcgccactgcactccagcctgggygacagagcgagactccgtctccaaaaaaaaaaaaagaaaaacagagcttttatctccccccacccttcattcccccaaatctatcctgccctcaggcttt

SEQ ID NO: 53648 - DNA, 201 bp, Homo sapiens
gagaatggtgaacccgggaggcggagcttgcagtgagcggagatcgcgccactgcactccagcctgggcgacagagcgagactccgtctccaaaaaaaaaraaagaaaaacagagcttttatctccccccacccttcattcccccaaatctatcctgccctcaggctttctgtctcagcaaatggcatcatcatccaccca

SEQ ID NO: 53649 - DNA, 201 bp, Homo sapiens
tgctctgtcacccaggctggagtgccgtggcaggatgtcggctcactgcaacctccgcctcccaggtttaagcaattctcctgcctcagcctcccaagtargtgggattacaggcgcccgccaccacacccagctaatttttgagttttttagtagagacgatgtttcaccaagttggccaggctggtctcgaacccctga

SEQ ID NO: 53650 - DNA, 201 bp, Homo sapiens
gtgaaacaccgtctctactaaaaatacaaaaaattagccgggcaggtgcctgtaatcccagctactcgggaggctgaggcaggagaatagcatgaacccaggagacggagcttgcagtgagctgagatcgcaccactgcactccacgctgggcgacagagcgagactccgtctcagaaaaaaaaaaaagactcagaaaaag

SEQ ID NO: 53651 - DNA, 201 bp, Homo sapiens
agcactttgggaggccgaggtgggcagatcacgaggtcaggagatcgagaccatcctggctaacacggtgaaaccccgtctctactaaaaatacaaaaatyagccaggtgtggtgacagatgcctgtagtcccagcactttgggaggccgaggcgggtggatcacaaggtcaggagatcgagaccatcctggctaacatgg

SEQ ID NO: 53652 - DNA, 201 bp, Homo sapiens
tttggggcacttttgggaatctgtgggtttagaagaagataaagggaggtggctttgagaaatagggacatttcttctactcacatctggcctgtttcccsagtcaccttgggacttcctttcacttcccaaacccagggtcttgagtccccctccttctcctgtagaatattccagccctctttctgttcttcctccctc

SEQ ID NO: 53653 - DNA, 201 bp, Homo sapiens
ggggatcacttgaggtcaggagttcgagaccagccgggccaacacggtgaaaccctgtctccactaaaaacacaaaaattagccgggcgtggtggcgggtrcctgtaatcccagctactcgggaggctgaggcaggagaatcgctggaatccaggggagggaggttgcagtgagccgaaatcatgccactgtactccagcc

SEQ ID NO: 53654 - DNA, 201 bp, Homo sapiens
tccctaaataggttcgtgcctctgcgtacgcgtaggctgcttttcttgtcaggaatgccctccatgactgctcacttcactcactgtcttccctgaaagcrgtctagagactcctgagtcctctgtgctggcttctgtgtgtttgctgtgagctcccttctagaaacccttccaaatggcagtcatcacactgtattgtaa

SEQ ID NO: 53655 - DNA, 201 bp, Homo sapiens
actgaggcaggagaaccttgaacctaagaggcagaggttgcagagagccaagatcgagccactgcactccagcctgggcgacagaacgagactccatctcaaaaaaaaaaaaaaaaaagagagagaaagaacttgataaacccaggtgtggctgtgactcttcccttctgtctgagccagttctttacccctttgtgactg

SEQ ID NO: 53656 - DNA, 201 bp, Homo sapiens
ctgaggcaggagaaccttgaacctaagaggcagaggttgcagagagccaagatcgagccactgcactccagcctgggcgacagaacgagactccatctcaaaaaaaaaaaaaaaaaagagagagaaagaacttgataaacccaggtgtggctgtgactcttcccttctgtctgagccagttctttacccctttgtgactgg

SEQ ID NO: 53657 - DNA, 201 bp, Homo sapiens
ggagactgtttttcctgggttacccctgccggccagtgccgggggctgccaggccctccctagcttcgtccctgggtctcaattgctcccgctggagcttygcttgggccgaggtgagcgctgaaattgctcacaccctctattctgggaccttacgatgctctgtgtccgaagtgttaaaaagatttcagactttccgca

SEQ ID NO: 53658 - DNA, 201 bp, Homo sapiens
tacttgggaggctgaggcaggagaatggtgtgagcccgggaggcggagcttgcagtgagccgagatcctgccactgcactccagcctgggagacagagtgmgactccatctcaaaaaaaaaaaaaagcaaaaattaaaaccttgtcagtagacagagacattttccctttgaaaattgataaattctgcttctctgtgtga

SEQ ID NO: 53659 - DNA, 201 bp, Homo sapiens
actccatctcaaaaaaaaaaaaaagcaaaaattaaaaccttgtcagtagacagagacattttccctttgaaaattgataaattctgcttctctgtgtgagygatgtaacatgtgacatttcttacactgccccctataagttgcttactagcttcccttcttctcccctgagactcttttttggtctctgctttgcctcag

SEQ ID NO: 53660 - DNA, 201 bp, Homo sapiens
aacctccaaggcctggaccttgacgatatttggctaggcatcccccactcctgcccgggctgttctgcctatatccgaaaggactaaggaagcttctcttygcgtaggtgtctgctccctgaatgctcaaagtcgtgagctgtgtgttgctgctgaattcgcatgatgtaaatgtcatgggcacccctaacattccgtgaa

SEQ ID NO: 53661 - DNA, 201 bp, Homo sapiens
aattgataaattctgcttctctgtgtgagtgatgtaacatgtgacatttcttacactgccccctataagttgcttactagcttcccttcttctcccctgaractcttttttggtctctgctttgcctcagcctctttgctttcagttgtctcatctgtagtctggttcccaaagctagccttgatacctgaagcaacaggc

SEQ ID NO: 53662 - DNA, 201 bp, Homo sapiens
ctctttgctttcagttgtctcatctgtagtctggttcccaaagctagccttgatacctgaagcaacaggctctgctcagtatgaagctgaagcctgggcattttttttttgctcagactacataagtgttaaggctcaaaaaacggaaaggaatttacagaaaggactctgctgacaattagaaagagggcttataggtca

SEQ ID NO: 53663 - DNA, 201 bp, Homo sapiens
ttcggcctgcctttcttgcctctgcttttcccacattctttacaaataattcccacgtaacagctatccgtcttctaagagcagacattagattgtgccaytcccctgcttattaaaaataacaaacaaacaaaactgatgcttgagcacacttagactaaaatccatacttttttcatggccagagcaaggcagtacttg

SEQ ID NO: 53664 - DNA, 201 bp, Homo sapiens
cagaagttcaacacaagcctggccaacatggagaaaccctgtctaccaaaaatacaaaaattagccggacatgatggtgggtgcctgtaatcccacctacytgggaggctgaggcacgagaatcgcttgaatctgggaggcagaggttgcagtgagccgagatcacaccactccactccagcctcagtgatagagtgagac

SEQ ID NO: 53665 - DNA, 201 bp, Homo sapiens
atgaactgcaggattggtcaccccgtcctcaagaggtcatctgtgagtcggtttggaccgattcgctcttctcaccaccctgcagttggcgtcttctgcaycttggtctcatctcaatctctcggttccagctttgcgcttcgcttgactgcagtgtgtccccagcagtgcttacagtggctaagctggctctgaaagtag

SEQ ID NO: 53666 - DNA, 201 bp, Homo sapiens
atctggtccttcaatagcaatgatttttatggctacgggtgtgtgatcagcaattgtttgaaacacttcgccaaacaccccttccccaatcttctcacagmgttgcagtttttctgtgggaaggcaatggctaaaggggacaggacccttctgactgcattccccataaaccttttcagcatcagatgcctttttgtttga

SEQ ID NO: 53667 - DNA, 201 bp, Homo sapiens
agagtgtttaaggggcttagcaaatacatagaggaggagtgccaagaggacggagcaccacttgttctgttcatgacaggccggtttgaacattctgatargagggatccagagagagaagtggcagtggtatagatgctgcagacctctgacacatcagtcacaattttcttcttgtggaaactgaaggaagccctggtt

SEQ ID NO: 53668 - DNA, 201 bp, Homo sapiens
tgaacctaagaggcagaggttgcagagagccaagatcgagccactgcactccagcctgggcgacagaacgagactccatctcaaaaaaaaaaaaaaaaaagagagagaaagaacttgataaacccaggtgtggctgtgactcttcccttctgtctgagccagttctttacccctttgtgactgggataagaaccatagcag

SEQ ID NO: 53669 - DNA, 201 bp, Homo sapiens
aacctaagaggcagaggttgcagagagccaagatcgagccactgcactccagcctgggcgacagaacgagactccatctcaaaaaaaaaaaaaaaaaagagagagaaagaacttgataaacccaggtgtggctgtgactcttcccttctgtctgagccagttctttacccctttgtgactgggataagaaccatagcagct

SEQ ID NO: 53670 - DNA, 201 bp, Homo sapiens
aggcgtggtagcacacacctgtcatcccagctactcgggcggctgaggtaggagaatcgcttgaacccgggaggcggaggttgcagtgagccgagatcacrccactgcactccagcctgggcaacagagcaagactccatctcaaaaaaaaaaaaaaagaaaaaaagaaaaagaaaaaaaaagcattattgttgtcatctt

SEQ ID NO: 53671 - DNA, 201 bp, Homo sapiens
gggcggctgaggtaggagaatcgcttgaacccgggaggcggaggttgcagtgagccgagatcacgccactgcactccagcctgggcaacagagcaagactycatctcaaaaaaaaaaaaaaagaaaaaaagaaaaagaaaaaaaaagcattattgttgtcatcttctcccccacatccaactctaaccctgccttccgtgg

SEQ ID NO: 53672 - DNA, 201 bp, Homo sapiens
cggctgaggtaggagaatcgcttgaacccgggaggcggaggttgcagtgagccgagatcacgccactgcactccagcctgggcaacagagcaagactccawctcaaaaaaaaaaaaaaagaaaaaaagaaaaagaaaaaaaaagcattattgttgtcatcttctcccccacatccaactctaaccctgccttccgtggtga

SEQ ID NO: 53673 - DNA, 201 bp, Homo sapiens
gtttcagtcagcgttttctgtaactgtctcctgcctagttccctcccaccaatacccagcgaccccacgcctcagctccaggtcccaccgacattcacagyccctctctcagaagcctaaaggccagggtgcaggagagagtttggagcccgtgtcgcagagggctctgagtccaccaggggctgggggagggcccagcgg

SEQ ID NO: 53674 - DNA, 201 bp, Homo sapiens
ttattcaaattttgccagttgtcctattaatgtcctttatagcaaaagaaaaaaaaggttctggtccaggatcattcatagcgttctacagttatttatcyttagtctcctttaatctggaagggtttctcactcagtctttccttgtcttttaatgacattaacatttttgaagggtacaggccagtccttttgtagaat

SEQ ID NO: 53675 - DNA, 201 bp, Homo sapiens
cacgccactgcactccagcctgggagacagagtgagactccatctcaaaaagcaaacaaacaacgaaaaacatactaaagcaataaataaaggcaggagayggacaagggttgctgggctgtacccagctcagggtgtaacagggcccctgtggctgcgagctgatggccagtcctctgtcagagctggtgggtcaatggt

SEQ ID NO: 53676 - DNA, 201 bp, Homo sapiens
tctagaagctgcctgcattccttggctcacggcctcctcctcctcaagcctgcagcatagtaagctttgcatctttctctgacactttggaagaccaaggygggagtgcttgagcccaggatcagcttgggcaacacagtgagacttcatctctatagacaaattaacaaaattagctgggcaaggtaactcgctcctgta

SEQ ID NO: 53677 - DNA, 201 bp, Homo sapiens
tagtttttaaccatacattgtcccaaaagtgtctgtgcattgtgcaaaaagtaaacttaggaaacatttggtattaaataaatttacacttttctttgcartagtgcctttaatctggaaatacagtattacttaggatttgcagtacattttgcctgatagggcaagttttcattcttatttttaaaaaatgatagattg

SEQ ID NO: 53678 - DNA, 201 bp, Homo sapiens
tcgcccttgttgcccaggctggagtacaatggcgtgatctcggctcactgcaacctctgcctcccaagttcaagcaattctcctgcctcagcctcccgagyagctgggattacaggcatgtatcaccatgctcggctaatttttgtacttttagtagagacggggtttcactatgttggccaggctggtcttgaacacctg

SEQ ID NO: 53679 - DNA, 201 bp, Homo sapiens
gctgaggtgggtggatcacctgaggtcaggatatcaagaccagcctggccaacatggtgaaaccctgtctctactaaaaatacaaaaattggccgggtgtrgtggctcacacctgtaatcccagcaatttgggaggccgaagtgagtggatcacctgaggtcaggagttcaagaccagcctggccaacatggtgaaaaccc

SEQ ID NO: 53680 - DNA, 201 bp, Homo sapiens
gggctgggtggaagagatcaggctatgtggctatattaaaaatacaacaaaaggccgggcgcgggggctcacgcctgtaatcccagcactttgggaggccsaggctggcggatcatgaggtcaggagatcgagaccatcctggctaacacagtgaaaccccgtctctactaaaaatacaaaaaaaaaaaaaaaattagctg

SEQ ID NO: 53681 - DNA, 201 bp, Homo sapiens
ctgcagatccttggtgaaatatctttcaacaaatctctatatgagggactgaatgcagagaaccacagaactaaggtaattcctggctggcttctgagtastgcccaaggaaaattgtgcctaacctttgagcacctccacagacattctgttgccctcttcctgttttcagccttaacacttctgatcttggctctgcca

SEQ ID NO: 53682 - DNA, 201 bp, Homo sapiens
cctacttgggaggctgaggcacgagaatcgcttgaatctgggaggcagaggttgcagtgagccgagatcacaccactccactccagcctcagtgatagagygagactcagtctcaaaaaataaataaataaataaaaaatgaattacctaagtgagaaattgttttttgtatccagtaactgtcttagtgtgctgtatcag

SEQ ID NO: 53683 - DNA, 201 bp, Homo sapiens
tgaatctgggaggcagaggttgcagtgagccgagatcacaccactccactccagcctcagtgatagagtgagactcagtctcaaaaaataaataaataaawaaaaaatgaattacctaagtgagaaattgttttttgtatccagtaactgtcttagtgtgctgtatcagtgtttagttatagtattaaacagtactcagga

SEQ ID NO: 53684 - DNA, 201 bp, Homo sapiens
tagactagatactggaactcttggaattctttttgcaaaagtatgactagaagtcagactgatgcctgtgatttgtggactgaatgctttgtgtgttaccstgtgttttcattcttgttgacccttgcctggacatggcttcagaggtgatctatctgtgagctctgagctctttagttaggcatgattctctactagagg

SEQ ID NO: 53685 - DNA, 201 bp, Homo sapiens
cttcatctctatagacaaattaacaaaattagctgggcaaggtaactcgctcctgtaggcccagcaacttgtgaggctgaggtaggaggattgctgagccsgggaggtcaaggctgcagtgagctgtgatcacactactgcactccagcctggacaacagagcaagacactacctaaaaaacaaacaaaccccacaaaata

SEQ ID NO: 53686 - DNA, 201 bp, Homo sapiens
ggaagagatcaggctatgtggctatattaaaaatacaacaaaaggccgggcgcgggggctcacgcctgtaatcccagcactttgggaggccgaggctggcrgatcatgaggtcaggagatcgagaccatcctggctaacacagtgaaaccccgtctctactaaaaatacaaaaaaaaaaaaaaaattagctgggcgtggtg

SEQ ID NO: 53687 - DNA, 201 bp, Homo sapiens
ccccacaaaataacaggaggctattaccatcaacaaggcaggacgatgatggaaggagcatctggagaagagttgctttctagaaataatttggagagtcrggcacggtggctcatgcttgtaattccagcactttgggaggctgaggtgggtggatcacctgaggtcaggatatcaagaccagcctggccaacatggtga

SEQ ID NO: 53688 - DNA, 201 bp, Homo sapiens
aatcccagcactttgggaggccgaggctggcggatcatgaggtcaggagatcgagaccatcctggctaacacagtgaaaccccgtctctactaaaaatacaaaaaaaaaaaaaaaattagctgggcgtggtggcgggcagctgtagtcccagctactcgggagtctgaggcaggagaatggcgtgaacccgggaggcggag

SEQ ID NO: 53689 - DNA, 201 bp, Homo sapiens
aatctgttttcttgcctttttaggcttctagaagctgcttgcattccttggctgacgggctcctcctcctccttaggcctgcagcatagcaagcttcacawctttctccgactctgattctcctgcctccctcctagaaggacttttgtgattacactggggctttacagcccagccaggacagccctgggggcttctggg

SEQ ID NO: 53690 - DNA, 201 bp, Homo sapiens
cttcagcatcataggctatactgagtatttttgcataaataagattagatccagtacagccgaaattatcatgctttgcaaaataagttaaaaaggttcarctgctcgggagagcagggttcagaggaaggtggagtcagttctgattgagggatgagcaccagaggtcttgaaggattggactctccaggagagattcag

SEQ ID NO: 53691 - DNA, 201 bp, Homo sapiens
ttgggaggccgaggctggcggatcatgaggtcaggagatcgagaccatcctggctaacacagtgaaaccccgtctctactaaaaatacaaaaaaaaaaaaraaattagctgggcgtggtggcgggcagctgtagtcccagctactcgggagtctgaggcaggagaatggcgtgaacccgggaggcggagcttgcagtgagc

SEQ ID NO: 53692 - DNA, 201 bp, Homo sapiens
ccttttgccataaaaggcaacatattcacaggttctggggattaggacgtggccttctttggggggccattattctgcctacgatagcagatggagaggtrggaatttcagccgttataggtgtattgaagccatgggcttggaagggatcactagggagagtgtgccggcaaggaagacagtgacccagcccccagatcc

SEQ ID NO: 53693 - DNA, 201 bp, Homo sapiens
gaaagcggtctagagactcctgagtcctctgtgctggcttctgtgtgtttgctgtgagctcccttctagaaacccttccaaatggcagtcatcacactgtrttgtaattatctctttttcctactagatgatgagcttgatgtaggaagctgtacttgatctccttctgtcttcagcatcataggctatactgagtatttt

SEQ ID NO: 53694 - DNA, 201 bp, Homo sapiens
gggcgtggtggcgggcagctgtagtcccagctactcgggagtctgaggcaggagaatggcgtgaacccgggaggcggagcttgcagtgagcggagattgcrccactgcactccagcctgggcgacagagcgagactccgtctcaaaaaaaaaaaaaaaaaaaaaaaatacaacaaaaaaccctgcatgaaactgttgaccc

SEQ ID NO: 53695 - DNA, 201 bp, Homo sapiens
tactctgattttaatttgcaggtacatggggagaacctctttggagcagaataccagttgcaaatttgcgtcccaaccaaattacgaggtctccaggttgyagcagtgaagaagctgacgaggactcaggtatttaaaggcagttctttatcagtcacacctctttccacagtgactacagagtctcaagtataaaaacca

SEQ ID NO: 53696 - DNA, 201 bp, Homo sapiens
ggtgcatgccaccacacccagctaattttttaattttaattttgtggagatgaggtctccctatattgcccaggctggtctcaaactccggggctcgagcsatcttctcatcttggcctcccgaagtggtggggttacaggcataagcacctgaccttgcttttttctcccaacaagtcaaactattccctaaataggttc

SEQ ID NO: 53697 - DNA, 201 bp, Homo sapiens
atgaaccaccactcccagcctcttttttaaaaataaacaccagggtctttgtcccccaagctggagttcagtggcacagttaagggctcactgcagcctcstactcctaggctcaggtgatcctcccatcttagtctcctgagtaactgggactgttactcaggtgcatgccaccacacccagctaattttttaattttaa

SEQ ID NO: 53698 - DNA, 201 bp, Homo sapiens
gagagagcgccacgctttgacttctgcaaatggcatcccccttccgcaggaagtagaaagttccctttcaagccctgggctgtcattccccctctaggccrtgggaacagacctgcagacagctgccgaggtggccaccgggagagaagtgcgaagtgcagaggctctccagccgaggagctggctgccttccttcataat

SEQ ID NO: 53699 - DNA, 201 bp, Homo sapiens
ctgacacagtcctagcaacagaaatgatacctacagcgtattgcgtgcccaccctgtgcccggcagtcctctgagtcattctgttttcatcctcaaaaccrcgccatttataagagaggaagctacagttcagagaatgtaggtcttttggttgccagtatgacaaagttcacacttttagtgttggtggctgattcgaaa

SEQ ID NO: 53700 - DNA, 201 bp, Homo sapiens
cgcctcggcctcccaaagttctgggattacaggcatgaaccaccactcccagcctcttttttaaaaataaacaccagggtctttgtcccccaagctggagytcagtggcacagttaagggctcactgcagcctcctactcctaggctcaggtgatcctcccatcttagtctcctgagtaactgggactgttactcaggtgc

SEQ ID NO: 53701 - DNA, 201 bp, Homo sapiens
cctccatggggccttttgaaatgtggctttcagaattagtcgattatgtgtaggcaagggaaatagttagcttacagagacgactagccaggccgggcgcrgtggctcacacctgtaatcccaacactttggaaggccaaggtgggtggatgacctgaggtcaggagtttgagaccaacctggtcaacatggcgaaaccct

SEQ ID NO: 53702 - DNA, 201 bp, Homo sapiens
tatcctgaggctgacagtggggaggacgaggaaggagctaccatttctgcccctgaggctgggggcagtaagattccccaggatgggtctgtgaggctggsgggttccttggtccacacagccagtcccacggtatcttgcacattccttggcacttacatacccaccaggcagtgcttctccacccacctgcccgaccaa

SEQ ID NO: 53703 - DNA, 201 bp, Homo sapiens
ttttagtagagacggggtttcaccatattggccaggctggtctcaaactcctgaccttgtgatcctcccgcctcggcctcccaaagttctgggattacagkcatgaaccaccactcccagcctcttttttaaaaataaacaccagggtctttgtcccccaagctggagttcagtggcacagttaagggctcactgcagcct

SEQ ID NO: 53704 - DNA, 201 bp, Homo sapiens
tagtcataattatattataatggcaccagaattttaccattacttgaactaggaacagattcagtatatggaatcaagggaaactttcattttattaattwattaatttatttatttatttgagatagagtcttgctctttctcccaggctggagtgcagtagcatgatctcggctcactgcaacctccgcctcccaggtt

SEQ ID NO: 53705 - DNA, 201 bp, Homo sapiens
tttgaaatgtggctttcagaattagtcgattatgtgtaggcaagggaaatagttagcttacagagacgactagccaggccgggcgcggtggctcacacctrtaatcccaacactttggaaggccaaggtgggtggatgacctgaggtcaggagtttgagaccaacctggtcaacatggcgaaaccctttctctaataaaaa

SEQ ID NO: 53706 - DNA, 201 bp, Homo sapiens
gctggggggttccttggtccacacagccagtcccacggtatcttgcacattccttggcacttacatacccaccaggcagtgcttctccacccacctgcccraccaaacccactgaggaaaagcagcaggcatccgctgttgctggacgcccatcaccacgctcacaaggctgggcacagagcagacgtcaatgggcacgtg

SEQ ID NO: 53707 - DNA, 201 bp, Homo sapiens
accatgcctggctaattgttttgtatttttagtagagacggggtttcaccatattggccaggctggtctcaaactcctgaccttgtgatcctcccgcctcrgcctcccaaagttctgggattacaggcatgaaccaccactcccagcctcttttttaaaaataaacaccagggtctttgtcccccaagctggagttcagtg

SEQ ID NO: 53708 - DNA, 201 bp, Homo sapiens
cataattatattataatggcaccagaattttaccattacttgaactaggaacagattcagtatatggaatcaagggaaactttcattttattaattaattwatttatttatttatttgagatagagtcttgctctttctcccaggctggagtgcagtagcatgatctcggctcactgcaacctccgcctcccaggttcaat

SEQ ID NO: 53709 - DNA, 201 bp, Homo sapiens
agacgactagccaggccgggcgcggtggctcacacctgtaatcccaacactttggaaggccaaggtgggtggatgacctgaggtcaggagtttgagaccarcctggtcaacatggcgaaaccctttctctaataaaaatacaaagttagccaggcgtggtggcacatgcctgtaatcccagctacttgggaggctgaggca

SEQ ID NO: 53710 - DNA, 201 bp, Homo sapiens
accctttctctaataaaaatacaaagttagccaggcgtggtggcacatgcctgtaatcccagctacttgggaggctgaggcaggagaatcgcttgaatcckggaggcagagatggcagtgagccgagatcgcgccattgcactccagcctggatgacagagcgagactccatctgaaaacaaacaaacaaacaaccgaaaa

SEQ ID NO: 53711 - DNA, 201 bp, Homo sapiens
aggcacggggctcagggacatagagcagtgtagcggcgtgacagcctcacagtcctgtgttgagaccggattccgtgggaccctctttcaagctgtcagarcatctttaacagaaggtcataatctcctgacagacctagcccttctagataaggggccagaatagtttcttacgaagtatttgggtgattggatagtttt

SEQ ID NO: 53712 - DNA, 201 bp, Homo sapiens
tgtaatcccagcactttgggaggcagaggtaggcggatcatgaggtcaggagtttgagacaagcctggtcaacatggtaaaaccccgtctctactaaaaawacaaaaattagctgggcatggtggtgggcgcctgtaatcacagctactgggcaggctgaggcaggagaatcgctcaaactcgggaggcggagggtgcagt

SEQ ID NO: 53713 - DNA, 201 bp, Homo sapiens
tgggtctcaggaaggacatctcctgaactttctagctgagccctgccagaagagagattagactcccgaaattgggagagcctttggaaaacaaaacctgmggatgacttctaatagctgagctctgcaagtagtacacatggatataatttgcatttattatgtcccttaggtaatacacactttttagtctggtgaggg

SEQ ID NO: 53714 - DNA, 201 bp, Homo sapiens; identical to SEQ ID NO: 15519

SEQ ID NO: 53715 - DNA, 201 bp, Homo sapiens
tgccgttcctcggcagcccagcctgcgtagacggtcccgcggcgctgactgaccgggctgtgctttctcgtcttcagcaccagcaggcagctggctccggytttggggtatctgggctccaggcagaagcacagcctccccgacctgccctacgactacggcgccctggaacctcacatcaacgcgcagatcatgcagctg

SEQ ID NO: 53716 - DNA, 201 bp, Homo sapiens; identical to SEQ ID NO: 15528

SEQ ID NO: 53717 - DNA, 201 bp, Homo sapiens
ctcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagt

SEQ ID NO: 53718 - DNA, 201 bp, Homo sapiens; identical to SEQ ID NO: 15529

SEQ ID NO: 53719 - DNA, 201 bp, Homo sapiens; identical to SEQ ID NO: 15546

SEQ ID NO: 53720 - DNA, 201 bp, Homo sapiens
tggctgtggtggcttcggcagcggcttcagcagatcggcggcatcagcggtagcaccagcactagcagcatgttgagccgggcagtgtgcgggtgagaagraaggggacccggtcacggccccaagggcgaaggggctcgcggcgggcagggcctccgcggcaatggcgacagtggccgcaccgggcctggcgggaccggg

SEQ ID NO: 53721 - DNA, 201 bp, Homo sapiens
ttgtttataagtgattgagtacctgcagagctttcttttacttaaacatattttaaaaattattaaaaagattttcatgtttgaaaacttggggaaaaaarataaaacaatgtcataatctcatcacatttaactgactaatatgaatatttttcaacaaaaagcatttgacttttattattatttgaggcaaaaactaaa

SEQ ID NO: 53722 - DNA, 201 bp, Homo sapiens; identical to SEQ ID NO: 15522

SEQ ID NO: 53723 - DNA, 201 bp, Homo sapiens
aaaattcagttactattgatttattaaaaaacaatagaaaagttacatctatttttagagtgactctcaagaaaatttaataagggaaacacagatctataaaaaaactgtttgtaaacctaacaaaggaaaaaaaaagttggtgtctttaaaaaaccctttgagattagctgtgtattcagatatcagttggttctctcc

SEQ ID NO: 53724 - DNA, 201 bp, Homo sapiens
ggcattgcactccagcctgggcaacaagagtgaaactccgtctcaaaaggtaaaaaatgaaaaaaaaaaaaaaaaaaaaaaaaagttgaagttataaaaawcaaaaacgtgaattaaaattgtgaaacttagatccaggtgtcgcattctgatgttgtctaatttcttgggccctatgacaaaaatattttaatacatgta

SEQ ID NO: 53725 - DNA, 201 bp, Homo sapiens
ctcccaaatagctgggattacaggcacataccaccatgcccagctaatttttgtgtttttagtacagacagggtttcaccatgttggccaggctggtcttraactcctgacctcaggtatctgcctgcctcggcctcctgaagtgctgggattacaggcatgagccaccatgcccagccaaatgttttacttattaaccct

SEQ ID NO: 53726 - DNA, 201 bp, Homo sapiens
ttttttttttttttttttgacggaatctcagtctgtcccgcaggttggagtgcagtgatgtgatctcggctcactacaacctccgtctcctgggttcaagyaattctcctgcctcagcctcctgagtagctgggattacaggcgtacgccaccacgcctggctactttttgtgggttttttagtagagacagggtttttcc

SEQ ID NO: 53727 - DNA, 201 bp, Homo sapiens
tttgtgaaaaggaaggagcacgaatgctttcaagttcctatgacatgctagtcatctttcagtgtgtcccattgttgcacccagtagtctcgatgcccagygtcacggtgattccaagtttgcctctctgcccactataatttgtgctccatgaagtcccaggacatgaggttcttgttcatttgtgcgtctgggcccata

SEQ ID NO: 53728 - DNA, 201 bp, Homo sapiens
gctactttttgtgggttttttagtagagacagggtttttccatgtcgtccaggctggtctggaactcctgacctcaagtgatccgcccatctcggcctccyaaagtgctgggattacaggcgtgagccacctcacctggccttgtatgtatgtttttttctttttctttctttttttttttctgtgacggagtattgccct

SEQ ID NO: 53729 - DNA, 201 bp, Homo sapiens
caggcgtgagccacctcacctggccttgtatgtatgtttttttctttttctttctttttttttttctgtgacggagtattgccctgtcgcccaggctggastgcagtggcgtgttcttggttcactgcaacctctgcctcctgggttcaagccattctcctgcctcatgctcctgagtagctgggattataggcacgcgcc

SEQ ID NO: 53730 - DNA, 201 bp, Homo sapiens
acaagaggatttccatttttttctaatattaatagttcatttagtctgtagcttcttgaaggcatagaaaagactattttattttgcctacttatttggcraggtacccatgcagtatgccaggagttacagggcctattgagaaggagtaaagggtctgggaggggtggcagggagttgctaattcatgtatggtggcta

SEQ ID NO: 53731 - DNA, 201 bp, Homo sapiens
atatattggtgcacccttatctacattttgtgcacagtaggaatcgattgttgatttactgaagttaccttatacttgttttttgttttttttgttgttgwttttttgagacaagagttttgctcttgttgcccaggctggagtacagtggcgcagtcttggctcactgcaacctccgcttcctgggttcaagtgattctc

SEQ ID NO: 53732 - DNA, 201 bp, Homo sapiens
gacccagttgatttagttgatgtgactaatctagaattatattctgtattactacagaataaaaggattacagctcttaaagtatacccttagttcagtcrtagagaaaactgcccatcaagacaggaagagctgggctgccttggagaagaacaatgactttattcccaaatggaggcgtagaagaaggagggtagaagt

SEQ ID NO: 53733 - DNA, 201 bp, Homo sapiens
tagccttgaggggaacatccaagttggtcatgtgagtgcaaaaaggccagtgaggctgcagctgcgtgagcacgtgctcaatgacggggtcaagtgcagcrcctcttggtagtaagagtagctgagtgtaaacacctagggttcgctccagtgagaaggggagcctttggagggggcaaggcccacccccaccccccaaaa

SEQ ID NO: 53734 - DNA, 201 bp, Homo sapiens
ttcttctacccctgacattggaatactcttgatctgtggctcacttcacaggatagacccagattttggcagaatctgaacagctcttttgggacagtgamatggcataacaatttgtaaaagccacaaaaaatttgtaagcaccgatctgtagagtcaggttatttgtagagctgcatgaccagaaaggctgatatttgt

SEQ ID NO: 53735 - DNA, 201 bp, Homo sapiens
tacccctgacattggaatactcttgatctgtggctcacttcacaggatagacccagattttggcagaatctgaacagctcttttgggacagtgacatggcrtaacaatttgtaaaagccacaaaaaatttgtaagcaccgatctgtagagtcaggttatttgtagagctgcatgaccagaaaggctgatatttgtaagtga

SEQ ID NO: 53736 - DNA, 201 bp, Homo sapiens
cctattggaatattttctttatataggcgttttttttttttctttttttttggagacagagtcttgctctgttgcccaggctggagtgcagtggcgcgacyggagctcactgcaacctccacttcccgggttcaagtgattgtcccacctcagcctcctgaatagctgggattacaggtgcatgctaccatgcctggctac

SEQ ID NO: 53737 - DNA, 201 bp, Homo sapiens; identical to SEQ ID NO: 15541

SEQ ID NO: 53738 - DNA, 201 bp, Homo sapiens
ttcacaaggaaaatagccctttagtgggaaactgaaacaggcttgtttttatttactatttactcatatttgtaatgcaattaaaatatatgttgttaactttttttttttttctcaagagctcggttgataaaaccaggggtatgtggactttttgagtctgtgccttttgggggtgtgtatgggaatgttatgttttaa

SEQ ID NO: 53739 - DNA, 201 bp, Homo sapiens
aattttaggacaaacggatgttatagataagctggtcccattatctaatagcttacaaagaaaaaaatataatgtatacagtggttgaaaaagtaggagtyacaaaaaaatgtgtttgcattttaacttttcaggagatgttacagcccagatagctcttcagcctgcactgaagttcaatggtggtggtcatatcaatca

SEQ ID NO: 53740 - DNA, 201 bp, Homo sapiens; identical to SEQ ID NO: 15526

SEQ ID NO: 53741 - DNA, 201 bp, Homo sapiens
tacacatattgccagcactggtgaattgtagggcctgaaaagaaagctctactgtgtcactcgttttttttgcaaattgaaattgttcttgttgtataatrtgctttggggaaatgtttggtctctcaggtaggtgtgccagccgtttgcaggagggctgagagcgcctgtccactggtggccagacatcatcgggtccgc

SEQ ID NO: 53742 - DNA, 201 bp, Homo sapiens
cccaggctggagtgcagtggcgcgaccggagctcactgcaacctccacttcccgggttcaagtgattgtcccacctcagcctcctgaatagctgggattayaggtgcatgctaccatgcctggctactttttgtatttttagcagagacagggtttcaccatgttggccagggtggtctcgaactcctgacctcaagtgat

SEQ ID NO: 53743 - DNA, 201 bp, Homo sapiens
tccagcctaggacttggagactccctgcatccccagctaccctgcaggtgaaacttcactgagcccacttgacttcaggtgggagaggaggaggcacaccrttgtggtgtgcgttaccaaaaaagcagtaacctaactgtggaacagttcaggatctttagacttgatacttttcttgatttcccttaggggtcaaagttc

SEQ ID NO: 53744 - DNA, 201 bp, Homo sapiens; identical to SEQ ID NO: 15548

SEQ ID NO: 53745 - DNA, 201 bp, Homo sapiens
tttttttttttctcaagagctcggttgataaaaccaggggtatgtggactttttgagtctgtgccttttgggggtgtgtatgggaatgttatgttttaacrttttttacaaaatagtattgtctttttaatttattcgttagtggtttgcacaaggaagataatcgatagtcatgttttttagactctctgtattgcttgg

SEQ ID NO: 53746 - DNA, 201 bp, Homo sapiens
atgttatgttttaacgttttttacaaaatagtattgtctttttaatttattcgttagtggtttgcacaaggaagataatcgatagtcatgttttttagackctctgtattgcttggtaagctacgtagtaaaaaatgtttacttttccttaaatgttttgaatttcggggttatgaaatttgttgagtaatttttagacag

SEQ ID NO: 53747 - DNA, 201 bp, Homo sapiens
agttggttctctcctttctgaatcgctaaacaactggagcttgtttcagaaagcagcattgtctacgtatgttccttttaaaaattttttttttaattctrtctaaaaaaaacagacggggtcacactatgttgcccaggctgctcttgaattcctgggctcccctatccacgcacctcggccttccagagtgctgggatt

SEQ ID NO: 53748 - DNA, 201 bp, Homo sapiens
acacatattgccagcactggtgaattgtagggcctgaaaagaaagctctactgtgtcactcgttttttttgcaaattgaaattgttcttgttgtataataygctttggggaaatgtttggtctctcaggtaggtgtgccagccgtttgcaggagggctgagagcgcctgtccactggtggccagacatcatcgggtccgca

SEQ ID NO: 53749 - DNA, 201 bp, Homo sapiens
tggccccctcctgtcctcctgggcagaggcagaggtggcaactttgtgaaccagacttctcccccgctgtccctgcaggtggagattctgcctcagggccrtgagagtcccatcttcaagcaatttttcaaggactggaaatgagggtgggcgtcttcctgccccatgctcccctgccccccaccacctgcctgcttgctt

SEQ ID NO: 53750 - DNA, 201 bp, Homo sapiens
aactttgtgaaccagacttctcccccgctgtccctgcaggtggagattctgcctcagggccgtgagagtcccatcttcaagcaatttttcaaggactggawatgagggtgggcgtcttcctgccccatgctcccctgccccccaccacctgcctgcttgcttctctggctgcctggtcagtgcagaggtgccccctgcaga

SEQ ID NO: 53751 - DNA, 201 bp, Homo sapiens
gatggacatcctatgaattcagcaaggtttggctgcagcacaggcaaccttctgtctcctggagcccatgaccaggctggaacccacctatgccttcaccyttaggtgtgcctggctctaaccaggttccggaatgacaggaccacaggatggtgcaagacttgtcttggaaaaaaacacctgagacgcttaattagaaca

SEQ ID NO: 53752 - DNA, 201 bp, Homo sapiens
accaggtcagagcccacctctaggcacccccaccctgcagcttccctcagagccagccctgcttctggctggttctcaccctgcagaagacccgggtgccyttggagccgggtccccacctttctgcccgtcttccagtgggatggggtgcagagggctctgggtctcctgtcagtccactcagatgggccgtctgggctg

SEQ ID NO: 53753 - DNA, 201 bp, Homo sapiens
taaatgctgtttctgcatctattgaggtgattacacatacatgtttgttaatagggtgtatagcattgattttcaaattttggcctgtttttttttttttkgcgttgtgagcggctttatttatttattttaaatttataattgacagataataattgcacatacttagcaggagcagtgtgatgtttcattgtacatatg

SEQ ID NO: 53754 - DNA, 201 bp, Homo sapiens
agtcatctggagcttctcaaacactgacatccaggctccacctagagagtctggttttaatgagtccaatatggaagctagtcactggggtttttctttcttatttttctgtaaattactttttttttttttttttttgagacagagtctcactctgtcacccaggctggagtgcagtggtgtgatctcggcttactgcaa

SEQ ID NO: 53755 - DNA, 201 bp, Homo sapiens
agatattaaaccaaccttgcattcctgggataaacctcatttggtcatcatggtttattttttatatattatttgatttcatttgctaaaattttgttaattttttttttttttttttttttttgagatggagtctcactctgtcacccaggctggagtacaatggcatgggcttagctcactgcagcctctgcctcttgg

SEQ ID NO: 53756 - DNA, 201 bp, Homo sapiens
ggcgcactccgtgtctcattcttgagcgctccctgatggcttgagcttggggcagccacttcaccagctcaggcctgagtcacaggctgggctgcctgttscaggggatgtgggcacagcatgtgatcctctgtgggatggagaaacgttaaagtttccctccgcaaacctctgctctctgcatgtcctcttccggaatcg

SEQ ID NO: 53757 - DNA, 201 bp, Homo sapiens
gatattaaaccaaccttgcattcctgggataaacctcatttggtcatcatggtttattttttatatattatttgatttcatttgctaaaattttgttaattttttttttttttttttttttttgagatggagtctcactctgtcacccaggctggagtacaatggcatgggcttagctcactgcagcctctgcctcttggg

SEQ ID NO: 53758 - DNA, 201 bp, Homo sapiens
ctgggagaactcccagagaaggcggaggccacttaatgtcctggaagtttccttggacagctggggcttgatacgggcctggaaggataagggggcttgtgtgtgtgtgtgtgtgtgtgtgtgtgtgtgtgtgtgtgtgacagattcttcctctgttgcccaggctagagtgcagtagtgccatctcggctcactgcaacc

SEQ ID NO: 53759 - DNA, 201 bp, Homo sapiens
atattaaaccaaccttgcattcctgggataaacctcatttggtcatcatggtttattttttatatattatttgatttcatttgctaaaattttgttaattttttttttttttttttttttttgagatggagtctcactctgtcacccaggctggagtacaatggcatgggcttagctcactgcagcctctgcctcttgggt

SEQ ID NO: 53760 - DNA, 201 bp, Homo sapiens
atagggtttcaccatgttggccaggctggtctcgaactcctgacctcatgatccacccaccttggcctcccaaagtgctgggattacaggcgtgagccacygtgtccagccaaattgtgttaatttttgtatgtgtatgttcatgagagatactgatctgtaattttctttttgcataatatatttatctggttttgttat

SEQ ID NO: 53761 - DNA, 201 bp, Homo sapiens
aacactgacatccaggctccacctagagagtctggttttaatgagtccaatatggaagctagtcactggggtttttctttcttatttttctgtaaattactttttttttttttttttttgagacagagtctcactctgtcacccaggctggagtgcagtggtgtgatctcggcttactgcaacctccacctcccaggttca

SEQ ID NO: 53762 - DNA, 201 bp, Homo sapiens
tgagtgcacctcacttccagcctatgcttggtgaaggcttgaagccaatgctgagcttttctttcttgaattctgtgcatttctttgtaatttggaatccwcctaatttccaaatgggttcggggcccctgtgctgcagggattggggtgatgagagggagtggggctgcctggaatttgcttttcaggtcttcactctct

SEQ ID NO: 53763 - DNA, 201 bp, Homo sapiens
gtgcatttctttgtaatttggaatcctcctaatttccaaatgggttcggggcccctgtgctgcagggattggggtgatgagagggagtggggctgcctggmatttgcttttcaggtcttcactctcttgtctgctcctgggacctgggcagtgggcagcgaggcacagtgggagggacctagggaggaccagcctccccct

SEQ ID NO: 53764 - DNA, 201 bp, Homo sapiens
ctgggccgttgtccctggctggtgccacccctcctgccgcagcacagtgtccacaagtcatcccgtggggagctgacagggctcagctaccgttggtggcrtttattaaactgtgcacccacgcccttgaagcagtctgttgcctctgtctgtgtccctgaaatcttggttctcatctcatggctcatccaggggagcttt

SEQ ID NO: 53765 - DNA, 201 bp, Homo sapiens; identical to SEQ ID NO: 15557

SEQ ID NO: 53766 - DNA, 201 bp, Homo sapiens
cagcagtcatcccgggatgagcagggggcctgtgccgtgctggctgtgcacctcaacacgctgctgggagagcggcctgtgcagcaccgcgaggtgcaggrcaatgagtctgacctcttcatgagctacttcccacggggcctcaagtaccaggtcagagcccacctctaggcacccccaccctgcagcttccctcagagc

SEQ ID NO: 53767 - DNA, 201 bp, Homo sapiens
tcacaagggccttgccctgccctctcccacttgtcccaggccagcagtcatcccgggatgagcagggggcctgtgccgtgctggctgtgcacctcaacacrctgctgggagagcggcctgtgcagcaccgcgaggtgcagggcaatgagtctgacctcttcatgagctacttcccacggggcctcaagtaccaggtcagag

SEQ ID NO: 53768 - DNA, 201 bp, Homo sapiens
gccactggaaagggcctctccagccccacgtgagaggtcctttttgtggcatttgtaataataatggcttcttctttctttccagatctgaagacagcatrtacacagccattccccagaggtaagctgcatgccccatctcctttcacaacttccccttctttacctccaagggctgcccctccccactgctctcctcat

SEQ ID NO: 53769 - DNA, 201 bp, Homo sapiens
cagtggctctccattcccaggctcagtgcaggatccaggcctgcatgtgtggcgggtggagaagctgaagccggtgcctgtggcgcaagagaaccagggcrtcttcttctcgggggactcctacctagtgctgcacaatggcccagaagaggtttcccatctgcacctgtggataggtaaggggatctggatgggggaagg

SEQ ID NO: 53770 - DNA, 201 bp, Homo sapiens
tgagactcagtctcaaaaaaaaaattcattgctcttctctcttgtttctgttttctgttaatttctgcttttattttaatttctgtgagatctcagcagayggaagaccctggcccaggggtcagagaccttatttccatgaaccactcactagctgtgtggccttggactcatttctgagactcattttctttgtctgca

SEQ ID NO: 53771 - DNA, 201 bp, Homo sapiens
gggctggtgtgtggggggtgagatcaggcactgtccctcctccccaggtctctgatgccactggacagatgaacctgaccaaggtggctgactccagcccmtttgcccttgaactgctgatatctgatgactgctttgtgctggacaacgggctctgtggcaagatctatatctggaagggtacgtggctcctctgtaaca

SEQ ID NO: 53772 - DNA, 201 bp, Homo sapiens
tgcctataatgccagcactttgggaggccaaagcaggaggatcacttgagcccaggagtttgagaccaacctgggcaatagagtgagacacagtctctccaaaaaaaaaaaaaagtttagctgggcgtggtggcatatgcctgcagtcccagctactcaggaggctgaggctggaggattgcttgagcctgggaggttgag

SEQ ID NO: 53773 - DNA, 201 bp, Homo sapiens
tctcgcaaagtttacagcacagtaagcttgtccttagcttcccctataccctccttcccacgcccaattctaggaccctttcgggcgccccagcctcccayaggggctccccgccagctcagaccggccgggcccctccctctgactcaccgggggcggctcctggccgcgcacctccagggggcggggggcggctgagac

SEQ ID NO: 53774 - DNA, 201 bp, Homo sapiens
cttcccacgcccaattctaggaccctttcgggcgccccagcctcccataggggctccccgccagctcagaccggccgggcccctccctctgactcaccggrggcggctcctggccgcgcacctccagggggcggggggcggctgagacagcgcccagggcctcggagcaaggcgttggcaggcaagtagtgcgcttcgggg

SEQ ID NO: 53775 - DNA, 201 bp, Homo sapiens
cgaggggttttcatctaccttggtgctgccggtttgggaaaattcttaagggactgactccacatctccaaagagcccctcggcattcttgggacccctgstccatttattgtaaaaattgctggctcttctgtggactcccttaaatttcctcaagaaaaatgggatggcagctaaagagggtccctgctctttttaaaa

SEQ ID NO: 53776 - DNA, 201 bp, Homo sapiens
ggcccagggcccagaagtcatgatgataaacatctggtgaatgagaagcagaccaaagggtagagacctgagaggcatcagcatggcatgcggaagatggygaagaatgttttatggcctcagccattccctgagaactgagcttagccaggtgcagtagcccacgcctgtaatcccagcactttgggaggccaaagtggg

SEQ ID NO: 53777 - DNA, 201 bp, Homo sapiens
catgatcagacccgggcagacgaggggttttcatctaccttggtgctgccggtttgggaaaattcttaagggactgactccacatctccaaagagcccctsggcattcttgggacccctggtccatttattgtaaaaattgctggctcttctgtggactcccttaaatttcctcaagaaaaatgggatggcagctaaagag

SEQ ID NO: 53778 - DNA, 201 bp, Homo sapiens
atcaaatgcattctttgagcacctgcatgaggttccagctagatccagaggcaaaatacacttcctgccctaaaggaccctacagtgtagtagtggaggtrggtgggtccataactcaccacactatggcagagtggggaaaagtaaaggctttaagaggtgtagaagaggctgtttggtaaggtggtgagtttcccatca

SEQ ID NO: 53779 - DNA, 201 bp, Homo sapiens
tttgtctgcataatggaactagggctcctagaggtggagtagttgatgaatatgaaagtacttggccactggaaagggcctctccagccccacgtgagagktcctttttgtggcatttgtaataataatggcttcttctttctttccagatctgaagacagcatgtacacagccattccccagaggtaagctgcatgcccc

SEQ ID NO: 53780 - DNA, 201 bp, Homo sapiens
aggggcccaggtcagagcagagttttgcatgatcagacccgggcagacgaggggttttcatctaccttggtgctgccggtttgggaaaattcttaagggaytgactccacatctccaaagagcccctcggcattcttgggacccctggtccatttattgtaaaaattgctggctcttctgtggactcccttaaatttcctc

SEQ ID NO: 53781 - DNA, 201 bp, Homo sapiens
aaatgcattctttgagcacctgcatgaggttccagctagatccagaggcaaaatacacttcctgccctaaaggaccctacagtgtagtagtggaggtaggygggtccataactcaccacactatggcagagtggggaaaagtaaaggctttaagaggtgtagaagaggctgtttggtaaggtggtgagtttcccatcactg

SEQ ID NO: 53782 - DNA, 201 bp, Homo sapiens
gaagccagttgtcccaggaaggtgacattggactagacctataggaggggagatgccactccaggcaaagggagaaggtgagctgagccaccaaggtgggkaagggtgcagacatgcacacaccaggggtctagtgagactgggacccgggctgggggacaggagcagggggagggaaattcctaagcaaggtggaaggtg

SEQ ID NO: 53783 - DNA, 201 bp, Homo sapiens
tgttcccctccctgaaatattccaggggcccaggtcagagcagagttttgcatgatcagacccgggcagacgaggggttttcatctaccttggtgctgccrgtttgggaaaattcttaagggactgactccacatctccaaagagcccctcggcattcttgggacccctggtccatttattgtaaaaattgctggctcttc

SEQ ID NO: 53784 - DNA, 201 bp, Homo sapiens
cagcctggctggtggggtgggctggactcagccctcactcacctcacctctgctgggtgccctagtgcagggcgcagtttgccccaccagaagcagtggcyctgggcatgatgggctgggaagttccagggcaggggtccctataaacctggcctgccctggcccctgcaggtcctgggccccaagcctgctctgaaggag

SEQ ID NO: 53785 - DNA, 201 bp, Homo sapiens
ggtggtcgtgggcattttcagagagccctctgtgctgtgctctgccttcctggttgtcctgcctcagggacagttcagagaggagagagggagagctgtgsgcccttctctgagctggggagcaggacacaggcatctggctctgacccggactttcctgcttccttgcagaacatcttcgcctggtgtggtggaaagtcc

SEQ ID NO: 53786 - DNA, 201 bp, Homo sapiens
gctagtctactttgttaaggaaaaccagcttgcacggaggttacagtggacctgtttcttgtttgagtttccagtagttcagtgtcatcccccaggatttrtgtggtttttgcagtggtcaaactggtgaattaaatggagatacgatagagaccatcccctgtgtcctccagctttttaaggatgtcatttctctcagga

SEQ ID NO: 53787 - DNA, 201 bp, Homo sapiens
gacgtgcaccaaactgttagaaccctaaaaattgtgctggcactgcaggccctttaattgcatagggcatgggtcttaccaaagaccgcactgtcctggcyactcctcgttgctcattcagtctgatagcacgatgcccctgatagagtaggctagtgtggtgctttgcaggtgttccacatttattcagactcttataac

SEQ ID NO: 53788 - DNA, 201 bp, Homo sapiens
acatacatgcatcccatgaagacagcgggaaagccctggctcctaaggtaagaaattagtaccttaacctcagcattgttaactcatactctttgtttcaytagaaaaaacagtgttgtctcacccacatcattcattactatcataagaaaatttatgctgttcttgaattttaaaatctctattgcaagagcagaaaac

SEQ ID NO: 53789 - DNA, 201 bp, Homo sapiens
tcttgatttccccaacacagaaacataccacattgttaattgtggttatttatatggctggtgtacctttctttctatatcaggagtcagtaaactctatraaggtccagatagtaaatattttaggctttgcaggcctactcaacgctgctgttatgaataatatgtacacaagtggacttgactgtcttttaataaaac

SEQ ID NO: 53790 - DNA, 201 bp, Homo sapiens
taaaatctctattgcaagagcagaaaactgtttacttccatgtactctttaactagtgtgtgtattttctgaatgtataaagcatgaattttatatagtayggtctttgcttgtcctattcatggaaaagaagaccttttatgttgatattcttggtacattggcctggggaggggtggagaactgtctaggaagtattta

SEQ ID NO: 53791 - DNA, 201 bp, Homo sapiens
tacatgcatagaattactcaaggaaaataaaatgtgaagctctgcattattactccatccataagagcatgaaatagtattattttagatattttatttasctagtctttgtgtccttaaatttaaactttattgtgcattaattatgtatttgggttctctaggtctcggtgattcagaatacacctacttttgcaatgg

SEQ ID NO: 53792 - DNA, 201 bp, Homo sapiens
tgtccttcggacagttattttatttcgttttaattttttccttaagcaaaagcataatcacagatgtctctgtctcatcagtgtgttcaccatttcgtagrcactttacacattctgcctttaacagccctgagccacttttccatagtacaagttcatttattcataaaattgctattaatgttattgaatgtagagctc

SEQ ID NO: 53793 - DNA, 201 bp, Homo sapiens
acattgcataatagctaatttctccccacaggcagtgtatggtaccctgaagtttttctaacctgcttaaaataagtttccagagcaggcagtctttgaaygcagggctaagccctctttctgttgagtggctgtttggagttccacatggacttttcttacaaaaaccacacccttactgcagctattaccagttttaat

SEQ ID NO: 53794 - DNA, 201 bp, Homo sapiens
aagatggaaaatatttcaagcctaagcattttcagtaattcttgaaagagtagcctttaatctttttgggatcatgactttattttaaatctgaaaactgsgcacctccctgcagaaaactgcacatatacctagtaagggtttgctgagctcctcacctctgaagccaacttatggacccattcctagaagcctttgctt

SEQ ID NO: 53795 - DNA, 201 bp, Homo sapiens
acgagatgcctgtgcctgcttgttggatctcctcctcgctttcccttcttgccagccaccactcagtctcctgctcggtgagtagtcgctttcacaagcaycttggtggctgttcgtgcactggtaggcgggccacctttctgtagtaaagaaaatttgctgctcttgtcttaccctttgtatcctatgcctaaagaatat

SEQ ID NO: 53796 - DNA, 201 bp, Homo sapiens
ggccagtggactggagctgatggtgagagtgtggctctaaggttcagggtcctgtgtgttggccgcacagatgcctggggctcagctgcgcatcaaggtcygggaacacaggcatacgctggtattgctagtttcttaactttcatgttaattgcactgaataagaagataatggatgttctaattattggacatttgtgg

SEQ ID NO: 53797 - DNA, 201 bp, Homo sapiens
gtactcaaccactgagtgtacaattctaattctcagactttttcagcttgacaaccttttagtgatccattatatattatatttcagaaaagagctcagayatttccttaagcatgggatcttaactcatctaaaggtttccttctcaagagatgctcctgttggggaggaggaagccccagcaaagtatgtgcaagacaa

SEQ ID NO: 53798 - DNA, 201 bp, Homo sapiens
gaaaataattgaaatgagtgaatagcacgttttccagctttctaaataaagcagaggcatttggtggcaaataattgagtttcccaaatggttccattaasgcagaaatctgacgaggtgaaaatttttctgtttggcaaacaaaagtttctgccactgcattgaggatgggttttgaaagaatcagttctctactgcagt

SEQ ID NO: 53799 - DNA, 201 bp, Homo sapiens
taatccactagatgtcagtattgtaccaggaactgtttttttaaaactacttgtaactgatttcttctaaccagctcccggaagtggccattaatggatamaatttttcaaatgtgccttgccacacttgtattgtcagtgagcataaagagtgttgtaattaggccgccatctccccagtgtggttttcgtgtcgtttta

SEQ ID NO: 53800 - DNA, 201 bp, Homo sapiens
gtcgttttattaatgtgtttattgcatttctagtcttgggtgagtaaagtactttagagagaggctcagctctctaaataaatatatgtatatttatatawatatagatttatatatatatatattccatcttcctttcctggtaatcagctcgagatgtaatttgagtatttagaattaatttactgtaatgaaagctta

SEQ ID NO: 53801 - DNA, 201 bp, Homo sapiens
aaagagttttaatggatactatggatacaccattatttgttgatgtaattatgggcaattgagtcattttcgctttttcactattaaaaaaggcaaacttycttgtactgtattaatttttgaacacttacttgaagtatatttgtaaaacaaattccttggagtagaattgctgttttaaaaatatttacattttaaatt

SEQ ID NO: 53802 - DNA, 201 bp, Homo sapiens
ttgggtgcatccctaggcagacatttaactgaatattctaatagctctacccacaaattgtgtcacaatttaaggcgggctcctttttgtaggcatttttrcgagcccttgtggactataccagtgacagtgctgaaaagcgcaggctacaggagctgtgcagtaaacaaggggcagccgattatagccgctttgtacgag

SEQ ID NO: 53803 - DNA, 201 bp, Homo sapiens
gtaggcatttttgcgagcccttgtggactataccagtgacagtgctgaaaagcgcaggctacaggagctgtgcagtaaacaaggggcagccgattatagcygctttgtacgagatgcctgtgcctgcttgttggatctcctcctcgctttcccttcttgccagccaccactcagtctcctgctcggtgagtagtcgctttc

SEQ ID NO: 53804 - DNA, 201 bp, Homo sapiens
cctgtcgcagtcagatacttgagagaacactggtccaccgagtggatgaaggtcatttccatttttcgaatgaaactttttacaatgggcatgatggaatytgaccccgaaaggctcaggttgtcgtgaacacaaccaagggcacagacgctccttgactaccttgtgaacatgatttagaggtttattttttaaagcagc

SEQ ID NO: 53805 - DNA, 201 bp, Homo sapiens
tctcggtgattcagaatacacctacttttgcaatggggggaagataattgataaacgacttcaagagcttggagcccggcatttctatgacactggacatrcagatgactgtgtagggtaagggcagtgttctctgtttactccaataagccctctatacatgatggaagttgatttgtaaaacatgtcagcttttcactt

SEQ ID NO: 53806 - DNA, 201 bp, Homo sapiens
atccatctctcctcgaacaacaaattctttccacttaccagatgacccctcaatccccatcataatggtgggtccaggaaccggcatagccccgtttattrggttcctacaacataggtatgttctttttttggctaatgggaaaatgtattcctgagtaaccgtttttgtttctttagtcattttgaggataattggact

SEQ ID NO: 53807 - DNA, 201 bp, Homo sapiens; identical to SEQ ID NO: 15601

SEQ ID NO: 53808 - DNA, 201 bp, Homo sapiens
agacatgggccttctttgacattggtgtttgaattagcagctcactgccacacccatcatttccttatcctgtgtaattttgcttcctaagacattgggamgtcattacccatcattctgtggatatatgtgataatgtgtatgtttattttcttttccttccactagaatgtaagttccgtaaagacaggggcgttgttt

SEQ ID NO: 53809 - DNA, 201 bp, Homo sapiens; identical to SEQ ID NO: 15608

SEQ ID NO: 53810 - DNA, 201 bp, Homo sapiens
cagaatagcaaatacagcaccattatctggaatatttggagcagcccctcaatttctttttaaggtgcctgacttttatttaaaatttttcaacctcatcrtgatgctaatctttattgtcttcatatttagggtacatttctccataatatatactattgtctgcccaccagaaagcagatcttatccatagaccaagaa

SEQ ID NO: 53811 - DNA, 201 bp, Homo sapiens
agtttaaagttgtccacaagaatggttgaaataaagcaacatttcaggctttatcatgaagtcctctttcttcatagtaatgaagaaatcagtgattcacktggagtgttgtcttaggagaagtttggtttctttattagagttgaaaggttcatagacctcaatagtggggattaggacttcttgggatatacttgagag

SEQ ID NO: 53812 - DNA, 201 bp, Homo sapiens
ctctctcccttgctggcaagaaatgtgagcttgtgtcattgtgagaggctcctccccagagccctggcctgcatctgtatcactctggggcttagaggcartgggcctagtaatagacttgacttgggaagtggtgactttttcagcccatgtttgctcacaaccagtatcgagccagatagtgtaatgttttatacttaa

SEQ ID NO: 53813 - DNA, 201 bp, Homo sapiens
tttctcattttttcttgggtaattgggtgcatccctaggcagacatttaactgaatattctaatagctctacccacaaattgtgtcacaatttaaggcggrctcctttttgtaggcatttttgcgagcccttgtggactataccagtgacagtgctgaaaagcgcaggctacaggagctgtgcagtaaacaaggggcagcc

SEQ ID NO: 53814 - DNA, 201 bp, Homo sapiens
tagtacagttattcacagattaaccctgccactgatgttcagcctggctgtgtgaacagaaggacatctgccacatctaagcaggagcactaagcctgtgrgcgtggtgtagcttggctctcttcttcctatctgccatgatattctctccacatagaccctcaagtgaagcagtcccacagccttcgaggaagagagccc

SEQ ID NO: 53815 - DNA, 201 bp, Homo sapiens
gctgcaggcataaggatagggattatctattcaggtattgtacaattccagtattgtactcaaccactgagtgtacaattctaattctcagactttttcascttgacaaccttttagtgatccattatatattatatttcagaaaagagctcagacatttccttaagcatgggatcttaactcatctaaaggtttccttct

SEQ ID NO: 53816 - DNA, 201 bp, Homo sapiens
ctccccagtgtggttttcgtgtcgttttattaatgtgtttattgcatttctagtcttgggtgagtaaagtactttagagagaggctcagctctctaaatawatatatgtatatttatatatatatagatttatatatatatatattccatcttcctttcctggtaatcagctcgagatgtaatttgagtatttagaattaa

SEQ ID NO: 53817 - DNA, 201 bp, Homo sapiens
tgaatgaatcctttacatgaagatccttagggcatattagattttataaatatcatctagtcctagtgcaagcaaataaaattggaaactttcttgaatawcaaaatgtagggtgtgagagtgtgaaggttgggggcagtttttaattacgtaataatggctttcctctgtgaggatttggaaggtagattagagcctata

SEQ ID NO: 53818 - DNA, 201 bp, Homo sapiens
ttatttaggattgattaaacaaatttagaatatgccctttgcagtcttaaaaaatgtgatcttgatagcatgtttttaatattagttcccaagggtgtgtrctatcatcgtaactatcatctatgaatctttttatgttgtatttgcatttaaatttttgttttctattgaaatgagggcttaaatagggctttttcttag

SEQ ID NO: 53819 - DNA, 201 bp, Homo sapiens
atgaaatagtattattttagatattttatttacctagtctttgtgtccttaaatttaaactttattgtgcattaattatgtatttgggttctctaggtctyggtgattcagaatacacctacttttgcaatggggggaagataattgataaacgacttcaagagcttggagcccggcatttctatgacactggacatgcag

SEQ ID NO: 53820 - DNA, 201 bp, Homo sapiens
caaataaaattggaaactttcttgaataacaaaatgtagggtgtgagagtgtgaaggttgggggcagtttttaattacgtaataatggctttcctctgtgmggatttggaaggtagattagagcctataaggaaatatttctaaactgaataaaaggattggtttgacccatatgtgtagtagtactgatatcgagttcaa

SEQ ID NO: 53821 - DNA, 201 bp, Homo sapiens
tcatttttaggataaaggagctgtggtacggatcatttggggagcttgtctacagggttgcacttaggaaacacagattcaagcccaagtagtttcgagcsgatcatctgatttctgagccatggaattagagtttcattcgtacactctccttaatttgatgaattcttatttaggctcatttgagattagtgctgaaaa

SEQ ID NO: 53822 - DNA, 201 bp, Homo sapiens
aaaaatgtgatcttgatagcatgtttttaatattagttcccaagggtgtgtgctatcatcgtaactatcatctatgaatctttttatgttgtatttgcatktaaatttttgttttctattgaaatgagggcttaaatagggctttttcttagtctaaatagggctttttctttgtcttacttttactagttattaactacg

SEQ ID NO: 53823 - DNA, 201 bp, Homo sapiens; identical to SEQ ID NO: 15585

SEQ ID NO: 53824 - DNA, 201 bp, Homo sapiens; identical to SEQ ID NO: 15586

SEQ ID NO: 53825 - DNA, 201 bp, Homo sapiens; identical to SEQ ID NO: 15587

SEQ ID NO: 53826 - DNA, 201 bp, Homo sapiens
catagtagagtcttgtctgacacttcgcttcattcagcaaacacctgagtgctggctaagtgcttggggcatattcagatgtcgatagatacgaggatatrttagtttttctgttgaggaatacctgagactaaagaaaagagatttaatgggctcacggtttaggctgtagaggaaacatggtgccggcacctgcttctg

SEQ ID NO: 53827 - DNA, 201 bp, Homo sapiens
gtgctttacttgtcacatttgtgaaatgcacttggaagcattaatagcagtggtcagagggctcagaaggaaaccctggggcacttgaacattgatcgtcygtcagggaagcaggaacaaagtagacagaaggaacagccactgaagaagcaaaattgtcccaaagccaagagggtgctgtttcagagagggagcctgtac

SEQ ID NO: 53828 - DNA, 201 bp, Homo sapiens
tcggtggtcaaatacaggctggagttttagagatgcacctctaaatagtagaggcagagttcattgtacagatcacagatatctggtcattgagaacttgragaatatcttaaatgtccagactcctaaaacattattccagaaatagctcctcccaatcactggtgctttacttgtcacatttgtgaaatgcacttggaa

SEQ ID NO: 53829 - DNA, 201 bp, Homo sapiens
cattcctaggatttaacacattctctaagtcaggttcttttttttttcaactgtaatgtagaagacaaaatactggcatcgtgacccagaacatatggatraagataattgaaacaagtttcatgaaacaaagcaacgttttctgtttagtttttataacacattctgatcatttctcttccattttatttagtttgcttt

SEQ ID NO: 53830 - DNA, 201 bp, Homo sapiens
atctaaaggtttccttctcaagagatgctcctgttggggaggaggaagccccagcaaagtatgtgcaagacaacatccagcttcatggccagcaggtggcragaatcctcctccaggagaacggccatatttatgtgtgtgggtgagtcattatcgtgcctaagtcgggtaggagagggccatcagtgatgtctgtagaag

SEQ ID NO: 53831 - DNA, 201 bp, Homo sapiens
agctcagacatttccttaagcatgggatcttaactcatctaaaggtttccttctcaagagatgctcctgttggggaggaggaagccccagcaaagtatgtrcaagacaacatccagcttcatggccagcaggtggcgagaatcctcctccaggagaacggccatatttatgtgtgtgggtgagtcattatcgtgcctaagt

SEQ ID NO: 53832 - DNA, 201 bp, Homo sapiens
ttttttttccacttagagagaaactccaagaacaacacccagatggaaattttggagcaatgtggttgttttttggctgcaggcataaggatagggattayctattcaggtattgtacaattccagtattgtactcaaccactgagtgtacaattctaattctcagactttttcagcttgacaaccttttagtgatccatt

SEQ ID NO: 53833 - DNA, 201 bp, Homo sapiens
tccttcggacagttattttatttcgttttaattttttccttaagcaaaagcataatcacagatgtctctgtctcatcagtgtgttcaccatttcgtagacrctttacacattctgcctttaacagccctgagccacttttccatagtacaagttcatttattcataaaattgctattaatgttattgaatgtagagctctc

SEQ ID NO: 53834 - DNA, 201 bp, Homo sapiens
tagatactatttgtcagatagtagagtcctgtccttcggacagttattttatttcgttttaattttttccttaagcaaaagcataatcacagatgtctctstctcatcagtgtgttcaccatttcgtagacactttacacattctgcctttaacagccctgagccacttttccatagtacaagttcatttattcataaaat

SEQ ID NO: 53835 - DNA, 201 bp, Homo sapiens
tgatatgaaataagtaaaataaaattgtacttctgtttatatttgtgaagtaatgagcaagtcttagatactatttgtcagatagtagagtcctgtccttyggacagttattttatttcgttttaattttttccttaagcaaaagcataatcacagatgtctctgtctcatcagtgtgttcaccatttcgtagacacttta

SEQ ID NO: 53836 - DNA, 201 bp, Homo sapiens
tttctccccacaggcagtgtatggtaccctgaagtttttctaacctgcttaaaataagtttccagagcaggcagtctttgaatgcagggctaagccctctwtctgttgagtggctgtttggagttccacatggacttttcttacaaaaaccacacccttactgcagctattaccagttttaatttcttgttttttttaatg

SEQ ID NO: 53837 - DNA, 201 bp, Homo sapiens
agctttatttaggattgattaaacaaatttagaatatgccctttgcagtcttaaaaaatgtgatcttgatagcatgtttttaatattagttcccaagggtrtgtgctatcatcgtaactatcatctatgaatctttttatgttgtatttgcatttaaatttttgttttctattgaaatgagggcttaaatagggctttttc

SEQ ID NO: 53838 - DNA, 201 bp, Homo sapiens
tttgcagctcaagtttatttcacccaggaaagctccattttgtcttcaacattgtggaatttctgtctactgccacaacagaggttctgcggaagggagtrtgtacaggctggctggccttgttggttgcttcagttcttcagccaaacatacatgcatcccatgaagacagcgggaaagccctggctcctaaggtaagaa

SEQ ID NO: 53839 - DNA, 201 bp, Homo sapiens
ccacaacagaggttctgcggaagggagtatgtacaggctggctggccttgttggttgcttcagttcttcagccaaacatacatgcatcccatgaagacagygggaaagccctggctcctaaggtaagaaattagtaccttaacctcagcattgttaactcatactctttgtttcattagaaaaaacagtgttgtctcaccc

SEQ ID NO: 53840 - DNA, 201 bp, Homo sapiens
cagccaaacatacatgcatcccatgaagacagcgggaaagccctggctcctaaggtaagaaattagtaccttaacctcagcattgttaactcatactcttkgtttcattagaaaaaacagtgttgtctcacccacatcattcattactatcataagaaaatttatgctgttcttgaattttaaaatctctattgcaagagc

SEQ ID NO: 53841 - DNA, 201 bp, Homo sapiens
acactgggaaccacattttaacataaagatttggagagggcacacatccaaactggatcagaggataagtgagttacacttcctaccctcaaacaacttaytccctggtgagaaagctacatataaacagacgtttctaacgtcggaagtgttccagagaggactgcaagagcacccaggaggggtaccgcccccttcttg

SEQ ID NO: 53842 - DNA, 201 bp, Homo sapiens
gtaaggtggagttttttactgtattcattttggggaatttttttggctgaataaacattgccacaagtcatgttgcactttgatgcgctgtaaagtactamagtaattgtgttttggggagtgtgtaaaacattttattcttcatcttctatgtcatgaacccctttcccgtctttacctgaaaaggagctaccttacccc

SEQ ID NO: 53843 - DNA, 201 bp, Homo sapiens
aatactgagtagccaggaagttttgtaagcccctgtggatcttgcgtagtcactaattgaaagaagggtataattgaaaattgcacttacgttttgtcacrtttgtttttcaaggaggaaagccaagtatctgtgacttcagcagatccagtttttcaagtgccaatttcaaaggcagttcaacttactacgaatgatgcc

SEQ ID NO: 53844 - DNA, 201 bp, Homo sapiens
ttgcatttaaatttttgttttctattgaaatgagggcttaaatagggctttttcttagtctaaatagggctttttctttgtcttacttttactagttattractacgtagcacattccacagtgatggaggtgactgcagttgaccttgtgttacccagctacacattgctgctccttctttaattggtgacagaaagcta

SEQ ID NO: 53845 - DNA, 201 bp, Homo sapiens
gttcctacaacataggtatgttctttttttggctaatgggaaaatgtattcctgagtaaccgtttttgtttctttagtcattttgaggataattggacttygtaaaatttttatttaaaaaattattattcaatgtgcgataacataatttgtcaccatgggaaaagtaaacacaatgttgtagagattgtgctttgtact

SEQ ID NO: 53846 - DNA, 201 bp, Homo sapiens
ccaggaaccggcatagccccgtttattgggttcctacaacataggtatgttctttttttggctaatgggaaaatgtattcctgagtaaccgtttttgtttytttagtcattttgaggataattggactttgtaaaatttttatttaaaaaattattattcaatgtgcgataacataatttgtcaccatgggaaaagtaaac

SEQ ID NO: 53847 - DNA, 201 bp, Homo sapiens
cgtcattacttcctacagtcgtccttgagttaaaagttaaaatgtatacagttacaccaccatgcaaggtggaggggaatcctgtcattcttaaatcttgrtatcagtatgacttttgcatatgacagtgaaactggaagtgaaacatactcagattgattcagaaatatcttttgaaattttaacaaaaagattttgata

SEQ ID NO: 53848 - DNA, 201 bp, Homo sapiens
gatatgaaggatataatttaaaactatctgaaattacctgtgcttgtgttgtgttttattacaaattatacagaatgttgacttttgcaagacctatcacmcaccctgccctactatggcggatagtacagttattcacagattaaccctgccactgatgttcagcctggctgtgtgaacagaaggacatctgccacatct

SEQ ID NO: 53849 - DNA, 201 bp, Homo sapiens
ttgactggatggcattcattaagtgaacatgaatgaagaagtttcaataatgatttgggtggaaaataattgaaatgagtgaatagcacgttttccagctktctaaataaagcagaggcatttggtggcaaataattgagtttcccaaatggttccattaacgcagaaatctgacgaggtgaaaatttttctgtttggcaa

SEQ ID NO: 53850 - DNA, 201 bp, Homo sapiens
aacagtttaaagttgtccacaagaatggttgaaataaagcaacatttcaggctttatcatgaagtcctctttcttcatagtaatgaagaaatcagtgattsacttggagtgttgtcttaggagaagtttggtttctttattagagttgaaaggttcatagacctcaatagtggggattaggacttcttgggatatacttga

SEQ ID NO: 53851 - DNA, 201 bp, Homo sapiens
cctaaggtaagaaattagtaccttaacctcagcattgttaactcatactctttgtttcattagaaaaaacagtgttgtctcacccacatcattcattactrtcataagaaaatttatgctgttcttgaattttaaaatctctattgcaagagcagaaaactgtttacttccatgtactctttaactagtgtgtgtattttc

SEQ ID NO: 53852 - DNA, 201 bp, Homo sapiens
gccttcattccattgcacagcctctaccgttttcccgtctggctctctgttttgcctttcagtaataatacaagaaggtgcaccattcttttggttgaaargggaattaagaatgaactcaagttctttcgcattatttaccgtgtaatgtgaaaagaaatctacttttgtagggatgtcttttaaagatgtttttacttt

SEQ ID NO: 53853 - DNA, 201 bp, Homo sapiens
ctctcaggaagggattgaaaatgcttgctaggggtgaagactaagcgctttataggacttcaaagcctttattactttcttgtgcttgtaactttgtcatstcctttcccatagtggtaagtagttatgcctttaacatttgcatttttctttggtgacaccaaaatgtatattgtcctttttactcttgggccagcaaga

SEQ ID NO: 53854 - DNA, 201 bp, Homo sapiens
gggcttttgtaaaaaatgtgtcatggtgcccaaaatatatgaacgcctccaagactctcctaagctcctcgttagtgaaatgtgggacatgcctcacgacrtatttgcccaattttataatcagaggaaatgcttgactttgatcaagaaccaccagggcagtgagcatttggctaatcaatttaggactcaggttggaaa

SEQ ID NO: 53855 - DNA, 201 bp, Homo sapiens
atttaaactttattgtgcattaattatgtatttgggttctctaggtctcggtgattcagaatacacctacttttgcaatggggggaagataattgataaaygacttcaagagcttggagcccggcatttctatgacactggacatgcagatgactgtgtagggtaagggcagtgttctctgtttactccaataagccctct

SEQ ID NO: 53856 - DNA, 201 bp, Homo sapiens
tgtgtcacaatttaaggcgggctcctttttgtaggcatttttgcgagcccttgtggactataccagtgacagtgctgaaaagcgcaggctacaggagctgygcagtaaacaaggggcagccgattatagccgctttgtacgagatgcctgtgcctgcttgttggatctcctcctcgctttcccttcttgccagccaccact

SEQ ID NO: 53857 - DNA, 201 bp, Homo sapiens
atatgcttagctttatttaggattgattaaacaaatttagaatatgccctttgcagtcttaaaaaatgtgatcttgatagcatgtttttaatattagttcscaagggtgtgtgctatcatcgtaactatcatctatgaatctttttatgttgtatttgcatttaaatttttgttttctattgaaatgagggcttaaatagg

SEQ ID NO: 53858 - DNA, 201 bp, Homo sapiens
gtatctttgcagctcaagtttatttcacccaggaaagctccattttgtcttcaacattgtggaatttctgtctactgccacaacagaggttctgcggaagrgagtatgtacaggctggctggccttgttggttgcttcagttcttcagccaaacatacatgcatcccatgaagacagcgggaaagccctggctcctaaggt

SEQ ID NO: 53859 - DNA, 201 bp, Homo sapiens
tgggcgtcgtgggcctccgtagcaaacgcggggcgggagcacgactcagggcggcgcaatgtgattggcccaggtccccttcggagctttctattggtccygggtaccgagcatgggcgctgcgtcagtgcgcgctggcgcaaggttggtggaagtcgcgttgtgcaggttcgtgcccggctggcgcggcgtgggtaagct

SEQ ID NO: 53860 - DNA, 201 bp, Homo sapiens
cttctttaattggtgacagaaagctaatgagagcgtaggattccccccaaccaccacttgccacttcctacagttgttaagatctactttgtgtaatactmcataactatttattgctgtaacagaaagcttcaggaaaaatggaagggttttggtaggtaataatcaattattatgtgaacttggaggtagaataatcca

SEQ ID NO: 53861 - DNA, 201 bp, Homo sapiens
tgccctaacagtgattctgaggtacaaagcctactccaaagactgcagcttgaagataaaagagagcactgcgtccttttgaaaataaaggcagacacaargaagaaaggtaacagccctgatgctgtgacgttggggtgttgtgggccagtggactggagctgatggtgagagtgtggctctaaggttcagggtcctgtg

SEQ ID NO: 53862 - DNA, 201 bp, Homo sapiens
gaattgagcttctcttctgaaaagctagctccatatatctgccctcattcatttaccttggaaatgaatactgagtagccaggaagttttgtaagcccctrtggatcttgcgtagtcactaattgaaagaagggtataattgaaaattgcacttacgttttgtcacatttgtttttcaaggaggaaagccaagtatctgtg

SEQ ID NO: 53863 - DNA, 201 bp, Homo sapiens
taaatcaagaatctgtatatttcaggatggaaagagttttaatggatactatggatacaccattatttgttgatgtaattatgggcaattgagtcattttygctttttcactattaaaaaaggcaaacttccttgtactgtattaatttttgaacacttacttgaagtatatttgtaaaacaaattccttggagtagaatt

SEQ ID NO: 53864 - DNA, 201 bp, Homo sapiens
tcctgtgaccatctacacacatgttgcattcttaaacatctgtcacattcttcaagatctctccttcctgaaacatttgcagacattctgtttcccttgaygtagtttattaggaaaactactagatctttacatgaacatgccagtatttttattttctatttgtatttcagaaattctaatgtctaatagataaagcgt

SEQ ID NO: 53865 - DNA, 201 bp, Homo sapiens
aaggaggtgtgggcaggggtaaggtgtgacctaagaatgctgaagtgtttctttcaggtggcagaggtagtcattgtcagcactgccatagcctttgcagraggcagtcttcttaggggtacatctcagtacccccacattatggctcccagacacccagaactgaccttcatcccagctttcccatatagccacttatcc

SEQ ID NO: 53866 - DNA, 201 bp, Homo sapiens
ttttatttcgttttaattttttccttaagcaaaagcataatcacagatgtctctgtctcatcagtgtgttcaccatttcgtagacactttacacattctgsctttaacagccctgagccacttttccatagtacaagttcatttattcataaaattgctattaatgttattgaatgtagagctctctctagatctcacagt

SEQ ID NO: 53867 - DNA, 201 bp, Homo sapiens
cttcagagttgtcctgagttggaacgaagaggctggacctttgtagtctttgatgagacattggatgtgggttgcctctgaaaggaggtgtgggcaggggyaaggtgtgacctaagaatgctgaagtgtttctttcaggtggcagaggtagtcattgtcagcactgccatagcctttgcagaaggcagtcttcttaggggt

SEQ ID NO: 53868 - DNA, 201 bp, Homo sapiens
ggctttctctgccttcactgtcatgggctgcatgagatgactgtgtctttctaagctcctgaggatgtcccctggcttagttctattttagttttacttasttcttaattggtgatttgtcctttaagctttttgcattttttttcaagtgcgagtgaattttagcagtagccccccaagtcccaccagtcttctcttctg

SEQ ID NO: 53869 - DNA, 201 bp, Homo sapiens
catgtgccttgctgtcatagatgagctatgctgatgctttgggtccctgggtaacaacattcatttgaaccccctcttaacagaccctggaatgtttgcayattccccttagcccagtgtacatttcccctttgggagaaggactgcagaagccattgtcaagtacagtttctatagtgtctcacagtccctcctcctagg

SEQ ID NO: 53870 - DNA, 201 bp, Homo sapiens
ctcccaggtatggaatgtgctacccacagatcctgaagagacttagcagtggttctgcttctctctagaagtgaggtacaaggtgcactagtgtggccttyacttgggaggggatgtcctgacgtgcaccaaactgttagaaccctaaaaattgtgctggcactgcaggccctttaattgcatagggcatgggtcttacca

SEQ ID NO: 53871 - DNA, 201 bp, Homo sapiens; identical to SEQ ID NO: 15604

SEQ ID NO: 53872 - DNA, 201 bp, Homo sapiens
ttctctgacacctaggaaatccttggcctactgtcgggacctggagcctgtggaggattgggagctgtagaaccgtgtggtcagctctgtctcctagaacrgtcactgtaggcaaaggcctggcctgggcatgagtgaggctgggagatctgtgtgagatgttctgagaagacggagggaagaactatggtggtacagtca

SEQ ID NO: 53873 - DNA, 201 bp, Homo sapiens
tacttttttccaactgtcagaatttataaccaactcaccttgcagccgttgaaggaaaagaggcttgaatatttttgccagaaagttgactggatggcatycattaagtgaacatgaatgaagaagtttcaataatgatttgggtggaaaataattgaaatgagtgaatagcacgttttccagctttctaaataaagcaga

SEQ ID NO: 53874 - DNA, 201 bp, Homo sapiens
ggcaagagagggagcaagaggcagggggaggtgccacacactcaaatagccagatctctcaggaactcagagggagaactcactcattacagcgagcatarcatcaagccattcatgaggcatctgcccccatgacccagacgcctcccaccaagccccacttctaacactgggaaccacattttaacataaagatttgga

SEQ ID NO: 53875 - DNA, 201 bp, Homo sapiens
tctttttaaggtgcctgacttttatttaaaatttttcaacctcatcgtgatgctaatctttattgtcttcatatttagggtacatttctccataatatatrctattgtctgcccaccagaaagcagatcttatccatagaccaagaaacatgatttgattatctatttagagttctacctcaaagacaccatgcctatcat

SEQ ID NO: 53876 - DNA, 201 bp, Homo sapiens
ctcaccctcttcagtgaagtcttcgagaaccatcagcaggaataggatgacagaacacagggtggggagttctaagtagtattagaaagttctcttatcgyatactaatttatttcaattcttttcgtagattttttgttaccttttagaatgttagaatgtttgtaacaataccacattacgtagttatataaaaaaatt

SEQ ID NO: 53877 - DNA, 201 bp, Homo sapiens
cgatgcccagtacaattaaaggcacccttctttgcaagtcagggcctgatttctcctcctttttcttagtgttttttccacttaggacctccccaaaatgstaagaccgtgttgctgaatgaggctgctcttctcaccatcctgtcctcaggctggccctctcaccctcttcagtgaagtcttcgagaaccatcagcagga

SEQ ID NO: 53878 - DNA, 201 bp, Homo sapiens
acctttctgtagtaaagaaaatttgctgctcttgtcttaccctttgtatcctatgcctaaagaatatatctaaatgaatggtggtgattggtaagtaaacrtcttatatcttgtcttcagggtgctgtgacatctgtgtgcccttccagaagtcacagaattccccttccagacttttggttttcttttttttccttccag

SEQ ID NO: 53879 - DNA, 201 bp, Homo sapiens
tactatagtatactattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctcttgagtagcattttaa

SEQ ID NO: 53880 - DNA, 201 bp, Homo sapiens
ctatagtatactattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctcttgagtagcattttaatt

SEQ ID NO: 53881 - DNA, 201 bp, Homo sapiens
tatagtatactattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctcttgagtagcattttaatta

SEQ ID NO: 53882 - DNA, 201 bp, Homo sapiens
atagtatactattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctcttgagtagcattttaattaa

SEQ ID NO: 53883 - DNA, 201 bp, Homo sapiens
tctctagaatacagacttttcctatcagcctggagatgccttcagcgtgatctgccctaacagtgattctgaggtacaaagcctactccaaagactgcagsttgaagataaaagagagcactgcgtccttttgaaaataaaggcagacacaaggaagaaaggtaacagccctgatgctgtgacgttggggtgttgtgggcc

SEQ ID NO: 53884 - DNA, 201 bp, Homo sapiens
atactattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctcttgagtagcattttaattaaggatg

SEQ ID NO: 53885 - DNA, 201 bp, Homo sapiens
actattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctcttgagtagcattttaattaaggatgca

SEQ ID NO: 53886 - DNA, 201 bp, Homo sapiens
ctattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctcttgagtagcattttaattaaggatgcac

SEQ ID NO: 53887 - DNA, 201 bp, Homo sapiens
tattttgtttcattatatctgctacttttatattgtaaaatagaagaaaactgcctacatgcatagaattactcaaggaaaataaaatgtgaagctctgcattattactccatccataagagcatgaaatagtattattttagatattttatttacctagtctttgtgtccttaaatttaaactttattgtgcattaatta

SEQ ID NO: 53888 - DNA, 201 bp, Homo sapiens
ctgttcgagtcaatgttaggcctaagcgtggaaccactcatttctcacccttttgtagagaaagaacatggagatgcctgcacaactgagggatttaagctttttttttttttttttttttacaccatgagacatagaagcaattcttgatttccccaacacagaaacataccacattgttaattgtggttatttatatgg

SEQ ID NO: 53889 - DNA, 201 bp, Homo sapiens
tacctttctgccatgtggaagtattacctctaataaccagagggtcttctgggttgtgtggtagagcggcaggacctgttaacgagcactgtcacttggayctgctgtagagccctctcctgctctgggccccacgcaaagctggtggccttttctgtcacctggtatttgggtctcagcagtcctcccaggtatggaatg

SEQ ID NO: 53890 - DNA, 201 bp, Homo sapiens
ctcaacgctgctgttatgaataatatgtacacaagtggacttgactgtcttttaataaaactttatttacaaagaaaggcagtgcatggtatttgtcccaraagctatggttggctgacccctgctcagtatcagaaaaaatgtacagatgacagatattgtggttttgcaacctgtctgatccttgttttaagatttcta

SEQ ID NO: 53891 - DNA, 201 bp, Homo sapiens
aacaaaggcctcagtcagctcctctccatatggtacctttctgccatgtggaagtattacctctaataaccagagggtcttctgggttgtgtggtagagcrgcaggacctgttaacgagcactgtcacttggatctgctgtagagccctctcctgctctgggccccacgcaaagctggtggccttttctgtcacctggtat

SEQ ID NO: 53892 - DNA, 201 bp, Homo sapiens
tatatatatatatatatatatatatatatatatatatatatatgggtttttttcaaaaatagtatgctcattggaaaaattctggatacagaaataacccrggaaaccaaagtattttataatcaaaccctctgagttaacacttgaattttgttttcctgaggaaaatatgggtatccatattatatgtgctgttccata

SEQ ID NO: 53893 - DNA, 201 bp, Homo sapiens; identical to SEQ ID NO: 15596

SEQ ID NO: 53894 - DNA, 201 bp, Homo sapiens; identical to SEQ ID NO: 15598

SEQ ID NO: 53895 - DNA, 201 bp, Homo sapiens
ctttgagtcctcacttacccgttcggtacccccactctcacaagcctctctgaatattcctggtttacccccagaatatttacaggtacatctgcaggagwctcttggccaggtaaggaagtttttctttatgctatagatgctatttaatcatggatgtttgctttgggcttttaaattattattacattagaagagagg

SEQ ID NO: 53896 - DNA, 201 bp, Homo sapiens
tatcttcttaaaataaagtttaccaattctggaatattaggaggaattctattcctgtcatcctattactagaatatcttcctatccctcttcatttcttytacctttatacatactcatgttttcagctacggtgctaatgaacacataatatatcctgcttgttaaaacttaatcatgaagtattttttgtattccgaa

SEQ ID NO: 53897 - DNA, 201 bp, Homo sapiens
accatattcgtgtgcaaggtactactatttattcacgtaatatatagcattgtttctccaaaatcttagactcaggcttccagatcattagagtttactartttattcagtgaaaacttacctgctttatggaagacagtaccaggcataataaagcagaagaagaatcatagagctcctgtcctctgggacttcatagaa

SEQ ID NO: 53898 - DNA, 201 bp, Homo sapiens
gcattaatccatagtgatttcttggtgatattttaatctgtaggaaacagatcagtagatcagtaaattggctaggcaaaaaaaaaaaaaaaaaaggtgcwtttgatggatggaatgagcatttgcagcattatggtagccttggattttggttaagttctgttagcattagtatgcctatttaaaattatatcttcttaa

SEQ ID NO: 53899 - DNA, 201 bp, Homo sapiens
acttgagtccaatacctgggttcaaatccttgatcccccacttactgactgagatcttggttgaattagttaagctttttgttccttggtttttgcctctrtgcaatagataacagtaatctatttactgtgtaagcttcgtaggagggtcaaacggattaatacatgtcgtcctcttagaagagtgcctgtcgtcatgta

SEQ ID NO: 53900 - DNA, 201 bp, Homo sapiens
accagatgacccctcaatccccatcataatggtgggtccaggaaccggcatagccccgtttattgggttcctacaacataggtatgttctttttttggctratgggaaaatgtattcctgagtaaccgtttttgtttctttagtcattttgaggataattggactttgtaaaatttttatttaaaaaattattattcaatg

SEQ ID NO: 53901 - DNA, 201 bp, Homo sapiens
ttatgtgaacttggaggtagaataatccactagatgtcagtattgtaccaggaactgtttttttaaaactacttgtaactgatttcttctaaccagctccyggaagtggccattaatggataaaatttttcaaatgtgccttgccacacttgtattgtcagtgagcataaagagtgttgtaattaggccgccatctcccca

SEQ ID NO: 53902 - DNA, 201 bp, Homo sapiens
tatgaatctttttatgttgtatttgcatttaaatttttgttttctattgaaatgagggcttaaatagggctttttcttagtctaaatagggctttttcttwgtcttacttttactagttattaactacgtagcacattccacagtgatggaggtgactgcagttgaccttgtgttacccagctacacattgctgctccttc

SEQ ID NO: 53903 - DNA, 201 bp, Homo sapiens
tgtagaaccgtgtggtcagctctgtctcctagaacggtcactgtaggcaaaggcctggcctgggcatgagtgaggctgggagatctgtgtgagatgttctsagaagacggagggaagaactatggtggtacagtcaaaaggaattagacttgtgaattaaggaggatttactaaaaatgcctgtttgtaagcagtcatctt

SEQ ID NO: 53904 - DNA, 201 bp, Homo sapiens
tgccacatttaaaaaatctatttatgatgaattcaactttcccaaaggagggttgctttttttttctcctgttgtcagcctccctgggaattttactaaartaaaaaaataaataaaggctttaactatttatttagtccaaggacttggcattaatccatagtgatttcttggtgatattttaatctgtaggaaacagat

SEQ ID NO: 53905 - DNA, 201 bp, Homo sapiens
tgtcaggatgtgcagaaagagttgtgtggtgcttggttatatatgctgagtggtgtgctgcttggttacatatgctgagttgtgtgcggcttggttacatrtgctgagttgtgtggtgcttggttacatatgctgagttgtgtggtgcttggttacatatgctgagttgtgtggtgcttggttacatatgctgagttgtgt

SEQ ID NO: 53906 - DNA, 201 bp, Homo sapiens
ttttctgagttcacatattaaaatcataatattgaaaactatatttttgttaccctacagcttaaactatgtaacacgtataatgtatttttttttttttcattttggctcttctctagaatacagacttttcctatcagcctggagatgccttcagcgtgatctgccctaacagtgattctgaggtacaaagcctactcc

SEQ ID NO: 53907 - DNA, 201 bp, Homo sapiens
taattttcctttcttttatttggcctatcttgaatttatagtcttcttatgtttttgtaaggtggagttttttactgtattcattttggggaatttttttggctgaataaacattgccacaagtcatgttgcactttgatgcgctgtaaagtactacagtaattgtgttttggggagtgtgtaaaacattttattcttcat

SEQ ID NO: 53908 - DNA, 201 bp, Homo sapiens
gatgtcagtattgtaccaggaactgtttttttaaaactacttgtaactgatttcttctaaccagctcccggaagtggccattaatggataaaatttttcaratgtgccttgccacacttgtattgtcagtgagcataaagagtgttgtaattaggccgccatctccccagtgtggttttcgtgtcgttttattaatgtgtt

SEQ ID NO: 53909 - DNA, 201 bp, Homo sapiens
taaacttgttttcacaaaggctcctcagggcagctctaatgtgtaaccacattttgagtagtgtaccacatgagcacctcccgagcacagtgaaatgacarcctgagtcataatgacacacgggcctgaaatctgcctcctcttggtattcatttcgctttaggaattagaatttaattgatcctcctttgagctgtgatt

SEQ ID NO: 53910 - DNA, 201 bp, Homo sapiens
gccggaggcaggggagacagaaaagttccactataaaacatttgatgagtccgggcgtggtgactcactcctgtaatcccagcactttgggaggccgaggygggcggatcatgaggtcaggagatcaagaccatcctggctaacacggtgaaaccccgtctctactaaaaatacaaaaaattagccgggcgtggtggcagg

SEQ ID NO: 53911 - DNA, 201 bp, Homo sapiens
agacagtctcattttatgtttaagatgtatactgcctctcaaataagtagttttacattgggagtctgagggcaactaaagattaattttatattgtccarttttggctagtagggtccccgcatccctgtttttctgcttttgttatctgtggtgtctgacatctgaacttgtgccattattgagaagacatatggctgt

SEQ ID NO: 53912 - DNA, 201 bp, Homo sapiens
tgaacccgggaggcggagcttgcagtgagccaagatcgagccactgcactccagcctgggcgacagtgataccctgtctcaaaaaaataaaaaaaaagaayatttgatgagcactggcttataggattctccctgtggccttcattccattgcacagcctctaccgttttcccgtctggctctctgttttgcctttcagta

SEQ ID NO: 53913 - DNA, 201 bp, Homo sapiens
agtgtggctctaaggttcagggtcctgtgtgttggccgcacagatgcctggggctcagctgcgcatcaaggtccgggaacacaggcatacgctggtattgstagtttcttaactttcatgttaattgcactgaataagaagataatggatgttctaattattggacatttgtggacatgaaaactgagtgtaaatgtagtt

SEQ ID NO: 53914 - DNA, 201 bp, Homo sapiens
gattttcaacctaactaccttacttgaatttttcctttttctgaaatgaagatattttcaagacattcttgcttgatgtgccaccacactaaatggggttrcgaatgcacacttgagtccaatacctgggttcaaatccttgatcccccacttactgactgagatcttggttgaattagttaagctttttgttccttggtt

SEQ ID NO: 53915 - DNA, 201 bp, Homo sapiens
cctttaacatttgcatttttctttggtgacaccaaaatgtatattgtcctttttactcttgggccagcaagatccttttcgatgcccagtacaattaaagrcacccttctttgcaagtcagggcctgatttctcctcctttttcttagtgttttttccacttaggacctccccaaaatggtaagaccgtgttgctgaatga

SEQ ID NO: 53916 - DNA, 201 bp, Homo sapiens
aatgtaatgcttgtgtcatccattaggcccatcactcatccatatttcacttctcttcaaaggctttcattttctctgttgatttattggtgtaagtattraaatgcttgactgtatatttcagtagactatagtgcttagattttcaacctaactaccttacttgaatttttcctttttctgaaatgaagatattttcaa

SEQ ID NO: 53917 - DNA, 201 bp, Homo sapiens; identical to SEQ ID NO: 15595

SEQ ID NO: 53918 - DNA, 201 bp, Homo sapiens
actgaataatctgtttatgagaaaattacaaattcagcaaatgtcttgcttttcggcatactgtatttctgctgaactcacccctgtgcccacttcttccrtctttcccttcagctctgatgccatgggttttttccatatcgccagcacacatattcttcctgattgtgacaaagctttgtgacatttccttgggaattc

SEQ ID NO: 53919 - DNA, 201 bp, Homo sapiens
gccaggcagagaaccatcatcccatttcagatgaagagtaacccatttttttgcccagagtgactcttctagtcctcatactccaacagaagagacctcarcattgtccctgagcagtcgatgtcctaggacctctctgtggctctcaggaagggattgaaaatgcttgctaggggtgaagactaagcgctttataggact

SEQ ID NO: 53920 - DNA, 201 bp, Homo sapiens
tgttaatttaattttcactcactatgttactgaataatctgtttatgagaaaattacaaattcagcaaatgtcttgcttttcggcatactgtatttctgcygaactcacccctgtgcccacttcttccgtctttcccttcagctctgatgccatgggttttttccatatcgccagcacacatattcttcctgattgtgaca

SEQ ID NO: 53921 - DNA, 201 bp, Homo sapiens
agggagcctggtgagccacacttcgctgttagagaacacaggtctgtgggccttcgctgcaggctgcattgcttggcgtgctcttaccgtctgaacggccrtttgccaccatgccaatcagacgtttacagacgcatactttatcttttcattacttttatttttgtttttacaagtcagtatttcacccattgtgccacc

SEQ ID NO: 53922 - DNA, 201 bp, Homo sapiens; identical to SEQ ID NO: 15603

SEQ ID NO: 53923 - DNA, 201 bp, Homo sapiens
catttttcagtttcactgttacatgccttgaagtgatgaggaggtttctgttactatatgctacacagcagggacaggcaaaggccatcgcagaagaaatrtgtgagcaagctgtggtacatggattttctgcagatcttcactgtattagtgaatccgataaggttagagccgttacagtggattttaccgttttgtgct

SEQ ID NO: 53924 - DNA, 201 bp, Homo sapiens
tattgtttattcactcattcagataacttatcgagtaccagtttcatgccaggtgccgttctgggcggttcattcaccgaaagccaagcttttggtttggrtttcagtttaaatctgtctctgcaaattgacagcccaccaattttagccgttagatgagtatggaaaaaaatctgtgagtgtcgtttgttttactactgc

SEQ ID NO: 53925 - DNA, 201 bp, Homo sapiens
gtagtgttttcatattgtttattcactcattcagataacttatcgagtaccagtttcatgccaggtgccgttctgggcggttcattcaccgaaagccaagmttttggtttgggtttcagtttaaatctgtctctgcaaattgacagcccaccaattttagccgttagatgagtatggaaaaaaatctgtgagtgtcgtttg

SEQ ID NO: 53926 - DNA, 201 bp, Homo sapiens; identical to SEQ ID NO: 15607

SEQ ID NO: 53927 - DNA, 201 bp, Homo sapiens
aaaagaaaagaaatagaacccagacaggcaggttagggttaattcctcagagcagtggttttgatttcttgagaatctggaaaaaattatggactctcccraaaaatgattacacttgtcccttagtatcttcgaaggatttgtcccaggacccctttcagatacccaaatcctcaaagctcaagtcccttatgtaaaatg

SEQ ID NO: 53928 - DNA, 201 bp, Homo sapiens
tcttttttcccccatttttcagtttcactgttacatgccttgaagtgatgaggaggtttctgttactatatgctacacagcagggacaggcaaaggccatygcagaagaaatatgtgagcaagctgtggtacatggattttctgcagatcttcactgtattagtgaatccgataaggttagagccgttacagtggatttta

SEQ ID NO: 53929 - DNA, 201 bp, Homo sapiens
tgctattttgtttctcttgttctatcttggtgtttagggaggaggatggcgtcaaattcagagacttcttcttggccctccccatgatgatagatcttaaygtcataggccaataattcggtgttgccctgtgccagctgctgagtggccactggaggtcctgggccaggacgccatttaccgcctggcccccatgtgcct

SEQ ID NO: 53930 - DNA, 201 bp, Homo sapiens
atccccagaattgcaagcagtatccatctctctgacattcatgaagacgccctggcgggagggagtgggagagatttgcccagggactgagtgggtgtgtrctcgtgcttctgagtttggcatgagaccaccagtggcgccggtcaggccagggaggcctagtcttgcatcacactctccgcctaggctaggcaagtggtg

SEQ ID NO: 53931 - DNA, 201 bp, Homo sapiens
tttttttttttaatttatgagacgagtctctctgttgcccagactagaatgcagtggcatgatctcggcaacccctgcctcctgggttcaagctattctcrtgcctcagcctccctagtagctgggactacaggtgcccaccaccacaccaggctgattttttgtatttttggtagagatgaggtctcaccatgttggcca

SEQ ID NO: 53932 - DNA, 201 bp, Homo sapiens
agcaagactgtgtcaaaaaaaaaaaattcaataatcaagatccataatgcagttttttgttgttgttggtttgttttttttaagagacagagttttgctaygttgcccaggctggacttgaacttctgggctcaagcaatctttctccctcagcctcccaaatagctgggaatataggcatgtgccatcatacctggctat

SEQ ID NO: 53933 - DNA, 201 bp, Homo sapiens
acaccaaaactttttttttttttttttaatttatgagacgagtctctctgttgcccagactagaatgcagtggcatgatctcggcaacccctgcctcctgrgttcaagctattctcatgcctcagcctccctagtagctgggactacaggtgcccaccaccacaccaggctgattttttgtatttttggtagagatgaggt

SEQ ID NO: 53934 - DNA, 201 bp, Homo sapiens
tcaggtctggggccagcagggcagaaccccctagaaccctgacttgctccaaagtcagacttgctccagagtctgtggccgccaccatcaccaccaccacrgagctgacttcctgggtttctctttcactttgacttgccttagggatgggctgtgacactttactttttttcttttttcttttttttcagtcttttctcc

SEQ ID NO: 53935 - DNA, 201 bp, Homo sapiens
tgaatcctccctctttctgcccacactgccccacctccctcgcgttctgcagccgcctccccctgatccccactgcggtctgagccgaggtgtgggggggsgctcctgaaatcccaccccagccctggcgattagcgggtagtccagattctccccatggccaccaggtggcaacagcggcgcgcgtttccccggccgggc

SEQ ID NO: 53936 - DNA, 201 bp, Homo sapiens
tgcgcctacccctcctctgtgccctcccttttaggtcctggtgggttcaaacctgcagggaaggcacacagcgggtgtctaaggcccagagaggtgttgcygcttactcaatgtcatacagaggtagggacagggtgaggttcggagcctctcacccatatgggtctggaacctcttgctggcatcctgagctcagttcca

SEQ ID NO: 53937 - DNA, 201 bp, Homo sapiens; identical to SEQ ID NO: 15647

SEQ ID NO: 53938 - DNA, 201 bp, Homo sapiens
agcttcctctcacactccaggagccttgcccatgcaggcccttccctgcctcctgcctggaatgtttgttttccacacggtccaactcctattcgtccttsaaaactcagctcaaaagttccctcctccagcaagacttctctgcctccttctggccatgcccttgtttacaactgtcccttctccctggtctgacactgc

SEQ ID NO: 53939 - DNA, 201 bp, Homo sapiens
tgcttattgagtgactgactggactgactgaatgaatgaatgcagtttttctgtggttaacacacacacacacacacacacgcacacacacaagtatatawatatatatatttgtgtttttttgttttttgtttttgagacaaaagtccagctctgttggccaggctgaagtgcagtggagcaatctcggctcactgcaac

SEQ ID NO: 53940 - DNA, 201 bp, Homo sapiens
taatgaatctcacatcccaaggtgtttgttaaatattcaaccgcgccagggaaggtggcagttcgcgagatgctggtggcaaattaatgagcagtctttarggaaaggggggccgtgaggctcaggtggcctctcactctcccgcttcctgctctgggccttgccagagccccagaaagcctcagcctcagcctgttcctt

SEQ ID NO: 53941 - DNA, 201 bp, Homo sapiens
gcccaccaccatgccgggctaattttttgtatttttagtagagacggggtttcaccgtgttagccaggatggtctcaatctcctgacctcatgatctaccygtctcggcctcccaaagtgctgggattagaggcgtgagcccccgtgcccggcctctcaaattccttttctaaggaaaaattttctgcttgaggtaactgg

SEQ ID NO: 53942 - DNA, 201 bp, Homo sapiens
caggagaatcgcttgaacccagaaggcagagattgcagtgagccgagatcgcaccagtgcactccagcctaggtaatagagtgagacttcgtctcaaaaarcaaacgaacaaacaaacaaacaaaaaaccttaggcaacatgagattacaggtggcagttatccctggggatgcaaattgtgttaatttttcttccttcag

SEQ ID NO: 53943 - DNA, 201 bp, Homo sapiens
ctgtcttgctctgtcaccctggctggagtgcagtggtgtgatcttggctcactgcaacctccgcctcacgggttcaagcgattctcctgcctcagcctccwgagtagctgggatttacaggcatgcaccaccacgcccagctaattttgtatttttagtagagatggggtttcgccatgtttgcccggctggtctcgaact

SEQ ID NO: 53944 - DNA, 201 bp, Homo sapiens
ctggacaattcttacggcctgatgttcgacctgcctctccccagagtcctgcctctgccccctggagatgaatgtggcccaggaattccagctccgacgayggcagctggggagccaaggaagttcctggagcaagtggagcagccccgtgtgcgttccccctggtaagatcactctgagtacaggaacaggggcaagcat

SEQ ID NO: 53945 - DNA, 201 bp, Homo sapiens
agtagctgggactacaggtgtctgcaaccacgcccggttaattttttgtattttttagtagagacggggtttcaccatgttagccaggatggtctcaatckcctgacctcgtgatctgccctcctcggcctcccaaagtgctgggattacaggcgtgagccaccgcgcccggcctactgctattttttgttttgttttgag

SEQ ID NO: 53946 - DNA, 201 bp, Homo sapiens
ctcagaaggctgaggcgggaggatcacttgaggccagtggtttgagaccagcccgggcaacatagtgagaccccatctctaaaaaataaaataaaatgggkctgggcgtggtggctgatgcctgtaatcccagcactttgggaggctgaggcgggcagatcacttgaggtcaggagttcgagaccagcctggccaacatgg

SEQ ID NO: 53947 - DNA, 201 bp, Homo sapiens
gacggggtttcgccatgtgggccaggctggtctcaaactcctcaggtgatccgcccaccttggccttccaaagtgctgggaatacaggcatgaaccaccaygccttgctcccactaaaattttttaaaataaattttttcttttggaataaccttcgattttcagaaaagttactatataaactggtgcagagaacgccca

SEQ ID NO: 53948 - DNA, 201 bp, Homo sapiens
atgcctggctaatttttatgtagagatgagggggtctcactatgttgcccaggctggtctcgaactcctgggcttaagtgatcttcctgccttggcctccyaaaatactggaattacagggtgagccaccgtatgtggcttgtgtataaatcttgactttttgatcataatataccaggcttagctgggacctgcaagtgt

SEQ ID NO: 53949 - DNA, 201 bp, Homo sapiens
caaaagtgcccgtctcttcacagccttgccagcaatgggtgttaatattttaaagttatcttcactaacaggatcctgtgtataaatctttattaaaaatkatttatttttaaattttaatttaattttaatttgttttgagacagagtcttgctctgtcacccaggccggagggcagtggtgggatcttgtctaactaca

SEQ ID NO: 53950 - DNA, 201 bp, Homo sapiens
ggaggctgaggtgggtggatcacaaggtcaagagatcgagaccatcctggtcaacatggtgaaaccccatctctattaaaaatacaaaaattagccaggartggccacgcgcgcctgtagtcccagctactggggagactgaggcaggagaatcgcttgaacccgggaggtggaggttacagtgagctgagattgagccac

SEQ ID NO: 53951 - DNA, 201 bp, Homo sapiens
tttctctctgctagccataatgctgccaagacctggttgggttcttattatctgttctcatgactcgacatcatgtattttgccgggtgcggtggatcacrcctgtaatcccagcactttgggaggctgaggtgggtggatcacaaggtcaagagatcgagaccatcctggtcaacatggtgaaaccccatctctattaaa

SEQ ID NO: 53952 - DNA, 201 bp, Homo sapiens
cctctccttctccctcctcagtgcccctggactctaagaatatttcttttttctgtagatgcatctcacgtaacctaaaattcatctttttttttttttttgagacatagtctcactctctcacccaggtgggagtgcagtggtgtgatctcggctcactgcaacctctgcctcccgggttcaagcgattctcctgcctca

SEQ ID NO: 53953 - DNA, 201 bp, Homo sapiens
caccactcagccttgtttgcctccctttaatcctggccctggtgccaataaaactttacttacaaaagcaggtagccgctgcagttgtcagtttcttttttgaggatgattgcctttttgccctaagtgtctcataaacaccatctctcacagatatttgaagataattgttctactccattttgcaggaggggaaactga

SEQ ID NO: 53954 - DNA, 201 bp, Homo sapiens
cccgcctcagcctcccaaagtgctgggatgacaggtgtgagccactgcacccgtccaggtctcaggatgttagagaatttaaccagcagtgacctggtccrttccatcctgctgtggatgggaagtagagctctgctcacagctgtggccctaccctccctctgcagacttggcagtggatcaacccagtggacttccagg

SEQ ID NO: 53955 - DNA, 201 bp, Homo sapiens
gccgctgcccacaccctgtgccagctccgccattgagttccctggagggaaggaggtaaggatgccttttctaattccaagtctttttattgggtgcacaygctggacaagggttacgcattagctcattttattctctcccaattcatcaaggtaaggactccaaaaccagtgctccataccccttcccattttaaagac

SEQ ID NO: 53956 - DNA, 201 bp, Homo sapiens
tacgtgtgggctgcccctcgccaatccctacctctgcttccagttaaatatgagcctcctctgggagacatcaaggtgtccaagttggccgggcagctgcrtatggagtgggagaccccggataaccaggttggtgctgaggtgcagttccggcaccggacacccagcagcccatggaagttggtgagtttgtttcccaag

SEQ ID NO: 53957 - DNA, 201 bp, Homo sapiens
agccactgcgctcagcccactacagggctttatcaagtgagaatcatcaggctgaacctcacggtgtctcaaggacaatgtcacctgcaggtggcagggtktactaaacagctgctgccctgagcctgggcaacaggaaaatgagtgagagggtttcaaaccatgcagaaaggcctggcgctgtggtttatgcctgtaatc

SEQ ID NO: 53958 - DNA, 201 bp, Homo sapiens
gggtgatcctggaggccctaagaggacagggcctggcctgcttctgctgagcccccaggacccagcacgtggctctgtacacagttggagctcaataagcrcatgatggttaagtgactggtgccaagtcctggacaattcttacggcctgatgttcgacctgcctctccccagagtcctgcctctgccccctggagatga

SEQ ID NO: 53959 - DNA, 201 bp, Homo sapiens
ctggaacccagagaacaaaagagtcagggttggtggggggcaggcaggcctgggtccaggggcagccacatgtgccctatgtgcaggctcctggaattacrgagtctttttttatctttttgagacagattttccctcttattgccgaggctggaatgcaatgatgcgatctcggctcactgcaacctccgcctcccgagt

SEQ ID NO: 53960 - DNA, 201 bp, Homo sapiens
aaataattattaatttttaaaatttagttataataattttttactgctttatatgttcctaaagaaggtttgaacctagagaaggttctctagtaattaaygatagaaataatccctggaagtatggtctttaatttaaaaaaatttagcgaggtgcggtggctcacgcctgtaatcccagtgctttgggaggccgagttg

SEQ ID NO: 53961 - DNA, 201 bp, Homo sapiens
agtggctctgaatatcagcgtcggaaccaacgggaccaccatgtattggccagcccgggctcagagcatgacgtattgcattgaatggcagcctgtgggcyaggacgggggccttgccacctgcagcctgactgcgccgcaagacccggatccggctggaatgggtaatggcctggaatggcctgcgcctacccctcctct

SEQ ID NO: 53962 - DNA, 201 bp, Homo sapiens
acagagtgagactctgtctcagaaaaaacaaaaacgaaaacaaacaaacaaaaaacaaaaacaagagaattagacttgagggtcttttttttttttttttwaattttatagacagggactcactctgtgcccaggctggagtgcagtggtgccatcatagctcacagcagcctcaacctcctgggctcaagcgatcctccc

SEQ ID NO: 53963 - DNA, 201 bp, Homo sapiens
ggaatgtcttttttctgctcccagattcaatccaggatcccacattgtgtttagtaaaataattattaatttttaaaatttagttataataattttttacygctttatatgttcctaaagaaggtttgaacctagagaaggttctctagtaattaacgatagaaataatccctggaagtatggtctttaatttaaaaaaat

SEQ ID NO: 53964 - DNA, 201 bp, Homo sapiens
cactgacctcatagcctgctgggcgcctgaccctggccagctcagctgcccctcggagccaggcttcttgaaggagggacctcctcccaggaagctgaacmgcattgcacaaacctggccacttgggcctcagtttccacagatgctcatccccaggagagaccctctccttctccctcctcagtgcccctggactctaag

SEQ ID NO: 53965 - DNA, 201 bp, Homo sapiens
atcatacctcttaaatttatacaatgatataaaaaaagaatcaggccgggtatgaccacggtgcagcaagactattttatgctaatttatgtctctccttrggtcaggttccttgaaatagatctaaaaactaagtacgatttccctgatagttctaaacaaacaaacaaacaaaaaaagaattggctggacacagtggct

SEQ ID NO: 53966 - DNA, 201 bp, Homo sapiens
gctgcctgcagaaccagtgagtgctgttttcaggacccgccatatccggatgcagactcaggttcggggcagttcctcattgttggctgaggattatgtakggctctgcctgaccccatccacagcggcccctcccatggcctccaccaccaggccaaagacccagccctgcctgtggtcttgggagtccccaccccacca

SEQ ID NO: 53967 - DNA, 201 bp, Homo sapiens
tgaggacaagttaggaggctgaggattcggaataggttgaggtgagagacggcaggggatgaggtaggaaggacgcggggagggtttaggctgaggtgacrctgaaagatgtaagcatcacaaagatttgtcttaggcacgaagacccctccagactctggtctgttcccaagcctacaggatctcttccaggctcggcct

SEQ ID NO: 53968 - DNA, 201 bp, Homo sapiens
gtagcagattattgctttaagtcccaaaacaacccattaagtgcagtctgattagtttacagagagggaaactgaggcatagagggagtatctctgttgaracaaaactgacaaatactccactcgttgactttaccatagtcatcttagtcaggtccctaatgggctgttactataaggctgtagcaaaaatcctttatt

SEQ ID NO: 53969 - DNA, 201 bp, Homo sapiens
tgcctcctgcctggaatgtttgttttccacacggtccaactcctattcgtccttcaaaactcagctcaaaagttccctcctccagcaagacttctctgccyccttctggccatgcccttgtttacaactgtcccttctccctggtctgacactgcggggttggggtagatgtgtcaaggtatctgggggctcttggggagg

SEQ ID NO: 53970 - DNA, 201 bp, Homo sapiens
tttccctgatagttctaaacaaacaaacaaacaaaaaaagaattggctggacacagtggctcatgcctataatcccagcactttgggagcccgaggtgggyggatcacccccaagagacaggcacttttgtaaattgcttaccagaattgattaccctctggcaagcaatttacaaaagtgcccgtctcttcacagccttg

SEQ ID NO: 53971 - DNA, 201 bp, Homo sapiens
acgatttccctgatagttctaaacaaacaaacaaacaaaaaaagaattggctggacacagtggctcatgcctataatcccagcactttgggagcccgaggygggcggatcacccccaagagacaggcacttttgtaaattgcttaccagaattgattaccctctggcaagcaatttacaaaagtgcccgtctcttcacagc

SEQ ID NO: 53972 - DNA, 201 bp, Homo sapiens
aatttatgtctctccttgggtcaggttccttgaaatagatctaaaaactaagtacgatttccctgatagttctaaacaaacaaacaaacaaaaaaagaatkggctggacacagtggctcatgcctataatcccagcactttgggagcccgaggtgggcggatcacccccaagagacaggcacttttgtaaattgcttacca

SEQ ID NO: 53973 - DNA, 201 bp, Homo sapiens
accatgtcgcccaggctggtcttgaactcctgagctcaggtgatggtgagccacctgcctcagcctcccaaagtgctgggattccaggaatgagccaccgygcccggccatattgtcggaacatttatgctcctaatgcaccctgaaaagggtctgaacactaagcagacacgctgtccattcttttgtttgataacgatt

SEQ ID NO: 53974 - DNA, 201 bp, Homo sapiens
tgtcacactctgggtggaatcctgggccaggaaccagacagagaagtctcctgaggtgaccctgcagctctacaactcaggttagcaccttgttctccccmcgtccgttttttacccagagaggccatcaggctgcaaggctggagctagagaggattcctggcccttggcaagggacttgatactactagccattgtcac

SEQ ID NO: 53975 - DNA, 201 bp, Homo sapiens
tggatggatgggtagatgggtggatggtggggtggatggatgatggatgaatacatggatggatggatggatggatggatggatggatgggtgaatggatraattcatgggtggatggatgggtagatggtggacggatgaataaatacatggatggatgggtagatgggcagataaatacatgggcagatggatggatgg

SEQ ID NO: 53976 - DNA, 201 bp, Homo sapiens
gcctgatcacagctcactgccacctccaccttccaggttcaagctattctccagcctcagccttccaagtagctgggattacaggtgttagccaccacacscggctaatttttgtatttttagtagagaccaggtttcaccatgtcgcccaggctggtcttgaactcctgagctcaggtgatggtgagccacctgcctcag

SEQ ID NO: 53977 - DNA, 201 bp, Homo sapiens
ggtagatgcgtggatggatggatgaatacatggatggataaatacatggatggatgggtaaatgggtggatggtggggtggatggatggatggatggatgsatggatggatgggtagatgggtgcatggatggatgaatacatggatggatgaatacatggatggatgggtgaatgggtggatggtgaggtggatggatgg

SEQ ID NO: 53978 - DNA, 201 bp, Homo sapiens
tgcatggattaatacatggattgatggatggatggatggatggatggatggatggatagatggatggggggtggatggatggatggatgaatacgtggatrgatggacggatggtggggtggatggatggatgtatgaatacgtggatggatggatggtggggcagatggatggatgagtagatggatgaatgaacacatg

SEQ ID NO: 53979 - DNA, 201 bp, Homo sapiens
tatatatatttttaagagatggggtcttgctgtgttggccagggtggtcttgaactcctgggctcaaatgatcctcctgtcttggcctcccaaagtgcttygagtacaggcgtgggcccctgtgcctggccatggatatgttaaattccttactgtagtaatcatttcactatggatatgtatatcaaaccatcatacctc

SEQ ID NO: 53980 - DNA, 201 bp, Homo sapiens
ctcccgaatagctggaattacaggcacatgtcaccaggcctggcaaatttttgtatttttagtagagacagggtttcgccttgttggccaggctggtctcraactcctgacctcaggtgatccgcccacctcggcctcccaaagtgttggaattacagatgtgaaccactgcacccagcccagcattatgtttttgagggt

SEQ ID NO: 53981 - DNA, 201 bp, Homo sapiens
tctcagctcactgcaacctctacctcccaggttcaagtaattctctctgcctcagcctcccgaatagctggaattacaggcacatgtcaccaggcctggcraatttttgtatttttagtagagacagggtttcgccttgttggccaggctggtctcaaactcctgacctcaggtgatccgcccacctcggcctcccaaagt

SEQ ID NO: 53982 - DNA, 201 bp, Homo sapiens
ctctgcccctcccccaggcctcacacatccatcccccagctgaccctggcctgggccccggggccagagaaggctgtcctgtatggggtcacagggcccccgtccccactgtgccaggcccaggacactgagtctttgtccctaactcactgacctcatagcctgctgggcgcctgaccctggccagctcagctgcccctc

SEQ ID NO: 53983 - DNA, 201 bp, Homo sapiens
ggtttcaccatgtttgccaggctggtctcaaactcctgacctcaggcgatccacccacctcagcctcccaaagtgctaggattacaggcatgagccactgygcccggcctaacatctatatattcttcaaaatccacttcaaattctctttgagaagtatcagaggaccttgtattgaatgaacaaatacattttattctt

SEQ ID NO: 53984 - DNA, 201 bp, Homo sapiens
aacccaggaggcagaggttgcagtgagccgagattgcagcactgcattccagcctgtgtggcagagcaagactctatctcaataataataataataaataractttccttctctgtacactggggatcagcggggtgctgactttttcaatggctcttgagatgcactgagtgcctgtagaatgcccacagcagtgctggc

SEQ ID NO: 53985 - DNA, 201 bp, Homo sapiens
tccttgctcagcttcaatgtgttccggagtggggacggggtggctgaacctcgcaggtggcagagaggctcccctggggctgtggggctctacgtggatcygatggagccgctggtgacctgggtggtccccctcctcttcctcttcctgctgtccaggcagggcggtgagtcccctgaccctggcatggcggctcctctt

SEQ ID NO: 53986 - DNA, 201 bp, Homo sapiens
accaccaccacggagctgacttcctgggtttctctttcactttgacttgccttagggatgggctgtgacactttactttttttcttttttcttttttttcwgtcttttctccttgctcagcttcaatgtgttccggagtggggacggggtggctgaacctcgcaggtggcagagaggctcccctggggctgtggggctcta

SEQ ID NO: 53987 - DNA, 201 bp, Homo sapiens
gatccttccacctcagcctctggagtagctgggactacagacatgcaccaccacacctggttaattttttatttttattttttgtagagacaggtgtctcyctacgttgcccaggctggtctcgaactcctgggctcaagtgatccacccatctccacctcccaaagtgctaggattacaggcgtgagccaccgtacccag

SEQ ID NO: 53988 - DNA, 201 bp, Homo sapiens
agaattggctgggcgcagtggctcacgcctgtaatcccagcactttgggaggccaaggcgggcggatcacctgaggtcaggagttcaagaccagcctgacmaacttggagaaaccccgtctctcctaaaaatacaaaattagccgggcatggtggcacatgcctgtaattctagctacacgggaggctgaggcaggagaat

SEQ ID NO: 53989 - DNA, 201 bp, Homo sapiens
gcgcccaccatcatgcctggctaatttttgtagttttagtagaaacagggtttccccatgttcctcaggctagtctcgaactcctgaccttaagtgatctrcccaccttggcctcccaatatgctgggattgcaggcatgagccatcgtggctgggctttttttttttttaaagacagggtcttgctctgttgcccaggct

SEQ ID NO: 53990 - DNA, 201 bp, Homo sapiens; identical to SEQ ID NO: 15652

SEQ ID NO: 53991 - DNA, 201 bp, Homo sapiens
ggagtgcagtggcctgatcacagctcactgccacctccaccttccaggttcaagctattctccagcctcagccttccaagtagctgggattacaggtgttmgccaccacacgcggctaatttttgtatttttagtagagaccaggtttcaccatgtcgcccaggctggtcttgaactcctgagctcaggtgatggtgagcc

SEQ ID NO: 53992 - DNA, 201 bp, Homo sapiens
tggagtgcagtggcctgatcacagctcactgccacctccaccttccaggttcaagctattctccagcctcagccttccaagtagctgggattacaggtgtyagccaccacacgcggctaatttttgtatttttagtagagaccaggtttcaccatgtcgcccaggctggtcttgaactcctgagctcaggtgatggtgagc

SEQ ID NO: 53993 - DNA, 201 bp, Homo sapiens
gatactactagccattgtcacttcacgtagtgtcacgcaaacactattgtgacaaagcagtctttcatggtccccttaccaatcccctattcgtgggcacktagattgcttctggtttctctctgctagccataatgctgccaagacctggttgggttcttattatctgttctcatgactcgacatcatgtattttgccgg

SEQ ID NO: 53994 - DNA, 201 bp, Homo sapiens
ttggagtgcagtggcctgatcacagctcactgccacctccaccttccaggttcaagctattctccagcctcagccttccaagtagctgggattacaggtgytagccaccacacgcggctaatttttgtatttttagtagagaccaggtttcaccatgtcgcccaggctggtcttgaactcctgagctcaggtgatggtgag

SEQ ID NO: 53995 - DNA, 201 bp, Homo sapiens
cctgtaattccagctactcgggaggctgaggcaggagaattgcttgaacccgggaggcagaagttgcagtgagtggagatcatgccaccacactccagccygggcgacagagcagggctccatctcaaaaaaaaaaaaaaaaattggctagagagggccagagacctggccaagtgcatggaaccacaggtggcccatggg

SEQ ID NO: 53996 - DNA, 201 bp, Homo sapiens
tgaatacatggatggatgggtgaatgggtggatggtgggatggatggatggatggatggatggattaatacatggatggatggatgaatggacgaatggayggataaatgggtggatggtggggtggatgcatggattaatacatggattgatggatggatggatggatggatggatggatggatagatggatggggggtg

SEQ ID NO: 53997 - DNA, 201 bp, Homo sapiens
agcctgctgggcgcctgaccctggccagctcagctgcccctcggagccaggcttcttgaaggagggacctcctcccaggaagctgaaccgcattgcacaamcctggccacttgggcctcagtttccacagatgctcatccccaggagagaccctctccttctccctcctcagtgcccctggactctaagaatatttctttt

SEQ ID NO: 53998 - DNA, 201 bp, Homo sapiens
acacacacacacacacacacacgcacacacacaagtatatatatatatatatttgtgtttttttgttttttgtttttgagacaaaagtccagctctgttgsccaggctgaagtgcagtggagcaatctcggctcactgcaacctccgcctcctggattcaagcaattctcctgcgctcagcctcccgagtagctggaatta

SEQ ID NO: 53999 - DNA, 201 bp, Homo sapiens
tcctgtatggggtcacagggcccccgtccccactgtgccaggcccaggacactgagtctttgtccctaactcactgacctcatagcctgctgggcgcctgrccctggccagctcagctgcccctcggagccaggcttcttgaaggagggacctcctcccaggaagctgaaccgcattgcacaaacctggccacttgggcct

SEQ ID NO: 54000 - DNA, 201 bp, Homo sapiens
tcctgagtagctgggattacagacacccgccaccactcccagctaatttttgcatttttagtagagacgggggtttcaccatgttggccaggctggtctcraactcctgacctttaagtgatccatccaccttggcctcccgaaaggctgggattgcaggtgtgagctaccgccccctgcctttgtggatatattttggtt

SEQ ID NO: 54001 - DNA, 201 bp, Homo sapiens; identical to SEQ ID NO: 15660

SEQ ID NO: 54002 - DNA, 201 bp, Homo sapiens
ggaacatgggggaaagactaagttgcatctcttaaatttttttttttttttttttaagagacaggatcttgctctgttacccagactggagtgcagtggcrcaatcacgattcactgcagcctcaacctcctgggttcaagccattctcccacctcagcctcctgagtagctgagaatacagatgtgtgccaccacgactg

SEQ ID NO: 54003 - DNA, 201 bp, Homo sapiens
ccccagcccatcaccccacagaaacccagacccactgtgtccatcttggtggtccccaaagcacctcctctggacttttgcctctgctgtggcctctgccrgagatgccctgtaattctatacattctagctcaagtgtccctcctccaggcagtcctccctgctccacttcagggcacccggcctccatctgttcctgat

SEQ ID NO: 54004 - DNA, 201 bp, Homo sapiens; identical to SEQ ID NO: 15661

SEQ ID NO: 54005 - DNA, 201 bp, Homo sapiens
ccaggctgatctcaaaatcttgggctcaagcgatcctcctgccttggcttcccaacgtgctgggattacaggcatgagccactgcgcccagcaactctatrttttaaatttgtaaaagacaaccaggctgttttccaaagcaaacacccagttaaatttaaatttccataaacaatgaatgttttttcagtgtaagtatgc

SEQ ID NO: 54006 - DNA, 201 bp, Homo sapiens
ctccctagtagctgggactacaggtgcccaccaccacaccaggctgattttttgtatttttggtagagatgaggtctcaccatgttggccaggcttgtctygaactcctggcctcaggtgattcacccaccttagcctcccaaagttctgggattgcaggccaaagagttttggtgttttgcctggccaaaacactaaaac

SEQ ID NO: 54007 - DNA, 201 bp, Homo sapiens
gggttcaaacctgcagggaaggcacacagcgggtgtctaaggcccagagaggtgttgctgcttactcaatgtcatacagaggtagggacagggtgaggttyggagcctctcacccatatgggtctggaacctcttgctggcatcctgagctcagttccaggcagatcacacacatacaggtaatgaatctcacatcccaag

SEQ ID NO: 54008 - DNA, 201 bp, Homo sapiens
gtcacatgaccattgctagagctgaggtggggtcactgcactgtcaaccacaccatctgtgaaaagagggagggaaatttcccaaagacagatgggagtgytcttcctaagaggggctgaatgggagtcagtgcggcagactccatcctcaaatcggtctcaggatatatggagtctcgctctgtcacccagcctggagtg

SEQ ID NO: 54009 - DNA, 201 bp, Homo sapiens
actcagctactgtctgcctctgtacatttgcctattttggatattttatataagtggaatcatacagtgtgtgcctttcctgtccatcttcgtccacccakcatgatgggtttttttttttgtgtatgtgtgtttttttttttttgagatggagtctcactctgtcacccaggctggagtgcagtggcacgatctcagctc

SEQ ID NO: 54010 - DNA, 201 bp, Homo sapiens
cttcattccgtttcatgaccaaataatattccattgtatatatgtacatgtacattttgttgatccactcatttgttggtggtcacttggattttttcacrttttggtagctattctgaatagagctgctataaacattggcatacaactttttgcatagatttatttctttatttatttattttgagatgaagtgttgct

SEQ ID NO: 54011 - DNA, 201 bp, Homo sapiens
aacataaaattaatgaaaacatttatgatgaacaaaacatcaaaacttttattttttattttatttttagagacggggatctcactatgttgcccaggctsgtcttgaactcctggcctcaaaagatccttctgcctaggcctcccaaagtgttgggattacaggtgtcagccaccgcatatggccaaaacaccaaaactt

SEQ ID NO: 54012 - DNA, 201 bp, Homo sapiens
gtgtattggattcatccatgggaagctgcccctcacatgtagcagcagctgaactctcatcaagcagggatgactgtctccattccacagatgaggaaacyaaggcctggaggggggatctgatgagggacaggaaagcccacaaaacagggtttagccaggagggtttttggctttccccaggaaagagttcaagtgcat

SEQ ID NO: 54013 - DNA, 201 bp, Homo sapiens
gctggaatgggtaatggcctggaatggcctgcgcctacccctcctctgtgccctcccttttaggtcctggtgggttcaaacctgcagggaaggcacacagygggtgtctaaggcccagagaggtgttgctgcttactcaatgtcatacagaggtagggacagggtgaggttcggagcctctcacccatatgggtctggaac

SEQ ID NO: 54014 - DNA, 201 bp, Homo sapiens
gtgggaacacaatctactgaatggcctggcctttgcttatccttccagcaacctacagctggagtcgagagtctggggcaatggggcaggaaaagtgttaytacattaccatctttgcctctgcgcaccccgagaagctcaccttgtggtctacggtcctgtccacctaccactttgggggcaatggtaagtgacccaaac

SEQ ID NO: 54015 - DNA, 201 bp, Homo sapiens; identical to SEQ ID NO: 15646

SEQ ID NO: 54016 - DNA, 201 bp, Homo sapiens
ccacaaggggtggtttgaatccatctcttcatctccagctggggcctcaggtggtctgagtgcccctggactcagtttcccaatctgtgaaataaggcaartgagggactctccaggaattggtggagttgggagggtctcaggatggtcaggagggggccatgactttcctctgatctctacctatttcctccacctttc

SEQ ID NO: 54017 - DNA, 201 bp, Homo sapiens
tctcagacgagcttctggggcagctgggtggggccataaggggcccacagggcctcttggcaggcctagagacggagggaaggaggtgggcttgccaagaygtggcaaggggaaggtgggatgtggggaacttcagagggagtgtcaggttgtgacttcaataaggggagaaataccacttcacctttgtctggggtaccc

SEQ ID NO: 54018 - DNA, 201 bp, Homo sapiens
ccctcgtgactcgatccttcctgcttcacccgcccccgagtctgtggggcacctgaaagtggggcagccctgggaacttatctcagacgagcttctggggmagctgggtggggccataaggggcccacagggcctcttggcaggcctagagacggagggaaggaggtgggcttgccaagatgtggcaaggggaaggtggga

SEQ ID NO: 54019 - DNA, 201 bp, Homo sapiens
tgggcaacatagcaagaccccgtctctacagaaagaaaaaagtttgccagccatggtggcatgtgcctgtagtcccaactactcaggaggctgaggtggtmagatcacttgatcccaggagtttgaggctgcagtgagctatgattgcaccactgcaatcatacaacctctgcctcccgggttcaagccattctccttcct

SEQ ID NO: 54020 - DNA, 201 bp, Homo sapiens
cctacactgaactgcctcctgaacaacccctcagtgggcaagaaggagtgcttattgagtgactgactggactgactgaatgaatgaatgcagtttttctrtggttaacacacacacacacacacacacgcacacacacaagtatatatatatatatatttgtgtttttttgttttttgtttttgagacaaaagtccagct

SEQ ID NO: 54021 - DNA, 201 bp, Homo sapiens
cctcagcctcccaaatagctgggaatataggcatgtgccatcatacctggctattatgcattattaaagaacaacaacaaaaactagctgagccactgcgytccaccctggttgatagagctacactctttttcaaaaaagaaaaaagagagaaagaaagaaaaaaggctagagttgaccctgtgtttatttaagatctaa

SEQ ID NO: 54022 - DNA, 201 bp, Homo sapiens
ctgggcaacatagcaagaccccgtctctacagaaagaaaaaagtttgccagccatggtggcatgtgcctgtagtcccaactactcaggaggctgaggtggkaagatcacttgatcccaggagtttgaggctgcagtgagctatgattgcaccactgcaatcatacaacctctgcctcccgggttcaagccattctccttcc

SEQ ID NO: 54023 - DNA, 201 bp, Homo sapiens
ccactttgggggcaatggtaagtgacccaaacctgcaggtttacattattttttctttttaaataatttaaaaaaatagaggctgggcacagtgactcacrcatgtaatcccagcactttgggaggccaaggtgggtggatcacctgaggtcaggagtttgaaaccagcctggccaatgtggcgaaaccctgtctctacta

SEQ ID NO: 54024 - DNA, 201 bp, Homo sapiens
ataatattccattgtatatatgtacatgtacattttgttgatccactcatttgttggtggtcacttggattttttcacgttttggtagctattctgaatasagctgctataaacattggcatacaactttttgcatagatttatttctttatttatttattttgagatgaagtgttgctctgatgcccaggctggagtgca

SEQ ID NO: 54025 - DNA, 201 bp, Homo sapiens
ggaggtcaggagttcgagaccagcctgggcaacacggtgaaaccccatctccaccaaaaaataataataaattagccaggaaatggtggcgcatgcctgtrgtcccagctactcaggaggctgaggcaggagactcatttgaacccgggaggctgaggttgcagggagccgagatcatgccactgcactccagcctgggcg

SEQ ID NO: 54026 - DNA, 201 bp, Homo sapiens
attccctaccaaatccctacaaccaccccctgaaaggaaccatgactgttgtactttacagatgtgatcgttgaggctcagagagggtgagtgactcgccygaggctacgtagcacacacaggagtcacatttggacccaaataacccagagctcctccaggctccagtgcacctgcctcctctctgccccgtgcctgttg

SEQ ID NO: 54027 - DNA, 201 bp, Homo sapiens
gactacaggcatgagccactgtgcctggcttagcacctgcattttttctttccctgggactcgcactttctctgcagccgcagttgtcttcggctgccccrctgtacagtgtggacactggagtatgctttcaggctcgaggggaccctaggaagggtcactgggcctgactgtccatgaggtactgtagaattgcatcaa

SEQ ID NO: 54028 - DNA, 201 bp, Homo sapiens
gaagctctcatggtgaatatcctggcaaggagacagcagttaggctggaggaggactcagctcattcaaacaccacctgctgactggatgcggcggattaygcctgtaatcccagcactttgggaagccaaggcaggtggatcactggaggtcaggagttcgagaccagcctgggcaacacggtgaaaccccatctccacc

SEQ ID NO: 54029 - DNA, 201 bp, Homo sapiens
agatggagtttcaccatgttgcccaggctggtctcaaactcctgccctcaggtgatccacccacctcagcctctcaaagtgctgggattacaggtgtgagycactgtggccgacctactatttttattatttttgagctaggttctcagtctgttggcagactggagtgcaatcatggctcactgcagccttgaactccca

SEQ ID NO: 54030 - DNA, 201 bp, Homo sapiens
gccaccatacccggctaattttgtatttttagtagagacggggtttcaccacgttggccaggctggtctcgaactcctgacctcaagtgatccacctgccwtggcctcccaaagtgttgggattataggcgtgagccaccatgcccagcctaatttttgtatttttagtagagatggagtttcaccatgttgcccaggctg

SEQ ID NO: 54031 - DNA, 201 bp, Homo sapiens
acttgggaggctgaggcaggagaatcgcttgaacccaggagccagaggttgcagtgagccaaaattgtgccattgcactccagcctgggcaacaaagagcragactgtgtcaaaaaaaaaaaattcaataatcaagatccataatgcagttttttgttgttgttggtttgttttttttaagagacagagttttgctatgtt

SEQ ID NO: 54032 - DNA, 201 bp, Homo sapiens
acctactctgagcctcagctagaccagggtgagaggagcgaggcagaaaattttaaaggagtgcctgatttaggggtgtatcaaaaattcagtaatcagcyaggcacggtggctcacacctgtaatcccagcactttgggaggctaagacaggtgaatcacctgaggtcagcagttcgagaccagtctggccaacgtggtg

SEQ ID NO: 54033 - DNA, 201 bp, Homo sapiens
agagacggggtttcaccgtgttagccaggatggtctcaatctcctgacctcatgatctacccgtctcggcctcccaaagtgctgggattagaggcgtgagmccccgtgcccggcctctcaaattccttttctaaggaaaaattttctgcttgaggtaactgggttaaaagatggaaacatttttgttttcctgaatgtcag

SEQ ID NO: 54034 - DNA, 201 bp, Homo sapiens
ggctgcagttctccgaccaggctggggtgtctgtgctgtacactgtcacactctgggtggaatcctgggccaggaaccagacagagaagtctcctgaggtsaccctgcagctctacaactcaggttagcaccttgttctccccccgtccgttttttacccagagaggccatcaggctgcaaggctggagctagagaggatt

SEQ ID NO: 54035 - DNA, 201 bp, Homo sapiens
aacttcccaagaccacagcctagtggaagagatagacaacaggcaaacaaatgtctatcacaaatgtgatgatgtgttttgaagaaccagaggaggaaagytggggccctggggaccccccaaaaaaaaacaccagaggagggtgagggatagagagagaggtggcaggacatctggcctctgtgaggacaagttaggagg

SEQ ID NO: 54036 - DNA, 201 bp, Homo sapiens
gaggtggcaggacatctggcctctgtgaggacaagttaggaggctgaggattcggaataggttgaggtgagagacggcaggggatgaggtaggaaggacgyggggagggtttaggctgaggtgacgctgaaagatgtaagcatcacaaagatttgtcttaggcacgaagacccctccagactctggtctgttcccaagcct

SEQ ID NO: 54037 - DNA, 201 bp, Homo sapiens
tctggaacctcttgctggcatcctgagctcagttccaggcagatcacacacatacaggtaatgaatctcacatcccaaggtgtttgttaaatattcaaccrcgccagggaaggtggcagttcgcgagatgctggtggcaaattaatgagcagtctttagggaaaggggggccgtgaggctcaggtggcctctcactctccc

SEQ ID NO: 54038 - DNA, 201 bp, Homo sapiens
gccagagaaggggactggggagagagatggcaactgtctcgatgcgtctctcccctctccttccagaaccagtggctctgaatatcagcgtcggaaccaaygggaccaccatgtattggccagcccgggctcagagcatgacgtattgcattgaatggcagcctgtgggccaggacgggggccttgccacctgcagcctga

SEQ ID NO: 54039 - DNA, 201 bp, Homo sapiens
tctgaatatcagcgtcggaaccaacgggaccaccatgtattggccagcccgggctcagagcatgacgtattgcattgaatggcagcctgtgggccaggacsggggccttgccacctgcagcctgactgcgccgcaagacccggatccggctggaatgggtaatggcctggaatggcctgcgcctacccctcctctgtgccc

SEQ ID NO: 54040 - DNA, 201 bp, Homo sapiens
tgcgtctctcccctctccttccagaaccagtggctctgaatatcagcgtcggaaccaacgggaccaccatgtattggccagcccgggctcagagcatgacrtattgcattgaatggcagcctgtgggccaggacgggggccttgccacctgcagcctgactgcgccgcaagacccggatccggctggaatgggtaatggcc

SEQ ID NO: 54041 - DNA, 201 bp, Homo sapiens
tcgatgcgtctctcccctctccttccagaaccagtggctctgaatatcagcgtcggaaccaacgggaccaccatgtattggccagcccgggctcagagcaygacgtattgcattgaatggcagcctgtgggccaggacgggggccttgccacctgcagcctgactgcgccgcaagacccggatccggctggaatgggtaat

SEQ ID NO: 54042 - DNA, 201 bp, Homo sapiens
acaattcttacggcctgatgttcgacctgcctctccccagagtcctgcctctgccccctggagatgaatgtggcccaggaattccagctccgacgacggcrgctggggagccaaggaagttcctggagcaagtggagcagccccgtgtgcgttccccctggtaagatcactctgagtacaggaacaggggcaagcattaga

SEQ ID NO: 54043 - DNA, 201 bp, Homo sapiens
ctccaaagaaaaaacaaaaaaaaacaaacgccatctgctacccactttgtgcctggccccaaggcagcctccagtgcagggaaacagccaaacacagacayccctggccctgtagggtcaggggtatagacgagagggtgggagagaggctgcaggagccagagaaggggactggggagagagatggcaactgtctcgatg

SEQ ID NO: 54044 - DNA, 201 bp, Homo sapiens; identical to SEQ ID NO: 15662

SEQ ID NO: 54045 - DNA, 201 bp, Homo sapiens
aatggcctggaatggcctgcgcctacccctcctctgtgccctcccttttaggtcctggtgggttcaaacctgcagggaaggcacacagcgggtgtctaagkcccagagaggtgttgctgcttactcaatgtcatacagaggtagggacagggtgaggttcggagcctctcacccatatgggtctggaacctcttgctggca

SEQ ID NO: 54046 - DNA, 201 bp, Homo sapiens; identical to SEQ ID NO: 15734

SEQ ID NO: 54047 - DNA, 201 bp, Homo sapiens
gcagatatctatttgagatactgattgcaattcctttgaatatatacccaatagtaggattgctggatcatgtggtagtgctatttttatttttttgaggracctctatactgttttccataatggctgtaccaatttttatttccacaatagtgtattagggtttccctttctccacatcctcaccaatacttgttatct

SEQ ID NO: 54048 - DNA, 201 bp, Homo sapiens; identical to SEQ ID NO: 15735

SEQ ID NO: 54049 - DNA, 201 bp, Homo sapiens
tgagggagctctggctcccagcactgtttgtcaactattaagatgccatggtggctgggcatggtggctcacacctgtaatcccagcactctgggaggccraggcaggcagatcacgaagtcaggagattgagaccatcgtggctaacatggtgaaaccctgtctctacaaaaatacaaaaaaattagctgagtgtggtgg

SEQ ID NO: 54050 - DNA, 201 bp, Homo sapiens; identical to SEQ ID NO: 15736

SEQ ID NO: 54051 - DNA, 201 bp, Homo sapiens
cctcagcctcccaaagtgttgtgattacaggcatgagccactgtgcctgaccacaagtagcatctatttataagattctttttataagtagcaaaaaatamagctattttcattttaaaaaatctacattctaggatatgtttcatgcttaggataaattttgcacaagcatatcttcataacaatactcaggtaaaatcc

SEQ ID NO: 54052 - DNA, 201 bp, Homo sapiens
tagtcccagctactcgggaggctgaggcaggagaatggtgtgaatccaggaggcggagcttgcagtgagctgagatcgagccactgcactccagcctggghgacagagcaagactctgtctcaaaaaaaaaaaaacaaaaacgccgtggttcttcacttccaaatctgcctctggaggtcaatgacctccacattctcaaa

SEQ ID NO: 54053 - DNA, 201 bp, Homo sapiens
catttaataagtgggagatgtggtcacagtggataaaaggagcacacataaaactttagagaggtgatttcactagagggagttttttttttttttttttyttgagatggagtctcgctctgtcacccaggctggagtgcagtggcacgatctcggctcactgcaagctccgcctcccggattcacgccattctcctgcct

SEQ ID NO: 54054 - DNA, 201 bp, Homo sapiens
gtcttcagcattgtaccaagtgcataatgagtgctaacaaatcctggtggagggacggagcaccgctgatctggcctgctgactcagcctgtgactcagcyattttgtgtgtgtcaactcctccagtataatagagacatcaggtggggaatgtggccatcctcaccttcgtcacagaacacaggcctgatgcccactatg

SEQ ID NO: 54055 - DNA, 201 bp, Homo sapiens
gctccgcctcccggattcacgccattctcctgcctcagcctcccgagtagctgggactacaggcgcccgccaccacgtccagctacttttttttttttttkgtatttttagtagagacagggtttcaccgtgttagccaggatgatctcgatctcctgacctcgtgatccgcccgtctcggcctcccaaagtacgtggatt

SEQ ID NO: 54056 - DNA, 201 bp, Homo sapiens
aagagaagttctaagatatctcaaagctctgcttcatgctcttcacaaaatttaggcactaatccatcctgattcaaacttgtgtgtgtggaaaggatatrtatattttttttaagtttgaaaggctatatatcaaaatactgatatagttatctctgggggtggagaatgggtgattttataatatgtgaataacttcct

SEQ ID NO: 54057 - DNA, 201 bp, Homo sapiens
gaaagctgaggcaggagaatcacttgaacccggcaggcggggcttacagtgagccgagatcatgccactgcactccagcctggccaacagagcgagactcyatctcaaagaaaaaaaaaaaatatatatatatatatatataatatatatgtatatataatatcatattttaatgcagtatttttcaaaaatccaatttaa

SEQ ID NO: 54058 - DNA, 201 bp, Homo sapiens
cacgtcacagaccagtggtggctgtaagacaagtcatcagcttagaagcccctcaccctcactgtgtcttaggttatgccacagttttatggcttttcccyctttaaataaattttgacgtttattgtaacctgctttcacttatataaaaatattgagggagaactcccagaatctaatttccgataggctccaggcacc

SEQ ID NO: 54059 - DNA, 201 bp, Homo sapiens
gcaggagaatcacttgaacccggcaggcggggcttacagtgagccgagatcatgccactgcactccagcctggccaacagagcgagactccatctcaaagaaaaaaaaaaaatatatatatatatatatataatatatatgtatatataatatcatattttaatgcagtatttttcaaaaatccaatttaatgcaaaaata

SEQ ID NO: 54060 - DNA, 201 bp, Homo sapiens
accgcctcacacagagcgtacatgggttcagtggtgcaacacacagaacgcgcccatcagagtggctggcacgtcacagaccagtggtggctgtaagacargtcatcagcttagaagcccctcaccctcactgtgtcttaggttatgccacagttttatggcttttccctctttaaataaattttgacgtttattgtaacc

SEQ ID NO: 54061 - DNA, 201 bp, Homo sapiens
cttgaacccggcaggcggggcttacagtgagccgagatcatgccactgcactccagcctggccaacagagcgagactccatctcaaagaaaaaaaaaaaatatatatatatatatatataatatatatgtatatataatatcatattttaatgcagtatttttcaaaaatccaatttaatgcaaaaatatctgtgattaac

SEQ ID NO: 54062 - DNA, 201 bp, Homo sapiens
aatctcacgcctctgccactctggcaagtcacttacccactctgagctttgtctaaaatgaggacagtcatggatcataaccgcctcacacagagcgtacrtgggttcagtggtgcaacacacagaacgcgcccatcagagtggctggcacgtcacagaccagtggtggctgtaagacaagtcatcagcttagaagcccct

SEQ ID NO: 54063 - DNA, 201 bp, Homo sapiens
ggtggaaggactgcttaagcccaggagttgaagaccagccggggcaacatagcgagaccttgtctctactaaaaatatatatatttttaaattagctggtsgtggtggtgcgtgcctgtagtctgagctactcaggaggctgaggcaagaggatcgattgagcccaggagtttgaggctacagtgagctgtattcgtgcca

SEQ ID NO: 54064 - DNA, 201 bp, Homo sapiens
agtacagatcacctgggacggctttaaggggtttggcagtaggggatttttttaaggtagttcttccaagtggtagtaaaatcaatccatcagtcaatcgyttagtctcagactcatgattgaatctcacgcctctgccactctggcaagtcacttacccactctgagctttgtctaaaatgaggacagtcatggatcata

SEQ ID NO: 54065 - DNA, 201 bp, Homo sapiens
aaagcaaagaacacactgcctccctttcttcggcaaactttccttcaccagggagtggaaggtggggccctgccagcctaacacgctgtggcagaaataawaaaagcctggatgttttttccaggccctacaaatatttttcttggttagataagttcagacttgagactaaaggagctgatcacttcctttctgagatcc

SEQ ID NO: 54066 - DNA, 201 bp, Homo sapiens
agatggagttaaaaaaaaaacagtagctagtaaatttagcacatttacatttattgtgattatacatatatttggatttattttggccacctaattctgascaatttttttactttattttctttttttctttttctagattattttggaatagcacagggttttgtttttttttcgttttttggtttttcttgagacgga

SEQ ID NO: 54067 - DNA, 201 bp, Homo sapiens
gaactggtttgggggcagcatgctgagatgctagcccaggccaatcagccatggctacactcctacctcagacccagtacagaccatggaacatggagcaraagaaatagaaagcaaagaacacactgcctccctttcttcggcaaactttccttcaccagggagtggaaggtggggccctgccagcctaacacgctgtgg

SEQ ID NO: 54068 - DNA, 201 bp, Homo sapiens
tgagcgagtgtggagagaggtacagccctcggcctacaagctctttaggtaagaatcagggcatctgatctgggaaacagagcaggttatagctgaggttktgtgtgtgtgtgtgtgtgtgtgtgtgtgttttgtgtgtgtgtccaagtgcaaatgtaatgctacttggagaagaaagaaaatgtttcaagcagatagcac

SEQ ID NO: 54069 - DNA, 201 bp, Homo sapiens
aacttctagctttcagagctttttgaatttcagaattgtggattagggatctcaggtctttctttttctttcttttcttttttaaatttccaggatgtctrcagcattctgcccatggcaggcactgagtagaagttgttgacttctagagtatgtgacatcttgatctccctcaaataatatttgattctagaaaccagg

SEQ ID NO: 54070 - DNA, 201 bp, Homo sapiens
atatttccatttaagatgtgtgcaggtcttcaggatggcccagggccggccggatggtttggaccgtggtgtaccattaaagttcagacagaatgggggcyggcagagcacaccattgcaccagggagcactctgtttttccttctggagtggatactgttttctctaagcacttaaaagaattcctgacctccaactgaa

SEQ ID NO: 54071 - DNA, 201 bp, Homo sapiens
aaggagccaaggaatgcaggatcttgaatgtgaagaggaattatgtgcgaaaagatggcagctccgagaagcaagaagtcactctgacgttcctccttacytcttgttgcctaatctgctttcaaaggccaataaattcaaaattctccatttttcaaacaaccccgcccaacatagtgattctttaatctctaaacatga

SEQ ID NO: 54072 - DNA, 201 bp, Homo sapiens
ccactgagggttcaagagtacaatatcgtgaaacactaggaaaagttctgccttctgtcttccccaccccaggggcctatctaaacatctagatttatcaracttcataagagcccactgaacctgacaatgccaagaaggagccaaggaatgcaggatcttgaatgtgaagaggaattatgtgcgaaaagatggcagctc

SEQ ID NO: 54073 - DNA, 201 bp, Homo sapiens
agcaaaacaaatttgaaatgggcccctacgaggtttacattagtgtgcatatacagttgtgtggagtgagacagacaataacaagtaaacaaaaaagtaawcacaatcctaaattatcataattgtcatgaaagaaacatgtttcagtctgagatagaggacaaggaagtcaggagggcttccttagataggctgggccta

SEQ ID NO: 54074 - DNA, 201 bp, Homo sapiens
atggacgtatcttgtttttcaaaaagtacttgccccttcatccctgggatacttgagagacactgaccttcctgttcatagatagcaactcctagatcccygtatgggataaagaagagtgcttgctcctcatttgctctgtgcgctaacctggtcggggggtattgaaaaagggagtggacagagaagttagagctttag

SEQ ID NO: 54075 - DNA, 201 bp, Homo sapiens
ccaaagctgtgtccaattgggaagagagaaaaatgccctggaaacccctcccaggcctgggaccatccttccttaaccaccagccacctcacaggcccgcrgactgcgggcatcacctgggcaggctgtgcttactcactacccgggaaccctgtgccctggagctgtccttcctctcttcaaagtgcattttgtgccttt

SEQ ID NO: 54076 - DNA, 201 bp, Homo sapiens
ccacctaaatgtttttttattgcctgcccttcaccatgagtaatgccactttccattttaagctgggagcttcaggagatgactgcattacaagccagggttttaaagctaagagctgcctgggggattactcacccatttcaagacgctgcccacaatgcaccctcccactcaggatgctgctggaagatcttcttcctt

SEQ ID NO: 54077 - DNA, 201 bp, Homo sapiens; identical to SEQ ID NO: 15742

SEQ ID NO: 54078 - DNA, 201 bp, Homo sapiens
gctaaatttttgaagggtgagtgtgacttagtcagaccatggtgaaagggtggaggaaaggagggaaggagggaggaagggagggagggagaaagagaaaragaaaaagagagagagaaaaaatactgttggcagcagcacaatgtttgggctaagacctgggtgagtatgagggtgtagggggactataaaaagaggcca

SEQ ID NO: 54079 - DNA, 201 bp, Homo sapiens
attcctagcccaatccacacccctttcctcccttttatgaagatgtcttcaaaaagacagtcagtagggggaattttagtctggagcttcaacttacatcraattgccaagtgacagagggcacagaaaccctctcttgaagttgtcatctcagccaagggtcccaatgtgaacacagcttcgtttcctctcactgcccac

SEQ ID NO: 54080 - DNA, 201 bp, Homo sapiens
ttggctgtaattcctagcccaatccacacccctttcctcccttttatgaagatgtcttcaaaaagacagtcagtagggggaattttagtctggagcttcawcttacatcgaattgccaagtgacagagggcacagaaaccctctcttgaagttgtcatctcagccaagggtcccaatgtgaacacagcttcgtttcctctc

SEQ ID NO: 54081 - DNA, 201 bp, Homo sapiens
actttatctgatattaatatagccacacgagttttcaatttttttttttgagacggagtcttgctctgtcacccaggctggagtgcagtggcgcgatctcmgctcactgcaagctccgcctcctgggttcacaccattttcctccctcagcctccccagcagctgggactacaggcgcccaccaccatgcccagctaattt

SEQ ID NO: 54082 - DNA, 201 bp, Homo sapiens
ggattaataactgcaacaataattagagaataatttcctcacaagcattccaaaccttcagctgcctgccacacccacaactcctcagctccccaagcacrcaagagactacgtggggagcagaattaccggcaccactcactgcacaaatggaaatgttcttaagcaaagtgcgtgccaatcaaatatttataaatcaag

SEQ ID NO: 54083 - DNA, 201 bp, Homo sapiens
cttctgtctcagggaaaacagcaatctcagattttataaaataacgatctgcggacaggaatctctcccatgactagaaggcccagacaattaaaaggcamccctgtgcaggttgataatgaaagcagaacacatgcaggctggccagatcctactctatggcatcccaagattgcagggatgagggagcccgggggagtg

SEQ ID NO: 54084 - DNA, 201 bp, Homo sapiens
agggtttcactgtgttagccaggatggtctcgatctccttacctcgtgatccgcccacctcggcctcccaaagtggtgggattacaggcgtgagccaccgygcccagccgagttttcaatttttttgttaacatttgtctggtatctatttttcattcttttgcttttaacctctctatgtcattatgttttaaatgtgtc

SEQ ID NO: 54085 - DNA, 201 bp, Homo sapiens
ctccccccatcagaagctggtgatctcccctctgcctctaccccaggtgggttgccatagaggctgagggattgacggaaacttcattgtgagggagttcmccgagtttcatatgtggcaaccagtcctaactccctgggaacctcttctgtctcagggaaaacagcaatctcagattttataaaataacgatctgcggac

SEQ ID NO: 54086 - DNA, 201 bp, Homo sapiens
ctggagtgcaatgccacaatctcagctcatcacaacctccgcctcccgggttcaagcgattctcctgcctcagcctcctgagtagctgggattacaggcaygcgccaccatgcccggttaattttgtatttttagtagagacggggtttctccatgttcgtcaggctggtcacgaagataagcacagttttatttattcca

SEQ ID NO: 54087 - DNA, 201 bp, Homo sapiens
ttcagagattgccaaatgtcccctttggagcaaaatcacccccagttgagaaccactgttctcatcactgcatttccaggtaacggcttcattctcccccyatcagaagctggtgatctcccctctgcctctaccccaggtgggttgccatagaggctgagggattgacggaaacttcattgtgagggagttccccgagtt

SEQ ID NO: 54088 - DNA, 201 bp, Homo sapiens
gagtgcaatgccacaatctcagctcatcacaacctccgcctcccgggttcaagcgattctcctgcctcagcctcctgagtagctgggattacaggcacgcrccaccatgcccggttaattttgtatttttagtagagacggggtttctccatgttcgtcaggctggtcacgaagataagcacagttttatttattccacct

SEQ ID NO: 54089 - DNA, 201 bp, Homo sapiens
agatcgcgccactgcacttcagcctgggcaacagaacaagactccgtctcaaaagaaaaaaaaaaaaagaaaagaacacaaagaaaaggcaatgaggggtygagatctaccaaccaaagctctgtgtgttccagcctctcctgccccttggcctctgccaagatgaacctcagagatgccccctcatcctcctagggaact

SEQ ID NO: 54090 - DNA, 201 bp, Homo sapiens
aatctcagctcatcacaacctccgcctcccgggttcaagcgattctcctgcctcagcctcctgagtagctgggattacaggcacgcgccaccatgcccggytaattttgtatttttagtagagacggggtttctccatgttcgtcaggctggtcacgaagataagcacagttttatttattccaccttatcccccttacgc

SEQ ID NO: 54091 - DNA, 201 bp, Homo sapiens
ttcctattcaaagaaattaaattaaaaatgaaaacaggccaggcgcagtggctcacacctgtaatcccagcactttgggaggctgaggcaggcagagcatraggtcaggaattcgagaccagcctggccaacatggtgaaaccccatctctactaaaaataccaaaattagccgggcatggtggtgcatgcctgtaatccc

SEQ ID NO: 54092 - DNA, 201 bp, Homo sapiens
aggaggaacacatccatcctaggtaccatgctcgtatatataggattttaaaaagatcatggggagatgtgctctgctacaagggtttgtgataaaggatwaaggattaattttcttttccttttttttttttttttttttttgagacagagtttcactcttgttgctcaggctggaatgcaatggcacaatctcggctca

SEQ ID NO: 54093 - DNA, 201 bp, Homo sapiens
acatctaccttcagtggctttatatactctgcaaaatatcctccttcatgggtattccacattgcttacacagtgacagggattaaaaacaaaactaaagsctgggcgtggtggctcacgcctgtaatcccagcactttgggaggctgaggcggacggatcacaaggtcaggagatggagaccatcttggctaacacggtg

SEQ ID NO: 54094 - DNA, 201 bp, Homo sapiens
ctatttaagttgtacaatgcaatggattttcttacaacttaacagagttgtgcaaccaacaccacaatccattttagaatattttccaaaagaagccccakgccttttaaccataattcccccatctccacccaccctggccctggataccctgaatctacttgctgtctttatggatttgcctattctggacatttcatt

SEQ ID NO: 54095 - DNA, 201 bp, Homo sapiens
gcttacacagtgacagggattaaaaacaaaactaaaggctgggcgtggtggctcacgcctgtaatcccagcactttgggaggctgaggcggacggatcacraggtcaggagatggagaccatcttggctaacacggtgaaaccccgtctctactaaaaatacaaaaaattagccgggcgcggtggcaggcgcctgtagtcc

SEQ ID NO: 54096 - DNA, 201 bp, Homo sapiens
gtgcctggcacattgtaggtgatcaataaaagttagccccttcctttgatctctcttaaacatataggattatgctgagaaattgacacaaaagtatatgygaaggttctctgaaaaccataaagtctgataaccatttaaaaaaaaaccagctttattgagataacacacataccatacaattcacctatttaagttgta

SEQ ID NO: 54097 - DNA, 201 bp, Homo sapiens
aggaacacatccatcctaggtaccatgctcgtatatataggattttaaaaagatcatggggagatgtgctctgctacaagggtttgtgataaaggataaakgattaattttcttttccttttttttttttttttttttttgagacagagtttcactcttgttgctcaggctggaatgcaatggcacaatctcggctcactg

SEQ ID NO: 54098 - DNA, 201 bp, Homo sapiens
cagggattaaaaacaaaactaaaggctgggcgtggtggctcacgcctgtaatcccagcactttgggaggctgaggcggacggatcacaaggtcaggagatsgagaccatcttggctaacacggtgaaaccccgtctctactaaaaatacaaaaaattagccgggcgcggtggcaggcgcctgtagtcccagctactcagga

SEQ ID NO: 54099 - DNA, 201 bp, Homo sapiens
ggcgcctgtagtcccagctactcaggaggctgaggcaggagaatggcgtgaacctgggaggcggagcttgcagtgagccgagattgtgccactgcaatccrgcctgggctaaagagcgggactccgtctcaaaaaaaaaaaaaaaaaaaaaaacaaaacaactaaaaaataaatgtcagtgtttgccttcctttgattctt

SEQ ID NO: 54100 - DNA, 201 bp, Homo sapiens; identical to SEQ ID NO: 15740

SEQ ID NO: 54101 - DNA, 201 bp, Homo sapiens
ggaacacatccatcctaggtaccatgctcgtatatataggattttaaaaagatcatggggagatgtgctctgctacaagggtttgtgataaaggataaagkattaattttcttttccttttttttttttttttttttttgagacagagtttcactcttgttgctcaggctggaatgcaatggcacaatctcggctcactgc

SEQ ID NO: 54102 - DNA, 201 bp, Homo sapiens
tattttaatgcagtatttttcaaaaatccaatttaatgcaaaaatatctgtgattaacaaaatattaaatatagcaaaatattaaataataataataaagrcaggatgagtaacagtgataatgtgagcaaaacaaatttgaaatgggcccctacgaggtttacattagtgtgcatatacagttgtgtggagtgagacaga

SEQ ID NO: 54103 - DNA, 201 bp, Homo sapiens
aggcaccgtgaaggtgcactcagggtcattttgtaaccaacagggtggacaggtaggtgagccggccgttgtctctccttcctttcccaaggacgtaattyccaatggacagctttctttggaaggcaaagaaaaagggactgtatttctatgttttgattaatctgaggctcatccctgagggctccgtgaaatgaatga

SEQ ID NO: 54104 - DNA, 201 bp, Homo sapiens
cacatccatcctaggtaccatgctcgtatatataggattttaaaaagatcatggggagatgtgctctgctacaagggtttgtgataaaggataaaggatthattttcttttccttttttttttttttttttttttgagacagagtttcactcttgttgctcaggctggaatgcaatggcacaatctcggctcactgcaacc

SEQ ID NO: 54105 - DNA, 201 bp, Homo sapiens
aggcaaagaaaaagggactgtatttctatgttttgattaatctgaggctcatccctgagggctccgtgaaatgaatgagcagaattttccatggccaactrtcctggctgccgggtcctatcggcaaaagcgtagtgtttatttacttttgctcgtgttatttttattccagttcagctgcagctcagtgcggaaagcgtg

SEQ ID NO: 54106 - DNA, 201 bp, Homo sapiens
agaagtcttccgaagtctcccaggtcctatagattgcttattacctggctctcagggcaacctggactttgccactataatactcagttcattcaaaatcrcttgcatggggaaaggtcttccccaccagaattcaaacttcaagagagcctctctgtgcctgccttgttattcacaatattccttatgtctggcacatag

SEQ ID NO: 54107 - DNA, 201 bp, Homo sapiens
cacatataccacttgatctgaggtcccaagacctcttacttgggcaattgcagctgatttccttgcctttcctccaattagtcactcagcagccagaatgwcattttaaaaatgcaaatctgataacatcacatcccagcctgagtattccatagtttcccacagttcttcagacaggtgcctacaggaccctgtgtagcc

SEQ ID NO: 54108 - DNA, 201 bp, Homo sapiens
aataactagtgcgaggcctccggggtgaagtctgagggagaagaaggaatatcctgggggtcgtagcaggtggaggtggtggcattgttggcaaagagagrtccatgccaacggaaaagcaagttcaaaggctcaaggtgagagtaagcatggcacatgtgagaactaaaaggagttcactcttgtttgaggccactgatg

SEQ ID NO: 54109 - DNA, 201 bp, Homo sapiens
gtccaggccatctgtgctatctgcttcgcggtacctcaccaacgcaacgtgagggtggagggcagaaccttggtcctggcctctcagcttttgtgggtttyagccagaccctaggtgttattttagtgcaactttggtgtttaatttgaggatgtgtgtggaccagaaggagggaccaaaacatgattcttttccccatgg

SEQ ID NO: 54110 - DNA, 201 bp, Homo sapiens
gagattacaggcgtgagccacggcaccaggcccaaggtggaactttcaagcctctgccctcatggtctggagggagagcctgacttaatcagaaaatacamaaataaaagtagaatttaagccccaaccggtgtcgtagaagacaggcaggcagcacaatgagagctgaggggtagaggaggacatccctgaagaagtcac

SEQ ID NO: 54111 - DNA, 201 bp, Homo sapiens
tcacctgggcaggctgtgcttactcactacccgggaaccctgtgccctggagctgtccttcctctcttcaaagtgcattttgtgcctttgctggaagaacsgactacaggtttgttcaatttcttacagtcttgaaagcgccacaagcagcagctgctgagccatggctgaaggggaaatcaccaccttcacagccctgac

SEQ ID NO: 54112 - DNA, 201 bp, Homo sapiens
ttctgaagcaacattgtttccaaattttcactattacaaacagcactgcagtgaatttcatgcattgatgtttgggcacttgtgtgagtccttctataggwcaaattcttaatgctggagttgtcagtcacggggtctacacataagtatgctgttttccttgaagggcttcttggattggtctgctcttcccttatggac

SEQ ID NO: 54113 - DNA, 201 bp, Homo sapiens
aacaaaattcggcccacctaagattgacaatacaaatgactatttgtgcagttaagtggcaaccactggtatataattattgtctcctgtaccaaatgaaktacataacttaggaagtgcttggaaaaaataaatgaaagaaaaaaatcattacctcttagttgtattttaaggaaggggaatctggtgatggttgagtgc

SEQ ID NO: 54114 - DNA, 201 bp, Homo sapiens
ggaaagctagctcacacagaagaagacaggaatacttctgacagttctgacccatctctcattaacctttccctatttcagagccacagcctgtggcactytggtagggtagcatgttggtcaaagcatgaaccctggaatgggactgtctgggtgtgaattctggatctgacgttcaatagctgcgtgaccctggtcaag

SEQ ID NO: 54115 - DNA, 201 bp, Homo sapiens
ggtgataatgatgtgtcacatagcttcattgattgtaacaaatggaccagtgtggttggtggggagtgctgtttaggggtgggactggggaagaggaattytctgtcctttctgctcggttttgctggaacctgaaactactcaaacaataaagactatgaatttcaaataaaaaggtaaaaaggttaagcaacccagctc

SEQ ID NO: 54116 - DNA, 201 bp, Homo sapiens
tctgtcgcacctataatgtgtttgactaaatatctacatatatgggcgataggttgaaaagagtcccaggcaactaacctcactccattccatggctacaratgggatcctggatggccacccaccatcttgtccatgtgtgatcttgaacacaagagggtccaagcaggagagtatcgctggatttggatcaatccattc

SEQ ID NO: 54117 - DNA, 201 bp, Homo sapiens
gagggtgatgatttttattctaagaccacttgataatcaatatgtattgatgatcacattcactactcacacttacaaagtacagctcccaggccgggcgyggtggcttacgcctgtaatcccagcactttgggaggccgaggcaggcggatcacgaggtcatgagttcaagaccagcctggccaacatggtgaaacccca

SEQ ID NO: 54118 - DNA, 201 bp, Homo sapiens
tggggtttctgtcgcacctataatgtgtttgactaaatatctacatatatgggcgataggttgaaaagagtcccaggcaactaacctcactccattccatrgctacagatgggatcctggatggccacccaccatcttgtccatgtgtgatcttgaacacaagagggtccaagcaggagagtatcgctggatttggatcaa

SEQ ID NO: 54119 - DNA, 201 bp, Homo sapiens
ggatcgcctgaagtcaggagtttaagaccatcctggccaacatgatgaaaccctgtctctactaaaaatacaaaaaaaaaaaaaaaaaaactagccaggcrtgatggtgcgtgcctgtaatcccagctacctgggaagctgagacaggagaatcgcttgaactgggaggtggaggttgcagtgagctgagatcacaccaca

SEQ ID NO: 54120 - DNA, 201 bp, Homo sapiens
gtgtgtgtatatatatatgtcattcagtctctggactgtatcaaaattttccagacaactttttcagaccttaaagaagcagacaccttttaagataaggttttttttttcatatatatttacatatatgtgtgtgtgtgtatatatatatatatatatatatatatatatatatatagatgtgtatatatatttatatat

SEQ ID NO: 54121 - DNA, 201 bp, Homo sapiens
tgatgggcacagtttgtgagaaggttcatgttgtcccctaagcttcagctcagggggacacataagtggtgtcaccatgagagggggaggtcctggaagargatcaggtccaggggaagatggccagttccattttggacacaagcattgaggagtgtctcacgtaccatgcagctgtcctcagggttataattctccatt

SEQ ID NO: 54122 - DNA, 201 bp, Homo sapiens
tgtgtgtatatatatatgtcattcagtctctggactgtatcaaaattttccagacaactttttcagaccttaaagaagcagacaccttttaagataaggttttttttttcatatatatttacatatatgtgtgtgtgtgtatatatatatatatatatatatatatatatatatatagatgtgtatatatatttatatata

SEQ ID NO: 54123 - DNA, 201 bp, Homo sapiens
atgtctctactggtggacttctagcctgcagagaaggtggttttggtttgtcccatttccattccttagatcgctgctgcaggcaattaccaatatggacygtgaacattggttacgctgccatgctaggaaggccaggcagaatcagccagggagtgctgcatagattccagggctgatgggcacagtttgtgagaaggt

SEQ ID NO: 54124 - DNA, 201 bp, Homo sapiens
ctctggactgtatcaaaattttccagacaactttttcagaccttaaagaagcagacaccttttaagataaggttttttttttcatatatatttacatatakgtgtgtgtgtgtatatatatatatatatatatatatatatatatatatagatgtgtatatatatttatatatatgtatatgcatatatatatatttttta

SEQ ID NO: 54125 - DNA, 201 bp, Homo sapiens
gcatgagacggatgctccctgactaaatgtgatccacacggcctggcaaggagatatttttgattccttgatcactagtttgagcataattagagactgargtgacagagtcacacgttaagacttccttcagaaagagcgtttctaaaagccaatcgaaaaatttaaacaaatcacacaagatagaaccgtatgcctttg

SEQ ID NO: 54126 - DNA, 201 bp, Homo sapiens
tctggactgtatcaaaattttccagacaactttttcagaccttaaagaagcagacaccttttaagataaggttttttttttcatatatatttacatatatgtgtgtgtgtgtatatatatatatatatatatatatatatatatatatagatgtgtatatatatttatatatatgtatatgcatatatatatattttttac

SEQ ID NO: 54127 - DNA, 201 bp, Homo sapiens
atgataatattagtgtccacttcaagggattatggtgagattacttgagataacctgtagcccaaaatacgttaatgatgagggtgatgatttttattctragaccacttgataatcaatatgtattgatgatcacattcactactcacacttacaaagtacagctcccaggccgggcgcggtggcttacgcctgtaatcc

SEQ ID NO: 54128 - DNA, 201 bp, Homo sapiens
tcaaaattttccagacaactttttcagaccttaaagaagcagacaccttttaagataaggttttttttttcatatatatttacatatatgtgtgtgtgtgwatatatatatatatatatatatatatatatatatatagatgtgtatatatatttatatatatgtatatgcatatatatatattttttaccactggaatta

SEQ ID NO: 54129 - DNA, 201 bp, Homo sapiens
ttgcgattcagctccatcgcttactagctgttgcccttgggcaggtcactgaacatctgtaagctttggttttattaaaaatgatgataatattagtgtcyacttcaagggattatggtgagattacttgagataacctgtagcccaaaatacgttaatgatgagggtgatgatttttattctaagaccacttgataatca

SEQ ID NO: 54130 - DNA, 201 bp, Homo sapiens
ataaggttttttttttcatatatatttacatatatgtgtgtgtgtgtatatatatatatatatatatatatatatatatatatagatgtgtatatatattwatatatatgtatatgcatatatatatattttttaccactggaattattttcccccaaattcgatttttccccttctctgtctttctctaatgttttacca

SEQ ID NO: 54131 - DNA, 201 bp, Homo sapiens
ctgaggcaggagaatcgcttgaacccgggaggcagaggttgtagtgagctgagatcacgccactgcactccagcctggcgacagagcgagaccctgtctcaaaaaaaaaaaaaaaactgacgcaagatctggtgaagcattttatcaaagaaaaatacaaaaaaaattattatcttttatttgtaaaaaaaaaaatacatg

SEQ ID NO: 54132 - DNA, 201 bp, Homo sapiens
cccattgcttcctggccggtcccacatcctgctggacctgcgttggctggctcatgtttctcattatctctcccccagcctctttaaaggcttctcactcyacccaagggttttatttttaacttgcacagtaacactagggttgagcagggataccacctacattcacaggaaatggggctgccttggaaaggtgtcccc

SEQ ID NO: 54133 - DNA, 201 bp, Homo sapiens
cttcagccttcagagcagctgagattgcagcacaaataacactttttataaaatgtaatactgttacataaggcaatgttactgtttttcaatgttactgyttaataatttgtttttatcatcctcattaacatttatacaatgcagcactgtgttaagcaccttacgtaactttacctcattttatcctcaaaataaccc

SEQ ID NO: 54134 - DNA, 201 bp, Homo sapiens
tgcagttgacaggcgtgaccagctcctaactgggagggcttggcaccaaccacatcttctgcttccaggattaaggctccttctgtatcccacaaccatcygacaccaacatcatgacagtggttccgccccacaaactgattcaataaacacatctgtgttatggatcagatgggtgtaggtcgggtcccaacactgctg

SEQ ID NO: 54135 - DNA, 201 bp, Homo sapiens
gtatcccacaaccatccgacaccaacatcatgacagtggttccgccccacaaactgattcaataaacacatctgtgttatggatcagatgggtgtaggtcrggtcccaacactgctgttcaccagttgtatcatcctgggacagttacttctcaatgtgcctcagtttccttgttttaaaaacaagaatgacaacagcacc

SEQ ID NO: 54136 - DNA, 201 bp, Homo sapiens
ccacaactcctcagctccccaagcacgcaagagactacgtggggagcagaattaccggcaccactcactgcacaaatggaaatgttcttaagcaaagtgcrtgccaatcaaatatttataaatcaagccacatcctaaaggcgctagcagagttcactggtcaaaacaatcctaccttgcagccctttctaaagggcagat

SEQ ID NO: 54137 - DNA, 201 bp, Homo sapiens
cttttcatgcccctggggtttcctttagcaacaaaaagggatttcattttttatatgtttcagctgagtcatcaatctcagttaccatggtctgtcagttycatgttgactccaggcttattttcagaagcctacatgtctccttcaggttttcagttgtggatctgaagggtttggggagccatctgacatcagtatagg

SEQ ID NO: 54138 - DNA, 201 bp, Homo sapiens
gtgctggaaaggtgggacctgctgcagcagcccaggtgagacaggtgctgggtctgtgctaaggcaacagaagtgaggctggagaaaagaggatggctttrggagacactaaaaaggtaaaactgaaagggcattttcaccaactgaacaggtgggagtgatttctattctgcccaaagaatagtctgaatgaaacaaatt

SEQ ID NO: 54139 - DNA, 201 bp, Homo sapiens
aaagaaggcagtgctggaaaggtgggacctgctgcagcagcccaggtgagacaggtgctgggtctgtgctaaggcaacagaagtgaggctggagaaaagargatggctttaggagacactaaaaaggtaaaactgaaagggcattttcaccaactgaacaggtgggagtgatttctattctgcccaaagaatagtctgaat

SEQ ID NO: 54140 - DNA, 201 bp, Homo sapiens
ttgtgttctttttcttttcttttcttgagatggaatctcgctctgccgccaggctggagtgcagtggcacgatctcggctcactgcaacctccttctcccrggttcaagcaattctctcgcctcagcctcccgagtagctgggattacaggcgcccaccaacacatctggctaatttttttttttttgtatttttagtaga

SEQ ID NO: 54141 - DNA, 201 bp, Homo sapiens
gagaatccacgtagagtgcctaaaatgttttagcacgcaatgcacagcacctagtatttgctcaataagatatgaatgattgttgcggctggcaaattttytggcaaaggttttttggaagtcttcatgagaatgtacttgaattcaaaaaatggtactaggacatgcaggtcacctgtttccctgctgttcctttgtcgg

SEQ ID NO: 54142 - DNA, 201 bp, Homo sapiens
cccaagagattgtgtgaaagacaggaaaaagtaggatacttggagtactcgacctggggtctggtcatgatttttccccttcttagaagtataacattgcrtaaaacacactctcaccaaacttcagctcttcaccaaaggacagagcaagcaccaccttcctccagggaacacttcgaggagaaaaggccacaaaagcac

SEQ ID NO: 54143 - DNA, 201 bp, Homo sapiens
acaatcatgactcactgaagcctcgaactcctgggctcaagaaatcctcccccctcagccccctgagtagctgggaccacagatgaataccaccatgcccrgctaatgtttttattttttgtagagacaaggtctcactatgttgctgaggctggtctcaaactcctgggctcgagcggcctcagccttccaaagtgctgg

SEQ ID NO: 54144 - DNA, 201 bp, Homo sapiens
aacccgcatgctgggattgctaactgttcttccagagatgccgggatattgtctgtctagtagaaatgtgagttttgtcctttttattttttaatgttttragggaggctgggccccttggaaatggggatgacattataaactggtatttcgggactgagggttttattattgactaagccacagatttgctttggtaag

SEQ ID NO: 54145 - DNA, 201 bp, Homo sapiens
aggatagaaagcttaataacttaattcaacatttatcaaatgtctcctgtgtctaagtgccatgttaggtactgaaagggtgtgaggatgaatgagctgcaatggagaggcatagtctaattgtttcttcagtagctaaaatcctccatgttccctgccctttccctatcatagctagtgctttatacaggtttgaccatg

SEQ ID NO: 54146 - DNA, 201 bp, Homo sapiens
tggaggcaaatgctctgcctggaaatgttatgggttaatgaaaatttttgcagcccagcgcagtggctcatgcctataatccctgaaatttggaaggccarggtggaaggactgcttaagcccaggagttgaagaccagccggggcaacatagcgagaccttgtctctactaaaaatatatatatttttaaattagctggt

SEQ ID NO: 54147 - DNA, 201 bp, Homo sapiens
tcgccaactgtgcatggcagtgcctagttcccacattctaagtcttgcaaatggttttttatctttgcacaaatttttttttatctttgcacataggatarctaacatatgataaataatttttaatttgcatttttctcgttagcagtattgaatgttttcataggtttgttgttcatttttaaaacatcaaataaaaca

SEQ ID NO: 54148 - DNA, 201 bp, Homo sapiens
gtctgagatagaggacaaggaagtcaggagggcttccttagataggctgggcctaacgcaattagatttggaggcaaatgctctgcctggaaatgttatgkgttaatgaaaatttttgcagcccagcgcagtggctcatgcctataatccctgaaatttggaaggccaaggtggaaggactgcttaagcccaggagttgaa

SEQ ID NO: 54149 - DNA, 201 bp, Homo sapiens
agaaaaataatcaagccttcccttcctttctaggctgcactgctttcttctatcttgatgtagaaaaaatatcacccagactagggagtctcacatcagamtcctctgtggaatcttgttgaacatgtgggtgccagccccgactcagcccagcaagtcagaaccctttgttgggggaacctatgtgattcccaggcaggt

SEQ ID NO: 54150 - DNA, 201 bp, Homo sapiens
aacaagagtagatttggacatatttcagtggctttgctaaaaagagaaaaataatcaagccttcccttcctttctaggctgcactgctttcttctatcttratgtagaaaaaatatcacccagactagggagtctcacatcagaatcctctgtggaatcttgttgaacatgtgggtgccagccccgactcagcccagcaag

SEQ ID NO: 54151 - DNA, 201 bp, Homo sapiens
ccagggtctcagagactaatgaaggagtcagtgaagtaaacgtagttaaattacattcatttgcccattcaacagatgtttatcaaatgcccatcaggtgycaggcattttgctaggcactgggataccattgtgagcaagaccaattggtttgtactatcatggagctgacagtccagtcatgaaaagagacattaaata

SEQ ID NO: 54152 - DNA, 201 bp, Homo sapiens
ctgtgttagaaaaagacctggatgctgccctcaggaaattcacagaccaaaagatgagatagatgaataaacagatcatgtcagtccagcatggtaaatgmgatgttagaattacatacaaggtggaacttttcttttttgagacagagtctcgctctgttgccaggctagagtgcagtggcatgatcttggctcactgca

SEQ ID NO: 54153 - DNA, 201 bp, Homo sapiens; identical to SEQ ID NO: 15732

SEQ ID NO: 54154 - DNA, 201 bp, Homo sapiens
gttggtgatagggaacagggacttgatgagcaagaatcaataattatctctatatttgcttcacttttttctataaaaataatctaggggaaaaacacttsctttagaagagcaaagttcatcacaacaaagagcagaatgggacactgaagtcccttagtgcgtagcagagtccttaggtcaagattctacaagctgaaa

SEQ ID NO: 54155 - DNA, 201 bp, Homo sapiens
gcttctgtcctgcagttctggtgatgtttgtggctggctggtctccttgagcaacgaatacaatttcccatgaatgtctgctgcatttcccattgccctckgtcatcgtggcgcttgcttcaccatgagaccaggacacccttcatctaactgcctcattgggcataaacagagggaaatgtgttgctggagggagagagt

SEQ ID NO: 54156 - DNA, 201 bp, Homo sapiens
ccctgttgctttaggggagtccagacttctattttctggttgggatcactcagcacctagcagttaaggcactttattccccaccaacatagacccgaagycaaaacagtttttcaaatgaccacgatggggagagctggaccccactgccagaagtcagagagaaggggaggtctccaggcaggaatgtactccgcgaca

SEQ ID NO: 54157 - DNA, 201 bp, Homo sapiens
tcactcagcacctagcagttaaggcactttattccccaccaacatagacccgaagtcaaaacagtttttcaaatgaccacgatggggagagctggaccccrctgccagaagtcagagagaaggggaggtctccaggcaggaatgtactccgcgacagggttctctcacctcggtcatatgtgatgggaaggactccttgcc

SEQ ID NO: 54158 - DNA, 201 bp, Homo sapiens
cactttattccccaccaacatagacccgaagtcaaaacagtttttcaaatgaccacgatggggagagctggaccccactgccagaagtcagagagaagggraggtctccaggcaggaatgtactccgcgacagggttctctcacctcggtcatatgtgatgggaaggactccttgccctcctccccacaaccctcatctga

SEQ ID NO: 54159 - DNA, 201 bp, Homo sapiens
gtaaaggagcaggactctggattctattgcgggcacatacagtcacaaatccaccaagtaaacacttccagccctcttcccgtacatttttacaatgcttwatctgagtttgaatttctccaagaaatttctatcgttagagtacctttttaaaagttgctttccatttcttcagctaaattaattgttaatgtccccatt

SEQ ID NO: 54160 - DNA, 201 bp, Homo sapiens
ttgcctccctcctttctgcactggtgactggcacttttcctttcattctctacagggatgcgattgtttacgagttagctccccgacccagtgggaggacwtgagcatcccggctgagggcgagccaggctgcccctccaccagctctgtgtaacagtgagccagcagcagtggcatcagggctgaaaggagtgggcctcg

SEQ ID NO: 54161 - DNA, 201 bp, Homo sapiens
tgcctccctcctttctgcactggtgactggcacttttcctttcattctctacagggatgcgattgtttacgagttagctccccgacccagtgggaggactygagcatcccggctgagggcgagccaggctgcccctccaccagctctgtgtaacagtgagccagcagcagtggcatcagggctgaaaggagtgggcctcgc

SEQ ID NO: 54162 - DNA, 201 bp, Homo sapiens
ggtcagcaaagcagaactgtggagcaaatcagataaggtgcagatgcattggtgtacctgctagtggcccgtgcctcccgtctcactgcagaagcagaaawtccggctccagcctcacacagcaaaacagagcaagaaggagggggagtcttcacttatgttgcctcaccctctgttttattttcttcccaccagcagcaa

SEQ ID NO: 54163 - DNA, 201 bp, Homo sapiens
gcctttccaccaggcaccatcatggtcagcaaagcagaactgtggagcaaatcagataaggtgcagatgcattggtgtacctgctagtggcccgtgcctcycgtctcactgcagaagcagaaaatccggctccagcctcacacagcaaaacagagcaagaaggagggggagtcttcacttatgttgcctcaccctctgttt

SEQ ID NO: 54164 - DNA, 201 bp, Homo sapiens
gggggatggagagaagaccaacaagattccatctccttcctcactagggtttataatctaaagaaacaaacatgctcacacatagagaacaatgaacaatrtaattggaaaccgccagacagggaatcaccaaccactgtgggtgaagagagactgcaggggtcacacgacttgaaaaaggcaaagcaaagtcagatgtct

SEQ ID NO: 54165 - DNA, 201 bp, Homo sapiens
gtccagtcatctggtgagtccaaggcagggtgcagaagagcagggacgacagtcctggatgcccaggctgcatggcaggcaatgagggagctctggctccyagcactgtttgtcaactattaagatgccatggtggctgggcatggtggctcacacctgtaatcccagcactctgggaggccgaggcaggcagatcacgaa

SEQ ID NO: 54166 - DNA, 201 bp, Homo sapiens
aaacatgtcagatctaccctcttggcaatcttcaagtataccacacattactgactatagtcaccatgctgtacgatagatctctagaacctattcatttygtctaactgaaaccttgtaccctttaaccaacatctcatttccagtcacctctccccagctcctggcaaccaccattctactctctacttcaatgagttt

SEQ ID NO: 54167 - DNA, 201 bp, Homo sapiens
tctctcaacaactatttttttccagctttattaaggtattattgacaaataaaagttgcacatatttagggaatatgatgtgatgttttgatctatgtgtmcattgtgaaatgattactatgatcaagctggttaacatatccatcacctcgcaacattatcgttttgtgtgtgtgtggtgaaaacatgtcagatctaccc

SEQ ID NO: 54168 - DNA, 201 bp, Homo sapiens
accccacctggcaaaggcctcagctccaatgccgcttctcagagagacccccccccccaccatactccacctcctggtgcactctccccttccagcccccrtgggctcctttctaccaggagatacgggaattagcaccattttagattttcttagctgttcacttttaaaaatttaatacctccccctataggaataaaa

SEQ ID NO: 54169 - DNA, 201 bp, Homo sapiens
tggagagactatcacaagctaaacagctttagtccttgtcctcagggagctaacagtctgggggtgtggggataaacagacaattatagtaaaatatcatracagaatatgctaaatcatatgacatgcatgctcagggagttttggaaaccaacagccagaggatttatactaaggtaggtatgaaggatgaggaggagc

SEQ ID NO: 54170 - DNA, 201 bp, Homo sapiens
aactacaagtttatgaacatgtgcattgtgtgtgcacatgggagcacgcagtactgactacctcaacgcggtggtgagaacttgggtttatatagcagctyaacagaagggcgaaagatttttagagaagtgacaagacaaaggaaaaggacttcaagtttctagagcagcaaattttgaaagtaaacatatgggagaaat

SEQ ID NO: 54171 - DNA, 201 bp, Homo sapiens
tattataagtattgtataaaactaccttcagactaggtatataaagtgtatatgaaacataaatgaatttagtatttagatttgggtcccatctaaacagrtaggagtggagtggtctaccatcttaggcccattggtgaggccctttaaattagactgacaaaagacaaattaagaggagaactacaagtttatgaacat

SEQ ID NO: 54172 - DNA, 201 bp, Homo sapiens; identical to SEQ ID NO: 15737

SEQ ID NO: 54173 - DNA, 201 bp, Homo sapiens; identical to SEQ ID NO: 15739

SEQ ID NO: 54174 - DNA, 201 bp, Homo sapiens
gagactgaggcatggagagctttagtattttgcccaatgtcacacagctagtaaatggggacccccatgtgaaactactcactgattgtcctactctcttktggttttatctttttagcagacaccaaatgaggaatgtttgttcctggaaaggctggaggagaaccattacaacacctatatatccaagaagcatgcaga

SEQ ID NO: 54175 - DNA, 201 bp, Homo sapiens
tgaccacaagtagcatctatttataagattctttttataagtagcaaaaaataaagctattttcattttaaaaaatctacattctaggatatgtttcatgyttaggataaattttgcacaagcatatcttcataacaatactcaggtaaaatcctgacgttagtgaaaatcaccaggataaaaggcattttagcagctttt

SEQ ID NO: 54176 - DNA, 201 bp, Homo sapiens
gatttttttcaagtaactgcactctttaatacgttgtggctgattttcaacttaataaatgtacagctgcactgggttctactgtacggatattcttttayccacttaaccaatcacctttccatggacatataggttactcctaatcgcttgcccctataaccattggttcagagaccatcctcaaaaatacagttgtac

SEQ ID NO: 54177 - DNA, 201 bp, Homo sapiens
ataggtctttatgggaaaggaatagaaatagaggcaatgtgattttgcccctattggtatctctgtgacaggagttaactggagagacagcttaaaccaaygactgcgggttttgaagttatttctagattttaatgttccctcctctgtatcctaacagttgataaactaaggcttggctgtaattcctagcccaatcca

SEQ ID NO: 54178 - DNA, 201 bp, Homo sapiens
gaaatatgatcttagtatattacgcctaagaatgtttgcattttccccattgataaagagaagttctaagatatctcaaagctctgcttcatgctcttcayaaaatttaggcactaatccatcctgattcaaacttgtgtgtgtggaaaggatatgtatattttttttaagtttgaaaggctatatatcaaaatactgata

SEQ ID NO: 54179 - DNA, 201 bp, Homo sapiens
gtcacttacccactctgagctttgtctaaaatgaggacagtcatggatcataaccgcctcacacagagcgtacatgggttcagtggtgcaacacacagaaygcgcccatcagagtggctggcacgtcacagaccagtggtggctgtaagacaagtcatcagcttagaagcccctcaccctcactgtgtcttaggttatgcc

SEQ ID NO: 54180 - DNA, 201 bp, Homo sapiens
agtgggaggacttgagcatcccggctgagggcgagccaggctgcccctccaccagctctgtgtaacagtgagccagcagcagtggcatcagggctgaaagragtgggcctcgctttgggaagtgatgtctagtgaagggtggccagcagtttactggagctgtttgtcagtgtggatgactgaggattttggtggagactc

SEQ ID NO: 54181 - DNA, 201 bp, Homo sapiens
ccacagatgaataccaccatgcccagctaatgtttttattttttgtagagacaaggtctcactatgttgctgaggctggtctcaaactcctgggctcgagyggcctcagccttccaaagtgctgggattataggccaccacacacagcccaaaaatgtttcttgagtacctaggtactacgtgctataggtgtgtctctta

SEQ ID NO: 54182 - DNA, 201 bp, Homo sapiens
atggatatataattaattacagatgatggtgaatgttggaagaaagagaacaagaggctgcaaaagagaatcatggaggtagagaaggaacttaccttagytggggagaccagggaagacctctgaggtggtggtactttagctgccctctgaaaggggcatgggaggcagcccatgggaaactgttagggaagggcactg

SEQ ID NO: 54183 - DNA, 201 bp, Homo sapiens
tttgggaagtgatgtctagtgaagggtggccagcagtttactggagctgtttgtcagtgtggatgactgaggattttggtggagactctgattcacagtcrcaaattcccttttcctttgttttctttgtgttggtctttgagggcttccgaggaaagtcccctcttgagatgttgatctgaaggcaagatcaacaatttg

SEQ ID NO: 54184 - DNA, 201 bp, Homo sapiens
gttgtactaagtgccatgaaagaaacaaggggcagaggaggaagaggatgtgggggagggtggtattggcagggagaatggggtggggatgaaaggacccygtgcgcagagtgtcacacactctggggagggcctcttttaggatatttaggctgaggcctggaggagaaggaccttgtgaatatctggaggaagaatgtc

SEQ ID NO: 54185 - DNA, 201 bp, Homo sapiens
gaggctggagaaatcacttgaacccgggaggtggaggttgcagtgagcagagatcgcaccactgcacttcagcctgggcgacagaacgagactctgtctcaaaaaaaaaaaaaaagtgtcaaaagggtacacagctggtgatagtcaagctaatatctatcgaatgcttacaagttctcaagtgctgagattacagtgact

SEQ ID NO: 54186 - DNA, 201 bp, Homo sapiens
ccaatgctaactgcttaaaacatttctctgtctttaactttttcgttgttttcccctttcctttttaataattaaattatactacttacgagagggagcayaacacattagctaagtacatagattctgtagctgggctgcctgggatccaaattctgccacttattagtcctgtgactttggcccttggtttcctcatct

SEQ ID NO: 54187 - DNA, 201 bp, Homo sapiens
ttacacaacctctttgattccataaaatagagataatagcagcggttctgtcctagggttgttgacaggaagatgtgagttaatatatctaaagtctatastacatgccagcactgcatcagtgtaacttgttcctatctcataggattggtgtaagaatgtagggagagaatccacgtagagtgcctaaaatgttttagc

SEQ ID NO: 54188 - DNA, 201 bp, Homo sapiens
gcgagccgagatcgcgccattgcgctccagcctgggtgacaaaagtgaaactctgtctcaaaaaaaaaaaaaaaaatagaggagaaaaggctgcttacaaktccatttgttccaaagcccaaagtgacactctataagtgacccctggtgccactgctagggtagcttggagacacatttgctttggcatggagctttgtt

SEQ ID NO: 54189 - DNA, 201 bp, Homo sapiens
tgtggctttgtccaggggttttcaaattttaatgtgcataagaatcacaggggaacttgtttaaaaatcaggttcctggttgctccccacaattttgattyggtggcttcataagggacccaggattctgcattttctgggtggggcctaggtaattctgttgcctttggtccacagagcacaattaaagaagatcaggtc

SEQ ID NO: 54190 - DNA, 201 bp, Homo sapiens
gctttttaaacttaatataatgtgttcaaggttcatccacattgtagcatgtatcagtactgcattcctttttatggttgaatgttttgcatggatatgcwaccttttgcttatccactcatcatttgttgctttccatttttggctttatgagtaactctgctatgaaaattaatgtactcttttttgcatgaatatgtt

SEQ ID NO: 54191 - DNA, 201 bp, Homo sapiens
aggcatggtggtgcgtgcctgtaatcccagctacttgggaggttgaggcaggagaatggcttgaacctgggaagcggaagttgcagtgagccgagatcacrccattgcattccagcctgggcgacagagtgagacttggtttcaaaaaaaaaaaaaaaaaaaaaactgtacagaaaaagacctgaaggagagcatccaaaa

SEQ ID NO: 54192 - DNA, 201 bp, Homo sapiens
tgagtcatcaatctcagttaccatggtctgtcagtttcatgttgactccaggcttattttcagaagcctacatgtctccttcaggttttcagttgtggatstgaagggtttggggagccatctgacatcagtataggcaccctcatgatgctccctctcactgaggggatcaggcagagagcagagttgtggccttgtatg

SEQ ID NO: 54193 - DNA, 201 bp, Homo sapiens
gtggtcctgaaaaaccacatggcaggggaacttgaccccaacagggggtcctggaaagcttccatgaggaggtgaggcttgggttgaggtctgacggatcrgcagatttcaactggtgagggcagaatatttcaggtggcagggagaggagcatgcacaaaggttgcctggtgtgaggaagcctggcatcaccaaggagcg

SEQ ID NO: 54194 - DNA, 201 bp, Homo sapiens
ctacccaagggttttatttttaacttgcacagtaacactagggttgagcagggataccacctacattcacaggaaatggggctgccttggaaaggtgtccycctctccagggactttctccctccctgcctcccttcctttcatatttagggagcacctaccccaggtgggccctccccagaggtagaacaacacaagagc

SEQ ID NO: 54195 - DNA, 201 bp, Homo sapiens
ttctttaaaggagaatgagtaacacaaatgtcacgccctagcatggtgcctggcatagaagagcagtcagtcaatgtcatctccatccctccccctgcacrcccttactccactttccccttctccttctcagaggaaacatctgtctatccagtgcctcccaaactggaagatgcctaaaaatcacctggggatgtttat

SEQ ID NO: 54196 - DNA, 201 bp, Homo sapiens
gggcagaaggaagtggaggggacagggagtgagtgagcagatgtgcccagcatgagcctgcccgcccggggcctggcgtggacacacgtgtgcactatgaygaggtgatgaggaagggctgcggccaccgccgaggcacccactcctccagccagacccagacagacgcaagcactactgggctgcttctgtgctgtgatg

SEQ ID NO: 54197 - DNA, 201 bp, Homo sapiens
cctgtcagtactggaactggatattccactgaagagtcagcaggctcgagttcaagcctactctgcccctttctacctggagcagccctggacaattaackttcttgccattatgcattctttctgtttgcaaactctgcgaaagaagcttcaagccccccagccctgggacgcttccagtcctttcctgactagaaattg

SEQ ID NO: 54198 - DNA, 201 bp, Homo sapiens
tcctgtcccactatgaccctccctaaggcttccccacctcccactgaggtctgagggtttaatacacagctggttcagggtggatccagatgcatgcggcrcaggggggagcgtttccaaggcgatggccgggttgtttctaacgacccattgacctgaccctccccacctcacgccgcccctgaaccaagccaagccttt

SEQ ID NO: 54199 - DNA, 201 bp, Homo sapiens
tgcattctttctgtttgcaaactctgcgaaagaagcttcaagccccccagccctgggacgcttccagtcctttcctgactagaaattgaagtgtctctagygttcccagataattttcaggaaaatcatttagtctcgctgagactcagtttcctcacctgtggaatgggaatggcagcattgcccagtgtgcctcacaag

SEQ ID NO: 54200 - DNA, 201 bp, Homo sapiens
aggaaggccttatggcttctcgttccctccaggcctctccctcttattctgacccgtggcaggcagaggaggggtgtggagtcccttgttctaagaattayaaagaatatctctttagaaacctctaaccacgtcttgctctaggatggaagcatatcctgaattggccactttaaagtcttttcatacactgcagatcca

SEQ ID NO: 54201 - DNA, 201 bp, Homo sapiens
caattgcagcttttgttattgtgttgctgtatcactcccaggttcatttgtctgtatccctaatcatgcagaagccccaagtgcagggaccatggctggcrctgagcgtaagtcccagcacctagtagatgaatatgtgttgactgaatggttttctgtcccccaaccctgagctgctacccgaggaaaaagctgctgctg

SEQ ID NO: 54202 - DNA, 201 bp, Homo sapiens
agacccaagggaggcccaagggctcactctgcctcagcagaattcaaacactccattattctctagctatgttacatccacccaccaccccaccacccccrcttgcctccctcctttctgcactggtgactggcacttttcctttcattctctacagggatgcgattgtttacgagttagctccccgacccagtgggagga

SEQ ID NO: 54203 - DNA, 201 bp, Homo sapiens
ctaaccacgtcttgctctaggatggaagcatatcctgaattggccactttaaagtcttttcatacactgcagatccagagagaggcttctggtgactaatygggagtcgtgcattggtcagactattgcagccccaaagtcagtgtttttccggagccaagatcccattgcttcctggccggtcccacatcctgctggacc

SEQ ID NO: 54204 - DNA, 201 bp, Homo sapiens
taaaatacacacacacacacacataatatatcacatatactatatatatatgatatatatgtgtatatatactatatatatatgatatatatgtgtgtgtrtatatatatatgtcattcagtctctggactgtatcaaaattttccagacaactttttcagaccttaaagaagcagacaccttttaagataaggttttttt

SEQ ID NO: 54205 - DNA, 201 bp, Homo sapiens
acatccatcctaggtaccatgctcgtatatataggattttaaaaagatcatggggagatgtgctctgctacaagggtttgtgataaaggataaaggattamttttcttttccttttttttttttttttttttttgagacagagtttcactcttgttgctcaggctggaatgcaatggcacaatctcggctcactgcaacct

SEQ ID NO: 54206 - DNA, 201 bp, Homo sapiens
aattcatagctcaggaaatgtgtttatgatcctggtggaattgtgtagagatttccctaaaccactgtcataggcagcacatgtgataaagcgcttctgamggctgggccaagtttttccatttttgtctaactatgggaaatactcagaaacatcttagtgtatgtgcaatagtgtgctctcaaaaccgaaatggcccta

SEQ ID NO: 54207 - DNA, 201 bp, Homo sapiens
atcctaggtaccatgctcgtatatataggattttaaaaagatcatggggagatgtgctctgctacaagggtttgtgataaaggataaaggattaattttcytttccttttttttttttttttttttttgagacagagtttcactcttgttgctcaggctggaatgcaatggcacaatctcggctcactgcaacctccgcct

SEQ ID NO: 54208 - DNA, 201 bp, Homo sapiens
aacagccatttattgagccccaggggctgtgctggggacataatcgtgagaaggaagctcatgcttctgtcctcgactggcttgtagtctagtcaagaagrcttgagggctgatgagcttttcagagatggaaatagaggatactgtgccccgtggcctctgctctgcccagccccctaccagtaaccaacaattttccag

SEQ ID NO: 54209 - DNA, 201 bp, Homo sapiens
cttgccccttcatccctgggatacttgagagacactgaccttcctgttcatagatagcaactcctagatccccgtatgggataaagaagagtgcttgctcytcatttgctctgtgcgctaacctggtcggggggtattgaaaaagggagtggacagagaagttagagctttagaggtgcctcatccacccgtcctgcctcc

SEQ ID NO: 54210 - DNA, 201 bp, Homo sapiens
taggtaccatgctcgtatatataggattttaaaaagatcatggggagatgtgctctgctacaagggtttgtgataaaggataaaggattaattttcttttycttttttttttttttttttttttgagacagagtttcactcttgttgctcaggctggaatgcaatggcacaatctcggctcactgcaacctccgcctcccg

SEQ ID NO: 54211 - DNA, 201 bp, Homo sapiens
ggaagctcatgcttctgtcctcgactggcttgtagtctagtcaagaagacttgagggctgatgagcttttcagagatggaaatagaggatactgtgccccrtggcctctgctctgcccagccccctaccagtaaccaacaattttccagaagaatttccaaattcccttctccaaagtctccactggctccactttcattt

SEQ ID NO: 54212 - DNA, 201 bp, Homo sapiens
catggactcaaacctaagctgggtcataaaacatctcaggggtcacgaggaacaaaaagtgggagtcttggccagctctaagtgtcccattgactatgaayggagctttaacacatcagctaccatcctaaaatgtatgaaggagaatcaggggagatcatagcaaatccctgatgaaaattttgtaaaatacacaaaaca

SEQ ID NO: 54213 - DNA, 201 bp, Homo sapiens
aggtaccatgctcgtatatataggattttaaaaagatcatggggagatgtgctctgctacaagggtttgtgataaaggataaaggattaattttcttttccttttttttttttttttttttttgagacagagtttcactcttgttgctcaggctggaatgcaatggcacaatctcggctcactgcaacctccgcctcccgg

SEQ ID NO: 54214 - DNA, 201 bp, Homo sapiens
accaacaattttccagaagaatttccaaattcccttctccaaagtctccactggctccactttcatttgcttgcagaaaaaagtctaaatgctttggaacrgcatcattcaaggtcctctatgatctgactccaagctagcttgcactaaccctgtgtgtccctgaaaaccccccgctcagcggcatcagccatgcatgct

SEQ ID NO: 54215 - DNA, 201 bp, Homo sapiens
ccatcctaaaatgtatgaaggagaatcaggggagatcatagcaaatccctgatgaaaattttgtaaaatacacaaaacaatatgcatagttcatgcatacrtagtaaaatagaaaactatgcactagatatagactaaacaccagcaaacactaggaatcctatcactcagagtcctccagtgtcaccagctggctgttct

SEQ ID NO: 54216 - DNA, 201 bp, Homo sapiens
tgaggcaggagaatggcttgaacctgggaagcggaagttgcagtgagccgagatcacaccattgcattccagcctgggcgacagagtgagacttggtttcaaaaaaaaaaaaaaaaaaaaaactgtacagaaaaagacctgaaggagagcatccaaaacgttagcagagcagggatgtgagtaatttgctgtgtatttcat

SEQ ID NO: 54217 - DNA, 201 bp, Homo sapiens
gtatttatgacttagcttctcaccttctttcaaggacaggaagcttatctcattcatcctgaataatcacaacaaaaataatagctaaaattatgagatgytagaatgcatattttatttatatgaggcaatgtgctaggtgcttcccttgcactatcttgttgcaaccttttgacaaacacgtgaggtaggtatatcact

SEQ ID NO: 54218 - DNA, 201 bp, Homo sapiens
ggaagcttatctcattcatcctgaataatcacaacaaaaataatagctaaaattatgagatgttagaatgcatattttatttatatgaggcaatgtgctargtgcttcccttgcactatcttgttgcaaccttttgacaaacacgtgaggtaggtatatcactggcctccttttataaaggaagctcagagagatgaattg

SEQ ID NO: 54219 - DNA, 201 bp, Homo sapiens
caagagcagcctccccaaggtcatgtgacaagtcacggtcacataaacatcacgaatgcgggagctttagcgaccacattttctcctacaccttttacctrggaaatggaagtcacagttttcaaagggaaactaaacgtttttgactgtgcaaaggattagatgacagtatgttgaatgcaaattgattgagtctgattt

SEQ ID NO: 54220 - DNA, 201 bp, Homo sapiens
ctccttccttgcctgtcctcagcagcagctgcaagaggatgtaggtctggaaaactggaatgaagtcacactagagagctggacaccaagccagctacacragccgctcagcctgggtgttgctccttcctgccagccctacttgcagaaggatatatgtttaggaaacttagccagaaagaaatctagtgaaaatgagct

SEQ ID NO: 54221 - DNA, 201 bp, Homo sapiens
gtagatgaatatgtgttgactgaatggttttctgtcccccaaccctgagctgctacccgaggaaaaagctgctgctgtgtggccagcccctccctctcttyccaaggccccactttctcatgctctctccttccttgcctgtcctcagcagcagctgcaagaggatgtaggtctggaaaactggaatgaagtcacactaga

SEQ ID NO: 54222 - DNA, 201 bp, Homo sapiens
atctatgagccctgatatgtgctaggcattatgctgaactccttcacttctacctaaccacaaccttgagaagttactaattattatcactctaagaacastgcagttgacaggcgtgaccagctcctaactgggagggcttggcaccaaccacatcttctgcttccaggattaaggctccttctgtatcccacaaccatc

SEQ ID NO: 54223 - DNA, 201 bp, Homo sapiens
tttccctcctactggactcctagaggacaaggactttgtctctcattgctcaacactacaaattttgtgtctagcacattgcctgccacttggtaaaatgyccagtaaacattaatttgataagtgactgaattgtattggtggcagctaaattcaaagtcaacaatatattcaataaacatctatgagccctgatatgtg

SEQ ID NO: 54224 - DNA, 201 bp, Homo sapiens
agccctgggacgcttccagtcctttcctgactagaaattgaagtgtctctagtgttcccagataattttcaggaaaatcatttagtctcgctgagactcartttcctcacctgtggaatgggaatggcagcattgcccagtgtgcctcacaagggcgaaacttctatttactagggttctgcaggtgagaggagtcctggg

SEQ ID NO: 54225 - DNA, 201 bp, Homo sapiens
tctccagtgacaaacattctcaggtctctcatttgagaaaagcttctctccattcctcctcaagacacttgttcttttttttttttttttttttttttggktggtgggggacaaatcactttttttttattattatactttaagttctgggatacatgtacagaacatgcaggtttgttacataggtatacacatgccatg

SEQ ID NO: 54226 - DNA, 201 bp, Homo sapiens
attcatggaccatgcaccagaggttgcaggctctaagaacaaatgaccacttcgctggtgctcacgctgtaccctcagatgcacaggtaatggggatggaygctggcgtttacacgaggtgacgttgttccttcctccccacccactgcacagaccctggagatgaggagcaggaaggctgaggctggggcttgcagctgc

SEQ ID NO: 54227 - DNA, 201 bp, Homo sapiens
cagtgacaaacattctcaggtctctcatttgagaaaagcttctctccattcctcctcaagacacttgttcttttttttttttttttttttttttggttggkgggggacaaatcactttttttttattattatactttaagttctgggatacatgtacagaacatgcaggtttgttacataggtatacacatgccatggtgg

SEQ ID NO: 54228 - DNA, 201 bp, Homo sapiens
aaaggtatattatatataatatggtggtttctgtgttctatctcacattagaaaatagctaggatgaaaacagcctgcgtgcaagggacagacccaccttytctgtgccacatgaagctatgtggaaagctgcagaatgggcaggaaccaggcatagccttcataatgatctgtctcataacatttcctttgatatggtat

SEQ ID NO: 54229 - DNA, 201 bp, Homo sapiens
accagggacaatggctggcccatgtggtggcagagtgggaaaaatgtaccagaaacattaaaatgccaggagcagagaaaacagatggaggcttccaacaygagccctcattttaaagtcataaggacaaattattgtaattggtgtcttgatttatgatggaaccatctcctatgagagcagctccgcacagctgctaca

SEQ ID NO: 54230 - DNA, 201 bp, Homo sapiens
aataaatgtcagtgtttgccttcctttgattcttaacacatcacagtctttccttccagcttagtttccagggccaagctgggcacaaatgtctcctagawataatgggcctcgcaaataactgtaataactatatagtaactgtcactatattaactgttgataagctgagaactgagtctgaaatgcagaccaggattt

SEQ ID NO: 54231 - DNA, 201 bp, Homo sapiens
tacagatgaggaacttgaggatcagagaggttagagggcttgcttggagtcacagagctagtaactagaagagctgggattggaacccaggtcagttggaygccaaagcccaggttctcatccactccttctaccaccttccaatattgactcaggggcatttcttcccaccacgcctgctgtaggctgaggaatgcgatg

SEQ ID NO: 54232 - DNA, 201 bp, Homo sapiens
agttcttctcttcccttcctgtctccatgtaaccttttcttcctgggccattcctggtcctggaggtaaggtcactgctgacagcacccatctggtgaccsaggaagccaagggtcagctggcttctctgacagtggtggatgccctattgtgctcctcctagaagagggttctcttaactcttgcttttctgctttgttt

SEQ ID NO: 54233 - DNA, 201 bp, Homo sapiens
tgacccatcagtgcacgctgcctgggaggtggggggcgcctttgttatttgttccttcaggtgggcagccagcttggcaaacagaaaacacaatggagcayctaactgcaggaaaaaagaacactttgcctccttcctccccctggggctcatctgtgcttgggctcacttggaactgctcactccccctggactttaggg

SEQ ID NO: 54234 - DNA, 201 bp, Homo sapiens
tctcatctctccaagtgtcttaactcttcagcctcaccctgcctcttcgaaagccttattcatgtcttaaccacttcctagctctgttcacatcaaatcgytaatggttttctagaattcctgcatgttaagatggaaatctggggcgagagaggtggaacgaagaggttgtctgtgtggaaaaaaaagtcaactggacaa

SEQ ID NO: 54235 - DNA, 201 bp, Homo sapiens
tcaaagtgtatagttcaatggcttttcgtatattcacagtgtcatgcaactactgccactatctaatctcaggacacatatgaatcagcagtcattccccrcttccccctccctcagccccgggcacaccactaatctacgttctgtctctagatatttgcttattccagacatttcatgtaaatggaatcgtacaatatg

SEQ ID NO: 54236 - DNA, 201 bp, Homo sapiens
cctttatttctaccctttaacaaatagtggattggcaaggaactttggaccaactaccgctcaaactataggtaaattacaaataaagtttaaaataaggscttttcatgcccctggggtttcctttagcaacaaaaagggatttcattttttatatgtttcagctgagtcatcaatctcagttaccatggtctgtcagtt

SEQ ID NO: 54237 - DNA, 201 bp, Homo sapiens
gtgtgcaacaggggagagggagcagctcagattgctgggatgtggaaggacgtagtggaaggtgaggcttttcacaccagatttgaggtcacttggccaargactttggccttcctagctgggaagtaggaaacaagggaaggtttctgagccaatggttggcacatgcagatctttcttgagaagcatgacctcagtgcc

SEQ ID NO: 54238 - DNA, 201 bp, Homo sapiens
tgtgcaacaggggagagggagcagctcagattgctgggatgtggaaggacgtagtggaaggtgaggcttttcacaccagatttgaggtcacttggccaagractttggccttcctagctgggaagtaggaaacaagggaaggtttctgagccaatggttggcacatgcagatctttcttgagaagcatgacctcagtgcca

SEQ ID NO: 54239 - DNA, 201 bp, Homo sapiens
gaggcaggagaatggcttgaacctgggaagcggaagttgcagtgagccgagatcacaccattgcattccagcctgggcgacagagtgagacttggtttcaaaaaaaaaaaaaaaaaaaaaactgtacagaaaaagacctgaaggagagcatccaaaacgttagcagagcagggatgtgagtaatttgctgtgtatttcatg

SEQ ID NO: 54240 - DNA, 201 bp, Homo sapiens
tggatttcatgaaatcttacaccccatcctatccagtacattgtatcatgtctttaagaaatttaaaggagcagaaacaagttttgagaagctaggattgtgtgtgtgtgtgtgtgtgtgtgtgtgtgtgtgtgtgtgtatgacatgctccttagaccattagagtcatcctgttgtgttatgaaaccagtgaaaagtcct

SEQ ID NO: 54241 - DNA, 201 bp, Homo sapiens
ggatttcatgaaatcttacaccccatcctatccagtacattgtatcatgtctttaagaaatttaaaggagcagaaacaagttttgagaagctaggattgtgtgtgtgtgtgtgtgtgtgtgtgtgtgtgtgtgtgtgtatgacatgctccttagaccattagagtcatcctgttgtgttatgaaaccagtgaaaagtccta

SEQ ID NO: 54242 - DNA, 201 bp, Homo sapiens
ttttctcctacaccttttacctaggaaatggaagtcacagttttcaaagggaaactaaacgtttttgactgtgcaaaggattagatgacagtatgttgaaygcaaattgattgagtctgatttaatttggatggtgatgtgccaagtcacacagccctgttggaccaggtgcctgaagcaaagaactttccttgcacccag

SEQ ID NO: 54243 - DNA, 201 bp, Homo sapiens
catatttagcatgggacatttggtagtgggaggacagccgctcctgtcatcttccctttctctctccccatcagcctgcgagggactaaaagccggcgatytttccttgctgtatttctttctttttttttttttttttttgagacggagtctcgctctgtcccccaggctggagtgcagtggcccgatctcagctcactg

SEQ ID NO: 54244 - DNA, 201 bp, Homo sapiens
tgattttacttcctacttcaacaagaaattaatatcacaacttgaaaagccttcctaactggtaaaatcgttctgctggaaaagctcattatcttttttcttttttttttttttctttcctgattaacctgcttctcacctatcctctgtccttcggaatctttttctttgtatggctgtctcaactcagcctaactttct

SEQ ID NO: 54245 - DNA, 201 bp, Homo sapiens
tacttcctacttcaacaagaaattaatatcacaacttgaaaagccttcctaactggtaaaatcgttctgctggaaaagctcattatcttttttcttttttytttttttctttcctgattaacctgcttctcacctatcctctgtccttcggaatctttttctttgtatggctgtctcaactcagcctaactttctttcaaa

SEQ ID NO: 54246 - DNA, 201 bp, Homo sapiens
agattgagaccatcctggccaacatggtgaaaccctgtctctactaaaaatacaaaaattagctgggtgtggtggtgggtgcctgtaatcccagctactcsggaggctgaggcaggagaatcgcttgaacccgggaggcagaggttgtagtgagctgagatcacgccactgcactccagcctggcgacagagcgagaccct

SEQ ID NO: 54247 - DNA, 201 bp, Homo sapiens
actttcctgaggaggcagaaatagatcagtagctccctagataataaaatcattgcatgttgtactaagtgccatgaaagaaacaaggggcagaggaggargaggatgtgggggagggtggtattggcagggagaatggggtggggatgaaaggaccccgtgcgcagagtgtcacacactctggggagggcctcttttagg

SEQ ID NO: 54248 - DNA, 201 bp, Homo sapiens
gactggaatgcagtggcacgatctaggctcactgcaacctccacctcctgggttcaagtgattctcctgcttcagcctcgcaagtagctgggattacaggygcgcaccaccacgcccagctaatcttttgtacttttagtatagatggagtttcaccatgttggccaggctagtctcgaactcctgacctcaagtgatctg

SEQ ID NO: 54249 - DNA, 201 bp, Homo sapiens; identical to SEQ ID NO: 15746

SEQ ID NO: 54250 - DNA, 201 bp, Homo sapiens; identical to SEQ ID NO: 15738

SEQ ID NO: 54251 - DNA, 201 bp, Homo sapiens
acaaaatttagttaatatctctaaggaagaattaagattttgggtgatgccattcatagccacaggcagcaaggacttagagcatatttggaaccaaagcyaaggcctgttttgtatatgctgggtttgaggatacatccaattatcaccttagcaggtgtctgtctacacatctaccttcagtggctttatatactctgc

SEQ ID NO: 54252 - DNA, 201 bp, Homo sapiens
tggagcccaagagattgtgtgaaagacaggaaaaagtaggatacttggagtactcgacctggggtctggtcatgatttttccccttcttagaagtataacrttgcataaaacacactctcaccaaacttcagctcttcaccaaaggacagagcaagcaccaccttcctccagggaacacttcgaggagaaaaggccacaaa

SEQ ID NO: 54253 - DNA, 201 bp, Homo sapiens
attcccaccctcactctgctttattttaggcacaaacataaaagagtttcttgtagtattctctcaaaactctcaaatgtattatcatataaacacagagkaaagattgattgatgttttggtaactcttcaatcactcattttagaatatctaatcccattccattcattcattcattcattccaaaaatgtttttcttt

SEQ ID NO: 54254 - DNA, 201 bp, Homo sapiens
gcagcggttctgtcctagggttgttgacaggaagatgtgagttaatatatctaaagtctatactacatgccagcactgcatcagtgtaacttgttcctatytcataggattggtgtaagaatgtagggagagaatccacgtagagtgcctaaaatgttttagcacgcaatgcacagcacctagtatttgctcaataagata

SEQ ID NO: 54255 - DNA, 201 bp, Homo sapiens
cactctttaatacgttgtggctgattttcaacttaataaatgtacagctgcactgggttctactgtacggatattcttttacccacttaaccaatcacctytccatggacatataggttactcctaatcgcttgcccctataaccattggttcagagaccatcctcaaaaatacagttgtacacttactcaaccatctcct

SEQ ID NO: 54256 - DNA, 201 bp, Homo sapiens
aaaaactgcatagaaggcagggggcggtggctcacatctgtaatcccagcacattgggaggccgaggcaggaagaccacctgagatcaggagttcgagacragcctggccaacagggtgaaaccccatctctactaaaaatacaaaaattagccaggcatggtggtgcgtgcctgtaatcccagctacttgggaggttgag

SEQ ID NO: 54257 - DNA, 201 bp, Homo sapiens
tttgggggcagcatgctgagatgctagcccaggccaatcagccatggctacactcctacctcagacccagtacagaccatggaacatggagcaaaagaaayagaaagcaaagaacacactgcctccctttcttcggcaaactttccttcaccagggagtggaaggtggggccctgccagcctaacacgctgtggcagaaat

SEQ ID NO: 54258 - DNA, 201 bp, Homo sapiens
accccatctctactaaaaatacaaaaattagccaggcatggtggtgcgtgcctgtaatcccagctacttgggaggttgaggcaggagaatggcttgaaccygggaagcggaagttgcagtgagccgagatcacaccattgcattccagcctgggcgacagagtgagacttggtttcaaaaaaaaaaaaaaaaaaaaaactg

SEQ ID NO: 54259 - DNA, 201 bp, Homo sapiens
agtgtcctatttatcattgcatctttgggatccacaaaatgcctgtatatatgaggcacttgcttgtgagcctgaattgaattggacaatttaattttttwaaaaagcaatgtttgtaaacaataaagaattaaaaccaaaatacatttaaatgtcaaccaactgaaatagatctatagatctaactcatttcacttgatc

SEQ ID NO: 54260 - DNA, 201 bp, Homo sapiens
aagatttcataagtcagcatgaagtttcgattcacttctcaacaagtctttttgagtaccacaagaagcacagtgttgggataaaagctgtcagggttacmataaggaattagcatggtagattcccgctctcaagaagctcacgatctaatgagcttgttagattaattagaactctaaggtctggaagaaactatgcca

SEQ ID NO: 54261 - DNA, 201 bp, Homo sapiens
aataaaatagaacaaaacaaaactgtgcatcagttctgatgtaaatttgaagtaatttttcatctatgtctgagaaacctgttacctcagacagggttagyagacatatgtgttttattctgattattaagaaagttgtaagcaccacctcaaaggctataaatgtgtggtttaagagtatacatctaaatataattttgt

SEQ ID NO: 54262 - DNA, 201 bp, Homo sapiens; identical to SEQ ID NO: 15789

SEQ ID NO: 54263 - DNA, 201 bp, Homo sapiens
tccatttacactggcaattacaaaaatattatttatcagtccctaattgcgtgccactctgatcttatctttcatttaaatttgagaatagtgggtgctargtaagttttctaaccaatccagaaagacaaagtgtgtgaggggggtggggattgttgatatgcaagaacttcattagctatgtataacctgagagcactg

SEQ ID NO: 54264 - DNA, 201 bp, Homo sapiens; identical to SEQ ID NO: 15790

SEQ ID NO: 54265 - DNA, 201 bp, Homo sapiens
ccctgtccatttacactggcaattacaaaaatattatttatcagtccctaattgcgtgccactctgatcttatctttcatttaaatttgagaatagtgggygctaggtaagttttctaaccaatccagaaagacaaagtgtgtgaggggggtggggattgttgatatgcaagaacttcattagctatgtataacctgagag

SEQ ID NO: 54266 - DNA, 201 bp, Homo sapiens
acaagtagttgagaatggtgaataggagtatgactagacagaagattgtagggatgacaagtttttggggcacagttcaagttgggctggtgtctggaatragactggggcctaataaaaaggagcgtccatacagaatcttaaatgggctgtaccttgtagcatttcgaggacaggcccgaattctgagaatggcaagtg

SEQ ID NO: 54267 - DNA, 201 bp, Homo sapiens
attaattcagatttgattccccctgctcaagtgcacttggtcatcagcaggctgaattttagaagaaaagatttcaaatagtagtctttaatactttaaakgattaaaacagtaatgcaacactgtctacgtgctaggacctgaactaaatacttggaaatattttattttatcaacccaatgaggatgatacaattatta

SEQ ID NO: 54268 - DNA, 201 bp, Homo sapiens
tatgctttccaaccatccgtcactggagaggaaaagagaaggaggactgccttgagaagttaacatctgctgcccagattatcactccctttaccttaagrcatgagtgtgtctcagctttaaagtgtgagcaacccactagcctgcagcaggccttgggtgtatggtgccacatttggccaaactcacctggaagaacca

SEQ ID NO: 54269 - DNA, 201 bp, Homo sapiens
catttacaagtagttgagaatggtgaataggagtatgactagacagaagattgtagggatgacaagtttttggggcacagttcaagttgggctggtgtctygaatgagactggggcctaataaaaaggagcgtccatacagaatcttaaatgggctgtaccttgtagcatttcgaggacaggcccgaattctgagaatggc

SEQ ID NO: 54270 - DNA, 201 bp, Homo sapiens
gttcctttttcttcaaaatgaaactctctcagtaggaacagattcttactcatctattgctgttaggttcatcatccctaaaaaaaatatttatgtgaagytaaccagaatctgaaattaattcagatttgattccccctgctcaagtgcacttggtcatcagcaggctgaattttagaagaaaagatttcaaatagtagt

SEQ ID NO: 54271 - DNA, 201 bp, Homo sapiens
ctcgggaggctgagacagaagaatcacttgaacccgggaggcggaggttgcagtgagctgagaccgcaccattgcactccagcctggtgacagagtgagamtctgtctcaaaaaaaaaaaaaaaaaagatatacctgtttcaagttcagggatgatctcgaaacaattgctaaccaactgctctgtgttgcctttctgtgg

SEQ ID NO: 54272 - DNA, 201 bp, Homo sapiens
agctactcgggaggctgagacagaagaatcacttgaacccgggaggcggaggttgcagtgagctgagaccgcaccattgcactccagcctggtgacagagygagactctgtctcaaaaaaaaaaaaaaaaaagatatacctgtttcaagttcagggatgatctcgaaacaattgctaaccaactgctctgtgttgcctttc

SEQ ID NO: 54273 - DNA, 201 bp, Homo sapiens
gttcctcttaactcttccccatactgtttctttccctattgaagtgattcagtgtgagcctttggaggccccagagctgggtaccatggactgtactcacyctttgggaaacttcagcttcagctcacagtgtgccttcagctgctctgaaggaacaaacttaactgggattgaagaaaccacctgtggaccatttggaaa

SEQ ID NO: 54274 - DNA, 201 bp, Homo sapiens
aaattagccaggcgtggtggcgggcacctgtaatcccagctactcgggaggctgagacagaagaatcacttgaacccgggaggcggaggttgcagtgagcygagaccgcaccattgcactccagcctggtgacagagtgagactctgtctcaaaaaaaaaaaaaaaaaagatatacctgtttcaagttcagggatgatctc

SEQ ID NO: 54275 - DNA, 201 bp, Homo sapiens
atttttgctaatgccttttctctattttctattttcaggcaagaaatccaagagaaggtaagttttattagtggcgaggagtttccacatctgctgattcrttctctacttccttaagttacttcctgctctagctagacacattaaccccatagtagtttatttacctggggtcctcatccaaatgaccagataaggtga

SEQ ID NO: 54276 - DNA, 201 bp, Homo sapiens
tcatgagctcagcagttcaagaccagcctggccaacatggtgaaaccctgtctctactaaaaatacaaaaattagccaggcgtggtggcgggcacctgtaktcccagctactcgggaggctgagacagaagaatcacttgaacccgggaggcggaggttgcagtgagctgagaccgcaccattgcactccagcctggtgac

SEQ ID NO: 54277 - DNA, 201 bp, Homo sapiens
aggcgggcggatcatgagctcagcagttcaagaccagcctggccaacatggtgaaaccctgtctctactaaaaatacaaaaattagccaggcgtggtggcrggcacctgtaatcccagctactcgggaggctgagacagaagaatcacttgaacccgggaggcggaggttgcagtgagctgagaccgcaccattgcactcc

SEQ ID NO: 54278 - DNA, 201 bp, Homo sapiens
gaaataattgcatgcagaaatgattgaggtcaggtcatcatttaaccttctcactcattaaaaacaagtaatttcaagagtttcaaggtatgccactaagyttcctataagtgttacagaatattagtattggtaatttcattccaaaagcaaataaatgcctatgactatatgcttagtgtattttatacgtaaaaattt

SEQ ID NO: 54279 - DNA, 201 bp, Homo sapiens; identical to SEQ ID NO: 15791

SEQ ID NO: 54280 - DNA, 201 bp, Homo sapiens
gaggcgggcggatcatgagctcagcagttcaagaccagcctggccaacatggtgaaaccctgtctctactaaaaatacaaaaattagccaggcgtggtggygggcacctgtaatcccagctactcgggaggctgagacagaagaatcacttgaacccgggaggcggaggttgcagtgagctgagaccgcaccattgcactc

SEQ ID NO: 54281 - DNA, 201 bp, Homo sapiens
gaatttttggtgtgtaagatttgtccctgtgcacaaaagctatacccctaaatcaagttacatcaaaatgatagatctacgtaggaagtacagaggaagarctagacaatcagtgcctttgataataaggcaggggaggagaagctgacagctggggccagttggaaacttaggctcacatcacctcagttttcacattgt

SEQ ID NO: 54282 - DNA, 201 bp, Homo sapiens
cgtggagatctatatcaagagaaacaaagatgcaggcaaatggaacgatgacgcctgccacaaactaaaggcagccctctgttacacaggtagggagtgasaagacggctatgctgcctcagactcaggaagggccacggttaagagaatactcagatttaccccatggaaaggtggggggatgagaacagcttctggttc

SEQ ID NO: 54283 - DNA, 201 bp, Homo sapiens
cgaggcgggcggatcatgagctcagcagttcaagaccagcctggccaacatggtgaaaccctgtctctactaaaaatacaaaaattagccaggcgtggtgrcgggcacctgtaatcccagctactcgggaggctgagacagaagaatcacttgaacccgggaggcggaggttgcagtgagctgagaccgcaccattgcact

SEQ ID NO: 54284 - DNA, 201 bp, Homo sapiens
ggaggccgaggcgggcggatcatgagctcagcagttcaagaccagcctggccaacatggtgaaaccctgtctctactaaaaatacaaaaattagccaggcrtggtggcgggcacctgtaatcccagctactcgggaggctgagacagaagaatcacttgaacccgggaggcggaggttgcagtgagctgagaccgcaccat

SEQ ID NO: 54285 - DNA, 201 bp, Homo sapiens; identical to SEQ ID NO: 15788

SEQ ID NO: 54286 - DNA, 201 bp, Homo sapiens
tattaggcttttagctcttctctgtgtttcagagttccagtcattgaacaagtccatggagctaaatacaacgatgaccattcttgccaacatttttaggkgcattttcaggaactctatgaaccacaaatctgggcattgagattctgtaggcattagactagcaaggctggtccagtctttgcctatgctgtagactca

SEQ ID NO: 54287 - DNA, 201 bp, Homo sapiens
ctagccactctgagaaatgggaagttttgatcagaaagctctgctttcacaatattgttacctttccgtaaagatttcataagtcagcatgaagtttcgaytcacttctcaacaagtctttttgagtaccacaagaagcacagtgttgggataaaagctgtcagggttaccataaggaattagcatggtagattcccgctc

SEQ ID NO: 54288 - DNA, 201 bp, Homo sapiens
cctgacatttctatcttcttatattaataagaaaaataaaacgaaatagtggtaaagtgttggggcagtgaaaatttttgggggtggtgtggagagataaygggcgatgtttctcagggctgcttcgagcaggattaggggtggcgtgagaacctagagtgggagagattaagctgaaggaagattttgtggtaaggggtg

SEQ ID NO: 54289 - DNA, 201 bp, Homo sapiens
atcattggcttttatttttcctgaagttgtattaggcttttagctcttctctgtgtttcagagttccagtcattgaacaagtccatggagctaaatacaaygatgaccattcttgccaacatttttaggtgcattttcaggaactctatgaaccacaaatctgggcattgagattctgtaggcattagactagcaaggctg

SEQ ID NO: 54290 - DNA, 201 bp, Homo sapiens
tttcctttgactggtgaattatccagttcagatcattggcttttatttttcctgaagttgtattaggcttttagctcttctctgtgtttcagagttccagwcattgaacaagtccatggagctaaatacaacgatgaccattcttgccaacatttttaggtgcattttcaggaactctatgaaccacaaatctgggcattg

SEQ ID NO: 54291 - DNA, 201 bp, Homo sapiens; identical to SEQ ID NO: 15787

SEQ ID NO: 54292 - DNA, 201 bp, Homo sapiens
tctgtaaaatcttctacaattccaaaacagccagcattttccaagtgatgttttaataatgaaccatagttaatttggtctcttataaattggactctacygttttagcaaatttggactttttaatctttgatttctataaagaaagggattgccaagaaataattgcatgcagaaatgattgaggtcaggtcatcattt

SEQ ID NO: 54293 - DNA, 201 bp, Homo sapiens
tagtatggagactttccctcctttcttttaggaaaggaataaggaacagttccagaaacatgtgtccttgtgcatgggctcatctagacacattttgtgcwccaggcattatcattttctgattagtcactaccattggccctgtttggtaaataaggaaaccagggcaatgatgttttaggccaaatctcaaaaatacca

SEQ ID NO: 54294 - DNA, 201 bp, Homo sapiens
gctcacatcacctcagttttcacattgtgaagtagagagtgtggtgctgcgtgcttccttcttggtctaaccttatataattttatataaaaattgcactrtctttggtgtatgaatatttctgtaaaatcttctacaattccaaaacagccagcattttccaagtgatgttttaataatgaaccatagttaatttggtct

SEQ ID NO: 54295 - DNA, 201 bp, Homo sapiens
taccaaatatttagcacctcattttctattttttattcatagttcagtgtacattaatgtcatttctacaattacaatacgagcttattaagggacggggstttatcattttttggtccttctcccattgttgtgacaaattttatatctgattcttgaagactctccagcaatagctttgaacttggtttttcatttcct

SEQ ID NO: 54296 - DNA, 201 bp, Homo sapiens
gcttatgaagaatagataggatttaggtatatggagaaaagcaggaaaggaaggcagtctgtaggaaggaaattgtgtaagcagtggtatggtagtgagamtatgaaagcatttttcaggggccactgagcagaactttcttgagcccatggcttattgaggagttgtggagttgaagttggaaaggaaggctggccccaa

SEQ ID NO: 54297 - DNA, 201 bp, Homo sapiens
acatgtaaatcagcccaggacacaccttcattaaaacaggttggctgattttcgcttttcatctgataaacttttaaaaatgtctattaccttcaaggcarcttgctaggctgataacaactaagtgagatattctaatggttctttgctcttatgtaattctttaatacttttttttttttgagacagagcctcactctg

SEQ ID NO: 54298 - DNA, 201 bp, Homo sapiens
atctcatctcatatagtttccaaatacaaaaattcttctgattccttgagtccattcttccttgaagtctctagagcaaggtagcaataatggcttaaatytgacagatgaggaataagacatgaaagttgtactgtttactaaatggcatggcagggtctaaaatgtgaaaactttgatttccaagtcttaaatttacct

SEQ ID NO: 54299 - DNA, 201 bp, Homo sapiens; identical to SEQ ID NO: 15794

SEQ ID NO: 54300 - DNA, 201 bp, Homo sapiens
gtgaaatctaagctcttcaagccccagagtaatgcttgatatataatagatactctttaaatcaatgaaaaaagataacattttctcttagttcccatgtytctccctaatctcatctcatatagtttccaaatacaaaaattcttctgattccttgagtccattcttccttgaagtctctagagcaaggtagcaataatg

SEQ ID NO: 54301 - DNA, 201 bp, Homo sapiens
gttgcatgagctgcctccgtgccactgcactccggactgggcaacagagtgagactccatctcaaaaataaataaataaataaattaaattaaattaaatwaaaataaacataaatttaaaaaatcaatctacactgtccttcagactcattagatctggagacaaagaccgtatgcaccacaaaaatttctccaagtggg

SEQ ID NO: 54302 - DNA, 201 bp, Homo sapiens
atttctacctaccattttgtcctacagggtgaaatctaagctcttcaagccccagagtaatgcttgatatataatagatactctttaaatcaatgaaaaaagataacattttctcttagttcccatgtttctccctaatctcatctcatatagtttccaaatacaaaaattcttctgattccttgagtccattcttccttg

SEQ ID NO: 54303 - DNA, 201 bp, Homo sapiens
ttgccagccctggtcatgcagtggccatggagaatgtgtagaaatcatcaataattacacctgcaactgtgatgtggggtactatgggccccagtgtcagyttggtaagtctctttcctttctttgcttcttcttaggtaaagtcacaggaatcattatagcttatcatgaagctggttggaacaaaatgatactagccac

SEQ ID NO: 54304 - DNA, 201 bp, Homo sapiens
gcttgaacccaggaggccgtggttgcatgagctgcctccgtgccactgcactccggactgggcaacagagtgagactccatctcaaaaataaataaataawtaaattaaattaaattaaattaaaataaacataaatttaaaaaatcaatctacactgtccttcagactcattagatctggagacaaagaccgtatgcacc

SEQ ID NO: 54305 - DNA, 201 bp, Homo sapiens
ggctcacgcctgtaatcccagcactttcggaggccgtggcaggtggatcatgaggtcaggagtttgagattagcttggccaatgtggtgaaaccccatctytactaaaaatacaaaaattagctgggtgtgctggcacgtgcctgtattcccagctactcaggaagttgaggcggaagaatcgcttgaacccaggaggccg

SEQ ID NO: 54306 - DNA, 201 bp, Homo sapiens
agaaggtctaggttctacttcaaatctgcaaacaactattctgtgatcctgagatggtcacatacactcttaggctctgtttcctcatctctaagtgtctrgctcagcctggagtagtgctaggttctttttagctgtaacattatgtaagtctgcataggtcacactgatgtcttgcagatttcctggcacatcatggaa

SEQ ID NO: 54307 - DNA, 201 bp, Homo sapiens
gggaggccgaggcgggcggatcatgagctcagcagttcaagaccagcctggccaacatggtgaaaccctgtctctactaaaaatacaaaaattagccaggygtggtggcgggcacctgtaatcccagctactcgggaggctgagacagaagaatcacttgaacccgggaggcggaggttgcagtgagctgagaccgcacca

SEQ ID NO: 54308 - DNA, 201 bp, Homo sapiens
cttattatgcttctcccataggtacatatgtgttggccttcaagaaatgattccaggattaaaaagtatacgtaaattgtatagttatatgatattacackgtaattagttgtaaatcattaacagctacaaagaaaaagaaatatgaatgtctaaaatatgttggttaaatttcacctgaaataattttgagaaaaaaat

SEQ ID NO: 54309 - DNA, 201 bp, Homo sapiens
ccaaactcacctggaagaaccattcaaggctgtaacattcatggacattgggcagcttttaagatatacctgttttggccaggtgtggtggctcatgcctrtaatcccagcactttgggaggccgaggcgggcggatcatgagctcagcagttcaagaccagcctggccaacatggtgaaaccctgtctctactaaaaata

SEQ ID NO: 54310 - DNA, 201 bp, Homo sapiens
aaagtcataaatctctatgtgtgtgtttaggtgtgtgtgtgtgtctatgtgtgtgtgtatatgtatatatatacacagagagagagagagagagagagagaatttataggctttttgggttctaatagttagaaaaagggcacaggtaactatttagagcatggtagccaatgaagtgactagagccttcacccctattct

SEQ ID NO: 54311 - DNA, 201 bp, Homo sapiens
tttggccaaactcacctggaagaaccattcaaggctgtaacattcatggacattgggcagcttttaagatatacctgttttggccaggtgtggtggctcaygcctgtaatcccagcactttgggaggccgaggcgggcggatcatgagctcagcagttcaagaccagcctggccaacatggtgaaaccctgtctctactaa

SEQ ID NO: 54312 - DNA, 201 bp, Homo sapiens
aaaagtcataaatctctatgtgtgtgtttaggtgtgtgtgtgtgtctatgtgtgtgtgtatatgtatatatatacacagagagagagagagagagagagagaatttataggctttttgggttctaatagttagaaaaagggcacaggtaactatttagagcatggtagccaatgaagtgactagagccttcacccctattc

SEQ ID NO: 54313 - DNA, 201 bp, Homo sapiens
tgagacagagcctcactctgtcaccaggctagagtgcagtggtgcaatttcagctcactgcaacctccgccttctgggttcaagctattctcccacctcakcctcccaagtagctgggactacaggagcgtgccaccatgcccagctaattttttgtatttttagtagacacggggtttcactgtgttagccagagtggtc

SEQ ID NO: 54314 - DNA, 201 bp, Homo sapiens
aaaaagtcataaatctctatgtgtgtgtttaggtgtgtgtgtgtgtctatgtgtgtgtgtatatgtatatatatacacagagagagagagagagagagagagaatttataggctttttgggttctaatagttagaaaaagggcacaggtaactatttagagcatggtagccaatgaagtgactagagccttcacccctatt

SEQ ID NO: 54315 - DNA, 201 bp, Homo sapiens
ttggctttaaggattctcactacagataatgctgaagataataatatgaagactagctaatgtttacttagaatttctgatgagtcaggctttgttctaasgtccttgacttatgctaattgaattacatttagtttccatatcaatttgataaagataacacaatttcattattcctcttatatagatgaagaaactgaa

SEQ ID NO: 54316 - DNA, 201 bp, Homo sapiens
taaaaagtcataaatctctatgtgtgtgtttaggtgtgtgtgtgtgtctatgtgtgtgtgtatatgtatatatatacacagagagagagagagagagagagagaatttataggctttttgggttctaatagttagaaaaagggcacaggtaactatttagagcatggtagccaatgaagtgactagagccttcacccctat

SEQ ID NO: 54317 - DNA, 201 bp, Homo sapiens
atttttttaaaattatactttaagttctagggtacatgtgcacaacatacaggtttgtcacacatgtatacatgtgccatgttggtgtgctgcacccattmactcgtcatttacattaagtatattttaaggtgtgcaggaaatttgtgactttgtcatttcagttgctcaaaaaggtatttctttttattaaaaaaagaa

SEQ ID NO: 54318 - DNA, 201 bp, Homo sapiens
gcatgcagaaatgattgaggtcaggtcatcatttaaccttctcactcattaaaaacaagtaatttcaagagtttcaaggtatgccactaagtttcctatargtgttacagaatattagtattggtaatttcattccaaaagcaaataaatgcctatgactatatgcttagtgtattttatacgtaaaaattttagcatatg

SEQ ID NO: 54319 - DNA, 201 bp, Homo sapiens
atggaacgatgacgcctgccacaaactaaaggcagccctctgttacacaggtagggagtgacaagacggctatgctgcctcagactcaggaagggccacgsttaagagaatactcagatttaccccatggaaaggtggggggatgagaacagcttctggttcattctaaaatacatctagccctctatataatcttgcatc

SEQ ID NO: 54320 - DNA, 201 bp, Homo sapiens
gctcaaaaaggtatttctttttattaaaaaaagaaatacttttctttcctggtgtctggctatctaattttttttttttttaggtatttgaggcattgacycattatgatcaagagtgaggctataacattaaatataagcatcaatagttaattaagcagcaacaatactttaaaaaatatacatagtaaatattaaata

SEQ ID NO: 54321 - DNA, 201 bp, Homo sapiens; identical to SEQ ID NO: 15826

SEQ ID NO: 54322 - DNA, 201 bp, Homo sapiens
gggttaataatagtagctattgcattaagccactggggaaaggcacaaagataataatgtatgtaaagcccattgcccaggttataataagcactgaatcracattggctatgattatttttgattaatgaaggggagggggttatggcactggaagattttaagtaggaaaaggacatgatctcatccctgggtcaggtg

SEQ ID NO: 54323 - DNA, 201 bp, Homo sapiens
ctccttgggggcctattcttcgggctaactctttgcatgttctgcagggagccaaacaagccgctcctacacttcgctggtcctgggcgtcctggtgggcrgtttcatcattgctggtgtggctgtaggcatcttcctgtgcacaggtggacggcgatgttaattactctccagccccgtcagaaggggctggattgatgg

SEQ ID NO: 54324 - DNA, 201 bp, Homo sapiens
cacaatccccgtaacttcagtctccccctcagagaggcagcaaataataaccagtattcaatgagtgctcactatggttaatacatgtattgacccatttmacttgcacaaacccctaaaggtgggtaatattattactatctccattttatgaggaggaaactgggtcacagagtagttaaggaccatgtctagggttat

SEQ ID NO: 54325 - DNA, 201 bp, Homo sapiens
gagaaagaaaccagcagagagggtaggagaatcagccccagggagaggggagaaaggggaactgagggtgatggtagataggggtacatctaggggagacrggaagaggctcagaagagaagagaaatggagggaatgggaagaccctgggaaaactgatggaagaagtgggggaagagtggggcagagagaggttagggg

SEQ ID NO: 54326 - DNA, 201 bp, Homo sapiens
cacccaggaagtgcaagaggttaggggatatcccccctagccaagggaagcggtgagggactgtgccctgggaaatggtgcactacggcccagatactgcrcttttcccaaggtcttcgccacctgtagaccaggagattccctctggtgcctacgccaccagggccctgggtttcaagcacaaaactgggcggccatttg

SEQ ID NO: 54327 - DNA, 201 bp, Homo sapiens
ggtcttcgccacctgtagaccaggagattccctctggtgcctacgccaccagggccctgggtttcaagcacaaaactgggcggccatttgggcagacaccragctagctgcaggagttttcttttttttttttcataccccagtggtgcgtggaacgccagcaagatagaatcgttcactctgcaggctgggcgcggtggc

SEQ ID NO: 54328 - DNA, 201 bp, Homo sapiens
aggtggagcttgcagtgagctgagattgcaccactgcactccagcctggacgacagggcgagactccgtctcaaaaaaaaaacaaaaaaaaaaaaacaggwttgttcaatccgctggaaagggggctgaagccagggagccaagtggtctggctccatgggtcccacccccacagagctcagcaagctaagatccactggc

SEQ ID NO: 54329 - DNA, 201 bp, Homo sapiens
acctgcacattctgcacatgtaccccaaacttaaagtataataaaaattaaaaaaagaaatctaaacacagaaaaggtacagtaaaaatatggtatagtcsattttaaaaggtacacctgtagagtgtgtacttcatgcatggagcttgaaggacttggtgttgctctgagtgggtcagtgagtgagtggtgagcaaatgt

SEQ ID NO: 54330 - DNA, 201 bp, Homo sapiens
cctgcacattctgcacatgtaccccaaacttaaagtataataaaaattaaaaaaagaaatctaaacacagaaaaggtacagtaaaaatatggtatagtcgwttttaaaaggtacacctgtagagtgtgtacttcatgcatggagcttgaaggacttggtgttgctctgagtgggtcagtgagtgagtggtgagcaaatgtg

SEQ ID NO: 54331 - DNA, 201 bp, Homo sapiens
agccactgcgcctggtcttctcactcattcttagacccagtgcaatctgacttctctataaactactctaagatcaccagtaacctctaattgtcaaaccrtcaccctacatggtatctgcaaatttgcggactagaactctctttttgccttaacttctgagataccatacttcaatttttaaaactgttctgtctactt

SEQ ID NO: 54332 - DNA, 201 bp, Homo sapiens
tagtttatgaagggtcgagaaggcgggcggccagcctcgaggtagggggttattatcttccgctgcccgccgccccctcccacgccggcccaggctgaagytgactctgcccgcaggcctccaaagacttcatatgctccagatctcctacttccgcgacccctatcacgtgtggtaccagggcaacgcgtcgctgggggg

SEQ ID NO: 54333 - DNA, 201 bp, Homo sapiens
acattggctatgattatttttgattaatgaaggggagggggttatggcactggaagattttaagtaggaaaaggacatgatctcatccctgggtcaggtgraggtcggaatagagaacggggagatgaagtagaaagttactaccccagtctagatgagacggatgaatcctgaatcagggcagtggaagaggagatggag

SEQ ID NO: 54334 - DNA, 201 bp, Homo sapiens
ataagcactgaatcgacattggctatgattatttttgattaatgaaggggagggggttatggcactggaagattttaagtaggaaaaggacatgatctcayccctgggtcaggtggaggtcggaatagagaacggggagatgaagtagaaagttactaccccagtctagatgagacggatgaatcctgaatcagggcagtg

SEQ ID NO: 54335 - DNA, 201 bp, Homo sapiens
gcaatatctagtaaaactgaagatgcatatactttattactcagaaattccactgtcaagtttgcacctacaaaaactcccacatatgcacaaggactcghgtatgagaatgttcataccagcactgtttgtaatagcaaaaaactggaaaaaacttaagtgttcagcaacaagagaatggatacataaataatgatctat

SEQ ID NO: 54336 - DNA, 201 bp, Homo sapiens; identical to SEQ ID NO: 15830

SEQ ID NO: 54337 - DNA, 201 bp, Homo sapiens; identical to SEQ ID NO: 15831

SEQ ID NO: 54338 - DNA, 201 bp, Homo sapiens
ctatttcattttttaaaaatggtaaccatgacctgctaaattgatttcattgtccactaataaattatgacctcagtttcaaaaagattgctttaggtaascaatcatcttctgagatttatacagattgctcataattctctcctattttttaaaaacatgctgcagtgaactgctttacactcattttatgactacttc

SEQ ID NO: 54339 - DNA, 201 bp, Homo sapiens
agggactgtgccctgggaaatggtgcactacggcccagatactgcgcttttcccaaggtcttcgccacctgtagaccaggagattccctctggtgcctacrccaccagggccctgggtttcaagcacaaaactgggcggccatttgggcagacaccgagctagctgcaggagttttcttttttttttttcataccccagtg

SEQ ID NO: 54340 - DNA, 201 bp, Homo sapiens
cacccaggtcacctccggagtggtcaccttcaccctgcagcagctcaatgcctacaaccgcactcggtatgaactgcgggaattcctggaggacacctgtstgcagtatgtgcagaaacatatttccgcggaaaacacgaaaggtatgatgggacggggcccaggcctgcaagctggggagagggcgggttccagacaaat

SEQ ID NO: 54341 - DNA, 201 bp, Homo sapiens
aggcgtgagctgccgcccctgccccagcctcaccccctgttttttttttctattacagttgaacaaggcctgacaattcccttttttcatcacagtccctrgccccttctttcttagcctctaacaggctaaccccaaacccctcctcacagccccaggcccttctccccatagttccctgacctagactcccctctcctc

SEQ ID NO: 54342 - DNA, 201 bp, Homo sapiens
cccaatttcttttctcaaagcaccaagcaccactccgtcccccttcccccaccatcatggcctttaactcctttctctcctagtcccccaccccacccccytttttttttttttttttttttttgagacggagtcttgctctgtcgtccaggctggagtgcagtggcgcgatctcggctcactgcaacttccgcctcccgg

SEQ ID NO: 54343 - DNA, 201 bp, Homo sapiens
ccgtcacaaccctaactccttcttctcaaagaccccaatttcttttctcaaagcaccaagcaccactccgtcccccttcccccaccatcatggcctttaaytcctttctctcctagtcccccaccccacccccttttttttttttttttttttttttgagacggagtcttgctctgtcgtccaggctggagtgcagtggcg

SEQ ID NO: 54344 - DNA, 201 bp, Homo sapiens
agtgaactgctttacactcattttatgactacttctgagaccaagatcccggattatgtaattgttatttacttaaaattctggtaaaatgtagccattayactggaaaactaaattttaatcttggatctgtcaccaccatgatatataaactttgggcaagtccctgcacctctctggacctcaatctccccatcagca

SEQ ID NO: 54345 - DNA, 201 bp, Homo sapiens
cctgtgagtaggcgcgcagcgggggcggggtctgggcggggctagtgggggcggggcctggcgggtgggggcggggcctggcggatggaggcgggctgggrcttgcagggacccggcagccactggagctcggtggcgcctgggcctttgaagattgctgggtgggggctggagagaggcagttgtccccgctaagaaagc

SEQ ID NO: 54346 - DNA, 201 bp, Homo sapiens
tcaggaaaccaggaggaatggatttggctgaaactggaatacatggatagataaggctagagagataggcaggagccaagccaacaatactaggctcccaycaattgctggggcaggcaagagcaggcatcatcctgagtgtttggagcttcttttcatgttccctaagttggggggtgttggggggatgatacaggggga

SEQ ID NO: 54347 - DNA, 201 bp, Homo sapiens
gatggatcacttgaggtcaggaattcgagaccagcctggccaacatgatgaaaccctatctctactaaaaatgcaaaaattagccaggcatggtggcaccygcctgtaatcccagctacttgggaggctgaggcaggagaattgcttgaatccaggaggtggaggttgcagtgagcagagatcataccattgcactccagt

SEQ ID NO: 54348 - DNA, 201 bp, Homo sapiens
cacaacccatcacacccagctaattttattttttttgtagagatgggggtctcactatgttgcccaggctggtcttgaactcctgggctcaaatgatccayccacctcggcctcccaaagtgctgggataatacctccccagccggaatattttaaagcagtgaaaatgaatggtctacacatagccacatgaatgaatct

SEQ ID NO: 54349 - DNA, 201 bp, Homo sapiens
ctgtaacctccaactcccaggttcaggcgattctcctgcctcagcctcctgagtagctgggactacaggcatgtaccaccacgcctggctaatatttgtayttttagtacagatggggtttcgccatgttggccaggctggtcttgaatccctgacctcaagtgatccgcccgcctcggcctcccaaagtgctgggattac

SEQ ID NO: 54350 - DNA, 201 bp, Homo sapiens
aatatttgtacttttagtacagatggggtttcgccatgttggccaggctggtcttgaatccctgacctcaagtgatccgcccgcctcggcctcccaaagtrctgggattacaggcatgagccaccgcgcccagtctctgagctgggtcttaaatcatgaataaacttcgccaggcagaaaaagggaggcagagcaatcctg

SEQ ID NO: 54351 - DNA, 201 bp, Homo sapiens
cagtggctcctgcctataccagaggattgcttgagtgcaggagttcaagaccagcctgggcaacatagcgagaccacatctctagtaaaaataaaaaaaaatagctaggcgtggtggcacagtggcacgtacctttagtctcagctactcgggtggttgaggtgggagaatcacttgagcccgggaggtcaagcctacaat

SEQ ID NO: 54352 - DNA, 201 bp, Homo sapiens
actcccctctcctcacagcactgactcttgccttctcatgttcttttccccttggtgggcctcgccccacacctggcaccctctctgcacagtcccctgaycctgactgtctatccacagttcctctgaccatccgctgcttcctgggctgtgagctgcctcccgagggctctagagcccatgtcttcttcgaagtggctg

SEQ ID NO: 54353 - DNA, 201 bp, Homo sapiens
ccaatttcttttctcaaagcaccaagcaccactccgtcccccttcccccaccatcatggcctttaactcctttctctcctagtcccccaccccaccccctyttttttttttttttttttttttgagacggagtcttgctctgtcgtccaggctggagtgcagtggcgcgatctcggctcactgcaacttccgcctcccggg

SEQ ID NO: 54354 - DNA, 201 bp, Homo sapiens
tgaatccaggaggtggaggttgcagtgagcagagatcataccattgcactccagtctgggcaacagagcgagactccatctcaaaaaaaaaaaaaaaaaaagaaagaaagaaaaggaaagaaagcccttgatgtaatgagctctgtgtaagataatgtggatgaaagtggacccagaccctacccgcttagatggaaggct

SEQ ID NO: 54355 - DNA, 201 bp, Homo sapiens
tccactcatgacccgaactcttcccccaaagaccccaagttcttctctcaaagccccactccttccccgtcacaaccctaactccttcttctcaaagaccscaatttcttttctcaaagcaccaagcaccactccgtcccccttcccccaccatcatggcctttaactcctttctctcctagtcccccaccccaccccctt

SEQ ID NO: 54356 - DNA, 201 bp, Homo sapiens
ctggccaacatgatgaaaccctatctctactaaaaatgcaaaaattagccaggcatggtggcacccgcctgtaatcccagctacttgggaggctgaggcargagaattgcttgaatccaggaggtggaggttgcagtgagcagagatcataccattgcactccagtctgggcaacagagcgagactccatctcaaaaaaaa

SEQ ID NO: 54357 - DNA, 201 bp, Homo sapiens
gaccaaaggtagataaatccatgaagatggggagaaaccagcacaaaaaggctgaaaattccaaaaaccagaatgcctcttctcctccaaaggatcacaaytccttgccagcaagggaacaaaactggaaacagagaatgagtttgaagaattgacagaagtagacttcagaaggtgggtaataacaaactcctccgagct

SEQ ID NO: 54358 - DNA, 201 bp, Homo sapiens
ccaggaggtggagcttgcagtgagctgagattgcaccactgcactccagcctggacgacagggcgagactccgtctcaaaaaaaaaacaaaaaaaaaaaaacaggtttgttcaatccgctggaaagggggctgaagccagggagccaagtggtctggctccatgggtcccacccccacagagctcagcaagctaagatcca

SEQ ID NO: 54359 - DNA, 201 bp, Homo sapiens
ttgatcctgtggggaggcagtgtagcagaatggctgagtgctggacttgactgcctacgtgcaaaccttggctctgctacactatctctgtctcagtttcvcatgtagactggggttaataatagtagctattgcattaagccactggggaaaggcacaaagataataatgtatgtaaagcccattgcccaggttataata

SEQ ID NO: 54360 - DNA, 201 bp, Homo sapiens; identical to SEQ ID NO: 15829

SEQ ID NO: 54361 - DNA, 201 bp, Homo sapiens
agagattaccaagcatggttccatagcctagaggagtccagtgtggcctgtgtgtgtttggagacagccaggtagtatcccgtgagatacacactaatatrtggtggtctgggatcactgaaacagacacactgtgtctcgtggggcatcagaaaaaaatttccaagaagagggcaactgagctgggtctttttttctttg

SEQ ID NO: 54362 - DNA, 201 bp, Homo sapiens
agatttatacagattgctcataattctctcctattttttaaaaacatgctgcagtgaactgctttacactcattttatgactacttctgagaccaagatcycggattatgtaattgttatttacttaaaattctggtaaaatgtagccattatactggaaaactaaattttaatcttggatctgtcaccaccatgatatat

SEQ ID NO: 54363 - DNA, 201 bp, Homo sapiens
agtggctcccagtaagaccatggccaaatacatcctgaagtagaatatctggaaaatttgagatttggcaaaagccaacaccacaatccctccaaattttstaagtgtgattccactgaacacctaaaagaagagatactgtgttagaaaccacttttaccaacctgtaattgaacaaaaacacttccttacaaggatttc

SEQ ID NO: 54364 - DNA, 201 bp, Homo sapiens
acctggccaagttgtagctgatggtctgtccgaaaatgctggttcactctccactggccaactgtctgtctgcactgcactgccagttgcctcttgcctgsgccattgcgctaacatctccacttactgttccacctgcttcctgtttctttgccgtttccagaccttccactttgccacgcaagctatctttgtaaaaca

SEQ ID NO: 54365 - DNA, 201 bp, Homo sapiens
tttctggtgaccatggtcctcctgggctgtgagctctggtctgcagtcatcatgtgtgccaccatcgccatggtcttggtcaacatgtttggagttatgtrgctctggggcatcagtctgaacgctgtatccttggtcaacctggtgatggtgagtcctcatacagtctcagtttgtccctagctcctgtttcacttgggg

SEQ ID NO: 54366 - DNA, 201 bp, Homo sapiens
agtgcagctgcctctcaccctttacctcgtgcctgggtcgctaacacagtgtcatgtatcacaccccccacaagatttaaagatagaagagcctttggtgycttttgttctgtctcagatatatagcccagtcccctgtagtgccccagctatttgggaggcagcctccctctgaggagttgaggcagtataggtctgcag

SEQ ID NO: 54367 - DNA, 201 bp, Homo sapiens
atatttctggtgaccatggtcctcctgggctgtgagctctggtctgcagtcatcatgtgtgccaccatcgccatggtcttggtcaacatgtttggagttaygtggctctggggcatcagtctgaacgctgtatccttggtcaacctggtgatggtgagtcctcatacagtctcagtttgtccctagctcctgtttcacttg

SEQ ID NO: 54368 - DNA, 201 bp, Homo sapiens
ttctgcagttaacatcctccttggccatggcaccagggtcggagccacgtacttcatgacctaccacaccgtgctgcagacctctgctgactttattgacrctctgaagaaagcccgacttatagccagtaatgtcaccgaaaccatgggcattaacggcagtgcctaccgagtatttccttacaggtaaagcctgccctt

SEQ ID NO: 54369 - DNA, 201 bp, Homo sapiens
ccagccatcccattactgggtatatacccaaaggattataaatcatgctgctataaagacacatgcacacgtatgtttatagcggcactattcacaatagyaaagacttggaaccaacctaaatgtccaacaacgatagactggattaagaaaatgtggcacatacacaccatggaatactctgcagccataaaaaatgat

SEQ ID NO: 54370 - DNA, 201 bp, Homo sapiens
caaaatggtagaatttatgtgtatccttaacccagtttccccgatgatacaacttacataactcatagtacatctagaactagaaataccatttgacccakccatcccattactgggtatatacccaaaggattataaatcatgctgctataaagacacatgcacacgtatgtttatagcggcactattcacaatagcaaa

SEQ ID NO: 54371 - DNA, 201 bp, Homo sapiens
tcaggtaactagttcatagtttctcccagtaagagaggtaactggtacatttatcctgctgtggctaatttagggggtgctgggagtgggaatggaggagsaaatgaattgccttcaggcattgctgtcataattgaaagaataagcagttaaaaagggggtgggaggcagcttttctagagctctgctatagtattagct

SEQ ID NO: 54372 - DNA, 201 bp, Homo sapiens
attactgataatagccaaactgtggaaacaactcagatatttatcacctgatatatggataaacaaaacatatgtccttgcaatgaaatgttgttcggccrtaaaaagaaatgaagtattgatacatgccacaatatgcatgaaccttgagaacattatgctaaatgaaagaagccggtcatgaaagaccacatattatat

SEQ ID NO: 54373 - DNA, 201 bp, Homo sapiens
tgcagtgagctgagatcacaccattggactccagcctgagggacagagactccatctccaaaaaaaaaaaaaaaaaaaaaactcttactactcaatgatarataaataacccaatttaaaatggcaaaagatctgaatagagtagacatttctctaaggaagatatacaaatgaccaacaagcacatgagagatgctcaat

SEQ ID NO: 54374 - DNA, 201 bp, Homo sapiens
aagaacacccactgtaacactattgtgattgtgaaaaattgaagacctcaagaacgagaagacaagacacagactgggagaaagtatttgcaaaagacatrttagtaaggactgttattcaaaatatacaaataactcctaaaactcaataagaaagcaaacagcccaattgaaaaatggacaaaacaacctgaacagata

SEQ ID NO: 54375 - DNA, 201 bp, Homo sapiens
tgggctgtgagctctggtctgcagtcatcatgtgtgccaccatcgccatggtcttggtcaacatgtttggagttatgtggctctggggcatcagtctgaaygctgtatccttggtcaacctggtgatggtgagtcctcatacagtctcagtttgtccctagctcctgtttcacttgggggaattggctgtcttagattcca

SEQ ID NO: 54376 - DNA, 201 bp, Homo sapiens; identical to SEQ ID NO: 15849

SEQ ID NO: 54377 - DNA, 201 bp, Homo sapiens
tcggtgagtcttgtagacagccagcaaggttttctgcaagggatgtttcccaaaggagtctgaccacttggcagtggtgacaggatgaacacgcagtgttygggagtgagagcgagctttaatgaggcctcccctctcccctccagtgtgttttatgtcttctacgaacagtacctgaccatcattgacgacactatcttc

SEQ ID NO: 54378 - DNA, 201 bp, Homo sapiens
ttgaagatgaactaaatcgtgaaagtgacagtgatgtcttcaccgttgtaattagctatgccatcatgtttctatatatttccctagccttggggcacatsaaaagctgtcgcaggcttctggtaagccggggggggggtggtgtatgttctagaggttaacagcagtgcacagtgtaacgtcatatttttgcctctttat

SEQ ID NO: 54379 - DNA, 201 bp, Homo sapiens
gacctggactctcttgacacccaggattctttcctcaggggacatgctgcctatagttctgcagttaacatcctccttggccatggcaccagggtcggagycacgtacttcatgacctaccacaccgtgctgcagacctctgctgactttattgacgctctgaagaaagcccgacttatagccagtaatgtcaccgaaacc

SEQ ID NO: 54380 - DNA, 201 bp, Homo sapiens
  misc_feature (1)...(201): n = A,T,C or G, or insertion/deletion polymorphism (see Tables 1-2)
ctattcttctaacagtcctccctgcatgtctccgccagtggttgaccctgcctgcgttcgctgcaggcctctgactccggaaggcaaacagaggcctcagnggggagacttcatgagattcctgcccatgttcctttcggataaccctaaccccaagtgtggcaaagggtaagtgctgctgccattgcagataagcatcca

SEQ ID NO: 54381 - DNA, 201 bp, Homo sapiens
tacaaaaaatctggagacctattcttctaacagtcctccctgcatgtctccgccagtggttgaccctgcctgcgttcgctgcaggcctctgactccggaargcaaacagaggcctcaggggggagacttcatgagattcctgcccatgttcctttcggataaccctaaccccaagtgtggcaaagggtaagtgctgctgcc

SEQ ID NO: 54382 - DNA, 201 bp, Homo sapiens
tgtgaagggcatcagctctccagtcaaattgaactgcttgctagcaaaatcctgcccatcttccagggccccatttcacatgctacattatctacgacatycttgtcctgttcccctaactagaatgccttccctctgaagttctgaatctttatttaaactgctgcaacagcatttgctgcctcattaaaagaccttggt

SEQ ID NO: 54383 - DNA, 201 bp, Homo sapiens
ttcgtttcctcagtggggttgcagcagtgggtgaggtggtgtgccagtgccgaggacacggctgcgaccaaggcagacatggtccttgcctttgtggcccyaccatctagtcagggtggcacagcagaaccaagtaattaatcatagctggggaggcgcgaaagcagcaggacaagagtgggaatagcagggcagggttga

SEQ ID NO: 54384 - DNA, 201 bp, Homo sapiens
gacttcctccctgtggagcaggtcagtaaccctgtctgtcctctctagtacccgaataggcttcgccccctcgtcctggatcgacgattatttcgactggrtgaagccacagtcgtcttgctgtcgagtggacaatatcactgaccagttctgcaatgcttcaggtaccttctcctttaccaaatctttcctgttttgctg

SEQ ID NO: 54385 - DNA, 201 bp, Homo sapiens
aaaaatcggctagacatcttttgctgtgtcagaggtgctgaagatggaacaagcgtccaggcctcagagagctgtttgtttcgcttcttcaaaaactcctrttctccacttctgctaaaggactggatgagaccaattgtggtatgcgcttatctgtggtttttctctttcctctcactgaaacagattatcacatgcctt

SEQ ID NO: 54386 - DNA, 201 bp, Homo sapiens
agagcccttctctccccgacaggagcattgtccgtgatgccagccgtgcacaccttctctctctttgcgggattggcagtcttcattgactttcttctgcmgattacctgtttcgtgagtctcttggggttagacattaaacgtcaagaggtaagttggtgccaggattatagtctatttaatttgagtctagaatctaga

SEQ ID NO: 54387 - DNA, 201 bp, Homo sapiens
gatgtccatcctgtttttataacctactgaacctgttttgtgagctgacatgtagccctcgacagagtcagtttttgaatgttacagctactgaagattaygttgatcctgttacaaaccagacgaaaacaaatgtgaaagagttacaatactacgtcggacagagttttgccaatggtaagtaaacttttaattattcct

SEQ ID NO: 54388 - DNA, 201 bp, Homo sapiens
agaaatggcgttgttattgagaaattttaatgtcgcataatttttttttttttttttaagagagatgaacgtcttcaaggggaaaccctggatcagcagcygggcagggtcctaggagaagtggctcccagtatgttcctgtcatccttttctgagactgtagcatttttcttaggtaattatgctttcaatcctaccagt

SEQ ID NO: 54389 - DNA, 201 bp, Homo sapiens
atcatgcagtccttcctctccccccatgctttgctttgcacatcattcttgtccctccctctggtgaagggttgtgatagagtcaggtcctcagtagagcyggcctcggggagctgttaaaaattttgttctgctgtagctggctggttttgtcaaacttagttttttatctgttctgttggctatgaccctgagcagtga

SEQ ID NO: 54390 - DNA, 201 bp, Homo sapiens
tgtaactaattggtgattgtgtctgtcgcctctctcaggtggattcgaaggtctcactaggcatcgcgggcatcttgatcgtgctgagctcggtggcttgstccttgggtgtcttcagctacattgggttgcccttgaccctcattgtgattgaagtcatcccgttcctggtgctggctgttggagtggacaacatcttca

SEQ ID NO: 54391 - DNA, 201 bp, Homo sapiens
taagtaagtagtaaaaaaaagaaaaaaagtccgtctatacactgtaaagtgctgtgtaaatgttcataattactatcactgtcttcttcatagttgatggrgggaaggctggatacataaaaaaatggtaatacagtaagaagtgctcagataagaataaagataaaatgttatggagagtccatttttgagctgagctat

SEQ ID NO: 54392 - DNA, 201 bp, Homo sapiens
agacagactcttgctctgtcaccgaggctggagtacagtggcatgatctcagcttactgcaacctcctcccgggttcaagcgattctcctgcctcagcctscccagtagctgggactgcaggcacatgccaccacacctagctaagttttatatttttagtagaggtggggtttcaccatgttggccaggctggtctcaaa

SEQ ID NO: 54393 - DNA, 201 bp, Homo sapiens
aatctgaccatttccttcactgctgaacgaagtattgaagatgaactaaatcgtgaaagtgacagtgatgtcttcaccgttgtaattagctatgccatcakgtttctatatatttccctagccttggggcacatcaaaagctgtcgcaggcttctggtaagccggggggggggtggtgtatgttctagaggttaacagcag

SEQ ID NO: 54394 - DNA, 201 bp, Homo sapiens
tagtttaactaaaaatataacattttgcttaccttttaggtttattaattttgtgaaaaactacaagaatcccaatctgaccatttccttcactgctgaaygaagtattgaagatgaactaaatcgtgaaagtgacagtgatgtcttcaccgttgtaattagctatgccatcatgtttctatatatttccctagccttggg

SEQ ID NO: 54395 - DNA, 201 bp, Homo sapiens
cctttcagtaatgtccttctattgtgccacccttttaagatgagaactcttacctatgtaactgagtaagacagggagaaatattaatccgtgagtggctrccagtaagaccatggccaaatacatcctgaagtagaatatctggaaaatttgagatttggcaaaagccaacaccacaatccctccaaattttgtaagtgt

SEQ ID NO: 54396 - DNA, 201 bp, Homo sapiens
atccgcccacctcggcctcccaaagtgctgggattacaggcatgagccactgcacctggcctagaaggggcttttttttaacctttcctgaactgttcctrtcgttgaaagaagcttccctatccagtcattttcttagtaattaaactctagagcatgttgtgaaatatccatatgatctaacctttaaaaatagaaact

SEQ ID NO: 54397 - DNA, 201 bp, Homo sapiens
aggttttaaaattttcttttgagattgcctcggtgtttttccttaaagttagcacattctttgctttctacttcagcctcaaggacaggaagttcattctygctctttacattggggtgttgatgtttgtggttttgttgttttgttcttcatgttactcatgatgtattgatattaattaacctaaatacatatggaaat

SEQ ID NO: 54398 - DNA, 201 bp, Homo sapiens
catctgcaccagagacactgccgggtccgagtgagggcaggaggctgcacgagggagcctccctgggagtgagcgataggttcgctatgggaggtgggttygaaaggtgcctgagattttcatttgaaactctgttgaagaggaattggcaatagaggaggaaatacaaatagaggaaagattggtttcgtcttaagcact

SEQ ID NO: 54399 - DNA, 201 bp, Homo sapiens
taatagatcaggaatgggtttagcctgctggcctgacccctgattcagtcaccacactgtgaacattccatagggaaaaaactgcagacagtgtatactgrcacccactttcatagttttgttttagttttgtggctcctaaatgtctaagactaactagtaatatgaccttgggtgagtcacataaaaaaccagaagcta

SEQ ID NO: 54400 - DNA, 201 bp, Homo sapiens
agcaattatgtgccgtagagaaaatgtggctattctgtttccctagagttttttaaaatttatttttaaaatttatttattttagagacaggttcttgctstgttgcccaggcgtgggggcagtgtcgccatcatagctcactgcagcctggaactcctggcctcaagcagtccttccaccttggcctcccaaagcactgg

SEQ ID NO: 54401 - DNA, 201 bp, Homo sapiens
caactttttggtttatcttaaagtttatttcacataatccagttttttcttatttgtccagtccatcacctaagaatgcaaactcataacatgtgttgccsgagcagacctagaaatgtttacaagtcctctctgaaacacagaattgtacattcaactctaggtttaatacagccctgtaaagtaaaaaggaggaccttt

SEQ ID NO: 54402 - DNA, 201 bp, Homo sapiens
aagaagccagacagcctgggaaggagattcttaaagctgttaaaatgtatctaaaaaaaaagcaaaagcaaatgtggaacagtagataaaatgtttttccygtgagcttttatcagtccatataaacaagagttttaagttttttattttgaaatagtttcagattcacagaaagttgcaaagaaacttttatttttcctc

SEQ ID NO: 54403 - DNA, 201 bp, Homo sapiens
atgttctagaggttaacagcagtgcacagtgtaacgtcatatttttgcctctttattcttattccattatgtttaaaactgccataaattcccccatgttktaattgtatgtaacgtttctgttgcctacatctattttcttcattccaactttttggtttatcttaaagtttatttcacataatccagttttttcttatt

SEQ ID NO: 54404 - DNA, 201 bp, Homo sapiens
ctgttaaaatgtatctaaaaaaaaagcaaaagcaaatgtggaacagtagataaaatgtttttcccgtgagcttttatcagtccatataaacaagagttttmagttttttattttgaaatagtttcagattcacagaaagttgcaaagaaacttttatttttcctcttaataatgaggaaatagaagccaagagaggtgaag

SEQ ID NO: 54405 - DNA, 201 bp, Homo sapiens
cttattccattatgtttaaaactgccataaattcccccatgttttaattgtatgtaacgtttctgttgcctacatctattttcttcattccaactttttgktttatcttaaagtttatttcacataatccagttttttcttatttgtccagtccatcacctaagaatgcaaactcataacatgtgttgcccgagcagacct

SEQ ID NO: 54406 - DNA, 201 bp, Homo sapiens
cacacttaaggaaacaccatctggggacacagggagaaggtgctgtctacaagccaggaagagagccctcaccaggaaccaaataagctccccatgctgawcttgaactctctaacctctagaactgtaacagataaattcctattgtttaagtcacaccagtctttggtattttgtgcaatggcctcagacgtcactaaa

SEQ ID NO: 54407 - DNA, 201 bp, Homo sapiens
tgcatagagtatctgagaaaatgaggcatgcagtcgatgtttggtatttttgtttcatttatttattttactgccatgcctcgagaacaatagatgttcaktaagtatttgaatatgttagttaatgctttaggatttcctaaaggcagtggaatagaattctcactgagttcagagcttttctgataataatgtgtgctt

SEQ ID NO: 54408 - DNA, 201 bp, Homo sapiens
ttcattaaactgtgaaagtgacatgtggctgaagcttttagataaggggaaagattatccctcactagtaaggaaagtaatcgatagagaagaaagtaatrcccctcactgtcagtattttaaaatgttttacaaaaaatctggagacctattcttctaacagtcctccctgcatgtctccgccagtggttgaccctgcct

SEQ ID NO: 54409 - DNA, 201 bp, Homo sapiens
acaaaataaataaaatcacagattgcatttaggtacttccatacattgctggctgcaatttctttggagggcaatttgacaacaatcaaaacttaaatacscatttcctttgatccaacaatataaaagtatttccaacagttctatttgcgcatgattgcaaagatttacatccaagaatgggccaggagtggtggctca

SEQ ID NO: 54410 - DNA, 201 bp, Homo sapiens
tctgtcctctctagtacccgaataggcttcgccccctcgtcctggatcgacgattatttcgactgggtgaagccacagtcgtcttgctgtcgagtggacartatcactgaccagttctgcaatgcttcaggtaccttctcctttaccaaatctttcctgttttgctgaaaaattttcaaattatcatttaaaaatcatttg

SEQ ID NO: 54411 - DNA, 201 bp, Homo sapiens
tctgggtggtcagtggccatgagaggtcaagtgagttgctttcggtgagtcttgtagacagccagcaaggttttctgcaagggatgtttcccaaaggagtytgaccacttggcagtggtgacaggatgaacacgcagtgttcgggagtgagagcgagctttaatgaggcctcccctctcccctccagtgtgttttatgtct

SEQ ID NO: 54412 - DNA, 201 bp, Homo sapiens
agcgggtataacctttgtttccctctgtcccctcagaaaaatcggctagacatcttttgctgtgtcagaggtgctgaagatggaacaagcgtccaggcctsagagagctgtttgtttcgcttcttcaaaaactcctattctccacttctgctaaaggactggatgagaccaattgtggtatgcgcttatctgtggtttttc

SEQ ID NO: 54413 - DNA, 201 bp, Homo sapiens
ctgtcccctttcctctccctccagcttttcctggactttttcacctgagggtcctgcagtaatggcaggtggcctgcccagaaccatgcccttacctgctkcttctccccattttgtttaaaggcagtgacagctaccagttactcaggcttgaggctttatccctgaattctgcctcgccctcgccttcctcatggggtt

SEQ ID NO: 54414 - DNA, 201 bp, Homo sapiens
tcagttagtttaactaaaaatataacattttgcttaccttttaggtttattaattttgtgaaaaactacaagaatcccaatctgaccatttccttcactgytgaacgaagtattgaagatgaactaaatcgtgaaagtgacagtgatgtcttcaccgttgtaattagctatgccatcatgtttctatatatttccctagcc

SEQ ID NO: 54415 - DNA, 201 bp, Homo sapiens
tcatttgtggagaacaaacatacagttaaaaaaacaaaactgggccgagagttattcatgcctgtaatcccagcaatttgggaggcagaggcgagcacatyacttgagctaggagtttgagaccagcctgagcaacatggagaaaccccgtctctgcaaaaaatacaaaaattagctgggcatggtggtgcatgcttgtag

SEQ ID NO: 54416 - DNA, 201 bp, Homo sapiens; identical to SEQ ID NO: 15874

SEQ ID NO: 54417 - DNA, 201 bp, Homo sapiens; identical to SEQ ID NO: 15875

SEQ ID NO: 54418 - DNA, 201 bp, Homo sapiens
ttcaccatgttggccaggttggtctcgatctcttgacctcgtgatcccgcccaccttggcctcccaaagtgctgggtttacaggcgtgagccaccgcgccyagcccagtagtgtgtttttaaaggacctaaaagttttaaataaaatgagggccacaaggtgaaattatcctttattaattgttctcttaacatcttctta

SEQ ID NO: 54419 - DNA, 201 bp, Homo sapiens
ttccttttattggagaatggtatgtagaaacgaagatctgggcactaggtatgctcattgctgctggaaagagtagcatgtttttgtttgtttgtttgtttttttgagatggagtcttgctctgtcaccaggctggaatgcagtggcgcgatctcagctcactgcaaccaccgcctccctggttcaagcagttctcctgcc

SEQ ID NO: 54420 - DNA, 201 bp, Homo sapiens
atgttgatagttgaaaatggcatccttgagtagccactgaatccttctccacatgacactctaagcagcagctcccaaatccacaggcactcgcttacaaratgtttgccgttgttttcaaaggcagtctttctcttctgtgcacacaactcattggggaagcagccttgttaatgaccagaagctcttgactcaccacat

SEQ ID NO: 54421 - DNA, 201 bp, Homo sapiens
ccatgctgatcttgaactctctaacctctagaactgtaacagataaattcctattgtttaagtcacaccagtctttggtattttgtgcaatggcctcagaygtcactaaatgacattgattacattctattaccccaaaaccctagttctatcttcattttctgttattgaactttaggcttcaggttaggaactaggcaa

SEQ ID NO: 54422 - DNA, 201 bp, Homo sapiens
gttccttttattggagaatggtatgtagaaacgaagatctgggcactaggtatgctcattgctgctggaaagagtagcatgtttttgtttgtttgtttgtttttttgagatggagtcttgctctgtcaccaggctggaatgcagtggcgcgatctcagctcactgcaaccaccgcctccctggttcaagcagttctcctgc

SEQ ID NO: 54423 - DNA, 201 bp, Homo sapiens
ggttccttttattggagaatggtatgtagaaacgaagatctgggcactaggtatgctcattgctgctggaaagagtagcatgtttttgtttgtttgtttgtttttttgagatggagtcttgctctgtcaccaggctggaatgcagtggcgcgatctcagctcactgcaaccaccgcctccctggttcaagcagttctcctg

SEQ ID NO: 54424 - DNA, 201 bp, Homo sapiens
tggttccttttattggagaatggtatgtagaaacgaagatctgggcactaggtatgctcattgctgctggaaagagtagcatgtttttgtttgtttgtttgtttttttgagatggagtcttgctctgtcaccaggctggaatgcagtggcgcgatctcagctcactgcaaccaccgcctccctggttcaagcagttctcct

SEQ ID NO: 54425 - DNA, 201 bp, Homo sapiens
agtcctccctgcatgtctccgccagtggttgaccctgcctgcgttcgctgcaggcctctgactccggaaggcaaacagaggcctcaggggggagacttcakgagattcctgcccatgttcctttcggataaccctaaccccaagtgtggcaaagggtaagtgctgctgccattgcagataagcatccactgcaactttaat

SEQ ID NO: 54426 - DNA, 201 bp, Homo sapiens
atattagtatgcatggcagtcagcattttcttaataaataaagatctcatctcagcctggccaaaatgtgaaaccctgtctctactgaaaatacaaaaaawattagccacacgtggtggtgtgtgcctgtagtcccagctactcgggagactgaggcaggagaatcacttgaatcctggaggtggagtttgcagtgagcca

SEQ ID NO: 54427 - DNA, 201 bp, Homo sapiens
tttactaagcagtctctgtcttatgattcatttgttgttccagatagcaatatttgtgggtgttctgtcattcagcatcgcagtcctgaacaaagtagatrttggattggatcagtctctttcgatgccagatgtaagatgacttccttttttttttttttttaacttctttagctgatgatgaatacatttttcaaaaca

SEQ ID NO: 54428 - DNA, 201 bp, Homo sapiens
actacacttcttccaaggggcagaacatggtgtgcggcggcatgggctgcaacaatgattccctggtgcagcagatatttaacgcggcgcagctggacaaytagtcagtaccaccttgtcttgtacttcagaagcagcggaggaggctctcagccaggcagtcagctcaggcctgaaatgtctcactgaaaatagactttc

SEQ ID NO: 54429 - DNA, 201 bp, Homo sapiens
gatcacgccactgcactccagcctgggctacagagcaagactctgtctcaaaataaaaaaaaaaagaagccagtctgggagagaacaagctaaacctttgstgttcccttatctgggggccttcttcatccctgaaatgtacagctgggtctgacctctgagtccagggtcaggtgattttgcttagcctcaagtgctcag

SEQ ID NO: 54430 - DNA, 201 bp, Homo sapiens
gctacagataatttagtcttgggtcaactttctcctctccctctacaagggaaatgttcaaaagtgtttagactttggtgatgcagcatgattgggaaagyagagggcacagaaagatgccaggctttgtggtctccaggcaagctcaggaatgtgacaaagcataccgaaaagaaaagcgggctgggagcagtggctcac

SEQ ID NO: 54431 - DNA, 201 bp, Homo sapiens
tggacctccgcttgacatacagatactgcaccaggtaacctgctgtttgaagaaataagtcactctagatgaccttgtggtttgctggcttttacatgttkactactgctagatggggatttggggctgaatgtcatggtatatcttgaaaatcttagcgtataatggcaaagctgcctttaagttaggtttcaagaaagt

SEQ ID NO: 54432 - DNA, 201 bp, Homo sapiens
gcctttcttccggacggagcagctcatcatccgggcccctctcactgacaaacacatttaccagccatacccttcgggagctgatgtaccctttggacctycgcttgacatacagatactgcaccaggtaacctgctgtttgaagaaataagtcactctagatgaccttgtggtttgctggcttttacatgttgactactg

SEQ ID NO: 54433 - DNA, 201 bp, Homo sapiens
agacagggagaaatattaatccgtgagtggctcccagtaagaccatggccaaatacatcctgaagtagaatatctggaaaatttgagatttggcaaaagcsaacaccacaatccctccaaattttgtaagtgtgattccactgaacacctaaaagaagagatactgtgttagaaaccacttttaccaacctgtaattgaac

SEQ ID NO: 54434 - DNA, 201 bp, Homo sapiens
cagtgggcttttctttgagtttaagtataatacaaaattttggatgtttttaattgagatttgtactcaacacaattcctttctgtagattttccagtccrtgggatggagcccatgaacaatgccaccaaaggctgtgacgagtctgtggatgaggtcacagcaccatgtagctgccaagactgctctattgtctgtggc

SEQ ID NO: 54435 - DNA, 201 bp, Homo sapiens
tatgtgtgagatcatgcagaatataatttacttttcctttagatgtccatcctgtttttataacctactgaacctgttttgtgagctgacatgtagccctygacagagtcagtttttgaatgttacagctactgaagattatgttgatcctgttacaaaccagacgaaaacaaatgtgaaagagttacaatactacgtcgg

SEQ ID NO: 54436 - DNA, 201 bp, Homo sapiens
tttaattgagatttgtactcaacacaattcctttctgtagattttccagtccatgggatggagcccatgaacaatgccaccaaaggctgtgacgagtctgkggatgaggtcacagcaccatgtagctgccaagactgctctattgtctgtggccccaagccccagcccccacctcctcctgctccctggacgatccttggc

SEQ ID NO: 54437 - DNA, 201 bp, Homo sapiens
atccatcagtcagtacctgcatgcgggtccgcctgtgtactttgtcctggaggaagggcacgactacacttcttccaaggggcagaacatggtgtgcggcrgcatgggctgcaacaatgattccctggtgcagcagatatttaacgcggcgcagctggacaactagtcagtaccaccttgtcttgtacttcagaagcagcg

SEQ ID NO: 54438 - DNA, 201 bp, Homo sapiens
ccagctttatcttacatattccctgtccctgccctgcaaggagctctggttccttttattggagaatggtatgtagaaacgaagatctgggcactaggtaygctcattgctgctggaaagagtagcatgtttttgtttgtttgtttgtttttttgagatggagtcttgctctgtcaccaggctggaatgcagtggcgcgat

SEQ ID NO: 54439 - DNA, 201 bp, Homo sapiens
tcagagtgttcacactctctcctattcttttatctttctttcaggactcctacatggtggattatttcaaatccatcagtcagtacctgcatgcgggtccrcctgtgtactttgtcctggaggaagggcacgactacacttcttccaaggggcagaacatggtgtgcggcggcatgggctgcaacaatgattccctggtgc

SEQ ID NO: 54440 - DNA, 201 bp, Homo sapiens
atattttgttcctcctgaaactcaaccactgattttagcattcattgttgggtcttgtctgcaacagttataactaaggtgtttgcctgatagtgattttyttctctttccctctcttcctctgcatttactaactggacttctgtacagaaagctatcccttctccctcatttatttactcagttatttacatcatggac

SEQ ID NO: 54441 - DNA, 201 bp, Homo sapiens
aatatcttgggggaagatgctttgagactatactaatattttgttcctcctgaaactcaaccactgattttagcattcattgttgggtcttgtctgcaacmgttataactaaggtgtttgcctgatagtgatttttttctctttccctctcttcctctgcatttactaactggacttctgtacagaaagctatcccttctc

SEQ ID NO: 54442 - DNA, 201 bp, Homo sapiens
agcaccctggggccctggggggaagactggtggtgttaggaatcatgagtccagctggaggcatctcagccaggaacctcctggcaccctcttattctccrtgatcctcgccttgcttagttactatcagagtgttcacactctctcctattcttttatctttctttcaggactcctacatggtggattatttcaaatcca

SEQ ID NO: 54443 - DNA, 201 bp, Homo sapiens
tacttagaaaattgcaccccgccccaggagctctccgaccagtgccttttgcctcctatgtggttatcaggtacttttaatcattaaagatgagagcactygagaaggtattcatggaaaatagaacagtgtatccgtactctcagatatgagccctgcttcagataggggagcactgaggtccaagaaaagaagttgtga

SEQ ID NO: 54444 - DNA, 201 bp, Homo sapiens
gcaaaatatcgcaaggacaaaaaaccaaacaccgcatgttctcactcataggtgggaattgaacaatgagaacacatggacacaggaaggggaacgtcacrcaccggggactgttgtggggtgggggcctgggggagggatagcattaggagatatacctaatgctaaatgacgagttaatgggtacaacacatcaacatg

SEQ ID NO: 54445 - DNA, 201 bp, Homo sapiens
aaaagaatgcctcaggatagaattccctttcagtaatgtccttctattgtgccacccttttaagatgagaactcttacctatgtaactgagtaagacaggyagaaatattaatccgtgagtggctcccagtaagaccatggccaaatacatcctgaagtagaatatctggaaaatttgagatttggcaaaagccaacacca

SEQ ID NO: 54446 - DNA, 201 bp, Homo sapiens
accatgcctgcatgcctgactaatttttgtatttttagtagagacggggtttcaccgtgttggccaggctgatctccaactcctgacctcaggtgatctgmccgccttggcctcccagagtgctgggattacaggagtaagccaccgtgcccagccggccactcattctttagaaagtcagagtcaaggccaggctcagtg

SEQ ID NO: 54447 - DNA, 201 bp, Homo sapiens
agctgccaagactgctctattgtctgtggccccaagccccagcccccacctcctcctgctccctggacgatccttggcttggacgccatgtatgtcatcakgtggatcacctacatggcgtttttgcttgtgttttttggagcattttttgcagtgtggtgctacaggtaagcagttttgtttgtcatccagggcaaaaag

SEQ ID NO: 54448 - DNA, 201 bp, Homo sapiens
ccagccaactagctccctttctcctgcagaaataagaaaaagtctctctctctcatagggccatcagtaaataaagccaaaagttgtgccactgaagagcratacaaaggaacagagcgcgaacggcttctaaatttctagccctctcgcagggcatcctgactgaactgtgtctaagggtcggtcggtttaccactggac

SEQ ID NO: 54449 - DNA, 201 bp, Homo sapiens
gactcaccacattacaaggagccagaataagctggaacaaagtcagcacttctgtgtttctttcacatagagaatcatcaaatagacccactagtggggckgtctgccccatgtctgaagtgtagtaagagcaaagtgactctgtccactataggggaggctggactggaatcactcagtccaaagaagaccatccacggg

SEQ ID NO: 54450 - DNA, 201 bp, Homo sapiens
ttctgtagattttccagtccatgggatggagcccatgaacaatgccaccaaaggctgtgacgagtctgtggatgaggtcacagcaccatgtagctgccaasactgctctattgtctgtggccccaagccccagcccccacctcctcctgctccctggacgatccttggcttggacgccatgtatgtcatcatgtggatcac

SEQ ID NO: 54451 - DNA, 201 bp, Homo sapiens
agtgattgttctaccttagcctcctgagtagctaggactacaggcatgcactaccatgtctagctaattttatttatgtttttctttatttttttttttttgagacagactcttgctctgtcaccgaggctggagtacagtggcatgatctcagcttactgcaacctcctcccgggttcaagcgattctcctgcctcagcc

SEQ ID NO: 54452 - DNA, 201 bp, Homo sapiens
agcaaagtgcttgctgcctttcttcatctcgagactgtccttgatccttttacttctatggccacttcaccttgcacaaaaatgacccacggttgaaagarcaatactgatttgcttcatttatagctttgtcactaaattgaagcactgaagtagaagattaagaaaatgaggggctttttatcatctccgggggataga

SEQ ID NO: 54453 - DNA, 201 bp, Homo sapiens
ttgtctcctttttcctttgggtttcctcttctagcaatgtacaatgcctgccgggatgtggaggccccctcaagtaatgacaaggccctgggactcctgtrtgggaaggacgctgacgcctgtaatgccaccaactggattgaatacatgttcaataaggacaatggacaggcaccttttaccatcactcctgtgttttca

SEQ ID NO: 54454 - DNA, 201 bp, Homo sapiens
cgacctcctgagctcaagcaatctctcaactcagcgtcccaagtagctgggactacaggcacatgccacaacccctggctaattttttaaaaatttgtttggggagatggggcttcaccatgttgcctagcctggtctcaaactcctaggctcaagcaatccaccctcctcagccttcctaagtactgggagtacaggcat

SEQ ID NO: 54455 - DNA, 201 bp, Homo sapiens
acctgccttggcttcccaaagtgctgggattataggcgtgagccaccacttccagccaggatgacttttttttttttttttttttttttttggtcttctcwgctgtgtctctagaagatgaccttttgagaagcaaacctgaatgttgattcaagcccaaatttcctgggctcaggtgttaattttttaagtctttggaac

SEQ ID NO: 54456 - DNA, 201 bp, Homo sapiens
ggccatggcaccagggtcggagccacgtacttcatgacctaccacaccgtgctgcagacctctgctgactttattgacgctctgaagaaagcccgacttayagccagtaatgtcaccgaaaccatgggcattaacggcagtgcctaccgagtatttccttacaggtaaagcctgccctttttcaatggggtttacccagca

SEQ ID NO: 54457 - DNA, 201 bp, Homo sapiens
tcgacctcctgagctcaagcaatctctcaactcagcgtcccaagtagctgggactacaggcacatgccacaacccctggctaattttttaaaaatttgtttggggagatggggcttcaccatgttgcctagcctggtctcaaactcctaggctcaagcaatccaccctcctcagccttcctaagtactgggagtacaggca

SEQ ID NO: 54458 - DNA, 201 bp, Homo sapiens
ctggtcaggtattttgtagcatgtccttccatttggctttatctggtattttctcatgatgagattgaaataaggtgttttgacaagtacatcacagaagycatgttatgtctttctcggtgcatcatgtcagggatccctgatgttgatgcgtctctttcctggtgatgttaaccttgatcacttgctcaaggtgatgtc

SEQ ID NO: 54459 - DNA, 201 bp, Homo sapiens
tgctcaatactatgagtcatcagggaaatacaaatcaaaaccacaatgagataccacttcacacccaccaggatggctagaatcaaagtcacataacaagmagtgttgacaaggctgtggaaaataggaacctttattaaaaagaaatccaaaaaccaaaaacagctgggcacagtggctcatgcctataatccagcactt

SEQ ID NO: 54460 - DNA, 201 bp, Homo sapiens
accacttacaaccataatttggtacaatcgtttcaaaactacttgaaaaacaactttgcagtacgtagtaagttgaagctaaccctcctcccagaaatttsacttatagatgcctgccttagagaaactctaaatgcatataaacctggagacccatataagaacacccactgtaacactattgtgattgtgaaaaattga

SEQ ID NO: 54461 - DNA, 201 bp, Homo sapiens
ctcgacctcctgagctcaagcaatctctcaactcagcgtcccaagtagctgggactacaggcacatgccacaacccctggctaattttttaaaaatttgtttggggagatggggcttcaccatgttgcctagcctggtctcaaactcctaggctcaagcaatccaccctcctcagccttcctaagtactgggagtacaggc

SEQ ID NO: 54462 - DNA, 201 bp, Homo sapiens
gagcgcgcggaagaggcacttgcccacatgggcagctccgtgagtaccctgagcagggccacgccggcagagtcgcaccacaaagtaatcctcctcagtgrctgaagagtctggatcctgtacttacaaagcagcttctaaggattgcaagctttcaggcaattcatgaattagctgccacatcgtggacagaacggacgt

SEQ ID NO: 54463 - DNA, 201 bp, Homo sapiens
tcagcctgggaagtggaggttgcagtgagctgagatcacaccattggactccagcctgagggacagagactccatctccaaaaaaaaaaaaaaaaaaaaaactcttactactcaatgataaataaataacccaatttaaaatggcaaaagatctgaatagagtagacatttctctaaggaagatatacaaatgaccaacaa

SEQ ID NO: 54464 - DNA, 201 bp, Homo sapiens
tgtgtgtgtgtaagtatttttttattttttggaagagacgggcctcactgtgttggtgaggctggtcttgaactcctggccttaagtgatcctcctgcctyggcctgccaaagtgttgggactgtaggtgtgagccaccacacctggcctatagtgcattattatttttatttagtttttaaattatgccatagccagttg

SEQ ID NO: 54465 - DNA, 201 bp, Homo sapiens; identical to SEQ ID NO: 15905

SEQ ID NO: 54466 - DNA, 201 bp, Homo sapiens
cctcgacctcctgagctcaagcaatctctcaactcagcgtcccaagtagctgggactacaggcacatgccacaacccctggctaattttttaaaaatttgtttggggagatggggcttcaccatgttgcctagcctggtctcaaactcctaggctcaagcaatccaccctcctcagccttcctaagtactgggagtacagg

SEQ ID NO: 54467 - DNA, 201 bp, Homo sapiens
tgagatagcaactaatgctttccctgttccgactttcaggaacggcttggctcttaacctccaccttcccttcctctcccgttcttccaggagaggcgtcytgctgtgaccctgtcagcgcagcatttgagggctgcttgaggcggctgttcacacgctgggggtctttctgcgtccgaaaccctggctgtgtcattttct

SEQ ID NO: 54468 - DNA, 201 bp, Homo sapiens
accgcgaaggtctgcagcttcactcctgagccagcgagatcacgaacccaccagaaggaagaaactccgaaaacatctgaacatcagaagggacagattcyagacgcgccaccttaagagctgtaacgctcaccgccagggtccgcggcttcattcttgaagtcagtgagaccaagaacccaccaattccggacacaatgt

SEQ ID NO: 54469 - DNA, 201 bp, Homo sapiens
aggtcagtaaccctgtctgtcctctctagtacccgaataggcttcgccccctcgtcctggatcgacgattatttcgactgggtgaagccacagtcgtcttrctgtcgagtggacaatatcactgaccagttctgcaatgcttcaggtaccttctcctttaccaaatctttcctgttttgctgaaaaattttcaaattatca

SEQ ID NO: 54470 - DNA, 201 bp, Homo sapiens
ctgcttttatgagctgtaacactcaccgcgaagatctgcagcttcactcctgagcccagcgagaccacgagcccactgggaggaacgaacaactccagacrcgctgccttaagagctgtaacactcaccgcgaaggtctgcagcttcactcctgagccagcgagatcacgaacccaccagaaggaagaaactccgaaaaca

SEQ ID NO: 54471 - DNA, 201 bp, Homo sapiens
ctttgctgagcagataggtagctgagggcaggggtctcatatgtgtccccaggtgggcttgattcctgccatgagatagcaactaatgctttccctgttcygactttcaggaacggcttggctcttaacctccaccttcccttcctctcccgttcttccaggagaggcgtcctgctgtgaccctgtcagcgcagcatttga

SEQ ID NO: 54472 - DNA, 201 bp, Homo sapiens
aggattgtaaatacaccaatcggcactctgtatctagctcaaggtttgtaaacacaccaatcagcaccctgtgtttagctcaaggtttgtgagtgcaccartcgacactctgtatctagctgctctggtggggccttggagaacctgtgtgtggaaactctgtatctaactaatctgatggggacgtggagaacctttgta

SEQ ID NO: 54473 - DNA, 201 bp, Homo sapiens
cttgtgaataaatagtaaatgtgtagccttttaaaataattctataataactttgcaaatacaggatgtgtcttacccttttgtacttcaaaaggattacrtgaatgaatgtgtcttagttcactgaggaatgttgaccttactctaactgttgcctactcccgtgtctgtgctctttcacctgaaaggaactctgtccag

SEQ ID NO: 54474 - DNA, 201 bp, Homo sapiens
aaatacaccaatcggcagtctatctagctcaaggtttgtaaacacaccaatcagcaccctgtgtttagctcaaggtttgtgagtgctccaatcgacactctgtatctagctgctctggtgaggacgtggagaacctttatgtctagctcaaggtttgtaaacacaccaatcagcaccctgtgtttagctcaaggtttgtga

SEQ ID NO: 54475 - DNA, 201 bp, Homo sapiens
tgatggcagtgatcagctgcggccagccaggtttttcttcatctggactgtgcctctcactttcaaatttttggaacatttgctttggcaacaaaactttyaaaaaaccaactctctctggtgcaggtgttctgttggaggatttgagagaagctttaaaattttatcttattactgtcccttgcttaggtcacaagagga

SEQ ID NO: 54476 - DNA, 201 bp, Homo sapiens
actcgttaaaccaaatcaggatgagagtgcctccggggaattgtgtccttgtgcacattaacgcccctcacataggtgtggcgtcaataggaagtggtgartcaggggagagggggttccgtggactagaaaaaactctccttcgacttctatttagttctcagaaggggataggtgatgttgatccaataatggactaag

SEQ ID NO: 54477 - DNA, 201 bp, Homo sapiens
cctgccaaagtgttgggactgtaggtgtgagccaccacacctggcctatagtgcattattatttttatttagtttttaaattatgccatagccagttgttytgaatagtgcagtactacaaaacagagtcaaggtctcatgctgtcacccaggctggaatacagtgatgcaatcatggctcactgcagcctcaacctccta

SEQ ID NO: 54478 - DNA, 201 bp, Homo sapiens
taaatacaccaatcggcagtctatctagctcaaggtttgtaaacacaccaatcagcaccctgtgtttagctcaaggtttgtgagtgctccaatcgacactctgtatctagctgctctggtgaggacgtggagaacctttatgtctagctcaaggtttgtaaacacaccaatcagcaccctgtgtttagctcaaggtttgtg

SEQ ID NO: 54479 - DNA, 201 bp, Homo sapiens
aaacaattttgcatcataattacttagaaaatacccgggagggggtgggggaggaggaccctttgtcatactccatgtaactcaccatcgcataactctgstcggcatccaggtactttttatactcatggttgagtttatcaaaaacagtggctatcacgggcagcgatgctctgtctgactcacttaacactggaaagg

SEQ ID NO: 54480 - DNA, 201 bp, Homo sapiens
acataaggtttctcatcctgttctaactccagcgattgcctctcaggattggtatctggccttagcttctcagaggagggcttttctttatcactttaccytgtggttttgtaggagcgtcgaggttgccctggaattttcttaataaaaacatagaagccccgggctctgaccagtcaaggccatacttgaaggaggaga

SEQ ID NO: 54481 - DNA, 201 bp, Homo sapiens
attgtgtttaccttagggaaggggctactgtcagggaggggtaattggggagcttcaactgaatctatagagtgtgtgtgtgtgtgtaagtatttttttawtttttggaagagacgggcctcactgtgttggtgaggctggtcttgaactcctggccttaagtgatcctcctgcctcggcctgccaaagtgttgggactgt

SEQ ID NO: 54482 - DNA, 201 bp, Homo sapiens
ggattgtgtttaccttagggaaggggctactgtcagggaggggtaattggggagcttcaactgaatctatagagtgtgtgtgtgtgtgtaagtatttttttattttttggaagagacgggcctcactgtgttggtgaggctggtcttgaactcctggccttaagtgatcctcctgcctcggcctgccaaagtgttgggact

SEQ ID NO: 54483 - DNA, 201 bp, Homo sapiens
ggctgtctggcattctgactgagcccctctgggcacagctgcagaacacgaataactagtcttatgaggttactttatgagatgctctcctgattgtgggkctagcaggaggagcaccctggggccctggggggaagactggtggtgttaggaatcatgagtccagctggaggcatctcagccaggaacctcctggcaccc

SEQ ID NO: 54484 - DNA, 201 bp, Homo sapiens
aggattgtgtttaccttagggaaggggctactgtcagggaggggtaattggggagcttcaactgaatctatagagtgtgtgtgtgtgtgtaagtatttttttattttttggaagagacgggcctcactgtgttggtgaggctggtcttgaactcctggccttaagtgatcctcctgcctcggcctgccaaagtgttgggac

SEQ ID NO: 54485 - DNA, 201 bp, Homo sapiens
tgcgggtggggtgaccttaacgggttccagcaatttctcctggtcaacacaaacgtgccacagaaaaccaggcttttggctgtgtgtagagagggccccaraaagttcctggtacagtaagattggtgtgatggaggccttgtaagtccaatgggatgcttggcctcctctagcacccagggtgccctgggtaattagcac

SEQ ID NO: 54486 - DNA, 201 bp, Homo sapiens
caggattgtgtttaccttagggaaggggctactgtcagggaggggtaattggggagcttcaactgaatctatagagtgtgtgtgtgtgtgtaagtatttttttattttttggaagagacgggcctcactgtgttggtgaggctggtcttgaactcctggccttaagtgatcctcctgcctcggcctgccaaagtgttggga

SEQ ID NO: 54487 - DNA, 201 bp, Homo sapiens
tggtgaaatccccctcatcctcggagctctgggtctgtacagtctcttcctcttggctataattttgccttttagtgtttgctccctcctctgtgcctgcrtagcgccatgcaccatgtgccattgatggcactgggctgtatttgcctgcctcttgcccagtgattctgagctcccaaaggtgagtgctgagctgtatta

SEQ ID NO: 54488 - DNA, 201 bp, Homo sapiens
tggtgtgggctgtctggcattctgactgagcccctctgggcacagctgcagaacacgaataactagtcttatgaggttactttatgagatgctctcctgaytgtggggctagcaggaggagcaccctggggccctggggggaagactggtggtgttaggaatcatgagtccagctggaggcatctcagccaggaacctcct

SEQ ID NO: 54489 - DNA, 201 bp, Homo sapiens
tcaggattgtgtttaccttagggaaggggctactgtcagggaggggtaattggggagcttcaactgaatctatagagtgtgtgtgtgtgtgtaagtatttttttattttttggaagagacgggcctcactgtgttggtgaggctggtcttgaactcctggccttaagtgatcctcctgcctcggcctgccaaagtgttggg

SEQ ID NO: 54490 - DNA, 201 bp, Homo sapiens
ttttttagagatgggatcttgctatgttgtccaggctggactcaaactcctgggttatagccatccttctgcctcagcttcctgagtacttgagattaggygtgccaccatacccggcatacaggacttgccaaaccaccatcttgctctcattccctctcactgttctctctccctccctttttcctcccacagttgtaa

SEQ ID NO: 54491 - DNA, 201 bp, Homo sapiens
tcaagaccagccggggcaacatggtgaaacaccgtcttaaaaacattttgtttttcttttcattgttgaggttgaggctgctgtgagctgtgatcacgccrgtgtactccagcctgggcaacagagcaagaccctgtgtcaaaacaaaaaagagagagaaataaataatagcaattatgtgccgtagagaaaatgtggcta

SEQ ID NO: 54492 - DNA, 201 bp, Homo sapiens
tgagctgtgatcacgccagtgtactccagcctgggcaacagagcaagaccctgtgtcaaaacaaaaaagagagagaaataaataatagcaattatgtgccktagagaaaatgtggctattctgtttccctagagttttttaaaatttatttttaaaatttatttattttagagacaggttcttgctctgttgcccaggcgt

SEQ ID NO: 54493 - DNA, 201 bp, Homo sapiens
aaaaatgatgggggacagaggtgcgtgagccttgtgtttcctcaaagcggacgtggttcccaccagtgtggaagcggtacagggagtggcaggctcctggyggcagggacctgaattggtttgtagttatgcttgtgcgcgtcctcataaccccagtctcgccctagcgctgtcccctttcctctccctccagcttttcct

SEQ ID NO: 54494 - DNA, 201 bp, Homo sapiens
agaacatggtgtgcggcggcatgggctgcaacaatgattccctggtgcagcagatatttaacgcggcgcagctggacaactagtcagtaccaccttgtctygtacttcagaagcagcggaggaggctctcagccaggcagtcagctcaggcctgaaatgtctcactgaaaatagactttcttggaaaagttgtttttatgc

SEQ ID NO: 54495 - DNA, 201 bp, Homo sapiens
cagctctccagtcaaattgaactgcttgctagcaaaatcctgcccatcttccagggccccatttcacatgctacattatctacgacattcttgtcctgttsccctaactagaatgccttccctctgaagttctgaatctttatttaaactgctgcaacagcatttgctgcctcattaaaagaccttggtgtgggtcttgac

SEQ ID NO: 54496 - DNA, 201 bp, Homo sapiens
actctaatcacatgaagtctcctcgttttcagcaacttccttgttttgagcattctcagtccagaagaggcggaaagctgcggcccaccttcttttccacraaggctgacaggacatgggtgtacacatctgactggtccagcaccgcctgggtccgcaccggcctcttgaggagcgggctgcttcggctctgccctgctt

SEQ ID NO: 54497 - DNA, 201 bp, Homo sapiens
ctgtcccccaggctgaagtgtagtggtttgattgtggctcactgaagtgttgaccctgggctcaagctatccttccacctcagcctcccacgtagctgggrctgcaggtgcatgccaccatgcccaactaatttttaaattttttgtagacacaaggtcttgctgtgttgcccaaggtggtcttgaattcctgggctggag

SEQ ID NO: 54498 - DNA, 201 bp, Homo sapiens
agtgttcacactctctcctattcttttatctttctttcaggactcctacatggtggattatttcaaatccatcagtcagtacctgcatgcgggtccgcctrtgtactttgtcctggaggaagggcacgactacacttcttccaaggggcagaacatggtgtgcggcggcatgggctgcaacaatgattccctggtgcagca

SEQ ID NO: 54499 - DNA, 201 bp, Homo sapiens
tgtggaactgtacctgttggtacggctcctttttaggtggcagtgtgctgaagcaggaaaataacagacaagttaaacatgagacagctggcagtctttcycatttaaaatgcaggggagcccgggccagaacccagcgtgtgatgtgcggttggtgcctggagagtcgtcttggttcaactctacaccctggcttagcct

SEQ ID NO: 54500 - DNA, 201 bp, Homo sapiens
ggtggaccagtgttcccgtggcttgtgttgggaggctatgatggtaagtaagagaagctttgacttttccttttagataaagtcatctcggttttgtcatyagcatcaagtggtaattatgaagatttcataaattgggcagttttgttaatttcttacctcttgaatcccagaatagtatctcctttggctttgggtttg

SEQ ID NO: 54501 - DNA, 201 bp, Homo sapiens
taaatacccatttcctttgatccaacaatataaaagtatttccaacagttctatttgcgcatgattgcaaagatttacatccaagaatgggccaggagtgstggctcacgcctgtaatcccagcactttaggaggctgaggcaggcagattgcttgagcccagcagttcaagaccaatctgggcaacatggtgaaaccccg

SEQ ID NO: 54502 - DNA, 201 bp, Homo sapiens
cttctttcaggttcttgacttacaaatagccatcgaaaacattactgcctcttatgacaatgagactgtgacacttcaagacatctgcttggcccctcttycaccgtataacacgaactgcaccattttgagtgtgttaaattacttccagaacagccattccgtgctggaccacaagaaaggggacgacttctttgtgta

SEQ ID NO: 54503 - DNA, 201 bp, Homo sapiens
ctcaacacaattcctttctgtagattttccagtccatgggatggagcccatgaacaatgccaccaaaggctgtgacgagtctgtggatgaggtcacagcaycatgtagctgccaagactgctctattgtctgtggccccaagccccagcccccacctcctcctgctccctggacgatccttggcttggacgccatgtatgt

SEQ ID NO: 54504 - DNA, 201 bp, Homo sapiens
ctgctcctgctcctccgctcctcctgcgcggggtgctgaaacagcccggggaagtagagccgcctccggggagcccaaccagccgaacgccgccggcgtcmgcagccttgcgcggccacagcatgaccgctcgcggcctggcccttggcctcctcctgctgctactgtgtccagcgcaggtgagcggtcgccggccaccgg

SEQ ID NO: 54505 - DNA, 201 bp, Homo sapiens
cttgtctcctttttcctttgggtttcctcttctagcaatgtacaatgcctgccgggatgtggaggccccctcaagtaatgacaaggccctgggactcctgkgtgggaaggacgctgacgcctgtaatgccaccaactggattgaatacatgttcaataaggacaatggacaggcaccttttaccatcactcctgtgttttc

SEQ ID NO: 54506 - DNA, 201 bp, Homo sapiens
ggatcacctacatggcgtttttgcttgtgttttttggagcattttttgcagtgtggtgctacaggtaagcagttttgtttgtcatccagggcaaaaagagsaaaattgcccactggcactttgagctttcatttgtcagagcttggttacttaggacaagaaacaaatacctccatgaataccattgcatggattattgtg

SEQ ID NO: 54507 - DNA, 201 bp, Homo sapiens
ctggactctcttgacacccaggattctttcctcaggggacatgctgcctatagttctgcagttaacatcctccttggccatggcaccagggtcggagccaygtacttcatgacctaccacaccgtgctgcagacctctgctgactttattgacgctctgaagaaagcccgacttatagccagtaatgtcaccgaaaccatg

SEQ ID NO: 54508 - DNA, 201 bp, Homo sapiens
gatacagagaagctccagagggcccaggcctgggaaaaagagtgagtcactcatgggtgtgagcagactgtccttgcattgtgggaagctagacacttgcrgcaagcacttaaacttcattttctaaattaaccaatggcagatctgagttacgtagttttgttcacttggtactaatgatgctaagaagaaactgtaaac

SEQ ID NO: 54509 - DNA, 201 bp, Homo sapiens
cgggctttcaccatgttggccaggctagtctcgaactcttgacctcaggtgatctgccagcctcagcctcccaaagtgctggaattacaggcataagccaytgagcccagccctaaacttactttaattcagcatgtatggaaccttagctgtaatctgatagtctccagtgtggaagaccctaatgcagtggctgggcat

SEQ ID NO: 54510 - DNA, 201 bp, Homo sapiens
tttaccttagggaaggggctactgtcagggaggggtaattggggagcttcaactgaatctatagagtgtgtgtgtgtgtgtaagtatttttttattttttkgaagagacgggcctcactgtgttggtgaggctggtcttgaactcctggccttaagtgatcctcctgcctcggcctgccaaagtgttgggactgtaggtgt

SEQ ID NO: 54511 - DNA, 201 bp, Homo sapiens
agtatgcctaagatgaaaatggtatttcagattcattaaactgtgaaagtgacatgtggctgaagcttttagataaggggaaagattatccctcactagtraggaaagtaatcgatagagaagaaagtaatgcccctcactgtcagtattttaaaatgttttacaaaaaatctggagacctattcttctaacagtcctccc

SEQ ID NO: 54512 - DNA, 201 bp, Homo sapiens
tgaggctggtcttgaactcctggccttaagtgatcctcctgcctcggcctgccaaagtgttgggactgtaggtgtgagccaccacacctggcctatagtgsattattatttttatttagtttttaaattatgccatagccagttgttctgaatagtgcagtactacaaaacagagtcaaggtctcatgctgtcacccaggc

SEQ ID NO: 54513 - DNA, 201 bp, Homo sapiens
accacgaccatgccattattattacattattattagctaaaccagagatcttaatcagatttcaccagctttttctctaatgcccttccctgtttcaaggycccatattacatttttgtgttttatgagtcccctctaatctgtgacagaaagttcctcagtctttccttttctggccttaacactcttgatgatactggt

SEQ ID NO: 54514 - DNA, 201 bp, Homo sapiens
ccaaaggtttggagtcgctgaggacgtggtactgcaggaactgatgcagcatataaaagaggttgtgctggacaagggttttgataacaagttcatgtagrtaatgctgaggacaaaagtaaaaagtgaaagaacacttccaaatcattcagctacaacagactagaggctccccaaggactggctattctaaccaacaca

SEQ ID NO: 54515 - DNA, 201 bp, Homo sapiens
tagcattcattgttgggtcttgtctgcaacagttataactaaggtgtttgcctgatagtgatttttttctctttccctctcttcctctgcatttactaacyggacttctgtacagaaagctatcccttctccctcatttatttactcagttatttacatcatggacttttaattctgtgggttgtatccaacactgtcatt

SEQ ID NO: 54516 - DNA, 201 bp, Homo sapiens
cagggcagggttgaacctcacccttcagaggctcctgtgtcggcatctcctctgtggggtgggaatagcgctcattgagggcagccaacaaaggtggcttygctgagcagataggtagctgagggcaggggtctcatatgtgtccccaggtgggcttgattcctgccatgagatagcaactaatgctttccctgttccgac

SEQ ID NO: 54517 - DNA, 201 bp, Homo sapiens
ttgatgaacacataacatgtgctatcgtgccagctagagattagtgctatgaggagaaaaataaggctggacagagtggggggtgcattgcttaagcgtgragatgtgcacaaagggagaggaaaggacagctgggcacatcacagggatgagagttcccggcagaaccagcagcaagtgcagagccctggcaggaagctc

SEQ ID NO: 54518 - DNA, 201 bp, Homo sapiens
tggccctattatgtgtgagatcatgcagaatataatttacttttcctttagatgtccatcctgtttttataacctactgaacctgttttgtgagctgacaygtagccctcgacagagtcagtttttgaatgttacagctactgaagattatgttgatcctgttacaaaccagacgaaaacaaatgtgaaagagttacaata

SEQ ID NO: 54519 - DNA, 201 bp, Homo sapiens
cttcttttccacgaaggctgacaggacatgggtgtacacatctgactggtccagcaccgcctgggtccgcaccggcctcttgaggagcgggctgcttcggytctgccctgcttccaccgcctgaaagaaaaaaaccacaaactatgatcttcggcatcttagaggaagggtgctgtttacagttcatccacaaggactgaa

SEQ ID NO: 54520 - DNA, 201 bp, Homo sapiens
ggtttctaggtgatggcagtgatcagctgcggccagccaggtttttcttcatctggactgtgcctctcactttcaaatttttggaacatttgctttggcarcaaaacttttaaaaaaccaactctctctggtgcaggtgttctgttggaggatttgagagaagctttaaaattttatcttattactgtcccttgcttaggt

SEQ ID NO: 54521 - DNA, 201 bp, Homo sapiens
actaaagacttcctccctgtggagcaggtcagtaaccctgtctgtcctctctagtacccgaataggcttcgccccctcgtcctggatcgacgattatttcractgggtgaagccacagtcgtcttgctgtcgagtggacaatatcactgaccagttctgcaatgcttcaggtaccttctcctttaccaaatctttcctgtt

SEQ ID NO: 54522 - DNA, 201 bp, Homo sapiens
ggggcttcaccatgttgcctagcctggtctcaaactcctaggctcaagcaatccaccctcctcagccttcctaagtactgggagtacaggcatgagccacrgtacctgtcctcacttgctgctttcatcataattattaaaggtttcaactttccctggaattactaatagaaatagtaagtagcactctggttgaattga

SEQ ID NO: 54523 - DNA, 201 bp, Homo sapiens
ttggccatggtcttactgggagccactcacggattaatatttctccctgtcttactcagttacataggtaagagttctcatcttaaaagggtggcacaatrgaaggacattactgaaagggaattctatcctgaggcattcttttcaagtatttgaactcatactaatggtcatttgataatgataaatgatactgagtaa

SEQ ID NO: 54524 - DNA, 201 bp, Homo sapiens
agatcctctgtaattattccttaaatgttattgcagggtggaggtggagatgagactaacaggcttaagtcttatcccggactctcaaactctaacctgtrgcatacagtgcagagaaagaacaccgtaactccaaaggcttaatttttcaggggctgactttatacctctcataaagtttcccaatagcaggttgctatt

SEQ ID NO: 54525 - DNA, 201 bp, Homo sapiens
aaaacacaaaaattagccaggcatggtggcgtgcacctgtttaatcccagctactcaggaggctggggcaggagaatcacttgaacctgggagaaatcctygtaaggaagtgtttttgttcaattacaggttggtaaaagtggtttctaacacagtatctcttcttttaggtgttcagtggaatcacacttacaaaatttg

SEQ ID NO: 54526 - DNA, 201 bp, Homo sapiens
tgggctagtctgcctgtaatttgttattctttagagattgcacaagcctgtagcctgatgacagcaggatgttcactttttacttagaaaattgcaccccrccccaggagctctccgaccagtgccttttgcctcctatgtggttatcaggtacttttaatcattaaagatgagagcactcgagaaggtattcatggaaaa

SEQ ID NO: 54527 - DNA, 201 bp, Homo sapiens
ctgacaggacatgggtgtacacatctgactggtccagcaccgcctgggtccgcaccggcctcttgaggagcgggctgcttcggctctgccctgcttccacygcctgaaagaaaaaaaccacaaactatgatcttcggcatcttagaggaagggtgctgtttacagttcatccacaaggactgaattcttcgatgtggaccc

SEQ ID NO: 54528 - DNA, 201 bp, Homo sapiens
gaatgctagggacctggcctagggacatttgttcagccagttgagcaaccacagtggctatttcttcagcatgggaacagagaaattattcctttttgccyttaaggacactgctcagccgactacttctcaagagctaaggactctcacttctggttctaaagaactttgaccttgagttctgtttgtttgttactggag

SEQ ID NO: 54529 - DNA, 201 bp, Homo sapiens
ttattttgcatttgtctgtccattactcttcccagactggccccctccttcaggagcccccttggtgggcaccccatgctctaggacaggacatcttttcyttgaattattattattttttttttagagatgggatcttgctatgttgtccaggctggactcaaactcctgggttatagccatccttctgcctcagcttcc

SEQ ID NO: 54530 - DNA, 201 bp, Homo sapiens
aaccctccactcctaaaagggatgcagtattctaagcatggcagattacctacagcggaagcctggatcagtcatctctgatctcgggtgcccctttctgscctttgacctccagctctgtgaagggcatcagctctccagtcaaattgaactgcttgctagcaaaatcctgcccatcttccagggccccatttcacatgc

SEQ ID NO: 54531 - DNA, 201 bp, Homo sapiens
tttgacctccagctctgtgaagggcatcagctctccagtcaaattgaactgcttgctagcaaaatcctgcccatcttccagggccccatttcacatgctamattatctacgacattcttgtcctgttcccctaactagaatgccttccctctgaagttctgaatctttatttaaactgctgcaacagcatttgctgcctca

SEQ ID NO: 54532 - DNA, 201 bp, Homo sapiens
ggagatgactgtcaccctagttaacctgtctttccagaacaagggtaaaacaaaatgaatgtgtaagcatctccttgaagattagggaaagaagatcctgsgaagtttctagcaagcagagactggtaaatgagaatcgacagtacaggacccattccagctattttcttaggtgtaatacactgatactatccttatgta

SEQ ID NO: 54533 - DNA, 201 bp, Homo sapiens
aagatacaaaattttaaaatgtaatgtgcagaatagtattttactgtttgtgtggttaagagggaaaggggaagaatctgtgtgtttgcttgtgtgtgtgyggagtggctctggaaagattcgcagatggtcacagtatggggaggagaactaagacaatgaaacagatgttggagaaggagagaattttcgataaacact

SEQ ID NO: 54534 - DNA, 201 bp, Homo sapiens
gattcattttgcccaaaggtgccactaaaaaggcaaaaggtcaacacgtgtcccgctgctgtagaaggtggtctcagtcgtcctgtagacccgacgtgggyggagactcagtgcacgtgagagtgatgttcactggtccagtcccctgccgcctgtgttccgagtgttttcctgataatgtggctggctcagctttccctt

SEQ ID NO: 54535 - DNA, 201 bp, Homo sapiens
atagggtcttgcttttttgcccaggctggcctcaaactcctggcctcaggagatcttcccacagtgctgggattacaggtgtgagtcactgcacctggccragtccattatttttttaatgttgaggcaaatgttgtgaaatggtatgactgatagttaactgggtaatgaggaaatgagaattgtattattctccatgtg

SEQ ID NO: 54536 - DNA, 201 bp, Homo sapiens
tgaaaggaactctgtccaggattcttctttggcaatgtcagtctctgttgtgatgttcggcagcttcagacactaaaagacaacctgcagctgcctctacrgtttctgtccaggtaggttctgctggggaaacagaacaactgggctgtagatacttgtgaactggtaatgctcagctttccatttattctttgtttacat

SEQ ID NO: 54537 - DNA, 201 bp, Homo sapiens
caggcttctggtaagccggggggggggtggtgtatgttctagaggttaacagcagtgcacagtgtaacgtcatatttttgcctctttattcttattccatyatgtttaaaactgccataaattcccccatgttttaattgtatgtaacgtttctgttgcctacatctattttcttcattccaactttttggtttatcttaa

SEQ ID NO: 54538 - DNA, 201 bp, Homo sapiens
tgtgggaaggacgctgacgcctgtaatgccaccaactggattgaatacatgttcaataaggacaatggacaggcaccttttaccatcactcctgtgttttmaggtaggtataaagattccaagtttggtgtgtttatgatattgttttaaagccaaggaactggctgggcacagtggctcaccagtgcttggggagactga

SEQ ID NO: 54539 - DNA, 201 bp, Homo sapiens
tgcaccattttgagtgtgttaaattacttccagaacagccattccgtgctggaccacaagaaaggggacgacttctttgtgtatgccgattaccacacgcrctttctgtactgcgtacggtaagtggcaagagacaatcattggtagacaccattcttgggtctgacttagggtacatgggcaaaagcttgttttatgagc

SEQ ID NO: 54540 - DNA, 201 bp, Homo sapiens
cggctatactagtatacctgatggtgcctctgaccatggaaatgtgatttcctggcctagttctgggctagtctgcctgtaatttgttattctttagagaytgcacaagcctgtagcctgatgacagcaggatgttcactttttacttagaaaattgcaccccgccccaggagctctccgaccagtgccttttgcctccta

SEQ ID NO: 54541 - DNA, 201 bp, Homo sapiens
gttaaattacttccagaacagccattccgtgctggaccacaagaaaggggacgacttctttgtgtatgccgattaccacacgcactttctgtactgcgtayggtaagtggcaagagacaatcattggtagacaccattcttgggtctgacttagggtacatgggcaaaagcttgttttatgagcataacccagaggtgagc

SEQ ID NO: 54542 - DNA, 201 bp, Homo sapiens
atcacgccactgcactccagcctgggctacagagcaagactctgtctcaaaataaaaaaaaaaagaagccagtctgggagagaacaagctaaacctttggygttcccttatctgggggccttcttcatccctgaaatgtacagctgggtctgacctctgagtccagggtcaggtgattttgcttagcctcaagtgctcaga

SEQ ID NO: 54543 - DNA, 201 bp, Homo sapiens
tgctccttgggtgtcttcagctacattgggttgcccttgaccctcattgtgattgaagtcatcccgttcctggtgctggctgttggagtggacaacatctycattctggtgcaggcctaccaggtatacttccatattctcacagggctcagcatctgttcaagtttcagggactgtgaatggctcctgggctccgcattc

SEQ ID NO: 54544 - DNA, 201 bp, Homo sapiens
cggggttacatgaccagtaagtggcagggctgaggttgttcccagggcccttgccctttcctgcttcctattacacaacaggactgagtaaaccctgtacmtttgattatacatgaaaccaggtggagaaacagcagctatgtaccaaagaacccagagcaatcgagaaaagcccatctggccaggcgaagtggctcacac

SEQ ID NO: 54545 - DNA, 201 bp, Homo sapiens
ccctcttattctccatgatcctcgccttgcttagttactatcagagtgttcacactctctcctattcttttatctttctttcaggactcctacatggtggwttatttcaaatccatcagtcagtacctgcatgcgggtccgcctgtgtactttgtcctggaggaagggcacgactacacttcttccaaggggcagaacatg

SEQ ID NO: 54546 - DNA, 201 bp, Homo sapiens
gtagccaccgttcctggggagcctccagggtgccagcgtcatgccaggcactccctgacattattccatttctcatcacgcagcctatgagtaggtggtgktatacccatttacagaagaggagactggggctcagaggtggtcattttgctcggggttacatgaccagtaagtggcagggctgaggttgttcccagggcc

SEQ ID NO: 54547 - DNA, 201 bp, Homo sapiens
gaagggcacgactacacttcttccaaggggcagaacatggtgtgcggcggcatgggctgcaacaatgattccctggtgcagcagatatttaacgcggcgcmgctggacaactagtcagtaccaccttgtcttgtacttcagaagcagcggaggaggctctcagccaggcagtcagctcaggcctgaaatgtctcactgaaa

SEQ ID NO: 54548 - DNA, 201 bp, Homo sapiens
ccctgggcatgagaatgaacgcagattcctgtgcacattccaagcggggctgagggagaggacggcctgctggtaatccaggcctgaaggaacttggcctrttcacttgtactgatggcagctggggcgtgatcttagctttagtaacattatcccacattaaggttgcgattcttttagcctcgtcatgctccttgccag

SEQ ID NO: 54549 - DNA, 201 bp, Homo sapiens
ttcgactgggtgaagccacagtcgtcttgctgtcgagtggacaatatcactgaccagttctgcaatgcttcaggtaccttctcctttaccaaatctttccygttttgctgaaaaattttcaaattatcatttaaaaatcatttgcatcgtgcctcagtttatacctatttgtatatcaaagctgggtctccctgtgtcatc

SEQ ID NO: 54550 - DNA, 201 bp, Homo sapiens
gagtgcagtggcatgatctcagctcgctgcagcctctgccttccaggttcaagtgattctcgtgcctcagcctcccaagtagctgggattacaggcacctkccaccacgcctggctaatttttgtatttttagtagagacgggctttcaccatgttggccaggctagtctcgaactcttgacctcaggtgatctgccagcc

SEQ ID NO: 54551 - DNA, 201 bp, Homo sapiens
catattatatgattggatttatgtgaactgtctgaaatagtcagataaatagagacagttcagtggttgcttagggcttagggaagtagggaggtagttgwgcatagctagaatacaggatttcttttgaggtgatgaaaatgttataaaattgactatggtgatagttgcatatatctatgaatatgctaaactccatta

SEQ ID NO: 54552 - DNA, 201 bp, Homo sapiens
cccagcactttgggaggcccagacgagaggctcacttgaggccgggagttcaagaccagcctaggcaatgtttgcatgtctctaaaaaaaagaaaaaagaraatttaaaaagaaaaaaaagcgtacaattcagtagctttactatattcacgtgtatgtgcagccatcaccacagtcaattttaggaacattttcattact

SEQ ID NO: 54553 - DNA, 201 bp, Homo sapiens
atagcgccaccacacctggctaatttttttttatttttttattttttgtagagacggggttttgccatattgcccaggctggtctggacctcctgagctcwggcagtccacccaccagggcctcccaaattactgggattaaaggtgtgcataaccacccctggcccaaagacaaatatcttaaaagcaaatagagacaag

SEQ ID NO: 54554 - DNA, 201 bp, Homo sapiens
tggagcaggtcagtaaccctgtctgtcctctctagtacccgaataggcttcgccccctcgtcctggatcgacgattatttcgactgggtgaagccacagtygtcttgctgtcgagtggacaatatcactgaccagttctgcaatgcttcaggtaccttctcctttaccaaatctttcctgttttgctgaaaaattttcaaa

SEQ ID NO: 54555 - DNA, 201 bp, Homo sapiens
gatcttgctatgttgtccaggctggactcaaactcctgggttatagccatccttctgcctcagcttcctgagtacttgagattaggcgtgccaccataccyggcatacaggacttgccaaaccaccatcttgctctcattccctctcactgttctctctccctccctttttcctcccacagttgtaattgtgtgagacacc

SEQ ID NO: 54556 - DNA, 201 bp, Homo sapiens
acagggagaaatattaatccgtgagtggctcccagtaagaccatggccaaatacatcctgaagtagaatatctggaaaatttgagatttggcaaaagccakcaccacaatccctccaaattttgtaagtgtgattccactgaacacctaaaagaagagatactgtgttagaaaccacttttaccaacctgtaattgaacaa

SEQ ID NO: 54557 - DNA, 201 bp, Homo sapiens
accatggccaaatacatcctgaagtagaatatctggaaaatttgagatttggcaaaagccaacaccacaatccctccaaattttgtaagtgtgattccacrgaacacctaaaagaagagatactgtgttagaaaccacttttaccaacctgtaattgaacaaaaacacttccttacaaggatttctcccaggttcaagtga

SEQ ID NO: 54558 - DNA, 201 bp, Homo sapiens
gatagaattccctttcagtaatgtccttctattgtgccacccttttaagatgagaactcttacctatgtaactgagtaagacagggagaaatattaatccytgagtggctcccagtaagaccatggccaaatacatcctgaagtagaatatctggaaaatttgagatttggcaaaagccaacaccacaatccctccaaatt

SEQ ID NO: 54559 - DNA, 201 bp, Homo sapiens
tcaacaggaagagagccatcctaaaggaagtgctttatttcagagctgtggcatctccgtggagttctgcagccacataaccagagcgttcacggtgagcrtgaaaggcagccgcgtggagcgcgcggaagaggcacttgcccacatgggcagctccgtgagtaccctgagcagggccacgccggcagagtcgcaccacaa

SEQ ID NO: 54560 - DNA, 201 bp, Homo sapiens
gtcttcaaggggaaaccctggatcagcagctgggcagggtcctaggagaagtggctcccagtatgttcctgtcatccttttctgagactgtagcatttttyttaggtaattatgctttcaatcctaccagtcctgtagtctgctgagcctggagaaagaaggagctggctacctgaacatgtccctttgtgttgcttcctt

SEQ ID NO: 54561 - DNA, 201 bp, Homo sapiens
tgggaagtttctagcaagcagagactggtaaatgagaatcgacagtacaggacccattccagctattttcttaggtgtaatacactgatactatccttatrtaatgtgttgtgtgtatgtgtaagaaaataaaatccaaaaagataacagtattaggggttttttttgttttttttttttgtttttttgtgatggagtctt

SEQ ID NO: 54562 - DNA, 201 bp, Homo sapiens
cctcggcctcccaaagtgctgggattacaggcgtgagcttccatgcccagctggaagcttacatcttaatggagggagacggttgatgaacacataacatrtgctatcgtgccagctagagattagtgctatgaggagaaaaataaggctggacagagtggggggtgcattgcttaagcgtggagatgtgcacaaagggag

SEQ ID NO: 54563 - DNA, 201 bp, Homo sapiens
aacgtagaaaaggaagttaggttttaagaaaaagtactgaaactaaagacttcctccctgtggagcaggtcagtaaccctgtctgtcctctctagtacccraataggcttcgccccctcgtcctggatcgacgattatttcgactgggtgaagccacagtcgtcttgctgtcgagtggacaatatcactgaccagttctgc

SEQ ID NO: 54564 - DNA, 201 bp, Homo sapiens
cactgtcagtattttaaaatgttttacaaaaaatctggagacctattcttctaacagtcctccctgcatgtctccgccagtggttgaccctgcctgcgttygctgcaggcctctgactccggaaggcaaacagaggcctcaggggggagacttcatgagattcctgcccatgttcctttcggataaccctaaccccaagtg

SEQ ID NO: 54565 - DNA, 201 bp, Homo sapiens
ccacttggcagtggtgacaggatgaacacgcagtgttcgggagtgagagcgagctttaatgaggcctcccctctcccctccagtgtgttttatgtcttctrcgaacagtacctgaccatcattgacgacactatcttcaacctcggtgtgtccctgggcgcgatatttctggtgaccatggtcctcctgggctgtgagctc

SEQ ID NO: 54566 - DNA, 201 bp, Homo sapiens
tctgcagtcatcatgtgtgccaccatcgccatggtcttggtcaacatgtttggagttatgtggctctggggcatcagtctgaacgctgtatccttggtcarcctggtgatggtgagtcctcatacagtctcagtttgtccctagctcctgtttcacttgggggaattggctgtcttagattccatgtaaaccctaaagatg

SEQ ID NO: 54567 - DNA, 201 bp, Homo sapiens; identical to SEQ ID NO: 15913

SEQ ID NO: 54568 - DNA, 201 bp, Homo sapiens
aggaagcccagggcaagtcaacgtcacaggcaacttgcatggcaggaggaaactgcagggcatgtttggaaaaacaagtcttctagtttggctaaagcatraattttgtggagttacgagttggacaaaaaggatggaaaagtaagttgagccagatggaagacagccctgaagagcaggctaaaatttattctggaggca

SEQ ID NO: 54569 - DNA, 201 bp, Homo sapiens; identical to SEQ ID NO: 15915

SEQ ID NO: 54570 - DNA, 201 bp, Homo sapiens
tgttctcaaagaaaactgtagatgatataccccatgagtctagtattttctttcctctcacctctcttttataaagcattcaatttgaggtccatgttgtyaagatgtaaaataattgggaaaaggcaaatgatggcttgatgatccaaattacttttgaagtatttccagttatgcatgtggcccctattcatgatcaca

SEQ ID NO: 54571 - DNA, 201 bp, Homo sapiens
agggataaaataaaatgtggtgagatcagaaggacctttgctataagtttggtaactcccaactatgtcttactgacttcccactagaaataggtctggaraggtctgttgcatagaatgtctcttgcttttaatcagtagaatccattgaattgggtattgctagatatttagaagaaataaaaattgttgtattgctcc

SEQ ID NO: 54572 - DNA, 201 bp, Homo sapiens
ccagaacctcaagcctcagagagaaacgggtcatctaccgttagttagcattaaatagcatttcatgaagagcacacacatttttatcaaaaggatacagmgactgttctcaaagaaaactgtagatgatataccccatgagtctagtattttctttcctctcacctctcttttataaagcattcaatttgaggtccatgt

SEQ ID NO: 54573 - DNA, 201 bp, Homo sapiens
cattggaatgatactcaacactcatcagctttgctttgtcactggagaaccaccagtgccactggatcatacagacaggtatagcagagctatactagaawctcataattaatagaaatttctgcctgatacaaaaacccaggactttctacataaagaagcagagactgtgctttacaagtgttgtcacaacattagaga

SEQ ID NO: 54574 - DNA, 201 bp, Homo sapiens
actctgatcccctgtacttcaaagacccattctcctatcatatcacctcttctcattgtcccattttgtttcagtaactaacattctttacttcatcacayatgaacatgcattaaggacaccagaatgaaatacttttctattccttagagttaaactccacttttccattccttaggtggcccaaaggaatgggtaacc

SEQ ID NO: 54575 - DNA, 201 bp, Homo sapiens
cacatcctgtgactatggctaccacaggcgatttgcatgtactgcacacacacaggtatgttggcaccctgaaatccagaacctcaagcctcagagagaawcgggtcatctaccgttagttagcattaaatagcatttcatgaagagcacacacatttttatcaaaaggatacagagactgttctcaaagaaaactgtaga

SEQ ID NO: 54576 - DNA, 201 bp, Homo sapiens
ttctgtcttgaagacacatcctgtgactatggctaccacaggcgatttgcatgtactgcacacacacaggtatgttggcaccctgaaatccagaacctcamgcctcagagagaaacgggtcatctaccgttagttagcattaaatagcatttcatgaagagcacacacatttttatcaaaaggatacagagactgttctca

SEQ ID NO: 54577 - DNA, 201 bp, Homo sapiens
ctctgatcccctgtacttcaaagacccattctcctatcatatcacctcttctcattgtcccattttgtttcagtaactaacattctttacttcatcacacrtgaacatgcattaaggacaccagaatgaaatacttttctattccttagagttaaactccacttttccattccttaggtggcccaaaggaatgggtaacca

SEQ ID NO: 54578 - DNA, 201 bp, Homo sapiens; identical to SEQ ID NO: 15918

SEQ ID NO: 54579 - DNA, 201 bp, Homo sapiens
ctttctaccctcccattaggggtgctgctttggtctgccattctgacactatgtctggcatagcagaggtcttccctcaggaacctgtggtcaagtaatarcagtttcagacttctctagtctagggaataagctgttcatgggcacatgcagagcctttttcagatgagggataattacattctttcgtttcctgcttct

SEQ ID NO: 54580 - DNA, 201 bp, Homo sapiens
ctcgacgtggctgcctgggcgcggcgggccccggtcctcgcagatccgatccctcccccacgcgcctgcagtggcagccctggaatccagtgcaaaccgcscgtctggcccctcctgcttccttttcacattgctttgcagtcccgggcgtccccagttctcttgctgtcctccgctccactctgcagtcccggtgggcga

SEQ ID NO: 54581 - DNA, 201 bp, Homo sapiens
tagagttatttcctcagtttgcagctcattaacttttttaaaagttttgttaagtttgaagtttgtaataaacatctatgaattattttttttattggggrattatttccacttcagtttcactcattcatatgatcaaacttgaattgattctaaagtttacttctgacatttagatttttaatgcttattatgttttta

SEQ ID NO: 54582 - DNA, 201 bp, Homo sapiens
aaggatagcactgaaaaaacagagtcacatacattcttctgaacatgcccacagcacagaaaacctggcaggttttatggcccatattgtgtggagttggktatagtagaaccaacccccgacccccaccgccagaacaccattataatttaagctaaaataatttgcacttaaataaacagattagttttttcttaattt

SEQ ID NO: 54583 - DNA, 201 bp, Homo sapiens
catgaacatgcattaaggacaccagaatgaaatacttttctattccttagagttaaactccacttttccattccttaggtggcccaaaggaatgggtaacmaagccagatacatttaaaagttattatttctggaattcttctactcagtttgtttatactttttttttttcagtttggtcttgacacacagacaagtgtg

SEQ ID NO: 54584 - DNA, 201 bp, Homo sapiens; identical to SEQ ID NO: 15912

SEQ ID NO: 54585 - DNA, 201 bp, Homo sapiens
aaaccactgccataaagtaagcaactgaagagttcagccccctctggtctgtacaaatcaagatgtcatatatttgagttctagaaccattgatactaggraaatactctgcaaaagattgaggtgtgtggaggtttcttcataatattcctactcctgagactcttcttagaatgaaatactggaagatatctattcaca

SEQ ID NO: 54586 - DNA, 201 bp, Homo sapiens
tgtcagactcttgtaagtactaacttaaaatttaatttgcaaataatagcatattatttatcatagtctgaccacataccataattttaaattttttattktgtttatcttagggattgagtcctggctgttatgatacctatggtgcagacatagactgccagtggattgatattacagatgtaaaacctggaaactata

SEQ ID NO: 54587 - DNA, 201 bp, Homo sapiens
tccctgcttgatttagctaagtcctcattaacaatttccttattgtagccctatggaaaaagaaatactgaggaactctttgtgttgcccaggtcagtgtraaccccagctacctggttcctgaatctgactataccaacaatgttgtgcgctgtgacattcgctacacaggacatcatgcgtatgcctcaggctgcacaa

SEQ ID NO: 54588 - DNA, 201 bp, Homo sapiens
gaggagatgtaacttacccacacattattcatgtgtgcatatacagattcccttttcagtgatctgcaagtcctgtgcaagggacctagagtttatttgcyccatttacaaaaagaggcactctggacagctcactctgaaatatttgaagctgggattgtagacattatagcacttctggttcccccccttctttggggt

SEQ ID NO: 54589 - DNA, 201 bp, Homo sapiens
aaccggcttagtaaataactgtaaaaaaagatatctctgttttttcacctgtgaaaccattccttccttctgttttatgctgaaaatagaatagtggttgsggttagcaaatggaggaaaaataagtttctttaaaagcactttaaaaagttgcctcttttaataatgcaaataagagcagaaggacaccatttctttctc

SEQ ID NO: 54590 - DNA, 201 bp, Homo sapiens
gggatccagtgtaaactttctaccctcccattaggggtgctgctttggtctgccattctgacactatgtctggcatagcagaggtcttccctcaggaaccygtggtcaagtaatagcagtttcagacttctctagtctagggaataagctgttcatgggcacatgcagagcctttttcagatgagggataattacattctt

SEQ ID NO: 54591 - DNA, 201 bp, Homo sapiens; identical to SEQ ID NO: 15920

SEQ ID NO: 54592 - DNA, 201 bp, Homo sapiens
ttttcttttttcaaaatcacagtacagcatacagggcagatgtcagagattatgatcacagggtgctgctcagatttccccaaagagtgaaaaaccaaggracatcagatttcttacccagccgaccaagatattcctgggaatggcacagttgtcatcagtaagtaaatgggcctcctgggtacttttgggttgcttttc

SEQ ID NO: 54593 - DNA, 201 bp, Homo sapiens
tttttcttttttcaaaatcacagtacagcatacagggcagatgtcagagattatgatcacagggtgctgctcagatttccccaaagagtgaaaaaccaagrgacatcagatttcttacccagccgaccaagatattcctgggaatggcacagttgtcatcagtaagtaaatgggcctcctgggtacttttgggttgctttt

SEQ ID NO: 54594 - DNA, 201 bp, Homo sapiens
tcccattttgtttcagtaactaacattctttacttcatcacacatgaacatgcattaaggacaccagaatgaaatacttttctattccttagagttaaackccacttttccattccttaggtggcccaaaggaatgggtaaccaagccagatacatttaaaagttattatttctggaattcttctactcagtttgtttata

SEQ ID NO: 54595 - DNA, 201 bp, Homo sapiens
tacccttgggtaagttatttgatcttagtgtgccttagttttctcatctataaaatggagataatagcccctcatgtagttgtgaaaattgaatttttatacacacacacacacacacacacacacatataaatgtttacgattgttcctgccacatactatttaataaatgttagttattcaaagatacaacgtaaactc

SEQ ID NO: 54596 - DNA, 201 bp, Homo sapiens
acccttgggtaagttatttgatcttagtgtgccttagttttctcatctataaaatggagataatagcccctcatgtagttgtgaaaattgaatttttatacacacacacacacacacacacacacatataaatgtttacgattgttcctgccacatactatttaataaatgttagttattcaaagatacaacgtaaactct

SEQ ID NO: 54597 - DNA, 201 bp, Homo sapiens
aaataaatttgtaacccatttctcatattacctacacacagaaaaacaaaatttgatatcctggggtttatttgctgagggcgcttcccataaaagcgagwgagtgtgcgttgggaaatgtgtctggttaactcttttatggataaactttagtcacaatcctcccccgcccccctctcacccccagcaccctcccaacct

SEQ ID NO: 54598 - DNA, 201 bp, Homo sapiens
tacagcaattgacttcaataaaatttactccaatgcattacagataggatttctttaaaagtccattacagccaagatcatctaaagttagttagcattaratagcatttcataaagaccacacgttttttatcacaagcattcagaaaccattctcaaagaaagatgtagatgatacatcccatcagctcagaaggacct

SEQ ID NO: 54599 - DNA, 201 bp, Homo sapiens
atacagcaattgacttcaataaaatttactccaatgcattacagataggatttctttaaaagtccattacagccaagatcatctaaagttagttagcattraatagcatttcataaagaccacacgttttttatcacaagcattcagaaaccattctcaaagaaagatgtagatgatacatcccatcagctcagaaggacc

SEQ ID NO: 54600 - DNA, 201 bp, Homo sapiens; identical to SEQ ID NO: 15921

SEQ ID NO: 54601 - DNA, 201 bp, Homo sapiens
cattgctttctctgtatgtaactgaccaccatctttttgttttgtgggacatcagacattaccacagtatggatgagtttagccactatgacctgcttgakgccaacacccagaggagagtggctgaaggccacaaagcaagtttctgtcttgaagacacatcctgtgactatggctaccacaggcgatttgcatgtactg

SEQ ID NO: 54602 - DNA, 201 bp, Homo sapiens
gtaggggaagtgagagaattacacatataactgtaatagagatacaatatgagaagtttcatgagggataaaataaaatgtggtgagatcagaaggacctktgctataagtttggtaactcccaactatgtcttactgacttcccactagaaataggtctggagaggtctgttgcatagaatgtctcttgcttttaatcag

SEQ ID NO: 54603 - DNA, 201 bp, Homo sapiens
cccgacccccaccgccagaacaccattataatttaagctaaaataatttgcacttaaataaacagattagttttttcttaatttttataattccttaattwattcatccattctccatttatttattcatttgcactctcatttttgtactgtttgttgatgccctgagctagatattactgaataatgcaaacataaata

SEQ ID NO: 54604 - DNA, 201 bp, Homo sapiens
ctatttataaacaatctaatctaatctaatctgtcttattttaaagaacttcaggggaaaatatgcagtctctttccataacgtctccagagtttaaccamttacttaagttaaaatcccttccctgcttgatttagctaagtcctcattaacaatttccttattgtagccctatggaaaaagaaatactgaggaactctt

SEQ ID NO: 54605 - DNA, 201 bp, Homo sapiens
agcaaaaagggataaacactgtaaaagctatccacaataaaaagtatcatggacgttcaaagcacaagaaggtaatttccaaaaggggaaactggggaggrtttcactgagaagaggacatttgagctaagataattattatgtggcctttattcctgaactgttaaaattctagaactttggtagaggcctattttgttc

SEQ ID NO: 54606 - DNA, 201 bp, Homo sapiens
tttctttaaaagcactttaaaaagttgcctcttttaataatgcaaataagagcagaaggacaccatttctttctccacacatatatatttaaatctacagyataattgatgtcagatgttgtttggatggatttttttaaagtagtgctgaactaagcagtttgcatgttttatcattggaaaatgcgtgtcagttaaaat

SEQ ID NO: 54607 - DNA, 201 bp, Homo sapiens
gtttctgtcttgaagacacatcctgtgactatggctaccacaggcgatttgcatgtactgcacacacacaggtatgttggcaccctgaaatccagaacctmaagcctcagagagaaacgggtcatctaccgttagttagcattaaatagcatttcatgaagagcacacacatttttatcaaaaggatacagagactgttct

SEQ ID NO: 54608 - DNA, 201 bp, Homo sapiens
tagagatagatgaagcctgtgatagcaaaaggatagcactgaaaaaacagagtcacatacattcttctgaacatgcccacagcacagaaaacctggcaggktttatggcccatattgtgtggagttggttatagtagaaccaacccccgacccccaccgccagaacaccattataatttaagctaaaataatttgcactta

SEQ ID NO: 54609 - DNA, 201 bp, Homo sapiens; identical to SEQ ID NO: 15919

SEQ ID NO: 54610 - DNA, 201 bp, Homo sapiens
gctcagtgccgcctgtcctccgggagctgtggcctccctgggccccggggctaggctgaggtaagcgcacagcggaggccaggggccccggcagaggccckggggatagggtggaggcatctctgggtgtgggtgtgggtgtgggtgtgggagggagagttcttgcctctctctctcccatctccaactcttgcttcagtg

SEQ ID NO: 54611 - DNA, 201 bp, Homo sapiens
cgggaggtttttgatccctttttttcagaatggattatttgctcatgattttctctctgctgtttgtggcttgccaaggagctccagaaacaggtaggcaygctcgttgacttgtaagtctcggaattacaagttagtgtgttcttatccaccttcatgcttttcttgcttctatttttccccgttctttttatgactgca

SEQ ID NO: 54612 - DNA, 201 bp, Homo sapiens
aaggttgggatggggctacggaagaaaccagaacaactctagtttatttaaaacctgtatttactgcccacttccccttagacttgaccatatgacccctygctcccattctaagcataggggcaggctttatttttacaatggtaatagatatcacttgaggttttatcaaagagttgcggcgggtggtgaaagttcaca

SEQ ID NO: 54613 - DNA, 201 bp, Homo sapiens
cagcttgaagccaaggaattgtatccagtcgttcaagcaatgtatgttcagtaaaatcacctgcagagcaaaagtctgttgactaactaccgcctcccccscccccgccaccaccccccgcaggcggtttctgggtgaagcagatgttttctttaaaatttgtcatcattgactttaggtttcttttggcaggtttttggc

SEQ ID NO: 54614 - DNA, 201 bp, Homo sapiens
gagagccctctggctatgagtccttccacaaccatatggtaccaccgactggcaggagaaatgtgtgaacatgtgcctcctcctcccccaaccactggggycggtggggtgacggtggcacttttagcagtatcctccgtggtttgagttgaaaataagttttaaaaatcctgtgagtcatggttttgcattgaaacctct

SEQ ID NO: 54615 - DNA, 201 bp, Homo sapiens; identical to SEQ ID NO: 15923

SEQ ID NO: 54616 - DNA, 201 bp, Homo sapiens
gtgttcttatccaccttcatgcttttcttgcttctatttttccccgttctttttatgactgcagcttagagagcaagtgtctgagaattattgctgaaagstactttaagtcttctagtgtaaaatgtaaaattcctctactgaatacaattaggtgcaattgactataacatgacattaaaataacttatcgttttatta

SEQ ID NO: 54617 - DNA, 201 bp, Homo sapiens
gtggagactgagaggcagaagtgatgatatagagggttagaatcacttaattttacttacagaaaaacctaggctcaaagtgttgaagccatttgtgcagragtgagtttgtagcagagctagaactggagcccggatttcctttgctgctatattttccctttagaaatgcccatttcagaactgaaatagaaatactgt

SEQ ID NO: 54618 - DNA, 201 bp, Homo sapiens
tgcttcttttctttttctctcttttcaactaagtcaccgtcaatttattaagatggccataactattcaaaacctatgctgagttcctcaaggcagggtcrcatagtgatgaaggttgggatggggctacggaagaaaccagaacaactctagtttatttaaaacctgtatttactgcccacttccccttagacttgacca

SEQ ID NO: 54619 - DNA, 201 bp, Homo sapiens
agcagaggagatctatgcatcctatagattaaaaggagcaaaagaatccctcttaaatatttccatgaagctctggaatgcaaaccgatgtcctctgtacytttagcacataccatttcatctacaggtagatttcccaaccaaaatatatccagagatgcctttgtcattgggttatatacagcctttgcctctctgagt

SEQ ID NO: 54620 - DNA, 201 bp, Homo sapiens
tgtgttcttatccaccttcatgcttttcttgcttctatttttccccgttctttttatgactgcagcttagagagcaagtgtctgagaattattgctgaaasctactttaagtcttctagtgtaaaatgtaaaattcctctactgaatacaattaggtgcaattgactataacatgacattaaaataacttatcgttttatt

SEQ ID NO: 54621 - DNA, 201 bp, Homo sapiens
gcggactccagcactgcacgggcaggtttagcaaaggtctctaatgggtattttctttttcttagccctgcccccgaattgtcagacggcgggcgtctgcytctgaagttagcagtgatttcctttcgggcctggccttatctccggctgcacgttgcctgttggtgactaataacacaataacattgtctggggctggaa

SEQ ID NO: 54622 - DNA, 201 bp, Homo sapiens
cccttttttctgtgtttcttgctgatggcaggctgtgtgcttcatctgcttttatctgctctgctagctctgactctactgtgatccagcatgtctctcgrcgtttgaggagacatcccccactgacctgctctttctctccccagcagtcttaggcgctgagctcagcgcggtgggtgagaacggcggggagaaacccac

SEQ ID NO: 54623 - DNA, 201 bp, Homo sapiens
cactttgcctatgataaaatacttcctcattctttgtgtgattttcaagcaacttaacgactgttagctttgctgagctaaatgcaacatctcataccaartttattggcttggcaaagttacaaattttattacgcaaaagttgagaaaggaaagctggagaatgctaaaaacagtacaatttgctactgtgtagtatct

SEQ ID NO: 54624 - DNA, 201 bp, Homo sapiens
agtgtaaaatgtaaaattcctctactgaatacaattaggtgcaattgactataacatgacattaaaataacttatcgttttattattattattccattatrtgtttccttggcttttaaaaaatgagaagagtatggacatatacaatttagtcaaatgtatgtttgtaatatatgtgtttatacaggtacacaggccata

SEQ ID NO: 54625 - DNA, 201 bp, Homo sapiens
tctctttggataataggcacgttgttccgtatggacttggaagccctaggtccaagagagccttggagaatttacttcccacaaaggcaacagaccgtgaraatagatgccaatgtgctagccaaaaagacaagaagtgctggaatttttgccaagcaggaaaagaactcaggtgagcagaaacacctttgcttttcaatc

SEQ ID NO: 54626 - DNA, 201 bp, Homo sapiens
cgaggtcagatgtgggttagtgcaacctgtgcttctcatgggagggtggagactgagaggcagaagtgatgatatagagggttagaatcacttaattttasttacagaaaaacctaggctcaaagtgttgaagccatttgtgcaggagtgagtttgtagcagagctagaactggagcccggatttcctttgctgctatatt

SEQ ID NO: 54627 - DNA, 201 bp, Homo sapiens
tttaaaataacatttgttttctcttatcttgctttattaggtcggagaccatgagaaacagcgtcaaatcatcttttcatgatcccaagctgaaaggcaakccctccagagagcgttatgtgacccacaaccgagcacattggtgacagaccttcggggcctgtctgaagccatagcctccacggagagccctgtggccga

SEQ ID NO: 54628 - DNA, 201 bp, Homo sapiens
tacggaagaaaccagaacaactctagtttatttaaaacctgtatttactgcccacttccccttagacttgaccatatgacccctcgctcccattctaagcrtaggggcaggctttatttttacaatggtaatagatatcacttgaggttttatcaaagagttgcggcgggtggtgaaagttcacaaccagattcaggtttt

SEQ ID NO: 54629 - DNA, 201 bp, Homo sapiens
catgttaaggagggaaaaaaataaagagcccttttttctgtgtttcttgctgatggcaggctgtgtgcttcatctgcttttatctgctctgctagctctgmctctactgtgatccagcatgtctctcggcgtttgaggagacatcccccactgacctgctctttctctccccagcagtcttaggcgctgagctcagcgcgg

SEQ ID NO: 54630 - DNA, 201 bp, Homo sapiens
cattccagcttgaagccaaggaattgtatccagtcgttcaagcaatgtatgttcagtaaaatcacctgcagagcaaaagtctgttgactaactaccgcctcccccccccccgccaccaccccccgcaggcggtttctgggtgaagcagatgttttctttaaaatttgtcatcattgactttaggtttcttttggcaggttt

SEQ ID NO: 54631 - DNA, 201 bp, Homo sapiens
tccccgttctttttatgactgcagcttagagagcaagtgtctgagaattattgctgaaagctactttaagtcttctagtgtaaaatgtaaaattcctctaytgaatacaattaggtgcaattgactataacatgacattaaaataacttatcgttttattattattattccattatgtgtttccttggcttttaaaaaatg

SEQ ID NO: 54632 - DNA, 201 bp, Homo sapiens
ccagcttgaagccaaggaattgtatccagtcgttcaagcaatgtatgttcagtaaaatcacctgcagagcaaaagtctgttgactaactaccgcctccccsccccccgccaccaccccccgcaggcggtttctgggtgaagcagatgttttctttaaaatttgtcatcattgactttaggtttcttttggcaggtttttgg

SEQ ID NO: 54633 - DNA, 201 bp, Homo sapiens
agctctcctctcctctcccaaggtcggctttggagagggaggtcagggcacccttgcctggcacaggcggcagcgctggcttccggctcagtgccgcctgycctccgggagctgtggcctccctgggccccggggctaggctgaggtaagcgcacagcggaggccaggggccccggcagaggccctggggatagggtggag

SEQ ID NO: 54634 - DNA, 201 bp, Homo sapiens
gcccagggattcggaattcaaaatccccccagcctaccttcagtcccctgacctgcttctcagccccaccttaggtcactggtttctatggagttaccctmctgaattgaatattgaatagttaatttctctctccaatcattttccccacctaattttgaaagatatacatcatctggggtaccctgtgccctacacagc

SEQ ID NO: 54635 - DNA, 201 bp, Homo sapiens
actttaccctctgaaatgatgctcccaagtgctatgtgatgagctccttgtgtgcccagtggaataggtgtgtccatgtgtcattttaaagactattaatyacactaatatagtttctttctctctttggataataggcacgttgttccgtatggacttggaagccctaggtccaagagagccttggagaatttacttccc

SEQ ID NO: 54636 - DNA, 201 bp, Homo sapiens
tgctcgtccctgatggataaagagtgtgtctacttctgccacctggacatcatttgggtcaacactcccgagtaagtctctagagggcattgtaaccctaktcattcattagcgctggctccactggagcccagttttagagtttcttttctagggactctgaaggtagtccttctaacaccatccaagtgcctcagtggg

SEQ ID NO: 54637 - DNA, 201 bp, Homo sapiens
gctatgagtccttccacaaccatatggtaccaccgactggcaggagaaatgtgtgaacatgtgcctcctcctcccccaaccactggggtcggtggggtgayggtggcacttttagcagtatcctccgtggtttgagttgaaaataagttttaaaaatcctgtgagtcatggttttgcattgaaacctcttcccactgtgta

SEQ ID NO: 54638 - DNA, 201 bp, Homo sapiens; identical to SEQ ID NO: 15925

SEQ ID NO: 54639 - DNA, 201 bp, Homo sapiens
gctctcctctcctctcccaaggtcggctttggagagggaggtcagggcacccttgcctggcacaggcggcagcgctggcttccggctcagtgccgcctgtyctccgggagctgtggcctccctgggccccggggctaggctgaggtaagcgcacagcggaggccaggggccccggcagaggccctggggatagggtggagg

SEQ ID NO: 54640 - DNA, 201 bp, Homo sapiens
aaacctactctctgatctaccacatgttctgcatttttctatcatggtctatggaaacttctcttagaaatccagtggcaagaagttctatgattaaagtrttctgagctcaggccaggcagtcatgaactacttctgagttgtttactactgatttgtggggcagcctcagctatcggtttcttcacacctgcttatgag

SEQ ID NO: 54641 - DNA, 201 bp, Homo sapiens
catggtctatggaaacttctcttagaaatccagtggcaagaagttctatgattaaagtgttctgagctcaggccaggcagtcatgaactacttctgagttrtttactactgatttgtggggcagcctcagctatcggtttcttcacacctgcttatgagagtatccatatttatggtcgcaggccagtaatgctccccacg

SEQ ID NO: 54642 - DNA, 201 bp, Homo sapiens
gcaaaaaaaaaaaatctttttaaaaataattgccataaagtatttgctctgggcctactgtatgcttcttttctttttctctcttttcaactaagtcaccrtcaatttattaagatggccataactattcaaaacctatgctgagttcctcaaggcagggtcgcatagtgatgaaggttgggatggggctacggaagaaac

SEQ ID NO: 54643 - DNA, 201 bp, Homo sapiens
gtggcaagaagttctatgattaaagtgttctgagctcaggccaggcagtcatgaactacttctgagttgtttactactgatttgtggggcagcctcagctrtcggtttcttcacacctgcttatgagagtatccatatttatggtcgcaggccagtaatgctccccacgagatcagtttctgaactaacctggaatttttt

SEQ ID NO: 54644 - DNA, 201 bp, Homo sapiens
atttcccaaccaaaatatatccagagatgcctttgtcattgggttatatacagcctttgcctctctgagtcaatgtatttaccactttccctgagaaatcraaaatcattttggggagcggacatttagaaaaagaatcaaagtgtcatggataatcaaattcttcaataagttgcagttattcagatggccaaaggaaaa

SEQ ID NO: 54645 - DNA, 201 bp, Homo sapiens
tgaaaataaataaaggttaaatttttaaaaatacaaaataaatgctaaattgtggacatatttttttctttctttctttcttttttgagacagggtcttgmtttgtcacccaggctggaatacagtggcgcgatcatagtttgctgcagcctccacttcatgggctcaagtaatcctgcctcagccttctgagtagctgag

SEQ ID NO: 54646 - DNA, 201 bp, Homo sapiens
gcatagcagtagatgataagcacaaatggaattaagaatccaaagaatgccaaggagatgaagtaatagagttggaagggagatgaggactcgcaagtgtygtgaacatcatggcaggtggtgatgtctggctgaacaagataatattcctgcttcagtatgaaaaatggcagcatatataagaaaactgttgcccacacc

SEQ ID NO: 54647 - DNA, 201 bp, Homo sapiens
agagtttgagaccagcctggccaacatggcaaaacccctatctctactaaaaatacaaaaattagccaggcgtggtggtgcatacctataatcccagctayttgggaggctgaggaaggagaatcacttgaacccaggaggtggaggttgcagtgagccgagatcgtgccactgcacttcagcctaggagacagtgagact

SEQ ID NO: 54648 - DNA, 201 bp, Homo sapiens
atgctaaggctgggcaccatggctcactcctgtaatcccagcactttgggaggcgtaaactggaggactgtttgagctcaggggtaagttcaaggccagcrtgggtaacatagtgagaccttttctctactgaaaataaataaaggttaaatttttaaaaatacaaaataaatgctaaattgtggacatatttttttcttt

SEQ ID NO: 54649 - DNA, 201 bp, Homo sapiens
tgccttcttattttctagcactattatggattgctttaaaagtatgtttgggccaggcatggctaacacctgtaatcccaacactttgggaggccaaggtrgggtggattgcttgagtccaggaattcaagaccagcctgggcaacatagtgaaacttagtctctctgaaaaatagaaaaatcagtcaggcatggtggtgc

SEQ ID NO: 54650 - DNA, 201 bp, Homo sapiens
ataaatgccatctctgataactattctttaagttgtgagagggggcagatatccttttaggtattttcttccagataaaagcagttcccaactcttagaaratggttcaatgaacaattgaaatgaattatctattcaagtatacttaggattccttgtagaaattttgaaacacatagaataacaatgtgtatttataat

SEQ ID NO: 54651 - DNA, 201 bp, Homo sapiens
ctttgtccaccgattgacatatggataaggcaagaattttcccaaaattactctgactacctcaagcttaaagccataaaaaaaagttttgacattttttrtggaaatttgctctgcctcttcctctttcagttcagttctagttgctttctgttttctaggaaccctcataatttttatctctatgccttcttattttct

SEQ ID NO: 54652 - DNA, 201 bp, Homo sapiens
ttttgtagtttcctcgagctcacacttcaccatctatgctttctttgtccaccgattgacatatggataaggcaagaattttcccaaaattactctgactrcctcaagcttaaagccataaaaaaaagttttgacattttttatggaaatttgctctgcctcttcctctttcagttcagttctagttgctttctgttttct

SEQ ID NO: 54653 - DNA, 201 bp, Homo sapiens
aaacttcgtaggactaaacttggaaggacacagcatctctgccttgaagcacaaagttgagcacaccattcagcagcctttactaagcacctattatttcytttgcccttggtagggatatagaaatggatgagactcgagggcctgtgctcagtgtctcataattttagtgtcttgatgaagccatgtttttaacatggg

SEQ ID NO: 54654 - DNA, 201 bp, Homo sapiens
ctttactctttttttatatatatactttaagttctagggtacatgtgcacaacgtgcaggtttgttacatatgtatacatgtgccatgttggtttgctgcrcccactaactcgtcatttacattaggtatttctcctaatgctatccctccccgctcccttactttactcttaactgatgtgtaacatccctcagtgggac

SEQ ID NO: 54655 - DNA, 201 bp, Homo sapiens
gacttttgtatgaaagtgggattaaggaaccctctttcatgtgtagatcctgatgccatgtacattgaaagcatatttgcagaaaaggataaattattttygtaaagcctaaactatctctccattttcctgcataattatgacaagcttcttaactattccaggccctagtgacctcactgcaacaaagagggtattggc

SEQ ID NO: 54656 - DNA, 201 bp, Homo sapiens
ccaaaatacagagcattgccatagtcagtatatatgaccttactttactctttttttatatatatactttaagttctagggtacatgtgcacaacgtgcakgtttgttacatatgtatacatgtgccatgttggtttgctgcgcccactaactcgtcatttacattaggtatttctcctaatgctatccctccccgctccc

SEQ ID NO: 54657 - DNA, 201 bp, Homo sapiens
gcatccctcaggaggtcaggagtttgagacctgcctggccaacttggtgaaaccctgtctctactaaaaatacaaaaaaaatttagcctggcatggtggckcatgcctgtagtcccagctacttgagaggctgagtcatgagaatcgcttgaacccaggaggcagaggttgcagtgagccaagatcgtactactgcactcc

SEQ ID NO: 54658 - DNA, 201 bp, Homo sapiens
cagcagcagtaacagcagcggagcatctcctgagagcttgttggaaaggcagatgcccaggccccactcagacctgccaaatcagaaagcctgtgacgggktctgcagtctgagttttaataggccctccaggtgattctgatgcgctagagcatcagaaaggtaaagaggcatttctgatatatagttactcttcacagt

SEQ ID NO: 54659 - DNA, 201 bp, Homo sapiens
tgttctccaaaatacagagcattgccatagtcagtatatatgaccttactttactctttttttatatatatactttaagttctagggtacatgtgcacaaygtgcaggtttgttacatatgtatacatgtgccatgttggtttgctgcgcccactaactcgtcatttacattaggtatttctcctaatgctatccctcccc

SEQ ID NO: 54660 - DNA, 201 bp, Homo sapiens
ttcttattcagatttacacagcggaccaaatgaatttttctcttgtgtgaaatttataaataattcttctattctggaaagacatcctgggtttggagacycaggcttggtttaaaaacaaatgaacagtctgatgcagtggctcacacctgtaatcccagcactttgggaggctgaggtgggcatccctcaggaggtcag

SEQ ID NO: 54661 - DNA, 201 bp, Homo sapiens
ttgttcactgtgtattttaatagatattctagatattgaggtacagattgtttgcatagaaatatatagaattattctgtgggttttttgttaacatgtgrtatcataatatgtgtggtaagctaaaatttccttttcatattagcaatatatcttagaggtcttcctgttctccaaaatacagagcattgccatagtcag

SEQ ID NO: 54662 - DNA, 201 bp, Homo sapiens
gagccatcatgtccagttcacatctttatataagtttgtatttgtatttgtgtgtacaatgatggggtatgtgtgtttacacatgtgcgtatttcagaagrtacataataaaatgttaaatagtagttgcctttataaagtagctaggtggaagtagagataggtacacaggtatgtataccctttctctttgttcactgt

SEQ ID NO: 54663 - DNA, 201 bp, Homo sapiens
tttccaaactgtgtcttgaaattgtaattgtccaagaaatcccaaatctaggaatcattgcctataattcttccaaattaagcagggttctagatacaccscacccacaaacccagtctgcaggccagccctctgtatatgggccttaatgtctccatgggctgctttgggtttctagataatgaaaaaagaaattagata

SEQ ID NO: 54664 - DNA, 201 bp, Homo sapiens
tgctggctttgaagatggaagaaagggtcataacccaaggaatgcaggcagattctagaagctgaaaaaagcaagatagccgattctctcctagagcctcsagaatgaacacaaccccaccaacagccttgattttaagacctctgatctccagaaatataatctgttattttaagccactcagtttgtaatgatttgata

SEQ ID NO: 54665 - DNA, 201 bp, Homo sapiens
gtgggcaaatggaattttctctgtgcctacttggtaataagtaagaggtttggtttccaaactgtgtcttgaaattgtaattgtccaagaaatcccaaatstaggaatcattgcctataattcttccaaattaagcagggttctagatacaccccacccacaaacccagtctgcaggccagccctctgtatatgggcctta

SEQ ID NO: 54666 - DNA, 201 bp, Homo sapiens
gatagaaacaacttacctgtaagagggagacagttctaatgacagaggatttttcataacctaaggaggccagaaggaagtacaacatttttcgggggaakcaaaggctgaatgaggagtctagacttccaccctcctgtaacaaggcacccagacacttgtagaacctggagagaaaataactgtcaacatagaatttta

SEQ ID NO: 54667 - DNA, 201 bp, Homo sapiens
tttgactttgcttaaatagcgctgaaggcctgtcagatgactagggggaagtttttcctaaacaaattcaagttattttgccaattcagtgatttttttttaaaaaaggatttctttaataaaatgaatgttatcacacccttaaaagtgacaacacccatgtaaaagaagctgattgtatatctaaatatcataaaaaag

SEQ ID NO: 54668 - DNA, 201 bp, Homo sapiens
acttgaatactttgaggctatcatatggttattaattaacctaatttcaatatcattgtgtctcaggaaatagggggcccaagaagagaagagaaaaaggraagttggtgaagcagtcagaacagacacatttattggttaagttctatgggcgtggtttgtggcaccccaaaacaattacaatagtaacatcgaagatca

SEQ ID NO: 54669 - DNA, 201 bp, Homo sapiens
caggggcaactggaaatgggggcgggcccatgtccgcttgtgaaaatgactaggggcccctgctgatagccggtggtgggaaggggccagggtgatagacrctggtagtgcatgcagagcaaaacactgttgtccacactgcccatagtgcccctctaaggacactgggccagcattcctgatgtgcaaatagagtcctca

SEQ ID NO: 54670 - DNA, 201 bp, Homo sapiens
agattcccccttgacctctatctggtggtaactgcacttcctttctttgtactgaagacattttatatattggtaaaacaagggggaaatgttgctttttwaaaaatgttatcggaatgtaaatcaactcccctccctccttctctataaaagcaattggggtgacagaagtaagtgggtaagtcaaggctgcctctctct

SEQ ID NO: 54671 - DNA, 201 bp, Homo sapiens
caatgttcaatatttattaagaatcaggaaaagtgagttttgatgaataaaaagtatctgcccctgtttgttatccttgtctgggttggctcttgtgtccrtcttcaagcttcccaaagcaaacctccattcacacaagcacattctggagcaagtcagaacctcacagggagaaggaagaggggctatccccattgctgt

SEQ ID NO: 54672 - DNA, 201 bp, Homo sapiens
aatactgagatgggggactatcatgaacaagccaaatacggttgctctttcaaaccatggtattcctccaatgttcaatatttattaagaatcaggaaaartgagttttgatgaataaaaagtatctgcccctgtttgttatccttgtctgggttggctcttgtgtccatcttcaagcttcccaaagcaaacctccattca

SEQ ID NO: 54673 - DNA, 201 bp, Homo sapiens
tatactggatcacaaagtaattctacgtttcactttttgaggagccaccaaactgttttccacagtggctgccccatcttacattcccactaacagttcayaagtgtttcaacttctcatcatcctcaccatcatttgttattttctgtttctttaaaaccagtagccatcttaataaagtaatattgcattacagttttg

SEQ ID NO: 54674 - DNA, 201 bp, Homo sapiens
tgttattacactcactctacagatgaggaaactgaagcttaggttaacctgtgtaggtttaccaagctaattatactctgcagatacccatatcttttatractccaaagcccaagcccaagcccttcatactagcccacactttctacaaaaacgtttatatcatagcatactacctgcatgcagatatccctttatcag

SEQ ID NO: 54675 - DNA, 201 bp, Homo sapiens
cgtggccaaataactttgtattgtatggatatataccacattttgtttatctattcatctgttgctgggcacgtgagttgtttccatgttttggtgatcawgactgatgctgcagttaacatggggtgcaggtatatatttgagtctttgcttctaattctttggggatattataatacctatactggatcacaaagtaat

SEQ ID NO: 54676 - DNA, 201 bp, Homo sapiens
acagcaactcagtaaaattgctgttattacactcactctacagatgaggaaactgaagcttaggttaacctgtgtaggtttaccaagctaattatactctscagatacccatatcttttatgactccaaagcccaagcccaagcccttcatactagcccacactttctacaaaaacgtttatatcatagcatactacctgc

SEQ ID NO: 54677 - DNA, 201 bp, Homo sapiens
tattaatacttaattatactacttcactgcttatattaacatgtggccttgagcatgtttcttaacctctctctgagtgtgttttcttccctggaaaatgktctaggtgatttacatatatttttaatcttcacagcaactcagtaaaattgctgttattacactcactctacagatgaggaaactgaagcttaggttaac

SEQ ID NO: 54678 - DNA, 201 bp, Homo sapiens
ggcctgagaggtgttgcagaaaataaaattctctgagctctttgggccaattgttccttagattttaataccttagcatgttgtctgtgcagttttttaargcatggcatcacacacatacccagcagcatttgatgaaaggctccagtttcaaggtaagatagtagtgtcaagctgtgcaaaatggttagtcggcctact

SEQ ID NO: 54679 - DNA, 201 bp, Homo sapiens
cagcagctccccattttacagatgtgaaacctacatttcagaatgtttaggtaaattgccttgatgacagagtatgccaaaggactgagattagagtccamgtctgtgtttccaaaacccttgccatttctaccatggacaggctgactttatggggctgtatgttggaggcaccgtgtacatttaaggaattgaccatta

SEQ ID NO: 54680 - DNA, 201 bp, Homo sapiens
cccaaatataatcattttgtatacttaaggcatttttctttttagtttttattcctgtttttctctttttaaaaatatatccatgttaggctgggcgtggkggctcacacctgtaatcccagcactttgggaggctgaggtgggcagatcacgaggtccggagatcgagactatcctggctaacacggtgaaaccccatct

SEQ ID NO: 54681 - DNA, 201 bp, Homo sapiens
acctgggaggcagaggttgcagtgagctgagatcatgccacagcactccagcctgagggacagagtgggactccatttcaaaaaaacaaaacaatacaccmctttttatttgtagtgcactatacttagagctgttgccataggaattgatataccaggcgtcatggtggtcagcagacaaataggaaactcctgttatgt

SEQ ID NO: 54682 - DNA, 201 bp, Homo sapiens
agcagggaccccctcgcaagtctggcacctggttgaggggaaggcctgcttggggctgctttccaaccagcttgcctcaggagccctgtgccagcgaggcwgagatcagggcctggcacatcccaatggcagggagagagtaacttgtgaggagcccagacttgtccagcgtagcttggcagagttggagaggtggtctta

SEQ ID NO: 54683 - DNA, 201 bp, Homo sapiens
gagggacagagtgggactccatttcaaaaaaacaaaacaatacaccactttttatttgtagtgcactatacttagagctgttgccataggaattgatataycaggcgtcatggtggtcagcagacaaataggaaactcctgttatgtcgtcagaatgagttgcagagagtaccatctgctacctgtattgtacatctttct

SEQ ID NO: 54684 - DNA, 201 bp, Homo sapiens
gagcagggaccccctcgcaagtctggcacctggttgaggggaaggcctgcttggggctgctttccaaccagcttgcctcaggagccctgtgccagcgaggstgagatcagggcctggcacatcccaatggcagggagagagtaacttgtgaggagcccagacttgtccagcgtagcttggcagagttggagaggtggtctt

SEQ ID NO: 54685 - DNA, 201 bp, Homo sapiens
gctaggattttgattggaattgcattaaatctatagatcactttgagaagtgacaactgtgttagatcttcaagtccatgaacatcataggtctctcctctttttttttttttttttttttgaaacggagtctcactctgtcacgcaggctggagtgcagtgagtggcacgatctcggctcactgccgactccgcctccca

SEQ ID NO: 54686 - DNA, 201 bp, Homo sapiens
aattcacacaaagacatatcatagtcaaacttctgaaaacaaaagacaaagaaaatatttggaaaagcagtgagatagaaacaacttacctgtaagagggrgacagttctaatgacagaggatttttcataacctaaggaggccagaaggaagtacaacatttttcgggggaatcaaaggctgaatgaggagtctagactt

SEQ ID NO: 54687 - DNA, 201 bp, Homo sapiens
tgaggccacatggggagtaataagaaggcacccctactctcccagccagagtgatatcaagagaggtccagtaggtagctggaccccctcccagcaataaygaggaggccttccccaccttagtagtaaggttccttgggtcccaagattcactagcctcctttttttctcttcacctttaagagagttatgtttgtttat

SEQ ID NO: 54688 - DNA, 201 bp, Homo sapiens
tccctctccctgctagagtggtgtgagaggagccatggcagagaggcaggaccttcacaccatccagttgtaatgaggtctttcccctcagttggtcaatkgaggccacatggggagtaataagaaggcacccctactctcccagccagagtgatatcaagagaggtccagtaggtagctggaccccctcccagcaataat

SEQ ID NO: 54689 - DNA, 201 bp, Homo sapiens
gtaataaggcacccagacttatagaatctggatcttgtgcccactgagcagtaatgtggcagccctccctctccctgctagagtggtgtgagaggagccawggcagagaggcaggaccttcacaccatccagttgtaatgaggtctttcccctcagttggtcaattgaggccacatggggagtaataagaaggcaccccta

SEQ ID NO: 54690 - DNA, 201 bp, Homo sapiens
tttcagacagtaactgctctactctagccaaacaccacacacacacacacacacacacacacacacacgaaaaaaactgtaatgcctccacctaggcagcraagcctgaatggcgagcctggacttccaccctcctggactgtaataaggcacccagacttatagaatctggatcttgtgcccactgagcagtaatgtggc

SEQ ID NO: 54691 - DNA, 201 bp, Homo sapiens
ccccagccacatggaactgtgagtccattaaacctgtttttcttcccagtctcaggtatgtctgtatcatcagcgtgaaaactgattaatacaggctctartgaaagcctgctctctgtagccaaaggaccaagaaagaaacaggctagcaagacagaaataatttcagacagtaactgctctactctagccaaacaccac

SEQ ID NO: 54692 - DNA, 201 bp, Homo sapiens
ctccccagccacatggaactgtgagtccattaaacctgtttttcttcccagtctcaggtatgtctgtatcatcagcgtgaaaactgattaatacaggctcyagtgaaagcctgctctctgtagccaaaggaccaagaaagaaacaggctagcaagacagaaataatttcagacagtaactgctctactctagccaaacacc

SEQ ID NO: 54693 - DNA, 201 bp, Homo sapiens
tagcaagaagaagaaagatcaacaataaaaaccgcactgttatttaaatttagaaggaggagggagaagaaaacaaaattaaaataaacatcaattttatrgtaataaaaatcccgattttttagagatacatatcaaagtatttacagatgaagtgatagatctaggatttgtttcaaaataattgaggggaaggtagac

SEQ ID NO: 54694 - DNA, 201 bp, Homo sapiens
accatgattgtgaggcctccccagccacatggaactgtgagtccattaaacctgtttttcttcccagtctcaggtatgtctgtatcatcagcgtgaaaacwgattaatacaggctctagtgaaagcctgctctctgtagccaaaggaccaagaaagaaacaggctagcaagacagaaataatttcagacagtaactgctct

SEQ ID NO: 54695 - DNA, 201 bp, Homo sapiens
tcacttgagccccggaagttaaggctgcagtgagccatgatagtgtcactgcactccagcctgggtgacagagtgagaccctgtctcataaaaaaaatagstgtggcaaaatttacttctttgtgacttcaggtgtgacctcagatatgcaggacaagggtcacagtttttcatttacattaatcatgactttttagaatt

SEQ ID NO: 54696 - DNA, 201 bp, Homo sapiens
tgaaactccatacgcattaaataataactcccattctctctcctcccagcactggataaccaccattctactttccatttctatgaatttgactgctccargtacctcatgtaaggggaattatacagtatttggtcttttatgtctggcttgtttcacttagcatgtcttcagggttcaaccatgtcatagcatgtatcc

SEQ ID NO: 54697 - DNA, 201 bp, Homo sapiens
ttagtagagatggagtttcaccatgttagccaggctggtctcgaactcctgacctcaagtgatccgcccacctcggctcccaaagtgctgggatgacaggygtgagccactcactgtactcggccaagacacaaatactttgaaagaagctgatttttggtcatggattatataaaaatttgtggctactactagacatat

SEQ ID NO: 54698 - DNA, 201 bp, Homo sapiens
tgattgtcttgggcatatgtggtaaatattctcaaagggtaaaaatgtttgatactaatgcattcctaaaacgttgaattatatatttgcatgccttgaartaagtggaagataaccattaacaagaaacttttttttcaattacccaggggttactctggtggttgatgttaatcagtgtttggaaggaaaaaaatcaag

SEQ ID NO: 54699 - DNA, 201 bp, Homo sapiens
atccgcccaccttggcctcccaaagggctgggattacaggcgtgagccaccgtgcccagcctctggaacttttttatcttcccaaactgaaactccatacrcattaaataataactcccattctctctcctcccagcactggataaccaccattctactttccatttctatgaatttgactgctccaagtacctcatgtaa

SEQ ID NO: 54700 - DNA, 201 bp, Homo sapiens
gaaaaacttacttttctattgatactcactttacattctgtttttgcctcctgtttttaacaagtgggaaggggtgtcatgtagaggaaaatgatatgtgrttgggagttggtttgcctaacttcctggtcccagctccaccacttacacaagcagcttgaccttccacagaccattttacctgtgggaagttcaatttgt

SEQ ID NO: 54701 - DNA, 201 bp, Homo sapiens
tccttttaatttcattttgttaacaattgtttcttgaggacctgttgcatgctgggtgcttttttcctgggtgatttcacatttagcatctgttttcattstcatgacttctctgtgaggtagcaagtattgtacccagttttctgatagaggaaattgtggcccagagagattgttgtaccccaaagtaatgaagatgaa

SEQ ID NO: 54702 - DNA, 201 bp, Homo sapiens
agcatctgttttcattctcatgacttctctgtgaggtagcaagtattgtacccagttttctgatagaggaaattgtggcccagagagattgttgtaccccmaagtaatgaagatgaatacagttgcagaaccaagttagaagccagatttttggagatccaaggtccagtgaacacagctgtacccccacagacacttccg

SEQ ID NO: 54703 - DNA, 201 bp, Homo sapiens
gcatcaggagaattgcttgaacccaggaaatggaggttgcagtgagccaagatcgcaccattgcactccagcctgggcgacaagagctacactctgtccckgggagggaaaaaagcccagaaaagtctgcgttagaatctcaggttcagatgctttttctcgttataaacaagactggctggagtctcaggggtcctcctg

SEQ ID NO: 54704 - DNA, 201 bp, Homo sapiens
atctttactaaaaatacaaaaattagctgggcatggtggcgggcacctgtaatcccagctacttggaaggctgcatcaggagaattgcttgaacccaggaratggaggttgcagtgagccaagatcgcaccattgcactccagcctgggcgacaagagctacactctgtcccggggagggaaaaaagcccagaaaagtctg

SEQ ID NO: 54705 - DNA, 201 bp, Homo sapiens
acaaaatgagtcagaggaaccaggaattttctttttccccactttagttgacctttgtgttgtgcatatgccattttgtactttgagtaacgttgtctccraaggttctgctttggtttaatgccgaacattggccgtccttaaataagggccacagtccttgtgggtatctccttattggagaaattgcaggtaaacttt

SEQ ID NO: 54706 - DNA, 201 bp, Homo sapiens
gatttttattaagcacctactatttcctagtgtcaaggatcaaggtggctgtcaacttctaggctagtatttatttgtaccacattgtaggtcatctacasgatactattcatctttaagaaactagtgtgacagtgtgtggccttagaagtagagcttaaggaaaaaaaaaaacttttttagtccaacttgatgtttgtc

SEQ ID NO: 54707 - DNA, 201 bp, Homo sapiens
ttttgaaacggagtctcactctgtcacgcaggctggagtgcagtgagtggcacgatctcggctcactgccgactccgcctcccaggttcaagcgattttcyttcgtcagcctcccgagtggatgggattacaggcacacgccaccatgcccggctaattttttgtatttttagtagaggcgaggtttcaccatgctggcca

SEQ ID NO: 54708 - DNA, 201 bp, Homo sapiens
tgtagattaggaaacagactcagattaattcagttacccaaggggcacgtaactggtaagtggcagagctttggttcagtctcaggcgtcgagctctggaktgtgtgtgtgtgtgtgtgtgtgtgtgctttcaaccattgtgttagatgcctctcaagacagataaggtccttgctattgtagaattcacagtctaactga

SEQ ID NO: 54709 - DNA, 201 bp, Homo sapiens
agtccaaaacctagctgggcaaattatgttcaattttaaggcctgaaaataattctttttacatgatgatctgtcctccaggcccattgggctggcagaattttttttttttttttttcagtatttattgatcattcttgggtgtttctcggagtgggggatttggcagggtcataggacaatagtggagggaaggtcagc

SEQ ID NO: 54710 - DNA, 201 bp, Homo sapiens
ggggccgggcagaggcaatcctcacatccctcacatcccagacggggcggcggggcagaggcgctccccacatctcagatgatgggcggccgggcagagaygctcctcacttcctagatgggatggcagctgggaagaggcactcctcacttcccagactgggcggccgggcagaggggctcctcacatcccagatgatgg

SEQ ID NO: 54711 - DNA, 201 bp, Homo sapiens
gatggcagctgggaagaggcactcctcacttcccagactgggcggccgggcagaggggctcctcacatcccagatgatgggcggccaggcagagacactcytcacttcccagacagggtggcggccgggcagaggctgcaatctcggcactttgggaggccaaggcaggcggctgggaggtggaggttgtagcgagccgag

SEQ ID NO: 54712 - DNA, 201 bp, Homo sapiens
cttatggactaaactggtctgtgaatttgtgattgtcttgggcatatgtggtaaatattctcaaagggtaaaaatgtttgatactaatgcattcctaaaaygttgaattatatatttgcatgccttgaagtaagtggaagataaccattaacaagaaacttttttttcaattacccaggggttactctggtggttgatgtt

SEQ ID NO: 54713 - DNA, 201 bp, Homo sapiens
gtctttacgtatagatgttaagactcaaaaaatgaattttttttttttttgagacgtagtgtcactctgttgcccaagctggaatgcagtgcagtggtgcratctcggctcaccgtaacctccacctcctgggttcaaacgattatttctcctgcctcagcctcccaagtagctaggattacagaagtatgccaccatgtc

SEQ ID NO: 54714 - DNA, 201 bp, Homo sapiens
ctagattgtctctgacttctttcatcagtgttttatagtttttatctctctttaaagttgaagaatccattgattctgatgtttgggggttttttgtttgttttttttacctttcttcctaacagaaatgttttcagaatctgatttaagtttcttttactgcagtaggtacactagaaaacataattatttgtccagatc

SEQ ID NO: 54715 - DNA, 201 bp, Homo sapiens
atctaattcttcttatggactaaactggtctgtgaatttgtgattgtcttgggcatatgtggtaaatattctcaaagggtaaaaatgtttgatactaatgsattcctaaaacgttgaattatatatttgcatgccttgaagtaagtggaagataaccattaacaagaaacttttttttcaattacccaggggttactctgg

SEQ ID NO: 54716 - DNA, 201 bp, Homo sapiens
ctacagcaagcaaaacctagtgccttcataccacatatgagtaaccaggaaagactattgtttttaataaaccatactcccatggtatctaattcttcttrtggactaaactggtctgtgaatttgtgattgtcttgggcatatgtggtaaatattctcaaagggtaaaaatgtttgatactaatgcattcctaaaacgtt

SEQ ID NO: 54717 - DNA, 201 bp, Homo sapiens
catgcaaaagaatgaagttagactctcacctcacatcatatacagaaagtagttcaaaatggatcaaagacctaaactatgagataaaagagaagaaaacmtaggtataaatatataacatataaaataccaaaaatataaacaacaaaagaagaaatagataaatgagacttcatcaagataaaaacatttttgcttcag

SEQ ID NO: 54718 - DNA, 201 bp, Homo sapiens
atttcattcattttttagttgcccctccctacatagaggaatgagaggagcactttgacaatagattatttgcataatcatggctttgttagatctgaatrttttcttgcaacatgggaatagggaactaaatgcttggtgaggctttcctgaaacaaaagacttagctataaacaggtagtgaggtagatcttgccgaat

SEQ ID NO: 54719 - DNA, 201 bp, Homo sapiens
cccgcatgatgactgggcacaagtttagaagtttcatatcatggctcctgcttcattgtgagggattttaatacctttagagcaatgttaagtacccagtctgactggttattctgtcagcagagtctgtcacctgtcctagaagaatagtcttgtttgttgctcctagactggctgatgattgataggagtttccaagtt

SEQ ID NO: 54720 - DNA, 201 bp, Homo sapiens
acagcttactgcagcctcaaactccagggctcaagcaatccccctacctcaaccccctgagtaactgggaccacaggtgcaaaccaccatgcctggctctttttttttttttttttttaagagagccagggcctcactgtgctgcccagcctggttcaaactcctggtctcaagcaatcctcccacctcaccctcccaaag

SEQ ID NO: 54721 - DNA, 201 bp, Homo sapiens
tttaattctttatagaggcttccattgggcataatatttcggaaatgtttttctatccgggaaaaggccttgaagaactaatccaaagagaatgaactccrgcctctcaggggtgtccaagggagagaatacagtcatggattcatagtttctgtttctagttgagccagtaaagccccttcctcatccctcttttccatt

SEQ ID NO: 54722 - DNA, 201 bp, Homo sapiens
atctgggtccacttaaataaggcttttattcctcagagcctggttttccttatgaattgtactcattgttaaatttttttattgtattttaattctttatrgaggcttccattgggcataatatttcggaaatgtttttctatccgggaaaaggccttgaagaactaatccaaagagaatgaactccggcctctcaggggt

SEQ ID NO: 54723 - DNA, 201 bp, Homo sapiens
tctgtttttagtctgactgaggatgagttgctggtggaatattagtgtgtaaaatgtccagcaactggttagaagactggatgtgggtccaaaattccagragcccaaattagaggcatgatttattgtagtctgcatggaggctctcgtttaatttaatgggagtggttgagatggcctagggggagttatgagaagaaa

SEQ ID NO: 54724 - DNA, 201 bp, Homo sapiens
tggattatagttattaataacatatggatattggctcatccattgtaacaaatgctccacactaatgtaagacattaatgggcataggtgaggggctatayggaaatcctgtacttttcttttaattttcctgtaaacctaaaactgctcaaaagtctatttgttgccttttttttttttttttttttttttgagacggag

SEQ ID NO: 54725 - DNA, 201 bp, Homo sapiens
atgcaggcagattctagaagctgaaaaaagcaagatagccgattctctcctagagcctcgagaatgaacacaaccccaccaacagccttgattttaagacstctgatctccagaaatataatctgttattttaagccactcagtttgtaatgatttgatatagcagcagtaggaaacgaatatagccgttattttgacttg

SEQ ID NO: 54726 - DNA, 201 bp, Homo sapiens
acatatggatattggctcatccattgtaacaaatgctccacactaatgtaagacattaatgggcataggtgaggggctatacggaaatcctgtacttttcytttaattttcctgtaaacctaaaactgctcaaaagtctatttgttgccttttttttttttttttttttttttgagacggagtcttgctctgtcacccagg

SEQ ID NO: 54727 - DNA, 201 bp, Homo sapiens
aagacattaatgggcataggtgaggggctatacggaaatcctgtacttttcttttaattttcctgtaaacctaaaactgctcaaaagtctatttgttgccttttttttttttttttttttttttgagacggagtcttgctctgtcacccagggtggagtgcagtggcatgatgatctcagcttactgcaacctctgcttcc

SEQ ID NO: 54728 - DNA, 201 bp, Homo sapiens
atcttgtgcggaaacaaaaactaaatgatcagtccttgtatgtaaagtgtttataatactattagaagaaacaaaaacagcccatcagaacattataggcrtgttgactacaaactatacaggcattcagacaatacttaatagattcagatgtttgagcaaaatgtcaaggaaaagatgaacttgagcaaagactagcaa

SEQ ID NO: 54729 - DNA, 201 bp, Homo sapiens
ttttaaaattactgaccccaggccacaagacatcaatcatggtaaaaattccactgtccttgatggcacacttgatattttgctagctctgtggatgagcktttccttatctgttttctctctcccattccagctgccagcatgctagctgcttacgtttggtctacccactcccagcctgtcctacctcctgccatcaga

SEQ ID NO: 54730 - DNA, 201 bp, Homo sapiens
catttactggttgtgaaaactctagtcctatcgattggacattcttacctggaattaaagtgggaaataattcactaagttaactttccttaggcaaccargagtttaatgtgttttgttaatgaggaggggtagaaatttgcaatgggataaaatgcttgttaggtctaaaatggttccagaattaagttttaggactcc

SEQ ID NO: 54731 - DNA, 201 bp, Homo sapiens
catagtgctatgcacatgtgaacataatttgatgacaacgaattgtaatttaatatttgtagagtttgatgtacgtgtaagaaaaaaagagaaagcatccrtgtctcccttctcttttcctcaagatgtttttcatgtaggaagtattttaacttggcctctttcatttttctggttctacttttctaactcagtgcattt

SEQ ID NO: 54732 - DNA, 201 bp, Homo sapiens
ctttaaccctcatagtgctatgcacatgtgaacataatttgatgacaacgaattgtaatttaatatttgtagagtttgatgtacgtgtaagaaaaaaagaraaagcatccgtgtctcccttctcttttcctcaagatgtttttcatgtaggaagtattttaacttggcctctttcatttttctggttctacttttctaact

SEQ ID NO: 54733 - DNA, 201 bp, Homo sapiens
gcatgactttgactccaggttgttgaaagtcaatctctgtttttctttctcctttaaccctcatagtgctatgcacatgtgaacataatttgatgacaacraattgtaatttaatatttgtagagtttgatgtacgtgtaagaaaaaaagagaaagcatccgtgtctcccttctcttttcctcaagatgtttttcatgtag

SEQ ID NO: 54734 - DNA, 201 bp, Homo sapiens
atactaacattctccatatataaattaagattcctaaaaatatatttcactaacctgccaactgatggcataattagaatctattctgttgtatcaggtcrgagaaggttcttaagatgactttgtcttactccacagatgggcttttcaacctcggaagcatctgtgagaaacatctgggctttatctccttagcttaga

SEQ ID NO: 54735 - DNA, 201 bp, Homo sapiens
gctatactaacattctccatatataaattaagattcctaaaaatatatttcactaacctgccaactgatggcataattagaatctattctgttgtatcagktcagagaaggttcttaagatgactttgtcttactccacagatgggcttttcaacctcggaagcatctgtgagaaacatctgggctttatctccttagctt

SEQ ID NO: 54736 - DNA, 201 bp, Homo sapiens
ggcctgttaggaaccaggcgacacagcaggaggggagcaagtgaagcttcatcctgtatttacagctgctccccattgctggcattaacacctgagctccrcctcctgtcagatcagtggcagcagtagattctcataggagtatgaaccctattgtgagctccacatgcaagggatctaggttgcacactccttatgaga

SEQ ID NO: 54737 - DNA, 201 bp, Homo sapiens
ttgggaaccacaataattgattgagggagagagtgtttgactagggtagcccgggaagactttttggagtaggtagcatttgagttgagacctgaatggtragaaaaagccaacagccacacagtgagggtagagtattgtggtctgaaagagactcgtgtgaaggtctagaacaggaagggggaagtaaacgggtgtgag

SEQ ID NO: 54738 - DNA, 201 bp, Homo sapiens
atgatccgcccacctcagcctcccaaagtgctgggattacaggcgtgagccaccactcctggccccaccttcattcttttgcatgtggatgtccagttgtyctagcactattagttaaacagactattctttcttcatagaatggtctaggcacccttgtcaaaaactaattgacaatacatgtatggctttatttctgga

SEQ ID NO: 54739 - DNA, 201 bp, Homo sapiens
ctctgtgtctgataaatatcgacgatccctgtgtttctctcaaattaaaaatatcccatggtaccctgggacaccttgacacttagtttgggaaccacaayaattgattgagggagagagtgtttgactagggtagcccgggaagactttttggagtaggtagcatttgagttgagacctgaatggtgagaaaaagccaac

SEQ ID NO: 54740 - DNA, 201 bp, Homo sapiens
ctgggatacaacagtgggtaagctggaaacagcccctgtcttacaggggtggagagcacagttcgacagtaggaccgcaaccaagttgcaggactaggacwcacccttggcctcacaagagttgagggcggttctttttgactacagattaccaaggcagatgaaaatttcagggagacaattcagggcagggcaggagag

SEQ ID NO: 54741 - DNA, 201 bp, Homo sapiens
tctctgtgtctgataaatatcgacgatccctgtgtttctctcaaattaaaaatatcccatggtaccctgggacaccttgacacttagtttgggaaccacartaattgattgagggagagagtgtttgactagggtagcccgggaagactttttggagtaggtagcatttgagttgagacctgaatggtgagaaaaagccaa

SEQ ID NO: 54742 - DNA, 201 bp, Homo sapiens
tcacactttaaataatactatcttttctccatcaaagaatcaaggatattccacatccatcctttacacacagagtaagaaagagaatgagattcatgatwcaacaccataaatcaaaagcacccgctgaccaagcagtgcagttttcaagaacttatacaaacccaagaatgcatatcagtacattagaacagttatgta

SEQ ID NO: 54743 - DNA, 201 bp, Homo sapiens
tgacacatctgtctcttacactacattgttaggtccttgaggacaatcaccatgttgttgtttgtttttaatttttgtctctgtgtctgataaatatcgaygatccctgtgtttctctcaaattaaaaatatcccatggtaccctgggacaccttgacacttagtttgggaaccacaataattgattgagggagagagtgt

SEQ ID NO: 54744 - DNA, 201 bp, Homo sapiens
agtagccttctgcaaagaatcacttccattgttctggaaacccccatttctcggaagcaggcagtttttcacatcatgtgctgtgttatgacatctacatytggtttgcatgcagacatcactgccgtcagccattagcatgtattaagtatctgttgggtgcagggcactgtgctcagtggcatggggaaggaattggga

SEQ ID NO: 54745 - DNA, 201 bp, Homo sapiens
ggtccaatatccagaaacatggatgcagctccgacagccaggagccagcctggaagaagctgtaacacgtcctctcaaggtttgagatgggaacaaagtayatgtcatcattcaaaatttcctagctattttgatgaaactgtttaatgcacatgtttgagtctgtcttaagacttttcccccctttattaggaaatattt

SEQ ID NO: 54746 - DNA, 201 bp, Homo sapiens
ccaatcccccaaacataccaaggaacgactgtagtaggaaatggaatacttgattttgaaaggttaggaaaacccagattttatatttgttgatgattgtrtatgtgaatatgttctgttctattctcaagcctttcttaatgacacatgtaagaagatttaattctattgattttgtgtttccaaattatatcactaatc

SEQ ID NO: 54747 - DNA, 201 bp, Homo sapiens
acaaaataaatattagtccacattttagactacagcttgtctttttttcattgcttttattttggttataatcaagatctaggtctgtcagtaccaacacrtatgtagatttgatgatagagttaaagcgtagttggggtaggctccagctccactgaaagggaattacagattttcttttggctttcatgaactgtgaga

SEQ ID NO: 54748 - DNA, 201 bp, Homo sapiens
cctctgccttccaaagcaccaccatgcccagctaatactcttctgaatttagggatcctcttctcattgatactttagtagcaaatgcattaaaggaaagktggaaaggctttttaaatttcttaggctactgccatttctttaagtacttagtaattatatattttgtagctcaagaaactttgcttctttcttttctca

SEQ ID NO: 54749 - DNA, 201 bp, Homo sapiens
actagttttatcttgaaagtggtagaaaaaactaatgccatgtgatattggcagtaatgtatgtgactaagatggaaaaatttggttcagtagataacaahtactactactactactactatatactactttcatgatatacactaaatggtattttttaaaactttctttattgcttcctggactttaagtgatattatt

SEQ ID NO: 54750 - DNA, 201 bp, Homo sapiens
attaacagtttagtataaacattttacttcatgttatcatcaaacctatattttgtggtagcctaagtaccttaatttagggatagcatggtagagaaaattttttttttttttgagacacagagtcttgctctgttgcccaggatggagtgcagtggcacaatcgtggctcactgcaacgtctgtctccctggttcaagc

SEQ ID NO: 54751 - DNA, 201 bp, Homo sapiens
gaatcacttgaatgtgggaggtggaggatgcagtgagctgagattgcgccactacactccagcctggatgatagtgtgagactccatctcaaaaaaaattwaaaaaaaaaaagtaagaatcattactttgacaagattttcctcaaccatgtaggttattatattaaaatgttaaggcatccacattcatagcaaccatag

SEQ ID NO: 54752 - DNA, 201 bp, Homo sapiens
gggacggtaaccctgcgtgccatggcgcactagggaagcctagttaggaaaggggaatagggatcggggatctctaatttgtaccagtcctggtctcactggcccacctgtaccaattccaaggccttcttccttgttaattcttgcttttagtctacataaagaatctaagagcatagttaggaaattccagcagtggtc

SEQ ID NO: 54753 - DNA, 201 bp, Homo sapiens
gaaactacggaatatttcccaaagttggtaacttcagtactggagagaaatactcaattggaaaagcctgtggagttctcttgtgttactttaaaaaaaawttttttttattattatactttaagttctgggatacatgtgcagaacatgcaggtttgttacataggtatacaagtgccatggtggtttgctgcacccatc

SEQ ID NO: 54754 - DNA, 201 bp, Homo sapiens
tgccactgcacgccagtctgggtgataaagtgagactcagtctcaaaaacaaacaaacaaactactaatgcttttgtaatgtttgacctttgaagcatatytcttaggagctcggaaatggagctccttgcactatgcttatgttgttcttgaaaacagacgttctctgtgatggctgtccttgttctctaagatcatttc

SEQ ID NO: 54755 - DNA, 201 bp, Homo sapiens
gaaacattataattatgtattaaggcagatgggaaaagatgtttattgcagctttgtttgcaatcacaaaacatgaaaaacaacctaaatgttgttaagcaaaaaaaaaatcatgctgtgatgtgcacatagatggaatatagataggcttgtgtatgtgttgggggaggggcgcacacactcttacatgtgtctaaaata

SEQ ID NO: 54756 - DNA, 201 bp, Homo sapiens
agaagctcaaggaaggcagaggatgagcaccttctccattatacttggtacttgattgttcatggaattaaaatttaaatataaatgaactatatataaaygccataataaaaatatacgaaagtgctttggaagtacagataagaaaagtgacacttctagcctgagaatcagggaagaatggtccttcaaggacttgaa

SEQ ID NO: 54757 - DNA, 201 bp, Homo sapiens
aaaagctatgtctaagaaaaaaaatagtggaggcattatttaaaacttctaaatggcctggtgagtatagtcttagtttagcttccttacttttttgtatkcccaacctgaaatgatgtcatcccgtatcatcacagtatgttgctttttcagtacgaagttaatgggctttcctgctgtttaactgctttgagattttaa

SEQ ID NO: 54758 - DNA, 201 bp, Homo sapiens
ctttgaaagaagcccctgagtgcccacaccatgccagctctgtgtcaggcatcctttctaggtgtggaaacagtagctttcatggtgtgattagagcattratatggagcctagggatctgggttctagttcaggcgttaaaccactgttagactatagttagaggtttgaaatatactggcaattactaacagatttaaa

SEQ ID NO: 54759 - DNA, 201 bp, Homo sapiens
ttcaccttgatgtttccactgaggtggctgtggccatggcacatggtaaacttacaagcattggaagacaaagttatttgctttgaaggtagacatcattyaaatcctggctttgccacaaattagttatgtgatcttggtcaaatcatcaaatctctatatgcttatttttgcatgtataaaattggaataatagtacct

SEQ ID NO: 54760 - DNA, 201 bp, Homo sapiens
ggagagtgggccttcaccttgatgtttccactgaggtggctgtggccatggcacatggtaaacttacaagcattggaagacaaagttatttgctttgaagrtagacatcatttaaatcctggctttgccacaaattagttatgtgatcttggtcaaatcatcaaatctctatatgcttatttttgcatgtataaaattgga

SEQ ID NO: 54761 - DNA, 201 bp, Homo sapiens
ctgaccctcctcactttgccaagcgcccccactcacatcagtctttctcatttaagcctcataccacctgtggaatgggtgctgtctcatctgatgtgaaygagcctgaggctcagggcgaatgcctggccaaggtacagccagtgagtgggagagtgagggctcatacacaagcctggagtccatacatcccaggggcag

SEQ ID NO: 54762 - DNA, 201 bp, Homo sapiens
gggaggtagcatgatgtggttaaaggagcatatgccttggaaccaaaaatatctgagattgaccctccctaactaagcctttttccttcatctataaagcwcaaaaacaaaagaaacaaaagccccactctgcatttgcagaactgttttgaggatttagtgtttggttcagtgcctgtcccagggagggtgctccaccaa

SEQ ID NO: 54763 - DNA, 201 bp, Homo sapiens
gggtacatgtgagccttgaagtcagaaggcagtactggatttgaatcccagttctgctgctcatttacctaatcatttttcaagcaggttggttaaaccgstataaaacctcaagtcctttatgagtggttatgagaatcacaagtgaaagtgttctataaccaataaatgttctttgtctagaaagttcaagttgattat

SEQ ID NO: 54764 - DNA, 201 bp, Homo sapiens
tcttgctctgtcacccaagctcgggtgcattggcacaatctcggctcactgcaacctccgcctcccaggttcaagtgattctcggggttatcacttacagrcatgcaccaccacgcctggctaatgttggccaggctggttttgaactcctgacctcaggtgatctgcccacctcagcctcccaaagttctgggattacag

SEQ ID NO: 54765 - DNA, 201 bp, Homo sapiens
gtcatttcatttgttgcagaaatatgaccaagataaccacccttttcttcagtgcctcttaacatgaagcactgaaattttttctgaccttaaaggtaaaygaaagttccaagcctaatcttgtattgtaataattataatagctaatatttactgcattcttaggtgcactttgcaactaaataccttccatatattctc

SEQ ID NO: 54766 - DNA, 201 bp, Homo sapiens
gcctaattagaagaccattttcattctaagtgaagcaaactcagtatgttgacaatgttattgctgcaattcactaacgaaagtgtgctaacatgaatcayaggattctgaagtcagcattctcaggtagtttaaaaggatgaaggatttgaaatctgtcatttcatttgttgcagaaatatgaccaagataaccaccctt

SEQ ID NO: 54767 - DNA, 201 bp, Homo sapiens
gtccctcaacatctcacaatgggaaaggcctgacagaggagtcggtctctgaggcgtccattataccatattaattttctctaattaccactgtcagcacrttactcctcttcggtgaggctgccaggagctccctgcttcttgtggctacaaatgtcaacaccgtcctcacatgctagaccttccagagcctagcttcac

SEQ ID NO: 54768 - DNA, 201 bp, Homo sapiens
ctggctgatcccgtccctcaacatctcacaatgggaaaggcctgacagaggagtcggtctctgaggcgtccattataccatattaattttctctaattacyactgtcagcacattactcctcttcggtgaggctgccaggagctccctgcttcttgtggctacaaatgtcaacaccgtcctcacatgctagaccttccaga

SEQ ID NO: 54769 - DNA, 201 bp, Homo sapiens
tactgcacatatatcctaatatagacaaaaatgtgattacctctttttaaaaacaagcccaactctaaaatatcatacttcggggagcttttatttttgcmtcctgccccttgctcccaattgtcaacttatctccccctactcttgctaccaattgtcagtttacccccagcccctacccctcacacatataccccaatt

SEQ ID NO: 54770 - DNA, 201 bp, Homo sapiens
gctatctgcctgcgtgatttcttcttaactcctatatccctatctgggcttgaagttttctccttatacttaaaaaatcaatccaaaggctagtcagcccrcatgatgactgggcacaagtttagaagtttcatatcatggctcctgcttcattgtgagggattttaatacctttagagcaatgttaagtacccagtctga

SEQ ID NO: 54771 - DNA, 201 bp, Homo sapiens
ttataagaacatccttttctaaacttgggaccatttactttctgagagcagtggtactgcatgttagaacaaaaagcacacaacaagccaaaaccaaaatrtttgcagctttgttgccctagtggggtaaattctttcccatgagagagctgttctctgtgtattttatacactttccaagtagtttacacaatcacgggt

SEQ ID NO: 54772 - DNA, 201 bp, Homo sapiens
agtaaatacaagtgtttttttgtttgttttgttttgttttttgagatggagtttcactctcgtcacccaggctggagtgcaatggcacaatctcagctcaycgcaacctctgcctcctggattcaagtgaatctcctgcctcagcctcccaagtagctgggattacaggtgcccactaccacacctggctaatttttgtat

SEQ ID NO: 54773 - DNA, 201 bp, Homo sapiens
ctttcatagagaatatatatgcattctgtttctccatttttctttggaggatttaattcttttcttcctatctttccaattaaaatgaaaacctatggtaygatttattacaagaagctttacttaacttctaatagtctgatctcatttccttgaataaaaatgacatcacagtaaaactagattataacatttttaggc

SEQ ID NO: 54774 - DNA, 201 bp, Homo sapiens
ttgatggataactctactgtataaagttaaatttgactggttttctatttctgaatcatggaagtgatgagaggaactaactgatttatctgaagtctggmtatgtaataaagtcttcatgaactgcagttgaatgtggctgcattgttactaatgtacagaattttttccatattggcttaacaaaaccaaatagagcag

SEQ ID NO: 54775 - DNA, 201 bp, Homo sapiens
tcgaggtaggaggttggtgtttgatggataactctactgtataaagttaaatttgactggttttctatttctgaatcatggaagtgatgagaggaactaaytgatttatctgaagtctggatatgtaataaagtcttcatgaactgcagttgaatgtggctgcattgttactaatgtacagaattttttccatattggctt

SEQ ID NO: 54776 - DNA, 201 bp, Homo sapiens
aaaaaattagccaggtgttgcatgatcctgtggtcccagctactctggaggctcatctgagcctggggaggttgaggctgcagtgagccttggtcacaccactgttctccagcctgggtgacagagtgagaccctgtctcaaaagcaagaaagaaaggaaggaagggaggggagaggagggtagggggagggaaaggaagg

SEQ ID NO: 54777 - DNA, 201 bp, Homo sapiens
gactcattgcctttccatgtaaatcaaagttcaagtgaattgaccattggtgattgtcttttaaccaactaacaaattttttacttctcagttcaagtgaygggagaaacattttcaccagctttgcttgctttctttccttcccactgagacagttgccttaagaagggtgattattcttctgaaaacatttatgaatct

SEQ ID NO: 54778 - DNA, 201 bp, Homo sapiens
gggtagagtattgtggtctgaaagagactcgtgtgaaggtctagaacaggaagggggaagtaaacgggtgtgaggtgcagccagagaggcagtaggcaggsccatgccgttggagccccgccatccctgagaaggcaccctgtgtttccttctaactgccggggggaagcctttggggaagctttaagtagaggagtggtg

SEQ ID NO: 54779 - DNA, 201 bp, Homo sapiens
aggttttatcctgacagaaacgttccattttaaatgagggttccctagaacagtgcttcccacacttgaatgcgcgtgtgtcatgtgaggatttggtgaarttgcagattctgttcccgcaggtctgggctgggccccgagactgcatgtgtaacaagctcccaggtgatgccggcactgcaggtctccaggccacattta

SEQ ID NO: 54780 - DNA, 201 bp, Homo sapiens
acgtgttaagtgttgagtgtatgatgtgtggattatatctcaataaagatgttaaaccacacacagtcatattacataattacacagtcatattgaattcygttataatttcagatttatggactaacactgaatactcagagtattaagcgacctgttccagtgcatatagctggtgatcacagagccagacttcctgaa

SEQ ID NO: 54781 - DNA, 201 bp, Homo sapiens
acagttcaacaaaggtagtcttttcaactggtggtgctgggacaactgggtagccacatgcaaaagaatgaagttagactctcacctcacatcatatacaraaagtagttcaaaatggatcaaagacctaaactatgagataaaagagaagaaaacataggtataaatatataacatataaaataccaaaaatataaacaa

SEQ ID NO: 54782 - DNA, 201 bp, Homo sapiens
tttctgtggatttttaggccaaatttgaacacaggctcttgatgacacatgaagtatctctaacttgattttatgtatgcacactttatgtactatctgtrcataagtcatagacatatagattggactagaatttagagttcagaaatgaacactcacttgtacagtcagttaattttcaataaaggtgccaagacagtt

SEQ ID NO: 54783 - DNA, 201 bp, Homo sapiens
ttttcttcttgccctaaaatttgaaagatttctcctttctctccccttctgccacaagtagtcccaccctaaaaaggaagatgaggttctctagcaacccwtaagatgctcataagaaatagcttaaacttttgctttgaaacaagacattcacatattggggttgtgggccaataaactagtcaatagaaagaatgggga

SEQ ID NO: 54784 - DNA, 201 bp, Homo sapiens
ttcttatattcttttagaatatgtcttatgtgctgatttttaaaatattaagggaaaaattgacttgtgatacttgaaagttcatagaacagggcactgcrttaaaacagggcttatgcaaataaaacacatttttctgttcttggccagcagttctaccgtcaggatacttattccatacagcactgtatgatacagacc

SEQ ID NO: 54785 - DNA, 201 bp, Homo sapiens
actatatcatctccccctgaaagagaagagtgagacataagtcctctgcagtctgttccactcctactagatcttgaagtcatatgttgattcttttcatsgtattgtgtgcctgtgttttaaggaaaataattagcattcttaaagcaaagcaaaaattttactaaagaaaataattagcctttcatgtcactttcttag

SEQ ID NO: 54786 - DNA, 201 bp, Homo sapiens
gtatagccatttttaatgaatatcctttgcttagtaattattcttatcactagactatgatcaatgctagttaaattttaattacccatttaaatatgtartacaatatttttatataatccttgtcatcaaattggcaggaggaaatggtgctgtatggaaaaatctattgcattaatcatagatcttttaaattttatt

SEQ ID NO: 54787 - DNA, 201 bp, Homo sapiens
atactatatcatctccccctgaaagagaagagtgagacataagtcctctgcagtctgttccactcctactagatcttgaagtcatatgttgattcttttcwtggtattgtgtgcctgtgttttaaggaaaataattagcattcttaaagcaaagcaaaaattttactaaagaaaataattagcctttcatgtcactttctt

SEQ ID NO: 54788 - DNA, 201 bp, Homo sapiens
atctcctgacctcgtgatccgcccgcctcggcctcccaaagtgctgggattacaggcgtgagccaccgcgcccggccttaaatgagttttatacagacaaktggcatatagtcctttcatcagtatccttaggtcaagattatattacattgcagattgtctccagggtactttggagatggattctaattcttattctca

SEQ ID NO: 54789 - DNA, 201 bp, Homo sapiens
cctgcaacttgacacctttaccataggttaaccctttctcacctatgtctggatcatgtgtctgcagtatatattgccctgatcacattgtattataattstttttctttttttttttcttttcttttttttttttttttttttttgtgagacagagtctcactctgtcccaaggctggagttcagtggcctgaccttggc

SEQ ID NO: 54790 - DNA, 201 bp, Homo sapiens
tttacctataataggaataatgcaatacattttcattgctgctgttgcttcctttctaaagctatctttaactacttagtctttgctccccctgcaacttsacacctttaccataggttaaccctttctcacctatgtctggatcatgtgtctgcagtatatattgccctgatcacattgtattataattctttttctttt

SEQ ID NO: 54791 - DNA, 201 bp, Homo sapiens
atttacctataataggaataatgcaatacattttcattgctgctgttgcttcctttctaaagctatctttaactacttagtctttgctccccctgcaactygacacctttaccataggttaaccctttctcacctatgtctggatcatgtgtctgcagtatatattgccctgatcacattgtattataattctttttcttt

SEQ ID NO: 54792 - DNA, 201 bp, Homo sapiens
ttcaaaattagatacctcctcattcagggagagcaagacccgtggtttggatcaacctatcttacatatttgaagagccctggcgccagtactctaagcarttgatttatgctggtcagaccatatccagaatgttatatttggactggggtgggaagggggatgcatattaaggtcattggtaactggaatgtgagcagg

SEQ ID NO: 54793 - DNA, 201 bp, Homo sapiens
taaccaggtttcatgactgggtggccctggaaggcaggcctctcagagtgagctcctgtttgagaatggaatgtgccaatattgtactctccaaaagaaawttaatatgagccacatgtaattttaacttttctagaagccttattttaaaaagaaatagatgaaattaattctaataatatattttatttaacccaatat

SEQ ID NO: 54794 - DNA, 201 bp, Homo sapiens
ctttggcaatgaattccacaggcctggtgtacagtagaagtccaagggaaacaggctgtgtgagcagtttgtcctccagcaactcttgagcaaataaacaytctttgtctttggtggggcacgttttattgactccagtcatttggtcattgcacagcttctctaaagaactagaagttccctagaaactgtatatcacaa

SEQ ID NO: 54795 - DNA, 201 bp, Homo sapiens
gcccaggagttcaacaccagcctggacaacacagtgagacccccatctctaatttttaaaaatttttaataaaaaatgtaaagcaaaacttcaaatcacaygtttgttaatatgtgggtatgttttaaacaatgtgggtaaaatattatactaggttagtataaaagacttttactccttactatttttcattttccccta

SEQ ID NO: 54796 - DNA, 201 bp, Homo sapiens
tccacttgagagctgagtttttggcaatattttttaaattgccctgaatcatgtgttaattcacactcactaacagcatatgcttgcattaatagcacccrtctgttcaacatcatagtcttctaattgtgtctgttatattaaacttctcttccaaatataagttttgacttaaagtcagctccttagtatatccctgga

SEQ ID NO: 54797 - DNA, 201 bp, Homo sapiens
aatctaatcacattgaaatatattcttgatccatgactgtattgtcaacatatccccatttgcatagtatgatccacttgagagctgagtttttggcaatmttttttaaattgccctgaatcatgtgttaattcacactcactaacagcatatgcttgcattaatagcacccgtctgttcaacatcatagtcttctaattg

SEQ ID NO: 54798 - DNA, 201 bp, Homo sapiens
cagcatgtttggttcaagtcttgctgcttgctgttggcaccatatgcagtgttttatgacttctcatgagtctggtctccttacaaaccctaaatgtgtgkacctgagctgattttcatatcctacttaaaccagagaaacttcttgctaatgagaactagcctaggtggctttagtcctgaatctaatcacattgaaata

SEQ ID NO: 54799 - DNA, 201 bp, Homo sapiens
aagctgcctgcacatgtttgaccaagtgtgagctaagctggggtgggtgcttggttggttaaacatgaagttgcttatgtggcctgagacctctgtgctgytaaaccaggagctgctggtatgcagacctatgcagcccgtggggtacacatagcacatcttctcaaaaatgccaattttactaagtttgggggtgggaac

SEQ ID NO: 54800 - DNA, 201 bp, Homo sapiens
aaaataaaaaagtgtatattcagcgctctgagggccaggtatgaacagcgatgtcactctgagtatggtaatcgcactaccagaagcctctgcatttgccrtcataacaacaaatgttctgttcttattttgtcagaaatactcggagatcaattaaactagatggaaaaggagaacccaaaggggcgaagagagcgaagc

SEQ ID NO: 54801 - DNA, 201 bp, Homo sapiens
agttaaattttaattacccatttaaatatgtagtacaatatttttatataatccttgtcatcaaattggcaggaggaaatggtgctgtatggaaaaatctrttgcattaatcatagatcttttaaattttattgcaaattgactataattttatgtattcctggggtacaaggtgatgttatcatttattattacaatgtg

SEQ ID NO: 54802 - DNA, 201 bp, Homo sapiens
tgtgaaataattaattcatatatgcatcacctcaaatacttagtttttgtgataagaacacttgaaatttactcctagcagtttttaaatgtgcaatacaytattattagctatattcaccacactgtgcaatagatttcaaaaaaaaactgattcctcctaagatttcatatcctttgaccatcatctccccgtttcccc

SEQ ID NO: 54803 - DNA, 201 bp, Homo sapiens
tcacctcaaatacttagtttttgtgataagaacacttgaaatttactcctagcagtttttaaatgtgcaatacattattattagctatattcaccacactrtgcaatagatttcaaaaaaaaactgattcctcctaagatttcatatcctttgaccatcatctccccgtttcccccaccctccagcctctgaaaccaccat

SEQ ID NO: 54804 - DNA, 201 bp, Homo sapiens
caatacattattattagctatattcaccacactgtgcaatagatttcaaaaaaaaactgattcctcctaagatttcatatcctttgaccatcatctccccrtttcccccaccctccagcctctgaaaccaccattctattctgcttctatgagttcaacttttttagattccacatataagcgagaacatgtggtatttgc

SEQ ID NO: 54805 - DNA, 201 bp, Homo sapiens
cgaaactccttctcctctaaaaatacaaaaattcgccggatgtggtggcatgtgcctgtaatcccagctggaggttgaggcaggagaatcacttgaacccrggaggcagaggttgcagtgagccaagatcacgccactgcactccagcctgggcaatagagcaagattccatctcaaaacaaaacaaaaaacctcccccca

SEQ ID NO: 54806 - DNA, 201 bp, Homo sapiens
ctctaaaaatacaaaaattcgccggatgtggtggcatgtgcctgtaatcccagctggaggttgaggcaggagaatcacttgaacccgggaggcagaggttrcagtgagccaagatcacgccactgcactccagcctgggcaatagagcaagattccatctcaaaacaaaacaaaaaacctccccccaaaaaagcaaagagt

SEQ ID NO: 54807 - DNA, 201 bp, Homo sapiens
atatagtatatagcaaaggaatttattagtttaaaagtactatggaaatgttaattttggaaatgtgaggtaatatttataaggcacttagaacaatgctrgccacatagtgtttgttaaatagattaaaacagtcctagtaatatcgttatctaggaatacacagttcatgttattgcaccaaagctacttctgaaatga

SEQ ID NO: 54808 - DNA, 201 bp, Homo sapiens
ctctatggacaaaattacctactatcacaaaataaaaaagtgtatattcagcgctctgagggccaggtatgaacagcgatgtcactctgagtatggtaatygcactaccagaagcctctgcatttgccatcataacaacaaatgttctgttcttattttgtcagaaatactcggagatcaattaaactagatggaaaagga

SEQ ID NO: 54809 - DNA, 201 bp, Homo sapiens
ggtctagcaaggcttaacctcaattactgatgggtgacaagggaagaatacacaaattgttatggctactcttcccttggcctcagcatctggtgctgtcrgtcatatgtagtgttgatcagtggttgtctttcccgtggcttgtgcaatatgtttggattggtgaacctccagaactgagtcatagcaatgagagtaaaa

SEQ ID NO: 54810 - DNA, 201 bp, Homo sapiens
agaaaactcagcatcttgatattctcttttcaggaggtagaccatgccacggacatggtgagccgtgcaatgatagattccaggactccagaagaaatgargcatagccaatctatgattgaagatgcacagctgcctcttgagcagaagaagaggaaaatccagaggaatcttcggacgttggaacagactggacacgtg

SEQ ID NO: 54811 - DNA, 201 bp, Homo sapiens; identical to SEQ ID NO: 15954

SEQ ID NO: 54812 - DNA, 201 bp, Homo sapiens; identical to SEQ ID NO: 15955

SEQ ID NO: 54813 - DNA, 201 bp, Homo sapiens
ctattaataatgtgtgattatattcattgcctttattaaactccttgttaggatttacatcagaaaatgatctgctttctcttgggaaatgtaggagaatmtatatctttaaaaaaaaaaagaaaactaaaactcttgagttttctctcttaaaaatggtcatgcacttctgcgtcactccagattgttggaaacctcctg

SEQ ID NO: 54814 - DNA, 201 bp, Homo sapiens
tgactacaaactatacaggcattcagacaatacttaatagattcagatgtttgagcaaaatgtcaaggaaaagatgaacttgagcaaagactagcaaggtwcctaaaaagatggaatttaatgagtaagattctgctggtgatgaatggacagaagcatagtgtgggctatcatgggatctgggaatgccagataagttga

SEQ ID NO: 54815 - DNA, 201 bp, Homo sapiens
aagaaaaccataggatagaattatatcctataattataggccatataggtaacaggaggatatgacttatgtgatatatattcttcttgtaaaaataatgkcaggtatttatcggggactgcagggtgggccttcttcctctcctagatgaagaactgaggttcagacagctaattatggaagataattagctgggataat

SEQ ID NO: 54816 - DNA, 201 bp, Homo sapiens
atataccttaatctcatatctcattcccagtagcacccttgtgaaattggcagtgttatccccaatttacacacagggaaacagaacttcagagaagttawgtcatgttgcaaggtcttaagatagcaaatggcagagctaaaactaaagtctgcttttcaagtcatgagtccagccatgttttctctgctccctactttg

SEQ ID NO: 54817 - DNA, 201 bp, Homo sapiens
caagattgaggatgattcatttaggcaactctggtctactctaggagcttgcatatctaacaatatgcagtattctcaggaattttaccagtgtgggattsctggtactttgaggggagaaggataacttcatatctggatttaatttctgagttaataaaccgccatcaccctggaatgcccatttttatttgtttcctt

SEQ ID NO: 54818 - DNA, 201 bp, Homo sapiens
aataaaattaatgtcctttgtttggaatgcttttagagaccattaggacttaggagcagtgcagtggatgtggagagaatgaaagattcaacaataactayataaaaccctaaggtcccactcaagtggggcggcctggccaaaatgtagctcaaaacataatagtggctatgagaaaaaagctattttgttgtcattgtt

SEQ ID NO: 54819 - DNA, 201 bp, Homo sapiens
tgttttgtttgctaaaccttgaaaaagtcttagtagatggaatacagtggaaagattaggaagatgcctttttccctcatacttcctttaattaaataatrtgaaaatatactgatttaatagatgtttctgtgagttgtgctaaatagaattggtaacagtgttacagttttatagggctttttatctgtttgagaggta

SEQ ID NO: 54820 - DNA, 201 bp, Homo sapiens
agcaagcatcttgctggtagcggtcagaggctaaagggaaaggtagcactgggatattgccttaagatgaataggatttccataagctggggtgaaggaaygaggaggagcacaaggaaaagattagcattgagaaggagcaaggtatttgggcaaaaggttggagcagagatttcctgttctggaattagcagtgggagg

SEQ ID NO: 54821 - DNA, 201 bp, Homo sapiens
ctgaaatccagccacacattaatttatatatggtctatggctgctttcctgctgcagtggtagtgctgagtggttgtttcagagacccatagcctgcaaarctgaaaatatttgcctttttttttttcttttcgagatgaagtctcactctgtcacccaggctggagtgcagcagggcaatcttggctcactgcaacctca

SEQ ID NO: 54822 - DNA, 201 bp, Homo sapiens
gaagctcaaggctacttatgcttgaggacactcattcatcctcaactggccatagttaacctgtggctgtccaacctcatttcttcttcctctctccttaycctttttgctgtaaaccaatttaggtatccacggacaggtcactgaaagagatagaggaggtgaattataaacgattccattctgctcttataatttgat

SEQ ID NO: 54823 - DNA, 201 bp, Homo sapiens
aatattttcttccacttctctggctctgaagctcaaggctacttatgcttgaggacactcattcatcctcaactggccatagttaacctgtggctgtccarcctcatttcttcttcctctctccttatcctttttgctgtaaaccaatttaggtatccacggacaggtcactgaaagagatagaggaggtgaattataaac

SEQ ID NO: 54824 - DNA, 201 bp, Homo sapiens
acaaaaataataataataattaaaaagactccctatgtttcctaaatagaaatatagtatttgtaataaaagaaaaatagcttattttcttaatttcattyaggttctctcattaatattttcttccacttctctggctctgaagctcaaggctacttatgcttgaggacactcattcatcctcaactggccatagttaac

SEQ ID NO: 54825 - DNA, 201 bp, Homo sapiens
ttaggcaggtcagagattctgattataactcagaagccagcaaggaagtttccctaggaagttaagcttgccaggcgctgccttcttcctgccccagcctrtgggcctgacttgatctaaaaagttagctcttagccctgaccaaacttgtctcctattccctgtcatcttgatttgggcttaacaacctaacttctgggt

SEQ ID NO: 54826 - DNA, 201 bp, Homo sapiens
atagcattatcttgttttttgcaaaaagaaagtgaagtcagttataaagacaaaacctctgcaaatgtatatatgaatttaaaatacataaaaggatatayacaaaagagcttgagtggtagcatttgttttcttattcttgcttactaagacttctgtattggctgagtgtggtagttcctgtctgtaatcttagcactt

SEQ ID NO: 54827 - DNA, 201 bp, Homo sapiens
tcatcagcagcccttctgctctctgtagtcaggattggcagtaactcattggtgggcaacactgccttggtcttgccgcttgcactgtgaactgtaactamggacacacatgtcaggaaagaatggtgcttgggatgctcctcctatctgtgcctcaaacgttttcactcgagggatattaaaaagtggcctactgcttat

SEQ ID NO: 54828 - DNA, 201 bp, Homo sapiens
actgtttgggagcaagggacatgccgtggagaggaaatgtgtggtggtctgaaattgcaccagtttccactacaattttaaaaccatgcctagccttgccraaggacctcgggggcaaaggttaagccgacacaccctttaggtcatggtacacagtatctctgggcacatggtggactctggtttgtgctggacccctaa

SEQ ID NO: 54829 - DNA, 201 bp, Homo sapiens
tacagcccacgatggttcacaagagagtctacaatcctcagagccaagaagcactgagactcaaggacagggccacttgacagagagagcagttcccagcygacttggggcctaggaggatattctgggtggcagggctctaattgattattaacctacatataaaatcaaggacatatagccaagcacagcagcaaatgc

SEQ ID NO: 54830 - DNA, 201 bp, Homo sapiens
gaccggcctccttgccttcactctcaggcatcacggccctccagcatgtttctctgaggagctgttgatcatttgcccaggagatggagctgggaacctcrttgtcaccaagtcagtaccaatgatttgtgcttcctgtcagggaaacctgtggtgcatgtgtttgtcttctgcttctcagccagtttctttttgcatcca

SEQ ID NO: 54831 - DNA, 201 bp, Homo sapiens
ttttttttttttcaatagtgcttttgtctttctgctaaaggtcagactgtagttgtcgagtactggtattgttcctgaattattcgggaagagggtggaartattgacttagtttttctattataatatcctatcacaatgctggattttaatgatttaaaaatgtaaataaaagtatttgcatttttagactacttgtga

SEQ ID NO: 54832 - DNA, 201 bp, Homo sapiens
gctggagtggggagaatgacagataattgctaaacatcctactgatcaaggttagatgacttctcagtctagaagatacatacccttctgagaaagccccytgtaggagtgaacacccaacatcctttgaccggttttactatcagaacatttacatacaggcagaactaaaatctgtgattatctggatgagaaaacagt

SEQ ID NO: 54833 - DNA, 201 bp, Homo sapiens
gctcttagattagtagactccttactagtctgtccatagatgaggtgaagagaactgagaggagtgagaggagaggacattgacctgtttggggaaactayggaatatttcccaaagttggtaacttcagtactggagagaaatactcaattggaaaagcctgtggagttctcttgtgttactttaaaaaaaatttttttt

SEQ ID NO: 54834 - DNA, 201 bp, Homo sapiens
gaaattagatatatatatattttttaattattattatactttaagttttagggtacatgtgcacaatgtgcaggtttgttacatatgtatacatgtgccaygttggtgtgctgcacccattaactcgtcctttagcattaggtatatctcctaatgctatccctctcccctccccccaccccacaacagtccccaaagtgt

SEQ ID NO: 54835 - DNA, 201 bp, Homo sapiens
gctttctaaagaatatgcatctagccagaactttgtgttttaacattttcgattaaaaattgaaattatatatctgacattaacttaatgatcatcatttwctttcatacagcccttatcaattccaaaaagctattttctttcatctaagtcacaatcacttgggaatttattaaaatgcaaattgatgggccccaccag

SEQ ID NO: 54836 - DNA, 201 bp, Homo sapiens
aacttaggaattccagttcagcctggccaacatagtgagacctcatctctgaaaacaccaaaagtttttttttttttttaattaaaaaaaaatgtgagagracagaatggtatattaagagagtatgagtttcagaatctgacccctgattctggcctgcttggcacccaatccttgggcaggtttccagctctctgagct

SEQ ID NO: 54837 - DNA, 201 bp, Homo sapiens
ccttatcaattccaaaaagctattttctttcatctaagtcacaatcacttgggaatttattaaaatgcaaattgatgggccccaccagagagctacataayaagaaattcctgtgggaggagcccaggcagcctttattttaactagcctatgtttttaaccagatgattctgatgtacacttaagttttagaacccccat

SEQ ID NO: 54838 - DNA, 201 bp, Homo sapiens
cctgtctcctccactcaatacttcttcccttcccagagataatgtcttagtctatccaggctgctataacaaaatgtcataaactgggtggcttagaaacmacagaaatttatttctcacaattcaggagactgggaagtccaagatcaagacattggtagattcggtatctggtgagggtctacttcctcatagatggct

SEQ ID NO: 54839 - DNA, 201 bp, Homo sapiens
atagtgcacagaaaactcatggtcttgaatgcaagaaatacaggaaagggtgaatttgtctttcttgaaaagatgagaggatttattgcatgattcttttraagtattagtacctttggaatttgtgatattgggtttattataatgcacatatgtgtgttcacatgaatggagttgacttagaatattgagtttctacta

SEQ ID NO: 54840 - DNA, 201 bp, Homo sapiens
tccttggacatacattaaagtatttgtcccttgggcaggtgccaaggctatgaagttggagcgtggcatgttctagaagcagaaagaaggctggtgaggtrgggacacagcaggtagggagtagagtgaggccaagccccaggtcagggctggacctcagggcctaggtccaggtgaaagcactgggcatgatgctgaggg

SEQ ID NO: 54841 - DNA, 201 bp, Homo sapiens
tagtcacctgcatttatcataactgagcatttgatccatgccaaacactgttttaagcacaatagtgtttttttaatgtaatatataatagtgacattttwacacactttgattgctgtgtaaatgtttattggtatttctttctttctttttttttttttgagatggaggcttgctctgtcacccaggctggagtgcagt

SEQ ID NO: 54842 - DNA, 201 bp, Homo sapiens
tctttgctttagttttaggttctgatttgctgtggtgtagtgaggacagaatttttcttttgctgtattttaattgcaatagcgagtaaacaaaccttttytccccccttggttatacttttctttggtttccttggagttttccttggttacattgaaaaccacccagtatttgcatttgcatgggttagttcttaaagt

SEQ ID NO: 54843 - DNA, 201 bp, Homo sapiens
tccagcactttgggaggctgagatgggagtattgcttgaggccaggagtttgagaccagcctaggtaatgtagcgaaaccctgtctctgcaaaaaaaaaawtttttgaattagctagatgtggtggcatgcaccagtagacctagctactctggaggctgaggcgtgaagatcactcaggaggctgaggatgcagtgagtt

SEQ ID NO: 54844 - DNA, 201 bp, Homo sapiens
tcccattaggctgcacctcccaacactgctgcattggggattaagtttccaacatgcaaatttggaggacatattcagactatagaaggctctgttcctcrgaacactgtctttttaaaaagaagtgcatttaattattcaaagaatacatgattatatttttgtcttttaaaataatatggataaattgaatttctcatt

SEQ ID NO: 54845 - DNA, 201 bp, Homo sapiens
atgtgccaccatgcccagctaattttgtatttttagtagagacagggtttctccatgttggtcaggctggtcttgagctctcaacctcaggtgatttgccygcctcggcctcccaaagtgctaggattacagtcgtgagccaccgcccccagctatgtattctcatttcttaaatgatggcttgatctccattcacccccc

SEQ ID NO: 54846 - DNA, 201 bp, Homo sapiens
ttttaaaaactttccagccattaaaaaatctaaaaaatatccttgacccacaggctgtatgtgccaatccctggtacataacatagaataggatgagtttygggaagaaacagtacaaaatacaggctgctatatgtttgcaatagtgtgaaaagaaagtttacccagcgttttcttggcaactgagacttcttgtaccat

SEQ ID NO: 54847 - DNA, 201 bp, Homo sapiens
ccagcactttgggaggctgagatgggagtattgcttgaggccaggagtttgagaccagcctaggtaatgtagcgaaaccctgtctctgcaaaaaaaaaaawttttgaattagctagatgtggtggcatgcaccagtagacctagctactctggaggctgaggcgtgaagatcactcaggaggctgaggatgcagtgagtta

SEQ ID NO: 54848 - DNA, 201 bp, Homo sapiens
accttttctgattcaagagataccatcaagaaagtgaaaagacaaatcatgtgtctgataaaggttacatgtattcagaatatacaaagggttcttaagtygggtgaggtggctcacacctgtaatcccagcactttgggaggctaaggccagcagatcgcttgagcccaggagatcgagaccagcctgggcaacatggtg

SEQ ID NO: 54849 - DNA, 201 bp, Homo sapiens
attttatatattataattcttagcaaagcaccagcacacagtaagtgttcaataaatatttagaggaagcaggtaaaaggtgtcatgagttagatatttcmaataggaggagatggacccttgatggggtcaaccagcatcaagtgtgcctcttttacaaaaccaggaacccaatcttctccttttttcaaagttgatcca

SEQ ID NO: 54850 - DNA, 201 bp, Homo sapiens
gatatattgcattgcaggggcaagagactgtactgagttgactttgatgtatcatatttaacttgtattccttcatttatcaatattaagtgcttactctrtgctcagtatcatgctaggtgccagaaatacaatgctgcataaaacattctggtgaatgataaattgatctcatctccttgctgaaggaagtcatttata

SEQ ID NO: 54851 - DNA, 201 bp, Homo sapiens
gccttttgtgagttgattttttcagagaaccttcagatggcaaaggggaggatttcctttggcctctgcatgggaaacagggactccagggtgttcatgaragtattgctgaaattgggttcttgaggtcccatctggccgaggagcctatgaagccaggatgggaaagatggagtggggtgaaatcaaggaaccacctac

SEQ ID NO: 54852 - DNA, 201 bp, Homo sapiens
atctagacctcaggtgaggtccttttatcttagcgaccttgttctttgattcactgacatggatcttgggcgccattaagatggtttatttgttgtcagayaccctttgttcttttctgtcctttcactgtggaatttttctcttggccaaattctatccattcttggcccacactgccttcctagcattcttgtatccct

SEQ ID NO: 54853 - DNA, 201 bp, Homo sapiens
gttgcaaagaaacagctttttgttcattataaatgttttaacaataactagaactggtgttgccatccaccccatttgggcatgagcttttttcttccacyggagacgtaggtccccagatgattgattggctgcaaagtatggacatgtcttgattgtttctagaaggggcgggaccactgccttcttggattgtaacta

SEQ ID NO: 54854 - DNA, 201 bp, Homo sapiens
aggacataaagggaaaaatatttttgtacagcagtaaaatgtatttgtgttaagctaatgagtcaaaaagttaaaattcaaaagtttataaagtaaaaaagttacagtaagctagggttaatttattattgaagaaagaacctttctttttctttttttgagatggagtttcgctcttgtcacccaggctggagtgcaatg

SEQ ID NO: 54855 - DNA, 201 bp, Homo sapiens
gactgctgtgagtctggatttgggggagagctgtgtcttggcattttcaaatataagagaaggatgttacctgatactcagagaatcttggctgaagcttrgcatccctctctggattagcttagtgttgtttcatgatactattttttgttttaaccagttgtgccattgtttgctgatggaaattgttacatgccagcc

SEQ ID NO: 54856 - DNA, 201 bp, Homo sapiens
tgccccttgtgtgggctttttactctcttgataatgtccttttccgcacaaatgtttttttttttttattttgatgaagtccagtttatctgttttttttkttgttgttgttgttgttgttgttgttacttgtgagatttaccccaatgttttgttctaaaggttctatagttttagcttttacagttaggtctattaacc

SEQ ID NO: 54857 - DNA, 201 bp, Homo sapiens
taaaataaactgattggtttataatgacatggagaaatgcttattcaggaagcaaaaaggcaagatacactgtagggaagttagaacctaaatagtacggrgaaaggactgaaaggaaatgtgtcaaattgttaacagttgttttagatagaatgatgtttcctgttctgtagtcttcatttttcccagagagacttgtaa

SEQ ID NO: 54858 - DNA, 201 bp, Homo sapiens
taaaaagctgaacaagaaaaaaggaggagaaatggaaatactgaataacaccgacaaccaaggaataaaaagtttgagtaaggagaggagaaaaacactasaaacatatcagcagctgttttaccttttacaggtgagaacaatttatcgttcactctgagtttgggagtaatactatgttacatgtttgtggcttacagg

SEQ ID NO: 54859 - DNA, 201 bp, Homo sapiens
cataaagatttactaaacaacatattcacatatggcaaaatattatctataaatagcttcaaaatgtctttgctttagttttaggttctgatttgctgtgrtgtagtgaggacagaatttttcttttgctgtattttaattgcaatagcgagtaaacaaaccttttttccccccttggttatacttttctttggtttcctt

SEQ ID NO: 54860 - DNA, 201 bp, Homo sapiens
catgtaatgtccctgagccagaagagaagtttaatatggacaaatacacagacctggtgacagtcagcaaaccagtcatttatatttcaattgaagaaatmatcagcacacactcagtaagtggggatggggagccatcttagcaatggacccatgatttaggcatctgttatcttgaaaatgcttaatctctacaggact

SEQ ID NO: 54861 - DNA, 201 bp, Homo sapiens
ggaggtgtgagctatggtgtccagccttcttttttcaaaatcattttcatacctgctttccctataacacctcgaggtagggtgcgaatgggcacagaggsaagagagctgagcctatatccagagcccaggccagaacccaattctctggatgaccatgcttcttcggtaagtatatttttgtggaatatttggagctct

SEQ ID NO: 54862 - DNA, 201 bp, Homo sapiens
aaaacacaaaactctaaaactcctagatattgtacatgttttgttagatttataatagaaaatctattatacatgactgtaggtttggcattgacgttatrtacaataccaaagacatgatctgtgaaagaaagaatcgataaactggacttaaattaaaattaaaaatttccgttctgtgaaaggccatgtcaagagaat

SEQ ID NO: 54863 - DNA, 201 bp, Homo sapiens
gccttcctattaaatggaagggatcagccacatggtataatttcttcttcaaagagagtggagttggcataaatgctgatttttttttttcaatctaagcragagtcaaaaatctaatgcaaaagagttagccagaaaataaccttatatttaaattgtttaatttgttagacatagtctcatctcccaaaaatgacaact

SEQ ID NO: 54864 - DNA, 201 bp, Homo sapiens
acaaagttggagaactgttgctatctaactttaagacttattataaatctacagcaatcaagacagtgtggtattggtgaaagaacagacaaatagatcartggaacagaatagggatctcagaaatagacctacttaaatatagtcaactgatctttgacaaaggagcaaaggtgtgatacaaggcagaaaagataattt

SEQ ID NO: 54865 - DNA, 201 bp, Homo sapiens
tttaaatcatctgctcattacagaacctcatttcaacataacagttctctggtgtatgaaatggatggaagcaaaagttatggtagatttacaaaccaaarttcaactatgtctcattttatgtatgtgagaggatggcatgcatccatagtcccagctacttgggaggatgagacgggaagatcatttgaacttaggaat

SEQ ID NO: 54866 - DNA, 201 bp, Homo sapiens
gtctggagcaagtgcccagttcgtcattttgattccatcctgactaaattgttttgactcattacaaaaatattatttttttgaaataacaaaatttcatktaccctttttaaaaagaatgaggtaaatatatacagacatgaaaagaagtttataaaaaaatttgattttttatatttgccctttttaacaaggaacttt

SEQ ID NO: 54867 - DNA, 201 bp, Homo sapiens
ggcaagatcgtgccactgcactccagcctgggtgacagagtgaaactctgtctcaaaagataagaataaataaaataaaatcagttaataatatgataccrgaataaagaccacacgtaatctgctcaaatctaaagggacatgcaatggaagcttaaatacaccatgttgtagttgaaaattgttttaggaaggggctgg

SEQ ID NO: 54868 - DNA, 201 bp, Homo sapiens
ttgaacctgggaggcagaggttgcaataaggcaagatcgtgccactgcactccagcctgggtgacagagtgaaactctgtctcaaaagataagaataaatwaaataaaatcagttaataatatgataccggaataaagaccacacgtaatctgctcaaatctaaagggacatgcaatggaagcttaaatacaccatgttgt

SEQ ID NO: 54869 - DNA, 201 bp, Homo sapiens
aatcttagagacaccagcaactgcgcaacaggtaatttgactttaagtgtaaaataataatagacaggtgttgattttcttcataaatctttatgccataygtttattatctcagagaaactgtatctgacatggtccggaagtaaggaattttatctattactgcagtggacttagttcagccatatataaacctgtatg

SEQ ID NO: 54870 - DNA, 201 bp, Homo sapiens
atgcaaacttcagtcacttgggaaatccctttccccacaaacagtttagtagtgaagttgcactctatggacaaaattacctactatcacaaaataaaaargtgtatattcagcgctctgagggccaggtatgaacagcgatgtcactctgagtatggtaatcgcactaccagaagcctctgcatttgccatcataacaac

SEQ ID NO: 54871 - DNA, 201 bp, Homo sapiens
aatgtaaacttttttagtttaaagtactattcaaagaggaatattcaaaatagtctgaagaggccgggcacaatgtctcatgcctataatcccagcacttygggaggccgaggcgggcagatcacttgaggtcaggagttcaagaccagcctgaccaacatggtgaaaccctgtaactactaaaaatacaaaaattagcca

SEQ ID NO: 54872 - DNA, 201 bp, Homo sapiens
ctggcttggagctcttattcagtctgcttcagctcttcctctctactattttggttcttgtctctttagaccatatttattcattcaagaaacttttactkagcacccattatgttctaggcactacgctggttgcccacctttattcctgttcctggtaagcatctccttaccattgcccctctgctcagcaacccccac

SEQ ID NO: 54873 - DNA, 201 bp, Homo sapiens
ccactgcttcctgaggaggcctgtcagagttttgcaggtgtattcctgatctcctggcttggagctcttattcagtctgcttcagctcttcctctctactmttttggttcttgtctctttagaccatatttattcattcaagaaacttttactgagcacccattatgttctaggcactacgctggttgcccacctttattc

SEQ ID NO: 54874 - DNA, 201 bp, Homo sapiens
attaaaaggtttttttttttaaacatatttatgccttctagggacttggactgaggggaagtctggagcaagtgcccagttcgtcattttgattccatccwgactaaattgttttgactcattacaaaaatattatttttttgaaataacaaaatttcatttaccctttttaaaaagaatgaggtaaatatatacagacat

SEQ ID NO: 54875 - DNA, 201 bp, Homo sapiens
ttgacacttctgatttttttttaaatctttaattttgtcaaggaatagattcacatagccttaataatatagtaagctttaaggacttaaaaattatttgrgcttgcctctgcttctggggaaatggaatgcatgttcttttccctattcttccgtaaatacaactaaaagcctccaatattatatataaacaaacataac

SEQ ID NO: 54876 - DNA, 201 bp, Homo sapiens
attttattcctttatatttaagtttactcatgtatatttttctgctattgtgaataacatctttattctattgtgttgtttattcttgacatgtagaaaasttatcaattttatattcattttataactagtcaccaggatgaactcttagttctaataaatttttagttgatcctcttgagtcataactaccattgacac

SEQ ID NO: 54877 - DNA, 201 bp, Homo sapiens
tcatcttcctgtataattctttatcaccataagagcttaagggagaaaaacccatgtgctcttttcaatagttactgcaaaagcatttgatagaattctakactcattcctgtgtttttaaatgattgcattgaagtttaaggtttttttttgagggcaattggcatctttataataataaactttacagttcaggcatta

SEQ ID NO: 54878 - DNA, 201 bp, Homo sapiens
aggccaacgtggacgaggacagagcaaaacaatgtaagccctcacctcctttgctcttgaaacttgcctttttggatttggttatgtgcctgaagtcatgygatttttaatttctgaaagatttggattcttaccaagttttagttcttggacacataattataccgaaattagttggttgccctattgtcagtgatttga

SEQ ID NO: 54879 - DNA, 201 bp, Homo sapiens
attcactcttctttctttttattctgtgacattgtccccaggactctgagagtgtttccaaagtgctttggctggatgagatacagcaagccgtcgatgakgccaacgtggacgaggacagagcaaaacaatgtaagccctcacctcctttgctcttgaaacttgcctttttggatttggttatgtgcctgaagtcatgtg

SEQ ID NO: 54880 - DNA, 201 bp, Homo sapiens
ttcctcatcattcactcttctttctttttattctgtgacattgtccccaggactctgagagtgtttccaaagtgctttggctggatgagatacagcaagcygtcgatgaggccaacgtggacgaggacagagcaaaacaatgtaagccctcacctcctttgctcttgaaacttgcctttttggatttggttatgtgcctga

SEQ ID NO: 54881 - DNA, 201 bp, Homo sapiens
gatctgcctgcctcggctttccaaagtgctgggattataggcataagccaccacacctggcctgtaaatcccatctgtctgtaattttcaaagtttctttrtatcaactgtatacccatatttgcttataataaacagcctctaattagagaagagattacaatgtcatggctatgcacaagagttctgttgttaggacat

SEQ ID NO: 54882 - DNA, 201 bp, Homo sapiens
acataatcccggagtgtgctgacaaatactatgatgcccttgtgaaggcaaaagagctcaaatctgaaagaggtaagttggtttgttactttagcacaaaytaagtattttaaatatcatttctgtggtattatattttcttaattttaagacaagtaatgctttcaaattaacatttctgtaattttttgtcatctatgg

SEQ ID NO: 54883 - DNA, 201 bp, Homo sapiens
gagtgcagtggcaccatcccagctcactgcaacctccacctcctgggttcaagtgattctcatgcctcagcttcccaagtagctgggattactggcatgcrccaccacacccagctcattttggtattttttatagagacagaatttcaccatgttggccaggctggtcttgaactcttggcctcgagtgatctgcctgcc

SEQ ID NO: 54884 - DNA, 201 bp, Homo sapiens
atgacaccacttagtatagtgaagaatgggaaatcttaatctagccagccaatgggagtgttaggcagacttcacaaatgatgtgtagaaagactgaatartaacactgaacaatgtttatgatcgtattgttgagtgagaaaagcaagactcaattgtaccttataaactctctcttttatagtacttgccaatttgttt

SEQ ID NO: 54885 - DNA, 201 bp, Homo sapiens
ttacacaaaactgtcatatcacctgaaaatgttttatttgataatagaatagtcaactaccagcattcctataaacaaatctgactgcatatttttacatwatcagtgcccctagtctacttcactaaggctttaaaataggaagcattttgatgatgaatgacttaacctatggtcttctagagagcatttaggagcacc

SEQ ID NO: 54886 - DNA, 201 bp, Homo sapiens
aagctcaggacccatccttagggaagagtttgaagctagaaaatcatttttgcatgaacaagaagagaatgtggtcaaaatacaggtatgtggatcacctrccactgtttacacaaaactgtcatatcacctgaaaatgttttatttgataatagaatagtcaactaccagcattcctataaacaaatctgactgcatatt

SEQ ID NO: 54887 - DNA, 201 bp, Homo sapiens
catcattctgagtttggccacagctcgttacaggggtctgcctactctggcctggggaagaaatgggaaagaagtctgaggaccttatggccattgcagtsttttccttggcagtccgagggaagcgggaggtgatgcatgtttttacagcaagcatccttgtccctttacattctgtggagctcaggcctcatgcctggt

SEQ ID NO: 54888 - DNA, 201 bp, Homo sapiens
aaatatctttttccagtaaagatgtcctttcatctcgccaccccacccccatccctgacctcttctacgtgcagtcttttttgtttttgttgtttgtttgyttgttttttagatggagtctcgctctgtcccccaggctggagtgcagtggcacaatctcggctcattgcaacctccgcctcccaggttcaagcaattctt

SEQ ID NO: 54889 - DNA, 201 bp, Homo sapiens
cttctagatttctgctctctatccttaatagcacttatcttgcctctcccacccctttgtcttttgccccagagcatcattctgagtttggccacagctcrttacaggggtctgcctactctggcctggggaagaaatgggaaagaagtctgaggaccttatggccattgcagtcttttccttggcagtccgagggaagcg

SEQ ID NO: 54890 - DNA, 201 bp, Homo sapiens
agttaataaaccgccatcaccctggaatgcccatttttatttgtttccttatccatttatgaactaccttaaggcatttatcaaatagtgacttaaatctaaaaataaaattaatgtcctttgtttggaatgcttttagagaccattaggacttaggagcagtgcagtggatgtggagagaatgaaagattcaacaataac

SEQ ID NO: 54891 - DNA, 201 bp, Homo sapiens
catgaaactttcttataacccccttcttccttttttctcattcttctagatttctgctctctatccttaatagcacttatcttgcctctcccacccctttktcttttgccccagagcatcattctgagtttggccacagctcgttacaggggtctgcctactctggcctggggaagaaatgggaaagaagtctgaggacct

SEQ ID NO: 54892 - DNA, 201 bp, Homo sapiens
agggggttgccggaatacatgatggaaacttgtctaaagaattctagtgctttaactagagcagaaaatagagcagaaaatagccacagatgttaactgayggttgaacatgtgtgaattggatctttgaaaatttacacatggattttctttgcaagttatgtgcttcacagagaagaaaggtatatgttcccttttgca

SEQ ID NO: 54893 - DNA, 201 bp, Homo sapiens
tgccctttctgatccaccatgctctgtgccctgggaggcagaccattatggatcacatatggggccccttgccctgtggcttttaggtatttatttccccygctccctccttccctcagcttcctcacatttgtaaaatgggatattatttaagtagtcagggtccaggcaggaaagaaatggtactcaaaacagtctaat

SEQ ID NO: 54894 - DNA, 201 bp, Homo sapiens
cacatatccaccagctctgcctttctagaacacttgtttaggttgtttttgacaatcttgctaaatatattagcactatacaagagaataccaggatttcygtaacttaaaaaggattttgcttatcctaaagtaaacaaatgtctttgtaaaactagttctcaaatacatgctaatgccctaggttacagctacatatct

SEQ ID NO: 54895 - DNA, 201 bp, Homo sapiens
cccaaaccttcaatcccaagttcactaaggatttgcatttgtattccagctgaatgaaaaggagacacagacacacacacacacacacacacacacacacatgactatttcatttgtataggatttaggacattttttagttttctcacagcatccatctaggtagagagagtagatatctgtagcctgtgggtggggaca

SEQ ID NO: 54896 - DNA, 201 bp, Homo sapiens
gcccaaaccttcaatcccaagttcactaaggatttgcatttgtattccagctgaatgaaaaggagacacagacacacacacacacacacacacacacacacatgactatttcatttgtataggatttaggacattttttagttttctcacagcatccatctaggtagagagagtagatatctgtagcctgtgggtggggac

SEQ ID NO: 54897 - DNA, 201 bp, Homo sapiens
ggcggagcttgcagtgagccaagatcgcaccattgcactccagcctgggcgacagagcgagactctgtctcaaaaaaaaatttatatatatatatatatawttatatatatacatatataaatatatatatatacatatatgtatatatatatgttaaaattagttaacattcccatcaccttgatgaagggtgttaaagt

SEQ ID NO: 54898 - DNA, 201 bp, Homo sapiens
aggcggagcttgcagtgagccaagatcgcaccattgcactccagcctgggcgacagagcgagactctgtctcaaaaaaaaatttatatatatatatatatatttatatatatacatatataaatatatatatatacatatatgtatatatatatgttaaaattagttaacattcccatcaccttgatgaagggtgttaaag

SEQ ID NO: 54899 - DNA, 201 bp, Homo sapiens
catacactttcagcaagtgactaaaaccttatgacccagagtaaaataattttatatcatgacccaggtagctgtgtgatatgtgtaataagtgggcgtgwgtgtctaactaaagattcaccgagcaacacttaacttctactatatgcaacagcctcttatgtttactattctgttctgttctaattcattttctaagaa

SEQ ID NO: 54900 - DNA, 201 bp, Homo sapiens
aaaaacagaatggacgaatggggtaattttgccaatgcaggaatgattcaatattaaataatctgttactatgacaggtcacttattcagaatgtttgcgratctcagataattgaaattaagtgtttttggagtttaggtaattccagaagagcagaataggaacttgagctaattccaattatcttgtttagcctttca

SEQ ID NO: 54901 - DNA, 201 bp, Homo sapiens
aaaatttacacatggattttctttgcaagttatgtgcttcacagagaagaaaggtatatgttcccttttgcatgtctgcttgctttccaaagactagctgytatcttaacttaaaaaattttatttttcatgccagaaaacattgtattttaaaaattgataaagacactccatttgtaagtacttgttttaaagtaatat

SEQ ID NO: 54902 - DNA, 201 bp, Homo sapiens
ggagtggaatttataatatacattcaaacaattgcacttctctgctttaaaccagtgttaaccaccaaaatataggaactgttaagatccatcacaacacrtgttttactggttggactgccatggaatcccagtgacccacgattagggtccacttcccctagtttctgttgtgctgttgggccacttttatgaacaact

SEQ ID NO: 54903 - DNA, 201 bp, Homo sapiens
ttgggccacttttatgaacaactgttggtgacatcagagaattttgcccatctcagaattgtcacactgtgacaaatcccatggggtagcattttctaaayggataattaatttaaaattttttattttggttatttacatttttatcatttaatgtgtgaacacatacccaatgctctctttgcctggaagattggtaaa

SEQ ID NO: 54904 - DNA, 201 bp, Homo sapiens
cggaacatcagaagggaagaaaggatagctagaagaataaaaatatgaataaatacatttttctactcttgagtttttaaagttgacagttgaagtgctgwtgtggctctgaatgaagcctgcttcattctctgtggtttctctcaagggatggcgttcagtgtctgtggcttttccaggcacgtggtacaagctgtcgat

SEQ ID NO: 54905 - DNA, 201 bp, Homo sapiens
tgacagttgaagtgctgttgtggctctgaatgaagcctgcttcattctctgtggtttctctcaagggatggcgttcagtgtctgtggcttttccaggcacrtggtacaagctgtcgatggatctaccattctggggtctggaggacagtggccatctgctcacagctccactaggcaatgccccagtggggactctgtgta

SEQ ID NO: 54906 - DNA, 201 bp, Homo sapiens
gacagttgaagtgctgttgtggctctgaatgaagcctgcttcattctctgtggtttctctcaagggatggcgttcagtgtctgtggcttttccaggcacgkggtacaagctgtcgatggatctaccattctggggtctggaggacagtggccatctgctcacagctccactaggcaatgccccagtggggactctgtgtag

SEQ ID NO: 54907 - DNA, 201 bp, Homo sapiens
aacatgacatggaaggcactaaggcttacagcttgcaccctctgaagcagcagccttagctgtacctgagccccttttagccatggttagatctggagcgsctgggatgcagggattactgtcccaaggctgtgcagtgcatcaaggccctgggcccacaaaaccattctgccctcctaggcttcccagcctgtgatggca

SEQ ID NO: 54908 - DNA, 201 bp, Homo sapiens
agacggcaaggaggagcaagtcacattttacatggatggcagcaggcaaaaatagagagcttgtgcaggagaactcctctttttaaaaccatcagatctcrtgagacttattcattatcatgagaacagcacaggaaagacttgcccccatgattcaattacctccaaccagcccctcccacaacacgtgggaattcaaga

SEQ ID NO: 54909 - DNA, 201 bp, Homo sapiens
catctcaaaaataaaataaataagaaaaagcagactttacattgataagattcagcttttacttttggttttacatttaactctagtaatcgttagttcartgtttcataatttaaaccgttgacttaaattcatctgatttgtaatttctctcttcagtttggcctataagactaatactttaagctttgaagtaagatt

SEQ ID NO: 54910 - DNA, 201 bp, Homo sapiens
aggtagcaggtagagaataggggaaattaaacagcgaccatgtcaactccttattgaattaggtagattttgggctatttttacattggattttgtacgtrttctttgggaaatggactcctaaaggaccctttcatttctaatttatacttctatttcaaaatactctctaacaacttgctttcattctgctccttgaat

SEQ ID NO: 54911 - DNA, 201 bp, Homo sapiens
atgtttgttgaacaaatgagtgaattttaatacaaagtgtatggtggccttggtgtctctgtgtgaaggtagcaggtagagaataggggaaattaaacagygaccatgtcaactccttattgaattaggtagattttgggctatttttacattggattttgtacgtgttctttgggaaatggactcctaaaggaccctttc

SEQ ID NO: 54912 - DNA, 201 bp, Homo sapiens
ggtggtgcttaactggagcaaaaggtggcaggagcatgtgagagctctagcataactgtggccttaaagtaagcagacgctatgtatttcctaagggtgartgttgataatttttatagattgctgaggccacagggtccagattaagcaagtgtgttccgaggagtctgacttcactgtgctttgactgaggtagatcca

SEQ ID NO: 54913 - DNA, 201 bp, Homo sapiens
gaggttgtcaggtgctccataatatgtctcagttctctttttgacatatttactggaagccaagaaagaaagtaaaactgcttgagtttacacagggtcartgcaactgtccatgttgtcttttgctgataaaaacctttttctctctctctctttactttttagtacatgctgcagttatagccattaatgaagcagttg

SEQ ID NO: 54914 - DNA, 201 bp, Homo sapiens
ccaaagacagccatgtggagaggttgtcaggtgctccataatatgtctcagttctctttttgacatatttactggaagccaagaaagaaagtaaaactgcytgagtttacacagggtcaatgcaactgtccatgttgtcttttgctgataaaaacctttttctctctctctctttactttttagtacatgctgcagttata

SEQ ID NO: 54915 - DNA, 201 bp, Homo sapiens
taccatctcatcttatgtttaatttttagaaaaactactcagctgaagttgactggaacaattgctgtgtgttttttcctcactccgccttttttccattrttttcttttgtcatctgttttatatgtagttatggattgaggtatatagccaaagtactgaagaattcgatccatgagaaattccccgatgcaacagaag

SEQ ID NO: 54916 - DNA, 201 bp, Homo sapiens
aagaaatagatgaaattaattctaataatatattttatttaacccaatatatccaaaaatatttaaatatgtaataaatgtaaaaaattgatgaaatattktacattctttgtttcatacaacatcttcaaaatccagtgtgtgtttcacacagcacatctcagtttgtactagccatgtctcaagtgctcaagtgccacc

SEQ ID NO: 54917 - DNA, 201 bp, Homo sapiens
ttctttactaggcagttctttatatatttattgagcattttaatttttctttccatgaatttcctgttaaagtcctttgccctattatttatatatatatatttttttatttttttcttgagatggagtctcgctctgtcgcccaggcttgagtgcagtggcacgatcttggctcactgcaagctctgccccctgggttca

SEQ ID NO: 54918 - DNA, 201 bp, Homo sapiens
gacatatttactggaagccaagaaagaaagtaaaactgcttgagtttacacagggtcaatgcaactgtccatgttgtcttttgctgataaaaacctttttytctctctctctttactttttagtacatgctgcagttatagccattaatgaagcagttgaaaaaggaatagcagagcaaaccgttgtaacactaagaaacc

SEQ ID NO: 54919 - DNA, 201 bp, Homo sapiens
ttcaatatatccctcaaatctaagcatttcgtaattatgccaaactttcaattgtttaataaaaactttgagagaccttttgagtcatattcatcactttktgttccatctccataataaactggcaccaagcagccactcaaatgtttgttgaacaaatgagtgaattttaatacaaagtgtatggtggccttggtgtct

SEQ ID NO: 54920 - DNA, 201 bp, Homo sapiens
tttttatagattgctgaggccacagggtccagattaagcaagtgtgttccgaggagtctgacttcactgtgctttgactgaggtagatccaggactcagtwggcggctgtttttgaaggctgatcattcttccactccttcattggaaattagccaagaattataaaaacaacagtttaactccatgcaaccaagtggttg

SEQ ID NO: 54921 - DNA, 201 bp, Homo sapiens
caaatctgaaagaggtaagttggtttgttactttagcacaaactaagtattttaaatatcatttctgtggtattatattttcttaattttaagacaagtawtgctttcaaattaacatttctgtaattttttgtcatctatggctaaggaaattaggaaaagttttagatgtttctttttagttttagaaagctatgatga

SEQ ID NO: 54922 - DNA, 201 bp, Homo sapiens
ttctttgtgtgtgtgttgctttctacataaagctcctgttggaacaccaggatgcaattgcccctgagaaaaatgacttactgagtgaattgctggggtcrctgggagaggtgccaaccgtggaatcttttcttggtaagagcttgttccttctacttatcccttggtttttgtttaattgggtgggttggttggttggtt

SEQ ID NO: 54923 - DNA, 201 bp, Homo sapiens
aaatctcgcaattatttattccatgactcttatacattaataaaactccttctcccaaacaacaaaattctatttttacataattattccctgactcctakacattaataaaacttctccccaaaaaagaaagtgtacttttggcataatccatttacaaagccagattgtgactggaatggtggcatatgcctgtaatcc

SEQ ID NO: 54924 - DNA, 201 bp, Homo sapiens
tggaggcttactgttttcattcagaaatcatgttgagagttagacttcaccagtcaggactcgatagaaaatgggtgaggggaaaactgtgggctagtaayaccaaagagaagactctagagaaatattttacagcattacatatgtagttttttcaactgttaactgcttactttaaatagaagcccctgggagggattt

SEQ ID NO: 54925 - DNA, 201 bp, Homo sapiens
atccaggttgataatgacctaaatgaatgctttattgaaagttagcattgaatgatttttattgaatggtgaacatgaacacttaagaaataatggatctkagaacttcatatgataatatttggaggcttactgttttcattcagaaatcatgttgagagttagacttcaccagtcaggactcgatagaaaatgggtgag

SEQ ID NO: 54926 - DNA, 201 bp, Homo sapiens
agataaattgggaaacttgctggtaaataattctataacccactcttttccttaggctttttggaaaggatataaacaacggaaggagtatatgcacaggyggcaaacgttcattgataatactgattctattgtgaaggtaaataccctttcctaccataccaagtgcttggcttaaacgtttcccctcatttcatgttt

SEQ ID NO: 54927 - DNA, 201 bp, Homo sapiens
acaggcggcaaacgttcattgataatactgattctattgtgaaggtaaataccctttcctaccataccaagtgcttggcttaaacgtttcccctcatttcrtgtttaatctgaaagacagctatagaaagggagggtacatgtgagccttgaagtcagaaggcagtactggatttgaatcccagttctgctgctcatttac

SEQ ID NO: 54928 - DNA, 201 bp, Homo sapiens
gtgaaggtaaataccctttcctaccataccaagtgcttggcttaaacgtttcccctcatttcatgtttaatctgaaagacagctatagaaagggagggtayatgtgagccttgaagtcagaaggcagtactggatttgaatcccagttctgctgctcatttacctaatcatttttcaagcaggttggttaaaccggtataa

SEQ ID NO: 54929 - DNA, 201 bp, Homo sapiens
cgtttcccctcatttcatgtttaatctgaaagacagctatagaaagggagggtacatgtgagccttgaagtcagaaggcagtactggatttgaatcccagytctgctgctcatttacctaatcatttttcaagcaggttggttaaaccggtataaaacctcaagtcctttatgagtggttatgagaatcacaagtgaaagt

SEQ ID NO: 54930 - DNA, 201 bp, Homo sapiens
tgccactgtttacacaaaactgtcatatcacctgaaaatgttttatttgataatagaatagtcaactaccagcattcctataaacaaatctgactgcatayttttacataatcagtgcccctagtctacttcactaaggctttaaaataggaagcattttgatgatgaatgacttaacctatggtcttctagagagcattt

SEQ ID NO: 54931 - DNA, 201 bp, Homo sapiens
ctaaaagataaaatatcagaagctattctatgtgtgcctttcagctgatgtgtgaagtgtaaccataagaaatatctcttgccaggacattattgaggaastcacagtaggttacattcgtgagaatatatggtctgcttcagaagagttgcttcttcgctttcaagccacaagctcaggacccatccttagggaagagtt

SEQ ID NO: 54932 - DNA, 201 bp, Homo sapiens
tagggtacatcaatgaagctattgatgaagggaatcctttgaggactttagaaactttgctcctacctactgcgaatattagtgatgtggacccagcccaygcccagcactaccaggatgttttataccatgctaaatcacagaaactcggagtaagttttagtatatctgtttcttttaaattttacaggctgggtggca

SEQ ID NO: 54933 - DNA, 201 bp, Homo sapiens
tagctgtagggtacatcaatgaagctattgatgaagggaatcctttgaggactttagaaactttgctcctacctactgcgaatattagtgatgtggacccwgcccatgcccagcactaccaggatgttttataccatgctaaatcacagaaactcggagtaagttttagtatatctgtttcttttaaattttacaggctgg

SEQ ID NO: 54934 - DNA, 201 bp, Homo sapiens
actaccaggatgttttataccatgctaaatcacagaaactcggagtaagttttagtatatctgtttcttttaaattttacaggctgggtggcagagggagrgaaggaggaggatttgacccatttacgttaaatctcatgagcttcttgtcccaacaattacccatgaatcagaatggaaataatagagctgttattttcc

SEQ ID NO: 54935 - DNA, 201 bp, Homo sapiens
ttgttagaggaggaaatcagtaatatgagaaaagaacttgagaaatatggaatacagatgccatctttcagcaaaataggtggtattctggccaatgaacwgtccgtggatgaagctgcatgtaagtccattcaaaatccaaacttgccatggatgtgagacttacctgtactttacctattgattttgattactcgaaat

SEQ ID NO: 54936 - DNA, 201 bp, Homo sapiens
acagacctatcttgtttgttcttgactgagttctccttctccatgtttgtgaaatgagaaacttgggctaggttcttcctaaggctcttgtttacaaacarccccacttcctgatgaagacatttcttgatatgattgtactcattcctgcatccatctctgtctgtagctttctctgataatgattatgattattttgtt

SEQ ID NO: 54937 - DNA, 201 bp, Homo sapiens
aaagccgcagtcagctagtataggtttttggggggtttgtctcttcagtatgaacctaaatttaaaatttttaggtaaccttaggaggaatggtgagtagdcatctttctttagttatagagtaagtttcctttctcctaattcctatatacttcacattgaaaaacagtcactacagagctatcaagaaaaagtactgag

SEQ ID NO: 54938 - DNA, 201 bp, Homo sapiens
gtcactttagaagtctggccttcattttcgacacacagataataccgtccagtggttaagagcgatggagtctattggtctacccaaggtaagccttcacscactggaatctgaactagaaaggcaaaggggtagtacacaaacatctctttatgagcaatgactttggagactgggttatgttaatgtagaaatgagaaa

SEQ ID NO: 54939 - DNA, 201 bp, Homo sapiens
cagtaagaaggccctcaccagttgcaggcccctcaaccttggacatcctagcctccagaactgtgcggaaacaaatttctgttcatcataaatgacccagyctcaggtattctgttatagcagcacaaaacagactaaaacaaatggaaaagtttaaaatctccactgactagagataaagcaaggttagcttcccaggga

SEQ ID NO: 54940 - DNA, 201 bp, Homo sapiens
taagaaggccctcaccagttgcaggcccctcaaccttggacatcctagcctccagaactgtgcggaaacaaatttctgttcatcataaatgacccagtctyaggtattctgttatagcagcacaaaacagactaaaacaaatggaaaagtttaaaatctccactgactagagataaagcaaggttagcttcccagggattt

SEQ ID NO: 54941 - DNA, 201 bp, Homo sapiens
ccaaaatacatttttaagaacccttgagatttcaaagatcaagaccagagcaggaagggaaagctctgggtctgaaccaggtctgtctgccaccaaaacamcactcttgatagggatgatgatctggaacagtggtaaaatctggcataattcaaacacttaaactagtttgcgtatatgtataaaattcctagaattcct

SEQ ID NO: 54942 - DNA, 201 bp, Homo sapiens
caagggctaaggggagggagggatgaataggtggagcatggaggatttttaggaatgtgaaactattctggatgatactgtcatagtggattatacattcrtcaaaatacagaatgtgcaacaccaacagtgagccatcacatgaactatggattatagttattaataacatatggatattggctcatccattgtaacaaa

SEQ ID NO: 54943 - DNA, 201 bp, Homo sapiens
gaatgtgaaactattctggatgatactgtcatagtggattatacattcgtcaaaatacagaatgtgcaacaccaacagtgagccatcacatgaactatggrttatagttattaataacatatggatattggctcatccattgtaacaaatgctccacactaatgtaagacattaatgggcataggtgaggggctatacgga

SEQ ID NO: 54944 - DNA, 201 bp, Homo sapiens
ttcgaagcaaaaaaaaaaaaaaaacaaaaaaaaacaaaaccaaaaagacgaagaagaagaacaaaagtcaacgtgaaatctccccagaggaaaaggaacckcgctgtttgtccctcagtaactgagcaacaccccggacacgaagggctccctgtgacttctgcggtttttcttgcacttctccgcgttggttcacttcca

SEQ ID NO: 54945 - DNA, 201 bp, Homo sapiens
ggctggaggagaaaggaaacctgctgcgggaggcggcggcgaccggccagggagcgagggaggagagttcacttttacttcagtgtcagcgcgcggcggcygtggctggctctggcgagagagcaccgagggagtgggtcgcagatcttcgggcggctaggggaaatcggcgagaggcgggatccgagcgcgccggcgggg

SEQ ID NO: 54946 - DNA, 201 bp, Homo sapiens
atggttcatcacagatggttgggatgttgccaagatacatcctttagcacgcctctgtttgctttatgtgaacattaataactctgttccaggagaaatamaattgaaaagcatcctgtacatgaaaaaagttattgcaaatgactcactttttgtgtggttccttctctccctttttccctcctatcgtcactttagaag

SEQ ID NO: 54947 - DNA, 201 bp, Homo sapiens
cctttttggatttggttatgtgcctgaagtcatgtgatttttaatttctgaaagatttggattcttaccaagttttagttcttggacacataattataccraaattagttggttgccctattgtcagtgatttgactctatctccaacaaaatgtaacaatgttgctgaacaaaatccagaaggtaaaaaatagtttttaa

SEQ ID NO: 54948 - DNA, 201 bp, Homo sapiens
ccttcttcctttgtctccaacacacacagcgaaatgctgcatgccttcatttgcagaaagttacccaactggaatcactttaatattttttttttaatctytttaggtggatggaagtttgcttagttgaagaattgccaccaaccactgaattggaagaagggctccggaatggagtttaccttgcaaagttagccaagt

SEQ ID NO: 54949 - DNA, 201 bp, Homo sapiens
gtggggaagaaggaggaagtggtcgggtttggggtctgcttcattaggagtgtgtacagtatatggcagagctggatagttgctgattaagaatttgtggraattatgattaaatggctcctcaaaagcagttattaattctgtttcctcatcattcactcttctttctttttattctgtgacattgtccccaggactctg

SEQ ID NO: 54950 - DNA, 201 bp, Homo sapiens
cagaaagtcttcccttcccaccagtgacaccgaaagatgtttcagatccttcttcctttgtctccaacacacacagcgaaatgctgcatgccttcatttgyagaaagttacccaactggaatcactttaatattttttttttaatctctttaggtggatggaagtttgcttagttgaagaattgccaccaaccactgaatt

SEQ ID NO: 54951 - DNA, 201 bp, Homo sapiens
ggcatgggagtgagctcagcgcttctgggctttcattccccctgttcgtctcatgttcaaaatccccattccacccagaaagtcttcccttcccaccagtracaccgaaagatgtttcagatccttcttcctttgtctccaacacacacagcgaaatgctgcatgccttcatttgcagaaagttacccaactggaatcact

SEQ ID NO: 54952 - DNA, 201 bp, Homo sapiens
agtgaagtacactgcagcaaagctgcatgagaaaggtgtcctgctagatatagatgatcttcaaacaaaccagtaagtgtgacctggaatctgcatagaayacgcatgccatttgatttcttgtggccttggagagagctccatttggtctagcaaggcttaacctcaattactgatgggtgacaagggaagaatacacaa

SEQ ID NO: 54953 - DNA, 201 bp, Homo sapiens
acagcgatgtcactctgagtatggtaatcgcactaccagaagcctctgcatttgccatcataacaacaaatgttctgttcttattttgtcagaaatactcrgagatcaattaaactagatggaaaaggagaacccaaaggggcgaagagagcgaagccagtgaagtacactgcagcaaagctgcatgagaaaggtgtcctg

SEQ ID NO: 54954 - DNA, 201 bp, Homo sapiens
acaagaaggcagcattttatgaagagcaaatcaattattatgacacctacataaagacttgtttagacaacttaaaaagaaagtaagttaaaatcatgtcrtgttcatttgtaatgtcatgatttctatgagatgtcaattctgtgtttctaggcagttgggttgggtatggaagaaaactttttgctctgtcttctaacc

SEQ ID NO: 54955 - DNA, 201 bp, Homo sapiens
gtgaacatcatggcaggtggtgatgtctggctgaacaagataatattcctgcttcagtatgaaaaatggcagcatatataagaaaactgttgcccacaccrgtccacatgttaccaaggcataggtgtgcttgggcaggccccggtaggtgaaaggatggacgatggccaggtagcggttgatgctgatgcaggcaaggag

SEQ ID NO: 54956 - DNA, 201 bp, Homo sapiens
tttagtggatgacaaccttgcaccagaatatcagaaagaactctgggatgccaaaaagaaaaaagaggaaaatgcaagactgaaggtgcttagattctgastaataaaaacagtaatgaatgtgcttatgagttactagtttgaaaagccttaatgttgaaagcaatacttttaaatcaattggctattttctctatagcc

SEQ ID NO: 54957 - DNA, 201 bp, Homo sapiens
tttttatgtttctatttatttctgcctaagtaaatgaccccgttttctttcttaccaccatccatccccattacaaattacatgcctttttgtaaaagatsttaacctcagaaggagaggaaatgcaatcagcaaactcacaaattttctttcagtcttaattttcttttgcctttttttttttttttttttttctgtgag

SEQ ID NO: 54958 - DNA, 201 bp, Homo sapiens
ttattgaactgtatgctgtgttcattagcaatctcgccatatcaaatttttgctacctgggttgaaacagggaatttgcatgtctttctaaaatgcatgcrtttttgtctgcagatgtcaaataggcaaggcacagctgaataagacatggaaatgtagcttgttacaagtatagtgtgtggaggaatttctaatctcttt

SEQ ID NO: 54959 - DNA, 201 bp, Homo sapiens
ttcacattcttgagtatattgagtggaagattcctctgaaaagaaagttcacatcaatagcctttgaaagatttagggaatattttgcagtgtaagattcrttatttaaaatctgaaatatatttttccttcctacgactcttctatgtgtttatagtaacatcaagacaatgacatcctgcaattgcactagaatgtatt

SEQ ID NO: 54960 - DNA, 201 bp, Homo sapiens
atgtctttgtaaaatttctgtcattaaactctttgtaattagactttttataattagactttgttttgagtacaatttttttcctgcctgaaccctgactrcttagataatatcccattttacaaatgtcaggaagttgaggcgtagagatcggtgaatatcagaactaggattcaaattcagattattttatgtcacggc

SEQ ID NO: 54961 - DNA, 201 bp, Homo sapiens
agtagagatggggttttgccacattgcctaggttggtctcaaactcctgagctcaggcaatctgcccacctcagcctcccaaagtgctaggattataggcrtgagccaccatgcccagcctatctttttaaaaaatttttattttattttattttaagttctgggatatatgtgtgggatgtgcaggtttattacataggt

SEQ ID NO: 54962 - DNA, 201 bp, Homo sapiens
attaaactctttgtaattagactttttataattagactttgttttgagtacaatttttttcctgcctgaaccctgactgcttagataatatcccattttayaaatgtcaggaagttgaggcgtagagatcggtgaatatcagaactaggattcaaattcagattattttatgtcacggctgattcttaacttcagtgtttt

SEQ ID NO: 54963 - DNA, 201 bp, Homo sapiens
gagtttgtttgaatcttctctctcattttcttggttagtttagcaaatgatttatcaattttgcttatcttttcaatgaaataactttttgtttcactgasgttttgtattttttgtttaaatttcatttagttctgctctaatcttttatttatttattattttctagttttagctttgtgtttgttcgtgtttctgtag

SEQ ID NO: 54964 - DNA, 201 bp, Homo sapiens
tgttttcctatttgtcacatccaaggaattctcatagtcatctttacattgagaagaaaccctagggaaaagtttcttacctgtcagatacagctatgaasttatgaggctataaaacaaactagctcttaaatatttcaataaataacatccttccaatcaactcctgtggttcagagtttttcgttactttcttttaga

SEQ ID NO: 54965 - DNA, 201 bp, Homo sapiens
gtgacggttcatggctcaaactcaacctgcacaaaaaatatgactactattacaacactgattcaaaagagagttcctgggtcacacctgaatcatgcttstataaagaatcatggctcacaggaaaagaaatcgaggtaggaggttggtgtttgatggataactctactgtataaagttaaatttgactggttttctatt

SEQ ID NO: 54966 - DNA, 201 bp, Homo sapiens
tgctttgatgatctgtctagtgctatcagtggagtactgaagtcccgtactattattgtgttgctgtctatctatttcttaggtccagtaataatagtttyatgaagctgggagctccagagttaggtgcacatatgtttaggtggtaatatcttcttgttggattgatccttttgttattatatagtgaccttctttgtc

SEQ ID NO: 54967 - DNA, 201 bp, Homo sapiens
agatacagctatgaagttatgaggctataaaacaaactagctcttaaatatttcaataaataacatccttccaatcaactcctgtggttcagagtttttckttactttcttttagaattgccatcagattcatattataagccaggaaggaaaaaataatctaaaagtaatcaaaccttcaatttgccaccgtattctcta

SEQ ID NO: 54968 - DNA, 201 bp, Homo sapiens
ccccccgcaaagattctacctgctaattcctggaacctacaagtatattcctttacctagcaaaagggattttgcagatctaacttagttaaggatcttcytttttttttttttttttttttgagacagtctcactctgtcgcccaggctggagtgcagtggcacgatctcagctcactgcaacctccgcctcccgggttc

SEQ ID NO: 54969 - DNA, 201 bp, Homo sapiens
cgccattctcctgcctcagcctccccagtagctgggactacaagcgcccgccaccaggcctggctaattttttgtatttttttagtagagacagggtttcrccatgttagccaggatggtctcgatctcctgacctcgtgatctgcccgcctcggccacccaaagtgctgggattacaggcgtgagccaccgcgcccggcc

SEQ ID NO: 54970 - DNA, 201 bp, Homo sapiens
aaaacaataaaattcttaggaataaaattaacaaaagaagtacaagaattgaacactgaaaactacaacacattgaaaattttaaaactcttaaatagacrgaaagacatctcatgttcatggattggaaaatagcattaagaaaacaatggtcccaaattgatttatagattcaatacagtttctagaaatattcccagc

SEQ ID NO: 54971 - DNA, 201 bp, Homo sapiens
aagaaaacactaagaaaaccccaccacaatgagtccatcatggttgtaggatactaggggagtgtgtaaaaatggcatttcttgacacgagcaataagcartctgaaaatgaaattaagaaagcaattcactatatgatagcattaaaaacaataaaattcttaggaataaaattaacaaaagaagtacaagaattgaaca

SEQ ID NO: 54972 - DNA, 201 bp, Homo sapiens
caaaaggcatccaggttagaaaggaagacgtgaaactatttctaagggatgttttctggtttatagaaaatccataggaatctactaaaaaacagaacagragaaaacactaagaaaaccccaccacaatgagtccatcatggttgtaggatactaggggagtgtgtaaaaatggcatttcttgacacgagcaataagcaa

SEQ ID NO: 54973 - DNA, 201 bp, Homo sapiens
acattgtactggagattttagccaggcagttaggcaagaaaaataagcaaaaggcatccaggttagaaaggaagacgtgaaactatttctaagggatgttwtctggtttatagaaaatccataggaatctactaaaaaacagaacagaagaaaacactaagaaaaccccaccacaatgagtccatcatggttgtaggatac

SEQ ID NO: 54974 - DNA, 201 bp, Homo sapiens
aaattgagaattataatattccagtatatctttaattttggttttattaatttcaaaattctataataaatcaggccattgaaaagttctttattcagagrggacatcactaccaacattacagaaatacaaaggattataaaggaatactatgaacaattacatgccaatgaaaacttagaggaaattgacaaattccta

SEQ ID NO: 54975 - DNA, 201 bp, Homo sapiens
gagatgcttatgaagaactgctgacacaagcagaaatccaaggcaatattaataaagtcaacagtaagtaatggatcgtatgaaggaaattgatatttccrtaagatacagactttccttgccagaatcccaacacaactctcaatttgtatacttggaaaactgccttatacaatgaaaaatctactcagtgtcagtgtt

SEQ ID NO: 54976 - DNA, 201 bp, Homo sapiens
gcaagaaatacaggaaagggtgaatttgtctttcttgaaaagatgagaggatttattgcatgattcttttgaagtattagtacctttggaatttgtgataytgggtttattataatgcacatatgtgtgttcacatgaatggagttgacttagaatattgagtttctactaaattgtatgcttgtactgtatatattcatc

SEQ ID NO: 54977 - DNA, 201 bp, Homo sapiens
accaagaaagaaacaggctagcaagacagaaataatttcagacagtaactgctctactctagccaaacaccacacacacacacacacacacacacacacacacgaaaaaaactgtaatgcctccacctaggcagcgaagcctgaatggcgagcctggacttccaccctcctggactgtaataaggcacccagacttataga

SEQ ID NO: 54978 - DNA, 201 bp, Homo sapiens
aaggatataaacaacggaaggagtatatgcacaggcggcaaacgttcattgataatactgattctattgtgaaggtaaataccctttcctaccataccaartgcttggcttaaacgtttcccctcatttcatgtttaatctgaaagacagctatagaaagggagggtacatgtgagccttgaagtcagaaggcagtactgg

SEQ ID NO: 54979 - DNA, 201 bp, Homo sapiens
ttctataacccactcttttccttaggctttttggaaaggatataaacaacggaaggagtatatgcacaggcggcaaacgttcattgataatactgattctrttgtgaaggtaaataccctttcctaccataccaagtgcttggcttaaacgtttcccctcatttcatgtttaatctgaaagacagctatagaaagggaggg

SEQ ID NO: 54980 - DNA, 201 bp, Homo sapiens
atcttatagaatcgttaaaagtcagcatcaaagatatcgcagtgtggcagtattgcagacagaatcaccaatgcagtatttactaaaacttagaggaaaawaacatgatctgagtctgaccaatgctaccaaaaatacttaatgacaagaagatagtgaagaacacagtttattgactcatttcagttgttcagaggtcgt

SEQ ID NO: 54981 - DNA, 201 bp, Homo sapiens
cgcagtgtggcagtattgcagacagaatcaccaatgcagtatttactaaaacttagaggaaaaaaacatgatctgagtctgaccaatgctaccaaaaatayttaatgacaagaagatagtgaagaacacagtttattgactcatttcagttgttcagaggtcgtacaacttttaggaaaacgacattgtagcaatggatta

SEQ ID NO: 54982 - DNA, 201 bp, Homo sapiens
ttgttcagaggtcgtacaacttttaggaaaacgacattgtagcaatggattattagtgctaattttgaagaaaaaaatgaaattatagacatactaaaaawttatatgccatggttgaaaagatgtatcaaactataaagcagcagcatcgaagatttaaaatttagaataaaaattgatcatgtggcatcccaagatata

SEQ ID NO: 54983 - DNA, 201 bp, Homo sapiens
cttgtatcttgcacatgataggtgcttacatatttaaatttgcttggagcttaagatattattagcaaagcagaaataattaattttataaaagaaatttstactataaatctgacactcaaaggatttttctaggtgggccaatgagtttacaatgtattcctttaaacaaatagtaggcaaaacacacaggaagtgaac

SEQ ID NO: 54984 - DNA, 201 bp, Homo sapiens
tgtctcttcatatccaggagcaaaaaaattatattcccagccaagctgcctttgtttggaaacgtaaaaaaactcataaatatagaagaataccagaaaawtttacataaatagttatgagatgaaacataataatgagctctcaaggtaaatagttaatccttagtatattaaaaaaaaaaaacagaatggacgaatggg

SEQ ID NO: 54985 - DNA, 201 bp, Homo sapiens
aaaactcataaatatagaagaataccagaaaattttacataaatagttatgagatgaaacataataatgagctctcaaggtaaatagttaatccttagtayattaaaaaaaaaaaacagaatggacgaatggggtaattttgccaatgcaggaatgattcaatattaaataatctgttactatgacaggtcacttattcag

SEQ ID NO: 54986 - DNA, 201 bp, Homo sapiens
ttaggaaaagttttagatgtttctttttagttttagaaagctatgatgagctcagtggcaatatatggatggcattaagaaaatgtcatatttgaggagtstgtgccttatacaggtcatgcttattgattcatttattcgtgtgagtagaccagtgatataaacagatgtttacactaatattttctctcacctaatcct

SEQ ID NO: 54987 - DNA, 201 bp, Homo sapiens
ctagtatttatttgtaccacattgtaggtcatctacaggatactattcatctttaagaaactagtgtgacagtgtgtggccttagaagtagagcttaaggaaaaaaaaaaacttttttagtccaacttgatgtttgtctagtagtaccctatgtacttgttttcaagtttcatatatttccaacttggagattccacctta

SEQ ID NO: 54988 - DNA, 201 bp, Homo sapiens
cattaatttatatatggtctatggctgctttcctgctgcagtggtagtgctgagtggttgtttcagagacccatagcctgcaaaactgaaaatatttgcctttttttttttcttttcgagatgaagtctcactctgtcacccaggctggagtgcagcagggcaatcttggctcactgcaacctcagcctcctgggttcaag

SEQ ID NO: 54989 - DNA, 201 bp, Homo sapiens
tgaaagatttaagttccagagctagccttagatatttgtgtctcttccttttctttgggttagcaggcatctgccattaaatacatcgaattcattccatrttagtgggtcacttctgatgcctttggctgtctgaaggtttggtgaaaaacatattcaattattttacatattaaagaaactacactaatgtttaagggt

SEQ ID NO: 54990 - DNA, 201 bp, Homo sapiens
gtataactttttgttatatcaagcatcagtctgttaagattattaaccagtggaaggtctaacactgttataaaaaattgtatttattctaaacaactggaatccagttacctgttttattcaatgaatgcatacatatatgtcttctcttaaagatatgtatgcatctttggtatgatttcacttttagctctttaagtt

SEQ ID NO: 54991 - DNA, 201 bp, Homo sapiens
ataactttttgttatatcaagcatcagtctgttaagattattaaccagtggaaggtctaacactgttataaaaaattgtatttattctaaacaactggaatccagttacctgttttattcaatgaatgcatacatatatgtcttctcttaaagatatgtatgcatctttggtatgatttcacttttagctctttaagttaa

SEQ ID NO: 54992 - DNA, 201 bp, Homo sapiens
taactttttgttatatcaagcatcagtctgttaagattattaaccagtggaaggtctaacactgttataaaaaattgtatttattctaaacaactggaatccagttacctgttttattcaatgaatgcatacatatatgtcttctcttaaagatatgtatgcatctttggtatgatttcacttttagctctttaagttaac

SEQ ID NO: 54993 - DNA, 201 bp, Homo sapiens
aactttttgttatatcaagcatcagtctgttaagattattaaccagtggaaggtctaacactgttataaaaaattgtatttattctaaacaactggaatccagttacctgttttattcaatgaatgcatacatatatgtcttctcttaaagatatgtatgcatctttggtatgatttcacttttagctctttaagttaacc

SEQ ID NO: 54994 - DNA, 201 bp, Homo sapiens
ctcataaatatagaagaataccagaaaattttacataaatagttatgagatgaaacataataatgagctctcaaggtaaatagttaatccttagtatattaaaaaaaaaaaacagaatggacgaatggggtaattttgccaatgcaggaatgattcaatattaaataatctgttactatgacaggtcacttattcagaatg

SEQ ID NO: 54995 - DNA, 201 bp, Homo sapiens
agaggctggccacccagaaatgccaatgggtacaggctctgatatggtttggctctgtgtccccacccgaatctcatcttgaattgaacttccataattcytgcatgttgtgggagggacccagtgggagataatttgaatcatgggggcggtttcccccatactgttcttgtggtagtgaataagtctcatgagacctga

SEQ ID NO: 54996 - DNA, 201 bp, Homo sapiens
ggaccaagaaagaaacaggctagcaagacagaaataatttcagacagtaactgctctactctagccaaacaccacacacacacacacacacacacacacacacacgaaaaaaactgtaatgcctccacctaggcagcgaagcctgaatggcgagcctggacttccaccctcctggactgtaataaggcacccagacttata

SEQ ID NO: 54997 - DNA, 201 bp, Homo sapiens
tttagaactgaaaaatacagtaacagatgtggaaacccaatgaatagtctttgcagcagaatggaaggacagaggaatgaatcagtgcactagagactataacaacagaaattcccagatctgaacaacaaagaaaaagcagactgaaagaaataaagaacagagcctcagggatcagtgggattataacagaagatttga

SEQ ID NO: 54998 - DNA, 201 bp, Homo sapiens
ttagaactgaaaaatacagtaacagatgtggaaacccaatgaatagtctttgcagcagaatggaaggacagaggaatgaatcagtgcactagagactataacaacagaaattcccagatctgaacaacaaagaaaaagcagactgaaagaaataaagaacagagcctcagggatcagtgggattataacagaagatttgac

SEQ ID NO: 54999 - DNA, 201 bp, Homo sapiens
tagaactgaaaaatacagtaacagatgtggaaacccaatgaatagtctttgcagcagaatggaaggacagaggaatgaatcagtgcactagagactataacaacagaaattcccagatctgaacaacaaagaaaaagcagactgaaagaaataaagaacagagcctcagggatcagtgggattataacagaagatttgaca

SEQ ID NO: 55000 - DNA, 201 bp, Homo sapiens
atggctaacacctgtaatcccaacactttgggaggccaaggtagggtggattgcttgagtccaggaattcaagaccagcctgggcaacatagtgaaacttwgtctctctgaaaaatagaaaaatcagtcaggcatggtggtgcacacctgtagtcccagctattcaggagtctgaggcaggaggatcagttgagcccagga

SEQ ID NO: 55001 - DNA, 201 bp, Homo sapiens
ttgtccttcctgtgagtcgatgattctttccaaattaaaaggtttttttttttaaacatatttatgccttctagggacttggactgaggggaagtctggarcaagtgcccagttcgtcattttgattccatcctgactaaattgttttgactcattacaaaaatattatttttttgaaataacaaaatttcatttaccctt

SEQ ID NO: 55002 - DNA, 201 bp, Homo sapiens
cagagtctcacactgtcgcccaggctggaatgcagtggcgcaatcttggctcactgcaacctccacctccccagttcaagcaattctcctgcctcagcctyccgagtagctggggttacaggcaccagccaccacacccagctaatattttgtattttcagtacagccggggtttcaccatgtgtgccaggctggtcttga

SEQ ID NO: 55003 - DNA, 201 bp, Homo sapiens
aaatttattatcttaaaaataagatctgctcccataccagagaagatgagacaatgagtctaccatcctaacaaacccaacacagatatgtttcaaatctktttccatctctttttattatttttttaagtttacatacatgaattcattttttggtgtaaaattgcacaagttttaacttatatattcctgtaatcacca

SEQ ID NO: 55004 - DNA, 201 bp, Homo sapiens
acagtaagagttctgtaattaatggagtccgggattataaaataattcagtattcttgaaggtaagctccagatatgtcaaaaaggaattgtcaacctgtrttatacagaaagaagccatcaataaagaaccaaatttattacaaaatgaaaaatacttttattaacagttatcctttttagtaatttgtatttgaaatac

SEQ ID NO: 55005 - DNA, 201 bp, Homo sapiens
cagcctgggcagcagagcgagactttgtctcaaaaaaaaaaaaaaaaaaaaaaaaaacttgagaaaaccaacagaatgaaagaaaataattgtaaataatrtgtttgattggggacttgtatccagaatatataaagaaatcctacaactcaatgatagaaacataatccaatttaaatattggacaattacacatcaaag

SEQ ID NO: 55006 - DNA, 201 bp, Homo sapiens
gcattgaagtttaaggtttttttttgagggcaattggcatctttataataataaactttacagttcaggcattaatctttttccatttattaatctgttcmaaactgtaccattataattttattcctttatatttaagtttactcatgtatatttttctgctattgtgaataacatctttattctattgtgttgtttatt

SEQ ID NO: 55007 - DNA, 201 bp, Homo sapiens
tatatattttaatccctagaaaaagtgccatctttgcttaaccagaagagaaattcttacaaacacaaaaacgactttcaaaattgctccctgacttaatygtagacatctaaaatcttgaatatgccacacatttttaaacatcaggagggaacacttagtctatgaccaggtttgaatagagtgaatgaactatagatg

SEQ ID NO: 55008 - DNA, 201 bp, Homo sapiens
caaagatagaatcagttgatgaggcagccaccagcatgagagtcaaaagagaccaaagaataaaaaatgatgtcaaatgtcaaggatggcaataccactcrcagaaatagggaagatggtgatttaaagagcttgaagtagcaataaggcaaatggaaatgtcattttccatagagttgtgatatcttttctcctgcatta

SEQ ID NO: 55009 - DNA, 201 bp, Homo sapiens
cagattcgtacagacttgtaaagtcatctcaggaatcttttatgcttaaagtttcctcagccccatttatattcactactatcattcactctttaccactmatatcttccctgctgtctaatcactaatatcttccctcctgtctaatcactaatgtcttccttcctgtctaatcactgagttaagggaaaaatagtcatt

SEQ ID NO: 55010 - DNA, 201 bp, Homo sapiens
taaaaatatgcatttaaaattgttttttattgttttgttgggcagtatgaaatatacagtcaaggcagattcgtacagacttgtaaagtcatctcaggaaycttttatgcttaaagtttcctcagccccatttatattcactactatcattcactctttaccactaatatcttccctgctgtctaatcactaatatcttcc

SEQ ID NO: 55011 - DNA, 201 bp, Homo sapiens
caacctcaggaagatatgccctgaaacatgctttcttgaatgtcagcttgctgctttatcatttgcatcttgcttatgaaaatagagtgaagaatgaggarctatgtagcttctgcagtccatacattcactgcttttctgtagtatgcattaccaaattcaagcttcgagctgtgttttccaccatgaaaacaaagcaac

SEQ ID NO: 55012 - DNA, 201 bp, Homo sapiens
tttttaagcacccaattttattttgaccttttatttgggcatctttttttctgaaatatgacacgatttttctgccccacaaatggaggaattggaacacratctaactgttgcttaatgatcacaaatcatggtgatttgctgtgtttctagaaattatgagctgccagcatgaaagcataccaacctcaggaagatatg

SEQ ID NO: 55013 - DNA, 201 bp, Homo sapiens
ttttttgttttttttttttcttgagacggagtctcgctctttcgcccaggcaggactgcagtggcgctatctcctgcctcagccttccaagtagctgggastacaggcgcccaccaccgcacccagctaattttttgtatttttagtagagatggggtttcaccgtgttagccaggatggtcttaatctcctgaccttgtg

SEQ ID NO: 55014 - DNA, 201 bp, Homo sapiens
gagccctaacactaaaatatgtttgctgttgcttttatatatgaaagatgacttcaaaataaattttccaaatgaacacaggctagttttcattttattcaaggtaaagtgtttttttttaagcagttatagtgatgttttttgtttgtttacttttttattacaaagacaaattccaattttaaaatctaggcaacttta

SEQ ID NO: 55015 - DNA, 201 bp, Homo sapiens
tcagcaaattgggtgcttttatggtaaccaaaacataaattttcatttctttcttagttcagcatctttagaaaactaaggctttgggattttctaatttaaaaaaaaataacttttctaagtttgttatcatctgttctcacccttttattctggaatgtcactgaacgcattccagcttgaaagatgctgaaactaaga

SEQ ID NO: 55016 - DNA, 201 bp, Homo sapiens
ctacaaagacacactgcccccgttatgcccccattgataacttctaaataaattacggtgtggtttcacatctgtgtgaaacctgccaacatcagggctcaaaaaaaaaaaagtataaaaagtgtcatttttacccaagaacagatgcctaagaccactctccctgtccctgttcccttcctatgtgccacatcagttttc

SEQ ID NO: 55017 - DNA, 201 bp, Homo sapiens
ttaatatggatgttgtatagccactaaaaatgatggtttttagactattttaaagcaggaggaaaggtttgcgatatagtagaggagaaaatagtgcctamggtagtatgatttcttttattatcaaaaaataataatccagaagaagaaagaagttaagtgatttttctttgggtgatagttaagtttatcttctccccc

SEQ ID NO: 55018 - DNA, 201 bp, Homo sapiens
gtttagtgaggaaaagagagattgtaaagggaaatggctttgttcttatagaacaatgctagctcttgctagtaaccttaacattttttatagttcttttaaatcagcattcctcctaaaatcctcaaaatctgtaggtcagtgaagtggctaacattggttttaggcaaaaagaatggtttggagaaagaagacagagca

SEQ ID NO: 55019 - DNA, 201 bp, Homo sapiens
aaagttttaggaaaagcaactttcttgccacttactctgggacagtgaactaatgttaagtggcaggggaggtgttctagaacagcgactttcaaatatgagtcgcatgccattagggtcatgaaatcaatttagtgtgtcacaatgagcaacctttaaaagtggaatagaataaaagcaaatagaaaatatcagcatgta

SEQ ID NO: 55020 - DNA, 201 bp, Homo sapiens
gacagccctagaggactggacctgaaacaagccctggactggctcgttcttgtcggaggaccactccgtgcccttggaaacatcaggcactctttgccccmacacccacagcctctgagaggatggcccagacccactgcagcagcaatttcccttcactcccatgccaccagggcagctagccacactgcctctcatgtt

SEQ ID NO: 55021 - DNA, 201 bp, Homo sapiens
gaaatatttataaccatgaaaacagttttctttttcatgttaaataaaatgctttatataaatgttttagttctttactcagtgccataatttcctgaccrcaaatttaatgccaaattggctatactttttttttccatttttaagtaaaaggcattggatgttttgcactaatggtaaaaccggctgaaaatatgaaag

SEQ ID NO: 55022 - DNA, 201 bp, Homo sapiens
gtgcctgttgttttattcttgtgaaatcttgaacatgttactgatgatacatgaagtacaatttaaagtttgtctttttgctctatgcgaaagctgagaayttcgtgatgcttgacagaaatgaattacaggaggaaattaatgttgccagtgagacatctgaggtccataagcctagagaggaaatggctccatagcctt

SEQ ID NO: 55023 - DNA, 201 bp, Homo sapiens
acttctcagcaccaccttgtggtaacttttacttaagccaggatgtttgtttattgtaagatttatattaatattacattgtacaatggagaaattaaaartgtaattggaaatagctatctaacttctttatcatcaaaggggaaaattaacagtttagtataaacattttacttcatgttatcatcaaacctatatttt

SEQ ID NO: 55024 - DNA, 201 bp, Homo sapiens
taaatgcttgggaaggaagtttgctattgctgtttcttttcagcatgggaatactgggtaaacacagtttcctgataaacatttgcccgtttgagtaatcrgctgggaagcacctcccacacagagattaggtgtaaaacgcccataccatgaaaagtgatctttccaaagctaacagtttaaacctcaacatcaatgatt

SEQ ID NO: 55025 - DNA, 201 bp, Homo sapiens
ttggaatgctctcagccctttgacttggctgttaggtaccaaacggtgcttaataaattaactgttgaagagctacatgagattggcactttttctattcratgggcttttttgttttttagattaagacttgatttcctatatacttcaggtaataagcagcctcatttgaatttaaatgcttgggaaggaagtttgcta

SEQ ID NO: 55026 - DNA, 201 bp, Homo sapiens
aaaaatgtttacatttattaaagtaaatttgtgttcatgaagtttcactccagagttccagctcattataatcttccacaagactttaataaaacaatcayttagccggctaaaattgaagtttagaaaaattttttgagaaatgtttttagaaattcagagaagcccagaaaaagaccatctgtatcctctctccacaaa

SEQ ID NO: 55027 - DNA, 201 bp, Homo sapiens
tgttgcatatagttggaaaaggaatgatttcccatttattgcatgattcatagtacccttcacttctttaggcaaaatatattctttaaatatgtatattraatacagatagaatgtttgaataatcttcaaggttaacagtagacaagattacttgtcaaatttattttgagtctgtttttctagtctggtcaaaaaggt

SEQ ID NO: 55028 - DNA, 201 bp, Homo sapiens
tgaagagcagggaatcagatactgctttgtgctttaataatatattaacttattgttttgtgggatttttttgttttctttttccttctttccttctagaycaaccctttatacttggctaagctgattttccagatgccacagaacaagtccactaaatttatggatactgttattttcacactatataattatgcctct

SEQ ID NO: 55029 - DNA, 201 bp, Homo sapiens
ttacaggcatgagccatagcgcccagtgtaacttgtttatagaaattagcctatggtaaaattgattttgttatacattattttgcttaaattcatagttyccaagtaggtgaggacttactgtactccattcttcaaggccaagtccaggttctaccacctttttaatgttttccttgattgctgcagtgataacccaat

SEQ ID NO: 55030 - DNA, 201 bp, Homo sapiens
gtgatgtaggtgttgttcctcccttcaggtaggaggttcagtaatcattcagggtcacacgactggaaaaggctgaccccagatgtaaagccaggctcccmgctccttgttcttccactgtgttctaaactccttcccagcttgcgcttgacacagccttgtcttctctccctccgtgcctcgcagtggtagggttccatg

SEQ ID NO: 55031 - DNA, 201 bp, Homo sapiens
gatgagccgatctggagagcctgcctggtgggagcaggttggtccctgcagtccagagtctgcacacagtccttccagtgagtgtctctggaggctgtatytcctgattacaactctatagttttgtctactagagctgacacctttgttttctgtcacttctcaggccaagaagtaactttttttaggaaaatatctttt

SEQ ID NO: 55032 - DNA, 201 bp, Homo sapiens
cttctcaggccaagaagtaactttttttaggaaaatatctttttccagtaaagatgtcctttcatctcgccaccccacccccatccctgacctcttctacrtgcagtcttttttgtttttgttgtttgtttgcttgttttttagatggagtctcgctctgtcccccaggctggagtgcagtggcacaatctcggctcattg

SEQ ID NO: 55033 - DNA, 201 bp, Homo sapiens
tccacgtccacaccacacatatgcacactgcggacttcaccactcacattcactttactttgttaatctggctgcaaggaaatttcttagcccttgacacrgtatgtgaagagagttctgttggcagctcaccatggtatttcaaatgtgtgcctcaaattgagagtgccggttggaaataacaattcactctaagcagtg

SEQ ID NO: 55034 - DNA, 201 bp, Homo sapiens
ctttactaggcagttctttatatatttattgagcattttaatttttctttccatgaatttcctgttaaagtcctttgccctattatttatatatatatatytttttatttttttcttgagatggagtctcgctctgtcgcccaggcttgagtgcagtggcacgatcttggctcactgcaagctctgccccctgggttcatg

SEQ ID NO: 55035 - DNA, 201 bp, Homo sapiens
atgccattctcctgcctcagcctcccgagtagctgggactacaggcacccaccacacctggctaattttttgtattttttagtagagacggggtttcaccrtgttagccaggatggtctcaatctcctgacctcatgatccgcctgcttcggcctcccaaagtgctgggattataggcgtgagccaccgcgcctggcttgc

SEQ ID NO: 55036 - DNA, 201 bp, Homo sapiens
tagccaggatggtctcaatctcctgacctcatgatccgcctgcttcggcctcccaaagtgctgggattataggcgtgagccaccgcgcctggcttgccctrttattttaaaaattgtctctatttattgatttgtaattctttatatattctgaatacgaaccctttgttacatagcaaatattttctcccagcttggcct

SEQ ID NO: 55037 - DNA, 201 bp, Homo sapiens
aacctgaaaactgagtctttttcttgcaggcaaggaaactaaagtctaaaagtaccagtatcagtccatggcctgttaggaaccaggcgacacagcaggaggggagcaagtgaagcttcatcctgtatttacagctgctccccattgctggcattaacacctgagctccacctcctgtcagatcagtggcagcagtagatt

SEQ ID NO: 55038 - DNA, 201 bp, Homo sapiens
tctagttgtaggaaaacaagctcagggcatccactcattctgtattatggtgagttgtataattatttcattatatattacaatgcaataataatagaaayaaagtgcacaataaatgtaacgcacttgaatcatcttcccgaaaccatcccccaccctgtccatggaaaaattgtcttccacaaaacctgtccctggtgc

SEQ ID NO: 55039 - DNA, 201 bp, Homo sapiens
actacagtaaaagtgaaacttcagatgtcaattagaccagtgtatgtataatttaaacaaacttttgtctgtgtttccttttcttctttcttttctttctktctatctatctatctagatatctatctgagatggtatctcactctgtcacccaggctggagtgcagtggcacgatttcagcttactgcaacctctgcctc

SEQ ID NO: 55040 - DNA, 201 bp, Homo sapiens
cagtaaaagtgaaacttcagatgtcaattagaccagtgtatgtataatttaaacaaacttttgtctgtgtttccttttcttctttcttttctttctttctrtctatctatctagatatctatctgagatggtatctcactctgtcacccaggctggagtgcagtggcacgatttcagcttactgcaacctctgcctcccgg

SEQ ID NO: 55041 - DNA, 201 bp, Homo sapiens
atatggatctagaggttaaaggcagttaaatgaccagaaaaaaaaaaaatttctcaccttctggaagggaaatgcgctcagctttgttctttgatagaaarttatgttcaattctggcagtaggcttattccttctagcccaagtgactcaagggaaataacatttctttctttagtttgggggtagaaatatttctattt

SEQ ID NO: 55042 - DNA, 201 bp, Homo sapiens
cagtaggcttattccttctagcccaagtgactcaagggaaataacatttctttctttagtttgggggtagaaatatttctatttgggaatatggggtagayaaatatatgcttttgctttaaaaaagaaaaaggctatcatgaagacatgatattctatttaatgaatattctattatatgaagaatttctatttaatgaa

SEQ ID NO: 55043 - DNA, 201 bp, Homo sapiens
tacctaagggcatggggaagttgtgggggagtgtatgtgtatgtaggtatttctttgaattcctaggggaatggtttttaacttgtttacaaaagaaaaayaatattaaacaggcaccgttttcttaagtcaaacattttcataacttaccaattagaattatgaaaaaaacttatatctgcaagtttaaatttagcatag

SEQ ID NO: 55044 - DNA, 201 bp, Homo sapiens
cctggctctttttttttttttttttttaagagagccagggcctcactgtgctgcccagcctggttcaaactcctggtctcaagcaatcctcccacctcacyctcccaaagtgctggaattacaggcatgagccatagcgcccagtgtaacttgtttatagaaattagcctatggtaaaattgattttgttatacattattt

SEQ ID NO: 55045 - DNA, 201 bp, Homo sapiens
ctcaaccccctgagtaactgggaccacaggtgcaaaccaccatgcctggctctttttttttttttttttttaagagagccagggcctcactgtgctgcccwgcctggttcaaactcctggtctcaagcaatcctcccacctcaccctcccaaagtgctggaattacaggcatgagccatagcgcccagtgtaacttgttta

SEQ ID NO: 55046 - DNA, 201 bp, Homo sapiens
tttttagcagtcagaatctttcataaccatatgttaagtacttgctttgtgtaaacaggttgccaggcacaaagggattataaagagaaagaagaaatggsctttgcctttgagcagttcataatgtcataagaattagccatggctatattttaaataggttgtagctaacctaagtttttgctatcagtgttttattta

SEQ ID NO: 55047 - DNA, 201 bp, Homo sapiens
gactgttgatgtgccaggaaacttctgctgagtactttcggttctttcttctttactttacctctgcaccccagctcatggttatcttgtaaaactgaagrtgctttgcactgcaaacagacatgacagctcagtctcccctgtagcaagttctagggaaggcaggttggcagagtcccatttttgagctcagttctccaa

SEQ ID NO: 55048 - DNA, 201 bp, Homo sapiens
tattccccaaagttcgtgtgttggaacgtagtcccccatgcagtagtgttgggaggtggagcctaatgagtggtgattaggccaccagagttctgccctcstgaatgggttaatgttattgtgagagtgagtttggtaaaaggatgagttcagcctccttttctctctctttcacccatgcgatgccttttgccatgttac

SEQ ID NO: 55049 - DNA, 201 bp, Homo sapiens
tagctagaggaagaaagcactgcaaatatggtattaagatgacattcctcacagttgaatttttcactgtgctattacttcacactacctgctgcgagctrttctcttttgatcctttaggctgtagaggaatcagtctgtgtaactctccctcattcaccacctccaagaaagggttaactttggacataagataactgt

SEQ ID NO: 55050 - DNA, 201 bp, Homo sapiens
gcactttaatagaagcagtaaggagaaaggaaagtggcaaggaaagcacaacaggctttcaacacttggcttagaaatctcagcagaatatccaaggttgycacttacaagctctaccttccacaaaacacaaaaatgcaattcagcaatgttcttggccattttataacaaggattgccttttttcagtgtctaataaca

SEQ ID NO: 55051 - DNA, 201 bp, Homo sapiens
cttctatgcctgtatttagaggtgatcttagaagctgtgttgtgtgacacacaaacccttctgctcacttttgcattttggaaaagttcttgcatctgacwtcacccaaagagaagtgcctttaaagataggcacaaagttagagaatggtgcctgaagagcatgccgtacaagttattagcctgattttaaaaagctgtt

SEQ ID NO: 55052 - DNA, 201 bp, Homo sapiens
gttcttttcttattttaaaaatgaatttaacaattaaatgtaaacttttttagtttaaagtactattcaaagaggaatattcaaaatagtctgaagaggcygggcacaatgtctcatgcctataatcccagcactttgggaggccgaggcgggcagatcacttgaggtcaggagttcaagaccagcctgaccaacatggtg

SEQ ID NO: 55053 - DNA, 201 bp, Homo sapiens
tctcccgtggtgctcatctggctgctgccatctgtgctggaccccgccaaggtatagagtctcatggacacgatctggaaggacccagacagtgtgccatygatgtcctctagatcagaggggcccagggaggtgactacttctactcctttggggactgccaccgctaaacagcctagcagcagctgcagccagactgcc

SEQ ID NO: 55054 - DNA, 201 bp, Homo sapiens
tactaaaaatacaaaaattagccaggcatattggcacgggcctgcagccccagctactcaggaggctgaggcaggagaatcgcttgaacctggaggtaaakgttgcagagatcaggccactgcactccagcctgggtgacagagcaagactatgtctaaaaaaaaaagtctgaaaaaattgcatttctgctactttgtgcc

SEQ ID NO: 55055 - DNA, 201 bp, Homo sapiens
caagacccaaggaacaaatgaaaatattaaaatatgtgcaattgatgattcattcaatttatgttcaacaaatatttattgagcacttacatttatacacrgaagaaccaaagataaaactctaagaaggaaaatttggtatagataaaatcagaaaaacagttaataaaatttgtagatatctaaattattggtggatat

SEQ ID NO: 55056 - DNA, 201 bp, Homo sapiens
tggctccacattcccaggaacaaggatcctactgcatttttgtctttatataaccctattatatggactacattctgccataaggaaaggaaaaccttggwtgcgatggtttaaacaaacaagtttgtttttccacatagcatgaattccagagatgggtggctaatggtattggttcaacagctgtgtgatggtaggggt

SEQ ID NO: 55057 - DNA, 201 bp, Homo sapiens
gagaatcgcttgaacctggaggtaaatgttgcagagatcaggccactgcactccagcctgggtgacagagcaagactatgtctaaaaaaaaaagtctgaaraaattgcatttctgctactttgtgccccttttaaaacgcaatttttccttaaactaaatgtgtggttattctaaaataacttctttgcctttccatccag

SEQ ID NO: 55058 - DNA, 201 bp, Homo sapiens
aaaaaattgcatttctgctactttgtgccccttttaaaacgcaatttttccttaaactaaatgtgtggttattctaaaataacttctttgcctttccatcmagagcaaaattaatgttaacaagtctcttaaagtgaaatatgtacactttccagttctgaagtaaaaagggatgggaaccctgtggtgttgagagtaaaa

SEQ ID NO: 55059 - DNA, 201 bp, Homo sapiens
tgaggccagcctgggcaatgtcaggagactctgtttctacaaaaaatctttaaaaattagctgtactctagcctgggtcacagagtgagactccatctcaaaaaaaaaaaaaaaatctctaaattgaaaagactttaagagtagtttctttgagacccatgctgtaggaaaatatttcatcaagggaaactactctgcgag

SEQ ID NO: 55060 - DNA, 201 bp, Homo sapiens
atttgccttttctttaactcctgccttccttcaaagcctgacttctgtttatcccatgaaacctcctgacaacaccaactcagaagaaaatgcttcttccwgagatggagtctcactctgcggcccaggctggagtgcagtggtgggatcttggctcactgcaacctccacctcccaggttcaagcgattctcctgcctca

SEQ ID NO: 55061 - DNA, 201 bp, Homo sapiens
gcccaggctggagtacagtggcatggtctcagctcactgcaacctccgcctcccaagttcaagcaattctcctgcctcagcctcccaagtagctggaattrcagacacatgccaccacacctggctaattttttgtatttttagtagatacagggtttcaccacgttggccaggctggtctcgaactcctgatctcaagtg

SEQ ID NO: 55062 - DNA, 201 bp, Homo sapiens
ctgccttccttcaaagcctgacttctgtttatcccatgaaacctcctgacaacaccaactcagaagaaaatgcttcttccagagatggagtctcactctgyggcccaggctggagtgcagtggtgggatcttggctcactgcaacctccacctcccaggttcaagcgattctcctgcctcagcctcgcgagtagctgggat

SEQ ID NO: 55063 - DNA, 201 bp, Homo sapiens
gtgatccccccacctcggcctcctaaagtgctgagattacaggtgtgagctaccatgcctgtcctcactagggtattctttttctttttcttttcttttctttttttttttttgtgttttaaacactttcaagctctcaaaacctcaaagaaggatacaatgaacatctattcccttcacttagctttaccacctgttgac

SEQ ID NO: 55064 - DNA, 201 bp, Homo sapiens
gctcactgcaacctccacctcccaggttcaagcgattctcctgcctcagcctcgcgagtagctgggattacaggcacatgccaccgcccagctaatttttktatttttagtaaagatggggtttcaccatgttggccaggtgatccgcccgcctcggcctctgaaagtgctgggattacaggcgtgagcgactgcgcctgg

SEQ ID NO: 55065 - DNA, 201 bp, Homo sapiens
tctcacccaggctggagtgcagtggtgcaatcatggctcactgcagcctcaaacctcccagcctcaagctgtcctcccacctcaccctcctgagtagctgrtactacaggcacacatcaccacacctagctaatttttgtatttttttgtagagatgggttttcaccatgttgcccaggctgagctcaagcagtcctccct

SEQ ID NO: 55066 - DNA, 201 bp, Homo sapiens
ttacaggcacatgccaccgcccagctaatttttgtatttttagtaaagatggggtttcaccatgttggccaggtgatccgcccgcctcggcctctgaaagygctgggattacaggcgtgagcgactgcgcctggcctgaagtttctataaaagttatcatctgaaatactcaattggctataggtcaataatgttcatgtt

SEQ ID NO: 55067 - DNA, 201 bp, Homo sapiens
ggcacacatcaccacacctagctaatttttgtatttttttgtagagatgggttttcaccatgttgcccaggctgagctcaagcagtcctccctcctcagcytcccaaagtgctgggattacaggtgtgagtcaccacacctggcctgatactgtgagcttttgggtactactctctgctcttatctgaatagtgaagttac

SEQ ID NO: 55068 - DNA, 201 bp, Homo sapiens; identical to SEQ ID NO: 15956

SEQ ID NO: 55069 - DNA, 201 bp, Homo sapiens
ttggctctgcaggagagcctagtaaattttgaaacgcagacaatcctacttcagtggaaaaatcctgatcttaaccccgagtctctggtctgtctctggcycccttgtgcaatctggggggattgtgcttcatgtctggtagaagaggacaggtctatgagaaggaggcatgtacacacagctctaagaagtggggaccgg

SEQ ID NO: 55070 - DNA, 201 bp, Homo sapiens
gacaatcctacttcagtggaaaaatcctgatcttaaccccgagtctctggtctgtctctggctcccttgtgcaatctggggggattgtgcttcatgtctgrtagaagaggacaggtctatgagaaggaggcatgtacacacagctctaagaagtggggaccggcttctacactttctgccaggttaatctcaaatggtgca

SEQ ID NO: 55071 - DNA, 201 bp, Homo sapiens
tacctggaaactggagttttggggtggtcagtgcaactaaactcttatccatctacgatgaccaatctgagatgaaatttaagttctgaagtagttaaacrcagttgtgtaaaaggtgattgaataagtcggtatttagcatagctcagctgtaacatcctatcagtgctttcgtttgaaccatagaaaggtatacgcagc

SEQ ID NO: 55072 - DNA, 201 bp, Homo sapiens
agttttctaccacgtttacattgtagcacctgtaggtttagcgaacagttaaatggaaaataggctcatttagaagctctttaatcaggcaggatggcagrgatatatattgttcttaaaataatttctatagcaacaggactttctgaaatatatccataactcagttaggaatatccactttctattttttgccttggg

SEQ ID NO: 55073 - DNA, 201 bp, Homo sapiens
ttcaggaattaacatttctagtcatttctgcactctgtactccgtcctacttggcttaatgtccctgggttgcttttttgtttgtttgttttttcccatcrtgtgatttgtaatacacagcttttcctgcccctggtatttctcaaggcaagagttgaggcagctatgtcatctgggagagtgacttagggcagtgatccc

SEQ ID NO: 55074 - DNA, 201 bp, Homo sapiens
gactggcacactgcctcctgaaataaaactggaatcccatttaaacaaaaaaaggaagtgtctttcttaaatgagtttttttttgttttgttttgttttgttttttttttttgagacggagtctcgctctgtcgcccaggctggagtgcagtggcgcgatctcggctcactgcaagctctgcctcccgggttcacaccatt

SEQ ID NO: 55075 - DNA, 201 bp, Homo sapiens
tctcaagctactctctatggaagacaccgcatgtcaccttgaagcatgcagaattttgaaaaagtttgtcacaaccaagaaaacagttttagacttcatayaatgtttcttcttttaacctctgccattactagatccctagagactattcagaattcaaactgcagagtgactcattatgtacacagaagattgttcttc

SEQ ID NO: 55076 - DNA, 201 bp, Homo sapiens
aactcagttaggaatatccactttctattttttgccttgggtaatcaaaaacagagacccaaatttgggactgaactgtagaattcgtgaggggcttcaayattgttttcagtgtgtttattcccccctgctttcattgtccttgtctacttttattttccctttacccaattttaagatttcttttatttataaaccttt

SEQ ID NO: 55077 - DNA, 201 bp, Homo sapiens
cgcccggccctaacagatctatttttgtaaacctcctcaaatatttttaggaaaaacatgagatataattaaagtgttcattggacaagtgagtggttggrctcctctctgccctcagggagctgattttctgggaggcgacatggcccactggcccagagctgggctctggctctgtcatttgctaatgcttagctctgg

SEQ ID NO: 55078 - DNA, 201 bp, Homo sapiens
ccaaacctagacacctaggaaagggggattctgttagtttttccaaggcaaccatataaattgtgccagccctgggcaagccaggacttatggtcaccctrcccataaggatgggtctgtgcaatgacattcactttcctagacagcctttacagcaacctttggagcagaagggaaaccaaacagttggagaggatgcca

SEQ ID NO: 55079 - DNA, 201 bp, Homo sapiens
gacattcactttcctagacagcctttacagcaacctttggagcagaagggaaaccaaacagttggagaggatgccacagcattccagaaaaggggaagccrggttccttttcaggaaagttgagctaaaaatagaacatcaccattcaacagttgctcgagctcttcaaacactggggcttgtgccattgttccttttctt

SEQ ID NO: 55080 - DNA, 201 bp, Homo sapiens
tttttcctcccaagaaacagcatagaatacatgggctttttttttttttttttttttttgagacagagtcttgctctgtcacccaggctagagtgcagtgrcatgatctcagctcactgcaacctctgcttcccgggttcaagcaattctcatgcctcaccctcctgagtagctgggattatagtcatgtaccaccatgcc

SEQ ID NO: 55081 - DNA, 201 bp, Homo sapiens
atgatatatctatagaggtggctgatgtggttcctggcacatagtgctaaacaagttgtaatggtttcaattaattgagcacctaatactagcaaagtatygtgatgaatgaaacaccgcttagctgctgacagcttaccagagaatctgggtgacaagtaaaaatgcttatacttttagtgcccttccaagttctgtgga

SEQ ID NO: 55082 - DNA, 201 bp, Homo sapiens
acaaacatgcttttgctctcattctgttctctactaatgagttttattttccaaaaagaaacaaagatacatttatttgtaaagaatatataaggccggayatggtggctcaagcctgtaatcccagcactttgggaggctaaggcaggaggattgcttaaggccaggagttcaagaccatctgggcaacgtagcaagacc

SEQ ID NO: 55083 - DNA, 201 bp, Homo sapiens
atggtggctcaagcctgtaatcccagcactttgggaggctaaggcaggaggattgcttaaggccaggagttcaagaccatctgggcaacgtagcaagaccytgtttctacaaaaacaaaataaaaaatgaatatataaagataattttttcctccatgagaaccagggtcacgtgaggcccttccctgctttggcactgat

SEQ ID NO: 55084 - DNA, 201 bp, Homo sapiens
ggactctgcctgtaacttttcacattagattaggggaactctgagaaagaagtggagcttataatgtgcttctgtattgtagctttgatatctctgaaaaygtgtacctttctctgctaagcaggacaaataagacaaaccaaacagggagggacatcctcatcctgtggacatgtgaatatttctagaaggttatgcaaa

SEQ ID NO: 55085 - DNA, 201 bp, Homo sapiens
atcttcaaaggtctctttatgtaagccaagccattggctatattggtgagtctgggacagttatatatgtgccctggaaagaaaacaaaacacgggtgtgwttccttttgtgtcagtgtttacaactcagataccaaaagaacaccttgttgattaaatcaagtctcaagctctggccttatctagtggtgagttagagaa

SEQ ID NO: 55086 - DNA, 201 bp, Homo sapiens
tgtttagaaatattatcttcaaaggtctctttatgtaagccaagccattggctatattggtgagtctgggacagttatatatgtgccctggaaagaaaacraaacacgggtgtgtttccttttgtgtcagtgtttacaactcagataccaaaagaacaccttgttgattaaatcaagtctcaagctctggccttatctagt

SEQ ID NO: 55087 - DNA, 201 bp, Homo sapiens
acctctgaaaataaactaagcaaaaaaaaaaaacaaaaaaaaaacacccttcccttggtgataggcttgtttagaaatattatcttcaaaggtctctttakgtaagccaagccattggctatattggtgagtctgggacagttatatatgtgccctggaaagaaaacaaaacacgggtgtgtttccttttgtgtcagtgtt

SEQ ID NO: 55088 - DNA, 201 bp, Homo sapiens
agtcccctgcacagagcaggcactccacaaatgcttgcaatgaatttaaataattagggaatggtttttgtcactcttcacatttttccatttgaatttcragttttggaaatattttatttaacctcagaaatcagtgaagactttgttttgcagaatagctgtatttcagaagaagaaagagatgcttatgaagaactg

SEQ ID NO: 55089 - DNA, 201 bp, Homo sapiens
caaattgcagcttgagtaaatagttatgaatgggactgctattgtgtctcccaaggaaagttcctgtgatattatattccttttttaaggaaagagaaaaygcacagaaaacttttgctgtgcttcctttttctgtcctacctctgaaaataaactaagcaaaaaaaaaaaacaaaaaaaaaacacccttcccttggtgat

SEQ ID NO: 55090 - DNA, 201 bp, Homo sapiens
tggcaggattcagtttctgacaggtttttggactggagatctcagttccttgctgctgttggccagagtcttccctcagttgctcaccacttgggcctctkacacatggaaacttacacatggcaactggtttccatcagagtaggcaactgagagaagaagatggaagctagtctttttgtaacctattcttagcaatga

SEQ ID NO: 55091 - DNA, 201 bp, Homo sapiens
actgataaacggtgatgtatccatacaatgaaatatttctcagctataaaaaagaatgaagtactgatacatactacaacatggatgaaccttaaaaacaygttgagtgaaagaagctagacacaaaaggccacatattatatgaaatgtccagaatagacaaatccacagagacaaagtagattagtgattgccagggcc

SEQ ID NO: 55092 - DNA, 201 bp, Homo sapiens
tgccttctttttttttaaatggagaaattagaaagctgattctaaaatttatatggtggccaggtctggtggcttgtgcttatcttccagcactttgggargctgagatgggagtattgcttgaggccaggagtttgagaccagcctaggtaatgtagcgaaaccctgtctctgcaaaaaaaaaaatttttgaattagcta

SEQ ID NO: 55093 - DNA, 201 bp, Homo sapiens
tttgtggcttacagggagtattttgtcatgcttcagctataatagcatacatgttttgagcatctactaagtaccaagtgctgttgttggtgctttacatrcattatctcatttaattcttaccataaccctgggagccgtgagagaatgagtactgttgttattcctgcattacagatgagaaaactgagacacagccag

SEQ ID NO: 55094 - DNA, 201 bp, Homo sapiens
agcaatgcacaatacaatgaggtatgcctgtatttccaattacgtgtgtttcaatcctatatgtgaagggaggagataaagagtatgagaattaaaaaagsagtaatctcatcaaattttttacaggatgtaatttcacacagtaaaaagctgaacaagaaaaaaggaggagaaatggaaatactgaataacaccgacaac

SEQ ID NO: 55095 - DNA, 201 bp, Homo sapiens
aacctaatttcaatatcattgtgtctcaggaaatagggggcccaagaagagaagagaaaaagggaagttggtgaagcagtcagaacagacacatttattgrttaagttctatgggcgtggtttgtggcaccccaaaacaattacaatagtaacatcgaagatcactgataggctgggcacggtggcttacgcctgtaatcc

SEQ ID NO: 55096 - DNA, 201 bp, Homo sapiens
tacgtcttagaatggcctttatgatgggctggtacagagggtggcttccagaacccctctgaaaaccaaagatcaagtattagaatttaataaagatcagrcccggtttggtggctcacccccataatcccagcactttgggaggcggaggcaagagaattgcttgagcccaggtgtttgaaaccagcctgggcaacatag

SEQ ID NO: 55097 - DNA, 201 bp, Homo sapiens
gtcaaaaatctgaaaaaagttttaggaaaagcaactttcttgccacttactctgggacagtgaactaatgttaagtggcaggggaggtgttctagaacagygactttcaaatatgagtcgcatgccattagggtcatgaaatcaatttagtgtgtcacaatgagcaacctttaaaagtggaatagaataaaagcaaataga

SEQ ID NO: 55098 - DNA, 201 bp, Homo sapiens
tacaaggcttgggtgaaccaactagaaacacagactggagaggccaggtaatagaatcaggaaggtgttggtcttctgttatgttttatgatatttttacrtgtgtatttattgatactcttaaactttgttaggcgaactgtacaaagtcagttatcaatccaaaatgttacctccctttaacatatccatgcaaattac

SEQ ID NO: 55099 - DNA, 201 bp, Homo sapiens
gcctctaatcagcgagaagaatatctacttctcaagctttttaaaactgctctggaggaagaaataaagtatgtatacaaatatgtatgtaaaaataccartgaatcaatccttttgttagtggtggctgtctttgatttactaaaattatttttaaattcttataagttattcccacatattaaaatatatcaagtttct

SEQ ID NO: 55100 - DNA, 201 bp, Homo sapiens
ttattttatatactcatctatatgcttttagtgacattaagtcattgaagagcagggaatcagatactgctttgtgctttaataatatattaacttattgwtttgtgggatttttttgttttctttttccttctttccttctagaccaaccctttatacttggctaagctgattttccagatgccacagaacaagtccact

SEQ ID NO: 55101 - DNA, 201 bp, Homo sapiens
agcttcctatagtatgatatgaataatattaagtaattaatatttgatattaatattttaaaatattaatatatgataggaagctaaagtagaaagttatrtaatatcagtctataggaaactgtagtagaaagttacactatatactaatagcatagagatgagtacctggcatataaaaattattttatatactcatct

SEQ ID NO: 55102 - DNA, 201 bp, Homo sapiens
tgcaggcaattgtaacacaattgtaagtatttgtgtatctaaacatagctcaacatagaaaaaatacagtaaaaatatagtactataatcttataggactwatgtcttatatgaggtccactgttgactgaaacattatgttgtttgtggttatatatgttcatgacactttggtctagctaagttcatttggaatctaag

SEQ ID NO: 55103 - DNA, 201 bp, Homo sapiens
caggatcacactagaggtcagtggggtttttgggactgtcagctcccagaagagggaagacgcctacatacagtcaagagtcacttaatgacagggatacrttctcagaaatgtagcattaggtgatttcatcctgatgcaaacatcatagagcacttacctaaacatagatggtggagtctactacacatctaggctata

SEQ ID NO: 55104 - DNA, 201 bp, Homo sapiens
tgaacctgatggacatcaagattggactgctggtgaagaacaggatcacactagaggtcagtggggtttttgggactgtcagctcccagaagagggaagaygcctacatacagtcaagagtcacttaatgacagggatacattctcagaaatgtagcattaggtgatttcatcctgatgcaaacatcatagagcacttacc

SEQ ID NO: 55105 - DNA, 201 bp, Homo sapiens
ggtttatgcagttgttttggtgttagttttcttactcctttagtgtcaaaacaccacagaactaaggtggaagtaaaaggaagactgtcaagggcctaggygtaaaggagggcaactaatgagatggccatggctggactagctcttccaagtcatctttctattactgggtctaatcattcgtcctcaatggaccagaca

SEQ ID NO: 55106 - DNA, 201 bp, Homo sapiens
gttaagtcactggctcttacaggtgatgtgggcagcacgtagactgggtgttttcgagtcaagcgcataaaaggctgcaggttttctcctggccacccggrgcactgcagtaggacggcacctctcctgaaataaagctaatttaggctcacctcagctcccccatgggttgggatatgtgtgtgtctgctcttgctaagt

SEQ ID NO: 55107 - DNA, 201 bp, Homo sapiens
caataaagtttaacagaaaaccagtgccagccttatttgccaatatttgttaagtgttgatgatttttaagagctgtgacttttcaaatgattggaaattratatgcttctagctggcaaaccatagcagtcagtttctctaagccatgtttccattttaaagcttagacaaaagaatataatttaaaagtattcagagct

SEQ ID NO: 55108 - DNA, 201 bp, Homo sapiens
gatggaaaaggtgcaactcaatattcaggtaagctgctggaatttctgcacattgatgataaattttatatgtggatcatacattgctaccctggctctckctcttcaggacaacaataaagtttaacagaaaaccagtgccagccttatttgccaatatttgttaagtgttgatgatttttaagagctgtgacttttcaa

SEQ ID NO: 55109 - DNA, 201 bp, Homo sapiens
tgaagtacactgcagcaaagctgcatgagaaaggtgtcctgctagatatagatgatcttcaaacaaaccagtaagtgtgacctggaatctgcatagaacaygcatgccatttgatttcttgtggccttggagagagctccatttggtctagcaaggcttaacctcaattactgatgggtgacaagggaagaatacacaaat

SEQ ID NO: 55110 - DNA, 201 bp, Homo sapiens
agccagtgaagtacactgcagcaaagctgcatgagaaaggtgtcctgctagatatagatgatcttcaaacaaaccagtaagtgtgacctggaatctgcatrgaacacgcatgccatttgatttcttgtggccttggagagagctccatttggtctagcaaggcttaacctcaattactgatgggtgacaagggaagaatac

SEQ ID NO: 55111 - DNA, 201 bp, Homo sapiens
ttttccgatgggactgttaatacatatgaagagacacaacccttagtgggtgggagaggcagccatcaactctggccacagtgggagggctcatgttcccytaacttggctgcatggatgagcggtggtgcattgctaaggccttccctgaagtggtcatgtcagtggcagcatctttgctggaaatagaaggaaaataaa

SEQ ID NO: 55112 - DNA, 201 bp, Homo sapiens
ctgaaactaagatgtggtcagttgtaggagcagactataaagtggtctgatttcctgaaattaaaatacctgtaccacaaagtcattctcagatgaagatrgcaaaaagcctagtattgatagaggaaatattaaattcgagccataacaattagtaaagctaaaatactaatttagttttttccgatgggactgttaata

SEQ ID NO: 55113 - DNA, 201 bp, Homo sapiens
atgcccaggtaatttttctgtatttttttagtagagacggggtttcaccatgttggccgggctggtctcaaactcctgaccttaggtgatctgctcacctyggcctcccaaagtgctggaattacaggtgtgagccaccacacccggcccaagaaagatatttaattggacttacagttccatgtggctggggaagcctca

SEQ ID NO: 55114 - DNA, 201 bp, Homo sapiens
gagtttggtcttgttgcccaggctggagtgcaatggtgcgatctcagctaactgcaacctccccctcccgggttcaagcaattctcctgcctcagcctccygagtagctgggattacaggtgcctgccatcacacctggctaatttttcatatttttagtagagatggggtttcaccatgttggccaggctggtcacaaac

SEQ ID NO: 55115 - DNA, 201 bp, Homo sapiens
cacagaggaacacatggtgaaaggaaatgggccttcctattaaatggaagggatcagccacatggtataatttcttcttcaaagagagtggagttggcatwaatgctgatttttttttttcaatctaagcgagagtcaaaaatctaatgcaaaagagttagccagaaaataaccttatatttaaattgtttaatttgttag

SEQ ID NO: 55116 - DNA, 201 bp, Homo sapiens
tgacctgagtcccgtctcttaaacgttatgaaatctgtaaaatcatggagcacaatttcacctcagttccatgtgtcagcagcaaatggaagccttggtcygtctgtagaagtttgctctcctgtgccgtgcaggcaggaaacttgccctggtcctccgcagggaaaggatgtaatccactcgatgcttcagtaagcatga

SEQ ID NO: 55117 - DNA, 201 bp, Homo sapiens
cagctcacctctcagctggtagatatgttgttgtttttggggttttttgttggttttttttgtttgttttttgttttttgttttttttttttcttgagacrgagtctcgctctttcgcccaggcaggactgcagtggcgctatctcctgcctcagccttccaagtagctgggactacaggcgcccaccaccgcacccagct

SEQ ID NO: 55118 - DNA, 201 bp, Homo sapiens
ttttgagacaagagtcttgctctatcacccaggctggagtgcagtggcatgatctcagctcactgcaacctccgcctcctgggttcaagagattcttctgyctcagcctcccaagtagttgggaccaccaggcacgcaccaccatgcccaggtaatttttctgtatttttttagtagagacggggtttcaccatgttggcc

SEQ ID NO: 55119 - DNA, 201 bp, Homo sapiens
gtcctcactctgcctccagcctgcagaatctactgaataatgtctcattccactagattccagctcacctctcagctggtagatatgttgttgtttttggrgttttttgttggttttttttgtttgttttttgttttttgttttttttttttcttgagacggagtctcgctctttcgcccaggcaggactgcagtggcgct

SEQ ID NO: 55120 - DNA, 201 bp, Homo sapiens
ttggtcacttcagaggctgctctaagaacagaggatacccattgtttccagtagattttgatcatctcaggccccaggttctaaaccagtacacagaggarcacatggtgaaaggaaatgggccttcctattaaatggaagggatcagccacatggtataatttcttcttcaaagagagtggagttggcataaatgctgat

SEQ ID NO: 55121 - DNA, 201 bp, Homo sapiens
gaaaaataaatgttgaatacaccacattgaaatactgtcagttctaagtagtgtcagttcttaaatactgacagttcttaaatgttctaaattcaaaaatratggagtaggtgggactctgggagatcaagacttgtcttaatcttttgcagaataatgaaattgtgaaaatacagtcactgttgagagcgaacaaagcta

SEQ ID NO: 55122 - DNA, 201 bp, Homo sapiens
gtaaacagacagaattcgattgactgagaaacaaactgggagaagatcacagcccacaaaacgctgggggttgcagcagaggtaggagctgtcgtgaggtktgctccaagcaaaggggacagcaaggaaaagaagagcctcaaagtgagcaatcgtcagcctaggaccagcagaactatatggcccttccctaaagcagca

SEQ ID NO: 55123 - DNA, 201 bp, Homo sapiens
tgactcttttaggctttttagattaaataaatgttgcgttctccaaggagaaagtgaagataaagagtcctaagtgcaaatactttcctcatgagaggaaytgagagaactttatcctttgtggggtgaatactacagagttcatataccatgagttagagtttgattgaatgctttatgccagggtggagcgacagtatt

SEQ ID NO: 55124 - DNA, 201 bp, Homo sapiens
aaaaagtcagactaagtagtgaaccttgggacccaaggaatgacatagtggtgagttctttgagttttctttttgtttatatttttctgacctggagctgragaggctggccacccagaaatgccaatgggtacaggctctgatatggtttggctctgtgtccccacccgaatctcatcttgaattgaacttccataattc

SEQ ID NO: 55125 - DNA, 201 bp, Homo sapiens
agactctagagaaatattttacagcattacatatgtagttttttcaactgttaactgcttactttaaatagaagcccctgggagggatttcttcctgaatmtttaaagaagagatatgggaacatagattggatcatctaagttgtgtgctaaaattattttccctttttagatctctttgtctaggcagttcccctacag

SEQ ID NO: 55126 - DNA, 201 bp, Homo sapiens
ccgcagagcttccttgggtcttttccccactcgcagcccaatgatgataaatgcccagcaggacagtggcatatcagactgaagtccatcagtccctaagyaggtttatgacagcaatctcctctttaaaccgtgggtgtgtggccacttagggtatattgtctctaaaatcacattgactcttttaggctttttagatta

SEQ ID NO: 55127 - DNA, 201 bp, Homo sapiens
ttagacttcaccagtcaggactcgatagaaaatgggtgaggggaaaactgtgggctagtaacaccaaagagaagactctagagaaatattttacagcattrcatatgtagttttttcaactgttaactgcttactttaaatagaagcccctgggagggatttcttcctgaatctttaaagaagagatatgggaacatagat

SEQ ID NO: 55128 - DNA, 201 bp, Homo sapiens
gggacgcaatgtgaatcaaatagagaagccttcctgacttcaggatgttagggatacacattttttgagggcggagactctcattgttcatttttttttttcctgtccagcaggttctcggtgtggtggttaaaatgacttccagcttgggccccagacatttctttggaagaatcttgctttaaaacctaaatttaagct

SEQ ID NO: 55129 - DNA, 201 bp, Homo sapiens
tgattctctaacctaccatcttggatagggctggatgttaagtcactggctcttacaggtgatgtgggcagcacgtagactgggtgttttcgagtcaagcrcataaaaggctgcaggttttctcctggccacccggggcactgcagtaggacggcacctctcctgaaataaagctaatttaggctcacctcagctccccca

SEQ ID NO: 55130 - DNA, 201 bp, Homo sapiens; identical to SEQ ID NO: 15967

SEQ ID NO: 55131 - DNA, 201 bp, Homo sapiens
acctcagcctctgcttctgatagcctcttgctttgttcctgaagttaaataaccaaaatatatgcttataaagtggtgatgaaaaattacttcttggtcartaggtgtctctgatggcagcaaatccatgttgcatttgtctttttctcttaataaaggacttgatggactgtgacaagattggccacctattttagagtc

SEQ ID NO: 55132 - DNA, 201 bp, Homo sapiens
ccatttttaatcaaactattttctcttctcctaaaatgcccagaacgttaaatgctgtttccttctaggaactggctgtaatacataattcatatttctgsattgtgatttagcaactactaactagaggctggatgataaaccgattaataaaaaacgaatttaaacagaattgttttgtataaggcaacatcaaattca

SEQ ID NO: 55133 - DNA, 201 bp, Homo sapiens
gcataggtgtgcttgggcaggccccggtaggtgaaaggatggacgatggccaggtagcggttgatgctgatgcaggcaaggagcagaatggagcagtacaygttgccatagaagatgactgtggtggcccggcacaggacctctccaaatacccagttgttcccattgagatgataagctatcttaaagggcaatgtaaca

SEQ ID NO: 55134 - DNA, 201 bp, Homo sapiens
tgcttatgaatatctgtgccacttagaggaagccaaaaggtaagatccagacttagtctatttgtgcaccatctcttggagataagctttgtgataagggygtgggatttgatgaccagagggttctgaaatgggccagcaattctaaagagttgtcgtagttggagatggccagggagagattcttgcctgcactcagtg

SEQ ID NO: 55135 - DNA, 201 bp, Homo sapiens
tcatgtaagaaaaatgcctgtgggattttatccaggttgataatgacctaaatgaatgctttattgaaagttagcattgaatgatttttattgaatggtgracatgaacacttaagaaataatggatcttagaacttcatatgataatatttggaggcttactgttttcattcagaaatcatgttgagagttagacttcac

SEQ ID NO: 55136 - DNA, 201 bp, Homo sapiens
cacttctctcttattaaggtggtgaaatttagagtaacatgtaaagcgttttgaaccccttaagaaacctcagtgaaagatgaagagtaggctttagagaytgattattcagtgggctgctttttttctttatcaagtatcattgtttttagaaaaactacacaaaaccgtattacgggttgtttggtgattactttgact

SEQ ID NO: 55137 - DNA, 201 bp, Homo sapiens
atattcaattattttacatattaaagaaactacactaatgtttaagggttcactgtgtctgtgtagaatttaacaaacttttttctttagtgtctagtgayggttcatggctcaaactcaacctgcacaaaaaatatgactactattacaacactgattcaaaagagagttcctgggtcacacctgaatcatgcttgtata

SEQ ID NO: 55138 - DNA, 201 bp, Homo sapiens
ggtaaaatagtacaaagttaaattattttccccacttctctcttattaaggtggtgaaatttagagtaacatgtaaagcgttttgaaccccttaagaaacmtcagtgaaagatgaagagtaggctttagagattgattattcagtgggctgctttttttctttatcaagtatcattgtttttagaaaaactacacaaaacc

SEQ ID NO: 55139 - DNA, 201 bp, Homo sapiens
aaacgcttcacccttctggcttttatttactgagtttaaggtaaaatagtacaaagttaaattattttccccacttctctcttattaaggtggtgaaattwagagtaacatgtaaagcgttttgaaccccttaagaaacctcagtgaaagatgaagagtaggctttagagattgattattcagtgggctgctttttttctt

SEQ ID NO: 55140 - DNA, 201 bp, Homo sapiens
ggaacatatgcctattctgtcaaaaaccattggtagcaattggtccctcatgagacctcttcgatgttttcctgtaaaaacttaaaggatattggatgcayttaaagggatgttagaagaaaccctagacttagtttacttgatttcctgactcattgcaactctcagcaaaacgcttcacccttctggcttttatttact

SEQ ID NO: 55141 - DNA, 201 bp, Homo sapiens
caaggaatggatatgtacaaggaagtcccatgagggtacacattttttatacttattaccctgtgtctggtgctttgactcacatgtggcacatagaaccyacgaattgaacattagttgagtaaagtccacagaatggtgctatctttgctccattaatgatcatactcttattgagtgtaaataaataaaattacctca

SEQ ID NO: 55142 - DNA, 201 bp, Homo sapiens
aactagtctcagctgtgagctgatgtgctctgctgtgtttaactggctacccccagagagggtgtccagatgagatctgaagggagggtgcctgacagtgycccagctccatgcggcctgagatgtgctctgctcttgcacttcctagataaattgggaaacttgctggtaaataattctataacccactcttttccttag

SEQ ID NO: 55143 - DNA, 201 bp, Homo sapiens
attatgaaaggtgttctctcccattcaaggaaggtgaggccaaagtgtgtgtagttagaaagtcagtgggccaggcagaaggtcagaaggcaaggaatggrtatgtacaaggaagtcccatgagggtacacattttttatacttattaccctgtgtctggtgctttgactcacatgtggcacatagaacccacgaattgaa

SEQ ID NO: 55144 - DNA, 201 bp, Homo sapiens
cttcttctaaagatactagtttgtgtccagtttttgtaaagagtttcctgtaaaaattattcttaatggtgataatcaggtaaagctatgttgatgaagcrttgtttaactttatgtggggatatatgaaatgatggtcagttgcagcaccagtgttttcagggatccaagggattcagggccacaagttggtagagcatc

SEQ ID NO: 55145 - DNA, 201 bp, Homo sapiens
tgacagtagattatgaaaggtgttctctcccattcaaggaaggtgaggccaaagtgtgtgtagttagaaagtcagtgggccaggcagaaggtcagaaggcraggaatggatatgtacaaggaagtcccatgagggtacacattttttatacttattaccctgtgtctggtgctttgactcacatgtggcacatagaaccca

SEQ ID NO: 55146 - DNA, 201 bp, Homo sapiens
aggtaaatatatacagacatgaaaagaagtttataaaaaaatttgattttttatatttgccctttttaacaaggaacttttacttcctaatttgaaaaacrgtatcagaattggggtgagttacaaagatgtttcaataaaaagatgctcataaatgaattggaataaactgtaacagttatgaatttacttcttctaaag

SEQ ID NO: 55147 - DNA, 201 bp, Homo sapiens
agtgaattattttattagctccatgatggatctttaaatgacagtgttattatccatgccagtggttcttatcaaaagccactacttagtaaatattgagwaatgcagaaatatttgcaggcagtctctgtggcccagaaggacttgcttttgctgttaagattttctcaaattccctaaccttcctagacttacaatttg

SEQ ID NO: 55148 - DNA, 201 bp, Homo sapiens
acagggtcttgatttgtcacccaggctggaatacagtggcgcgatcatagtttgctgcagcctccacttcatgggctcaagtaatcctgcctcagccttcygagtagctgagactataggcttgcaccaccacactcagccaattttttgtatttttttgtagagatggggcttcaccatgttgcccatgctagtctcaaa

SEQ ID NO: 55149 - DNA, 201 bp, Homo sapiens
agcgcatgagtccagggaacagtgtgagagagagctgataaaagggataaaaggggagttgataactagaaaagagtggggccagatatctgttttgtgcrtttatttattgatcagtttccttgtccagattttaaattgtgtgggggtgggtagaatgattctcaccctagaccaagtactttcattggtatatttttc

SEQ ID NO: 55150 - DNA, 201 bp, Homo sapiens
ttcatttctttcttagttcagcatctttagaaaactaaggctttgggattttctaatttaaaaaaaaataacttttctaagtttgttatcatctgttctcmcccttttattctggaatgtcactgaacgcattccagcttgaaagatgctgaaactaagatgtggtcagttgtaggagcagactataaagtggtctgattt

SEQ ID NO: 55151 - DNA, 201 bp, Homo sapiens
aagttggtttgttactttagcacaaactaagtattttaaatatcatttctgtggtattatattttcttaattttaagacaagtaatgctttcaaattaacrtttctgtaattttttgtcatctatggctaaggaaattaggaaaagttttagatgtttctttttagttttagaaagctatgatgagctcagtggcaatata

SEQ ID NO: 55152 - DNA, 201 bp, Homo sapiens
ataatgccaggtgtttgctaattgcacagagcagctgaatgtttttaaattgcttcatggttttaaaaaattattgacacaactggcaaaatttggcagcygtctattatccattagcataagtattataggtttttatatacagtatagccatttttaatgaatatcctttgcttagtaattattcttatcactagacta

SEQ ID NO: 55153 - DNA, 201 bp, Homo sapiens
ggaggccaaggcaggtggatcacctgagatcaggagttcgagaccagcctggccaacatggtgaaaccccgtctctactaaaaatacaaaaagtagccccrggcatgtggtggtgcacacctgtagtcccagctactcaggaagctgaggcaggagaatcgcttgaacctgggaggtggaggttgcagtgaaccaagatca

SEQ ID NO: 55154 - DNA, 201 bp, Homo sapiens
tgcttataataaacagcctctaattagagaagagattacaatgtcatggctatgcacaagagttctgttgttaggacataataggaaaagctcatctcaawggaactaaaacttacagactaaaaaaagaaaaacagaattttggcaaatgaaatatgaggcatgtagtattctgcttctatggaacaaaaaaattctttt

SEQ ID NO: 55155 - DNA, 201 bp, Homo sapiens
gaaacatacacgttataaactgggaacagtggctcacgcctgtaatcccagcactttgggaggccaaggcgggtagatcatttgaggtcagaagttgggascagcctggccaacatggtgaaactctatctctctgaaaatacaaaaattagctgggcatggtggcatgtgcctgtaatccgagctactcaggaggctgag

SEQ ID NO: 55156 - DNA, 201 bp, Homo sapiens
tttgaaaattctctacttggaataagagattggagaacatcttcaaacatacgaacatcttcacacaagtggccaccacatggcggcacagaaggaaaagsttaacagtacttagaattgtctgtggaacccactgtttcacgccagcaaacctagaaagaaagggggctcactttaaacaggaaaggactttggtctgcc

SEQ ID NO: 55157 - DNA, 201 bp, Homo sapiens
tgtcatgcttcagctataatagcatacatgttttgagcatctactaagtaccaagtgctgttgttggtgctttacatacattatctcatttaattcttacmataaccctgggagccgtgagagaatgagtactgttgttattcctgcattacagatgagaaaactgagacacagccagtaaatgataaagcaggggttttg

SEQ ID NO: 55158 - DNA, 201 bp, Homo sapiens
gttttaccttttacaggtgagaacaatttatcgttcactctgagtttgggagtaatactatgttacatgtttgtggcttacagggagtattttgtcatgcktcagctataatagcatacatgttttgagcatctactaagtaccaagtgctgttgttggtgctttacatacattatctcatttaattcttaccataaccct

SEQ ID NO: 55159 - DNA, 201 bp, Homo sapiens
tgggattataggcataagccaccacacctggcctgtaaatcccatctgtctgtaattttcaaagtttctttatatcaactgtatacccatatttgcttatrataaacagcctctaattagagaagagattacaatgtcatggctatgcacaagagttctgttgttaggacataataggaaaagctcatctcaaaggaacta

SEQ ID NO: 55160 - DNA, 201 bp, Homo sapiens
accacacccagctcattttggtattttttatagagacagaatttcaccatgttggccaggctggtcttgaactcttggcctcgagtgatctgcctgcctcrgctttccaaagtgctgggattataggcataagccaccacacctggcctgtaaatcccatctgtctgtaattttcaaagtttctttatatcaactgtatac

SEQ ID NO: 55161 - DNA, 201 bp, Homo sapiens
ctttgtgttttcagcaagttgccttatgatgtgaccacagaacaagctctaacatacccagaagtgaaaaataaactggaggcttccattgagaacctgakaagggtcaccgacaaagtcctgaattctatcatttcttcccttgatctactgccgtaagttgtacttgcagcaagtttaacattctttcctggaacgttc

SEQ ID NO: 55162 - DNA, 201 bp, Homo sapiens
tgtggttacatgcgtatcattggtctttgttgattttctttttcttaagccagaacagatgcccaatagggaattattgagccagagaaaaattctcctayagcatgtgatggaagtggccacattttacctcttgctttatttccagaaatgaacacaggtgtctatatccatttaatacacccctttttggccgggtgt

SEQ ID NO: 55163 - DNA, 201 bp, Homo sapiens
ccagattttaaattgtgtgggggtgggtagaatgattctcaccctagaccaagtactttcattggtatatttttctagtaattatttaagaccttgtttcyttcctgttgataatcattccaagctttcctaattaaagtatacctgttcctgtcactgcagttggctctgaaaacccaccattaacagtaattcgcaaat

SEQ ID NO: 55164 - DNA, 201 bp, Homo sapiens; identical to SEQ ID NO: 16003

SEQ ID NO: 55165 - DNA, 201 bp, Homo sapiens; identical to SEQ ID NO: 16005

SEQ ID NO: 55166 - DNA, 201 bp, Homo sapiens
acccctgagaggccggagttcattctctttggattagttcttcaaggccttttcccggatagaaaaacatttccgaaatattatgcccaatggaagcctcyataaagaattaaaatacaataaaaaaatttaacaatgagtacaattcataaggaaaaccaggctctgaggaataaaagccttatttaagtggacccagat

SEQ ID NO: 55167 - DNA, 201 bp, Homo sapiens
tttcttctcataactccccctaggccatctcaaccactcccattaaattaaacgagagcctccatgcagactacaataaatcatgcctctaatttgggctyctggaattttggacccacatccagtcttctaaccagttgctggacattttacacactaatattccaccagcaactcatcctcagtcagactaaaaacaga

SEQ ID NO: 55168 - DNA, 201 bp, Homo sapiens
cacatgacttcaggcacataaccaaatccaaaaaggcaagtttcaagagcaaaggaggtgagggcttacattgttttgctctgtcctcgtccacgttggcmtcatcgacggcttgctgtatctcatccagccaaagcactttggaaacactctcagagtcctggggacaatgtcacagaataaaaagaaagaagagtgaat

SEQ ID NO: 55169 - DNA, 201 bp, Homo sapiens
caagtcaaaataacggctatattcgtttcctactgctgctatatcaaatcattacaaactgagtggcttaaaataacagattatatttctggagatcagasgtcttaaaatcaaggctgttggtggggttgtgttcattctcgaggctctaggagagaatcggctatcttgcttttttcagcttctagaatctgcctgcat

SEQ ID NO: 55170 - DNA, 201 bp, Homo sapiens
tcaacttatctggcattcccagatcccatgatagcccacactatgcttctgtccattcatcaccagcagaatcttactcattaaattccatctttttaggwaccttgctagtctttgctcaagttcatcttttccttgacattttgctcaaacatctgaatctattaagtattgtctgaatgcctgtatagtttgtagtca

SEQ ID NO: 55171 - DNA, 201 bp, Homo sapiens
ttgctagtctttgctcaagttcatcttttccttgacattttgctcaaacatctgaatctattaagtattgtctgaatgcctgtatagtttgtagtcaacaygcctataatgttctgatgggctgtttttgtttcttctaatagtattataaacactttacatacaaggactgatcatttagtttttgtttccgcacaagat

SEQ ID NO: 55172 - DNA, 201 bp, Homo sapiens
tcatgcttactgaagcatcgagtggattacatcctttccctgcggaggaccagggcaagtttcctgcctgcacggcacaggagagcaaacttctacagacrgaccaaggcttccatttgctgctgacacatggaactgaggtgaaattgtgctccatgattttacagatttcataacgtttaagagacgggactcaggtca

SEQ ID NO: 55173 - DNA, 201 bp, Homo sapiens
aacagctttttaaaatcaggctaataacttgtacggcatgctcttcaggcaccattctctaactttgtgcctatctttaaaggcacttctctttgggtgawgtcagatgcaagaacttttccaaaatgcaaaagtgagcagaagggtttgtgtgtcacacaacacagcttctaagatcacctctaaatacaggcatagaag

SEQ ID NO: 55174 - DNA, 201 bp, Homo sapiens
tcaggcacataaccaaatccaaaaaggcaagtttcaagagcaaaggaggtgagggcttacattgttttgctctgtcctcgtccacgttggcctcatcgacrgcttgctgtatctcatccagccaaagcactttggaaacactctcagagtcctggggacaatgtcacagaataaaaagaaagaagagtgaatgatgaggaa

SEQ ID NO: 55175 - DNA, 201 bp, Homo sapiens
tatcaaatcattacaaactgagtggcttaaaataacagattatatttctggagatcagaggtcttaaaatcaaggctgttggtggggttgtgttcattctsgaggctctaggagagaatcggctatcttgcttttttcagcttctagaatctgcctgcattccttgggttatgaccctttcttccatcttcaaagccagca

SEQ ID NO: 55176 - DNA, 201 bp, Homo sapiens
gaacccgggaggcggaggttgcagtgagctgagatcgtgccactgcactccagcctgggcgacagagtgagactgtctcaaaaaaaaaaaaaaaaaaaaargaagatccttaactaagttagatctgcaaaatcccttttgctaggtaaaggaatatacttgtaggttccaggaattagcaggtagaatctttgcgggggg

SEQ ID NO: 55177 - DNA, 201 bp, Homo sapiens
gttggctttttctcaccattcaggtctcaactcaaatgctacctactccaaaaagtcttcccgggctaccctagtcaaacactctctccctcaatcaattrttgtggttcccaaactaagtgtcaaggtgtcccagggtaccatgggatatttttaatttgagagaaacacagggatcgtcgatatttatcagacacagag

SEQ ID NO: 55178 - DNA, 201 bp, Homo sapiens
ggccgggcgcggtggctcacgcctgtaatcccagcactttgggtggccgaggcgggcagatcacgaggtcaggagatcgagaccatcctggctaacatggygaaaccctgtctctactaaaaaaatacaaaaaattagccaggcctggtggcgggcgcttgtagtcccagctactggggaggctgaggcaggagaatggcg

SEQ ID NO: 55179 - DNA, 201 bp, Homo sapiens
tgccacccagcctgtaaaatttaaaagaaacagatatactaaaacttactccgagtttctgtgatttagcatggtataaaacatcctggtagtgctgggcrtgggctgggtccacatcactaatattcgcagtaggtaggagcaaagtttctaaagtcctcaaaggattcccttcatcaatagcttcattgatgtacccta

SEQ ID NO: 55180 - DNA, 201 bp, Homo sapiens
ttggctttttctcaccattcaggtctcaactcaaatgctacctactccaaaaagtcttcccgggctaccctagtcaaacactctctccctcaatcaattaytgtggttcccaaactaagtgtcaaggtgtcccagggtaccatgggatatttttaatttgagagaaacacagggatcgtcgatatttatcagacacagaga

SEQ ID NO: 55181 - DNA, 201 bp, Homo sapiens
ccagcctgtaaaatttaaaagaaacagatatactaaaacttactccgagtttctgtgatttagcatggtataaaacatcctggtagtgctgggcatgggcwgggtccacatcactaatattcgcagtaggtaggagcaaagtttctaaagtcctcaaaggattcccttcatcaatagcttcattgatgtaccctacagcta

SEQ ID NO: 55182 - DNA, 201 bp, Homo sapiens; identical to SEQ ID NO: 16004

SEQ ID NO: 55183 - DNA, 201 bp, Homo sapiens
catctatagttcattcactctattcaaacctggtcatagactaagtgttccctcctgatgtttaaaaatgtgtggcatattcaagattttagatgtctacrattaagtcagggagcaattttgaaagtcgtttttgtgtttgtaagaatttctcttctggttaagcaaagatggcactttttctagggattaaaatatata

SEQ ID NO: 55184 - DNA, 201 bp, Homo sapiens
taatgcaggagaaaagatatcacaactctatggaaaatgacatttccatttgccttattgctacttcaagctctttaaatcaccatcttccctatttctgygagtggtattgccatccttgacatttgacatcattttttattctttggtctcttttgactctcatgctggtggctgcctcatcaactgattctatctttg

SEQ ID NO: 55185 - DNA, 201 bp, Homo sapiens; identical to SEQ ID NO: 16008

SEQ ID NO: 55186 - DNA, 201 bp, Homo sapiens
aatggaaaagagggatgaggaaggggctttactggctcaactagaaacagaaactatgaatccatgactgtattctctcccttggacacccctgagaggcyggagttcattctctttggattagttcttcaaggccttttcccggatagaaaaacatttccgaaatattatgcccaatggaagcctctataaagaattaaa

SEQ ID NO: 55187 - DNA, 201 bp, Homo sapiens
ctagtggtgcagctactcaattctttttttaattataatttttattttaagttccagggtacatgtgcaggatgtgcaggttacataggtaaacatgtggycatggtggtttgctgtacctatcaactcatcaggtattaagcccggcatgcgttagctatttttcctaatgctgtcccgcccccccacccaacgggcccc

SEQ ID NO: 55188 - DNA, 201 bp, Homo sapiens
gtttttgttttttgttttgtagttgatattcactgatggactccaaagaatcattaactcctggtagagaagaaaaccccagcagtgtgcttgctcaggaraggggagatgtgatggacttctataaaaccctaagaggaggagctactgtgaaggtttctgcgtcttcaccctcactggctgtcgcttctcaatcagact

SEQ ID NO: 55189 - DNA, 201 bp, Homo sapiens
tgttaaatatttgtcttaatatcaagcttttgcatatcggggccctcttttataagctttataagcaatcttttgttttctctgcttgctcaaagtagctrtgtttgttgtatctgttagtatttgctctataacaaacatactgggtgccttcccacttagatttggcaattatcactcctgtaaatgagatattacata

SEQ ID NO: 55190 - DNA, 201 bp, Homo sapiens
gcctagagtctggcaaggtgatgtgttgaatctagtgtctgcctgcatgccagcatccctttactgatgagatttgtggttttcatcacttcatggtaatyatcccaagttataagatggagtctctagaaaatcagtagagtatgaaggcccaagtaaaatacatgtgagtgcatgtatgtgtgcatacaaattacttct

SEQ ID NO: 55191 - DNA, 201 bp, Homo sapiens
ccccaacttttatgttaaaagttgcaacaaggtttaagggcttatgtttgataggccagatggtgaccagctgtgataaaacacagggaacccttgcaaargatttcaaaatttatgcagtagtccgccttatctgcagttttgctttccaaggtttcagttacccgcagtcaactgtgttctgaaaatattaagtgaaaa

SEQ ID NO: 55192 - DNA, 201 bp, Homo sapiens; identical to SEQ ID NO: 16017

SEQ ID NO: 55193 - DNA, 201 bp, Homo sapiens
tcagatagggattgcattgaacctgtagatcagtttggggaatattgccatcataacaattagtaggtcttccaacccatgaatacaagacttctttccayttctgtagatatttagtttctttcattaatattttgtagttttcaatataaaagtcttgtacttcgattaaatttattcttgaatattttgggttttgat

SEQ ID NO: 55194 - DNA, 201 bp, Homo sapiens; identical to SEQ ID NO: 16018

SEQ ID NO: 55195 - DNA, 201 bp, Homo sapiens
tattctttgaagattgtgggcaccctgaagtctctgtttgttagtttagtggtcacctaataattaacagagatttcattaaatgcctagaagcaaaataycttccagtctttgcccatggcctctgtgtatgcattagggcaggccttgaactcttacccagggagtttacaaccctgccttagcctttactaccagctt

SEQ ID NO: 55196 - DNA, 201 bp, Homo sapiens
caggggttatagaggtagctcagagagttgggtgcaagtagagaaatccacccggcttgcattacacatcttatttctagagaagctttcctttgaagaargagttctaaggtttaaaaaattaccttgaatgccacttatattgcattttaattttattttagagaaatcaatggaaagtagaaaaattaaggcactgat

SEQ ID NO: 55197 - DNA, 201 bp, Homo sapiens
gaattctttttaaatgtttgtagaattatttttcacttattaggtaaaacgtgtattttttgattttctccaatttcagctttctcatgttgctatgctcmattttgtataccatatatagttttgttaaattgacaaagtggtgttttttgttcttctttttcccattggttaaaatttaaagagaaagtggaagctaga

SEQ ID NO: 55198 - DNA, 201 bp, Homo sapiens
cgcaaaacatctgatggtttaaatatggcagtttcccctgtgctttctctctctcctgccaccatgtaagactttccttgcttcctctttgccttctgccrtgattgtatgtttcttgaggcctccccagctatgcagaactatgagtaaattaaacctcccttataaattacccagtctcagatattctttatagtagtg

SEQ ID NO: 55199 - DNA, 201 bp, Homo sapiens
cctcacagtgcttgcctttcattcaggtgccaggaaacgtctgcctgaatgaatgggtgtaatttacctgcacattttacatgcttctctaggtgtgtgawtaactcataatccatccatgactttcacccataatcctccttgtagcaattgctttgcttgcaacaaaactaagtagacatatctagctttatgcatggt

SEQ ID NO: 55200 - DNA, 201 bp, Homo sapiens
aaaatatttctcccatcttaatagttttagaaagtaaaaatacttcttgaataaactgtgtagcgcagaccttcccattacagttcatttctatgtatttktttaaatacccacagctcgaaaaacaaagaaaaaaataaaaggaattcagcaggccactacaggagtctcacaagaaacctctgaaaatcctggtaacaa

SEQ ID NO: 55201 - DNA, 201 bp, Homo sapiens
ttgtttaaatacccacagctcgaaaaacaaagaaaaaaataaaaggaattcagcaggccactacaggagtctcacaagaaacctctgaaaatcctggtaasaaaacaatagttcctgcaacgttaccacaactcacccctaccctggtgtcactgttggaggttattgaacctgaagtgttatatgcaggatatgatagct

SEQ ID NO: 55202 - DNA, 201 bp, Homo sapiens
cagttgaggtcaggagttcgagaccagcctggccagcatagcaaaaccccatctctactaaaattacaaaaattagccgggcatggtggtatgaatctgtmttcctagctacttgggaggctggcactgagaatcacttgaacccgggaggcggaggttgcagtgagccgagatggcaccattgcactccagcctgggtga

SEQ ID NO: 55203 - DNA, 201 bp, Homo sapiens
ctgttgataagaatctgtgtagacttttttctccttccttcctttgatctttgatcatgggaagacatggaaaaagaaagctaactacagtgattttgtcyactacactgttatttggttaaaaattttagtttcctaatgagtattagcatgtatgagaaattatgggagaaaaaggcgcatcctagaaaaggtgtgctt

SEQ ID NO: 55204 - DNA, 201 bp, Homo sapiens
aatagacaaatacagagaaacagccaagatcagcttactgggaaaagatgccactgaagccaggaagactatggcaatttgggaaaagatgccactgaagycaggaagactatggcaattttgatgaattgctggaggctgagtgaggactagcttcagagttaaaaactcccagggacccagtcttagtgggggtttcct

SEQ ID NO: 55205 - DNA, 201 bp, Homo sapiens
acagtgagaccctatctatctcaaaaaaaaaaaaaaaagaaaagaaaagaaaaagaaaatcctttaactgacttcatcttaaccttttagttcctaaggayggtctgaagagccaagagctatttgatgaaattagaatgacctacatcaaagagctaggaaaagccattgtcaagagggaaggaaactccagccagaact

SEQ ID NO: 55206 - DNA, 201 bp, Homo sapiens
aaaatgcggaagtgactttggaactgggtaacaggcagtggttagaacagtttggagggctcagaagaaaactggaagatataggaaagtttggaacgtcstagagacttgttttgaatacttttgaccaaaatgctgatagtgacgtggacaatgaagtccaggctgaaatggtcccagagatgaggaacttattgggaa

SEQ ID NO: 55207 - DNA, 201 bp, Homo sapiens
aatagtgccaagtaatggtgaggttatacctgtattctgattataatctcataaatatttaccatgttagctgtctcagagttcttttgcaaaacagatamagatagaaagtataaataagaaaaataagtgaacatatactgaactttgtacaagatgctggcgatatggagagacccaagacatgggccctacctaaaa

SEQ ID NO: 55208 - DNA, 201 bp, Homo sapiens
caattactgatgtttataagtagatttattacaccaaagcacctagcaaattcttgaatggatcaggtcttatttttcagtcttactttgcaaatttaagycaaataattaaggatttgttaaatatttgtcttaatatcaagcttttgcatatcggggccctcttttataagctttataagcaatcttttgttttctctg

SEQ ID NO: 55209 - DNA, 201 bp, Homo sapiens
ttcacattgacctttccaaggttatcagtgacctgcttgtccttaaattcagtgggcactttccagtaacctactgttggcaccagccctgtgctagacamcaggatcctgtttgtaaaggcatctgccagtggtttctgtgacacaattctgtttctagttttcctccttctacttctctagcctcttggcaagttcttc

SEQ ID NO: 55210 - DNA, 201 bp, Homo sapiens
ggctccctgatgaaccacctgccacggcccgtatgaccgcatccaggggtgatgatgtcattttcacagggttattgagagctaaaactacgaagtactayaaactattatttaaaatataaatacatactatatatgcatatgtgtgtatatataattaatggggtaaacattacagaatactgtcctaacctttaaaca

SEQ ID NO: 55211 - DNA, 201 bp, Homo sapiens
gtcagagatgttgactagagttaatgcctcttttaggagaggtaccaggtaagtgttctcaaagaactggaaactgagaccaccacctctggcattatctrtttgtgaacacaagcaagtctgaatttttccgcaccatagctacctttcatgtaagcttcttttcttagaagaaaagaaggtaacatttgggtgtaattt

SEQ ID NO: 55212 - DNA, 201 bp, Homo sapiens
gagagaaaaattattcagatgttttcctttgtcaataatacaaggagcatttgtagggaaaaatatttacaaatacagtaagacctattctctttctatayttatgggaaaattttaagttgtgcccttgtttcatgtgtgtttctatttaaagataccatacttaatatatattgttgattcattaacattgaactcatg

SEQ ID NO: 55213 - DNA, 201 bp, Homo sapiens
tttccattatatgcaaagcccatgaaaggctaaatatcagttaagaggggagaggagggtggctcctaggtcctctaatgggcaggaaagtatttaaaacracaatacaaaaagatctagaataaaatagaaaagtacaagttgatgtctgggagtttggtcagggagcataaggtaacactataagaaagtgctatcata

SEQ ID NO: 55214 - DNA, 201 bp, Homo sapiens
tctttctatatttatgggaaaattttaagttgtgcccttgtttcatgtgtgtttctatttaaagataccatacttaatatatattgttgattcattaacaytgaactcatggctaacagcactataaatcatgtctgatcaaaacttatgatacatgtactttcttcgtaaggtacatcatagtcttctcgtacatgggaa

SEQ ID NO: 55215 - DNA, 201 bp, Homo sapiens
tcacacaaatgatacttatcccttggtgtttgatctaaatttctacaatgagaatgtgattttatagtctttactggggaaggaagtaggtttttcaggcygaaattcttgtgtagcaaaaattaacacttaagttagcccttggcaatctccagttctataatggtaaaatggatttcccagaaagtcactctctatccc

SEQ ID NO: 55216 - DNA, 201 bp, Homo sapiens
ccaagctggtctggaactcctgacctcaggtgatccacccgccttggcctcccaaagtgatgggattacaggcgtgagctaccgcgcccagtcagcatcattttttttttctcatcaacgttaaaacaatgttgaacaaaacattattcaaagacctgccgtatggctattttctagttgtgtgactttctttgggaaagt

SEQ ID NO: 55217 - DNA, 201 bp, Homo sapiens
ttctgagcttaaatgtcctcattcataaaatggggctagtaataatgcataaggtttttgtaagaattagaattaataaagtacttagaccataataactmattagtattagttgttgtctttgctattattttgatgtggtggttgtttggtttcacctgtgtactatcaggacatgctgaaataaaatttaagaattgg

SEQ ID NO: 55218 - DNA, 201 bp, Homo sapiens
aagtaaccagaaggaaagaaattttaattcttaaaatgtaatagtttcttggtttttttttttctgtgaaacacctgcatggcacctttttgttattcatmctgttttgactgtggctgtcgtagattcttgttgaaagtctgagagactgagacttgtcattttgaacatggcatcagtggaacagcttatgattcaata

SEQ ID NO: 55219 - DNA, 201 bp, Homo sapiens
ttgcttccaggccacaaacttacagcatgttactgtactgaacactgcaggcacctctaatacatcggtaagtatttatgtatctaaacatagaaaaggtmcaataaaaatacaatataaaagaggaaaaaaatagtacacctgtataggtgcttactgtgaatagggcttccaggattggaagttgctgtgagtcattga

SEQ ID NO: 55220 - DNA, 201 bp, Homo sapiens
acttcagttttgtagacatttttcctaaggccaattatgaaatatcctttcacctagtcatgtgtatataaaatcaccatgttattacagaatttagtaayactgtttttaaaaagtatgattaatccattaaattagaataatgcacccttcatatattatggtactacagtgattcatgaaataattctatataattct

SEQ ID NO: 55221 - DNA, 201 bp, Homo sapiens; identical to SEQ ID NO: 16024

SEQ ID NO: 55222 - DNA, 201 bp, Homo sapiens
tctgctttttggacatttgtgtattttctttgaagaaatgtctttaacattctttgcccattttaaaattaggttgtctttttattgttgagttgtcggtktgtgtgtgtgtgtgtgtgtgtgtgtgtgtgtatctagaatatatgtgtatgtatatatgcagatatattctaaacactagacccttatgaaatatataat

SEQ ID NO: 55223 - DNA, 201 bp, Homo sapiens
taggtacaagtaagtttatgattattatatcttcttgatagattgattcttttatcattatacagtgccctataagaacaatttttatcttaagtctattkgtctatattagtatagccacttcagctttcttttgtttactgtttgcatggaatattttcttcttttactttctatttgtgttcttgagtctaaggtgaa

SEQ ID NO: 55224 - DNA, 201 bp, Homo sapiens
tttgctgctatactttgttaacatattttaggaatatttcattttagtcacaactaggatataaacattattttggtggcgatctccttgtaatcacgacrtcaaccaaatttgggaaattttgatttgttagatttataaattttacagtaacacaaaagtctaatttcctatatattttcaaggcccctatacctttgt

SEQ ID NO: 55225 - DNA, 201 bp, Homo sapiens
gcagattaatattataaatttgaatgtacaaaggaagctttagcagtaaaatagcaacttttatctgtcttacgtattggaggttctgcataagatttaattttttttttttttgaaatggagttttgctcttgttcacggggctggagtgcaatggtgtgatctcggctcaccacaacctctgcctcccgggtttaagtg

SEQ ID NO: 55226 - DNA, 201 bp, Homo sapiens
gaggcaggagaatcacttgaacccgggaggcagaggttgcagtgagccgagatcacaccactgtactccagcttggcgacagagcaagactccgtcttggaaaaaaaaaaaaaaaaagaaacctgaaactagttataagttagagtttcatatccctgtttatataacaagttgtataattaacactgatctcagcattaa

SEQ ID NO: 55227 - DNA, 201 bp, Homo sapiens
atccaaaagtctccttggggtaggattccctgtgattcatgggttgagaggtgtaacattagacacagtcccagtctagattttttttttaaagaattgtrgtccatcctatacacactgggtgccttaatactatatgtggcaattatcactcctataaatcaggttttacataagataggaaaaagaacagtatcattc

SEQ ID NO: 55228 - DNA, 201 bp, Homo sapiens
tccatgtactagttacattataataaagccaaaagcagcaggcctacctgactttctcctgaggtctatcatgagcttagagagaaggaacgtggacatayagaggtagctctagatggagaagggcactaggtgtcatggaaagaatcatgtgcaagaagtaaagaggtgctctgaatgtcctagccctgcttaggtgtc

SEQ ID NO: 55229 - DNA, 201 bp, Homo sapiens; identical to SEQ ID NO: 16015

SEQ ID NO: 55230 - DNA, 201 bp, Homo sapiens
taggccagataattttttcaaaatagaggacaacaaacatgagatgttcccactgaccaatttggaagcctgatcattaccatatcttctcttgcaggtgrttgaaaatctccttaactattgcttccaaacatttttggataagaccatgagtattgaattccccgagatgttagctgaaatcatcaccaatcagatacc

SEQ ID NO: 55231 - DNA, 201 bp, Homo sapiens
gagtacaaaaagaaattgaaacagctggtacagatatttggcattggagagcagctctgaacaaaggtgaattatagtctagtggtcaattttgtggcctrttctttacaaagaattgaacctgatacagttaaccatctaccccaaactattatttgtttaaaacacaatctattggctgggcgtggtggctcatgcctg

SEQ ID NO: 55232 - DNA, 201 bp, Homo sapiens
gcaccaacaaggcagtcactaggtataaaatgaataaaatagtgcctgtattcaagtagtttatctgctagttaggttgcagagtcagtcacaaaatagcrtggcacaccatagagggcatagggccacaggaacaagaggaaggtcacctaattctgtcttggaagtcaaggaagaagtaacattgaattttaaatctat

SEQ ID NO: 55233 - DNA, 201 bp, Homo sapiens
ccacaaacttacagcatgttactgtactgaacactgcaggcacctctaatacatcggtaagtatttatgtatctaaacatagaaaaggtacaataaaaatmcaatataaaagaggaaaaaaatagtacacctgtataggtgcttactgtgaatagggcttccaggattggaagttgctgtgagtcattgagtagtgagtga

SEQ ID NO: 55234 - DNA, 201 bp, Homo sapiens
gaccaggctatttaaacttaactgcagagtgtcagcatgttaaacattgatttacataaaatgatagctgcccactttcttgtaaatgttataaaaactgyagagattaactaaaaaatgcacacagaagtttgctttcagttccacaagggtagtttatttttgttataaaaacagtattccccactttcttagatacca

SEQ ID NO: 55235 - DNA, 201 bp, Homo sapiens
aggttgattctatgtctttgctattgtgagtagtactgcagtgaacatacacatgcatgcgtctttatggtagaatcatttatattcctctgggtatatacccagtgatgggattgctgggtcgaatggtagttctgttttaagttctttgagaaatcatcaaactgctttccacaatggctggattaatttacacttcca

SEQ ID NO: 55236 - DNA, 201 bp, Homo sapiens; identical to SEQ ID NO: 16020

SEQ ID NO: 55237 - DNA, 201 bp, Homo sapiens; identical to SEQ ID NO: 16022

SEQ ID NO: 55238 - DNA, 201 bp, Homo sapiens
tacagggagtaataaataggatgtggaagatgggttagaattggcaaaatctctgcatgtaagtctgggttactaaatatagtgagagaaattcaaatctstctttaagaatcgaataaaatatttagaaataagttactgttgtatttgaggtgaacacaaatggcatttcaaagatgctcgagataccttgttggaaaa

SEQ ID NO: 55239 - DNA, 201 bp, Homo sapiens; identical to SEQ ID NO: 16023

SEQ ID NO: 55240 - DNA, 201 bp, Homo sapiens
gcattgtacttttaaatgtggcatgctgaatgggagcaggggacatggctttttattctggaagatagaaactactcttctggtaacaaagaatttgattyggagttaactaaaaggttcatttaacaagctgcctcttactaatcggatcaggaagataatgtgactttagagcttatgatgttttccccccgtttttgt

SEQ ID NO: 55241 - DNA, 201 bp, Homo sapiens; identical to SEQ ID NO: 16026

SEQ ID NO: 55242 - DNA, 201 bp, Homo sapiens
actatgcgatcaaaaagtttttagtctttcttcttaccatactggttcttggtattctgtttaccattcaatgtactattattgcttctgcttaaaactcrcatcccctaatgcaagcctgagcaaacagaactgataacacacagcctgagaagggagtgcttggggtctcaagacttattctgtttttctccatctttg

SEQ ID NO: 55243 - DNA, 201 bp, Homo sapiens
catttatctatgatgctggtttatttaatctctataatttgctgtatttgaaagagcatagtgatagaggtcatgataaaatctaggcccagtgccacaastaaatccctgtaggaactctcaaggttttgatttcatctctgaatgggaataacaccttccaagaatattatgaagattaaaaagttacgtatcataaat

SEQ ID NO: 55244 - DNA, 201 bp, Homo sapiens
actgaacactaaaacttatttcttctaactgtatttttgcacccgtcaaccattcccgcttcatccccatcaccactatctttcccggtcactggtaaccrccaagccaagaattttggctattttactatttagttcatgtttacttaagcagacagaggtgacaaaactggctttttttttttttttttacattaaaag

SEQ ID NO: 55245 - DNA, 201 bp, Homo sapiens
aataataattagggcaggcttgctgagcatttttaaactgcactgtttattgtcatgcatttgaatgattatcgcagactttatgaattttcattttatawtaatttgtaggccaggcacagtggctcacgtctgtaatcccggcactttgggaggccaaggcaggcgggtcactggaggtcaggagttcaacaccagcct

SEQ ID NO: 55246 - DNA, 201 bp, Homo sapiens
ccctcctttttctggtaggagtagagggaaggtaaaatttggaaatacgtagcagagtgttcacaacaaaaggcctgccctgtaaggaaaactaattcaayaggcccttatgtgacctgggggaaaggcaaatagaggattctagcccttccttagccttcttgtctcatttctgaaagtcacagcccagggattcagacc

SEQ ID NO: 55247 - DNA, 201 bp, Homo sapiens
ttgaacattactggtgtatagaaatgctactgatttttgtacattgattttaaatcctgaacctttaccaaagttgtttatcagctccaggagccttttgrcagagtcttcagggttttctaggtatagaatcataagtgaaaagagatcgtttgattatttattttcctatttggaagccttttatctctttctcttacc

SEQ ID NO: 55248 - DNA, 201 bp, Homo sapiens
atcagaagacttctctgacacctctctatgtctaaaggtcctttgatattctcacatggcggcatgaatcacagtgtattttaactggccttttccttgtrtgtctcctacaatgagctgttgaagcttcatgaaaacacaatctgttttactcagggcagttataattccaattacaaagcacatttcctggctcctggc

SEQ ID NO: 55249 - DNA, 201 bp, Homo sapiens
gggagtttacaaccctgccttagcctttactaccagcttctgcagagcattaaggtcaacaggtggtgagagtttggagcctactccatctttcctgagcrtatacacagccctactcatgcatgtggccctctagatttccaggagtatgttggaccctttcaaagcccttacagactccccagcttttcctctcaatct

SEQ ID NO: 55250 - DNA, 201 bp, Homo sapiens
cgagcggctcctctgccagaggtaagaagcgaggcgggagggggccggggcgcgctcgctcccccgaggtgccgctgggaccggagacaactcgggggccrccgcgggagcctacaaacttttattagcctcggggagtgggggtggggggctggcaagggccgggcgacggtgacgaaagggcagcgcgcgggtgacagc

SEQ ID NO: 55251 - DNA, 201 bp, Homo sapiens
cagatgtaccactatgacatgaatacagcatccctttctcaacagcaggatcagaagcctatttttaatgtcattccaccaattcccgttggttccgaaarttggaataggtgccaaggatctggagatgacaacttgacttctctggggactctgaacttccctggtcgaacagttttttctaatggctattcaaggtaa

SEQ ID NO: 55252 - DNA, 201 bp, Homo sapiens
taccactatgacatgaatacagcatccctttctcaacagcaggatcagaagcctatttttaatgtcattccaccaattcccgttggttccgaaaattggartaggtgccaaggatctggagatgacaacttgacttctctggggactctgaacttccctggtcgaacagttttttctaatggctattcaaggtaagatcag

SEQ ID NO: 55253 - DNA, 201 bp, Homo sapiens
ccacaactcacccctaccctggtgtcactgttggaggttattgaacctgaagtgttatatgcaggatatgatagctctgttccagactcaacttggaggawcatgactacgctcaacatgttaggagggcggcaagtgattgcagcagtgaaatgggcaaaggcaataccaggtaagatgcaaaacataaaagagcaacta

SEQ ID NO: 55254 - DNA, 201 bp, Homo sapiens
tcgtctgagacgcaccttgtcacgtttctgccgccaggaatcatgtaggaatgattccagtcgcttaaacctgagcccttttcctttcttctgtcttgctactgccatctttctagtggtgcagctactcaattctttttttaattataatttttattttaagttccagggtacatgtgcaggatgtgcaggttacatagg

SEQ ID NO: 55255 - DNA, 201 bp, Homo sapiens
gcattaaggtcaacaggtggtgagagtttggagcctactccatctttcctgagcatatacacagccctactcatgcatgtggccctctagatttccaggartatgttggaccctttcaaagcccttacagactccccagcttttcctctcaatctttagactagtgtgttgttttcttcaacagttatctgtcaggcagca

SEQ ID NO: 55256 - DNA, 201 bp, Homo sapiens
cactttccagtaacctactgttggcaccagccctgtgctagacaccaggatcctgtttgtaaaggcatctgccagtggtttctgtgacacaattctgtttstagttttcctccttctacttctctagcctcttggcaagttcttctttcagagtttctcagagctttgtgctaggccctcttctcattttctccttctcta

SEQ ID NO: 55257 - DNA, 201 bp, Homo sapiens
ccaatttggaagcctgatcattaccatatcttctcttgcaggtggttgaaaatctccttaactattgcttccaaacatttttggataagaccatgagtatkgaattccccgagatgttagctgaaatcatcaccaatcagataccaaaatattcaaatggaaatatcaaaaaacttctgtttcatcaaaagtgactgcctt

SEQ ID NO: 55258 - DNA, 201 bp, Homo sapiens
taaagataatctgaaaatgcggaagtgactttggaactgggtaacaggcagtggttagaacagtttggagggctcagaagaaaactggaagatataggaargtttggaacgtcctagagacttgttttgaatacttttgaccaaaatgctgatagtgacgtggacaatgaagtccaggctgaaatggtcccagagatgagg

SEQ ID NO: 55259 - DNA, 201 bp, Homo sapiens
cctcccaaagtgctgggattaccgtgccagcctgatgttactattttaattgttttcaggcaccataaacctcacctgtataaggcaccgtacttaattgrtaaatattgcgcatgatctgactgctcttccaactggccattccctgtctgtctccctcttcctgggactctcaaatccctgagagacaataatattaaa

SEQ ID NO: 55260 - DNA, 201 bp, Homo sapiens
tcttatggacaaatgagcaaataaatttttttcttgagatggaatctactcctggtgaagattctgtgaaccttgttgaaataacaacaaaggatttagartattacataaacttaattggtaaagcagcagcatggtttgagtggattcattccagttttgaaagagtttctactgtgggtaaaatgctatcaaacagca

SEQ ID NO: 55261 - DNA, 201 bp, Homo sapiens
tacagtaagacctattctctttctatatttatgggaaaattttaagttgtgcccttgtttcatgtgtgtttctatttaaagataccatacttaatatataytgttgattcattaacattgaactcatggctaacagcactataaatcatgtctgatcaaaacttatgatacatgtactttcttcgtaaggtacatcatagt

SEQ ID NO: 55262 - DNA, 201 bp, Homo sapiens
aacgagccaactctacacagacagtggccctggacagagctgggcaggcatcagttttttttcttttttttgtggggggtgagggtggggcatggagtctyactctgtcacccaggctggattgcagtgcagtggtgtgatctcagctcactacaacctccacctcccgggttcaagagtttctcctgcctcagcctccca

SEQ ID NO: 55263 - DNA, 201 bp, Homo sapiens
tgaggcaggggaatctcttcaacccaggaggcggaggttgcagtgagccaagattgtgccattggactccagcctgggcgacagagcgagactctgtctcaaaaaaaaaaaaaaaaaaaaaaaatcatctttaaagagataactaacccttccccagaaggcagggccaaagtctaaggttcttccaggtcctttgtattc

SEQ ID NO: 55264 - DNA, 201 bp, Homo sapiens
tttggaacgtcctagagacttgttttgaatacttttgaccaaaatgctgatagtgacgtggacaatgaagtccaggctgaaatggtcccagagatgaggarcttattgggaactggagcaaaggttatttttgctatgctttagcaaaaagactggcagcattttacccctgccctagagaactgatgaactttgagatga

SEQ ID NO: 55265 - DNA, 201 bp, Homo sapiens; identical to SEQ ID NO: 16009

SEQ ID NO: 55266 - DNA, 201 bp, Homo sapiens
aaatttgctgttctggtattaccaaaccacacatttgtaccgaattggcagtaaatgttagccatttacagcaatgccaaatatggagaaacatcataatwaaaaaatctgctttttcattatgtgactccaacatgcttttgtagaacttgtacagttccgattgtccaatctgatttttgtttactgaaagtagagtta

SEQ ID NO: 55267 - DNA, 201 bp, Homo sapiens; identical to SEQ ID NO: 16012

SEQ ID NO: 55268 - DNA, 201 bp, Homo sapiens
ttttccctgtctcagcaacccgagtagctaggattacaggtatgccaccatacccgctaatttttgtatttaatagaaacagggtttcgccatgttgacargctggacttgaactcctcacttgaactcctcacgtcaagtgatctgcctgctttagcctcccaaagtgctgggattacaggcatgagctaccgcgcctgg

SEQ ID NO: 55269 - DNA, 201 bp, Homo sapiens
tttaaaatgccacctaaaattgtttttatcagaatacttaaaaaaaaatcctcactttattctctgggggtgggaagaggcaattccttccttccaccacracattgaattatcacataaaattgtaaaattatgaatattatgattgagcttagtaaagcattttctaagttcatttatagtaaaacaagagaaacctta

SEQ ID NO: 55270 - DNA, 201 bp, Homo sapiens
gggagctgaaataaaagcatgtgttaaatataccatctttaaccagaactacatttgactggtcattttattttcaagctcacatacacttcaaacagagrtatggctaaaggaattatcatgtgaacaacagccagggctctgaacatcacagattatatcatcatacttgaaatatttgaaattttgattcaaaatgag

SEQ ID NO: 55271 - DNA, 201 bp, Homo sapiens
gagtcatggaaaatatacattgatgattcctgttgcataaagagttttcaagaaaattttgttgaattaagctataactacaaaaaaaaatccattacatrttgacctttagaaaggatttttaaaagcccatgctgtccttatttctgcagcttcagagagccgactgctcttattttcttctggcatattctattaata

SEQ ID NO: 55272 - DNA, 201 bp, Homo sapiens
tgatagcccaggttatcttccccagatagaaataagccttaagactgacaggtgtatatgaatacagagagtatacataaagaagatgtattttcaattgwcagtctctaaatttgctttaagacttcgaaatggattgcttttcataatttcttagaataactctggtctgtttaccattgaaaaattagagtagccaat

SEQ ID NO: 55273 - DNA, 201 bp, Homo sapiens
aaattaatttttgcaatacttttatgaagatacaaactctgacaaagcttttaaaacaagtttgagagaatacagtattgatttcacttgtaaatctgacrattattttagaaaaaaggaaaatattatttactattattttgcttataaatgtttatcaattttaaagcttccacattgcacatctcccactacaacagt

SEQ ID NO: 55274 - DNA, 201 bp, Homo sapiens
tctggcatattctattaatacttgggttttgtatttttcaagtaaataaaatattcctattgagaatttcaattttaaaaaagaaaaggtctactaagtgytcctttccctgttgaattatgtgtgatcatttctatgctaaactagattagggtgtgacttgtgatggtgatttttgttcattttacatattaagaaaga

SEQ ID NO: 55275 - DNA, 201 bp, Homo sapiens
ttagtaaagccctccaaatgtttctggtattgcttctaagaacaattgataacataatagctgtggccattataggggtattctgtcatatttagatatargcataccttgttttattgtacttcccaaatattgcgtgtttattttgttttgtttcacttacaaattgaaggtttgtggcaaccctatattaagcgagtc

SEQ ID NO: 55276 - DNA, 201 bp, Homo sapiens
catgattcatgatcaaaatgaacattataaggctatccctcttcagaattaaatacgttactcctgtggaaaacttgcttttaatgtagaagttgtcccaragcctttcttcctttctcatgtcctcttatgtccactgctgagctaacatgggtctcactgaatgattaagaaaaaacatcttaggtggggagttctgta

SEQ ID NO: 55277 - DNA, 201 bp, Homo sapiens
gtgatgcttagtggttaagttctgatttgtgttttcttgaagttattaaggaactttatgataacagtttatatattccctcttcttggcatagtaatgargtaatagagactattcacctctaagcctgattttttaaataagtgtttattttatgtttaagtaaggtaggtctgcttttggcttggacttgaatttggc

SEQ ID NO: 55278 - DNA, 201 bp, Homo sapiens
aaaaccatttaacagaaatattgtgaaaggtttcccctaaagcatttttctatttgatttgaaaactattccatagcttattatcaaacaaatcagtaatyctttagctaatgcagagataaatgggcagtcagaaaatataatcacctggtgtgtgcagctgagtatttacatttttcctaatgaacaaagataagaaaa

SEQ ID NO: 55279 - DNA, 201 bp, Homo sapiens
cctactgaaaacttttttcagtcttaaattttttatctaactggctgtattgcagatgtctgctatataacttttatataattttaaaaactatttctttyctccttgatcttctaggggtaaggttaccaatgttttcattatttactaaatatagcagcccccaccccttattcatggaggataggttccaaaacccct

SEQ ID NO: 55280 - DNA, 201 bp, Homo sapiens
tatcgagtattatgtactgtacacagttgtatttgctgtacttttctataactggtagcacggtaggtttgtttataccagcatcaccacaaacataagcwtggtgttgtattacaatgcacagctgcagctaagtgataggactttttcagctccattataattttatgggaccatcactataaatgctgtccatcattg

SEQ ID NO: 55281 - DNA, 201 bp, Homo sapiens
ttctaatctttctcgagtgaggaaaatgtcagcagatagtgaatatcactgagagagagatgatagcccaggttatcttccccagatagaaataagccttragactgacaggtgtatatgaatacagagagtatacataaagaagatgtattttcaattgtcagtctctaaatttgctttaagacttcgaaatggattgct

SEQ ID NO: 55282 - DNA, 201 bp, Homo sapiens
gggagctggggcgggggcttcccgcacgggcacccctcgccccacggccctctcctttctcaggacggaccacgagttcccttccccttggactgaggggraagctcctaacaggaacatctgtagggagttgaacgctggcattttaaagctgcctgtattttgttttatttgtaggggcaggggtcctatgaacgtgat

SEQ ID NO: 55283 - DNA, 201 bp, Homo sapiens
tttcccttcactgcagtatgataattactttcaagcacaaaggtttagaattaagatttcttactcctgggctaggtatggcttaccgtatttgtttctcytttcctagggatcataatcatgtattgcttgttgtccagttttccagtaggaggggaattccaggctgtacttacttcctgcagccaaaagaggaagtaa

SEQ ID NO: 55284 - DNA, 201 bp, Homo sapiens
aatagcatggcacaccatagagggcatagggccacaggaacaagaggaaggtcacctaattctgtcttggaagtcaaggaagaagtaacattgaattttamatctataagctgagtaggaattagatagatgaaaaataagggcagagacatgatcagatttgtattttacaaagactaatcttacatggagagaccaatt

SEQ ID NO: 55285 - DNA, 201 bp, Homo sapiens
atcgagtattatgtactgtacacagttgtatttgctgtacttttctataactggtagcacggtaggtttgtttataccagcatcaccacaaacataagcakggtgttgtattacaatgcacagctgcagctaagtgataggactttttcagctccattataattttatgggaccatcactataaatgctgtccatcattga

SEQ ID NO: 55286 - DNA, 201 bp, Homo sapiens
tcgagtattatgtactgtacacagttgtatttgctgtacttttctataactggtagcacggtaggtttgtttataccagcatcaccacaaacataagcatkgtgttgtattacaatgcacagctgcagctaagtgataggactttttcagctccattataattttatgggaccatcactataaatgctgtccatcattgac

SEQ ID NO: 55287 - DNA, 201 bp, Homo sapiens; identical to SEQ ID NO: 16021

SEQ ID NO: 55288 - DNA, 201 bp, Homo sapiens
gagcaactatataaacctttgtgttttcttcagcaaaaacactttggcttttatatcatcgtgagcccatggcttatcttgtttctcttagttctggggaytatgaaggggagagtcaggtgaatacaggtgatagggagtttataataaaacatttacattactccctgcttttcaaatcattatgcacaggatggtaat

SEQ ID NO: 55289 - DNA, 201 bp, Homo sapiens
ggacatttattatatgaagtctactgtagtgtaaactctgtagacttaggctacactaaatttatagaaaaattttcttcaataataaattaaccttagcstactgtaacttttttactttgtaaacttttaatttttttaacattttgactcctttttagtaacacttagcttaaaacacacacattgtacagctgtaaa

SEQ ID NO: 55290 - DNA, 201 bp, Homo sapiens
cccacccaaatcttatcttgaattgtaatccccatatattgagggagggacctggtgtgaggtgtttggatcatggaagtgatttcctccatgctgttctygtgatagtgtgggagatcgcaaaacatctgatggtttaaatatggcagtttcccctgtgctttctctctctcctgccaccatgtaagactttccttgctt

SEQ ID NO: 55291 - DNA, 201 bp, Homo sapiens
tattatcccagcaatttgggaggccaagatgggaggattgcttgaggcctggagtttgagaccagcctgagcaacataacgagaccccgtctctacaggaaaaaaaaaaaaaaaaaaaacgttatccaggcatcgcacctgtagtctcagctactcaggaagctaaagcaggagattcaggctgcaaagagctatgacaca

SEQ ID NO: 55292 - DNA, 201 bp, Homo sapiens
aatgatgtttcccttgtagaataagttagggatgaggccctctttctagattgcttttttagaatagttttagtaggattagtaccagctcttctttgtayatctggtagaatttggctgtgaatccatctggtcaagggctttttttaattggtaggttttttattattgattcaatttcagaactcgttattggtctgt

SEQ ID NO: 55293 - DNA, 201 bp, Homo sapiens
cactaaaataacttcaggagtatgaataagtctactaaaaagtctacaggatccatgttgtagtttgagtagatggttccataccaagtcaaggtaaaagwtaatttatatataatatgaaaatggctgctttaggtttatagagtaatcaatataaatcttccttataaaagggaaatttcccacttataatttatgtaa

SEQ ID NO: 55294 - DNA, 201 bp, Homo sapiens
ttcatggcagcccttcctatcacaggcctggaggtctaggaggaaaaaatggtttcgtgggccaggcccagggttgcgctgctctctgcagcctcaggacrtggtgccctgcatcccagctgctctagctccagctgtggctaaaaggggccaggagataatcttgggctgttgcttcagagggggtaagcctcaaacctt

SEQ ID NO: 55295 - DNA, 201 bp, Homo sapiens
ggaggcggaggttgcagtgagccgagatggcaccattgcactccagcctgggtgacagagcaagactttgtctcaattaaaaaaaaaaaaaaaaaaaaaamcacaagagggtttgtgagtcttaaagtgtcagatgacagaagaaaactgtgtctacctagtatttaatttccattttctgttaggggtgcccttgttttg

SEQ ID NO: 55296 - DNA, 201 bp, Homo sapiens
tccagggttcaagtgattctctgcctcagcctcccgaatagctgggattacaggcgcactccaccacacttggctaattttttgtatttttagtagagacrgggttttgccatattggccaggctggtcttgaactcctgacctcaagtgatccacccactttggcctcccaaagtgctgggattacaggtgtgagccacc

SEQ ID NO: 55297 - DNA, 201 bp, Homo sapiens
cacttggctaattttttgtatttttagtagagacggggttttgccatattggccaggctggtcttgaactcctgacctcaagtgatccacccactttggcmtcccaaagtgctgggattacaggtgtgagccaccgcacccagccctccacccttttttcttagcccactatgtttccatactgctctggtgtctgtgaca

SEQ ID NO: 55298 - DNA, 201 bp, Homo sapiens
ttttgttttttgttttgtagttgatattcactgatggactccaaagaatcattaactcctggtagagaagaaaaccccagcagtgtgcttgctcaggagargggagatgtgatggacttctataaaaccctaagaggaggagctactgtgaaggtttctgcgtcttcaccctcactggctgtcgcttctcaatcagactcc

SEQ ID NO: 55299 - DNA, 201 bp, Homo sapiens
gcctccaagagagcatggtaaactaattagcatggttctatcatgattctgtttctattttgaactattaataaaaatttttgcaattctcagttaccccatttagtatagaacacaataagaatggaaccattctattctaacattgtacattgagatatcgttcccaccaccatatctgtcctccatagactatatggt

SEQ ID NO: 55300 - DNA, 201 bp, Homo sapiens
actaaaataacttcaggagtatgaataagtctactaaaaagtctacaggatccatgttgtagtttgagtagatggttccataccaagtcaaggtaaaagataatttatatataatatgaaaatggctgctttaggtttatagagtaatcaatataaatcttccttataaaagggaaatttcccacttataatttatgtaat

SEQ ID NO: 55301 - DNA, 201 bp, Homo sapiens
attgatctcattgctccttggcaattcccacagagatgatcttctgaagagtgttgcctcatacctttatttctcttaattcaggtttcaggaacttacayctggatgaccaaatgaccctactgcagtactcctggatgtttcttatggcatttgctctggggtggagatcatatagacaatcaagtgcaaacctgctgt

SEQ ID NO: 55302 - DNA, 201 bp, Homo sapiens
tacacctggaatgcagtaagaaaaatacggatttctgtacatcatcttccctccctgctcttacccccatttaagagttacagggtcagaacccaagagtstgagtttttgaaagtccctaaaaattttggatgatcacctacatttagaaccactgcactaagaaggacaacaaatatgccaataaattctgttgccaag

SEQ ID NO: 55303 - DNA, 201 bp, Homo sapiens
tgtcagatttataaccaaatattactgaaactaatttttttaagttcaaaaacccaatctagtagtttctctcttattttcaacttttattttagattctrggggtacatgtacaggtttgttactaagatacattgtgtgatgccggtgtttggagtatgattgaacctttcatctaggaagtaagcacagtacctaaca

SEQ ID NO: 55304 - DNA, 201 bp, Homo sapiens
gacacttcaaaagaaatgacctcattcttaattttgtttaaagaagaatataacatgatttgaatatatttagctaggatattttagtgcctgctagcacytgaagccagagttcactgtgagcattctgactatgaagtgagaagctaagagaactgtattttgatattcctttgacagttaaatcataacactgttctt

SEQ ID NO: 55305 - DNA, 201 bp, Homo sapiens
atggcagaaacagagaggtatatgagctgcatagggatctctgttgataagaatctgtgtagacttttttctccttccttcctttgatctttgatcatggraagacatggaaaaagaaagctaactacagtgattttgtccactacactgttatttggttaaaaattttagtttcctaatgagtattagcatgtatgagaa

SEQ ID NO: 55306 - DNA, 201 bp, Homo sapiens
gaataatgcacccttcatatattatggtactacagtgattcatgaaataattctatataattctacatacaatcaaagaaatataaaatgtgttttgtacrgaagtgcttatttttcatctggggaattccagtgagattggtatattctaggccagataattttttcaaaatagaggacaacaaacatgagatgttccca

SEQ ID NO: 55307 - DNA, 201 bp, Homo sapiens
acacctataatcccagcactttgggaggctgtgggcagatcacttgaggtcaggagttcgagaccagcctgaccaacatggcgaaaccccgactctactamaactataaaaagccgggtgtggtggtgcatgcctgttatcctagctactcgggaggctgaggcacaagaatcatttgaacctgggagatggaggttgcag

SEQ ID NO: 55308 - DNA, 201 bp, Homo sapiens
aggtatatgaaaaatctctgtaccttcctcccaattttgctgtgaacttaaaactgctctaaaaaaagtcttttttaaaaaaagctctatgaactagttgstattataaaccttaggccatttcaagtaaaaattacatatcaatgtttattaaatactgagttaatagctgaatacctctttcatatacaaataagtaca

SEQ ID NO: 55309 - DNA, 201 bp, Homo sapiens
ttgagttaatgctggaaggagttaagacttccggggactattgagaatgcaagattgtgttttgaaatgtaagaacatgagatttaggaggggccgggggyagaataatatggcttggctgtgtgtccccacccaaatctcaatcacttgtaatccccacatgtcaggggaggggcctagtgggaggtgactgaatcacaa

SEQ ID NO: 55310 - DNA, 201 bp, Homo sapiens
gtatatgaaaaatctctgtaccttcctcccaattttgctgtgaacttaaaactgctctaaaaaaagtcttttttaaaaaaagctctatgaactagttggtattataaaccttaggccatttcaagtaaaaattacatatcaatgtttattaaatactgagttaatagctgaatacctctttcatatacaaataagtacatt

SEQ ID NO: 55311 - DNA, 201 bp, Homo sapiens
tgcatagtataacccaagacatggccaactttttctgtaaagggccagatggtaaatgttgttagctttgcacagtctctgtcacagctactaaactctgyccttgtggcaggaacatagtcattgacggtactcaaatagaacaggcatggctgtgttccaataaaactttatttacaaatacaggctgcaagtaggatt

SEQ ID NO: 55312 - DNA, 201 bp, Homo sapiens
ctcgacctcataatggcaatgtaggcaagaacattccctcaaggcaatacctgtgggtgtcttggttatattccaccggaaacaaagacagaggctgtccktataaaatatgtttgaagacctgtgaaactttaatagtgccttttattccatataggacagcacaattacctatgtgctggaaggaatgattgcatcatc

SEQ ID NO: 55313 - DNA, 201 bp, Homo sapiens
taatgtgtaaaattaacccattgttaatatagaatgccgttatcactcctgattaagcggtcttcattttcatgttaatactgatgtcttgtaatgctttmtggaatcaaacattttcatacatattcattagtctaattctaatcataatccaatgaaaaagagcaggaaagatgctcaaggaggttatattcaagtcca

SEQ ID NO: 55314 - DNA, 201 bp, Homo sapiens; identical to SEQ ID NO: 16010

SEQ ID NO: 55315 - DNA, 201 bp, Homo sapiens
ttcttctgtcttgctactgccatctttctagtggtgcagctactcaattctttttttaattataatttttattttaagttccagggtacatgtgcaggatktgcaggttacataggtaaacatgtggccatggtggtttgctgtacctatcaactcatcaggtattaagcccggcatgcgttagctatttttcctaatgct

SEQ ID NO: 55316 - DNA, 201 bp, Homo sapiens
tgttgtagtttatagtttcattgggcattttcagtagttttatctgaagtcacatttcaaattttgtaattgaagctccaaagtatgctaccggaaacacragctgatgctgtgagacaaaatcaacaggtaatccaccatcacaactgtgggctagaatgctcaagaaaccttggaggcccagagagctgagatgaatac

SEQ ID NO: 55317 - DNA, 201 bp, Homo sapiens
ggccatagccccccacctcatctgatggtatcctctggcagccacagaccacacagttctttctacctaaattagtcattagcacatagtaggtacccagwaaatgtttgttgaattaatactgtttatatatttctaatttatctccaagtaaatccagtctccttaaggacaaggaacgttttcactataacacctagc

SEQ ID NO: 55318 - DNA, 201 bp, Homo sapiens
tctagcacacactgtgtgtagacatcttgttaaatagaaaatagatttatgggtatgactatgaagagtctaattccccaaaccacacacacaactctatmtacgtttgaccaggctatttaaacttaactgcagagtgtcagcatgttaaacattgatttacataaaatgatagctgcccactttcttgtaaatgttata

SEQ ID NO: 55319 - DNA, 201 bp, Homo sapiens
aaattgtgccaatatttcttacataaacgtttaaaaataatattttatttttattcacagatatatttcttagcctcctctcacccccaagtatttaattmtagaatatattttccttttctggttgtttctatgaagagattgattccccataataaaacccttcataatagaatatgatgctctaaagagtcaatctgt

SEQ ID NO: 55320 - DNA, 201 bp, Homo sapiens
  misc_feature (1)...(201): n = A,T,C or G, or insertion/deletion polymorphism (see Tables 1-2)
aaagagttctactcatatcaaaatgaggcagtggccatagaaaatatcaagagaggcctggctagcctatttcagacacagttaagctctggaaccaccantgaggtacttaccaatattaataaggattcagcatctcaataaaatttgtaaggatttctacttatacaatttcagtagaagagttactactaaggtaat

SEQ ID NO: 55321 - DNA, 201 bp, Homo sapiens
atttttgcttcatttgtgttctgttcccctctccccaccaggtcaaagagttctactcatatcaaaatgaggcagtggccatagaaaatatcaagagaggyctggctagcctatttcagacacagttaagctctggaaccaccaatgaggtacttaccaatattaataaggattcagcatctcaataaaatttgtaaggat

SEQ ID NO: 55322 - DNA, 201 bp, Homo sapiens
aagacaaaattgtgcccatcttggagctcatattccaagcacttggccctcttggtattggtcccctttctcctttactatagatatgttataatttcatwtattagatgattaataagtgcctttaattggaggcaaagagaaaatgttgatgttaacagaaacaagaaagtttaggacacaacagaatagagctaccac

SEQ ID NO: 55323 - DNA, 201 bp, Homo sapiens
gtccaagaacttttttatttgctattattttaaaccttagttattttttgtttcaagtacagttacaggtagagaacatgctgacatgttcaaacagaatkttcatcatttctcttccctgggccatccttgttttcatgaggctcccagcctatatcagtgctctctcccaatgctgtgcccatcatgcaagagccttca

SEQ ID NO: 55324 - DNA, 201 bp, Homo sapiens
ctttactatagatatgttataatttcatatattagatgattaataagtgcctttaattggaggcaaagagaaaatgttgatgttaacagaaacaagaaagkttaggacacaacagaatagagctaccactgtctcctcacttggctctctcaggcacgagggcttaggtgatatttatcctgaaggcaggagctgaactat

SEQ ID NO: 55325 - DNA, 201 bp, Homo sapiens
gaatgtataagttaatggtggcttctgtcatattttgcccatgatttccttatctgtaagaggctgtatggtttatagtcactcagagaaagtttcgaatwtgaacttgaaacctaagtaatttgatccattgaacttgacaaatgtccatttgtcttttcaaaggtgcacatattcacaaaactgaaattgtgccaatat

SEQ ID NO: 55326 - DNA, 201 bp, Homo sapiens
aatgagtatggctgtgttccaataaaattttatgtacaagaatagccagtgggccagacttgcctgctggccatagtttgccaatccctgatctagattawcttgtacagtttttctattcactaagctagggcagctaaggcaaggcatattctatgagaaagattgccccctagctattaaacatagcccagtgtctgt

SEQ ID NO: 55327 - DNA, 201 bp, Homo sapiens
tttctggttttggctttgtgttgattaaattaaccacgtggctgctgagtcagacctttattttgtattgtttccgggcattgatttgctctctaaatcascatggctcttgtacacacactgaactgccacaagaaatgtgacaccttgaaagtccttctgaaatttgttgtatatttctttacttgtttgttctccagt

SEQ ID NO: 55328 - DNA, 201 bp, Homo sapiens
gttctggcattctaaggagaagtaacctgaacatctttcagtacattgggaaggctggtcttcacggtagccaggtaactcacttctcatggattttgctyaataaagtatgcaagaaatcaggctgaggtaaaataaaacatatatgctgtgggtaatgctatagaatgtataagttaatggtggcttctgtcatatttt

SEQ ID NO: 55329 - DNA, 201 bp, Homo sapiens
tggatgaacaagattataattttcaaattaggaagagagaaaaagatgcaaagaaaggaatatttctgaggtgaggcacaccatagctttcatttggaaayaatcatgtttggagtacacatacagaactctcatattttggtcccatagttcacaggcataggtgaaaatgtgggcatgactattgtgttttcttcagga

SEQ ID NO: 55330 - DNA, 201 bp, Homo sapiens
gaagagagagtaaacctagtctgtgttcttcctgaggaaggaaccaagtactcccctgaataacagtgtttggtcagttaaaatggtttagatttatgtgytgagaagggaggccaaattagttggtctctggggacttttccaattgtaatatatggtgattcccttatttgcttctcaagaacctaaagataatagatt

SEQ ID NO: 55331 - DNA, 201 bp, Homo sapiens
aaaattaactgggcttagtggcgtgagtgtgtggtcccaactactcagaaggctgaggtgggaggatcacttgagcctggagatgaaggttgcagtgagcygagatcgcatgactgcactccagcctgggtgacagagtgagaccctgtctcaaaaaaaaaaaaaaaaaaaaagtaaagaaagaagaagaaactttctctg

SEQ ID NO: 55332 - DNA, 201 bp, Homo sapiens
tttctttgaaggttcgacagattatgtgacttcactacccaaaattctatggcagcgtcccatctcactcaaactccccaaatcttcctgccacccatagrtacctcctttaccttgtctccttcactgtgtcttttacttatttatttccagcctctttggtctccctgctcttcctccattacacctgcaggagccctc

SEQ ID NO: 55333 - DNA, 201 bp, Homo sapiens
taagtcacatctagaattcagggaggatagagggcttaatgaagttagggggaagcatatggtgtcaagaatgtggacaacggctgaaccttgaaagttcwgtcacataatagttatttgtccacaggtgacatactttactggcctcagtgttctgattattgctgcaaggactgaaaaaggataccaggatctttgcct

SEQ ID NO: 55334 - DNA, 201 bp, Homo sapiens
ccaatattaataaggattcagcatctcaataaaatttgtaaggatttctacttatacaatttcagtagaagagttactactaaggtaatgctcagaaaagrtgacttgtgtagtgaagtcgcatttgcctatgaaacaattgccatttatcccaatgttttgttaattaattacaaggtagagaggattagaaatatttat

SEQ ID NO: 55335 - DNA, 201 bp, Homo sapiens
ccagctggcaccaccctggctcttggaaaggcatgaggaaaatttggcttcctcttttttccactgaggattttttttttccaaatttgacttgggaaacwgtcattacaatgaatgtgcagctttttttttcctcatatgttgcagcaaaattgtccgtcgagttctgaaggaaatggtcgctcacaattatgaccgttt

SEQ ID NO: 55336 - DNA, 201 bp, Homo sapiens
aaatttttgattcatcttgagctatggatgaaggaactgagagcaatcaaacagtagcacatttaatgtgaagtgtgacccacagtgttaccaaaaggaamcacagaatgaaaaatgacactggtcatcaaaaggttcacaatataacttagggcttcccacataatcagtcatctttcacctctttccaaagtactttct

SEQ ID NO: 55337 - DNA, 201 bp, Homo sapiens
aatctagatgtgcactaagtttgaacatcttatgaacaggtgaagaagaccttaaacagaatataccaccaaaaccgtaaagttcatgaaaagactgtgcrcactgctgcagctgctatcattttaaataacaatccatcctacatggacgtcaagaacatcctgctgtctattggggagcttccccaagaaatgaataaa

SEQ ID NO: 55338 - DNA, 201 bp, Homo sapiens
ctgatgaagacagatataggaagttttttttaacagctttctttctgttactccagatgaaggatgtaaatgttgaaaatgtgaatcagcagagaggagasaagagcatcttcaaaggaaaaagcccatctaaaataatgggaaaggaaaacttggaagctctgcaaagacctacgctccttcatctaatccatggaaagg

SEQ ID NO: 55339 - DNA, 201 bp, Homo sapiens
agttatgagtggggtatgagcctgcagtgtatgttttgcagctctcggagctctggcggtccaccaggaaatacctgcagcctgacaacctttccaaggcygaggctgtcagaaacttcctggccttcattcagcacctcaggactgcgaagaaagaagagatccttcaaatactaaagatggaaaataaggaagtattgt

SEQ ID NO: 55340 - DNA, 201 bp, Homo sapiens
aaattatatagtttctgtgtcccctcagtctcttcatctataaaatgagactaataatagtgcctacctcattagatttttgtgaggattaaataagttamtacatgtaacatgcagatgatggatttttgaccaccatttcctctgggcaagtacgtgctgtcatatgtagaggagacagtgaacagattgttactgtgt

SEQ ID NO: 55341 - DNA, 201 bp, Homo sapiens
taagttccccaacctttgtgtggggttgtctgtcagaaacatttctggattgttggttttttgaagtaagaaagaccccttttaaaccaactgccccaccwccaaaacaattattttcttgtactacattttcatcgaaaagttatgccacagtgcagtaatttaatggtcacttgaccagaaatacaatagcagattttc

SEQ ID NO: 55342 - DNA, 201 bp, Homo sapiens
gttcaaaggttctattggtagcagtgacatcagagaaactgttatgatcatcactgggacacttgtcagaaagttgtgtcagaatgaaggctgcaaactcwaagtaagtgcaaatccaatctcatgtattacatcattctacaccattgtccatttgatactcaccatgctgcctactattggcactcctaattctcttta

SEQ ID NO: 55343 - DNA, 201 bp, Homo sapiens
aaaattaaaataaaatggggaggggtctttttgagaaagtcttaatcattttttcatttgttcaaattaaaaaaaaaatcacttcttgagaaaactcaaaycaatagaaactctgtgaatggtagagatttttaagtattccttcccctaaacattgatatccatgattatgcctttttttatagacctcagctggtggat

SEQ ID NO: 55344 - DNA, 201 bp, Homo sapiens
gtcaagaacatcctgctgtctattggggagcttccccaagaaatgaataaatacatgctcgccattgttcaagacatcctacgttttgaaatgcctgcaakgtataatacattgcacatgtctctctgtgtattcaagcttatttgtgtgttcatggggtaccgatgtagctaataataatgatgtggtcattatgcaggg

SEQ ID NO: 55345 - DNA, 201 bp, Homo sapiens
actaaaagccaatatagaggtccagggtggtctagctattgatatttcaggtgcaatggagtttagcttgtggtatcgtgagtctaaaacccgagtgaaawataggtaagtgtttatgcattatacatttatgaattacatataagactatatacagagaacttccgaaatatgttttgggaattaatcttctgacttttc

SEQ ID NO: 55346 - DNA, 201 bp, Homo sapiens
cagagaggagagaagagcatcttcaaaggaaaaagcccatctaaaataatgggaaaggaaaacttggaagctctgcaaagacctacgctccttcatctaayccatggaaaggtaaaggggcgtttagattccacaactttttctccaacttcatatttttcttcccttcagtagatattattttgaggtaatcacattgta

SEQ ID NO: 55347 - DNA, 201 bp, Homo sapiens
ttaactggataattaccagatttccatttctggttttggctttgtgttgattaaattaaccacgtggctgctgagtcagacctttattttgtattgtttcygggcattgatttgctctctaaatcagcatggctcttgtacacacactgaactgccacaagaaatgtgacaccttgaaagtccttctgaaatttgttgtat

SEQ ID NO: 55348 - DNA, 201 bp, Homo sapiens
cagtttttttctttgaatgcccctcagtacttctgcatttataggatggtagactggtttggtttagctctcaaaagtgaaaacatttaaagtttcctcaytgggtgaaaaaaattaaaaagagtgagagactgaaaactgcagcccacctacgtttaatcattaatagtgagcccttcagtgaacttaggtcctgatttt

SEQ ID NO: 55349 - DNA, 201 bp, Homo sapiens
aagtgtttctgttgatataaaaagaaatgagaagaaaatcacccattcatggagtagcctttgacactcatatcctttctcagattgctttggaacagaarcttcaagtacattcagtaacttggctggagaggtatagggtgacttaactgtgtgtgtaattctgttattgttgctgttgttgtacaggcaatttgagaa

SEQ ID NO: 55350 - DNA, 201 bp, Homo sapiens
agtttgtgtccatcacattagttataatgcctcaaacaaccccttcatcccatgcagccatattttgtcctatatcaaatgtctctttaagtatccttagrgctatctcctaatgtgtcctgagcatggcactgagaatctcatgcttccatcaaagagtgtccttcagactgaaagtagcttcatgccgcaaccgtactt

SEQ ID NO: 55351 - DNA, 201 bp, Homo sapiens
ttcccaggcaatgctgatgctgttgttcacagaaacacactttgagaaccattgttcctttcaaagtgtagcaatgattgaaggaaaacatccttcttaaytggcacttcatcactctggtattttaattgactaattaatttagcaaatcaacagagtctacttccggtgcttaaaattaggacagcatgtttccaagcc

SEQ ID NO: 55352 - DNA, 201 bp, Homo sapiens
tgaatataggacatcagaaggtactctaagtgattcagggattaaaacgacctctgacctatttttacactgatcataacagcagcaggggttttaatttrcgcagcaaaaattaatattcctgtcaaaacataagggcataaaactctcatttaattgtgaaagcagtttctcacagtttgatttaaagtccacaattca

SEQ ID NO: 55353 - DNA, 201 bp, Homo sapiens
tactttctagacagaagtttttccaaatgaaatggaattgaattctttgcaaagagaaatcaacaacagcaacaacaacaaaaagtaatttggattttttwaaaaagtacacagtatccttaagaatctacccttatccatattgtaaccaatctgtcttccatttccacttgttcatttgaaaaaaatatcttttaaacc

SEQ ID NO: 55354 - DNA, 201 bp, Homo sapiens
agataagacaacatgtatttcctttatgccctatgtggaatttgataggtgtcataaaaagaaggcctcctgaccgaaatatttttcctgaccagaaagcyagtatttgaacccgctatagagtccccaattacaatgcagaagacatagagataagagggaatcccagtcttcatccccttcaaggtttttcctgactct

SEQ ID NO: 55355 - DNA, 201 bp, Homo sapiens
aatataggacatcagaaggtactctaagtgattcagggattaaaacgacctctgacctatttttacactgatcataacagcagcaggggttttaatttgcrcagcaaaaattaatattcctgtcaaaacataagggcataaaactctcatttaattgtgaaagcagtttctcacagtttgatttaaagtccacaattcaat

SEQ ID NO: 55356 - DNA, 201 bp, Homo sapiens
aattctaaatgcacttgaagggcaaatgaaagagattctgacttttttggctaatattactttctgttttggttttatctaacaacagttatcaaaaaatrttactatacatactctgaagagcactatcctacaaaaggaattaagtcaacaatataaatgggacatgccccaatgcccagtgttgccagatctctgcaa

SEQ ID NO: 55357 - DNA, 201 bp, Homo sapiens
agaatatataaggagattgaaataaaaatttacagatgattggattgacttgtaaagtttactttattgttttaatacattaatggataatagcctacgtktgaattttgcctccgttaccttcttgctatgtgctcttgggcagttacttaatagccttaagccacaatttcatactagtaaaatgaggcacctggaaca

SEQ ID NO: 55358 - DNA, 201 bp, Homo sapiens
aaaaaaacaccaaacaataaaatatagcaaaacgacagtatatattcatacaatttttaaaatacagcataacagcaacatagcatttacactgtattagrtattataagtaatctagagatgatttaaagtgtatgggaggatgggtgtaggttacatgcaaatactatgcctttttatataagggacttgagcaccctt

SEQ ID NO: 55359 - DNA, 201 bp, Homo sapiens
ttgaaattatttatcctcttcatcattatccagggcacattccccagccaatgcaatctgtttatccagttatctagagcatcattaaaggacccaccatwtttttcctcctaggacctactgtacatgccccactgtaagaatgattttttgtaacacaatattttttcaaatatcttggcaatcaagggcttacgcctc

SEQ ID NO: 55360 - DNA, 201 bp, Homo sapiens
tttttcaatgggtgtctgaacaaaattgtttctgtcaatacaaatgtagaaaggacaaagagcagtgcgtcttgtatcccttaatcctcaagtcacacatkaaaaaaacagttctcaaattatatcagaattttacattgcacaattccagttttaatgaaagaatcgtctaaaggcagcataagtactgaaaaagtagtc

SEQ ID NO: 55361 - DNA, 201 bp, Homo sapiens
agatttggagtgtcagatctctttctcccaggattaatacaggtaagaatctgaccttgcctgacacttatttaaatctgataaatgatgcatttttgctycatttgtgttctgttcccctctccccaccaggtcaaagagttctactcatatcaaaatgaggcagtggccatagaaaatatcaagagaggcctggctagc

SEQ ID NO: 55362 - DNA, 201 bp, Homo sapiens
tctaagcacatccaggtcacctctgaatcccttaagtgtttccttccagtcactggcatcatacgttcagaccctgtaaagttacagctgttagtccaatwccattaaatataatatgaacaagttttttctttttttctcaaatgtttagggtgactgtggtaataaccactgacatcacagtggactcctcttttgtga

SEQ ID NO: 55363 - DNA, 201 bp, Homo sapiens
agagtccacttctcagtgactcctagctgggcactggatgcagttgaggattgctggtcaatatgattcttcttgctgtgctttttctctgcttcatttcstcatattcagcttctgttaaaggtaagtttgtgttgccttttgctaaactttaatttccatctttggagttggaggcagatacgtgcgtgtgtgtgtgtt

SEQ ID NO: 55364 - DNA, 201 bp, Homo sapiens
cattcaggtaagatgcagcgttcaggtcatgttccaggaccatccccagtgcaccaggaacttgcattcagtttagaacattcagtttcagaattaaaacraaacagtagaaacccagggaaagatgaattttctttaaatgagtagaagaataattgataaggccaaaaaaagtcagtttctgggataccaaaaaaaaat

SEQ ID NO: 55365 - DNA, 201 bp, Homo sapiens
tatcagctcaggatagctgtatataacaaaaacaaaaagcaatttagagtggcttaactaaatagtttcacttttatagtgtaacaaacatttggaagtasgtggtccagggttaatatggaaatcttaagatatcatcagaatccaagctgccttccttcagctcagccattcttacttgtgacttttgacctcatgctt

SEQ ID NO: 55366 - DNA, 201 bp, Homo sapiens
atggagcaagtgagtgagaaaagaagccaaatctctctgcagccatgtatttctagttgaacgcatttagcttctccatttctttgtttgcttttatgagrccctgtgaaggagatcctgggtgtacttgctgccttcgtcttatggctctagcatttcagggacccggaaagaggagacagtggggtagagaacagacta

SEQ ID NO: 55367 - DNA, 201 bp, Homo sapiens
gactttctatatctagtagggtaatacatttccttccaacctttagtggggtgaagttcatttgtcttctaatctaagaaaatacgttaactcctgacaayctctgacactcaacagaaacacaactgtactttggaattaatcatccatctttatttcatagtctccttatttatcaatgcaaatggaagtatagcaaat

SEQ ID NO: 55368 - DNA, 201 bp, Homo sapiens
ctgaggtgggaggatcacttgagcctggagatgaaggttgcagtgagccgagatcgcatgactgcactccagcctgggtgacagagtgagaccctgtctcaaaaaaaaaaaaaaaaaaaaagtaaagaaagaagaagaaactttctctgcctttctctgcttgttaactggtgtagtcccagagccttaaaaagtacttac

SEQ ID NO: 55369 - DNA, 201 bp, Homo sapiens
gtgtagatcattgtaacatttttaatccaacaaagaaaattttccttttattgcatgaatcagttatgatatacattcagagaaatgacttaccacccagmatttccttatctgtaatctcttgtcagaagagcaaaccattggcttcatgctctgtgtgtaactatagggagatgctctttccttcagtattactggtgt

SEQ ID NO: 55370 - DNA, 201 bp, Homo sapiens
tgcggcaggagaatggcgtgaacccgggaggcggagcttgcagtgagccgagatcccgccactgcactccagcctgggcgacagagcgagactccgtctcaaaaaaaaaaaaaaaaaaaaaaaaatttaaatatacacatacactagacaatggcataattgggaaatggcataaatgagaaaatgtggtttagaatatta

SEQ ID NO: 55371 - DNA, 201 bp, Homo sapiens
aacttcaagtacattcagtaacttggctggagaggtatagggtgacttaactgtgtgtgtaattctgttattgttgctgttgttgtacaggcaatttgagwaaaagtacgaaaggctgtccacaggcagaggttatgtctctcagaaaagaaaagaaagcgtattagcaggatgtgaattcccgctccatcaagagaactc

SEQ ID NO: 55372 - DNA, 201 bp, Homo sapiens
atttgagttaatcccagtggattttaattaatcccacaggattttaagaatttctaatcatgttcagctagttgaagttacacacacacacacacacacacacacaccacacacacacagaatctagatacagcattaacaatcaactcccttgccacagaattacccatttatccaaagtttcaattattaccaggccat

SEQ ID NO: 55373 - DNA, 201 bp, Homo sapiens
tgctgatttgctccaacctcatacagtttcacacataaggacaatcatctatgtttcatgaaagttctatctactttaacattattttgaagtgattggtkgtggtatgaattaacagtttaaatttaaatcctaaaattcagtgtgaattttttataatagcataaaaattcaaagatgtccatacaagaaaaattaaaa

SEQ ID NO: 55374 - DNA, 201 bp, Homo sapiens
tgagttaatcccagtggattttaattaatcccacaggattttaagaatttctaatcatgttcagctagttgaagttacacacacacacacacacacacacacaccacacacacacagaatctagatacagcattaacaatcaactcccttgccacagaattacccatttatccaaagtttcaattattaccaggccatttg

SEQ ID NO: 55375 - DNA, 201 bp, Homo sapiens
aattaaaacaaaacagtagaaacccagggaaagatgaattttctttaaatgagtagaagaataattgataaggccaaaaaaagtcagtttctgggataccaaaaaaaaatctaatgactagttcatttgattctggagatagttatcatattctaatccagaaacaatttatccaggaaagaaaggcctatgatttaccat

SEQ ID NO: 55376 - DNA, 201 bp, Homo sapiens
gttaatcccagtggattttaattaatcccacaggattttaagaatttctaatcatgttcagctagttgaagttacacacacacacacacacacacacacaccacacacacacagaatctagatacagcattaacaatcaactcccttgccacagaattacccatttatccaaagtttcaattattaccaggccatttgtct

SEQ ID NO: 55377 - DNA, 201 bp, Homo sapiens
tagcagtcatataaaagaaaaagagatgtgttcatttttctagttctggggaagcaataaaaactaatagaaaggattaaaaaaacttttttcattgtgtytcacagtttatatctatcattcagcctgccaggagggaaaaaaggctctaacaccattttctaagggatccagaggtcaagatcaaaacttgatccattg

SEQ ID NO: 55378 - DNA, 201 bp, Homo sapiens
aaggggaaaatagtatcgaagtaagataatgctaaaatttttattttctttgctattctttgttatattattatacttgatttgtaaatagatctgtgtttgtgtgtgtgtgtgtgtgcgcgtgtagtcatgcattgcttaacaatgggaataagttctgagaaaagcattgttaggcaatttcatcactgtgcaaacatc

SEQ ID NO: 55379 - DNA, 201 bp, Homo sapiens
attgttgctgttgttgtacaggcaatttgagaaaaagtacgaaaggctgtccacaggcagaggttatgtctctcagaaaagaaaagaaagcgtattagcakgatgtgaattcccgctccatcaagagaactcagagatgtgcaaagtggtgtttgcccctcagccggatagtacttccagcggatggttttgaaactgacc

SEQ ID NO: 55380 - DNA, 201 bp, Homo sapiens
aggggaaaatagtatcgaagtaagataatgctaaaatttttattttctttgctattctttgttatattattatacttgatttgtaaatagatctgtgtttgtgtgtgtgtgtgtgtgcgcgtgtagtcatgcattgcttaacaatgggaataagttctgagaaaagcattgttaggcaatttcatcactgtgcaaacatca

SEQ ID NO: 55381 - DNA, 201 bp, Homo sapiens
tgtcatttcaaatgtcaaacagcagggtattaggcttagttaaatttgccttcgttttctagttggatgtaggcaattcctggaacttgtatacagttggygtctctgtaaccgctggttcctcatcaaattcaaccaacctcagatcaaaaatatttggaaaaaaaacaccaaacaataaaatatagcaaaacgacagta

SEQ ID NO: 55382 - DNA, 201 bp, Homo sapiens
ataatgcctcaaacaaccccttcatcccatgcagccatattttgtcctatatcaaatgtctctttaagtatccttagagctatctcctaatgtgtcctgarcatggcactgagaatctcatgcttccatcaaagagtgtccttcagactgaaagtagcttcatgccgcaaccgtacttttttaatacacctggttgtaaac

SEQ ID NO: 55383 - DNA, 201 bp, Homo sapiens
atcctgctgtctattggggagcttccccaagaaatgaataaatacatgctcgccattgttcaagacatcctacgttttgaaatgcctgcaaggtataatayattgcacatgtctctctgtgtattcaagcttatttgtgtgttcatggggtaccgatgtagctaataataatgatgtggtcattatgcagggttacgttgc

SEQ ID NO: 55384 - DNA, 201 bp, Homo sapiens
tttatttctcaggctatgcctaatgtgcataaggaagtatgtggtctgaagttcactacagtcatggaagaaagagatggagaaagccaccagctcttaayggcctcagcctagaagtgatcctcatagattctatccatggcgtattagccagaactagtcacgtggcccccaccaaatcacaaaggaatctgggaaatg

SEQ ID NO: 55385 - DNA, 201 bp, Homo sapiens
cattgattatataaaagtaaacgagtcagttgtattttcagagaataaaagattgtgctttatagttaaactattaagctgtcactaacttacattaagtkatatctagaatgaacctccacaaatgcattttaaaaaccccaaccttctaatggttgaaatgcagtgaccaccaacccacccacatgattaattggtttg

SEQ ID NO: 55386 - DNA, 201 bp, Homo sapiens
aaacattacttcatataactacctttccccagagccccatgccatgtagtatccttaaaattctatattagttaggtaacaccaggttatgctgcaataamaaatgtccctcaaaatctcagcaatgtgttaaaagtttatttctgagccaggcatggtggctcacgcctgtaatcccaacactttggaaggccgaggcgg

SEQ ID NO: 55387 - DNA, 201 bp, Homo sapiens
atacttctccactcttccccatatcatccattctccccaaccccatgtatgtgtgtgtgtgtgtgtgtgtgtatgtgtgtgtctgtgtgtttgtgtgtgcytgtagcctaatttcagaggttatgaatcctgtggatgaattagatcttaaaaccctttatttttaaaaaatttttcagcctagactctgtcatacaaaga

SEQ ID NO: 55388 - DNA, 201 bp, Homo sapiens; identical to SEQ ID NO: 16058

SEQ ID NO: 55389 - DNA, 201 bp, Homo sapiens; identical to SEQ ID NO: 16059

SEQ ID NO: 55390 - DNA, 201 bp, Homo sapiens
atttaccaaattgtgagttcccactgctatctctaattctaattctaattcaacactacagggttattttttccctcatttcatcattctattttccttcycccactgtgacaactgtggttttcgagaacaccaatatattgattcacctgctcaattctaaaacatacacaatatatttttggaattgccatactgata

SEQ ID NO: 55391 - DNA, 201 bp, Homo sapiens
gcccaagattgatgtctggaaagcaggctgcagccataatcaaagcagttgattcaaagtacacggccattcccattgtggggcaggtcttccagagccastgtaaaggatgtccttctgtaagtgcagacaaatatgggaataatcatgacatcagactctgttttcattttgtctccagtgaaagcatcaactcattca

SEQ ID NO: 55392 - DNA, 201 bp, Homo sapiens
gcttgggtattaacttattaagttctggcagaaattaaatttattatttttatattagggaagcatgacttcttatatttttcaatttccataattatttkagtagctgatttacttcagctatttgtgtattaaatatcttggcaaaagataaaacccacatatcaaaagatctattcagcagtatttaatgagcatcta

SEQ ID NO: 55393 - DNA, 201 bp, Homo sapiens
cctaggagaacaccctttgtaaatgtggatgttcacagttatgagtggggtatgagcctgcagtgtatgttttgcagctctcggagctctggcggtccacmaggaaatacctgcagcctgacaacctttccaaggctgaggctgtcagaaacttcctggccttcattcagcacctcaggactgcgaagaaagaagagatcc

SEQ ID NO: 55394 - DNA, 201 bp, Homo sapiens
tgcaaacttaaattttcaaatcttttaatataattgttgctccagaaagacttcataatgagctttcagttacctctggagatatcacagtttgaaagacrtggctatatacaacttgaataaattactatcttgtttgccaaaagaatggcaattagtatcttgttcactcaaaagaatgattataatatagcatttccc

SEQ ID NO: 55395 - DNA, 201 bp, Homo sapiens
ctatagcctttcagaacttactaggataaaagctacagtcctgtgacagtctgaatggcagctagacaagtgcacaaccagtactatgccacatgtttctkttttatgtttgtcttttgcttatgttttgacctcccggcatcctaattccttattttcactgaatttgtacttgaaaaaatgtaaacctacagaaaagtt

SEQ ID NO: 55396 - DNA, 201 bp, Homo sapiens
caaatgcattttaaaaaccccaaccttctaatggttgaaatgcagtgaccaccaacccacccacatgattaattggtttggttccacatttgccttgggcsagagctcttagaatgtttctctgtccgcattctctgcttaaatccagctgggcttgcctgttactcaaaaggagagtgctcccaaggtggggcttctgga

SEQ ID NO: 55397 - DNA, 201 bp, Homo sapiens
atttttctggaaatctttatagtggaatgaagtatttatttattgatgaaaggcattattaaaaggtaaatttctcatcaaattataagggattacaaacrtaatgtaacaaagcaagtcatcaaagcatgattggatgaattcaggaaaggagacaaattatgagactgaaatgatccaactgagattagtaatattgat

SEQ ID NO: 55398 - DNA, 201 bp, Homo sapiens
tgatgaaaggcattattaaaaggtaaatttctcatcaaattataagggattacaaacataatgtaacaaagcaagtcatcaaagcatgattggatgaattyaggaaaggagacaaattatgagactgaaatgatccaactgagattagtaatattgatttgttatgagattatcgatatctggctaaagtacaaggttaaa

SEQ ID NO: 55399 - DNA, 201 bp, Homo sapiens
tactgtccctatgaaaaatactattgagttcatgttgaacttgactattaactcagtgtcatttcaaatgtcaaacagcagggtattaggcttagttaaabttgccttcgttttctagttggatgtaggcaattcctggaacttgtatacagttggcgtctctgtaaccgctggttcctcatcaaattcaaccaacctcag

SEQ ID NO: 55400 - DNA, 201 bp, Homo sapiens
ggggaaaatagtatcgaagtaagataatgctaaaatttttattttctttgctattctttgttatattattatacttgatttgtaaatagatctgtgtttgtgtgtgtgtgtgtgtgcgcgtgtagtcatgcattgcttaacaatgggaataagttctgagaaaagcattgttaggcaatttcatcactgtgcaaacatcat

SEQ ID NO: 55401 - DNA, 201 bp, Homo sapiens
aaaagaaaaagagatgtgttcatttttctagttctggggaagcaataaaaactaatagaaaggattaaaaaaacttttttcattgtgtttcacagtttatrtctatcattcagcctgccaggagggaaaaaaggctctaacaccattttctaagggatccagaggtcaagatcaaaacttgatccattgcagtgggtcagt

SEQ ID NO: 55402 - DNA, 201 bp, Homo sapiens
gggaaaatagtatcgaagtaagataatgctaaaatttttattttctttgctattctttgttatattattatacttgatttgtaaatagatctgtgtttgtgtgtgtgtgtgtgtgcgcgtgtagtcatgcattgcttaacaatgggaataagttctgagaaaagcattgttaggcaatttcatcactgtgcaaacatcata

SEQ ID NO: 55403 - DNA, 201 bp, Homo sapiens
taataacacatagtttaaaacacattgtataggtgtacaaaaaatattttttctttaaatctttataagcttttttctatttttaaattttttatttttatttttttcttttaaaaatttctggttaaaaattaagacataagcatatatattagcctcggcctacacaaggtcaggatcatcaatatcactgtcttcctc

SEQ ID NO: 55404 - DNA, 201 bp, Homo sapiens
agacaaattatgagactgaaatgatccaactgagattagtaatattgatttgttatgagattatcgatatctggctaaagtacaaggttaaagattttaaragggtatgacaagtctaaagtagagtttttttaaagcctttagaaattattttaaaactatgacatggaaaagccttttatatattaaaataatgattga

SEQ ID NO: 55405 - DNA, 201 bp, Homo sapiens
ctatttcagacacagttaagctctggaaccaccaatgaggtacttaccaatattaataaggattcagcatctcaataaaatttgtaaggatttctacttayacaatttcagtagaagagttactactaaggtaatgctcagaaaaggtgacttgtgtagtgaagtcgcatttgcctatgaaacaattgccatttatcccaa

SEQ ID NO: 55406 - DNA, 201 bp, Homo sapiens
ctttccttctattgggagccttttgttaatacttctccactcttccccatatcatccattctccccaaccccatgtatgtgtgtgtgtgtgtgtgtgtgtrtgtgtgtgtctgtgtgtttgtgtgtgcttgtagcctaatttcagaggttatgaatcctgtggatgaattagatcttaaaaccctttatttttaaaaaatt

SEQ ID NO: 55407 - DNA, 201 bp, Homo sapiens
cagtaattgcttattagtttctgaaattgagttagaggaaaaaggaaacattttaaaacacaaaatcatcattttcaaacattgtttcttcttttacctgttttttttttcatatgtcatttaatgttctaatgtaattttctaatgctgtatgagatggaaattatttaggaaggtggctaataaaactaaacttttctt

SEQ ID NO: 55408 - DNA, 201 bp, Homo sapiens
tgtttgagtgagagagaggggcgttcaaggagaaaattaaaataaaatggggaggggtctttttgagaaagtcttaatcattttttcatttgttcaaattaaaaaaaaaatcacttcttgagaaaactcaaaccaatagaaactctgtgaatggtagagatttttaagtattccttcccctaaacattgatatccatgatt

SEQ ID NO: 55409 - DNA, 201 bp, Homo sapiens
ttgttaatacttctccactcttccccatatcatccattctccccaaccccatgtatgtgtgtgtgtgtgtgtgtgtgtatgtgtgtgtctgtgtgtttgtktgtgcttgtagcctaatttcagaggttatgaatcctgtggatgaattagatcttaaaaccctttatttttaaaaaatttttcagcctagactctgtcata

SEQ ID NO: 55410 - DNA, 201 bp, Homo sapiens
taagaaaccatggactccagagtcagaaaaacctaggtttcaatcccagcaatgccatttaccatttaccagctatatgaccttgaacaaatgactaggtrtatctgcgtctgtttcctagcatgtacaggggaatattaatattaaactgacagagatgttcagtggattaaatgaggtggtagtattagtaacagctaa

SEQ ID NO: 55411 - DNA, 201 bp, Homo sapiens
ggggctagccctaatcctgatgctaccacgccagctggcaccaccctggctcttggaaaggcatgaggaaaatttggcttcctcttttttccactgaggattttttttttccaaatttgacttgggaaacagtcattacaatgaatgtgcagctttttttttcctcatatgttgcagcaaaattgtccgtcgagttctgaa

SEQ ID NO: 55412 - DNA, 201 bp, Homo sapiens
ctatggcctattagagacctcaattttcaagccacttctcactagaattcaaatggcccacaaggaatcccaagcattatgcccttgcctttctttttagrtagatatctctggaaattgtaaagtgacctaccaggctcatcaagacaaagtgatcaaaattaaggccttggattcatgcaaaatagcgaggtctggatt

SEQ ID NO: 55413 - DNA, 201 bp, Homo sapiens
ttttttgttcattgaccccatgaatccaatccataaatttccagggttaagaattccctgtaccacaggttaaaaatccctgaaaaggggattaactcttyaattcaaagctagatagcaaatgtgtaagtgtctcaaaagcaaaattctgagtttgcaatctagaaacataaaaatactttaccaagtatgtgtttattt

SEQ ID NO: 55414 - DNA, 201 bp, Homo sapiens
tatgcctttttttatagacctcagctggtggatgctgtcacctctgctcagacctcagactcattagaagccattttggactttttggatttcaaaagtgmcagcagcattatcctccaggagaggtttctctatgcctgtggatttgcttctcatcccaatgaagaactcctgagagccctcattgtaagtcaaatagaa

SEQ ID NO: 55415 - DNA, 201 bp, Homo sapiens
cgagagatgctgttaattagaactatttattaggttgttgcaaaagtaattgtggtttttgccattacttttgtgacaacctaatattatttttaaaaccrcaatagaataacttagtgtgtgtgagaattacctttatctaaatgctactctaaaaaacatagatataagaaatgaataattcagaccttagcaacagca

SEQ ID NO: 55416 - DNA, 201 bp, Homo sapiens
attcatattgatatgctctctgccttcagaaatgacccagtaaatctttagctaagtgcagctggaatttcacttggaatatcttcttaagattacatagytaaaaggcacttgaaaaagagaaaaaaaaggatccattgcttattaaaagtaatgaataatttaaaaactggcagcaagttattactatagagttagaga

SEQ ID NO: 55417 - DNA, 201 bp, Homo sapiens
gctgaatttctaaaaaacttttttcctccatcataaattaaccttagcttactgtaatatttttacgttaaaaactttttaatttttgttaacttttgaastactctgtaataacacatagtttaaaacacattgtataggtgtacaaaaaatattttttctttaaatctttataagcttttttctatttttaaatttttt

SEQ ID NO: 55418 - DNA, 201 bp, Homo sapiens
gcaacaggatgagttgtcaaaatgtcagcatctgagctataagaaacacttatgggaccaagaggatcaaagaggtcacattagctacaaagttctaatawctttttcctctagttcataggaaagaatctaaataaatatgcactctgggccaaacaaggacataaacctatgctctctctctctttttttttccttttt

SEQ ID NO: 55419 - DNA, 201 bp, Homo sapiens
caattttcaagccacttctcactagaattcaaatggcccacaaggaatcccaagcattatgcccttgcctttctttttaggtagatatctctggaaattgyaaagtgacctaccaggctcatcaagacaaagtgatcaaaattaaggccttggattcatgcaaaatagcgaggtctggatttacgaccccaaatcaggtat

SEQ ID NO: 55420 - DNA, 201 bp, Homo sapiens
ttgtctttgtatcttatcatcctgggggagaaaaaaagtcccctatggcctattagagacctcaattttcaagccacttctcactagaattcaaatggccyacaaggaatcccaagcattatgcccttgcctttctttttaggtagatatctctggaaattgtaaagtgacctaccaggctcatcaagacaaagtgatcaa

SEQ ID NO: 55421 - DNA, 201 bp, Homo sapiens
tttacctgttttttttttcatatgtcatttaatgttctaatgtaattttctaatgctgtatgagatggaaattatttaggaaggtggctaataaaactaawcttttcttatgctctgcactattaatttctctcccatagatattaaacattatgagccatctaagatttttgataattatttcttaattattatagaaaa

SEQ ID NO: 55422 - DNA, 201 bp, Homo sapiens
cgctcacaattatgaccgtttctccaggagtggatcttcttctgcctacactggctacatagaacgtatgtacaccaaaaagaggttctccttccataccycacaacttagcattgctggaactgctattaaattacagttattgtgtgtcatcaggtagtccccgttcggcatctacttacagcctagacattctctact

SEQ ID NO: 55423 - DNA, 201 bp, Homo sapiens
tttttagctgttgcaaatatttaagtttttggccccttgagaagttctagctgcagctcagaagcttcaccattatttacagagcaggcagggagcttgcrtcatgaacattatattgattttatccaggtggttattgaagcccaaggactggaagccttaatcgcagccacccctgacgagggggaggagaaccttgac

SEQ ID NO: 55424 - DNA, 201 bp, Homo sapiens
attgggagccttttgttaatacttctccactcttccccatatcatccattctccccaaccccatgtatgtgtgtgtgtgtgtgtgtgtgtatgtgtgtgtstgtgtgtttgtgtgtgcttgtagcctaatttcagaggttatgaatcctgtggatgaattagatcttaaaaccctttatttttaaaaaatttttcagccta

SEQ ID NO: 55425 - DNA, 201 bp, Homo sapiens
aggccaagatccacatcacaggcctctgctggactgggtggatgaacaagattataattttcaaattaggaagagagaaaaagatgcaaagaaaggaatayttctgaggtgaggcacaccatagctttcatttggaaacaatcatgtttggagtacacatacagaactctcatattttggtcccatagttcacaggcatag

SEQ ID NO: 55426 - DNA, 201 bp, Homo sapiens
agttcataatctttatggaaaatgtacccattcagaatctgataaaagtgatgaggcccctttttactcatacataaaattttataaccctcacccctcctttttttttttttttttttgttcattgaccccatgaatccaatccataaatttccagggttaagaattccctgtaccacaggttaaaaatccctgaaaagg

SEQ ID NO: 55427 - DNA, 201 bp, Homo sapiens
aaacaaaacagtagaaacccagggaaagatgaattttctttaaatgagtagaagaataattgataaggccaaaaaaagtcagtttctgggataccaaaaaraaatctaatgactagttcatttgattctggagatagttatcatattctaatccagaaacaatttatccaggaaagaaaggcctatgatttaccataggag

SEQ ID NO: 55428 - DNA, 201 bp, Homo sapiens
ccttttgttaatacttctccactcttccccatatcatccattctccccaaccccatgtatgtgtgtgtgtgtgtgtgtgtgtatgtgtgtgtctgtgtgtktgtgtgtgcttgtagcctaatttcagaggttatgaatcctgtggatgaattagatcttaaaaccctttatttttaaaaaatttttcagcctagactctgt

SEQ ID NO: 55429 - DNA, 201 bp, Homo sapiens
agagatactctgatgaagacagatataggaagttttttttaacagctttctttctgttactccagatgaaggatgtaaatgttgaaaatgtgaatcagcasagaggagagaagagcatcttcaaaggaaaaagcccatctaaaataatgggaaaggaaaacttggaagctctgcaaagacctacgctccttcatctaatcc

SEQ ID NO: 55430 - DNA, 201 bp, Homo sapiens
ttttgttaatacttctccactcttccccatatcatccattctccccaaccccatgtatgtgtgtgtgtgtgtgtgtgtgtatgtgtgtgtctgtgtgtttrtgtgtgcttgtagcctaatttcagaggttatgaatcctgtggatgaattagatcttaaaaccctttatttttaaaaaatttttcagcctagactctgtca

SEQ ID NO: 55431 - DNA, 201 bp, Homo sapiens
tgcctgacacttatttaaatctgataaatgatgcatttttgcttcatttgtgttctgttcccctctccccaccaggtcaaagagttctactcatatcaaartgaggcagtggccatagaaaatatcaagagaggcctggctagcctatttcagacacagttaagctctggaaccaccaatgaggtacttaccaatattaat

SEQ ID NO: 55432 - DNA, 201 bp, Homo sapiens
tggtacttatcatgagcttctcctgttttcccattttataaactagaacattgggtgacctcatgttttcaaatatacttataaaaaatttaaggccgggygtggtggctcacgcctgtaatcccagcactttgggaggccgaggcgggcggatcacgaggtcaggagatcgagaccatcccggctaaaacggtgaaaccc

SEQ ID NO: 55433 - DNA, 201 bp, Homo sapiens
catcccggctaaaacggtgaaaccccgtctctactaaaaatacaaaaaattagccgggcgtagtggcgggcgcctgtagtcccagctacttgggaggctgmggcaggagaatggcgtgaacccgggaggcggagcttgcagtgagccgagatcccgccactgcactccagcctgggcgacagagcgagactccgtctcaaa

SEQ ID NO: 55434 - DNA, 201 bp, Homo sapiens
aacatttgagtgaaagtgggcagatacatattttttactaaaaggaaaccactcactattcaggtcacacaaaagcataatcacatacacacacacacacmccccccacacacaccccattgttaagctaggtcaacagtaaatgaatgaatgaatgaatgaatgaatgaatgaacaaatggacaagcaaacagcagaatt

SEQ ID NO: 55435 - DNA, 201 bp, Homo sapiens
taatagccaacacttaaacttacacttaacagcgtgataggtattgttccaaacacattaaattcatttaatggtccttacatgtctatgtatttggtgaytattatccttattattcacattgctgagtgtattattctgttctcatgatgctgatagagacatacccgagactggataacttattaaaaaaaaaaaggt

SEQ ID NO: 55436 - DNA, 201 bp, Homo sapiens
tgtctcaaaaaaagaacctactagtctacataccacacttcctcatccccatctgagactatatatattttttctaacatgaggcaatgccaaaaagaggrgctggtgagtgaaagtaagaacagaaagacatggaggcaagtcttatagaataatagccaacacttaaacttacacttaacagcgtgataggtattgttc

SEQ ID NO: 55437 - DNA, 201 bp, Homo sapiens
gaaagttgagaatctgaatacagatttaattaacactctctttgcttgtgaaccccttgggaagtcagccttatcctggtttgaagaattccacttcagcrtttggaatggtgcattttgaaatgtgataggaagaacagcttgtgacacaacacaattcagagaaagcagtggggttaggttcgcaccaaagggttatcg

SEQ ID NO: 55438 - DNA, 201 bp, Homo sapiens
tatgaagggagtgaaaagcagttattccagattagccttaactctgttaacgcttcttttaattgggaggtctctgaatggaaacattttctcacaacagkcatagcatcacttcctactccaggggtgcaatgtccagccctcaccactcctgggcagggaaccatgtactgtaggcatcatccgggaacctttggtttt

SEQ ID NO: 55439 - DNA, 201 bp, Homo sapiens
tcactctgcattttgtgcaaataaacagctgtaaatcataacgttatgatactctcagtgtttaatcataggtcctgcagagatcagcagcttataagaayacaaaatatgcctacttaccaaagtcaagattcagaagctcccagatgaaaagttctaggcttatgagataactctactctctgggacacattaactggt

SEQ ID NO: 55440 - DNA, 201 bp, Homo sapiens
ttctcacaacaggcatagcatcacttcctactccaggggtgcaatgtccagccctcaccactcctgggcagggaaccatgtactgtaggcatcatccgggracctttggttttaataccacttgttactttggctgcaacgctggattcacactcataggagacagcactctcagctgcagaccttcaggacaatggacag

SEQ ID NO: 55441 - DNA, 201 bp, Homo sapiens
ttctgacactcgtggagaattcaatgttggctccacctgccatttctcttgtgacaacggctttaagctggaggggcccaataatgtggaatgcacaactkctggaagatggtcagctactccaccaacctgcaaaggtaataatatgtacttgctaagacagttctacttttggaaatttattctacaacaacaaacaat

SEQ ID NO: 55442 - DNA, 201 bp, Homo sapiens
caaccacaaccactactccaagtgtcatctcccttatgaaatccacaccaatcccattagaagtaatgtgtcacaggcatttcacttctgtccttcctcaygtcacaagctaaagctaatacacaagtactcagagacttaaaggaagaaacatttgcagatgtccaagatgtgttagaaaaatagacatattaaatgtaa

SEQ ID NO: 55443 - DNA, 201 bp, Homo sapiens
catctttgtaccagtgcagttgcaaaatagaatttttaatatgttagcatggaggaagaagcctacataggcaaagttgcctgaagtctatgaaagtcatratgcagccctggctatatcagaatgaagtctttaaggcaaaacaatgccctggaaatgtcagcaagggaggtacaagcatgactaaccctcatgcaggca

SEQ ID NO: 55444 - DNA, 201 bp, Homo sapiens
tagaagtaatgtgtcacaggcatttcacttctgtccttcctcatgtcacaagctaaagctaatacacaagtactcagagacttaaaggaagaaacatttgyagatgtccaagatgtgttagaaaaatagacatattaaatgtaaaacctgctatagaaattggtaaactagaagttgcatattatgtgacagtataaacat

SEQ ID NO: 55445 - DNA, 201 bp, Homo sapiens
ttttgtgtattaatgttctggtcggaaattcatctgagtatgcagaagcatacttgggatcacggcctcttttttggtgaggggtactaacctggcactcmctctcctttactctagaactaacaaaccagaaagaagtggcagcatggacttatcattacagcacaaaagcatactcatggaatatttcccgtaaatact

SEQ ID NO: 55446 - DNA, 201 bp, Homo sapiens
gttgcatattatgtgacagtataaacattccatattttcataataatttgaacctaaataaaaagttaagccatacatgatatttcctgaagagctatcgycctacacataaagcattgagacctatgtttctttcatttttgtatcccccacaaaacatagcacagtgctttgcaaatgtcactactgataaataacatt

SEQ ID NO: 55447 - DNA, 201 bp, Homo sapiens
aaagttgtaattctgggagattatgaaaaagttatttttgtgaaaatgttcacagatgacttcatgtctaggagttacaccagtagacatgtttcaaaaakgtttagtaaattgatttgatgtgtcagatatgaagttgttaattactcaacaatttgagagtactgaactgaaattcactgtgttattttggctatttga

SEQ ID NO: 55448 - DNA, 201 bp, Homo sapiens
attgagacctatgtttctttcatttttgtatcccccacaaaacatagcacagtgctttgcaaatgtcactactgataaataacatttatttgaattaaatytaatttcttgacctttaatttcctatccataaattagaaagaataaccctgaagttccctgaaaatgtagtttaaggaggatgacagtctacttctttca

SEQ ID NO: 55449 - DNA, 201 bp, Homo sapiens
ctgtacattggttttccatgagggagcatataggtcttgaagaggtttgtaaaaatcaaactatctaagtaaatgagacttatctgaccaaggtattgttktcagaatagccttagatttaaagaaagaatagtcacttcatttgtctataacccaacatttattgataaataatagtcttatattagagaattaatgggg

SEQ ID NO: 55450 - DNA, 201 bp, Homo sapiens
acagtgctttgcaaatgtcactactgataaataacatttatttgaattaaatctaatttcttgacctttaatttcctatccataaattagaaagaataacsctgaagttccctgaaaatgtagtttaaggaggatgacagtctacttctttcaaacttccagtgtccagatatgctgaacacttattaagtatttcaataa

SEQ ID NO: 55451 - DNA, 201 bp, Homo sapiens
gatggcaccagaggctgcagaaggccaagaatcaagctagaaggccacatgtcaccgtggaccttcctgccaccagtcactgtccctcaaatgacccaaasaccaatattcaaatgcgtaattaaaagaattttccccaaatgccgtgttcctctattttatggtttgttcagtaaggtctgtatacatcacattgtttac

SEQ ID NO: 55452 - DNA, 201 bp, Homo sapiens
cgtatatctcactataataaaaaattgaacagcaaaaaaaaaaaaaaagaaaaaacaagaaggcaatagaatagatggctatacaccatgatgctgacacytagtctgagttatggaatgtattgtatatgttatctgggagaaaaagacacaatgagctctttgacacacttaaaacggatcataagggattattcaagc

SEQ ID NO: 55453 - DNA, 201 bp, Homo sapiens
gagtgtaatggcacaatctcggcccactgcaacctccgcctcccgggttcaagcaattctcctgtctcagcttcccgagtagctgggactacaggtgcccrccactgcacccagctaatttttgtatttttggtagagatgaggtttcaccatcttagctaggctggtctcaaactcctgacctcaggtgatctgcctgac

SEQ ID NO: 55454 - DNA, 201 bp, Homo sapiens
cactttggccaggctggtctcaaactcccgacctcaagtgattcactcacatcagcctctcaaagtgctgggattataggtgtgagccattgtgctcagcyggatttttggttcttaaatgctctgagtctgtaaaaaccagaggtcaaagcccagagcaaagaggtagtctttacactttgaaaagtttcagaaatagcc

SEQ ID NO: 55455 - DNA, 201 bp, Homo sapiens
gagtgaaagtgggcagatacatattttttactaaaaggaaaccactcactattcaggtcacacaaaagcataatcacatacacacacacacaccccccccmcacacaccccattgttaagctaggtcaacagtaaatgaatgaatgaatgaatgaatgaatgaatgaacaaatggacaagcaaacagcagaattgaatgtc

SEQ ID NO: 55456 - DNA, 201 bp, Homo sapiens
gaaatagctttttcttcttcctttaatgctcttcttcctgcttctcactggctggtttcttgcagtcattcttctctccacttaaacattatctcattaawgaggtcttccctgacgttcctgaccaacatagtgacacagtcattctatcacataagtttcatttcctacctagcacttatggctatattctgttaatat

SEQ ID NO: 55457 - DNA, 201 bp, Homo sapiens
gtttgtttgtttgttttgagacagagtctcactctgtcgcccaggctgaagtgcagtggcacgatctcagctcactgcaacctctgcctcccaggttcaarcgattctcctgcctcagcctcccgaatagctaggattacaggcaactttttgtatttttaatagagactagggtttcaccactttggccaggctggtctc

SEQ ID NO: 55458 - DNA, 201 bp, Homo sapiens
ttgagtgaaagtgggcagatacatattttttactaaaaggaaaccactcactattcaggtcacacaaaagcataatcacatacacacacacacaccccccmcacacacaccccattgttaagctaggtcaacagtaaatgaatgaatgaatgaatgaatgaatgaatgaacaaatggacaagcaaacagcagaattgaatg

SEQ ID NO: 55459 - DNA, 201 bp, Homo sapiens
tcttaatacctataccaatatttcgaatcatctctggcatacgaatgtatttatatccaaaggcaaagctctggaataaataagaaattagtaaaaggtayaatttttctcttataaagtgggagaaaggtgtattttaggcagattgtttttaagaaagtatatatgtgaaagttgagaatctgaatacagatttaatta

SEQ ID NO: 55460 - DNA, 201 bp, Homo sapiens
tttgtttgtttgtttgtttgttttgagacagagtctcactctgtcgcccaggctgaagtgcagtggcacgatctcagctcactgcaacctctgcctcccargttcaaacgattctcctgcctcagcctcccgaatagctaggattacaggcaactttttgtatttttaatagagactagggtttcaccactttggccaggc

SEQ ID NO: 55461 - DNA, 201 bp, Homo sapiens
gtttgtttgtttgtttgtttgtttgtttgttttgagacagagtctcactctgtcgcccaggctgaagtgcagtggcacgatctcagctcactgcaacctcygcctcccaggttcaaacgattctcctgcctcagcctcccgaatagctaggattacaggcaactttttgtatttttaatagagactagggtttcaccactt

SEQ ID NO: 55462 - DNA, 201 bp, Homo sapiens
gtttttgtttgtttgtttgtttgtttgtttgtttgtttgttttgagacagagtctcactctgtcgcccaggctgaagtgcagtggcacgatctcagctcastgcaacctctgcctcccaggttcaaacgattctcctgcctcagcctcccgaatagctaggattacaggcaactttttgtatttttaatagagactagggt

SEQ ID NO: 55463 - DNA, 201 bp, Homo sapiens
tagaggattttggtgtttttgtttgtttgtttgtttgtttgtttgtttgtttgttttgagacagagtctcactctgtcgcccaggctgaagtgcagtggcrcgatctcagctcactgcaacctctgcctcccaggttcaaacgattctcctgcctcagcctcccgaatagctaggattacaggcaactttttgtattttta

SEQ ID NO: 55464 - DNA, 201 bp, Homo sapiens
agagagaaacactagaggattttggtgtttttgtttgtttgtttgtttgtttgtttgtttgtttgttttgagacagagtctcactctgtcgcccaggctgragtgcagtggcacgatctcagctcactgcaacctctgcctcccaggttcaaacgattctcctgcctcagcctcccgaatagctaggattacaggcaactt

SEQ ID NO: 55465 - DNA, 201 bp, Homo sapiens
tttcttgcctaaaacataagagagaagagagaaacactagaggattttggtgtttttgtttgtttgtttgtttgtttgtttgtttgtttgttttgagacasagtctcactctgtcgcccaggctgaagtgcagtggcacgatctcagctcactgcaacctctgcctcccaggttcaaacgattctcctgcctcagcctccc

SEQ ID NO: 55466 - DNA, 201 bp, Homo sapiens
aataaacaaaacaattagtgaggagattcaaatggaagaaatagtttgaggcagaaagcaatcattgcagttttaggtgtgttgaatttgagaagatggcrtgatatatgggagcaagtagtctcaggcaagaggaagggcggaaatgaaatcctggattgcacccattcaagtaagatagagggagctgcggcaggctac

SEQ ID NO: 55467 - DNA, 201 bp, Homo sapiens
tatgtaagatccaccttgaaatggactggaaaattcataaatactctcactcatcctcttgtcctataacccaaggatcccaaatgcaaatgcctccgggrgataggcagattacacaagtgtcaggatgtctggccatagacagtagggcatggcccttgctaactccttatcagggtctttacccagacctgaaggctc

SEQ ID NO: 55468 - DNA, 201 bp, Homo sapiens
catctgcactgagcattggcatgcctttctttatcagatattcactgagaacctactatgggccatgtcctttgtgcttgggaccagggatgagatgaaayggtgcgtgaagccagtcttaggcacatgtccactatagtatagtcaaggtgaggtttgcactgattgacacatatagggtgcattggaatgaagaagatg

SEQ ID NO: 55469 - DNA, 201 bp, Homo sapiens
tcgaatcatctctggcatacgaatgtatttatatccaaaggcaaagctctggaataaataagaaattagtaaaaggtataatttttctcttataaagtggragaaaggtgtattttaggcagattgtttttaagaaagtatatatgtgaaagttgagaatctgaatacagatttaattaacactctctttgcttgtgaacc

SEQ ID NO: 55470 - DNA, 201 bp, Homo sapiens
tatcctggtttgaagaattccacttcagcatttggaatggtgcattttgaaatgtgataggaagaacagcttgtgacacaacacaattcagagaaagcagyggggttaggttcgcaccaaagggttatcgatcactctgcattttgtgcaaataaacagctgtaaatcataacgttatgatactctcagtgtttaatcata

SEQ ID NO: 55471 - DNA, 201 bp, Homo sapiens
aactgccaaatagccatcttgtaccagagattccagagagtggtctttggaatttcccaactcctttgcttcagtgccctgatctctggtaaactttatgytaacttttcacttaggcctaagtaattagggtagagcccagatctatgtgtgagaaatttaaggattgtagccagttggtttgaggcatgggaaaactgt

SEQ ID NO: 55472 - DNA, 201 bp, Homo sapiens
tttaaataaacaggaaagaaacccatttccaggcctgattgcttgctttgtacacctcttcatgtgggaaatggcctctcctgccccgggtggactcccayagactatgataagagtgctgtagtacctttatacttttgaaacgcacattctttagttcatttggtatcaaaaacacttgtgaaaaagggctgttctgag

SEQ ID NO: 55473 - DNA, 201 bp, Homo sapiens
aaaagttgaagaattcagaggagaagagttcaggctgtggtgatcagcagagtcttcagagactttacgagttaaatcctggaggattagtgggattttaygccataaaagtggaaaaattctcaggggaatgtgagccaagaaccagaagcaataacacacaaagtcacttcagggaattccaagaaactaatctatctt

SEQ ID NO: 55474 - DNA, 201 bp, Homo sapiens
aagttgaagaattcagaggagaagagttcaggctgtggtgatcagcagagtcttcagagactttacgagttaaatcctggaggattagtgggattttacgycataaaagtggaaaaattctcaggggaatgtgagccaagaaccagaagcaataacacacaaagtcacttcagggaattccaagaaactaatctatcttga

SEQ ID NO: 55475 - DNA, 201 bp, Homo sapiens
aacacttctgaacctcacttttcttgcctaaaacataagagagaagagagaaacactagaggattttggtgtttttgtttgtttgtttgtttgtttgtttrtttgtttgttttgagacagagtctcactctgtcgcccaggctgaagtgcagtggcacgatctcagctcactgcaacctctgcctcccaggttcaaacgat

SEQ ID NO: 55476 - DNA, 201 bp, Homo sapiens
tgaagaattcagaggagaagagttcaggctgtggtgatcagcagagtcttcagagactttacgagttaaatcctggaggattagtgggattttacgccatraaagtggaaaaattctcaggggaatgtgagccaagaaccagaagcaataacacacaaagtcacttcagggaattccaagaaactaatctatcttgaccag

SEQ ID NO: 55477 - DNA, 201 bp, Homo sapiens
cattcaagtaagatagagggagctgcggcaggctacgaggtctctgaagcagagggtgtagagaaaatagggtgacattgtaagttcttgagtatggctgyctaaatctttgacttctttgtcttcgtgacttgtacctatactcttctctgtaagcttaccatcctcccactgccctttgcagcaaatgacctacatgat

SEQ ID NO: 55478 - DNA, 201 bp, Homo sapiens
ccatgtatatttggctttctgctgaatttcttatatttctgtaccatttcttgcttctttttaaaatagcaacaacaatgactcctctgatttcttctctkggccaggagaatcatctcctcaaggatgatttttaataattttcctcatctggttttctatctctgacactgatagtttttcttaacttccttaaatagc

SEQ ID NO: 55479 - DNA, 201 bp, Homo sapiens
tctgtccttcctcatgtcacaagctaaagctaatacacaagtactcagagacttaaaggaagaaacatttgcagatgtccaagatgtgttagaaaaatagrcatattaaatgtaaaacctgctatagaaattggtaaactagaagttgcatattatgtgacagtataaacattccatattttcataataatttgaacctaa

SEQ ID NO: 55480 - DNA, 201 bp, Homo sapiens
tattgttgtcagaatagccttagatttaaagaaagaatagtcacttcatttgtctataacccaacatttattgataaataatagtcttatattagagaatyaatggggagaaaagaataatgctaagaaaatatgtaactgcaataatttgtaaaaatacttttggggggaaattgtgaattaaaatttaaattcatttat

SEQ ID NO: 55481 - DNA, 201 bp, Homo sapiens
ataggtcttgaagaggtttgtaaaaatcaaactatctaagtaaatgagacttatctgaccaaggtattgttgtcagaatagccttagatttaaagaaagawtagtcacttcatttgtctataacccaacatttattgataaataatagtcttatattagagaattaatggggagaaaagaataatgctaagaaaatatgta

SEQ ID NO: 55482 - DNA, 201 bp, Homo sapiens
taatgtacttttagtagagacagggtttcactatgttggccaggctggtcttgaattcctgacctcatgatccgcccacctcagcctcccaaagtgctggsattacaggcatgagccactgtgcctggccccaaaaacattttaaaaatattcatagatttgatgaaatcccaacagaagagagttcatgagaaataatag

SEQ ID NO: 55483 - DNA, 201 bp, Homo sapiens
aaataatattttaatagctttagttaaatattccacagtttcaagaacatcctggccaacatggtgaaaccccgtttctactaaaaatacaaaaaatagcygggcatggtggtgcatgcctgtagtcccagctactcgggaggctgaggcaggagaatcgcttgaacccaggaggtggaggttgcagtgagctgagattgt

SEQ ID NO: 55484 - DNA, 201 bp, Homo sapiens
tatattccccaagctttttccccctcaatgtatccaattccttagttaacttttatagacaatgctgctttttaaacgcaagattttcatttataaaaathtgcagaaatataataaagaaatgaagaaatatcctcttaaatactcctatcctaaaatagacactgttaggcttctggtatgaattcttccaatattttc

SEQ ID NO: 55485 - DNA, 201 bp, Homo sapiens
atgaagcatcatgaaattcaaacaatcacttttagccaaataccatcgttgtatattaatcacacacacacacacacacacacacacacacacacacacasagagagagagagggagaaagagagagagagttacagagttcaggttgctgaattataaaatgatctcttcttttctcctctgccatgcccatgatagcca

SEQ ID NO: 55486 - DNA, 201 bp, Homo sapiens
tgatgaagcatcatgaaattcaaacaatcacttttagccaaataccatcgttgtatattaatcacacacacacacacacacacacacacacacacacacasacagagagagagagggagaaagagagagagagttacagagttcaggttgctgaattataaaatgatctcttcttttctcctctgccatgcccatgatagc

SEQ ID NO: 55487 - DNA, 201 bp, Homo sapiens
aggcttggtcatgtcgcatgctttatcatccaaaacagcaatgcagcatgggatttagaagcctggaggttaatgaaggttaaaaaaaaaaaaaaaaaaaagtacagtggaaagagctctttcttgtttcaaagtcaagctctgctactgtcattctgaacgtgttatttagatgccccaagcttcagtattttcatgtgc

SEQ ID NO: 55488 - DNA, 201 bp, Homo sapiens
tgataaataacatttatttgaattaaatctaatttcttgacctttaatttcctatccataaattagaaagaataaccctgaagttccctgaaaatgtagtytaaggaggatgacagtctacttctttcaaacttccagtgtccagatatgctgaacacttattaagtatttcaataaacacatactgacatgccagttgat

SEQ ID NO: 55489 - DNA, 201 bp, Homo sapiens
atttcaataaacacatactgacatgccagttgatcacaaatgtagtaataacatttagactaacagtattttaagaaccaaaattttgtaaatagtatatktggaggcaagatttatcaatgcattagcaggtatttgtcggatgctactatgtgtccatctttgcatcttggttctttggatatcacccttcgagagaat

SEQ ID NO: 55490 - DNA, 201 bp, Homo sapiens
aatttttttttaatgtacttttagtagagacagggtttcactatgttggccaggctggtcttgaattcctgacctcatgatccgcccacctcagcctcccraagtgctgggattacaggcatgagccactgtgcctggccccaaaaacattttaaaaatattcatagatttgatgaaatcccaacagaagagagttcatga

SEQ ID NO: 55491 - DNA, 201 bp, Homo sapiens
ctaatttttttttaatgtacttttagtagagacagggtttcactatgttggccaggctggtcttgaattcctgacctcatgatccgcccacctcagcctcycaaagtgctgggattacaggcatgagccactgtgcctggccccaaaaacattttaaaaatattcatagatttgatgaaatcccaacagaagagagttcat

SEQ ID NO: 55492 - DNA, 201 bp, Homo sapiens
agcacccgccaccacacctgtctaatttttttttaatgtacttttagtagagacagggtttcactatgttggccaggctggtcttgaattcctgacctcakgatccgcccacctcagcctcccaaagtgctgggattacaggcatgagccactgtgcctggccccaaaaacattttaaaaatattcatagatttgatgaaa

SEQ ID NO: 55493 - DNA, 201 bp, Homo sapiens
gataactctactctctgggacacattaactggtttgagttgagttctccctggtatctggtcaggctgtagtcaaaagtgcatgaacacatgcacacacaygaccccacactgtcccatgcaccctactgggcgtgacacatacacaaccccacactgtcccatgcaccctacataatccatcactgggcgtgacacacac

SEQ ID NO: 55494 - DNA, 201 bp, Homo sapiens
ttttgcatttttagtagagacgaggttttaccatgttgccaggctgttctcgaactcctgacctcaagtgatctgcccaccttggcctcccaaagtgctgrgattagaggcatgagccactgcaccagcccagttctttattaaagtaaaattaaagataatcatggtacttaatgaaggcttacacaggcacaggatgtt

SEQ ID NO: 55495 - DNA, 201 bp, Homo sapiens
gagtgcagtagtgccatctcagctcactgcaacctctgtctcctgggttcaagcgattctcctgtctcagccttctgagtagctgggattacaggcatgcrccaccatgcccagctaatttttgtattttttagtggagttggtttcgccatgttggcaaggctggtcttgaacttctgacctcaagggatctgcctgcct

SEQ ID NO: 55496 - DNA, 201 bp, Homo sapiens
ggagtgcagtagtgccatctcagctcactgcaacctctgtctcctgggttcaagcgattctcctgtctcagccttctgagtagctgggattacaggcatghgccaccatgcccagctaatttttgtattttttagtggagttggtttcgccatgttggcaaggctggtcttgaacttctgacctcaagggatctgcctgcc

SEQ ID NO: 55497 - DNA, 201 bp, Homo sapiens
ctgggatgggagttatggaagactcaaggatgaatcattcttgggttttagacactttcccatccagtagaagagtgagggtatgacatgggacatgacarcacatcagttcagacaaaaagttgaagaattcagaggagaagagttcaggctgtggtgatcagcagagtcttcagagactttacgagttaaatcctggag

SEQ ID NO: 55498 - DNA, 201 bp, Homo sapiens
tggagtgcagtagtgccatctcagctcactgcaacctctgtctcctgggttcaagcgattctcctgtctcagccttctgagtagctgggattacaggcatrcgccaccatgcccagctaatttttgtattttttagtggagttggtttcgccatgttggcaaggctggtcttgaacttctgacctcaagggatctgcctgc

SEQ ID NO: 55499 - DNA, 201 bp, Homo sapiens
ggctggagtgcagtagtgccatctcagctcactgcaacctctgtctcctgggttcaagcgattctcctgtctcagccttctgagtagctgggattacaggsatgcgccaccatgcccagctaatttttgtattttttagtggagttggtttcgccatgttggcaaggctggtcttgaacttctgacctcaagggatctgcc

SEQ ID NO: 55500 - DNA, 201 bp, Homo sapiens
catctgggctttgctaccaacaagttgtatagttctgcatcctcaacaactctcatattcacctcccctatttgcattcccactgatgccagaccaaaccwgtccctctttaactctcactgggaccattgcaatagcctcttcttttgcagtgcaatctccctgattgtaactcatttaaaaaaaaaaaagtatcgcact

SEQ ID NO: 55501 - DNA, 201 bp, Homo sapiens
agcaggctggagtgcagtagtgccatctcagctcactgcaacctctgtctcctgggttcaagcgattctcctgtctcagccttctgagtagctgggattasaggcatgcgccaccatgcccagctaatttttgtattttttagtggagttggtttcgccatgttggcaaggctggtcttgaacttctgacctcaagggatc

SEQ ID NO: 55502 - DNA, 201 bp, Homo sapiens
atgttggctccacctgccatttctcttgtgacaacggctttaagctggaggggcccaataatgtggaatgcacaacttctggaagatggtcagctactccrccaacctgcaaaggtaataatatgtacttgctaagacagttctacttttggaaatttattctacaacaacaaacaattatctagttcttatatgtgaact

SEQ ID NO: 55503 - DNA, 201 bp, Homo sapiens
acaatgactcctctgatttcttctcttggccaggagaatcatctcctcaaggatgatttttaataattttcctcatctggttttctatctctgacactgayagtttttcttaacttccttaaatagctcttgcaggagcctcccttgttatgaagggagtgaaaagcagttattccagattagccttaactctgttaacgc

SEQ ID NO: 55504 - DNA, 201 bp, Homo sapiens
taggatctcccaatcttcagcaggctggagtgcagtagtgccatctcagctcactgcaacctctgtctcctgggttcaagcgattctcctgtctcagcctyctgagtagctgggattacaggcatgcgccaccatgcccagctaatttttgtattttttagtggagttggtttcgccatgttggcaaggctggtcttgaac

SEQ ID NO: 55505 - DNA, 201 bp, Homo sapiens
tacttctttcaaacttccagtgtccagatatgctgaacacttattaagtatttcaataaacacatactgacatgccagttgatcacaaatgtagtaataayatttagactaacagtattttaagaaccaaaattttgtaaatagtatatttggaggcaagatttatcaatgcattagcaggtatttgtcggatgctactat

SEQ ID NO: 55506 - DNA, 201 bp, Homo sapiens
aaacttcagttatggatcaatctgctctttccattgtctagagggccagttacttaatggctctgcacaaacagcatgccaagagaatggccactggtcamctaccgtgccaacctgccaaggtacaattttcatgtgggttaagaagtcactttgatgtggaaaataacaaaatcagtgtttcttccctgtgtctttctc

SEQ ID NO: 55507 - DNA, 201 bp, Homo sapiens
gacatgccagttgatcacaaatgtagtaataacatttagactaacagtattttaagaaccaaaattttgtaaatagtatatttggaggcaagatttatcawtgcattagcaggtatttgtcggatgctactatgtgtccatctttgcatcttggttctttggatatcacccttcgagagaatattttcatatatgtgctgt

SEQ ID NO: 55508 - DNA, 201 bp, Homo sapiens
gtgatggacaaaatttgtccaaggactcacactattattctgtggttggttttagctgcccagtgcccacccctgaagattcctgaacgaggaaacatgayctgccttcattctgcaaaagcattccagcatcagtctagctgcagcttcagttgtgaagagggatttgcattagttggaccggaagtggtgcaatgcaca

SEQ ID NO: 55509 - DNA, 201 bp, Homo sapiens
aaagagaccaagtagagatggatagcttgggttaaaagtttagaaaattagagttaagagggttacacaaatagttacagctttcagcaaacatgacattsctgttaattctacatggaaaataaaaatcactattttgtctcctgcagtgagagagtgtggagaacttgagctccctcaacacgtgctcatgaactgcag

SEQ ID NO: 55510 - DNA, 201 bp, Homo sapiens
atattccccttataatgagccctcctgaaaatcagtctactggttttccccagtaatttctatccttaatgaccctctctttcatcttgttttttttttttaatcattcattcttgtcttcttgctgattttagatgatgggaaatgccccttgaatcctcacaggtaaggtagaaatgttttatgattgagtaaattttg

SEQ ID NO: 55511 - DNA, 201 bp, Homo sapiens
ttaattctacatggaaaataaaaatcactattttgtctcctgcagtgagagagtgtggagaacttgagctccctcaacacgtgctcatgaactgcagccaycctctgggaaacttctcttttaactcgcagtgcagcttccactgcactgacgggtaccaagtaaatgggcccagcaagctggaatgcttggcttctggaa

SEQ ID NO: 55512 - DNA, 201 bp, Homo sapiens
tcttgcaggagcctcccttgttatgaagggagtgaaaagcagttattccagattagccttaactctgttaacgcttcttttaattgggaggtctctgaatkgaaacattttctcacaacaggcatagcatcacttcctactccaggggtgcaatgtccagccctcaccactcctgggcagggaaccatgtactgtaggcat

SEQ ID NO: 55513 - DNA, 201 bp, Homo sapiens
actgccttggtagtcagtgaaaatagaacactaagcgtgcaataaatgcaaaccttatctgttttctatttttgtaattattcaggagtttttttttttttgccaaagttttagagtaggctcaagaatatgaccacttctcaaagttatgcacaaaagtcattcctgggtataactcttttcctgcatctgcactaatct

SEQ ID NO: 55514 - DNA, 201 bp, Homo sapiens
tacacttcttatgtcttgcatgtgtgtgtgtttgttttgtagcaggaccattgactatccaggaagccctgacttactttggtggagcggtggcttctacrataggtctgataatgggtgggacgctcctggctttgctaagaaagcgtttcagacaaaaaggtaaataggaaagagtcttctctttgcatcttggttaca

SEQ ID NO: 55515 - DNA, 201 bp, Homo sapiens
ccagattagccttaactctgttaacgcttcttttaattgggaggtctctgaatggaaacattttctcacaacaggcatagcatcacttcctactccagggktgcaatgtccagccctcaccactcctgggcagggaaccatgtactgtaggcatcatccgggaacctttggttttaataccacttgttactttggctgcaa

SEQ ID NO: 55516 - DNA, 201 bp, Homo sapiens
agtgcccagaactctttgccccagagcagggcagcctggattgttctgacactcgtggagaattcaatgttggctccacctgccatttctcttgtgacaayggctttaagctggaggggcccaataatgtggaatgcacaacttctggaagatggtcagctactccaccaacctgcaaaggtaataatatgtacttgctaa

SEQ ID NO: 55517 - DNA, 201 bp, Homo sapiens
catcaagtgcccagaactctttgccccagagcagggcagcctggattgttctgacactcgtggagaattcaatgttggctccacctgccatttctcttgtracaacggctttaagctggaggggcccaataatgtggaatgcacaacttctggaagatggtcagctactccaccaacctgcaaaggtaataatatgtactt

SEQ ID NO: 55518 - DNA, 201 bp, Homo sapiens
ttgatactctagccatcaagtgcccagaactctttgccccagagcagggcagcctggattgttctgacactcgtggagaattcaatgttggctccacctgycatttctcttgtgacaacggctttaagctggaggggcccaataatgtggaatgcacaacttctggaagatggtcagctactccaccaacctgcaaaggta

SEQ ID NO: 55519 - DNA, 201 bp, Homo sapiens
tacggtgaggcttcctttttgttgatattattttggttttatgctagagatgatgccaagaagtaaataaatcatgttgaagtctctccagtgagaatagratggtaccagcccccctctatcatctgtctcctccactcagtgtccctagacacacactctaggtaaaaacattttattcttgggagaaaacattgactc

SEQ ID NO: 55520 - DNA, 201 bp, Homo sapiens
gtgtaacatttccattattaactgctaggtggtgatgatgtggccttgcctgcaaagcagaagtcaggactgctgaaaaatgtttacgaactgttatggartcaattccctatgctacctgctggaaaaacaaaaataatctgatgctatccctctcccaaaaagtgggtagttgagtgtcctacaaaaagcctgaatggc

SEQ ID NO: 55521 - DNA, 201 bp, Homo sapiens
tgttttatctaagcttcactgttaggctacatgatgttgggatctggggcctgtcctctggctccgcagctgctgttcctcctactagaatttataggggmtctctgagaatagatcatggtaaacctgtcaccccattttccaagactgtacttctctctgggataaatgatggaataaatggaagactgggtaggtgcc

SEQ ID NO: 55522 - DNA, 201 bp, Homo sapiens
caaataaagccatcgtggtttacagaggctgtgttttatctaagcttcactgttaggctacatgatgttgggatctggggcctgtcctctggctccgcagstgctgttcctcctactagaatttataggggctctctgagaatagatcatggtaaacctgtcaccccattttccaagactgtacttctctctgggataaat

SEQ ID NO: 55523 - DNA, 201 bp, Homo sapiens
gtaagcagtctgggttgggcagaaggcagaaaaccagcagagtcacagaggagatggtgagtttatttttttctgcatgggaagtggttgaagtgagttgragtggtatggagtaaagtcaggcaggtaaaggttcagaaagtgaggaacagcgatagccatggagttttatgttgaattgcctattagattttgtgagta

SEQ ID NO: 55524 - DNA, 201 bp, Homo sapiens
cctcctttttacaatgtcttttgcaatgtcttcttttctactctgaagtaaaatacacagataacaaatattctaattaaaatataaagtaggaataaaaygaaaagtaatttataataaaaacaagatgcaaaaacttaggcgctgtgccagtagatgcaatgaggtcatcagaagcgtgcaccttccacagaatcacta

SEQ ID NO: 55525 - DNA, 201 bp, Homo sapiens
aatagattttttggtatgcatcttgattacatacttagcataaattcttgggtccaaaagcatgataacttaaaaattattgacacatgttgccaagatgytcaacaaaggtttagcatttcctaataaaatccttcatgtgccgttataattaaatgacactttttcttatcttctatgttaaacaagcccaattcagga

SEQ ID NO: 55526 - DNA, 201 bp, Homo sapiens
gggttgggcagaaggcagaaaaccagcagagtcacagaggagatggtgagtttatttttttctgcatgggaagtggttgaagtgagttggagtggtatggrgtaaagtcaggcaggtaaaggttcagaaagtgaggaacagcgatagccatggagttttatgttgaattgcctattagattttgtgagtacttttaaactt

SEQ ID NO: 55527 - DNA, 201 bp, Homo sapiens
tttttatttaacatcatacattgagacctctctcctatctttacaagttaaaatatattatttttagtgacctttaacattcttttcatggatccaccatmattaatttccaccctcaattaatggcatttgtgtttgttttcaatattccgctcttacaaataatgtcttcacaaaaatctctaaatagattttttggta

SEQ ID NO: 55528 - DNA, 201 bp, Homo sapiens
aacatggtgaaacaccatatttactaaacttacaaaaactggctgggcatgttggcatgtgcctgtaatcccagctactcaggaggctgaggcaggacaawctcttgaacccaggaggtggaggtggcagtgagttgagatcacaccactgaactccagcctgggtgacagagcaagacttgtctcaaaaacaaaacaaaa

SEQ ID NO: 55529 - DNA, 201 bp, Homo sapiens
atggagtttttacaaacgctgcatttgacccgagtccttaaggtaagatccctataaagatatttttgaaggaaatagaacactagggaaaaatggaagaytataaagcttaacttttctttacataatcatatattaaattttaagtatgtattaaattttcaggcatgaaggaaattgtgttggcagtaggacacaggt

SEQ ID NO: 55530 - DNA, 201 bp, Homo sapiens
gtggggagtggtggctgccccatcttaggcattcgaagtctgaaagacttcctgcagaacagcagataaatgctaagttggcttggaagtgacctttatgktctcctatagctctgaaataacctgtaagaggtgaatcttggtatttggtgatgcatagaaacagaaaagtatgtcagattaaagcaggggatgcacact

SEQ ID NO: 55531 - DNA, 201 bp, Homo sapiens
ggcttctggtatgaattcttccaatattttctccgcttttcctcctatgcaattaatatttttatgatgtatatacaattttaacaataaagttgaatggrtaaaagactagacagttctacattatttgccatacctttcactttgtatagactttcaacatttgagtgaaagtgggcagatacatattttttactaaaa

SEQ ID NO: 55532 - DNA, 201 bp, Homo sapiens
agtggtggctgccccatcttaggcattcgaagtctgaaagacttcctgcagaacagcagataaatgctaagttggcttggaagtgacctttatgttctccyatagctctgaaataacctgtaagaggtgaatcttggtatttggtgatgcatagaaacagaaaagtatgtcagattaaagcaggggatgcacactgacttg

SEQ ID NO: 55533 - DNA, 201 bp, Homo sapiens
aagtgggtagttgagtgtcctacaaaaagcctgaatggcagaatattcgaaatctagaaagaaaagattatgctgcgcctcagggtgtagatatgatgagyaatttttttctttcttttatttttttaaggaaatgataattatttaaatttctttggtctcatttccagagacctgtccttttcctggtctcctcattca

SEQ ID NO: 55534 - DNA, 201 bp, Homo sapiens
taggtcattgaaagttatatagtatttatctggaactgatgttaaaaaaaatagagagccaaaaattatagtagtcatcttgtctctgtaaaatgtaattmaataaatatgtcatgtacactgtatatacataagcaaacatgcaaataaaaaagcagcctactcaaaggttacaataatgttgcaacaattctggtagta

SEQ ID NO: 55535 - DNA, 201 bp, Homo sapiens
tctgaccttttacattctgcctcatttattggcaatgttaggttacaaaagaaactataatctctttcacctccaatccacatgttgtttctcttgcattmtttcttttctgcagctgtgaaatgctcagaactacatgttaataagccaatagcgatgaactgctccaacctctggggaaacttcagttatggatcaatc

SEQ ID NO: 55536 - DNA, 201 bp, Homo sapiens
gtgcccagcttccgttggcttatcattgcacttagaataaaatctcatccccttgttttggatcccaaagcccgatgtgatctgtcactacccccggctcrtatttttctctccattgctcattccattctggccacactaatgtcttcatgttctttgaacacactgcagtttgcttccaccttaaggcctttgaaatag

SEQ ID NO: 55537 - DNA, 201 bp, Homo sapiens
gggttggccactgtgatgggagactgggagcctcaccgactccttcgccctacacactcttgtgagctggccccaaagccagggaaatccctagaaatackctgttcagggagaaaaccacttccacaggaagagtaccactaaatttaaaatcgttgcactccttctgcaatctgtctgaatagaggcaaagcccaggtt

SEQ ID NO: 55538 - DNA, 201 bp, Homo sapiens
aataaacttggagattgtgacactcttaatttgatactctagccatcaagtgcccagaactctttgccccagagcagggcagcctggattgttctgacacycgtggagaattcaatgttggctccacctgccatttctcttgtgacaacggctttaagctggaggggcccaataatgtggaatgcacaacttctggaagat

SEQ ID NO: 55539 - DNA, 201 bp, Homo sapiens
gttaaaatgtttttcttttctattgagttagcatgacaactactttcagtacacaattaaataaagtaaatatactgcaagttttgacaagtaacttaaamctttatatttaaattgctattaaagattcatctctaagacaggaggagctttccctcatttgttcatatatccatgaatgaatattacttatcaacaaaa

SEQ ID NO: 55540 - DNA, 201 bp, Homo sapiens
gaaaacggatttgctgcaatatcatttacaatattcaaattcttaatacctataccaatatttcgaatcatctctggcatacgaatgtatttatatccaarggcaaagctctggaataaataagaaattagtaaaaggtataatttttctcttataaagtgggagaaaggtgtattttaggcagattgtttttaagaaagt

SEQ ID NO: 55541 - DNA, 201 bp, Homo sapiens
ctctcagtgtttaatcataggtcctgcagagatcagcagcttataagaacacaaaatatgcctacttaccaaagtcaagattcagaagctcccagatgaaragttctaggcttatgagataactctactctctgggacacattaactggtttgagttgagttctccctggtatctggtcaggctgtagtcaaaagtgcatg

SEQ ID NO: 55542 - DNA, 201 bp, Homo sapiens
agagcccagatctatgtgtgagaaatttaaggattgtagccagttggtttgaggcatgggaaaactgtccaagtccagattgctggaagacaaatgtaccyaacgccatcatattggtagaaagggcataggaaagaacttaaaatgatatatccaggacgaatgtatccattaggcacagtagacacagacgcacaaaat

SEQ ID NO: 55543 - DNA, 201 bp, Homo sapiens
gcctttaggtaccagtcagtctgcagcttcacctgcaatgaaggcttgctcctggtgggagcaagtgtgctacagtgcttggctactggaaactggaattytgttcctccagaatgccaaggtaagagtgtattctttctaacatcatggaaataaattgtaggcagtatttttaaaggctggattttagaggtgacaact

SEQ ID NO: 55544 - DNA, 201 bp, Homo sapiens
gccatcatattggtagaaagggcataggaaagaacttaaaatgatatatccaggacgaatgtatccattaggcacagtagacacagacgcacaaaattttyaaagacccacacacgtctgaatttcttttataattattttctttgaagtcaaagaaaatgttttaatatatagtgatatattcatctttgtaccagtgca

SEQ ID NO: 55545 - DNA, 201 bp, Homo sapiens
tgaaggaaccatggactgtgttcatccgctcactgcttttgcctatggctccagctgtaaatttgagtgccagcccggctacagagtgaggggcttggacrtgctccgctgcattgactctggacactggtctgcacccttgccaacctgtgagggtaggatttttcattagcaacctccattctgtccaagaaggaatca

SEQ ID NO: 55546 - DNA, 201 bp, Homo sapiens
agaaagggcataggaaagaacttaaaatgatatatccaggacgaatgtatccattaggcacagtagacacagacgcacaaaattttcaaagacccacacaygtctgaatttcttttataattattttctttgaagtcaaagaaaatgttttaatatatagtgatatattcatctttgtaccagtgcagttgcaaaatagaa

SEQ ID NO: 55547 - DNA, 201 bp, Homo sapiens
accattgctctctgtgtggcttttctcctttctcagtatctttctctttatccttggttattctctccagctgtgcagtgtcagcacctggaagcccccartgaaggaaccatggactgtgttcatccgctcactgcttttgcctatggctccagctgtaaatttgagtgccagcccggctacagagtgaggggcttggac

SEQ ID NO: 55548 - DNA, 201 bp, Homo sapiens
ttctgagccctatcttaataagggagtattcagacatggaagaagtagagtagttaatgaaagacaaacagccaagaagaatggaaagactataagattgyagatcaggatatctgatttcccacccgggttctgccacaaacctactgtgtttcactcattcaacaagtatttattgaaggcctattaagtgctaaactc

SEQ ID NO: 55549 - DNA, 201 bp, Homo sapiens
tgaaataatataaatcaatatgtttaagaattcagatgcaatcatgtatactttcttgatggactatagaagaacaccaatgaatacccatatgtgatagmactgccttggtagtcagtgaaaatagaacactaagcgtgcaataaatgcaaaccttatctgttttctatttttgtaattattcaggagtttttttttttt

SEQ ID NO: 55550 - DNA, 201 bp, Homo sapiens
ttattatacttctttgcaaaataaaaatataaaatttcaattttctacaactgtaagtctctatgtgttaaaatgtttttcttttctattgagttagcatkacaactactttcagtacacaattaaataaagtaaatatactgcaagttttgacaagtaacttaaacctttatatttaaattgctattaaagattcatctc

SEQ ID NO: 55551 - DNA, 201 bp, Homo sapiens
ttctacaactgtaagtctctatgtgttaaaatgtttttcttttctattgagttagcatgacaactactttcagtacacaattaaataaagtaaatatactrcaagttttgacaagtaacttaaacctttatatttaaattgctattaaagattcatctctaagacaggaggagctttccctcatttgttcatatatccatg

SEQ ID NO: 55552 - DNA, 201 bp, Homo sapiens
gtcttcttgctgattttagatgatgggaaatgccccttgaatcctcacaggtaaggtagaaatgttttatgattgagtaaattttgctaccttaactttawaattcactgtaatatgtcagaatgattacatgcaatgcctgcctcctttttacaatgtcttttgcaatgtcttcttttctactctgaagtaaaatacaca

SEQ ID NO: 55553 - DNA, 201 bp, Homo sapiens
tttattgaaggcctattaagtgctaaactctaggctcagtgctaaggatccaaagctaaaaagaaaacaccgtcggagatttacaacctggcagatgtagmctgtatcatagaaacagacattaccgtacatggcaatgagcacaatggaggcagggatgaggtgctgtgggagcctggaggaaggaacacagagtccacc

SEQ ID NO: 55554 - DNA, 201 bp, Homo sapiens
ggccccacttcccattctgttgcagtggatttatgaattccagatcttctttcatgttagcttgtcagcattcccaggacctttggtgatcctacttgatygcacatcttagagttcttgaaaactttctgggagagaaagactagtcttttgcataatacacttcttatgtcttgcatgtgtgtgtgtttgttttgtagc

SEQ ID NO: 55555 - DNA, 201 bp, Homo sapiens
ctgttttgctgagaaagtacatacagtgggcaatgaggctggaccaactggtaggctccaggtcataaagcatgttattttccatgtgaagaggtagagcytgcccttaagacattttatatgtcatttaatctgagcttgggcaaattacttatgtctccttcttttataaaaggacaggagtaagttagatgacttcca

SEQ ID NO: 55556 - DNA, 201 bp, Homo sapiens
tccctgcacacctttgctaagccctcagaatggaacaatgacctgtgttcaacctcttggaagttccagttataaatccacatgtcaattcatctgtgacragggatattctttgtctggaccagaaagattggattgtactcgatcgggacgctggacagactccccaccaatgtgtgaaggtaggctgtgggtctgtcc

SEQ ID NO: 55557 - DNA, 201 bp, Homo sapiens
tgaagaggtagagcttgcccttaagacattttatatgtcatttaatctgagcttgggcaaattacttatgtctccttcttttataaaaggacaggagtaarttagatgacttccagggtccctcctaactttgatatcttatgattccaaacctttaacatcaaggatcctcagaagatgacattttcctattctgacatc

SEQ ID NO: 55558 - DNA, 201 bp, Homo sapiens
atcactaattaatacaactttacctgaacacagatgggttttatctccaccaacacagtactctaagcagccactaccattgattgtcgttttgccatctragatgtaaaggatgtagagaagcatcaattatccatgggagatgagaaatagatatatttactgtaatatgaaattaagtttgattgttggaataattct

SEQ ID NO: 55559 - DNA, 201 bp, Homo sapiens
tttacaggactaggtaacagtgtcaacaataagctatgctagtccagcttttttttttttccctataagtccagcattttcctgtatatactcttttcagrttcaatttcacagataatgtcaatatttaatgagcactttcaatgtacaaaacactctgctcagctccagaataaaactatgaatgactgagcccaactt

SEQ ID NO: 55560 - DNA, 201 bp, Homo sapiens
agataatgtcaatatttaatgagcactttcaatgtacaaaacactctgctcagctccagaataaaactatgaatgactgagcccaacttcgaggagaccayggtataatggggaagaatgacaatcatgtatgaacagcgcaagaacagaggctgtgggagcacattgcaggggcttctacccttagttaaggtgggaagg

SEQ ID NO: 55561 - DNA, 201 bp, Homo sapiens
gcttttagttctttatttactctgaactttctcctcttgttgctgggtgcacatcaagtgaaatacccaaatgtgggctgggcaggaaggtaccatgcagwgtgcaatccactcgctgttgtaatacttctgagagagtgttatcagacaatttccctttttaatgtcctcccacccctccacatctacccctgctgtcag

SEQ ID NO: 55562 - DNA, 201 bp, Homo sapiens
tggttcttaaatgctctgagtctgtaaaaaccagaggtcaaagcccagagcaaagaggtagtctttacactttgaaaagtttcagaaatagcctggaaatraaatgctttatcaaggaagagcatgaggaaaccaatctttatcagaactgaggtcactcagggcttaattgtgctcaggaattcactttggctgcactca

SEQ ID NO: 55563 - DNA, 201 bp, Homo sapiens
ttgctctttggcttagagacaacctcttttctcactgtatttctttttccacccctaagctgggctaccaatatctgtgccacaccactaacaccaccacygtccagaaacataagggaactaatgtattagctgtaatagcttgtaacatctgggctttgctaccaacaagttgtatagttctgcatcctcaacaactct

SEQ ID NO: 55564 - DNA, 201 bp, Homo sapiens
caccatgtagtctttgagggtagcctttgacaaagaagcaaaggaaggaacactgcatcgaaaaagtgtgtgatgcaatcccaggcaattacataattccrccaaaatgaattctctgcaattgcctcacaccctcagtttataaggcggacagtggtaatgggagaataggaaatttacgatagattagtgaattcccag

SEQ ID NO: 55565 - DNA, 201 bp, Homo sapiens
aaacctgtatccatttagctgctattgcctcctacatcttctctttatttgaacccttcccagtgtctcagtgcagcttcaccaaattcactggctgccayaggaacttcttcctatagaaccttgcatggtttatagaattttagtatctcagaattgagaggaaacatagagatcatgtagcacagcatatccacatat

SEQ ID NO: 55566 - DNA, 201 bp, Homo sapiens
ttctactaaaaatacaaaaaatagctgggcatggtggtgcatgcctgtagtcccagctactcgggaggctgaggcaggagaatcgcttgaacccaggaggyggaggttgcagtgagctgagattgtgccattgcactccagcctggtgacagagtgagactctgtctcaaaaaaaaattgcacagtttcaggaagtgcttt

SEQ ID NO: 55567 - DNA, 201 bp, Homo sapiens
gctttagttaaatattccacagtttcaagaacatcctggccaacatggtgaaaccccgtttctactaaaaatacaaaaaatagctgggcatggtggtgcaygcctgtagtcccagctactcgggaggctgaggcaggagaatcgcttgaacccaggaggtggaggttgcagtgagctgagattgtgccattgcactccagc

SEQ ID NO: 55568 - DNA, 201 bp, Homo sapiens
agataaaaaagttctccctctctttaaataatattttaatagctttagttaaatattccacagtttcaagaacatcctggccaacatggtgaaaccccgtytctactaaaaatacaaaaaatagctgggcatggtggtgcatgcctgtagtcccagctactcgggaggctgaggcaggagaatcgcttgaacccaggaggt

SEQ ID NO: 55569 - DNA, 201 bp, Homo sapiens
tgaagcatcatgaaattcaaacaatcacttttagccaaataccatcgttgtatattaatcacacacacacacacacacacacacacacacacacacacacmgagagagagagggagaaagagagagagagttacagagttcaggttgctgaattataaaatgatctcttcttttctcctctgccatgcccatgatagccat

SEQ ID NO: 55570 - DNA, 201 bp, Homo sapiens
aactggtgatgaagcatcatgaaattcaaacaatcacttttagccaaataccatcgttgtatattaatcacacacacacacacacacacacacacacacasacacacacagagagagagagggagaaagagagagagagttacagagttcaggttgctgaattataaaatgatctcttcttttctcctctgccatgcccat

SEQ ID NO: 55571 - DNA, 201 bp, Homo sapiens
ctaactggtgatgaagcatcatgaaattcaaacaatcacttttagccaaataccatcgttgtatattaatcacacacacacacacacacacacacacacasacacacacacagagagagagagggagaaagagagagagagttacagagttcaggttgctgaattataaaatgatctcttcttttctcctctgccatgccc

SEQ ID NO: 55572 - DNA, 201 bp, Homo sapiens
atagccttagatttaaagaaagaatagtcacttcatttgtctataacccaacatttattgataaataatagtcttatattagagaattaatggggagaaargaataatgctaagaaaatatgtaactgcaataatttgtaaaaatacttttggggggaaattgtgaattaaaatttaaattcatttattcattcacttggc

SEQ ID NO: 55573 - DNA, 201 bp, Homo sapiens
taaaaatcacctctaaagctgtttgtgattgagcacttcaggatgtcaatcaactgtaagctgctgctattttacacctctacaatctctaactggtgatraagcatcatgaaattcaaacaatcacttttagccaaataccatcgttgtatattaatcacacacacacacacacacacacacacacacacacacacacag

SEQ ID NO: 55574 - DNA, 201 bp, Homo sapiens
gacatgggacatgacagcacatcagttcagacaaaaagttgaagaattcagaggagaagagttcaggctgtggtgatcagcagagtcttcagagactttaygagttaaatcctggaggattagtgggattttacgccataaaagtggaaaaattctcaggggaatgtgagccaagaaccagaagcaataacacacaaagtc

SEQ ID NO: 55575 - DNA, 201 bp, Homo sapiens
aagccaaaattgacaaatgggatctaattaaactaaagagcttctgcacagcaaaagaaactaccatcagagtgaacaggcaacctacagaatgggagaayatttttgcaatctactcatctgacaaagggctaatatccagaatctacaatgaactcaaacaaatttacaagaaaaaaacaaacaaccccatcaaaaagt

SEQ ID NO: 55576 - DNA, 201 bp, Homo sapiens
atgggacatgacagcacatcagttcagacaaaaagttgaagaattcagaggagaagagttcaggctgtggtgatcagcagagtcttcagagactttacgarttaaatcctggaggattagtgggattttacgccataaaagtggaaaaattctcaggggaatgtgagccaagaaccagaagcaataacacacaaagtcact

SEQ ID NO: 55577 - DNA, 201 bp, Homo sapiens
cctgtgtaaattttgcttcaagttcagagagtggctttaattaacttttaggacctgagaaaatgaggataaggtttttctggtggggtattttcaatcasatagatctcagaggagtagctcttgattgggaacttatagttaaattgcactgatgtttgtcaaagttttagcgggctatggccgggctcagtggctcat

SEQ ID NO: 55578 - DNA, 201 bp, Homo sapiens
caataaaagccaaaattgacaaatgggatctaattaaactaaagagcttctgcacagcaaaagaaactaccatcagagtgaacaggcaacctacagaatgrgagaacatttttgcaatctactcatctgacaaagggctaatatccagaatctacaatgaactcaaacaaatttacaagaaaaaaacaaacaaccccatca

SEQ ID NO: 55579 - DNA, 201 bp, Homo sapiens
gggatcattcaaatggaagaaatagtttgagacagaaagcaatcattgcagtaaatttcaactttcacattgacctttagtcagagaacagtaccatttcycaataaggcagggttgggcaggcagttggcccatgtatatttggctttctgctgaatttcttatatttctgtaccatttcttgcttctttttaaaatagc

SEQ ID NO: 55580 - DNA, 201 bp, Homo sapiens
aagcaaaaacatcgacataaacaccaacctttagagacaaccacaggaggttcccagacctccatgtggatcccagggtaagaacccttctcgattgcctsctgggctttatgttcagaagcccctctcttggtaccctgaaattaggcttgagctctacagcgaagtgctaaggccccagccctggaatggtttttaata

SEQ ID NO: 55581 - DNA, 201 bp, Homo sapiens
ctcacaacaggcatagcatcacttcctactccaggggtgcaatgtccagccctcaccactcctgggcagggaaccatgtactgtaggcatcatccgggaamctttggttttaataccacttgttactttggctgcaacgctggattcacactcataggagacagcactctcagctgcagaccttcaggacaatggacagca

SEQ ID NO: 55582 - DNA, 201 bp, Homo sapiens
ataaccctgaagttccctgaaaatgtagtttaaggaggatgacagtctacttctttcaaacttccagtgtccagatatgctgaacacttattaagtatttyaataaacacatactgacatgccagttgatcacaaatgtagtaataacatttagactaacagtattttaagaaccaaaattttgtaaatagtatatttgga

SEQ ID NO: 55583 - DNA, 201 bp, Homo sapiens
gtgcaatgtccagccctcaccactcctgggcagggaaccatgtactgtaggcatcatccgggaacctttggttttaataccacttgttactttggctgcarcgctggattcacactcataggagacagcactctcagctgcagaccttcaggacaatggacagcagtaactccagcatgcagaggtaaggtgaaaaggagc

SEQ ID NO: 55584 - DNA, 201 bp, Homo sapiens
gcaagtactcaagctagccattgtgcctgtatgttgaagtctcacccaaccacaaccactactccaagtgtcatctcccttatgaaatccacaccaatccyattagaagtaatgtgtcacaggcatttcacttctgtccttcctcatgtcacaagctaaagctaatacacaagtactcagagacttaaaggaagaaacatt

SEQ ID NO: 55585 - DNA, 201 bp, Homo sapiens
acttccagtgtccagatatgctgaacacttattaagtatttcaataaacacatactgacatgccagttgatcacaaatgtagtaataacatttagactaayagtattttaagaaccaaaattttgtaaatagtatatttggaggcaagatttatcaatgcattagcaggtatttgtcggatgctactatgtgtccatcttt

SEQ ID NO: 55586 - DNA, 201 bp, Homo sapiens
ttcatttttgtatcccccacaaaacatagcacagtgctttgcaaatgtcactactgataaataacatttatttgaattaaatctaatttcttgacctttamtttcctatccataaattagaaagaataaccctgaagttccctgaaaatgtagtttaaggaggatgacagtctacttctttcaaacttccagtgtccagat

SEQ ID NO: 55587 - DNA, 201 bp, Homo sapiens
agagctactgtgaatattggaagtggctcatatcctttctgaccttttacattctgcctcatttattggcaatgttaggttacaaaagaaactataatctstttcacctccaatccacatgttgtttctcttgcattatttcttttctgcagctgtgaaatgctcagaactacatgttaataagccaatagcgatgaactg

SEQ ID NO: 55588 - DNA, 201 bp, Homo sapiens
ttttgtatcccccacaaaacatagcacagtgctttgcaaatgtcactactgataaataacatttatttgaattaaatctaatttcttgacctttaatttcytatccataaattagaaagaataaccctgaagttccctgaaaatgtagtttaaggaggatgacagtctacttctttcaaacttccagtgtccagatatgct

SEQ ID NO: 55589 - DNA, 201 bp, Homo sapiens; identical to SEQ ID NO: 16222

SEQ ID NO: 55590 - DNA, 201 bp, Homo sapiens
caaaaatcaatgagtacatgtgtattactgtttctttattccttacttcctcatcccttagctttgcagtgccaggatctcccagttccaaatgaggcccrggtgaactgctcccaccccttcggtgcctttaggtaccagtcagtctgcagcttcacctgcaatgaaggcttgctcctggtgggagcaagtgtgctacag

SEQ ID NO: 55591 - DNA, 201 bp, Homo sapiens
agggttggccactgtgatgggagactgggagcctcaccgactccttcgccctacacactcttgtgagctggccccaaagccagggaaatccctagaaatamtctgttcagggagaaaaccacttccacaggaagagtaccactaaatttaaaatcgttgcactccttctgcaatctgtctgaatagaggcaaagcccaggt

SEQ ID NO: 55592 - DNA, 201 bp, Homo sapiens
actgaattaattaattcatagctcctgtttagttgcaaaaggtgctattgttctaatgtattgttcagtgtagagttagtaataatgagaccagtgataatggtaataattattgcttaatgtaggactacctatttcataagcatcatcacattcaatccacacaaatgacccttaagttggttattactatgcccattt

SEQ ID NO: 55593 - DNA, 201 bp, Homo sapiens
ttacctcttacacctttctaagtggaaagctacaattttttatcccaaattttaaaagcaaaagaagattggattttccagtgtattacaaaaattagackgtaaaaataaaattgttacataatttcttaaagtttatccaatggaataaagtactagcatgatctgcaatcctcatcacttaaaagaccacaagcaggc

SEQ ID NO: 55594 - DNA, 201 bp, Homo sapiens
gtattgttcagtgtagagttagtaataatgagaccagtgataatggtaataattattgcttaatgtaggactacctatttcataagcatcatcacattcartccacacaaatgacccttaagttggttattactatgcccattttaaaggtgaagaaactgaggctttgagaggttaagtagctagcaaagttcatatagc

SEQ ID NO: 55595 - DNA, 201 bp, Homo sapiens
attcatctctaagacaggaggagctttccctcatttgttcatatatccatgaatgaatattacttatcaacaaaattagacaagtttggcatcaatattaytcccatatttcattttcaaggatttaaacattgagaaacttcattcatatgaataagtaaatggaattagaagttttattatagcaatgtctcaattcct

SEQ ID NO: 55596 - DNA, 201 bp, Homo sapiens
gcttaatgtaggactacctatttcataagcatcatcacattcaatccacacaaatgacccttaagttggttattactatgcccattttaaaggtgaagaarctgaggctttgagaggttaagtagctagcaaagttcatatagcttgaagtatggagacaggatgcaaacccaggcctagtctgattatagggctagtgtt

SEQ ID NO: 55597 - DNA, 201 bp, Homo sapiens
aagtaaatggaattagaagttttattatagcaatgtctcaattccttgaagtccttccaagttatatgccccaaattatatagtgatttactatcaaaatktagtcagacttgacaacttaatcgggtgctccctcaaagctgatgaaaggaaataaatggaaatcactagacttgaaaacggatttgctgcaatatcatt

SEQ ID NO: 55598 - DNA, 201 bp, Homo sapiens
cctgaacgaggaaacatgacctgccttcattctgcaaaagcattccagcatcagtctagctgcagcttcagttgtgaagagggatttgcattagttggacyggaagtggtgcaatgcacagcctcgggggtatggacagccccagccccagtgtgtaaaggtgagtttcaggtagttgggatgtataatgtccattgcacc

SEQ ID NO: 55599 - DNA, 201 bp, Homo sapiens
aaatggttcctcttattttcccatatgcctgaacccattaatttttaaccctcagcactgccccctagaaccccaattttcacatggtgttttgcagagtwctaggatacatcagatggactcaggggcctccaagtaagcagaggcagtgtggcaggtggagttctcaagctgtctcttcagagtgcaatgtgagatttc

SEQ ID NO: 55600 - DNA, 201 bp, Homo sapiens
agaattccacttcagcatttggaatggtgcattttgaaatgtgataggaagaacagcttgtgacacaacacaattcagagaaagcagtggggttaggttcrcaccaaagggttatcgatcactctgcattttgtgcaaataaacagctgtaaatcataacgttatgatactctcagtgtttaatcataggtcctgcagaga

SEQ ID NO: 55601 - DNA, 201 bp, Homo sapiens
cagcaaacatgacattgctgttaattctacatggaaaataaaaatcactattttgtctcctgcagtgagagagtgtggagaacttgagctccctcaacacrtgctcatgaactgcagccaccctctgggaaacttctcttttaactcgcagtgcagcttccactgcactgacgggtaccaagtaaatgggcccagcaagct

SEQ ID NO: 55602 - DNA, 201 bp, Homo sapiens
cttgcccttaagacattttatatgtcatttaatctgagcttgggcaaattacttatgtctccttcttttataaaaggacaggagtaagttagatgacttcyagggtccctcctaactttgatatcttatgattccaaacctttaacatcaaggatcctcagaagatgacattttcctattctgacatcattcacactttta

SEQ ID NO: 55603 - DNA, 201 bp, Homo sapiens
gagcaccttgaagaatataagatcagaattagagaaaactagctgcttaaaactagagggaaattttaatatcatccagctcacctgtctcatcttataamtgatgaaaaggacactcacgaggttttagtttctcaaggccgtggagcaggacagaagcaaagtgaggaccagaaaccagtctcccaaattttaggtgta

SEQ ID NO: 55604 - DNA, 201 bp, Homo sapiens
cttatatttctgtaccatttcttgcttctttttaaaatagcaacaacaatgactcctctgatttcttctcttggccaggagaatcatctcctcaaggatgmtttttaataattttcctcatctggttttctatctctgacactgatagtttttcttaacttccttaaatagctcttgcaggagcctcccttgttatgaagg

SEQ ID NO: 55605 - DNA, 201 bp, Homo sapiens
ggtcttgaagaggtttgtaaaaatcaaactatctaagtaaatgagacttatctgaccaaggtattgttgtcagaatagccttagatttaaagaaagaatartcacttcatttgtctataacccaacatttattgataaataatagtcttatattagagaattaatggggagaaaagaataatgctaagaaaatatgtaact

SEQ ID NO: 55606 - DNA, 201 bp, Homo sapiens
aaatacttttggggggaaattgtgaattaaaatttaaattcatttattcattcacttggcaagtggttactgagcactgcctcttgagatcctgggatggsagttatggaagactcaaggatgaatcattcttgggttttagacactttcccatccagtagaagagtgagggtatgacatgggacatgacagcacatcagt

SEQ ID NO: 55607 - DNA, 201 bp, Homo sapiens
ggaaatgaaatcctggattgcacccattcaagtaagatagagggagctgcggcaggctacgaggtctctgaagcagagggtgtagagaaaatagggtgacwttgtaagttcttgagtatggctgcctaaatctttgacttctttgtcttcgtgacttgtacctatactcttctctgtaagcttaccatcctcccactgccc

SEQ ID NO: 55608 - DNA, 201 bp, Homo sapiens
ccaaaaaggctctcaccaacgaggctgagaactgggctgataatgaacctaacaacaaaaggaacaacgaggactgcgtggagatatacatcaagagtccrtcagcccctggcaagtggaatgatgagcactgcttgaagaaaaagcacgcattgtgttacacaggtagggccttctctactttgaaactttcctgttaaa

SEQ ID NO: 55609 - DNA, 201 bp, Homo sapiens
gtagaaagtgttcttgaaacctcatgctgtttaagtcagtggctgaaaaatgaccctaggagcaaggacttcatgtctaaaacaccaaaagcaatggcaayaaaagccaaaattgacaaatgggatctaattaaactaaagagcttctgcacagcaaaagaaactaccatcagagtgaacaggcaacctacagaatgggag

SEQ ID NO: 55610 - DNA, 201 bp, Homo sapiens
tttccgttatgggtccagctgtgagttctcctgtgagcagggttttgtgttgaagggatccaaaaggctccaatgtggccccacaggggagtgggacaacsagaagcccacatgtgaaggtacagtctttgtttttattttattttaagataaaaagaactattgaagagcttgggaacttggttaccttgggaaacgtat

SEQ ID NO: 55611 - DNA, 201 bp, Homo sapiens
gtttccgttatgggtccagctgtgagttctcctgtgagcagggttttgtgttgaagggatccaaaaggctccaatgtggccccacaggggagtgggacaaygagaagcccacatgtgaaggtacagtctttgtttttattttattttaagataaaaagaactattgaagagcttgggaacttggttaccttgggaaacgta

SEQ ID NO: 55612 - DNA, 201 bp, Homo sapiens
cttcccatggaacacaacctgtacatttgactgtgaagaaggatttgaactaatgggagcccagagccttcagtgtacctcatctgggaattgggacaacragaagccaacgtgtaaaggtagagttgttccacatggagacttactgtgaacattctttctctcaacccatactggaaatgggcaagctaattctaggcc

SEQ ID NO: 55613 - DNA, 201 bp, Homo sapiens
gttaggcacccagctcaataggaagtgaaaagatcattcttctgtaaaattcatggtgctctttcaaatcctcagtggttgagtgtgatgctgtgacaaayccagccaatgggttcgtggaatgtttccaaaaccctggaagcttcccatggaacacaacctgtacatttgactgtgaagaaggatttgaactaatgggag

SEQ ID NO: 55614 - DNA, 201 bp, Homo sapiens
tccatgacccatatgttgtcctcagactgcgtgaaatctttccttggaccataatttattttgtgtgttagaagaacagtgctcaggaactaatgttctgrttaattagtcttttaattagtgccatgatcagtgagggggctgaaattcaaagaaaacacagccatcttcccatttgtccagggaattataaagaatctt

SEQ ID NO: 55615 - DNA, 201 bp, Homo sapiens
taggcaaagtggaaatcagaaaagatagaatatccatgaaaaagaataaaagcttttattctggctgtgcatgtccctaagaattgacataggactttggratctaccctttgaaggcagcttcctcactctgttaggcacccagctcaataggaagtgaaaagatcattcttctgtaaaattcatggtgctctttcaaat

SEQ ID NO: 55616 - DNA, 201 bp, Homo sapiens
gaggccaaaaaaagaaaaatcagttcttcaggctctgatgggctaaaataaatgaatagcctacgtatgtcagtactagtcataactcctaatctggaatstattttttttaaatttttacctcacgtaaatgataacatagattagagaccactcagcataggcaaagtggaaatcagaaaagatagaatatccatgaaa

SEQ ID NO: 55617 - DNA, 201 bp, Homo sapiens
aagaaaaggggtagaattacagtcaattttacaaattccattagaaattttataaatttttaaactaaaaaaaaaaaaaaccaaactgtagttctagtttycagtgttcttatctgttaaaggtgagagatgagcagaactgatttgggtttctttttcagttgtgaactgtacagccctggaatcccctgagcatggaag

SEQ ID NO: 55618 - DNA, 201 bp, Homo sapiens
tatcctcctattattcacaggaagcaatccctcctataaaagggcctcagccgaagtagtgttcagctgttcttggctgacttcacatcaaaactcctatrctgacctgagacagaggcagcagtgatacccacctgagagatcctgtgtttgaacaactgcttcccaaaacggtaagtgcagaacgctttataagggcag

SEQ ID NO: 55619 - DNA, 201 bp, Homo sapiens
ggtgcatactaagtgctcaataaagcttagttattctgattattattctactacaaaatgggtatactataatgttgtgagtgagtgtggataaggtaccyagtgggtggcagtcacaaaagagataaacaataagtcgctgtttcttcatacgtacttcttacttttgaaaagatgagaaaagtctgggccatgtcacaa

SEQ ID NO: 55620 - DNA, 201 bp, Homo sapiens
cttcttggtgcatactaagtgctcaataaagcttagttattctgattattattctactacaaaatgggtatactataatgttgtgagtgagtgtggataargtacctagtgggtggcagtcacaaaagagataaacaataagtcgctgtttcttcatacgtacttcttacttttgaaaagatgagaaaagtctgggccatg

SEQ ID NO: 55621 - DNA, 201 bp, Homo sapiens
ccaggaaagtatttcaagcctaaacctttgggtgaaaagaactcttgaagtcatgattgcttcacagtttctctcagctctcactttgggtaagtcagtgycattagaccaagatttctcattctcgcactatagatatttcagactgaaatatccttgcttgtctggggctgtcctgcacaggatatctggcagcatcct

SEQ ID NO: 55622 - DNA, 201 bp, Homo sapiens
caccatttctcctctggcttcggaaatgcttacggaaaggtgaggaagtttatgaatgtacttcaaaaatgtttttgaaaatacatttctttctcattgayaagtcatggtcttgcttactgatttaaacaataattagaatctggataaaatgcagtataattaagcagaagtattaagaaaagagttagtagtacaact

SEQ ID NO: 55623 - DNA, 201 bp, Homo sapiens
gggtacaggtcaaatacttcataaagtttctgaacctagattgccccaaaggggtttggtcctaatttcctacatgctgaaaactaagtagcgcttacacwttacattcattgttgacttttaagcaagttttggaagttttccagtagatttttctgaaactctgcctgtgtacctaacatttgcagtggtaaaatgttc

SEQ ID NO: 55624 - DNA, 201 bp, Homo sapiens
gagaagcccacatgtgaaggtacagtctttgtttttattttattttaagataaaaagaactattgaagagcttgggaacttggttaccttgggaaacgtawtgctggagatgcaaacaaacttctaaagtgctctctcgtgtgttccagctgtgagatgcgatgctgtccaccagcccccgaagggtttggtgaggtgtgc

SEQ ID NO: 55625 - DNA, 201 bp, Homo sapiens
attgaacattccacatatttttctctcttcatgttggaagacagtgctttacctagtgttctcatgtattccacagcagctgccaaagccttgaatcagayggaagctaccaaaagccttcttacatcctttaagttcaaaagaatcaggtaagacttgtaaatcacaaatggttatgagagaggtatcttctctacatgc

SEQ ID NO: 55626 - DNA, 201 bp, Homo sapiens
gagagactttaacatcaattcttcctcatgacctttcttcgtctcttacttccttagctcccactgagtccaacattcccttggtagctggactttctgcygctggactctccctcctgacattagcaccatttctcctctggcttcggaaatgcttacggaaaggtgaggaagtttatgaatgtacttcaaaaatgtttt

SEQ ID NO: 55627 - DNA, 201 bp, Homo sapiens
ccagcccccgaagggtttggtgaggtgtgctcattcccctattggagaattcacctacaagtcctcttgtgccttcagctgtgaggagggatttgaattayatggatcaactcaacttgagtgcacatctcagggacaatggacagaagaggttccttcctgccaaggtagaattgagtgcagacttttttagggtacagg

SEQ ID NO: 55628 - DNA, 201 bp, Homo sapiens
tatgagccacatgtggttattgagtacttgaaatgtggctggtgacactgaggaactgaattttaaatgttatttgatttcaacgaattcaagtagccacmgatagtggctactatagtagacagtgcagcattagggttttaaaatttgtaatgtattctagtacttaaatttgaaatatagctttgtgaatggttctca

SEQ ID NO: 55629 - DNA, 201 bp, Homo sapiens
gttccatagctgtgttttccagtgtgtacctatgagccacatgtggttattgagtacttgaaatgtggctggtgacactgaggaactgaattttaaatgtyatttgatttcaacgaattcaagtagccacagatagtggctactatagtagacagtgcagcattagggttttaaaatttgtaatgtattctagtacttaaa

SEQ ID NO: 55630 - DNA, 201 bp, Homo sapiens
cagtggccacggtgaatgtgtagagaccatcaataattacacttgcaagtgtgaccctggcttcagtggactcaagtgtgagcaaagtaagtctggttctygcctctttcttcacttgagatggtagcaccatctcacgtcctagctggcattagagtcaggtctgcatgccttcccttccctggtgcagatggtgtcata

SEQ ID NO: 55631 - DNA, 201 bp, Homo sapiens
gaagggatccaaaaggctccaatgtggccccacaggggagtgggacaacgagaagcccacatgtgaaggtacagtctttgtttttattttattttaagatraaaagaactattgaagagcttgggaacttggttaccttgggaaacgtattgctggagatgcaaacaaacttctaaagtgctctctcgtgtgttccagctg

SEQ ID NO: 55632 - DNA, 201 bp, Homo sapiens
aggtagagttgttccacatggagacttactgtgaacattctttctctcaacccatactggaaatgggcaagctaattctaggccgtgctaatatcaatgcrtatatttgttacagctgtgacatgcagggccgtccgccagcctcagaatggctctgtgaggtgcagccattcccctgctggagagttcaccttcaaatca

SEQ ID NO: 55633 - DNA, 201 bp, Homo sapiens
ctgttgattctaaaatcaaaggcactcagtataagcacagtaatagtcctcctcatcatgctttgtattttccgtagctgcctgtaccaatacatcctgcmgtggccacggtgaatgtgtagagaccatcaataattacacttgcaagtgtgaccctggcttcagtggactcaagtgtgagcaaagtaagtctggttcttg

SEQ ID NO: 55634 - DNA, 201 bp, Homo sapiens
ttggaatctaccctttgaaggcagcttcctcactctgttaggcacccagctcaataggaagtgaaaagatcattcttctgtaaaattcatggtgctctttmaaatcctcagtggttgagtgtgatgctgtgacaaatccagccaatgggttcgtggaatgtttccaaaaccctggaagcttcccatggaacacaacctgta

SEQ ID NO: 55635 - DNA, 201 bp, Homo sapiens
gggctccaggtgaacccaacaataggcaaaaagatgaggactgcgtggagatctacatcaagagagaaaaagatgtgggcatgtggaatgatgagaggtgsagcaagaagaagcttgccctatgctacacaggtagggagtttgcggcagcagtgggaggtagtttcagtgtgtgggcatcttggcaaatttacagcatgc

SEQ ID NO: 55636 - DNA, 201 bp, Homo sapiens; identical to SEQ ID NO: 16190

SEQ ID NO: 55637 - DNA, 201 bp, Homo sapiens; identical to SEQ ID NO: 16169

SEQ ID NO: 55638 - DNA, 201 bp, Homo sapiens
tagctaaaacctgtcttttctctttgacctaaataatgaaagtcttaaaatttgtttatttatttgattaaactctgaaataaagattattgcactagtgkcctttgcccaaaatcttaggatgctgccttaaacatcatggtagaataatgtaactagctacccacgatttccttctttaattcattttgtgttttatct

SEQ ID NO: 55639 - DNA, 201 bp, Homo sapiens
ttcaggaaataaaaatgttagtcgtgcctaatattgtacaactccagggggtgctattcatgttgaattatatgatgcctcccggaattgtgcaatggaastgccatgatgagcactctaaggaaaatggataaaattcttcctaaggagatttatttggagtacaggcttaaatttgagagtctctcataaggaatatgg

SEQ ID NO: 55640 - DNA, 201 bp, Homo sapiens
atgaaacacagatatgcaaaaggccttctaataaaaaccacatctgtacaagctcttattgtattgtagctaaaacctgtcttttctctttgacctaaatratgaaagtcttaaaatttgtttatttatttgattaaactctgaaataaagattattgcactagtgtcctttgcccaaaatcttaggatgctgccttaaac

SEQ ID NO: 55641 - DNA, 201 bp, Homo sapiens; identical to SEQ ID NO: 16175

SEQ ID NO: 55642 - DNA, 201 bp, Homo sapiens
aaacttgccaatatcttagggagggagcaggggagaaatcatcacctgggtattgttctggaaagttgctttattttttgtagaaggagaggaaagaaacrgatctagctttattgtgtaatttcatttatgatagataataataatgaagatagctgacccttacattgcacttattatattctgggaatttttctaagc

SEQ ID NO: 55643 - DNA, 201 bp, Homo sapiens
ctctgcttcttgtattaaactagatagctcttctgctcctagtaatgaatgtacagaaaaaaggccaaagggacaggacggagagactttaacatcaattyttcctcatgacctttcttcgtctcttacttccttagctcccactgagtccaacattcccttggtagctggactttctgctgctggactctccctcctgac

SEQ ID NO: 55644 - DNA, 201 bp, Homo sapiens
ttcaaagaaaacacagccatcttcccatttgtccagggaattataaagaatcttcagttctccaagtgttgcttgaatgaactgggttcactcaacaaacrccaagtactctctagttccactgcaatattttctgaccatcattttgatgtctcagctttccagtgcacagccttgtccaaccccgagcgaggctacatg

SEQ ID NO: 55645 - DNA, 201 bp, Homo sapiens
attcaagtagccacagatagtggctactatagtagacagtgcagcattagggttttaaaatttgtaatgtattctagtacttaaatttgaaatatagcttkgtgaatggttctcatcctggttggaagcttactgtagtatttttagcagttgtgagaaaagtaacaagaaatttgttgtggtacctaagtttgctgtgtt

SEQ ID NO: 55646 - DNA, 201 bp, Homo sapiens
gttaaagtctatggcactctgtaggactgctgatgtctctgttgcacactgttgattctaaaatcaaaggcactcagtataagcacagtaatagtcctccycatcatgctttgtattttccgtagctgcctgtaccaatacatcctgcagtggccacggtgaatgtgtagagaccatcaataattacacttgcaagtgtga

SEQ ID NO: 55647 - DNA, 201 bp, Homo sapiens
ggtaagtcagtgccattagaccaagatttctcattctcgcactatagatatttcagactgaaatatccttgcttgtctggggctgtcctgcacaggatatmtggcagcatccttgacctctacctgcaatgtgttcttccctgggcttggggtcatttactttacctcttggtgtctccctttccttaagtgtaaagtgtg

SEQ ID NO: 55648 - DNA, 201 bp, Homo sapiens
cagctaatttttgtatttttagtagagattttgtattttttcgtcatgttggccaggctgatcttgaactcctgatccacccgccttggcctctcaaagtrctgggattacaggcgtgagccactgggcctggcctgttactttatttcttatcacacagatgaagaaaatgagacagagaagttaagtaaattgtctgaa

SEQ ID NO: 55649 - DNA, 201 bp, Homo sapiens
ctgtacatttgactgtgaagaaggatttgaactaatgggagcccagagccttcagtgtacctcatctgggaattgggacaacgagaagccaacgtgtaaargtagagttgttccacatggagacttactgtgaacattctttctctcaacccatactggaaatgggcaagctaattctaggccgtgctaatatcaatgcgt

SEQ ID NO: 55650 - DNA, 201 bp, Homo sapiens
atgatcttggctcactgcaacctccacctcctgcgttcaagcaattctcctgcctcagcctcctgagtagctgggattacaggtgcctgccaccacacccrgctaatttttgtatttttagtagagattttgtattttttcgtcatgttggccaggctgatcttgaactcctgatccacccgccttggcctctcaaagtgc

SEQ ID NO: 55651 - DNA, 201 bp, Homo sapiens
aagatcattcttctgtaaaattcatggtgctctttcaaatcctcagtggttgagtgtgatgctgtgacaaatccagccaatgggttcgtggaatgtttccmaaaccctggaagcttcccatggaacacaacctgtacatttgactgtgaagaaggatttgaactaatgggagcccagagccttcagtgtacctcatctggg

SEQ ID NO: 55652 - DNA, 201 bp, Homo sapiens
tggcatgatcttggctcactgcaacctccacctcctgcgttcaagcaattctcctgcctcagcctcctgagtagctgggattacaggtgcctgccaccacrcccagctaatttttgtatttttagtagagattttgtattttttcgtcatgttggccaggctgatcttgaactcctgatccacccgccttggcctctcaaa

SEQ ID NO: 55653 - DNA, 201 bp, Homo sapiens
gtggcatgatcttggctcactgcaacctccacctcctgcgttcaagcaattctcctgcctcagcctcctgagtagctgggattacaggtgcctgccaccayacccagctaatttttgtatttttagtagagattttgtattttttcgtcatgttggccaggctgatcttgaactcctgatccacccgccttggcctctcaa

SEQ ID NO: 55654 - DNA, 201 bp, Homo sapiens
ggatcataatgacctatttcccagatgcattgtgaggattcaatagcatggttcatggaaagtacctcatacagtgcttcttggtgcatactaagtgctcrataaagcttagttattctgattattattctactacaaaatgggtatactataatgttgtgagtgagtgtggataaggtacctagtgggtggcagtcacaa

SEQ ID NO: 55655 - DNA, 201 bp, Homo sapiens
ggagtgcagtggcatgatcttggctcactgcaacctccacctcctgcgttcaagcaattctcctgcctcagcctcctgagtagctgggattacaggtgccygccaccacacccagctaatttttgtatttttagtagagattttgtattttttcgtcatgttggccaggctgatcttgaactcctgatccacccgccttgg

SEQ ID NO: 55656 - DNA, 201 bp, Homo sapiens
ctgggcttggggtcatttactttacctcttggtgtctccctttccttaagtgtaaagtgtggatcataatgacctatttcccagatgcattgtgaggattmaatagcatggttcatggaaagtacctcatacagtgcttcttggtgcatactaagtgctcaataaagcttagttattctgattattattctactacaaaat

SEQ ID NO: 55657 - DNA, 201 bp, Homo sapiens
atgggtatactataatgttgtgagtgagtgtggataaggtacctagtgggtggcagtcacaaaagagataaacaataagtcgctgtttcttcatacgtacytcttacttttgaaaagatgagaaaagtctgggccatgtcacaaacattgccaaaaataagacaataaaaagcacagttgtcagagttaaaccacaacagt

SEQ ID NO: 55658 - DNA, 201 bp, Homo sapiens
gactggagtgcagtggcatgatcttggctcactgcaacctccacctcctgcgttcaagcaattctcctgcctcagcctcctgagtagctgggattacaggkgcctgccaccacacccagctaatttttgtatttttagtagagattttgtattttttcgtcatgttggccaggctgatcttgaactcctgatccacccgcc

SEQ ID NO: 55659 - DNA, 201 bp, Homo sapiens; identical to SEQ ID NO: 16179

SEQ ID NO: 55660 - DNA, 201 bp, Homo sapiens
tcatggtagaataatgtaactagctacccacgatttccttctttaattcattttgtgttttatctccccaggaaagtatttcaagcctaaacctttgggtkaaaagaactcttgaagtcatgattgcttcacagtttctctcagctctcactttgggtaagtcagtgccattagaccaagatttctcattctcgcactata

SEQ ID NO: 55661 - DNA, 201 bp, Homo sapiens
cctctacctgcaatgtgttcttccctgggcttggggtcatttactttacctcttggtgtctccctttccttaagtgtaaagtgtggatcataatgacctayttcccagatgcattgtgaggattcaatagcatggttcatggaaagtacctcatacagtgcttcttggtgcatactaagtgctcaataaagcttagttatt

SEQ ID NO: 55662 - DNA, 201 bp, Homo sapiens
ctagactggagtgcagtggcatgatcttggctcactgcaacctccacctcctgcgttcaagcaattctcctgcctcagcctcctgagtagctgggattacmggtgcctgccaccacacccagctaatttttgtatttttagtagagattttgtattttttcgtcatgttggccaggctgatcttgaactcctgatccaccc

SEQ ID NO: 55663 - DNA, 201 bp, Homo sapiens; identical to SEQ ID NO: 16182

SEQ ID NO: 55664 - DNA, 201 bp, Homo sapiens; identical to SEQ ID NO: 16185

SEQ ID NO: 55665 - DNA, 201 bp, Homo sapiens
accctggaagcttcccatggaacacaacctgtacatttgactgtgaagaaggatttgaactaatgggagcccagagccttcagtgtacctcatctgggaaytgggacaacgagaagccaacgtgtaaaggtagagttgttccacatggagacttactgtgaacattctttctctcaacccatactggaaatgggcaagcta

SEQ ID NO: 55666 - DNA, 201 bp, Homo sapiens
tctctcttcatgttggaagacagtgctttacctagtgttctcatgtattccacagcagctgccaaagccttgaatcagatggaagctaccaaaagccttcytacatcctttaagttcaaaagaatcaggtaagacttgtaaatcacaaatggttatgagagaggtatcttctctacatgctctgtttctccttgaaccctc

SEQ ID NO: 55667 - DNA, 201 bp, Homo sapiens
ttcttcgtctcttacttccttagctcccactgagtccaacattcccttggtagctggactttctgctgctggactctccctcctgacattagcaccatttytcctctggcttcggaaatgcttacggaaaggtgaggaagtttatgaatgtacttcaaaaatgtttttgaaaatacatttctttctcattgataagtcatg

SEQ ID NO: 55668 - DNA, 201 bp, Homo sapiens
attttaagataaaaagaactattgaagagcttgggaacttggttaccttgggaaacgtattgctggagatgcaaacaaacttctaaagtgctctctcgtgygttccagctgtgagatgcgatgctgtccaccagcccccgaagggtttggtgaggtgtgctcattcccctattggagaattcacctacaagtcctcttgtg

SEQ ID NO: 55669 - DNA, 201 bp, Homo sapiens
gttccatcaggcactggtataaaaaattgtatccatattataatagttgttggtatgagaacattttaaaataatttcagacttttcatggttcacatttaaatatctttccttctacatgttccagccatcatacctttgagagaataattgagtaggagagtggtttatgtgcaggttttagaactagactaataagtg

SEQ ID NO: 55670 - DNA, 201 bp, Homo sapiens
aatctgaagactgtgctataatgagaataacagtattttgcatttgacaaatatgcagtgacatgtaccacctctttaagtcttctaaatcttagttcttmaggtgcctggtctcagacaaactcctggttgtctgttttggtttgttttatttctcactacaccaggttgccctcataggaggataaatatcattgtcat

SEQ ID NO: 55671 - DNA, 201 bp, Homo sapiens
agttccatcaggcactggtataaaaaattgtatccatattataatagttgttggtatgagaacattttaaaataatttcagacttttcatggttcacatttaaatatctttccttctacatgttccagccatcatacctttgagagaataattgagtaggagagtggtttatgtgcaggttttagaactagactaataagt

SEQ ID NO: 55672 - DNA, 201 bp, Homo sapiens
gagttccatcaggcactggtataaaaaattgtatccatattataatagttgttggtatgagaacattttaaaataatttcagacttttcatggttcacatttaaatatctttccttctacatgttccagccatcatacctttgagagaataattgagtaggagagtggtttatgtgcaggttttagaactagactaataag

SEQ ID NO: 55673 - DNA, 201 bp, Homo sapiens
agagttccatcaggcactggtataaaaaattgtatccatattataatagttgttggtatgagaacattttaaaataatttcagacttttcatggttcacatttaaatatctttccttctacatgttccagccatcatacctttgagagaataattgagtaggagagtggtttatgtgcaggttttagaactagactaataa

SEQ ID NO: 55674 - DNA, 201 bp, Homo sapiens
gaggaaaagggtgagagagtaggactaatggaaggtgttatagtccatgtcaatagtatcctagactgagttcagggtgaatatatggctaggacagaaasaaggcaagtaatccaaagatggattgacacatcaaagtagagcaaaatgagtatagggacccaagagtcttggaaaggcatgcatgaagacatttcaagt

SEQ ID NO: 55675 - DNA, 201 bp, Homo sapiens
tgatatctgtgtcttgaaactcattctggcccaatatggaatcacagaatgttacagtagcaaggagcaaagcatctggtctagatttttccttttaattstaaatacacaggagattaaataattttagcttagtttggtagcagaatcaggactagaatcccattctcccagtaaacaggccatgctccttccaccatt

SEQ ID NO: 55676 - DNA, 201 bp, Homo sapiens
aagcttgtttcatggagaatttaatattattcttttcttttagttatattctcatattttaaatatatgagttgcatatgaatgtgatgtcacaaaattasttctataatatatagccatctgctggtaagccagctctccaaataaaacacgttttctgccagacattgttcgttgtatctaagtgttgccaaattctct

SEQ ID NO: 55677 - DNA, 201 bp, Homo sapiens
gcttgaacccaggaggcggaggttgcagtgggtcctgagattgcatcactgcactccagcctaggagacagagcgagactccatctcaaaaaaaaaaagaaaaatgctccagtgatgtcccatttcacttagaagaaaattcaagttcttaccgtagcccatagggcctcccttgttctacacacctaccatccacctcat

SEQ ID NO: 55678 - DNA, 201 bp, Homo sapiens
gtaaaaatgcttgtaaggacatttcctttaataatgtatttaataagactgtcttagatcagggaataaagtatctgcaactgtaactaatcacttaaaarctgtcactaaagggtttcaatttgaggttaaattttcagaaactctgtaactagcatgcatcaaattgacttcaatgctgcacctttgagcaaagtttgt

SEQ ID NO: 55679 - DNA, 201 bp, Homo sapiens
tgcttgaacccaggaggcggaggttgcagtgggtcctgagattgcatcactgcactccagcctaggagacagagcgagactccatctcaaaaaaaaaaagaaaaatgctccagtgatgtcccatttcacttagaagaaaattcaagttcttaccgtagcccatagggcctcccttgttctacacacctaccatccacctca

SEQ ID NO: 55680 - DNA, 201 bp, Homo sapiens
ttgcttgaacccaggaggcggaggttgcagtgggtcctgagattgcatcactgcactccagcctaggagacagagcgagactccatctcaaaaaaaaaaagaaaaatgctccagtgatgtcccatttcacttagaagaaaattcaagttcttaccgtagcccatagggcctcccttgttctacacacctaccatccacctc

SEQ ID NO: 55681 - DNA, 201 bp, Homo sapiens
tttattggccttttaccccatcatgtaaaacatttcaggcttttttccccagatccttgttgtctgcctacatccacactgatgttctcaccttcttctcktaaagaatttatcaagttattgtaccaaacaaaaataactgcatcccaaagagaaattctgtcaccagctgatgatagggaatctttcacctaattaaat

SEQ ID NO: 55682 - DNA, 201 bp, Homo sapiens
gagtgcctattactagaatattaccaacttttagattggaaatattcaactctaagaactctgatgtgacaaaggcataatttgtagccataattgctttyattccggcccatggtctgattgcattgaaaacacatcagtcagatcaaaagcattcctgtcaattgggaaacctgtgtaaagcatccttcttcatgactt

SEQ ID NO: 55683 - DNA, 201 bp, Homo sapiens
catgaaaatctgatcgaggatttcaactcggggctgattgggcccctgcttatctgtaaaaaaggtaagaacacccccaccaaaagattcaacaactaaaygttggaatggtcaggagttctgtcatgggacaaagcttgggagcatcttggtaacttcttgtacatcaagcagaggaagacggcacggagaccagatcat

SEQ ID NO: 55684 - DNA, 201 bp, Homo sapiens
ttcatggtataaccttgtcactccatacttcattttacaatcttttaaaaaaatttgcactctctataatttgctcttagtctttgtgatataacaagggyctcaaagataaaatgctaatttttaatggtgtcatttcaaagttagaattcgggatcagaaatatgtgttttacttaacccccttccattcacatgaaat

SEQ ID NO: 55685 - DNA, 201 bp, Homo sapiens
aaactctcagtgtgatctagaccaagaatggttctgccaatcagagtgccgacagcatctctgtgaagaaagtgcctggattatatagacacatcacaacyctccaaggaagggctctaatttggaattacctccatcagcccattttcaataagacctacctgagattcaaactaggcctgactcttccaaagtcctcag

SEQ ID NO: 55686 - DNA, 201 bp, Homo sapiens; identical to SEQ ID NO: 16227

SEQ ID NO: 55687 - DNA, 201 bp, Homo sapiens
agcaataaatctaaggcttggctgatccaggccccacttggctgctgaagggctggaggtgggaagagggatcaataaataggtgcactagaaacctgccrtggcacacctgtcaggagttgcagtacttccctttgggtggagagaagccaccatgattcacaatggagaaagtagctgaaacctggaatcagtttcctg

SEQ ID NO: 55688 - DNA, 201 bp, Homo sapiens
ctctgcgtggtgaggaaaagggtgagagagtaggactaatggaaggtgttatagtccatgtcaatagtatcctagactgagttcagggtgaatatatggcyaggacagaaagaaggcaagtaatccaaagatggattgacacatcaaagtagagcaaaatgagtatagggacccaagagtcttggaaaggcatgcatgaag

SEQ ID NO: 55689 - DNA, 201 bp, Homo sapiens
ttttgagttaatttttgtatatgatgaatccagtttcattggattcattggggttcagtttcattcttccacatatgggtagccggctattccagcaccayttattaaatatgagtccttttccccttgttttttgttgttgttgttgctgttgttgttgactttgtcaaagttcaggtggttgtaagtgtgtggctttat

SEQ ID NO: 55690 - DNA, 201 bp, Homo sapiens
ctctttagacttgttcatggtataaccttgtcactccatacttcattttacaatcttttaaaaaaatttgcactctctataatttgctcttagtctttgtsatataacaagggcctcaaagataaaatgctaatttttaatggtgtcatttcaaagttagaattcgggatcagaaatatgtgttttacttaacccccttcc

SEQ ID NO: 55691 - DNA, 201 bp, Homo sapiens
gtagaatttttagttcttttcagtgacttaggctcctaggaaaacctttgtgaaacagaggttctactcaggtaaactctcagtgtgatctagaccaagartggttctgccaatcagagtgccgacagcatctctgtgaagaaagtgcctggattatatagacacatcacaactctccaaggaagggctctaatttggaat

SEQ ID NO: 55692 - DNA, 201 bp, Homo sapiens
tgtatttatttacagcttactcagtaatacaaaggatctgagacagtttctcaagttataaaggcataaaacaaggagtctatgtaattgggatagaataygcggacaaagaaaataaagccacagataagtagataccatgtgaccctgtaaggctgtcttcaaattttgtcctaagctttatggcagtcagtgtaaaaa

SEQ ID NO: 55693 - DNA, 201 bp, Homo sapiens
tgaaaagaagagctggtactatgaaaagaagtcccgaagttcttggagactcacatcctcagaaatgaaaaaatcccatgagtttcacggtattttcctcrgactttgatctaatctcctaattaaatcacactgggtcacagtgatttctgcccttagatattcacaagattagacatgagatgcttctgagacacccag

SEQ ID NO: 55694 - DNA, 201 bp, Homo sapiens
cgttgtttataagccactcaatccagggtactttgttaacagcaacccaaactaagaaaatcaccaatttctatcttactcacatgtgttaccagaactcragcacacttaagatctatcttatctaaagtagaacataaaggaaagaggctgtattaattgcaacatgactgggaaagaaaatacttaaccaaaatgtga

SEQ ID NO: 55695 - DNA, 201 bp, Homo sapiens
acagaagatggcatttatttgaaattttcttgaacaagtattagctatgttctgctctttctttatgaaaagaactgcaaagtcaagactcctttatctgwcattctgcaatgtatatatacttcaaaacaatatgtcatacacagtatatgcatacaattttatctgtcaattaaaaagagaaacaactcctccatttca

SEQ ID NO: 55696 - DNA, 201 bp, Homo sapiens
gaatcacttgaacccaggaggtggaggctgcagtgagctgacatcgcatcacttcactccaacctgggtgacagagcgaaactctatctcaaaaaaaaaamaacaacaacaacaacaacaaaaaagtatattgagaacctactacattctaggctctgggataaagtgaataagacatggaccttgatttccaggagccaa

SEQ ID NO: 55697 - DNA, 201 bp, Homo sapiens
ttgaatgattggccatgaattagaatgcctacatttacagaagatggcatttatttgaaattttcttgaacaagtattagctatgttctgctctttctttrtgaaaagaactgcaaagtcaagactcctttatctgacattctgcaatgtatatatacttcaaaacaatatgtcatacacagtatatgcatacaattttat

SEQ ID NO: 55698 - DNA, 201 bp, Homo sapiens
caggcaacatgtaacctttggggactggtattttttcactcagtataattctctggagattcatctggttattgcatgtattccattatatgggtgtaccmcagtttttttgttgttgttgttttatacacatttatggtgtaaacatgatgttttaatatatttataaattgtgaattggctaaatcaagctaattaacc

SEQ ID NO: 55699 - DNA, 201 bp, Homo sapiens
ccaaagctcttttgtaatctttcacagataatgcttcctgcttattagtggagactttctccataaactttttttcttttatagactagaattatgttatmacttacaggaagtgacttaagcttttatcatttctcagctcttgacagttttattatcaaagtgaaagtacagcctagagtaaatattagttattagtgt

SEQ ID NO: 55700 - DNA, 201 bp, Homo sapiens
atcccattatgctgatgttcagatcattgtaagcatagtagagttccatcaggcactggtataaaaaattgtatccatattataatagttgttggtatgakaacattttaaaataatttcagacttttcatggttcacatttaaatatctttccttctacatgttccagccatcatacctttgagagaataattgagtagg

SEQ ID NO: 55701 - DNA, 201 bp, Homo sapiens
tgatcccttttatgtgctctcagcaagtgtagacataccttattaaaagttcaggatctggctatttgtctgtgcctctcaagcaagtagcttttcccccycaccaagggtcttactctgtcacccaggctggagtgcagtggtgtgatcatggctcactgcaacctccacttcctgggctcaggcgattctcgcacctca

SEQ ID NO: 55702 - DNA, 201 bp, Homo sapiens
gatggcaataatcataaagataatagtcatgcaagttattgtatcagccgctgaatagtaagtacctgatgttaatatggttctaattatcccattatgcygatgttcagatcattgtaagcatagtagagttccatcaggcactggtataaaaaattgtatccatattataatagttgttggtatgagaacattttaaaa

SEQ ID NO: 55703 - DNA, 201 bp, Homo sapiens
aaacagtacaggaaagccttattatgattatcatcaccactgcaaacaaatgctggctgaactccatgagtgccgtgacttccttctcctgcttctaggaygcctaatggcgagaagccaatcccatgacacttgtggatggctcagaaatgacagtagttgatttctgtcacttgtctggaatggggcttttggtcatag

SEQ ID NO: 55704 - DNA, 201 bp, Homo sapiens; identical to SEQ ID NO: 16228

SEQ ID NO: 55705 - DNA, 201 bp, Homo sapiens; identical to SEQ ID NO: 16229

SEQ ID NO: 55706 - DNA, 201 bp, Homo sapiens; identical to SEQ ID NO: 16233

SEQ ID NO: 55707 - DNA, 201 bp, Homo sapiens; identical to SEQ ID NO: 16236

SEQ ID NO: 55708 - DNA, 201 bp, Homo sapiens; identical to SEQ ID NO: 16238

SEQ ID NO: 55709 - DNA, 201 bp, Homo sapiens; identical to SEQ ID NO: 16195

SEQ ID NO: 55710 - DNA, 201 bp, Homo sapiens
atatttaagtcagggccacacaaggtaggtaaaaatatctaattattgagtcagaaacataatccctaaccatggagttttactttattgtatatattttrtaagcaaaaattattcattttttttctgtttttcatagactgtaggatgccaatgggactaagcactggtatcatatctgattcacagatcaaggcttca

SEQ ID NO: 55711 - DNA, 201 bp, Homo sapiens
accactcgccctctctgtgtcaacagatttttaattgatttcaactctttgtcctttcagccattaatgggatgatctacagcttgcctggcctgaaaatrtatgagcaagagtgggtgaggttacacctgctgaacataggcggctcccaagacattcacgtggttcactttcacggccagaccttgctggaaaatggca

SEQ ID NO: 55712 - DNA, 201 bp, Homo sapiens
acttacagtgcttgaatgtattaagggaaacagtacaggaaagccttattatgattatcatcaccactgcaaacaaatgctggctgaactccatgagtgcygtgacttccttctcctgcttctaggacgcctaatggcgagaagccaatcccatgacacttgtggatggctcagaaatgacagtagttgatttctgtcact

SEQ ID NO: 55713 - DNA, 201 bp, Homo sapiens; identical to SEQ ID NO: 16210

SEQ ID NO: 55714 - DNA, 201 bp, Homo sapiens; identical to SEQ ID NO: 16212

SEQ ID NO: 55715 - DNA, 201 bp, Homo sapiens
aaaagatgaatttcttatattatgcttttcctccaagtggaattattagaatatctttaaaggcagagaatggagcacaaaatatttactatacatttgaygaatgactaaatcaatgtaaatggaaggctttatctttttcctgagatttctcctttggctaatttaggagaataatctctcatttgaaaattctgagtt

SEQ ID NO: 55716 - DNA, 201 bp, Homo sapiens
cagaaaattactctcagctttctttgcataacttccttttggcagtgaatctatcatagttctagaccagtgctgtccaatagaaactacgtatgagctayatgcgtaatttaaaattttctgatagcaacattaaaaagtaaagagaaataggtgacattaattttagtaatatgttttacttaactcagtatatcctga

SEQ ID NO: 55717 - DNA, 201 bp, Homo sapiens
gtgaggacagtggacccacccatgatgaccctccatgcctcacacacatctattactcccatgaaaatctgatcgaggatttcaactcggggctgattggscccctgcttatctgtaaaaaaggtaagaacacccccaccaaaagattcaacaactaaatgttggaatggtcaggagttctgtcatgggacaaagcttggg

SEQ ID NO: 55718 - DNA, 201 bp, Homo sapiens
tataatcagatatatttaagtcagggccacacaaggtaggtaaaaatatctaattattgagtcagaaacataatccctaaccatggagttttactttattrtatatattttctaagcaaaaattattcattttttttctgtttttcatagactgtaggatgccaatgggactaagcactggtatcatatctgattcacaga

SEQ ID NO: 55719 - DNA, 201 bp, Homo sapiens
attaatctgatgcctgacatctccacattagaactctgtttaaaacaccttttcctatgacttcctatttaaatgttgcactcaataccacatgagaacaactagctacctgagtatttctaagcaaggccccgagggagtgagatgcagggcctgtccagagtgaatagggatggaaccaccttcaaaatcttgtattcc

SEQ ID NO: 55720 - DNA, 201 bp, Homo sapiens
atagttaaagtcctgaatcttgggaaacccctcagaccagaacagtcggttaccttcttggttcccttcttggcctaatcctttagcaatccctgtgtttytgagttcacatccaccatctctaagctctgttgttacctgtataatgccatttatcacaatgagttgtcactgcttgtttgctggtcactcagatgtctg

SEQ ID NO: 55721 - DNA, 201 bp, Homo sapiens
acaaataagattgaataaaaaagcaatgctaaactgtatgcagaatttaagaaatccactttaatgagagagacaaagataggtaaaaaataaaggatagraaattatataccataccagctaacactaatccaacacaaaagggtgtgtaatgatgattccattgatatgacattacagaaaagccaaattatagtgaaa

SEQ ID NO: 55722 - DNA, 201 bp, Homo sapiens
gaacagagcatcagtgaactgtgggaccatatcaagtgatctaacatatgtgtaattggatcccagaagtagcaggaacagaaaaagtatttgaagaaatratgactgaaaaattcccaaatgtaatgtaaactacaaaccaacagattcaagatgtttgacaaaactaagaagaaggaacatgaagaaaaccacaccaag

SEQ ID NO: 55723 - DNA, 201 bp, Homo sapiens
tcatctcaagattcttaatcatagatacacagtcccttttgccatataaagtagcatatttccaggtcccagagattaggacgtggacatctcagcagggrcacattattctgcctactacacccaccaaacaaagccctcccacggtgtcctccatctcagagaatggcaccctcctccacccagctccccaaatcagaa

SEQ ID NO: 55724 - DNA, 201 bp, Homo sapiens
ctccagcctaggagacagagcgagactccatctcaaaaaaaaaaagaaaaatgctccagtgatgtcccatttcacttagaagaaaattcaagttcttaccrtagcccatagggcctcccttgttctacacacctaccatccacctcatctcttctttcttcccgtactgtttttcttactgttccttagatacatcaagac

SEQ ID NO: 55725 - DNA, 201 bp, Homo sapiens
tcctaactcagattctcctgcatccctctgataaggacctttgttattacatgggatccacctggacagcccagaagaatctcatctcaagattcttaatmatagatacacagtcccttttgccatataaagtagcatatttccaggtcccagagattaggacgtggacatctcagcaggggcacattattctgcctacta

SEQ ID NO: 55726 - DNA, 201 bp, Homo sapiens
acaggacagggattttcacagtgcttttctatacaatgtctgtaatctatagataacataaccgattaggtcacgggtcgatctttaactaccaggtccakggtgtggcgccgggctgtctgcttgtggatttcatttctgccttttagtttttacttcttctttctttggaggcagaaattgggcataagacaatatgag

SEQ ID NO: 55727 - DNA, 201 bp, Homo sapiens
caaccataatttcttctcttgagttatttcattgtctttctgtcctaactcagctgggatgcaggcttacattgacattaaaaactgcccaaagaaaaccrggaatcttaagaaaataactcgtgagcagaggcggcacatgaagaggtgggaatacttcattgctgcagaggaagtcatttgggactatgcacctgtaat

SEQ ID NO: 55728 - DNA, 201 bp, Homo sapiens; identical to SEQ ID NO: 16226

SEQ ID NO: 55729 - DNA, 201 bp, Homo sapiens
tgatggcaataatcataaagataatagtcatgcaagttattgtatcagccgctgaatagtaagtacctgatgttaatatggttctaattatcccattatgmtgatgttcagatcattgtaagcatagtagagttccatcaggcactggtataaaaaattgtatccatattataatagttgttggtatgagaacattttaaa

SEQ ID NO: 55730 - DNA, 201 bp, Homo sapiens
gacaataactgtactgtgtatcaagctctacttatggttttatcaggtctctcaaatgttacatttatttgaaatattagaagaaattgaactatttctgmtctttgacattaacagggggaaagagaagttgtgttttgtaaaacaggtgaaatagagagagaatgctatccaattatttcccagataaccctgcagcaa

SEQ ID NO: 55731 - DNA, 201 bp, Homo sapiens
agtttttgtattttatttccagtttgaatctttctgtaacttcctttaagaaaattgtctacagagagtatgaaccatattttaagaaagaaaaaccacartctaccatttcaggtaagcctgaaatatacttttttaattttaaagataaatttctatgggtaatttggcattcacatgcatctaaaatatccatttact

SEQ ID NO: 55732 - DNA, 201 bp, Homo sapiens
atatttgactcatttttattaattctttaaatgacctgagatatcagaatggcatgaataacttgatgatcccttcagccaactaaatccaaattccctamtttctatcctcatatctccctcccttaagatacctacactccaatttcctggctttctatagaattccagggcctatccttaaattaggccactagaaag

SEQ ID NO: 55733 - DNA, 201 bp, Homo sapiens; identical to SEQ ID NO: 16197

SEQ ID NO: 55734 - DNA, 201 bp, Homo sapiens
aattttaacagattttacactttcagctatcaatggctatgtgcctgagagcataactactcttggattctgctttgatgacactgtccagtggcacttcygtagtgtggggacccagaatgaaattttgaccatccacttcactgggcactcattcatctatggaaagaggcatgaggacaccttgaccctcttccccat

SEQ ID NO: 55735 - DNA, 201 bp, Homo sapiens
cttctcttgagttatttcattgtctttctgtcctaactcagctgggatgcaggcttacattgacattaaaaactgcccaaagaaaaccaggaatcttaagwaaataactcgtgagcagaggcggcacatgaagaggtgggaatacttcattgctgcagaggaagtcatttgggactatgcacctgtaataccagcgaatat

SEQ ID NO: 55736 - DNA, 201 bp, Homo sapiens
acccctgggtatggaaaatggaaagatagaaaacaagcaaatcacagcttcttcgtttaagaaatcttggtggggagattactgggaacccttccgtgccygtctgaatgcccagggacgtgtgaatgcctggcaagccaaggtcaagtatactctatgcatggtgttctcttagggctccagaagaaagcaaaggccctc

SEQ ID NO: 55737 - DNA, 201 bp, Homo sapiens
gagaaaagacgtatgataagactgaagagagaagtagaggtaaatcatacatggacttgtggtccacgttaaggactttatgcaagaagtaaatctagatrtacctactcaacttatggtttccatgctcagaacctcatgagatacattgcacgttactgtagtacctgaatccttcattgctattgaatggatgtgcct

SEQ ID NO: 55738 - DNA, 201 bp, Homo sapiens
cccctgggtatggaaaatggaaagatagaaaacaagcaaatcacagcttcttcgtttaagaaatcttggtggggagattactgggaacccttccgtgcccrtctgaatgcccagggacgtgtgaatgcctggcaagccaaggtcaagtatactctatgcatggtgttctcttagggctccagaagaaagcaaaggccctca

SEQ ID NO: 55739 - DNA, 201 bp, Homo sapiens
ctggaagaggggggtcagtcagtggagtccgacatgtcaggagtcaaaagaggtgtagacatctggactattctataaagatgggggcctgagcctgcccygtggaaggaatagggagagctttggctcaggagtccagagatctgagttctgatcccagcaatgctaccagatcactgactgaccttgggcaagtcacct

SEQ ID NO: 55740 - DNA, 201 bp, Homo sapiens
cagagggtagcagctggaagaggggggtcagtcagtggagtccgacatgtcaggagtcaaaagaggtgtagacatctggactattctataaagatgggggyctgagcctgccccgtggaaggaatagggagagctttggctcaggagtccagagatctgagttctgatcccagcaatgctaccagatcactgactgacctt

SEQ ID NO: 55741 - DNA, 201 bp, Homo sapiens
accccacaaaactttaaaaaatcattttatcatcaaacaaaatacccagatttctcagactggccaatggtatacggcagagtagaacatctggtcttgcrcctcaaggagctcatgctaaaaattggctaccaagacttttgattttactattgtagtttgttttgttctttatttcagtgtacctgaagtaaatagtag

SEQ ID NO: 55742 - DNA, 201 bp, Homo sapiens
agagtcttttccaggaaaaaccgatagctgggggtcattgatttctctacataaaaagcccagcctctctgcagggatttggcaaggatcagataccttastcttatgaccacgcgcccatttccaaaactctcctcagtcatcttttctgggtttgaccacacatgtagtatttcagccagattcacagggtcttatcag

SEQ ID NO: 55743 - DNA, 201 bp, Homo sapiens
tgtgaatggtaccccctacagttgtgcagcatgcagcctatgaaaccatacatgacaatcctatctatgaatcagtttttctctttatgcttttctctackacaatgtagtgaagcagctccatttggggtacatatatggtaaaggaaggaacactatggtaggagctaaaggcctgttagtgtgctcttaacactgcca

SEQ ID NO: 55744 - DNA, 201 bp, Homo sapiens
agcctgagaaccctagttatctaatctgagaagtgggcagaggagttgtcataccaataagagaataaacatgacttgctatggttgctggatacaccaaygataaactcctaattttataaactcctagacttcctaatttgcctgaaactttctctgaatttagaaggccttaaggtgacatgctgcatatctccttgc

SEQ ID NO: 55745 - DNA, 201 bp, Homo sapiens
ttcacaaggaaaatttgccctgtaagctagtaactgaaacagaaactgagaagagaaaggtacgagcttgtgttatgaatatgtagataggtgttctcacrcctgatataatttgaaggatgcccaaatgatctcaacccgtccctctccaaaaattcacctgcctggtttctgaaatttcacagcagttcctctaactta

SEQ ID NO: 55746 - DNA, 201 bp, Homo sapiens
ctcttagcctggtatcagaagttaaaaatgagataacagtacatagtgcatggtaagcacttggtaaatatttgttcaatgaatgaatttatatttaccakataagatagttgtcaggattaaatgggagattgcaggcaaatcatttaatatagtaatagattctcaataaatagtatcccttatattatcaatttatta

SEQ ID NO: 55747 - DNA, 201 bp, Homo sapiens
gggctgggaggagcttcatgggtctgactgctggggtgtgaagacttctcatatggcatttaagtcctttaccatctggccccaacctgctccttttctascctcatttctcaccaggttccacctgtccctgtgcatttcacagcccagttccaccgagatccttgctattccccaaactcttcctttactcccctgctc

SEQ ID NO: 55748 - DNA, 201 bp, Homo sapiens
tccatatgaattttagaatagctttgtctaatcctgaggaaaatgattccagtagttgttaaaaaatagtgttgaatctgtagattgctttgggcacaatrgctattttaacaatactgattcttccaatacataagcatagaatgtttttccatttgtttgtgtcatctatgatttctttcatcagtgttttgtaattct

SEQ ID NO: 55749 - DNA, 201 bp, Homo sapiens
acgataatttaacacaatatttaaaaaacttattctaagtaactcaggaatcaaaaaccagacactgtatgttctcacttacaaatgggagataaactgcrggtatgcgaaggcagacagattggtataatggacattggagactcaaaagggaacgggggatggatgaaaagctacctattgggtacagggtacactact

SEQ ID NO: 55750 - DNA, 201 bp, Homo sapiens; identical to SEQ ID NO: 16222

SEQ ID NO: 55751 - DNA, 201 bp, Homo sapiens
tgggtatggaaaatggaaagatagaaaacaagcaaatcacagcttcttcgtttaagaaatcttggtggggagattactgggaacccttccgtgcccgtctraatgcccagggacgtgtgaatgcctggcaagccaaggtcaagtatactctatgcatggtgttctcttagggctccagaagaaagcaaaggccctcactac

SEQ ID NO: 55752 - DNA, 201 bp, Homo sapiens
tcctatctatgaatcagtttttctctttatgcttttctctacgacaatgtagtgaagcagctccatttggggtacatatatggtaaaggaaggaacactayggtaggagctaaaggcctgttagtgtgctcttaacactgccacctcttctggtgtataatgatcccaaagagtcttttccaggaaaaaccgatagctggg

SEQ ID NO: 55753 - DNA, 201 bp, Homo sapiens
aggattacaggcatgagccactgcacctggccatggatggtacctaatgttgtaaaatagcataatttaagataaaagcagaagaaaatcagtttaaaaartgattacatttcaggatttcagttgctttcttctaggatgccactatatctattaaagcaccagtcttgttagtgcatttaccattttataatcagatat

SEQ ID NO: 55754 - DNA, 201 bp, Homo sapiens
ctcggcctcccagagtgctaggattacaggcatgagccactgcacctggccatggatggtacctaatgttgtaaaatagcataatttaagataaaagcagragaaaatcagtttaaaaaatgattacatttcaggatttcagttgctttcttctaggatgccactatatctattaaagcaccagtcttgttagtgcattta

SEQ ID NO: 55755 - DNA, 201 bp, Homo sapiens
gacaattctccttaaatgtcatgtcacttcaccaagatagataagaattggacagcagagaattaaaggttgcaatctttgacaaaatcctagagtgtagwtaatctacagacaaaggatgatccaaaggctttgacaatcaaccaaatagaagataggattaaggttctcttttgcagattaaagagcctaactaggact

SEQ ID NO: 55756 - DNA, 201 bp, Homo sapiens
gtgaatcttgctagagatttgtcgattttaaaaaaatcttcttggccgggcgcagtggctcacgtctgtaatcccagcactttgggaggccgaggtgggcrgatcacgaggtcaagagatcaagaccatcctgaccaacatggtgaaaccccctctctactaaaaatattaaaaaaaattaggcagggtggcgtgcacttg

SEQ ID NO: 55757 - DNA, 201 bp, Homo sapiens; identical to SEQ ID NO: 16224

SEQ ID NO: 55758 - DNA, 201 bp, Homo sapiens
atgtttgtagtgattttgcctgtttcatctctgatattgtcatctgcccctcctttcttttttgtgtgaatcttgctagagatttgtcgattttaaaaaaatcttcttggccgggcgcagtggctcacgtctgtaatcccagcactttgggaggccgaggtgggcagatcacgaggtcaagagatcaagaccatcctgacc

SEQ ID NO: 55759 - DNA, 201 bp, Homo sapiens
gaactttttttcatatttttatattttgtatttttattttttttgtagagaagaggttgcccaagatcaaactcctggcctcaagtaatcctcccccctcrgcctcccagagtgctaggattacaggcatgagccactgcacctggccatggatggtacctaatgttgtaaaatagcataatttaagataaaagcagaaga

SEQ ID NO: 55760 - DNA, 201 bp, Homo sapiens
tttttaattttaaagataaatttctatgggtaatttggcattcacatgcatctaaaatatccatttactgaaaatttatagaaacgtgtggttttttttttaagaagtactggctacataatatgtggggcccagtgcaaaatgaaaatgtgagtccccttgttcatattattgaaaatttcacagtgactgcaaagcatt

SEQ ID NO: 55761 - DNA, 201 bp, Homo sapiens
agaactttttttcatatttttatattttgtatttttattttttttgtagagaagaggttgcccaagatcaaactcctggcctcaagtaatcctcccccctyggcctcccagagtgctaggattacaggcatgagccactgcacctggccatggatggtacctaatgttgtaaaatagcataatttaagataaaagcagaag

SEQ ID NO: 55762 - DNA, 201 bp, Homo sapiens
atgaaaagaagagctggtactatgaaaagaagtcccgaagttcttggagactcacatcctcagaaatgaaaaaatcccatgagtttcacggtattttcctyggactttgatctaatctcctaattaaatcacactgggtcacagtgatttctgcccttagatattcacaagattagacatgagatgcttctgagacaccca

SEQ ID NO: 55763 - DNA, 201 bp, Homo sapiens
agtcacagcaatgtcaaattgctttagaaaaacaaaagtttactaaatatttcattctcatttttctctccttgtgttattttgacccagtaatcaatagktcacagacaagcagtggtccacagcccatacttgaatattcctgacgaaagtttattagaaattacctgccacaatggattattgtgttttcatgtcttt

SEQ ID NO: 55764 - DNA, 201 bp, Homo sapiens
atagtttgcaccaacctaacacatgctgcctgaggagttagtgaaggcagcccctcgacagcactttgggtgacgttgtgtgaatctgcctcagatgcagrcacagaagtccaaatggactggtttgattaagagcagggaaaaaaagagggttcttattggtttttcacatgccagtaactcactaatacatctagagag

SEQ ID NO: 55765 - DNA, 201 bp, Homo sapiens
tgattatcagaagagcaaggaaattcctgagaaagaggcaatacaatttactctgtttttccaggaaaaagatattcactcaggcttgataggtcccctcstaatctgccaaaaaggaatactacataaggacagcaacatgcctatggacatgagagaatttgtcttactatttatgacctttgatgaaaagaagagctg

SEQ ID NO: 55766 - DNA, 201 bp, Homo sapiens
agatgaacgcactggtcatgtgcttagagtcacagcaatgtcaaattgctttagaaaaacaaaagtttactaaatatttcattctcatttttctctccttrtgttattttgacccagtaatcaataggtcacagacaagcagtggtccacagcccatacttgaatattcctgacgaaagtttattagaaattacctgccac

SEQ ID NO: 55767 - DNA, 201 bp, Homo sapiens
gtgtgtcttcttttgaaaagtgtctgttcctgtccttggcctactttttaatggggctgtttgtttttttcttgtaaatttaagttccttataaatgctcsatattagacctttgccagatgcatagtttgcaaaaattttctcccattctgaatgttgtctgtttactctcttgatagtttcttttgctgtgcaggagct

SEQ ID NO: 55768 - DNA, 201 bp, Homo sapiens
gatcattccttttcctaggttcgttttaaaaatttagcatccagaccgtattctctacatgcccatggactttcctatgaaaaatcatcagagggaaagasttatgaagatgactctcctgaatggtttaaggaagataatgctgttcagccaaatagcagttatacctacgtatggcatgccactgagcgatcagggcca

SEQ ID NO: 55769 - DNA, 201 bp, Homo sapiens
caatgtatggtgtgacttatgcatatgagttcattaatctgatgcctgacatctccacattagaactctgtttaaaacaccttttcctatgacttcctatwtaaatgttgcactcaataccacatgagaacaactagctacctgagtatttctaagcaaggccccgagggagtgagatgcagggcctgtccagagtgaata

SEQ ID NO: 55770 - DNA, 201 bp, Homo sapiens
tgcgttaacttgcttagaataatggcctccagctccatccatgtccctgcaaaggacataatcttgttctttttgatggtcacatagtattctatggtgtwtatgtaccatattttcttcatccagtctgtcattgatgggcatttgggttgatttcatgtctttgctattgtgaagagtgcgaaaatgaacatacgcatg

SEQ ID NO: 55771 - DNA, 201 bp, Homo sapiens
ttagatttttgttaagcttaagtacatttgtggatcattccttttcctaggttcgttttaaaaatttagcatccagaccgtattctctacatgcccatggrctttcctatgaaaaatcatcagagggaaagacttatgaagatgactctcctgaatggtttaaggaagataatgctgttcagccaaatagcagttatacct

SEQ ID NO: 55772 - DNA, 201 bp, Homo sapiens; identical to SEQ ID NO: 16239

SEQ ID NO: 55773 - DNA, 201 bp, Homo sapiens; identical to SEQ ID NO: 16191

SEQ ID NO: 55774 - DNA, 201 bp, Homo sapiens
aaccataatttcttctcttgagttatttcattgtctttctgtcctaactcagctgggatgcaggcttacattgacattaaaaactgcccaaagaaaaccasgaatcttaagaaaataactcgtgagcagaggcggcacatgaagaggtgggaatacttcattgctgcagaggaagtcatttgggactatgcacctgtaata

SEQ ID NO: 55775 - DNA, 201 bp, Homo sapiens
ctgccaagtgggggtcaaagtccaggttccccactccattgccacctaagaagggattgttccttggtggctgggtgggaagggaagttccccatttggcmtccactgatactgcaggggcaggagcttcattaggggctggagatgaaagccctaaatccctacatggccttttctgacacaaccccagtgagggtgtag

SEQ ID NO: 55776 - DNA, 201 bp, Homo sapiens
cagagttactttgaccattaaaatagtaatatgcgccaagtgcctagcactcagtagacaccaacaatggtaactattggagactcaccaagaaatctttratgttccagcaatgcatgccatttcagagattcaaaattgtcctcgtgaattattacttagaaacatctaaatgtctcttatttgtggggatagagctca

SEQ ID NO: 55777 - DNA, 201 bp, Homo sapiens
tacacaagttacttggccacactgagccacaagtcatttatctggaaaacagtgtaatcacatctcacagagttactttgaccattaaaatagtaatatgygccaagtgcctagcactcagtagacaccaacaatggtaactattggagactcaccaagaaatctttgatgttccagcaatgcatgccatttcagagattc

SEQ ID NO: 55778 - DNA, 201 bp, Homo sapiens
agtcacttaagtgatttaagtaggtatttaaatatttgttaatgccagtcattatactggtactaaggctaagagtggtaatcgaggtagacatgagcccygcccttgtagaaatcatacctttggttttttactatgcttagtacataagtaaataaaaatattgcctacagcagtgtcccttttaacaataatgaaatg

SEQ ID NO: 55779 - DNA, 201 bp, Homo sapiens
catcatgtaaattattaaagtcacttaagtgatttaagtaggtatttaaatatttgttaatgccagtcattatactggtactaaggctaagagtggtaatsgaggtagacatgagccctgcccttgtagaaatcatacctttggttttttactatgcttagtacataagtaaataaaaatattgcctacagcagtgtccct

SEQ ID NO: 55780 - DNA, 201 bp, Homo sapiens
ccaaagatggattgacacatcaaagtagagcaaaatgagtatagggacccaagagtcttggaaaggcatgcatgaagacatttcaagtgatcagtaagatkttcagaacaaaaggaattccctgaatgagggttccggcatttgctgcagttctaaagttcagtggccaaaagcactgccatggcagtctgagagaaatgt

SEQ ID NO: 55781 - DNA, 201 bp, Homo sapiens
tcatagcaacatttttaagcaagaggtcaaaggctcacatccttagaaatgcgtttgatcttctattccaagcgtgtgtgtgtgtgtgtgtgtgtgtgtgkacacagacatactctgcgtggtgaggaaaagggtgagagagtaggactaatggaaggtgttatagtccatgtcaatagtatcctagactgagttcagggt

SEQ ID NO: 55782 - DNA, 201 bp, Homo sapiens
tcttggcctaatcctttagcaatccctgtgtttttgagttcacatccaccatctctaagctctgttgttacctgtataatgccatttatcacaatgagttrtcactgcttgtttgctggtcactcagatgtctgcttttgcagggcacaaactacaactggagtgtctgttccctcaaagctttatacaatgcctgacaca

SEQ ID NO: 55783 - DNA, 201 bp, Homo sapiens
catgacttgtgatccatggacaagtgcatataagaaattttccagcttccaagagttgaggagggaaaaggtcacaggaatttaacaatgactgagtcacyaaacttgacatttcagcatttaggaaacacagttttcatctgtccatctgttcatccattctttaagccattactaagcactgttgagtatgaagcactg

SEQ ID NO: 55784 - DNA, 201 bp, Homo sapiens; identical to SEQ ID NO: 16205

SEQ ID NO: 55785 - DNA, 201 bp, Homo sapiens
ataaccgattaggtcacgggtcgatctttaactaccaggtccagggtgtggcgccgggctgtctgcttgtggatttcatttctgccttttagtttttactwcttctttctttggaggcagaaattgggcataagacaatatgaggggtggtctcctcccttaaaatagtagttctgtttcaaattctttgagaaaccccca

SEQ ID NO: 55786 - DNA, 201 bp, Homo sapiens
aacaggacagggattttcacagtgcttttctatacaatgtctgtaatctatagataacataaccgattaggtcacgggtcgatctttaactaccaggtccrgggtgtggcgccgggctgtctgcttgtggatttcatttctgccttttagtttttacttcttctttctttggaggcagaaattgggcataagacaatatga

SEQ ID NO: 55787 - DNA, 201 bp, Homo sapiens
ccagtaattagaacagaacagaacaggacagggattttcacagtgcttttctatacaatgtctgtaatctatagataacataaccgattaggtcacgggtmgatctttaactaccaggtccagggtgtggcgccgggctgtctgcttgtggatttcatttctgccttttagtttttacttcttctttctttggaggcagaa

SEQ ID NO: 55788 - DNA, 201 bp, Homo sapiens
taatagaattgctaggtcaaattgtagcaggacaagccacagacaaaaacccctcagacaccaagttaaagaaggaagggctttattcagccgggagcttyggcaagactcatgtctccaacaaccgagctccccgagtgagcaattcctgtcccttttaagggctcacaactctaagagggtccacgtgagtgggtcgtg

SEQ ID NO: 55789 - DNA, 201 bp, Homo sapiens
agtagagacagggttttaccatgttggccaggctggtctcaaactcctgacctcgggcaatctgcctgcctcagcttcccaaagtgctgggattacaggcrtgagccattgcgcccggctgaacaatttattttcttttttggctatatacccagtaatagaattgctaggtcaaattgtagcaggacaagccacagacaa

SEQ ID NO: 55790 - DNA, 201 bp, Homo sapiens
gcctcagcctcccgagtagctgggattacaggcacccaccaccatgcccagctaatttttgtatttttagtagagacagggttttaccatgttggccaggstggtctcaaactcctgacctcgggcaatctgcctgcctcagcttcccaaagtgctgggattacaggcatgagccattgcgcccggctgaacaatttattt

SEQ ID NO: 55791 - DNA, 201 bp, Homo sapiens
cctgcctcagcctcccgagtagctgggattacaggcacccaccaccatgcccagctaatttttgtatttttagtagagacagggttttaccatgttggccrggctggtctcaaactcctgacctcgggcaatctgcctgcctcagcttcccaaagtgctgggattacaggcatgagccattgcgcccggctgaacaattta

SEQ ID NO: 55792 - DNA, 201 bp, Homo sapiens; identical to SEQ ID NO: 16211

SEQ ID NO: 55793 - DNA, 201 bp, Homo sapiens
ttcaagcaattctcctgcctcagcctcccgagtagctgggattacaggcacccaccaccatgcccagctaatttttgtatttttagtagagacagggtttyaccatgttggccaggctggtctcaaactcctgacctcgggcaatctgcctgcctcagcttcccaaagtgctgggattacaggcatgagccattgcgcccg

SEQ ID NO: 55794 - DNA, 201 bp, Homo sapiens
cccaggttcaagcaattctcctgcctcagcctcccgagtagctgggattacaggcacccaccaccatgcccagctaatttttgtatttttagtagagacarggttttaccatgttggccaggctggtctcaaactcctgacctcgggcaatctgcctgcctcagcttcccaaagtgctgggattacaggcatgagccattg

SEQ ID NO: 55795 - DNA, 201 bp, Homo sapiens; identical to SEQ ID NO: 16213

SEQ ID NO: 55796 - DNA, 201 bp, Homo sapiens
tcccaggttcaagcaattctcctgcctcagcctcccgagtagctgggattacaggcacccaccaccatgcccagctaatttttgtatttttagtagagacrgggttttaccatgttggccaggctggtctcaaactcctgacctcgggcaatctgcctgcctcagcttcccaaagtgctgggattacaggcatgagccatt

SEQ ID NO: 55797 - DNA, 201 bp, Homo sapiens
tttgtcttgtctatttttatcagtaccatcactgccgaaggcaagtctagagtgtgataacatattttgtcttagtttcaaattccaggtctgttggtatyggatgtgttgagcaagttgattagcctttcctaatttcttccttttatcaaatgggtaataaccctcctaaaaatgttacaggtctgtttgggggttcag

SEQ ID NO: 55798 - DNA, 201 bp, Homo sapiens; identical to SEQ ID NO: 16214

SEQ ID NO: 55799 - DNA, 201 bp, Homo sapiens
agtggcacttctgtagtgtggggacccagaatgaaattttgaccatccacttcactgggcactcattcatctatggaaagaggcatgaggacaccttgacmctcttccccatgcgtggagaatctgtgacggtcacaatggataatgttggtgagtaagagtctggacactcacagaggaagcttgctttgaatttctggt

SEQ ID NO: 55800 - DNA, 201 bp, Homo sapiens
ttccattttccaccttaatgtgtgagtgaaacactctctccaatgctcctgccaagtgatgaggggaggttactgctcagataaacagatctaattttccyactgtgtgtacacatgtatacacacacaccatccaaaaggtgaatatgcaaagctagtatcttatattatttgtcatgatcaaccttaaatcctagaata

SEQ ID NO: 55801 - DNA, 201 bp, Homo sapiens
atccttagaaatgcgtttgatcttctattccaagcgtgtgtgtgtgtgtgtgtgtgtgtgtgtacacagacatactctgcgtggtgaggaaaagggtgagrgagtaggactaatggaaggtgttatagtccatgtcaatagtatcctagactgagttcagggtgaatatatggctaggacagaaagaaggcaagtaatcca

SEQ ID NO: 55802 - DNA, 201 bp, Homo sapiens
cagcagacatcgaacagcaggctgtgtttgctgtgtttgatgagaacaaaagctggtaccttgaggacaacatcaacaagttttgtgaaaatcctgatgargtgaaacgtgatgaccccaagttttatgaatcaaacatcatgagcagtaagtcagagtactatttttgttcatcagtttttcattcctgtggttgaaata

SEQ ID NO: 55803 - DNA, 201 bp, Homo sapiens
tatttatttacagcttactcagtaatacaaaggatctgagacagtttctcaagttataaaggcataaaacaaggagtctatgtaattgggatagaatatgsggacaaagaaaataaagccacagataagtagataccatgtgaccctgtaaggctgtcttcaaattttgtcctaagctttatggcagtcagtgtaaaaaag

SEQ ID NO: 55804 - DNA, 201 bp, Homo sapiens
cacagatcagatagttgtaggtgcgcagccttatttctgagttctctattctgttccattggtctatgcgtctgttcttgtaccagtactatactgttttktcctccagagggcagcagacatcgaacagcaggctgtgtttgctgtgtttgatgagaacaaaagctggtaccttgaggacaacatcaacaagttttgtga

SEQ ID NO: 55805 - DNA, 201 bp, Homo sapiens
gatcagcaggaagattgcagtaaagatgaacagattaggagtaatcctcaacacacaaaaaaaaccagcatttcaaaaggtgacagaagagtaatattcartggcatctagaatattttctctttccatttgcatttgggcacttatgagaaggcaaaatcatagcaatcgttaagagaaaaaataactaattcccactta

SEQ ID NO: 55806 - DNA, 201 bp, Homo sapiens
agaatccagcccatctttcattaaaacaaacaaccacagtgagccacagcatgggaaataacgtgatggactcaccatctgcctatacatacacgctcagrccatacctacatacatgcccaatgtatttactcattatacaaagactttttttccatttcctggtatatataagatactgtgatggtactgaaaaaaacc

SEQ ID NO: 55807 - DNA, 201 bp, Homo sapiens
tttatcccatgagaatccagcccatctttcattaaaacaaacaaccacagtgagccacagcatgggaaataacgtgatggactcaccatctgcctatacayacacgctcaggccatacctacatacatgcccaatgtatttactcattatacaaagactttttttccatttcctggtatatataagatactgtgatggtac

SEQ ID NO: 55808 - DNA, 201 bp, Homo sapiens
ctatcagtagggaaagtccaatatacatggaggtgttaatgatgtgtctttgggtgcacaaagtacaaagtaagacatctaagtttcaggggatggacacrtttcatattcatacagacaaccagcctgcataggggagttagacgctgtggctcgggggaaaaaattgagataatcagatggctaagatgaaataaagag

SEQ ID NO: 55809 - DNA, 201 bp, Homo sapiens
gcatctcttctttcttgacttttcaatcatcgccattctgactggcatgagagggcatctcattgcgtttttctttctttttttgagacggagtctcgctstgtcgcccaggctggagtgcagtggcgcaatctctgctcactgcaagctccgcctcccaggctcacgccattctcctgcctcagcctcccgagtagctga

SEQ ID NO: 55810 - DNA, 201 bp, Homo sapiens
ttgcgtttttctttctttttttgagacggagtctcgctctgtcgcccaggctggagtgcagtggcgcaatctctgctcactgcaagctccgcctcccaggytcacgccattctcctgcctcagcctcccgagtagctgagactacaggggcccgccaacacaaatacaaaatacaaaaaatataattttttgtatttttag

SEQ ID NO: 55811 - DNA, 201 bp, Homo sapiens
cctctgcctcccaggttcaagcaattctcctgcctcagcctcccgagtagctgggattacaggcacccaccaccatgcccagctaatttttgtatttttartagagacagggttttaccatgttggccaggctggtctcaaactcctgacctcgggcaatctgcctgcctcagcttcccaaagtgctgggattacaggcat

SEQ ID NO: 55812 - DNA, 201 bp, Homo sapiens
caacctctgcctcccaggttcaagcaattctcctgcctcagcctcccgagtagctgggattacaggcacccaccaccatgcccagctaatttttgtatttytagtagagacagggttttaccatgttggccaggctggtctcaaactcctgacctcgggcaatctgcctgcctcagcttcccaaagtgctgggattacagg

SEQ ID NO: 55813 - DNA, 201 bp, Homo sapiens
atctcaactcactgcaacctctgcctcccaggttcaagcaattctcctgcctcagcctcccgagtagctgggattacaggcacccaccaccatgcccagcyaatttttgtatttttagtagagacagggttttaccatgttggccaggctggtctcaaactcctgacctcgggcaatctgcctgcctcagcttcccaaagt

SEQ ID NO: 55814 - DNA, 201 bp, Homo sapiens
atgatctcaactcactgcaacctctgcctcccaggttcaagcaattctcctgcctcagcctcccgagtagctgggattacaggcacccaccaccatgcccrgctaatttttgtatttttagtagagacagggttttaccatgttggccaggctggtctcaaactcctgacctcgggcaatctgcctgcctcagcttcccaa

SEQ ID NO: 55815 - DNA, 201 bp, Homo sapiens
gaggtatgatctcaactcactgcaacctctgcctcccaggttcaagcaattctcctgcctcagcctcccgagtagctgggattacaggcacccaccaccahgcccagctaatttttgtatttttagtagagacagggttttaccatgttggccaggctggtctcaaactcctgacctcgggcaatctgcctgcctcagctt

SEQ ID NO: 55816 - DNA, 201 bp, Homo sapiens
tacagaggtatgatctcaactcactgcaacctctgcctcccaggttcaagcaattctcctgcctcagcctcccgagtagctgggattacaggcacccaccrccatgcccagctaatttttgtatttttagtagagacagggttttaccatgttggccaggctggtctcaaactcctgacctcgggcaatctgcctgcctca

SEQ ID NO: 55817 - DNA, 201 bp, Homo sapiens
ttaacaagaccatactacagtgacgtggacatcatgagagacatcgcctctgggctaataggactacttctaatctgtaagagcagatccctggacaggcraggaatacaggtattttgtccttgaagtaacctttcagaaattctgagaatttcttctggctagaacatgttaggtctcctggctaaataatggggcatt

SEQ ID NO: 55818 - DNA, 201 bp, Homo sapiens
gagtacagaggtatgatctcaactcactgcaacctctgcctcccaggttcaagcaattctcctgcctcagcctcccgagtagctgggattacaggcacccrccaccatgcccagctaatttttgtatttttagtagagacagggttttaccatgttggccaggctggtctcaaactcctgacctcgggcaatctgcctgcc

SEQ ID NO: 55819 - DNA, 201 bp, Homo sapiens
ctcgtgatttgcccgcctcggcctcccaaagtgctgagagtacaggcgtgagccaccgcgcccggcctcattgtggttttgatttgcatttctctcatgawcactgatgttgagctttttaaaatgtgctttttggccgcatgtagttgcttttgcaaactaaggtaataaagagggcaggggaaaagtggttcatgtttc

SEQ ID NO: 55820 - DNA, 201 bp, Homo sapiens
aggctggagtacagaggtatgatctcaactcactgcaacctctgcctcccaggttcaagcaattctcctgcctcagcctcccgagtagctgggattacagscacccaccaccatgcccagctaatttttgtatttttagtagagacagggttttaccatgttggccaggctggtctcaaactcctgacctcgggcaatctg

SEQ ID NO: 55821 - DNA, 201 bp, Homo sapiens
acctatacttataagtggaacatcttagagtttgatgaacccacagaaaatgatgcccagtgcttaacaagaccatactacagtgacgtggacatcatgaragacatcgcctctgggctaataggactacttctaatctgtaagagcagatccctggacaggcgaggaatacaggtattttgtccttgaagtaacctttca

SEQ ID NO: 55822 - DNA, 201 bp, Homo sapiens
actctgtcgcccaggctggagtacagaggtatgatctcaactcactgcaacctctgcctcccaggttcaagcaattctcctgcctcagcctcccgagtagstgggattacaggcacccaccaccatgcccagctaatttttgtatttttagtagagacagggttttaccatgttggccaggctggtctcaaactcctgacc

SEQ ID NO: 55823 - DNA, 201 bp, Homo sapiens
cactctgtcgcccaggctggagtacagaggtatgatctcaactcactgcaacctctgcctcccaggttcaagcaattctcctgcctcagcctcccgagtarctgggattacaggcacccaccaccatgcccagctaatttttgtatttttagtagagacagggttttaccatgttggccaggctggtctcaaactcctgac

SEQ ID NO: 55824 - DNA, 201 bp, Homo sapiens
tcaaaaaaagaggatgcaaacactctgtatgtactaatacaaaaagttctccaagatatgttattaaattaaaaagctgggatgtagtatagcgtgtatayatagctgccttttgttaaaggagtgaaagggataagaatatttatattttcttatttgtaagacataaaggtattctggaattacacgcatgaaattaat

SEQ ID NO: 55825 - DNA, 201 bp, Homo sapiens
tatctaatggctacatgttatccaggttccaagtagaatatttaaagaattcaattgaacaatgagaacatttagacacaggatggggaacatcacacacyggggcctgtcggggggggggggtggggggcggggggagggatagcattaggagatatacctaatgttaatgacaagttaatgggtgcagcacaccaacat

SEQ ID NO: 55826 - DNA, 201 bp, Homo sapiens
ttgatttaactttgtagatcgtgttcaaaaatatggccagccgcccctatagcatttaccctcatggagtgaccttctcgccttatgaagatgaagtcaaytcttctttcacctcaggtttgaatctttcacttctactgaatccaactagtaacttctgagaggctgccacatttttctgctattctccttgcccggtgg

SEQ ID NO: 55827 - DNA, 201 bp, Homo sapiens
tttaataaattaggatacattcatacaatggaatactaagcatcaaaaaaagaggatgcaaacactctgtatgtactaatacaaaaagttctccaagataygttattaaattaaaaagctgggatgtagtatagcgtgtatacatagctgccttttgttaaaggagtgaaagggataagaatatttatattttcttatttg

SEQ ID NO: 55828 - DNA, 201 bp, Homo sapiens
ggaatagggaaggaagaagacaaagaaaggaagaaaggagaaaagaaaagaaactaggaaaggaaaaagaaaagaaagggaagagaaaggaaggggagggraaggattaatcatttcagttttcaaaaagtgtagttgcttcagtaagaggagttttattggccttttaccccatcatgtaaaacatttcaggcttttttc

SEQ ID NO: 55829 - DNA, 201 bp, Homo sapiens
tggaaatctaactatacagatacacttgttcacaggtgaaatgatgtatgtacaacatattcactgttgcaacgttagtagtagtaagactggaaacaacycaaaatgtccatcagtagaaaactagtttaataaattaggatacattcatacaatggaatactaagcatcaaaaaaagaggatgcaaacactctgtatgt

SEQ ID NO: 55830 - DNA, 201 bp, Homo sapiens
atccaacacaaaagggtgtgtaatgatgattccattgatatgacattacagaaaagccaaattatagtgaaataaagcagattagtggttgtctgggcccrgagggcattggctacaaatggcatgaagaaatgttttggaatgatggaactcttctctatcttgattggaactatagctataagactgggtaattgtttt

SEQ ID NO: 55831 - DNA, 201 bp, Homo sapiens
cagtcttgcttctcaatgcagaatcctttcttcccatgcactaactccctctttctcccttgccctttcaagccacctgcaccgcagacaaactttcctcrgttcctaacaaccaaacttagatattttgctcttagatttataacttgctctttggggatggagaaagcgaaggaattggcaaaggtttttttttttttt

SEQ ID NO: 55832 - DNA, 201 bp, Homo sapiens
gacttgtcattaaaacaatcaaaaagtaagtaaaaataacaattgaaaatcctcacatcatcttcacatcttcttcccttaggcagagcttcgaccactasagctagagagctgagaggattaagtgcttgaactcagccctattggcggttctggtgatttgactccctccagctgagatcagactggggtgaccaaaca

SEQ ID NO: 55833 - DNA, 201 bp, Homo sapiens
atataaagatggcagttttaaattcaaccatatcatcaattacattaaaagtaaatggaaagaacactacaattaagaaacaaataagattgaataaaaaagcaatgctaaactgtatgcagaatttaagaaatccactttaatgagagagacaaagataggtaaaaaataaaggatagaaaattatataccataccagct

SEQ ID NO: 55834 - DNA, 201 bp, Homo sapiens
acactgcattttaaggagagtgtgtaaccccaaagtgatttcgttgacttgtcattaaaacaatcaaaaagtaagtaaaaataacaattgaaaatcctcayatcatcttcacatcttcttcccttaggcagagcttcgaccactagagctagagagctgagaggattaagtgcttgaactcagccctattggcggttctgg

SEQ ID NO: 55835 - DNA, 201 bp, Homo sapiens
tcctttagatagaagaaatattatgtcagagagacatttagattcataagaaggaatgaaaagttccagaagttgataaatatagagaaattttttcctcrttttaatctattaaaaaggcaattgattatctaaatgttaaagcaaaatagtaacaatttattgtggggtatattatgtatatataaataaaatgtatga

SEQ ID NO: 55836 - DNA, 201 bp, Homo sapiens
cttccaccaaagcctcctagtgatgcaaggaatcctggctttgttgcaatggtctcctaaaaaaaacaagcctttgtgtgggtaaggaactgattctcagscccattatctagtatctagtgattatgtatctgagatgtaaaacagaaacctaaaagccaaggatggagtctccccacagagcaaatgagcattttccca

SEQ ID NO: 55837 - DNA, 201 bp, Homo sapiens
gcagaaagaatttctcactaacagagcagaaaaaaatgttaaaggaactcctttagatagaagaaatattatgtcagagagacatttagattcataagaargaatgaaaagttccagaagttgataaatatagagaaattttttcctcgttttaatctattaaaaaggcaattgattatctaaatgttaaagcaaaatagt

SEQ ID NO: 55838 - DNA, 201 bp, Homo sapiens
aagtatatggatgccaagaaaagcaaaaccatatgcacaaaaataaaaataaattgatctgagcttagagtttacgaatttatagttcccaaaagaataaytgggggtaaatgggacaaggtagggaaagaccatcagtagaaactaagaatagtaaacatttgtaaaaaccctctgccttataaagcagaataaattgaa

SEQ ID NO: 55839 - DNA, 201 bp, Homo sapiens
aggtacaattaaagaagggaagctgacattgctgtaatgtaaaaaaatattttatatggaaatttagcatctcagactttggcttcagaacataaggaacmagatttaccctttttctcaacaactagacaggcagacaaaacatataaaacagaagttttcagacatcgaatgacagacaactcaagacagtaaaagaag

SEQ ID NO: 55840 - DNA, 201 bp, Homo sapiens
aatacaatccagcacttttccttgaggaactcacacttgggtgaccaaaatgtgcaggacacaaatacttatgatctagtagaagaaaatgaattagtcayataatctcacaggcatttaattacaaattgtgatgggtgctgtaaaagaaaaaaatgtgtatcagaattggagataaaggtagaagtgaacagatattca

SEQ ID NO: 55841 - DNA, 201 bp, Homo sapiens
tgaacaaaattggtccagtaagaactgatcatcagaaagcagaaaagggcagctaagatccagatccaacaaaattctgtgcaggagtttggtcctgttgytaaccagatctccaggtttttgttttttaaagagaaaccagtaatccaaattcttatataatttctccggatgtttaatgttggcatttaatctatttta

SEQ ID NO: 55842 - DNA, 201 bp, Homo sapiens
ctcaatacacttggtgagtgaatgtttgatcacagagtacttgactgaatgcttattttggcctgtgtctctccctctttctcagatataacagtttgtgyccatgaccacatcagctggcatctgctgggaatgagctcggggccagaattattctccattcatttcaacggccaggtcctggagcagaaccatcataag

SEQ ID NO: 55843 - DNA, 201 bp, Homo sapiens
cttaacaagaccatactacagtgacgtggacatcatgagagacatcgcctctgggctaataggactacttctaatctgtaagagcagatccctggacaggygaggaatacaggtattttgtccttgaagtaacctttcagaaattctgagaatttcttctggctagaacatgttaggtctcctggctaaataatggggcat

SEQ ID NO: 55844 - DNA, 201 bp, Homo sapiens
gataatgctgttcagccaaatagcagttatacctacgtatggcatgccactgagcgatcagggccagaaagtcctggctctgcctgtcgggcttgggcctrctactcagctgtgaacccagtaggtactttcattgaaagtttttctcattcccctaacctcgtaatctgaagtccaccaaatggaagagtcggggttatt

SEQ ID NO: 55845 - DNA, 201 bp, Homo sapiens
catattttaaatatatgagttgcatatgaatgtgatgtcacaaaattagttctataatatatagccatctgctggtaagccagctctccaaataaaacacrttttctgccagacattgttcgttgtatctaagtgttgccaaattctctatacaaaaatttgctcttctagatttttccaaaacattccaatgcttgactt

SEQ ID NO: 55846 - DNA, 201 bp, Homo sapiens
ctttaaaaagcttgtttcatggagaatttaatattattcttttcttttagttatattctcatattttaaatatatgagttgcatatgaatgtgatgtcacmaaattagttctataatatatagccatctgctggtaagccagctctccaaataaaacacgttttctgccagacattgttcgttgtatctaagtgttgccaa

SEQ ID NO: 55847 - DNA, 201 bp, Homo sapiens
tgattcacatggtgagtacacagggaaccatgactggtcattctgtcccctcatcctgtgggtaagtttccaaagttctggagattcgttcctctggtagsaattgttgagtcaaaaccatagaaacacaacccagacaaactgtcatattgtttaaccctaaatcatatcatttctctctagcattttcttatgaaaaat

SEQ ID NO: 55848 - DNA, 201 bp, Homo sapiens
gagtctcactctgtcgcccaggctggagtacagaggtatgatctcaactcactgcaacctctgcctcccaggttcaagcaattctcctgcctcagcctccygagtagctgggattacaggcacccaccaccatgcccagctaatttttgtatttttagtagagacagggttttaccatgttggccaggctggtctcaaact

SEQ ID NO: 55849 - DNA, 201 bp, Homo sapiens
ttgctactgtgaataatgctgtgatgaacatcctagtacatgtgtcttttcagtagaacaatgtattttctgtctttctttcttttttttttttttgagayggagtctcactctgtcgcccaggctggagtacagaggtatgatctcaactcactgcaacctctgcctcccaggttcaagcaattctcctgcctcagcctc

SEQ ID NO: 55850 - DNA, 201 bp, Homo sapiens
atagtacccaatagtttttcatcccttgctcatctccttccttcccccttctagaagtccccagtgtttattgccatctttatgttcatgagtacccaatrtttagctcccacttataagtgagaacatgtggtatttggctttctgtttctgcattaattcacttagcataatagcctccagctggcatccatgttgttg

SEQ ID NO: 55851 - DNA, 201 bp, Homo sapiens
actaaaataaggactgaactttgtgacctccacagtcctgtgtaaagctaacataaaaacaaacaaaaagcttcaggcacaagatcagaataaactccagsagtaggagttcaaggaaaggaataggacaaccgtgggtggcaagacaggggtagggaaagataggacctctgtcccagaaatcagagtttaccattgctt

SEQ ID NO: 55852 - DNA, 201 bp, Homo sapiens
ggagttttagaccagcctgggcaatgtagtgagactctgtttctatttaaaaaaatacatacatatatatatatatatatatatatatatatatatatatttaaattagccagacatggtggtacatacctgtcatttcagctactggggaggctaaggcaagagggtcatttaggacaagagcatcacttgagcccagga

SEQ ID NO: 55853 - DNA, 201 bp, Homo sapiens
gagactcaaaagggaacgggggatggatgaaaagctacctattgggtacagggtacactactcaggtgacaggtacactaaaatcctagacttcaccactmtacaattcatccatgtaaccaaaaaccacttgcattcctaaagcaactgaagttttttaaaaaatttaaaaatcaaaattaatgcacgaaagccacaata

SEQ ID NO: 55854 - DNA, 201 bp, Homo sapiens
aggagttttagaccagcctgggcaatgtagtgagactctgtttctatttaaaaaaatacatacatatatatatatatatatatatatatatatatatatatttaaattagccagacatggtggtacatacctgtcatttcagctactggggaggctaaggcaagagggtcatttaggacaagagcatcacttgagcccagg

SEQ ID NO: 55855 - DNA, 201 bp, Homo sapiens
caggagttttagaccagcctgggcaatgtagtgagactctgtttctatttaaaaaaatacatacatatatatatatatatatatatatatatatatatatatttaaattagccagacatggtggtacatacctgtcatttcagctactggggaggctaaggcaagagggtcatttaggacaagagcatcacttgagcccag

SEQ ID NO: 55856 - DNA, 201 bp, Homo sapiens
aataaatctaaggcttggctgatccaggccccacttggctgctgaagggctggaggtgggaagagggatcaataaataggtgcactagaaacctgccatgrcacacctgtcaggagttgcagtacttccctttgggtggagagaagccaccatgattcacaatggagaaagtagctgaaacctggaatcagtttcctgttg

SEQ ID NO: 55857 - DNA, 201 bp, Homo sapiens
agtaatattcagtggcatctagaatattttctctttccatttgcatttgggcacttatgagaaggcaaaatcatagcaatcgttaagagaaaaaataactrattcccacttagaccacatctcttctatttctctctggtagaactgacctacaactaaagatccagggtatatgatactagcctgagggaaaaacattaa

SEQ ID NO: 55858 - DNA, 201 bp, Homo sapiens
gccaggagttttagaccagcctgggcaatgtagtgagactctgtttctatttaaaaaaatacatacatatatatatatatatatatatatatatatatatatatttaaattagccagacatggtggtacatacctgtcatttcagctactggggaggctaaggcaagagggtcatttaggacaagagcatcacttgagccc

SEQ ID NO: 55859 - DNA, 201 bp, Homo sapiens
aactaggcacaatggctgacctcatggcacttatacccagtgagagacagatattaatagataatctcacaaataaattatatataatctacaatatataytctagagatattataagaatactacaggaatttactatatatactataataatactatagaaatatgagaaattgatatagagacttgacctagtctaaa

SEQ ID NO: 55860 - DNA, 201 bp, Homo sapiens
caaggtgggaggattgcttgaggccaggagttttagaccagcctgggcaatgtagtgagactctgtttctatttaaaaaaatacatacatatatatatatrtatatatatatatatatatatatatttaaattagccagacatggtggtacatacctgtcatttcagctactggggaggctaaggcaagagggtcatttag

SEQ ID NO: 55861 - DNA, 201 bp, Homo sapiens
cttcttggactcttaaagcagtgctttccaatattttttacttcaaagcacacaaagaaaataatatctgcctggcattctgaggtaaaagaatgaagcawtaaatctaaggcttggctgatccaggccccacttggctgctgaagggctggaggtgggaagagggatcaataaataggtgcactagaaacctgccatggc

SEQ ID NO: 55862 - DNA, 201 bp, Homo sapiens
ttttaatttttaaaggaacctcccatactgttttccataatggctgtactaatttacactctcaccaagagtatacaagagttcccttttcttcacatccwtgccaacatttatctcttgtcatttttataatagccatcctaacggtgtgaggtgagccctcattgtgattttaaattgcatttctctgattattagtaa

SEQ ID NO: 55863 - DNA, 201 bp, Homo sapiens
ctactatttgctgtgtttgatgaaagcaagagctggagccagtcatcatccctaatgtacacagtcaatggatatgtgaatgggacaatgccaggtaacaygagggctgtgtaccattaaacaacagtaaaatcattagtaatttttcggtcctgttttcttcaaagcactagagaagttgaccatactcactgttttgca

SEQ ID NO: 55864 - DNA, 201 bp, Homo sapiens
gacagaaagaaggcaagtaatccaaagatggattgacacatcaaagtagagcaaaatgagtatagggacccaagagtcttggaaaggcatgcatgaagacrtttcaagtgatcagtaagattttcagaacaaaaggaattccctgaatgagggttccggcatttgctgcagttctaaagttcagtggccaaaagcactgcc

SEQ ID NO: 55865 - DNA, 201 bp, Homo sapiens
aatggagtatcagtgaggacagtggacccacccatgatgaccctccatgcctcacacacatctattactcccatgaaaatctgatcgaggatttcaactckgggctgattgggcccctgcttatctgtaaaaaaggtaagaacacccccaccaaaagattcaacaactaaatgttggaatggtcaggagttctgtcatggg

SEQ ID NO: 55866 - DNA, 201 bp, Homo sapiens
gatttgagagtggtgaaaacgcaatcctcagaaactgcccacatgtcttgatggctgttactcctccaggtgcttcttaccttgaccacacattccctgcrgagaagatggacgacgctgtggctccaggccgagaatacacctatgaatggagtatcagtgaggacagtggacccacccatgatgaccctccatgcctca

SEQ ID NO: 55867 - DNA, 201 bp, Homo sapiens
tctctcaccccaaaacatttgcaaggcaagaaactctcctgacagtcttgcttctcaatgcagaatcctttcttcccatgcactaactccctctttctccyttgccctttcaagccacctgcaccgcagacaaactttcctcagttcctaacaaccaaacttagatattttgctcttagatttataacttgctctttgggg

SEQ ID NO: 55868 - DNA, 201 bp, Homo sapiens
tcccaaagagaaattctgtcaccagctgatgatagggaatctttcacctaattaaatgaggaattcctcaggcagaggaaactgttcattccacttggctmtctatggcactcacctctccccttcctgacctcacttgctccattttattattgaaaacctcacccaaccctctacacttcttttaatattgagtatctc

SEQ ID NO: 55869 - DNA, 201 bp, Homo sapiens
cagttggaaagaagatctgaaatagcaaaacaaaataatacataaacagctctgactatcctcccatctcatgttaataggctaagtatgtcttattaaasaccacaaagaagatatcacccattcttatattctgagatggtttactaatcaaaggcgattcaattctctgattatatttaaataataattgttcaggta

SEQ ID NO: 55870 - DNA, 201 bp, Homo sapiens
agacacaacaaagtccactttatgctagcgcaaagttcacaaactcagatgcctatagtagccagataagtagttcagtgaacaaaattggtccagtaagdactgatcatcagaaagcagaaaagggcagctaagatccagatccaacaaaattctgtgcaggagtttggtcctgttgttaaccagatctccaggtttttg

SEQ ID NO: 55871 - DNA, 201 bp, Homo sapiens
caaagtgaaagtacagcctagagtaaatattagttattagtgtcaagctatcctttggggtgtgttgggggaagacacaacaaagtccactttatgctagygcaaagttcacaaactcagatgcctatagtagccagataagtagttcagtgaacaaaattggtccagtaagaactgatcatcagaaagcagaaaagggca

SEQ ID NO: 55872 - DNA, 201 bp, Homo sapiens; identical to SEQ ID NO: 16221

SEQ ID NO: 55873 - DNA, 201 bp, Homo sapiens
tttgattacaaagtcaaaatcacattcaccaaaactgcatctcacaaatgcttcctcttaatagctgtttgtattttatactttatattaatgtatgttgyaaaatcaaagatacaacaaacctgttttattctagactaaaggtaaaataatttgaagtgaaaagaataaaagcattgataaaattacaccccaattgtc

SEQ ID NO: 55874 - DNA, 201 bp, Homo sapiens
aacaaaatccttttgagctctgtgcttttttgcataacttggtctaaaaaaaaagcaaaggttttaacatcttccttatctatgtgtttttgtcattttcrtaggcaaacaacaataagcagtggctagaaattgatctactcaagatcaagaagataacggcaattataacacagggctgcaagtctctgtcctctgaaa

SEQ ID NO: 55875 - DNA, 201 bp, Homo sapiens
ccatacctacatacatgcccaatgtatttactcattatacaaagactttttttccatttcctggtatatataagatactgtgatggtactgaaaaaaaccktaaaacttacaaaagactcttcttgcattttaccatcagcagcatgtttttctcatagtgagaatggattaatgctgatacttccacccaattatctaat

SEQ ID NO: 55876 - DNA, 201 bp, Homo sapiens
tctcttcttttcagtttagagcttaattttttttattttgattacaaagtcaaaatcacattcaccaaaactgcatctcacaaatgcttcctcttaatagytgtttgtattttatactttatattaatgtatgttgtaaaatcaaagatacaacaaacctgttttattctagactaaaggtaaaataatttgaagtgaaaa

SEQ ID NO: 55877 - DNA, 201 bp, Homo sapiens
ttgtggttattgtttttgtcatttgttggtagtaatattatttcttatctcctctgcagtgcatgaagccatgcagggaatattggtgtgtaattaatcamgttacttttcttttgataggatgttccacacccctgggtatggaaaatggaaagatagaaaacaagcaaatcacagcttcttcgtttaagaaatcttggt

SEQ ID NO: 55878 - DNA, 201 bp, Homo sapiens
gcagctgaacaaggacttcttgtgctctagcacaatagttgtccctgtccatttctcttcttttcagtttagagcttaattttttttattttgattacaaagtcaaaatcacattcaccaaaactgcatctcacaaatgcttcctcttaatagctgtttgtattttatactttatattaatgtatgttgtaaaatcaaaga

SEQ ID NO: 55879 - DNA, 201 bp, Homo sapiens
aacggctatagtttgtatatttaataaatcacaaaaatgtggatcccttttccaaagagacttgcaagtcctgtgcaatgaaatcagctctttataaaacrtcagcattgattcgcccattgcctacattatagcttctaaaagaatattctgaatctttgaatgtagtgaagcattcactaagtttattaacttaggaga

SEQ ID NO: 55880 - DNA, 201 bp, Homo sapiens
ggcaagaggattacttgagaggagtttaaggctgcagtgagccatgactgtgccactggactcaagcctgggcaacagaataagaccctgtctaaaaaaamacaaaaacaaaaaaccttagccatttatgttgtcattaaagattttctcttatttggctttcagatttttgaaggaaatactaataccaaaggacatgtg

SEQ ID NO: 55881 - DNA, 201 bp, Homo sapiens
gacctacctgagattcaaactaggcctgactcttccaaagtcctcaggtcactcaaacttcaatgtcatgacagtatctggcaacatcactgccatatatrtggtgttcaatgagtgtttttgaaatctgaattggcttcccaacttcctgaaaccacaattcttctttatattttctttcataccctgtgtaggtactca

SEQ ID NO: 55882 - DNA, 201 bp, Homo sapiens
gggtcatttttaggaattctgtcttgggctttaaaatggctagtcttggctgggcatagtggctcatgactgtaatcccagcactttgggaggccaaggtrggaggattgcttgaggccaggagttttagaccagcctgggcaatgtagtgagactctgtttctatttaaaaaaatacatacatatatatatatatatata

SEQ ID NO: 55883 - DNA, 201 bp, Homo sapiens
ataaaaatccctctcattacccctttatagtcacatctgccttcctcccaccatagcccttccttattccctggcaaccagtagtctgatctccatttctrtaattttgtcatttcaagaatattacataaatggaatcaggcaacatgtaacctttggggactggtattttttcactcagtataattctctggagattca

SEQ ID NO: 55884 - DNA, 201 bp, Homo sapiens
agctggggtcatttttaggaattctgtcttgggctttaaaatggctagtcttggctgggcatagtggctcatgactgtaatcccagcactttgggaggccraggtgggaggattgcttgaggccaggagttttagaccagcctgggcaatgtagtgagactctgtttctatttaaaaaaatacatacatatatatatatat

SEQ ID NO: 55885 - DNA, 201 bp, Homo sapiens
ccgagggagtgagatgcagggcctgtccagagtgaatagggatggaaccaccttcaaaatcttgtattccattcaaggctcacaacccacttttatggcaktcggagttgctttacccactcccttgtgttctgtgagtttgcatgttatgctcagagtctggaaagatgggattagtaggggaggtagaccagaagaaag

SEQ ID NO: 55886 - DNA, 201 bp, Homo sapiens
gtacagctggggtcatttttaggaattctgtcttgggctttaaaatggctagtcttggctgggcatagtggctcatgactgtaatcccagcactttgggakgccaaggtgggaggattgcttgaggccaggagttttagaccagcctgggcaatgtagtgagactctgtttctatttaaaaaaatacatacatatatatat

SEQ ID NO: 55887 - DNA, 201 bp, Homo sapiens
ttaatctgatgcctgacatctccacattagaactctgtttaaaacaccttttcctatgacttcctatttaaatgttgcactcaataccacatgagaacaactagctacctgagtatttctaagcaaggccccgagggagtgagatgcagggcctgtccagagtgaatagggatggaaccaccttcaaaatcttgtattcca

SEQ ID NO: 55888 - DNA, 201 bp, Homo sapiens
gatgtagaaatctcctttttgcatttacttgtttagatcagaatttctaagagatccaaatcccttttttaaaagaatatttacaattcagttttgcttasgggtagaaagccatgttgaactgggctctttgttctgggatgaagatacagaaagagaagagagaggaggaaaggagcaaggcttagtcaactacaaatt

SEQ ID NO: 55889 - DNA, 201 bp, Homo sapiens
cattaatctgatgcctgacatctccacattagaactctgtttaaaacaccttttcctatgacttcctatttaaatgttgcactcaataccacatgagaacaactagctacctgagtatttctaagcaaggccccgagggagtgagatgcagggcctgtccagagtgaatagggatggaaccaccttcaaaatcttgtattc

SEQ ID NO: 55890 - DNA, 201 bp, Homo sapiens
tcagtgacttttatgaagttatttaacctctgtgtgcctcatctttctcatctgtaaaatggtaataataatcatgtctctgtcatacaggtttgttgtcrtgaaatcttagaataatgactggcatataacagataataaatattagccatgatagtaaagataattcttcaattaaaatgtgttcaaataatttagtat

SEQ ID NO: 55891 - DNA, 201 bp, Homo sapiens
ctgccccttcctttcacatactaagctccacctccccactggataactgtcagttctctaaaaaggccacattttctggcacctcagggcctttgcgcacrctactctaactttttagaatgtctttggccatcccttttcctctctgcctttggacctcagttaaaggattaattcctcgggaagggattccccaactca

SEQ ID NO: 55892 - DNA, 201 bp, Homo sapiens; identical to SEQ ID NO: 16231

SEQ ID NO: 55893 - DNA, 201 bp, Homo sapiens
agttccagaccagcctggcccacatggtgaaaccccgcctctactgaaaatacaaaaattagttgtgcatgatggtacatgcctgtagtcccagctactcrggaggctgagacatgagaatcacttgaacccaggaggtggaggctgcagtgagctgacatcgcatcacttcactccaacctgggtgacagagcgaaactc

SEQ ID NO: 55894 - DNA, 201 bp, Homo sapiens; identical to SEQ ID NO: 16234

SEQ ID NO: 55895 - DNA, 201 bp, Homo sapiens
tctgttcttgtaccagtactatactgttttgtcctccagagggcagcagacatcgaacagcaggctgtgtttgctgtgtttgatgagaacaaaagctggtmccttgaggacaacatcaacaagttttgtgaaaatcctgatgaggtgaaacgtgatgaccccaagttttatgaatcaaacatcatgagcagtaagtcagag

SEQ ID NO: 55896 - DNA, 201 bp, Homo sapiens
gatcctcagagtctagagtcatggtaatcaccttctctagtaggtaatcacacatgtgaggatgatttctgcatgttctgttcatatagcttcagatgacygacagctagggattatcagagctgacaggtgccaggtcaaataattcaaacagaaaattactctcagctttctttgcataacttccttttggcagtgaat

SEQ ID NO: 55897 - DNA, 201 bp, Homo sapiens
cttggcctcccaaagtgctggtattacaggcgtgagccaccgcgccaggcctacatttaagtctttaatccatcttgagttaatttttgtatatgatgtawgaaaggggtccagtttcaattttctgcctacggctagccagttttcccagaaccatttatggaatagagaatcctttccctattgcttgcttttgtcaca

SEQ ID NO: 55898 - DNA, 201 bp, Homo sapiens
gttttacgtttaagtgtgttgttgttgttttttgtttgtttgtttctgttatttttgagatggagtctcgttctgttgcccaggctggagtgcagtggtaygatctcagctcactgcaacctctgcctcccatgttcaggtgattctcctgcctcggcccctcggcctcccgagtagctgggattacaggcataagccacg

SEQ ID NO: 55899 - DNA, 201 bp, Homo sapiens
gggttttacgtttaagtgtgttgttgttgttttttgtttgtttgtttctgttatttttgagatggagtctcgttctgttgcccaggctggagtgcagtggyacgatctcagctcactgcaacctctgcctcccatgttcaggtgattctcctgcctcggcccctcggcctcccgagtagctgggattacaggcataagcca

SEQ ID NO: 55900 - DNA, 201 bp, Homo sapiens
tcatcgcctttggaatagatacatcactacaatggattggaagtttgtgtcctccaaaaattcacatactgaaatctaacctccagtgtgatggcattagyaggtggggcctttgggagatttttttttattatactttaagttttagggtacatgtgcacattgtgcaggttagttacatatgtatacatgtgccatgct

SEQ ID NO: 55901 - DNA, 201 bp, Homo sapiens
ttatgtgcaggatgtgcaggtttgttacataggtaaacatgtgtcatggaggtctgttgtacttactacttcatcacccaggtattaagcctagtatccaytagttattttttctgatcctctccctctttccaccctccatcctctgataggccccagtatgtattgttcccttctatgtgtccatgtgttctcataatt

SEQ ID NO: 55902 - DNA, 201 bp, Homo sapiens
tacagacatagtttaaatatttgttttcacaggacttcttgggcctactttatatgctgaagtcggagacatcataaaagttcactttaaaaataaggcasataagcccttgagcatccatcctcaaggaattaggtacagtaaattatcagaaggtaagataaatctaatatttttctgaaaagggaaaatgtctaagtc

SEQ ID NO: 55903 - DNA, 201 bp, Homo sapiens
gtagccctagaagaaatctagaggtcaaacctatcacaattagggcaccaacatgtaccctagagttaactaggcagagcccctcaggggcccaggccctktcttctttacatttgtactctggcatttagcacagagcctggaacctagtggatgatgatggtcatgatcatgatgatattaatcattactgaactaaac

SEQ ID NO: 55904 - DNA, 201 bp, Homo sapiens
attattggcatataatattgcctctggtcctatgaatctaagaaaggtaaatacatattggtagggaaagtaaaattttaccttggaaatgagatgcaaayctagtaagcagatagtatcttttatggtaaaagacaagccttataagttgattttattatgccctctgcattaaaataaaacatctcctcctccatgtct

SEQ ID NO: 55905 - DNA, 201 bp, Homo sapiens
agggcctttgcgcacgctactctaactttttagaatgtctttggccatcccttttcctctctgcctttggacctcagttaaaggattaattcctcgggaarggattccccaactcacctccaattggactagattccactgtcaaatactcttcagagtattccctccttttctgtcataatatttaccataggtttaaat

SEQ ID NO: 55906 - DNA, 201 bp, Homo sapiens
ccagaaatcagagtttaccattgcttctgtaaccagttactgcaaacttagtggctaaaacaacacaaatttattcttttatgattatatatctgcagatsagaagtccaaaatgggttttattgggctaaaatcaaggtgttggcagagctgcattccttctggaggctctgggggagaattgtttccttgtcttttcca

SEQ ID NO: 55907 - DNA, 201 bp, Homo sapiens
cccagaaatcagagtttaccattgcttctgtaaccagttactgcaaacttagtggctaaaacaacacaaatttattcttttatgattatatatctgcagaygagaagtccaaaatgggttttattgggctaaaatcaaggtgttggcagagctgcattccttctggaggctctgggggagaattgtttccttgtcttttcc

SEQ ID NO: 55908 - DNA, 201 bp, Homo sapiens
ccaaggcagatggatcacttgaggtcaggagttccagaccagcctggcccacatggtgaaaccccgcctctactgaaaatacaaaaattagttgtgcatgrtggtacatgcctgtagtcccagctactcaggaggctgagacatgagaatcacttgaacccaggaggtggaggctgcagtgagctgacatcgcatcacttc

SEQ ID NO: 55909 - DNA, 201 bp, Homo sapiens
tgaggccaggcgtggtggctcatgcactttgggaggccaaggcagatggatcacttgaggtcaggagttccagaccagcctggcccacatggtgaaacccmgcctctactgaaaatacaaaaattagttgtgcatgatggtacatgcctgtagtcccagctactcaggaggctgagacatgagaatcacttgaacccagga

SEQ ID NO: 55910 - DNA, 201 bp, Homo sapiens
ccaggctggtctcaaactcctgacctcgggcaatctgcctgcctcagcttcccaaagtgctgggattacaggcatgagccattgcgcccggctgaacaatktattttcttttttggctatatacccagtaatagaattgctaggtcaaattgtagcaggacaagccacagacaaaaacccctcagacaccaagttaaagaa

SEQ ID NO: 55911 - DNA, 201 bp, Homo sapiens
gggtttcaccatgttggctaggctggtctcgaactcctgacctaaggtgttccacctgcctcagcctcccaaagtgctggtattacaggtgtgagccactstgcccggctcttttgggatattttaatctctgaattttcttatctgttctgtttgcttttgcatattacctttagctctaacaagtgctgtgtacacaat

SEQ ID NO: 55912 - DNA, 201 bp, Homo sapiens
ttgggcctactactcagctgtgaacccagtaggtactttcattgaaagtttttctcattcccctaacctcgtaatctgaagtccaccaaatggaagagtcrgggttatttcttgtcaaatgtctgtcttgcttttcatgaggaatgcataagggtgtggttaacagtctgcatttatcataaccagggactctccatgcag

SEQ ID NO: 55913 - DNA, 201 bp, Homo sapiens
ctggttattttttaattttaaaagaaaaagatgctcatataattttaaattcaaatgcaacttttagtttttatttagtatttgtatttatttacagcttrctcagtaatacaaaggatctgagacagtttctcaagttataaaggcataaaacaaggagtctatgtaattgggatagaatatgcggacaaagaaaataaa

SEQ ID NO: 55914 - DNA, 201 bp, Homo sapiens
ctcttgagtagctgggattacaggcgcccgccaccacccccatgtaatttttgtattttttagtagagacagggtttcaccatgttggctaggctggtctygaactcctgacctaaggtgttccacctgcctcagcctcccaaagtgctggtattacaggtgtgagccactgtgcccggctcttttgggatattttaatct

SEQ ID NO: 55915 - DNA, 201 bp, Homo sapiens
attacattgctgctgaagaaatatcctgggattattcagaatttgtacaaaggtttggccagttttctccttttttattctcatttttccattactgctgmaaaaagtagctactacaattcagggggataattgtgggcaaattatactaagaacagtgtggttcccctattgcaagttggcctgttctttttcctttgt

SEQ ID NO: 55916 - DNA, 201 bp, Homo sapiens
ctcctgcctcagtctcttgagtagctgggattacaggcgcccgccaccacccccatgtaatttttgtattttttagtagagacagggtttcaccatgttgkctaggctggtctcgaactcctgacctaaggtgttccacctgcctcagcctcccaaagtgctggtattacaggtgtgagccactgtgcccggctcttttgg

SEQ ID NO: 55917 - DNA, 201 bp, Homo sapiens
gagatcagactggggtgaccaaacattccattttgccgtggactttttaccagttctaatagttaaagtcctgaatcttgggaaacccctcagaccagaamagtcggttaccttcttggttcccttcttggcctaatcctttagcaatccctgtgtttttgagttcacatccaccatctctaagctctgttgttacctgta

SEQ ID NO: 55918 - DNA, 201 bp, Homo sapiens
gattctcctgcctcagtctcttgagtagctgggattacaggcgcccgccaccacccccatgtaatttttgtattttttagtagagacagggtttcaccatkttggctaggctggtctcgaactcctgacctaaggtgttccacctgcctcagcctcccaaagtgctggtattacaggtgtgagccactgtgcccggctctt

SEQ ID NO: 55919 - DNA, 201 bp, Homo sapiens
caggggcacattattctgcctactacacccaccaaacaaagccctcccacggtgtcctccatctcagagaatggcaccctcctccacccagctccccaaaycagaacctcatcagccatccacagcaactgatgtcctttattctctaccccacatccaatccatcttcaagttccaactattttatctcataaatacatc

SEQ ID NO: 55920 - DNA, 201 bp, Homo sapiens
gagagcagtggcaccattttagatcactgcaacctctgcctcctgggttcaagtgattctcctgcctcagtctcttgagtagctgggattacaggcgcccrccaccacccccatgtaatttttgtattttttagtagagacagggtttcaccatgttggctaggctggtctcgaactcctgacctaaggtgttccacctgc

SEQ ID NO: 55921 - DNA, 201 bp, Homo sapiens
ggacagcccagaagaatctcatctcaagattcttaatcatagatacacagtcccttttgccatataaagtagcatatttccaggtcccagagattaggacrtggacatctcagcaggggcacattattctgcctactacacccaccaaacaaagccctcccacggtgtcctccatctcagagaatggcaccctcctccacc

SEQ ID NO: 55922 - DNA, 201 bp, Homo sapiens
cagagatagacagactttcagctgccatagcgaaatgagatttttcttttgggatttgttttttttttttttttcttttgagacagagtctcactctgtcwcccaggctggagagcagtggcaccattttagatcactgcaacctctgcctcctgggttcaagtgattctcctgcctcagtctcttgagtagctgggatta

SEQ ID NO: 55923 - DNA, 201 bp, Homo sapiens
agatatacctaatgttaatgacaagttaatgggtgcagcacaccaacatgacacatgtatacatatgtaacaaacctgcacgttgtgcacatgtaccctaraacttaaagtataatttaaaaaaaataaaaataaaagaattccttttgcaatattaattggttccagcgaaagcttatttatttatttattatcatgaaa

SEQ ID NO: 55924 - DNA, 201 bp, Homo sapiens
gggggagggatagcattaggagatatacctaatgttaatgacaagttaatgggtgcagcacaccaacatgacacatgtatacatatgtaacaaacctgcaygttgtgcacatgtaccctagaacttaaagtataatttaaaaaaaataaaaataaaagaattccttttgcaatattaattggttccagcgaaagcttattt

SEQ ID NO: 55925 - DNA, 201 bp, Homo sapiens; identical to SEQ ID NO: 16220

SEQ ID NO: 55926 - DNA, 201 bp, Homo sapiens
gggcctgtcggggggggggggtggggggcggggggagggatagcattaggagatatacctaatgttaatgacaagttaatgggtgcagcacaccaacatgrcacatgtatacatatgtaacaaacctgcacgttgtgcacatgtaccctagaacttaaagtataatttaaaaaaaataaaaataaaagaattccttttgca

SEQ ID NO: 55927 - DNA, 201 bp, Homo sapiens
cacgagggctgtgtaccattaaacaacagtaaaatcattagtaatttttcggtcctgttttcttcaaagcactagagaagttgaccatactcactgttttscaactccctatcaagaaggaaatattttctctttttttttttaaacaggaaatagaagagacaaattagaagctagagaagaaatgtgcagccttgttag

SEQ ID NO: 55928 - DNA, 201 bp, Homo sapiens
ataaatatgctattttaaaaaataagaatttcttcaagttgaaatcattatggttgattgcttgccctaaactctttgctatccaggaaagctaatgagcrtcttctatctgcagtgctactgaaaacatgtctttcctttcatagggaccctaactgagggtgggacacagaagacgtttgacaagcaaatcgtgctact

SEQ ID NO: 55929 - DNA, 201 bp, Homo sapiens
ccccccaccaagggtcttactctgtcacccaggctggagtgcagtggtgtgatcatggctcactgcaacctccacttcctgggctcaggcgattctcgcayctcagcctctcaagtagctgggactacaggcacacgccccaacgcctggctaatttttgtatttttttgtagagatgaggtttcaccatgttgcccaggc

SEQ ID NO: 55930 - DNA, 201 bp, Homo sapiens
aaattctgactcagccatcaactttttccctaactccccagacagaatttgtgcttcatcctctcttcttctgtaatattttgcccatatctcagcagtcrctcctatcatacatctatctccaaactagcttgtgagttccttcagtacagggactgtatttgatccaggtagccagaaactttctaacacagtgcctgg

SEQ ID NO: 55931 - DNA, 201 bp, Homo sapiens
ttttattgttgttttttgaatatttttgatccaaaattggttgactccatggatgtgtaaccatgaatatgaaccatggtcatggagggctgactatatayaattcctcaaattctgactcagccatcaactttttccctaactccccagacagaatttgtgcttcatcctctcttcttctgtaatattttgcccatatct

SEQ ID NO: 55932 - DNA, 201 bp, Homo sapiens
gcaataacctatgcacatcctctcatatactttaaatcatctttaaattagttataatactgaatgcaatgtaaatactatgtaaattgctattatgttakagttttatttgtattgtttttattgtttattttttattgttgttttttgaatatttttgatccaaaattggttgactccatggatgtgtaaccatgaata

SEQ ID NO: 55933 - DNA, 201 bp, Homo sapiens
ccccaagtatattttataaccaaattgatttagtttggaccccatgaaaatgtagtattacaatattaaattagatcaaaattttaatataaagtcacttyatagatcattgttacataactaaactttcctcttttcttctagtattttaatggcaattcagatgcctctacaataaaagagaatcagtttgacccacct

SEQ ID NO: 55934 - DNA, 201 bp, Homo sapiens
aacgcctggctaatttttgtatttttttgtagagatgaggtttcaccatgttgcccaggctggtcttgaactcctgagctcaagtgatccacctgcttcakcctcccaaagtgctggggttacaggtttgagccactgaacctagctgagaagatgacttcaaagacagtgtcctaaaaaatctaccgggcaggggaaggg

SEQ ID NO: 55935 - DNA, 201 bp, Homo sapiens
cacgccccaacgcctggctaatttttgtatttttttgtagagatgaggtttcaccatgttgcccaggctggtcttgaactcctgagctcaagtgatccacstgcttcagcctcccaaagtgctggggttacaggtttgagccactgaacctagctgagaagatgacttcaaagacagtgtcctaaaaaatctaccgggcag

SEQ ID NO: 55936 - DNA, 201 bp, Homo sapiens
caatttattattatcatcattgttactgggataaagatcaatcagaggaaggaggattatgaatacaacagaattaggtgataaatatccaggcttattaygccattcatttataatcttcatcttcaaattcagagcctatcagaaagtttccttttctatatgatgagtgattatcagaagagcaaggaaattcctgag

SEQ ID NO: 55937 - DNA, 201 bp, Homo sapiens
aaactaggaaaggaaaaagaaaagaaagggaagagaaaggaaggggagggaaaggattaatcatttcagttttcaaaaagtgtagttgcttcagtaagagkagttttattggccttttaccccatcatgtaaaacatttcaggcttttttccccagatccttgttgtctgcctacatccacactgatgttctcaccttctt

SEQ ID NO: 55938 - DNA, 201 bp, Homo sapiens
ctagttctggtaatttctttcaaaatcttgtgtccagacccacgattataacttgcttttataacaaagtttacttccgccatttttgctaaccgctcacrttcaaaaacccagaaagaaccctgattctaaagtaagctattctagattttaaaatataatctactatacctgtgtaagcattcactacattttcagtga

SEQ ID NO: 55939 - DNA, 201 bp, Homo sapiens
gtggtgtgatcatggctcactgcaacctccacttcctgggctcaggcgattctcgcacctcagcctctcaagtagctgggactacaggcacacgccccaaygcctggctaatttttgtatttttttgtagagatgaggtttcaccatgttgcccaggctggtcttgaactcctgagctcaagtgatccacctgcttcagcc

SEQ ID NO: 55940 - DNA, 201 bp, Homo sapiens
ctgttctctccataactaaaatgtctctacctcttttatgcctgtgaaaacctctagctggttatactctgcatcactggtacaaccttgatatgaagacwcactaagataccacccagatgtcactagaggatgttatagacttaaaagttttctcatataatcattctaattcagttaatttgcttttaaaatacatat

SEQ ID NO: 55941 - DNA, 201 bp, Homo sapiens
tttagcctcaggagcatagaagtctaggctccccattcagcctttgctgttgtgggttggggaggggcctcaggtttttctgtggtgtttggctaaaggasagaagtcagtgtccaccagttttctatcatatctcgctatgctgccctttactggtactttggttagagaaagcagattttatttgggctttttcagtct

SEQ ID NO: 55942 - DNA, 201 bp, Homo sapiens
aaagttcaggatctggctatttgtctgtgcctctcaagcaagtagcttttcccccccaccaagggtcttactctgtcacccaggctggagtgcagtggtgygatcatggctcactgcaacctccacttcctgggctcaggcgattctcgcacctcagcctctcaagtagctgggactacaggcacacgccccaacgcctgg

SEQ ID NO: 55943 - DNA, 201 bp, Homo sapiens
gagcatagaaatgggcatatgtgaatctttccaaataataaaagttcactattgaaggacatatgcatctccagagaactcatcttagctatccccagatktgagagtggtgaaaacgcaatcctcagaaactgcccacatgtcttgatggctgttactcctccaggtgcttcttaccttgaccacacattccctgcggag

SEQ ID NO: 55944 - DNA, 201 bp, Homo sapiens
agtacatgagcatagaaatgggcatatgtgaatctttccaaataataaaagttcactattgaaggacatatgcatctccagagaactcatcttagctatcmccagatttgagagtggtgaaaacgcaatcctcagaaactgcccacatgtcttgatggctgttactcctccaggtgcttcttaccttgaccacacattccc

SEQ ID NO: 55945 - DNA, 201 bp, Homo sapiens
tcattgcgtttttctttctttttttgagacggagtctcgctctgtcgcccaggctggagtgcagtggcgcaatctctgctcactgcaagctccgcctcccrggctcacgccattctcctgcctcagcctcccgagtagctgagactacaggggcccgccaacacaaatacaaaatacaaaaaatataattttttgtatttt

SEQ ID NO: 55946 - DNA, 201 bp, Homo sapiens
tatcaaagcctttgtaagtacatgagcatagaaatgggcatatgtgaatctttccaaataataaaagttcactattgaaggacatatgcatctccagagarctcatcttagctatccccagatttgagagtggtgaaaacgcaatcctcagaaactgcccacatgtcttgatggctgttactcctccaggtgcttcttacc

SEQ ID NO: 55947 - DNA, 201 bp, Homo sapiens
tcaatcatcgccattctgactggcatgagagggcatctcattgcgtttttctttctttttttgagacggagtctcgctctgtcgcccaggctggagtgcartggcgcaatctctgctcactgcaagctccgcctcccaggctcacgccattctcctgcctcagcctcccgagtagctgagactacaggggcccgccaacac

SEQ ID NO: 55948 - DNA, 201 bp, Homo sapiens
acaacaggatatttttgaagagaccaataattatttcattaactttacttattgatcatatttataaaactgtggacttctgaaatacaataaagatactrgtattctactagaagtctgaagatatgagagatctactttttttgtaatgtgagaaatagatattgaatatgcctttcaaattagtttttgtattttatt

SEQ ID NO: 55949 - DNA, 201 bp, Homo sapiens
tttcttgacttttcaatcatcgccattctgactggcatgagagggcatctcattgcgtttttctttctttttttgagacggagtctcgctctgtcgcccargctggagtgcagtggcgcaatctctgctcactgcaagctccgcctcccaggctcacgccattctcctgcctcagcctcccgagtagctgagactacaggg

SEQ ID NO: 55950 - DNA, 201 bp, Homo sapiens
ccatgagaatccagcccatctttcattaaaacaaacaaccacagtgagccacagcatgggaaataacgtgatggactcaccatctgcctatacatacacgctcaggccatacctacatacatgcccaatgtatttactcattatacaaagactttttttccatttcctggtatatataagatactgtgatggtactgaaaa

SEQ ID NO: 55951 - DNA, 201 bp, Homo sapiens
atttactctgtttttccaggaaaaagatattcactcaggcttgataggtcccctcctaatctgccaaaaaggaatactacataaggacagcaacatgcctrtggacatgagagaatttgtcttactatttatgacctttgatgaaaagaagagctggtactatgaaaagaagtcccgaagttcttggagactcacatcctc

SEQ ID NO: 55952 - DNA, 201 bp, Homo sapiens
cattttgagctaataggataaaaaattttctgggttgggcatgatggctcatgtctgcaatgccagcactttggaaggctgaggcaagaggattacttgaraggagtttaaggctgcagtgagccatgactgtgccactggactcaagcctgggcaacagaataagaccctgtctaaaaaaaaacaaaaacaaaaaacctt

SEQ ID NO: 55953 - DNA, 201 bp, Homo sapiens
aaaggattaatcatttcagttttcaaaaagtgtagttgcttcagtaagaggagttttattggccttttaccccatcatgtaaaacatttcaggcttttttycccagatccttgttgtctgcctacatccacactgatgttctcaccttcttctcgtaaagaatttatcaagttattgtaccaaacaaaaataactgcatcc

SEQ ID NO: 55954 - DNA, 201 bp, Homo sapiens
ataatttctcaaaccaaattggaaaacattataagaaagttatgtacacacagtacgaagatgagtccttcaccaaacatacagtgaatcccaatatgaargaagatgggattttgggtcctattatcagagcccaggtcagagacacactcaaagtaagtaacacaaatacagaatcatgggagaaattacatagtaaaa

SEQ ID NO: 55955 - DNA, 201 bp, Homo sapiens
tttgtcgtctatgttcatgagaggatattggtatatagttttatttttttaattgtctttttctgtttttgataccacagttatactagctttcataaaaytggtaagcatgctcttttctacattctaggagaaaatgtctgcaattggtaataattctttaaatatttggtaggaatcactagtgaaaccatctgggcc

SEQ ID NO: 55956 - DNA, 201 bp, Homo sapiens
ttggataatttctcaaaccaaattggaaaacattataagaaagttatgtacacacagtacgaagatgagtccttcaccaaacatacagtgaatcccaataygaaagaagatgggattttgggtcctattatcagagcccaggtcagagacacactcaaagtaagtaacacaaatacagaatcatgggagaaattacatagt

SEQ ID NO: 55957 - DNA, 201 bp, Homo sapiens
aaatgatctcaacccgtccctctccaaaaattcacctgcctggtttctgaaatttcacagcagttcctctaacttaagaaggaggaaacaaagcacttccytcactttggtttcagttaaacgtttggtaacactaaactttatctttacagttttgtgttacatttttaaggtgatcaagtttctcaggaactttttaaa

SEQ ID NO: 55958 - DNA, 201 bp, Homo sapiens
cccatgagaatccagcccatctttcattaaaacaaacaaccacagtgagccacagcatgggaaataacgtgatggactcaccatctgcctatacatacacgctcaggccatacctacatacatgcccaatgtatttactcattatacaaagactttttttccatttcctggtatatataagatactgtgatggtactgaaa

SEQ ID NO: 55959 - DNA, 201 bp, Homo sapiens
aaatgtcacctaatttatgaactatttgcagcaccacacaggctaaatgtgtgacccaactcagttgcaacataacatgcagtttctcccaagccactgtrtgtcatacagatgaggtcttaagcagatgaaaaaatgaatcccacagggctcaggcagctacagctatctctgctgggagggtttccagattcttcagtt

SEQ ID NO: 55960 - DNA, 201 bp, Homo sapiens
tgagttgggattcaaatttaggtactctgtgcccaaatatgaattgcatgtagtcattgtatcagtttgctaagatcttatgtgctagctctttagttctraagaaagctgattgtataatgaatttaggcagtgtgtgacttgttgacaaggacagttctgtttactggctttcctatattgcaggtggacatgcaaaag

SEQ ID NO: 55961 - DNA, 201 bp, Homo sapiens
gacaaaacatataaaacagaagttttcagacatcgaatgacagacaactcaagacagtaaaagaagagtaacaaaccagatgtgccctatgagcacctaarcttactgcttgaagagtgtttccagggaacagcacaagcagggagaacccagacagagtctctatgggttgaggaaatagagtttggacttcggagaagc

SEQ ID NO: 55962 - DNA, 201 bp, Homo sapiens
agatttaccctttttctcaacaactagacaggcagacaaaacatataaaacagaagttttcagacatcgaatgacagacaactcaagacagtaaaagaagwgtaacaaaccagatgtgccctatgagcacctaagcttactgcttgaagagtgtttccagggaacagcacaagcagggagaacccagacagagtctctatg

SEQ ID NO: 55963 - DNA, 201 bp, Homo sapiens
tccatgctcagaacctcatgagatacattgcacgttactgtagtacctgaatccttcattgctattgaatggatgtgccttattttccactcccacctggrgaatccaaacatatgctgatgccatgcaaactcatgcaaagcgttttgagtggaatagattttccacagttgggatggggaaaggtacaattaaagaagg

SEQ ID NO: 55964 - DNA, 201 bp, Homo sapiens
aaactacagggctcctttgatgtcagtgtcaagggcatcagcatttcggtcaacctcctgttgggcagcgagtcctccgggaggcccacagttactgcctscagctgcagcagtgacatcgctgacgtggaggtggacatgtcgggagacttggggtaggtctccatcggggcactgccagctggactcctggttgcagct

SEQ ID NO: 55965 - DNA, 201 bp, Homo sapiens
taaaatcaatcgaaagcaacttccagctttatctgactccctcaggcctctcctggcagacttgtatattttcttctcttgatgtaatctcctaattctgytcccagttagccaggctctaccccaacatgaacctggaactccagggatcagtgccctctgctccgctcctgaacttcagccctgggaatctgtctgtgg

SEQ ID NO: 55966 - DNA, 201 bp, Homo sapiens
gtaacccaggctgtggagaagcgacagtcttgcacatccccctgtctccccaatcttctttagaccttcagctccagcgggagcaccctaaaacttcttcrtgtctctttgctgcagataccgcctgactctaatatccgactgaccaccaagtccttccgacccttcgtcccacgggtaaggagtcccttagttccccat

SEQ ID NO: 55967 - DNA, 201 bp, Homo sapiens
ataaatatttgtaaatcagtgatcactgagcacatgtgtggaataatgtgactgcagtgatcagcacggggccagaccagagctggggaactcactcagtyattctcttcccatgtttttcagatttgcgaaatgatccagaaatcagtgtcctccgatctacagccttatctccaaactctgccaggtaggacaccccat

SEQ ID NO: 55968 - DNA, 201 bp, Homo sapiens
tgactcccagctatttcctttccacagcggcccaggaggggctattggctctgcagagtgagctgctcaggatcacgctgcctgacttcaccggggacttraggatcccccacgtcggccgtgggcgctatgagttccacaggtggggctctcccttctgctgcggctctgaagtggctggagctggctgtcagggggaat

SEQ ID NO: 55969 - DNA, 201 bp, Homo sapiens
agccttggctacttaagggacctgggcccaatccacagctgggacagtcctggcccactgcactgggaatctaggatgggggccttggccagagccctgcygtccatactgctggcattgctgcttacgtccaccccagaggctctgggtgccaaccccggcttggtcgccaggatcaccgacaagggactgcagtatggt

SEQ ID NO: 55970 - DNA, 201 bp, Homo sapiens
ttttcctaggacttcctgttcttgggtgccaatgtccaatacatgagagtttgaggacaagaaagatgaagcttggaggtcacagctggatctgcttgttscatttccagctgtgcagcacgtctcagagattcttgaagaatgaagacatttctgctctcagctccgggggtgaggtgtgcctggcctctgcctccaccc

SEQ ID NO: 55971 - DNA, 201 bp, Homo sapiens
acaaaacaaaaaaagaaagcattgctgtccttcaacccagcaactccacctctaggaatgttttcctgaaaagaatagccaagggtgctcacaggaggtgktcattataatggcaaaaccctggagacaacttgatgcccaatagagtttaatccatcgcaggacccatacataacgaaatacaacacagccgtgaaatag

SEQ ID NO: 55972 - DNA, 201 bp, Homo sapiens
caggtgggagccaccgtagggtttagagcaggggaggaggcaggcagatcaagctgactcccagctatttcctttccacagcggcccaggaggggctattrgctctgcagagtgagctgctcaggatcacgctgcctgacttcaccggggacttgaggatcccccacgtcggccgtgggcgctatgagttccacaggtggg

SEQ ID NO: 55973 - DNA, 201 bp, Homo sapiens
agactccagaggtttctctttaaaacctctgcatctctcagcttgaccaagagtgagaaggccgggatgagactcccactgaaggctggggtgctgctccyttcaaagcctaaataacagaggccacgccccatatcttgtgggaccacagcttgtccaatcttttattggtgttatctaagaatcccaaggaatgctggc

SEQ ID NO: 55974 - DNA, 201 bp, Homo sapiens
gggcatggtggcacatgcctgtagttccagctacatgggaggctgaggcaggagaattgcttgagcccaggaggcagaggttgcagtgagctgtgatctcrctacttcactgcagcctgggcaacagagtgagactgcatctcaaaaaaaaaaaaaaaaatatatatatatatatatatatatatttatatgtgaatgagg

SEQ ID NO: 55975 - DNA, 201 bp, Homo sapiens
ccgctgtagcctgggaggcggaggttgcggtgagccaagatcacgccactgcactccagtctgggcaagagagtgagaccctatctcaaaataattaattmattagttaattaaataaaataaattagccaccacacctggctaatttttaaaattatttattataaataaataaatctcattaatattttttatattgat

SEQ ID NO: 55976 - DNA, 201 bp, Homo sapiens
ctgatgatttctggaggtttattaaaaaatattttagtgaatgaggccgggcaaggtggctcatgcctgtaatcctcgcactttgggaagccaaggtgggyggatcacctgaggtcacgagttcaagaccagcctggtcaacatggcaaaacctcatctctactaaaaatacaaaaattagctgggcatggtggcacatgc

SEQ ID NO: 55977 - DNA, 201 bp, Homo sapiens
aacatggtgaaaccccatctctactaaaaatacaaaaattagctgggcgtagtggcgcatgcctgtaatctcagctacttaggaggatgagacaggagaaycgctgtagcctgggaggcggaggttgcggtgagccaagatcacgccactgcactccagtctgggcaagagagtgagaccctatctcaaaataattaattc

SEQ ID NO: 55978 - DNA, 201 bp, Homo sapiens
tgctgcggctctgaagtggctggagctggctgtcagggggaattggagagtgaggaagagagagcctcaggattgggctgtggggggacctctccggggcrgacagtgggatagttccctgaagagctcagaaggaaattctgggaaggaattgagctcctccactcagtcacgcagcaaatattaaggaagacctactgg

SEQ ID NO: 55979 - DNA, 201 bp, Homo sapiens
gaagtcagcctggtgggcaagtgaagctctgtctagctggggaactcagggacagcggagaacacgcctctgagttactccagccccacgctgtcaccccrtcctcctgcttgccattggccaagggctgcttccaggggctctggctctcaggcactttgaacagttctctgacctcagaggcacttggatggaaggggt

SEQ ID NO: 55980 - DNA, 201 bp, Homo sapiens
ctgtagtcccagctacttgggaggccaaggtgggaggatcgcttgagcccaggaggtcaaggcagcggtgggctgaaattgtgccactgcactccagcctrggccacagagtgagatcctatctcaaaaagaaatgaaataaaataaaacatgaggtccatgcatattgttgcatgcacctgtagtgtagctggtttattc

SEQ ID NO: 55981 - DNA, 201 bp, Homo sapiens
tcacagttctggaggctgagggccaaggtcaaggttttggcaggcctggtttcttctgaggccactctctttggcttgcagatggctgccctttggcaatktcctcacgtggtctttcctctgtgctcaagaaatcccatttctgaggccatgcacgttggctcacccctgtaatcccagcactttgggaggctgaggcgg

SEQ ID NO: 55982 - DNA, 201 bp, Homo sapiens
aacccacaggggagtggggaagtgaggaagggaagggaagggaaggaagtcagcctggtgggcaagtgaagctctgtctagctggggaactcagggacagyggagaacacgcctctgagttactccagccccacgctgtcaccccgtcctcctgcttgccattggccaagggctgcttccaggggctctggctctcaggca

SEQ ID NO: 55983 - DNA, 201 bp, Homo sapiens
caggatggtcttgatctcctgacctcgtgatccgcccgctcggcctcccaaagtgctgggattgcaggcgtgagagctcacgcctgtaatcccaacatttwgggaggccgaggcgggtggattacctgaggtcaggagttcgagaccagcccagtcaacatggtgaaaccccgtctctactaaaaatacaaaaattagcca

SEQ ID NO: 55984 - DNA, 201 bp, Homo sapiens
tttaaatgtagtagcccaacggttagagctgaagtttgtacttgggggagtcagggaaggcttccaggagaaggtggcatttgagccaagtcttcaaaagwttactagacttgagcagctgatgctttaaaagagcgtgaactgctttttgagggatgggcagtgaagaaacgacaatcagactcgtagcacattgtaccc

SEQ ID NO: 55985 - DNA, 201 bp, Homo sapiens
agaaggctttctttgttcaactttaaaatatgaggtcagggctgggcgcggtggctcacgcctttattttttgttttctttttttttttttttttttttgkgagacggagtctcgctctgttgcccaggctggagtgcagtggcgcaatctcggctcactgcaagcttcgcctcgcgatttcacgccattctcctgtctca

SEQ ID NO: 55986 - DNA, 201 bp, Homo sapiens
aaagagagttggacttggaaaacagggctctcctgggggctgtatgaccgtgggcaagtcacttctctctgagcttagtgacctgcctgtgacatgggatygttgaagttggcctcatctccctccagggctctaatgagggttgggggctgggacagctctttggagcacgggaaacctccttataagcgggacagaggg

SEQ ID NO: 55987 - DNA, 201 bp, Homo sapiens
tactgcatttcctgttcatatctttttttttcttttgagttgttctttctttccttgttaatttatattggcttgttctttgtatattagggaaataagcycatatattaaggaaattggctctttagatgtctcatactgcaattttttttttactttacatatggcattttttttgtccactgaagttttaattttcta

SEQ ID NO: 55988 - DNA, 201 bp, Homo sapiens
gaccctatctcaaaataattaattcattagttaattaaataaaataaattagccaccacacctggctaatttttaaaattatttattataaataaataaawctcattaatattttttatattgattacatgttgaaatcatactatgtattactaaaattaatttcagctctttctttttatctttttaatgtatcttctg

SEQ ID NO: 55989 - DNA, 201 bp, Homo sapiens
ctggttcaagtgattctcctgcctcagcctcccgagtagctgggattacaggcacatgctaccacgcccagctaatttttgtatttttagtagagacaggrtttcactatgttggccaggatggtctcgatgatccacccgcctcggcctcccaaagtgctgggattacaggcgtgagccactgcgcccgacccctttcca

SEQ ID NO: 55990 - DNA, 201 bp, Homo sapiens
ttatcctcacagcccccttcttgctttgcagtttcaatggcatgccaatgaggaaagtttagtttagtttagtttagtttagtttagtttagtttagtttwgttttgttttgttttgttttgtttgagacagagtctgactctgtcgcccaggctagagtgcggtagtgcgatctcggctcactgcaatctctgcctcccg

SEQ ID NO: 55991 - DNA, 201 bp, Homo sapiens
gcctctctttcaatgggatgataatagctacgttttatggagcactcaccatgtgctgggccttgtgctaggatgttcgtttaggcctcacagtgactcgraggtggggactattgttatccccattttatggataaggaagttgaggttcagggagatggaagggctggcctgagatcacaaagtcaggacacaaaccga

SEQ ID NO: 55992 - DNA, 201 bp, Homo sapiens
ctgcttggcatatagtgggggttagaagttgtgtttcatgattttggtagagaagcttattttgtttttattaaattttttaaattatgtaggtagttcargaaaaacattctcactgtaaataaaaccgatactaaagataaggctaaggacatgtcaaatgttgatgttcttcctttagaggaaagactgtcgggtgtg

SEQ ID NO: 55993 - DNA, 201 bp, Homo sapiens
ctactttgccttgcccatcatgcagaaaaggccaatcagagcgggtcttagggagtgtagatgggcctagggcatatagaggggctggccaggacttcctrtgggttaatgtagcaaagcttctggtgagcttttcattaaaagacataacactgcctttaatggtggagtttcaggcagtgttccagccagcgtcccttc

SEQ ID NO: 55994 - DNA, 201 bp, Homo sapiens
tgatgtttaaggtgagggtcctggggccgggctgcgtgggtgaggctttccctcagggtcagccattctttgggccacctgtccccccaacttcagatctrtcctcatcctcccagtggttcccgctttgtcaagggccgggtgatatggagtggtggggagtgtttccagagctaggattctcccacggctgtcttacac

SEQ ID NO: 55995 - DNA, 201 bp, Homo sapiens
ctcctgctcccgccctacctttggccctgtgccttctcaagcccatcctttctcgcttctggggacccccgcattgcttaaacttgcataaagcccacacyttttaatcttctctgattcattacagggtaaaagtggaactgaaagaatccaaagttggactattcaatgtaagttgtttttattgatgacatgattaga

SEQ ID NO: 55996 - DNA, 201 bp, Homo sapiens
caagagtgagaaggccgggatgagactcccactgaaggctggggtgctgctcctttcaaagcctaaataacagaggccacgccccatatcttgtgggaccrcagcttgtccaatcttttattggtgttatctaagaatcccaaggaatgctggcatagtccataaaatgtaccctaatgaacagcagctaacaattacagg

SEQ ID NO: 55997 - DNA, 201 bp, Homo sapiens
gctgttgaacctcttccacaaccagattgagtccaagttccagaaagtactggagagcagggtaagaaggtccaagcctctggcctcccccgagcttggcragggctgaatggaagacctcactgaccaatggccctggaccaggccatgggggctggtttagacgtacttgggcccaaagcccagggaggacaaatcatt

SEQ ID NO: 55998 - DNA, 201 bp, Homo sapiens
ctaattctgccctgtcctcattcacagttacaacagagattgacagtttcgccgacattgattatagcttagtggaagcccctcgggcaacagcccagatrctggaggtgatgtttaaggtgagggtcctggggccgggctgcgtgggtgaggctttccctcagggtcagccattctttgggccacctgtccccccaactt

SEQ ID NO: 55999 - DNA, 201 bp, Homo sapiens
ggcactgggaagccagacacaccgaatcaggctggatgtgctgggacacagcagggcgccgggaaggggtggagagggctccctttgtggactggcctgascagggaccagggcctggctttcccaggcacccggccatccccaagttcagtggcagactgtgcttctctccccaggtggctgttgaacctcttccacaac

SEQ ID NO: 56000 - DNA, 201 bp, Homo sapiens
catccaagggaatccatgtagtgtctttcttgaagaagcaattctttgcctcagggccgggctagtagggggattctgaagaaagtcacagggaatgtgartcagccagagcccttgcccctcctccagcagctgaaagtgtcatctggcccctaattctgccctgtcctcattcacagttacaacagagattgacagttt

SEQ ID NO: 56001 - DNA, 201 bp, Homo sapiens
agggcctgagtctcagcatctccgactcctccatccgggtccagggcaggtggaaggtgcgcaagtcattcttgtaagttggctctgctcccaggccctgragctcttggccttggccttcgccccatccttcttaggtccaaggtgttcctagcttatcagaaaggccacgtgatggacagatggagtccaagcccggag

SEQ ID NO: 56002 - DNA, 201 bp, Homo sapiens
caggcatctcctccctgccagggtaacccaggctgtggagaagcgacagtcttgcacatccccctgtctccccaatcttctttagaccttcagctccagcrggagcaccctaaaacttcttcatgtctctttgctgcagataccgcctgactctaatatccgactgaccaccaagtccttccgacccttcgtcccacgggt

SEQ ID NO: 56003 - DNA, 201 bp, Homo sapiens
gatcagagagctaaggaggtgagggaagatcagagggagaccttgagtctgcttttttagttcagcatatcaatgtgccatatattggcgtattgttttcygagccccaacagtgttatatctcgatggggtagtacaggacaacacagctggccctagagtcccatagcaggttctgacgccctgaaatctgactgtaaa

SEQ ID NO: 56004 - DNA, 201 bp, Homo sapiens
cccttcagcctgaacatccacagctgtgagctgcttcactctgcgctgaggcctgtccctggccagggcctgagtctcagcatctccgactcctccatccrggtccagggcaggtggaaggtgcgcaagtcattcttgtaagttggctctgctcccaggccctggagctcttggccttggccttcgccccatccttcttag

SEQ ID NO: 56005 - DNA, 201 bp, Homo sapiens
gtatgtgtgtgtgtgtgtgtgcttgtctggaaactgcttaggccctaggctgagcatacacccccaccattgttaactcatccaagggaatccatgtagtstctttcttgaagaagcaattctttgcctcagggccgggctagtagggggattctgaagaaagtcacagggaatgtgagtcagccagagcccttgcccctc

SEQ ID NO: 56006 - DNA, 201 bp, Homo sapiens
atttccttggtacctggctcatgacaagcacttataaatatttgtaaatcagtgatcactgagcacatgtgtggaataatgtgactgcagtgatcagcacsgggccagaccagagctggggaactcactcagtcattctcttcccatgtttttcagatttgcgaaatgatccagaaatcagtgtcctccgatctacagcct

SEQ ID NO: 56007 - DNA, 201 bp, Homo sapiens
ggcatgaagaaagtaacgtgcttagcatggtcataagatcgatgcctggggcacagcaggtgcttacctggagcagatcctgctggtctagtccccactgkggagaggggaggcgcaaggtccctggtgaggctgggtccaggcccagggctgacacctccttccatgtctctcccttcagcctgaacatccacagctgtg

SEQ ID NO: 56008 - DNA, 201 bp, Homo sapiens
catgaggtcaaaagtttgagaccagcctggccaacatggtgaaaccccatctctactaaaaatacaaaaattagctgggcatggtggtgcgcacctgtaaycccagctacttaggaggctgaggcaggagaatggcttgaacacgggaggcagaggttgcagtgagctgagatcatgccactgcactccagcctgggcgac

SEQ ID NO: 56009 - DNA, 201 bp, Homo sapiens
tagagtttgcagagaacattttcggtaaaaatctgtctctaattattatttattcaccaatctctttcaatgttgtgcttcaacctctagataagttggcygaaggcttcccccttcctctgctgaagcgtgttcagctctacgaccttgggctgcagatccataaggtcggtgggttcaggggggctctgaggatgtgtg

SEQ ID NO: 56010 - DNA, 201 bp, Homo sapiens
gttatcctcacagcccccttcttgctttgcagtttcaatggcatgccaatgaggaaagtttagtttagtttagtttagtttagtttagtttagtttagttttgttttgttttgttttgttttgtttgagacagagtctgactctgtcgcccaggctagagtgcggtagtgcgatctcggctcactgcaatctctgcctccc

SEQ ID NO: 56011 - DNA, 201 bp, Homo sapiens
ctgtgcctccccttcccgctcccaggaacccatccagcctcaggaactgcccccagccatcgagccttggctacttaagggacctgggcccaatccacagytgggacagtcctggcccactgcactgggaatctaggatgggggccttggccagagccctgccgtccatactgctggcattgctgcttacgtccaccccag

SEQ ID NO: 56012 - DNA, 201 bp, Homo sapiens
ttttttaggccaggagcggtggttcatgcctgtaaccccagcactttgggaggccaaggcgggcagatcatgaggtcaaaagtttgagaccagcctggccracatggtgaaaccccatctctactaaaaatacaaaaattagctgggcatggtggtgcgcacctgtaatcccagctacttaggaggctgaggcaggagaat

SEQ ID NO: 56013 - DNA, 201 bp, Homo sapiens; identical to SEQ ID NO: 16257

SEQ ID NO: 56014 - DNA, 201 bp, Homo sapiens
gtctctttgctgcagataccgcctgactctaatatccgactgaccaccaagtccttccgacccttcgtcccacgggtaaggagtcccttagttccccatgwgtgcagaccgagcctactagactccagaggtttctctttaaaacctctgcatctctcagcttgaccaagagtgagaaggccgggatgagactcccactga

SEQ ID NO: 56015 - DNA, 201 bp, Homo sapiens
tgttatcctcacagcccccttcttgctttgcagtttcaatggcatgccaatgaggaaagtttagtttagtttagtttagtttagtttagtttagtttagttttgttttgttttgttttgttttgtttgagacagagtctgactctgtcgcccaggctagagtgcggtagtgcgatctcggctcactgcaatctctgcctcc

SEQ ID NO: 56016 - DNA, 201 bp, Homo sapiens
agcgggagcaccctaaaacttcttcatgtctctttgctgcagataccgcctgactctaatatccgactgaccaccaagtccttccgacccttcgtcccacrggtaaggagtcccttagttccccatgagtgcagaccgagcctactagactccagaggtttctctttaaaacctctgcatctctcagcttgaccaagagtg

SEQ ID NO: 56017 - DNA, 201 bp, Homo sapiens
tatagagtttgcagagaacattttcggtaaaaatctgtctctaattattatttattcaccaatctctttcaatgttgtgcttcaacctctagataagttgrccgaaggcttcccccttcctctgctgaagcgtgttcagctctacgaccttgggctgcagatccataaggtcggtgggttcaggggggctctgaggatgtg

SEQ ID NO: 56018 - DNA, 201 bp, Homo sapiens
ttgttatcctcacagcccccttcttgctttgcagtttcaatggcatgccaatgaggaaagtttagtttagtttagtttagtttagtttagtttagtttagttttgttttgttttgttttgttttgtttgagacagagtctgactctgtcgcccaggctagagtgcggtagtgcgatctcggctcactgcaatctctgcctc

SEQ ID NO: 56019 - DNA, 201 bp, Homo sapiens
cttgttatcctcacagcccccttcttgctttgcagtttcaatggcatgccaatgaggaaagtttagtttagtttagtttagtttagtttagtttagtttagttttgttttgttttgttttgttttgtttgagacagagtctgactctgtcgcccaggctagagtgcggtagtgcgatctcggctcactgcaatctctgcct

SEQ ID NO: 56020 - DNA, 201 bp, Homo sapiens
tgcttgttatcctcacagcccccttcttgctttgcagtttcaatggcatgccaatgaggaaagtttagtttagtttagtttagtttagtttagtttagttdagttttgttttgttttgttttgttttgtttgagacagagtctgactctgtcgcccaggctagagtgcggtagtgcgatctcggctcactgcaatctctgc

SEQ ID NO: 56021 - DNA, 201 bp, Homo sapiens
cgcaggcactgggaagccagacacaccgaatcaggctggatgtgctgggacacagcagggcgccgggaaggggtggagagggctccctttgtggactggcmtgaccagggaccagggcctggctttcccaggcacccggccatccccaagttcagtggcagactgtgcttctctccccaggtggctgttgaacctcttcca

SEQ ID NO: 56022 - DNA, 201 bp, Homo sapiens
tgtcaagggcatcagcatttcggtcaacctcctgttgggcagcgagtcctccgggaggcccacagttactgcctccagctgcagcagtgacatcgctgacrtggaggtggacatgtcgggagacttggggtaggtctccatcggggcactgccagctggactcctggttgcagctcccggccaatccagcgctcagcctgg

SEQ ID NO: 56023 - DNA, 201 bp, Homo sapiens
aggagccatctacaagtggagtctctggatccagggtgcacacattaagctcggagggggagaccctggcaaattatctgagatgttctctgatgccttakctcctaagcccctatgcggttatttgctgacatcacctttaccagaggtccaggtcggcaacccggtactgggacttggaacattcatccattcagggtt

SEQ ID NO: 56024 - DNA, 201 bp, Homo sapiens
tggccctggaccaggccatgggggctggtttagacgtacttgggcccaaagcccagggaggacaaatcatttgcccaggtcatggagctgttgtggggcaygctggggacaaagctccaagtccgttcggttgggcagaaaatggtcaactgcttgaccaagggttaaacagcaggggctaaacagagactccagcccctc

SEQ ID NO: 56025 - DNA, 201 bp, Homo sapiens
tgtggactggcctgaccagggaccagggcctggctttcccaggcacccggccatccccaagttcagtggcagactgtgcttctctccccaggtggctgttkaacctcttccacaaccagattgagtccaagttccagaaagtactggagagcagggtaagaaggtccaagcctctggcctcccccgagcttggcgagggct

SEQ ID NO: 56026 - DNA, 201 bp, Homo sapiens
agaaaatggtcaactgcttgaccaagggttaaacagcaggggctaaacagagactccagcccctccctctgctccaccttgctcagtgccccacactgccytgcattccaccaaggtccgaaaggaaaccattcctcaggcgcctgcaagagaccaggcaggaaagctcagcgagggcgtgggccaggtgggaactgggcg

SEQ ID NO: 56027 - DNA, 201 bp, Homo sapiens
cacaaagtcaggacacaaaccgaagtctgtgtgaccgcaaacctcaccctcgcagaccctctgagtgggagccacacatcagctgccccccggggagagcrggcaggatgctgaagtcccatgtgctctccttgggtgaatgcaggacaggcatctcctccctgccagggtaacccaggctgtggagaagcgacagtcttg

SEQ ID NO: 56028 - DNA, 201 bp, Homo sapiens
tgcctgaccttcctggttattggctcagcattaagctccaggtgtggctggagaggtgaagcctggactcatggtgtgtgtgtatgtgtgtgtgtgtgtgygcttgtctggaaactgcttaggccctaggctgagcatacacccccaccattgttaactcatccaagggaatccatgtagtgtctttcttgaagaagcaat

SEQ ID NO: 56029 - DNA, 201 bp, Homo sapiens
atgatgcttcagtgagctgccccacaccacgcgtatatcttggcaggaagagctacgggataaaggcttagaagttaaattactgggccaaagagtatgtrtgttagaacgaggagagatctcactgatttgtgtttcagaaagcttgtgccaatgtgcactctcccagccacagtgtctgggacttctgtttactcgtac

SEQ ID NO: 56030 - DNA, 201 bp, Homo sapiens
cacgtaaagctctgagctctctgcttggcatatagtgggggttagaagttgtgtttcatgattttggtagagaagcttattttgtttttattaaatttttwaaattatgtaggtagttcaggaaaaacattctcactgtaaataaaaccgatactaaagataaggctaaggacatgtcaaatgttgatgttcttcctttag

SEQ ID NO: 56031 - DNA, 201 bp, Homo sapiens
ccaggagattgaggctgcagtgagccatgattgcaccactgcactccagctgggcgacagacagagactccatctctaaaacaataataataatttattawtgttgttactagggctgaatcttgacctgagataactagaaatgatcctttttagagctttccaagggtaggtactctataccttctcttagtagtctgt

SEQ ID NO: 56032 - DNA, 201 bp, Homo sapiens
gataatctctgggtggcctcaccaactctttactagcttctcaacaattccatcacttgtataaccaattccccgtattaaattccctctgcgttaaacaytgagagtcagttttccttttttgatggactctgtctaatagggaagggatgttgggtcctttgggggccttgctccctggatggagaactctgctctctt

SEQ ID NO: 56033 - DNA, 201 bp, Homo sapiens
ccaatgggaggtactgtcaggagaatgatggcggggaggaaggatgaagccagagtactatttcctctttctttaccacggcagaggctctggctgtgacwatgtctcctcatggtgacttccataattccacctccactctttgttcctctagtcctggggtggatacagcctcctgtctctggataatctctgggtggc

SEQ ID NO: 56034 - DNA, 201 bp, Homo sapiens
tgcactttgatttccacccaggtcaaccaatgggaggtactgtcaggagaatgatggcggggaggaaggatgaagccagagtactatttcctctttctttrccacggcagaggctctggctgtgactatgtctcctcatggtgacttccataattccacctccactctttgttcctctagtcctggggtggatacagcctc

SEQ ID NO: 56035 - DNA, 201 bp, Homo sapiens
agccatccacatgtccttcagaagtggcacctctgctggtgcaggtggcatttgacacagccctatgccaccaccacatcccatccctaccatgaggggcytgagggaagctcaagaccagctcgttttgaaaatactgcgggccgggtgcagtggctcacgcctgtaatcccagcactttgggaggctggggcgggcaga

SEQ ID NO: 56036 - DNA, 201 bp, Homo sapiens
gtatttggaggtcagaactgagccttctattttccccacaaatggtggcagacccctggtctaggaactaaccatggcttctcttacctcctccagcaaamtacagggctcctttgatgtcagtgtcaagggcatcagcatttcggtcaacctcctgttgggcagcgagtcctccgggaggcccacagttactgcctccag

SEQ ID NO: 56037 - DNA, 201 bp, Homo sapiens
tgttgaacctcttccacaaccagattgagtccaagttccagaaagtactggagagcagggtaagaaggtccaagcctctggcctcccccgagcttggcgarggctgaatggaagacctcactgaccaatggccctggaccaggccatgggggctggtttagacgtacttgggcccaaagcccagggaggacaaatcatttg

SEQ ID NO: 56038 - DNA, 201 bp, Homo sapiens
taggacaccccatccatcccgggacacttttatttctgttaatttctataagagcatatatatatcttataaaatagtaaatggggcaaaaatatagaaartaaaaattaagggccaggcgcagcggctcacacctgtaatctcagcagtctgggaggccgaggcgggtggatcacctgaggtcaggagttcgagaccagc

SEQ ID NO: 56039 - DNA, 201 bp, Homo sapiens
actaaccatggcttctcttacctcctccagcaaactacagggctcctttgatgtcagtgtcaagggcatcagcatttcggtcaacctcctgttgggcagcragtcctccgggaggcccacagttactgcctccagctgcagcagtgacatcgctgacgtggaggtggacatgtcgggagacttggggtaggtctccatcgg

SEQ ID NO: 56040 - DNA, 201 bp, Homo sapiens
cagctttatctgactccctcaggcctctcctggcagacttgtatattttcttctcttgatgtaatctcctaattctgctcccagttagccaggctctaccycaacatgaacctggaactccagggatcagtgccctctgctccgctcctgaacttcagccctgggaatctgtctgtggacccctatatggagatagatgcc

SEQ ID NO: 56041 - DNA, 201 bp, Homo sapiens
cctcctccagcaaactacagggctcctttgatgtcagtgtcaagggcatcagcatttcggtcaacctcctgttgggcagcgagtcctccgggaggcccacrgttactgcctccagctgcagcagtgacatcgctgacgtggaggtggacatgtcgggagacttggggtaggtctccatcggggcactgccagctggactcc

SEQ ID NO: 56042 - DNA, 201 bp, Homo sapiens
aaaaaggaagagtcttgccccaaattaaactctgtacctatctctagtacacagaaaattaagagcacttttgaaatggtggaatctagggctggtcgtgktggctcacacctataatcctagcactctgggaggccaaagtgggggggtagcttgaggccaggagttcaagaccaacctggacaacatagcaaaaccctg

SEQ ID NO: 56043 - DNA, 201 bp, Homo sapiens
ccaggcatggtggctcatgcctgtaatcccagcattgtgggtggccaaggtgggtggattgcttgagtccaggagttcaagaccagcctgggcaacatgaygaaaccccatctctacaaaaaatacaaaaattagccaagcgtagcggcacatagctgtagtcccagccactggggaggctgaggtgggaagatcacctga

SEQ ID NO: 56044 - DNA, 201 bp, Homo sapiens
aagtcccatgtgctctccttgggtgaatgcaggacaggcatctcctccctgccagggtaacccaggctgtggagaagcgacagtcttgcacatccccctgyctccccaatcttctttagaccttcagctccagcgggagcaccctaaaacttcttcatgtctctttgctgcagataccgcctgactctaatatccgactga

SEQ ID NO: 56045 - DNA, 201 bp, Homo sapiens
aactttccaaaatttttctattcacttgcataccaaatgttcatctcaaaagagttttatcttataaaatagtagcatgatgtaatactagtttgcttttyccaagcgttttgctatgttggcacacacagaaccaccatgtggccctgtggcgatgtaaatatatctctcctgttctcttccaggcagagctgttggaag

SEQ ID NO: 56046 - DNA, 201 bp, Homo sapiens
aatatactgaatatagagtttgcagagaacattttcggtaaaaatctgtctctaattattatttattcaccaatctctttcaatgttgtgcttcaacctcyagataagttggccgaaggcttcccccttcctctgctgaagcgtgttcagctctacgaccttgggctgcagatccataaggtcggtgggttcaggggggct

SEQ ID NO: 56047 - DNA, 201 bp, Homo sapiens
accctccttgctgcagtcatgagccttcctgaggaacacaacaaaatggtctactttgccatctcggattatgtcttcaacacggccagcctggtttatcrtgaggaaggatatctgaacttctccatcacagatgacatggtgaggatggtggcaaacaggtctctcaaatgaacacataacctaccgctccttccttct

SEQ ID NO: 56048 - DNA, 201 bp, Homo sapiens
tgtgcttcctccagacagcaccatgcctgatagcttaggctcccaagtcagcctccctgggtttaaatcccctttctgacacttcctgtgtgacctagaayaagttacttggccactctgtgcctcagtttccttatctgtaaaatggaaagaataatcacacctacctcatagtcttggaaatcactaaatgggaatata

SEQ ID NO: 56049 - DNA, 201 bp, Homo sapiens
gaaatctttcatcgtaaccaccgttctccagttaccctccttgctgcagtcatgagccttcctgaggaacacaacaaaatggtctactttgccatctcggrttatgtcttcaacacggccagcctggtttatcatgaggaaggatatctgaacttctccatcacagatgacatggtgaggatggtggcaaacaggtctctc

SEQ ID NO: 56050 - DNA, 201 bp, Homo sapiens
ctctaccccaacatgaacctggaactccagggatcagtgccctctgctccgctcctgaacttcagccctgggaatctgtctgtggacccctatatggagayagatgcctttgtgctcctgcccagctccagcaaggagcctgtcttccggctcagtgtggtaaggttcagagcctttgcaaatgctgtttccttttcccca

SEQ ID NO: 56051 - DNA, 201 bp, Homo sapiens
agggctctcctgggggctgtatgaccgtgggcaagtcacttctctctgagcttagtgacctgcctgtgacatgggatcgttgaagttggcctcatctcccyccagggctctaatgagggttgggggctgggacagctctttggagcacgggaaacctccttataagcgggacagagggacacatggaagtgccccacatcc

SEQ ID NO: 56052 - DNA, 201 bp, Homo sapiens
taatggtggagtttcaggcagtgttccagccagcgtcccttcatcggactgtgtaggggaatacctagcccctgccccacgataggctttgaaaagtccarttggaccctatttccctctccagggtgaaatctttcatcgtaaccaccgttctccagttaccctccttgctgcagtcatgagccttcctgaggaacacaa

SEQ ID NO: 56053 - DNA, 201 bp, Homo sapiens
gaaccaccatgtggccctgtggcgatgtaaatatatctctcctgttctcttccaggcagagctgttggaagcgctcctcaactattacatccttaacaccytctaccccaagttcaatggtaagaatcactgtggatttttccaagtcaaaagtgaacactgctgtctggaggaaagagagttggacttggaaaacagggc

SEQ ID NO: 56054 - DNA, 201 bp, Homo sapiens
ggcccacagttactgcctccagctgcagcagtgacatcgctgacgtggaggtggacatgtcgggagacttggggtaggtctccatcggggcactgccagcyggactcctggttgcagctcccggccaatccagcgctcagcctggcctccgataattgcaatgatccaggtggcttgcacaggcacttgaagatcattctc

SEQ ID NO: 56055 - DNA, 201 bp, Homo sapiens
ctgggtccaggcccagggctgacacctccttccatgtctctcccttcagcctgaacatccacagctgtgagctgcttcactctgcgctgaggcctgtcccyggccagggcctgagtctcagcatctccgactcctccatccgggtccagggcaggtggaaggtgcgcaagtcattcttgtaagttggctctgctcccaggc

SEQ ID NO: 56056 - DNA, 201 bp, Homo sapiens
tttgccatgtcccgctagtggccatgagcagccctgtccctgggtctatctcttcaggcttatgatcctatttaatcctcatgacaaccgctaaaggtagmcaaggttgcccttgtttttcagatgaggagtctctagaaaagtcgtgtggcctgctaagctaactgttcagagcctgggctctggagtcacctggcggtg

SEQ ID NO: 56057 - DNA, 201 bp, Homo sapiens
cccaaatctgctgaatgtgatcatgcgattgggtgccgcaggcactgggaagccagacacaccgaatcaggctggatgtgctgggacacagcagggcgccrggaaggggtggagagggctccctttgtggactggcctgaccagggaccagggcctggctttcccaggcacccggccatccccaagttcagtggcagactg

SEQ ID NO: 56058 - DNA, 201 bp, Homo sapiens
gctgcagcagtgacatcgctgacgtggaggtggacatgtcgggagacttggggtaggtctccatcggggcactgccagctggactcctggttgcagctccyggccaatccagcgctcagcctggcctccgataattgcaatgatccaggtggcttgcacaggcacttgaagatcattctctggggaaccctgttgagatga

SEQ ID NO: 56059 - DNA, 201 bp, Homo sapiens
gtgatcagcacggggccagaccagagctggggaactcactcagtcattctcttcccatgtttttcagatttgcgaaatgatccagaaatcagtgtcctccratctacagccttatctccaaactctgccaggtaggacaccccatccatcccgggacacttttatttctgttaatttctataagagcatatatatatctta

SEQ ID NO: 56060 - DNA, 201 bp, Homo sapiens
tgtgactgcagtgatcagcacggggccagaccagagctggggaactcactcagtcattctcttcccatgtttttcagatttgcgaaatgatccagaaatcrgtgtcctccgatctacagccttatctccaaactctgccaggtaggacaccccatccatcccgggacacttttatttctgttaatttctataagagcatat

SEQ ID NO: 56061 - DNA, 201 bp, Homo sapiens
tataaatatttgtaaatcagtgatcactgagcacatgtgtggaataatgtgactgcagtgatcagcacggggccagaccagagctggggaactcactcagkcattctcttcccatgtttttcagatttgcgaaatgatccagaaatcagtgtcctccgatctacagccttatctccaaactctgccaggtaggacacccca

SEQ ID NO: 56062 - DNA, 201 bp, Homo sapiens; identical to SEQ ID NO: 16252

SEQ ID NO: 56063 - DNA, 201 bp, Homo sapiens
gcttgttatcctcacagcccccttcttgctttgcagtttcaatggcatgccaatgaggaaagtttagtttagtttagtttagtttagtttagtttagtttwgttttgttttgttttgttttgttttgtttgagacagagtctgactctgtcgcccaggctagagtgcggtagtgcgatctcggctcactgcaatctctgcc

SEQ ID NO: 56064 - DNA, 201 bp, Homo sapiens
ccacatgggggcccacatagttttattgtttgtatttccttggtacctggctcatgacaagcacttataaatatttgtaaatcagtgatcactgagcacaygtgtggaataatgtgactgcagtgatcagcacggggccagaccagagctggggaactcactcagtcattctcttcccatgtttttcagatttgcgaaatg

SEQ ID NO: 56065 - DNA, 201 bp, Homo sapiens
gtgccccctcctcaggctatgtcagtgactccctagctcaggtgtccagccctgggacagactgaaaagtccaactggaccctagtggagtccacatgggkgcccacatagttttattgtttgtatttccttggtacctggctcatgacaagcacttataaatatttgtaaatcagtgatcactgagcacatgtgtggaat

SEQ ID NO: 56066 - DNA, 201 bp, Homo sapiens
atttaatcttgcttttagaggggtttttttgtttttcgtttttttggttttttggttttttttgcacctcacctttccagagtatttatcttaggttttcrtagaaagaacccttatagctggggccgggcatggtggctcatgcctgtaatcccagcactttgggaggccgatgggggtggaccatttgaggtcagaagt

SEQ ID NO: 56067 - DNA, 201 bp, Homo sapiens
aggcgtaagccaccacacccagccagtcccattggatcttaacctcgaccttggaaggaggtgccattttccacatggacagaggaggctgaggggtggaktagctttcccagtgtcaccttgctggtgagaggctgaatcaggattggagcttcctagaatgtggagcagcttgtaccaaagcccttctagggctaggtg

SEQ ID NO: 56068 - DNA, 201 bp, Homo sapiens
tcccttcagcctgaacatccacagctgtgagctgcttcactctgcgctgaggcctgtccctggccagggcctgagtctcagcatctccgactcctccatcygggtccagggcaggtggaaggtgcgcaagtcattcttgtaagttggctctgctcccaggccctggagctcttggccttggccttcgccccatccttctta

SEQ ID NO: 56069 - DNA, 201 bp, Homo sapiens
aagtttgagaccagcctggccaacatggtgaaaccccatctctactaaaaatacaaaaattagctgggcatggtggtgcgcacctgtaatcccagctactyaggaggctgaggcaggagaatggcttgaacacgggaggcagaggttgcagtgagctgagatcatgccactgcactccagcctgggcgacagagcaagact

SEQ ID NO: 56070 - DNA, 201 bp, Homo sapiens
agctcccggccaatccagcgctcagcctggcctccgataattgcaatgatccaggtggcttgcacaggcacttgaagatcattctctggggaaccctgttragatgaacagacttaagccaggaatattggtgcatcattttcattaaaaaaataaactttcattcacctgacaaggggacccttgtcaggtgaatgaaat

SEQ ID NO: 56071 - DNA, 201 bp, Homo sapiens
ccctatgccaccaccacatcccatccctaccatgaggggcctgagggaagctcaagaccagctcgttttgaaaatactgcgggccgggtgcagtggctcaygcctgtaatcccagcactttgggaggctggggcgggcagatcacgaggtcaggagtttgagaccagcctggccaacatggtgaaaccccatctctattaa

SEQ ID NO: 56072 - DNA, 201 bp, Homo sapiens
tctcaaaggctgcataacattgggtgcccacagcttattcaacctgtcgctgctagcggacatgtaggctgcttcctttttttttttttttttttttttttgctactgcctatgatgcttcagtgagctgccccacaccacgcgtatatcttggcaggaagagctacgggataaaggcttagaagttaaattactgggcca

SEQ ID NO: 56073 - DNA, 201 bp, Homo sapiens
agttagccaggctctaccccaacatgaacctggaactccagggatcagtgccctctgctccgctcctgaacttcagccctgggaatctgtctgtggacccstatatggagatagatgcctttgtgctcctgcccagctccagcaaggagcctgtcttccggctcagtgtggtaaggttcagagcctttgcaaatgctgttt

SEQ ID NO: 56074 - DNA, 201 bp, Homo sapiens
tttcattaaaagacataacactgcctttaatggtggagtttcaggcagtgttccagccagcgtcccttcatcggactgtgtaggggaatacctagcccctsccccacgataggctttgaaaagtccaattggaccctatttccctctccagggtgaaatctttcatcgtaaccaccgttctccagttaccctccttgctgc

SEQ ID NO: 56075 - DNA, 201 bp, Homo sapiens
agcaaagcttctggtgagcttttcattaaaagacataacactgcctttaatggtggagtttcaggcagtgttccagccagcgtcccttcatcggactgtgkaggggaatacctagcccctgccccacgataggctttgaaaagtccaattggaccctatttccctctccagggtgaaatctttcatcgtaaccaccgttct

SEQ ID NO: 56076 - DNA, 201 bp, Homo sapiens
gtagcaaagcttctggtgagcttttcattaaaagacataacactgcctttaatggtggagtttcaggcagtgttccagccagcgtcccttcatcggactgygtaggggaatacctagcccctgccccacgataggctttgaaaagtccaattggaccctatttccctctccagggtgaaatctttcatcgtaaccaccgtt

SEQ ID NO: 56077 - DNA, 201 bp, Homo sapiens
aattggcccaattcttctgccccactggtcctgcccccacaaatctcaaattgttaaagaattcactaagactgttacttcttaatgtatgaattttagamgccagctatatgaacttcctgaaatgataaagagtgagctttttgacactatctcatctgccctgtgacagtcttcccgatgtcattgtatcactgcttt

SEQ ID NO: 56078 - DNA, 201 bp, Homo sapiens
tcctgatcgaccttctctacctgcagggtcccccagcgatgcaccccatgcccaccaccccctgcaccctcacctgatgcaggaacatatgggaaccaacrtcatcgttgccaacacaatgcccactcacctcagcaacggacagatgtgtgagtggccccgacccaggggacaggcaggtgggcaaactctgggatttta

SEQ ID NO: 56079 - DNA, 201 bp, Homo sapiens
gctccttgttcattagaggcccagcagacacctcaacatgtgtggcactggctggagtagcccagcaagcctggaccataaacccatggctctgcttcacsggaagcagtgcgatgacaccaggaagccacttttcctctctaagcctcagtgtcctcatctgtggaatagaggtgctcggctgacctcagaggggagatg

SEQ ID NO: 56080 - DNA, 201 bp, Homo sapiens
ggaggtagaggttgcattaagctgagatcatgccactgccactccagcttgggcagcagaacaagactctatctcaaaaaaaacaaaacaaaacaaaaaaacaaaaaacaaacaaaaaatcttcttctggggttctctaatggggataacattaatcatctcctaagatgactatagtagaggtgcattggtgggtcaggg

SEQ ID NO: 56081 - DNA, 201 bp, Homo sapiens
gggaggtagaggttgcattaagctgagatcatgccactgccactccagcttgggcagcagaacaagactctatctcaaaaaaaacaaaacaaaacaaaaaaacaaaaaacaaacaaaaaatcttcttctggggttctctaatggggataacattaatcatctcctaagatgactatagtagaggtgcattggtgggtcagg

SEQ ID NO: 56082 - DNA, 201 bp, Homo sapiens
cgcccccatcactttttccaagcccaggaactgtgtgctcctgaggcagaggccaagcccctgaactgggagtcccaaagacaagaccacctccagctctkgaaccagaaagatctgggctcaaatccggcatagatccttccaacctgtgtgaatgtggcaaggcaatttcctctctgagcctcagtttcctcacctata

SEQ ID NO: 56083 - DNA, 201 bp, Homo sapiens
tgggaggtagaggttgcattaagctgagatcatgccactgccactccagcttgggcagcagaacaagactctatctcaaaaaaaacaaaacaaaacaaaaaaacaaaaaacaaacaaaaaatcttcttctggggttctctaatggggataacattaatcatctcctaagatgactatagtagaggtgcattggtgggtcag

SEQ ID NO: 56084 - DNA, 201 bp, Homo sapiens
gccaaaagaaagtctcggtggaagtctcactggccaggagagttgggacaagtttttatttctttttcttgatgaccttaggagaatttgaggactgaaaycctaaaatagtccctgagaaccagaaagtgtgagctggaaaggtaggatttcaagaccagctgagtctataagaggtcatcaaatctacctgctccccac

SEQ ID NO: 56085 - DNA, 201 bp, Homo sapiens
tcacttgaacctgggaggtagaggttgcattaagctgagatcatgccactgccactccagcttgggcagcagaacaagactctatctcaaaaaaaacaaaacaaaacaaaaaaacaaaaaacaaacaaaaaatcttcttctggggttctctaatggggataacattaatcatctcctaagatgactatagtagaggtgcat

SEQ ID NO: 56086 - DNA, 201 bp, Homo sapiens
ctcacttgaacctgggaggtagaggttgcattaagctgagatcatgccactgccactccagcttgggcagcagaacaagactctatctcaaaaaaaacaaaacaaaacaaaaaaacaaaaaacaaacaaaaaatcttcttctggggttctctaatggggataacattaatcatctcctaagatgactatagtagaggtgca

SEQ ID NO: 56087 - DNA, 201 bp, Homo sapiens
tttctgcctgtgtctaggaaatcataattcatgctggcgtaccctggttgttgaggtccctgaatccttgtgcccacactgctgaagactccttgtgtgayacaagtcaggggacatctgggtcttgactccccagatgctccagctggaccctgctgccctcccttgcccaccctcttccattgtagatgccaaggggct

SEQ ID NO: 56088 - DNA, 201 bp, Homo sapiens
actcacttgaacctgggaggtagaggttgcattaagctgagatcatgccactgccactccagcttgggcagcagaacaagactctatctcaaaaaaaacaaaacaaaacaaaaaaacaaaaaacaaacaaaaaatcttcttctggggttctctaatggggataacattaatcatctcctaagatgactatagtagaggtgc

SEQ ID NO: 56089 - DNA, 201 bp, Homo sapiens
gactcacttgaacctgggaggtagaggttgcattaagctgagatcatgccactgccactccagcttgggcagcagaacaagactctatctcaaaaaaaacaaaacaaaacaaaaaaacaaaaaacaaacaaaaaatcttcttctggggttctctaatggggataacattaatcatctcctaagatgactatagtagaggtg

SEQ ID NO: 56090 - DNA, 201 bp, Homo sapiens
tcattttccaaacggctgtctgagataaataatattgtaatctccaaggacagaagaaaaaactaaggttcaagattaaaaaaaaaacacaaacaaacaaaaaatgtcatctgactcgagacttgacacaatccagctgttgctggccctctgctctaggccacagatatggctggacagagaaaggagaactccagtgac

SEQ ID NO: 56091 - DNA, 201 bp, Homo sapiens
ttcattttccaaacggctgtctgagataaataatattgtaatctccaaggacagaagaaaaaactaaggttcaagattaaaaaaaaaacacaaacaaacaaaaaatgtcatctgactcgagacttgacacaatccagctgttgctggccctctgctctaggccacagatatggctggacagagaaaggagaactccagtga

SEQ ID NO: 56092 - DNA, 201 bp, Homo sapiens
acccctctgagggggatattttgcccatggtcttccctgctgcatctccaccacccacaacgatgcacgcagaaggtgctgaataaatgttgactgtttcratggacgatttccatcctttattcactcagttattcatccagcctatttatatcaagtgggtcctgggaatacaatggtagatgggacacagtccagtgg

SEQ ID NO: 56093 - DNA, 201 bp, Homo sapiens
ggcacggagagggaaaatgacttgcccaaagccagtgagtcagcaaactgaagcaggtcaagaatccagagggaaccctgaagttccctgagcagaaaacratcggttaaaatctcattgccacttctgccttgaactccaaatcctccttcctgagctccaggcatggggtcccctccatcccctcacccagagcttgtc

SEQ ID NO: 56094 - DNA, 201 bp, Homo sapiens
tttcattttccaaacggctgtctgagataaataatattgtaatctccaaggacagaagaaaaaactaaggttcaagattaaaaaaaaaacacaaacaaacaaaaaatgtcatctgactcgagacttgacacaatccagctgttgctggccctctgctctaggccacagatatggctggacagagaaaggagaactccagtg

SEQ ID NO: 56095 - DNA, 201 bp, Homo sapiens
ttctacacttcatcctctctttgggatttctgagtccagacacagtgaggaccccgacagcccccctcctcacctcttgtcctgggaaggccaggcctgcrtggcagagatgtaaccagactccaaagctttctgggccgggcttcatggaaggccgtatcggtgcaggggcataaacacaagctctggagccaggtagag

SEQ ID NO: 56096 - DNA, 201 bp, Homo sapiens
gatgctaggattacaggtgtgagcccctgtgcctggcctgaaactttcaaggtctcaagacactgtacatttaaagtaccccaatgttttccttttccacytcccgttctttctccttatctaacatgaagaacattgtattaaatctgatttttaaggagtttttgtctgttatgtgttaagggtttgtttggtacccca

SEQ ID NO: 56097 - DNA, 201 bp, Homo sapiens
tgagcaagtccctttcaccctctgaggctccgtgaggggccccaggtctgggccccaagtctatggttcagtctgtggccagctgccactcccctgacggsctcagtgtttccgtccactaaatgggtgggttagccaaggcatcttttccagtcttgaagctttgtgggtgcctgatttgattaagccacagtggccttt

SEQ ID NO: 56098 - DNA, 201 bp, Homo sapiens
aaacacaatgccactcatggtctgtgatgaagtagaaagtgctcgttgttaagacaaagctcacccaccaccgctgcgtggacttgagcaagtccctttcrccctctgaggctccgtgaggggccccaggtctgggccccaagtctatggttcagtctgtggccagctgccactcccctgacggcctcagtgtttccgtcc

SEQ ID NO: 56099 - DNA, 201 bp, Homo sapiens
tccagtcctcactgcctcacagtggctctgcttggcgcttggcacagtgacgtgatggtgagctcccccttggtgcccagctccagcgattcagcccagcwcggccccttcgtgaaccccttgggcctaggttcagagagacggcaagggatgttgtatccctggagatggtggttggagacataaccgcatttctcggtg

SEQ ID NO: 56100 - DNA, 201 bp, Homo sapiens
tgccactcccctgacggcctcagtgtttccgtccactaaatgggtgggttagccaaggcatcttttccagtcttgaagctttgtgggtgcctgatttgatyaagccacagtggcctttgccgagtgcagagggtggtatgattggcattttaggagctcaaggaagagaaagggaggggacctacctggtatctgccgttg

SEQ ID NO: 56101 - DNA, 201 bp, Homo sapiens
aaaacttctccaatgggaaaccaaggccagggagggaaatgaccttgcccaaggacacacagtggctggaaccagagctggggcaggacacccagcagctyacatgaagccctagggcaaataagaaaaaggcaccccactctgggcaggcagagctccatgggcacttcgcttggcaagtggaacaagggctgggtttcc

SEQ ID NO: 56102 - DNA, 201 bp, Homo sapiens
gggtgggttagccaaggcatcttttccagtcttgaagctttgtgggtgcctgatttgattaagccacagtggcctttgccgagtgcagagggtggtatgaktggcattttaggagctcaaggaagagaaagggaggggacctacctggtatctgccgttggtatcagcaagtgtcagatcccagctccaggaagagggctg

SEQ ID NO: 56103 - DNA, 201 bp, Homo sapiens
ctcggcctcccaagatgctaggattacaggtgtgagcccctgtgcctggcctgaaactttcaaggtctcaagacactgtacatttaaagtaccccaatgtyttccttttccacttcccgttctttctccttatctaacatgaagaacattgtattaaatctgatttttaaggagtttttgtctgttatgtgttaagggttt

SEQ ID NO: 56104 - DNA, 201 bp, Homo sapiens
ggctgtggcatggtgtggttgatcttggttgatcgtagaccttatttaattgaatctaagatgtcatctatggaaaaatgcattgttatttttgttgccartgaaattctgacatgacattgatcacattccccgttaagcaatgtggaactgtgcctcagagtggaagaggccatgtattcctggattgtgtggggagta

SEQ ID NO: 56105 - DNA, 201 bp, Homo sapiens
agggccaatttccagcaaaagtcgatcccggctattcctcccaggcccttccagtcctcactgcctcacagtggctctgcttggcgcttggcacagtgacrtgatggtgagctcccccttggtgcccagctccagcgattcagcccagcacggccccttcgtgaaccccttgggcctaggttcagagagacggcaagggat

SEQ ID NO: 56106 - DNA, 201 bp, Homo sapiens
tcaacctttctcccaagacagaggtctgagcaacgctggagggaggaggtggaggaacacagtgggaatgaccacaatgcccagaaatggttccagcctcsctgccttaccgcagaccaggctgagccgtctggcagggatttcaggggcacttgagtgaggtggtgggggaaggcttgggagctctgagcagggcacagt

SEQ ID NO: 56107 - DNA, 201 bp, Homo sapiens
atggcgagtgagcgtgggttagtcgatgctagtgtttgtttacatgcctgggttacctggaagatcatgacacatgcagtcacttggttgttttgagaacrggccagagtgacaaagtgttcagttgccactgtggtcaagccataggaaatgagggtattcctagctgtgcctgtcttctaggccccaccacccctcctc

SEQ ID NO: 56108 - DNA, 201 bp, Homo sapiens
ccaggccccacttggtgcttgatttatgccatctcatttccttctcaaaccaccctttgaagttgattgtacattttacagaaaaggaaactgaggctcgkagaggagaatcatttacccaaggtcccagttagtagacggtaggtgcctgaatgtaaatccaggtctctgcctgctccgggagggggtgggggtgaggga

SEQ ID NO: 56109 - DNA, 201 bp, Homo sapiens
ccttctcaaaccaccctttgaagttgattgtacattttacagaaaaggaaactgaggctcggagaggagaatcatttacccaaggtcccagttagtagacrgtaggtgcctgaatgtaaatccaggtctctgcctgctccgggagggggtgggggtgagggaaacaggagaatgtgatgggaaaatccgagatggagccag

SEQ ID NO: 56110 - DNA, 201 bp, Homo sapiens
agtgcaatggcagtatctcggctcactgcaacctccacctcctgggtgtgagtgattctcctgcctcagcctcccaagtagctgggattacaggcatgtgycaccacacctggctaattttgtatttttagtagagacagggtttcaccatattggccaggctggtctggaacccctgacctcaggtgatccgcctcggcc

SEQ ID NO: 56111 - DNA, 201 bp, Homo sapiens
gtttcattttccaaacggctgtctgagataaataatattgtaatctccaaggacagaagaaaaaactaaggttcaagattaaaaaaaaaacacaaacaaacaaaaaatgtcatctgactcgagacttgacacaatccagctgttgctggccctctgctctaggccacagatatggctggacagagaaaggagaactccagt

SEQ ID NO: 56112 - DNA, 201 bp, Homo sapiens
aactcttttggatctttgattattcttcaaggggcatagctttctttctttctttctttctttttttttttttgagacgaactctcgctctgctgccgggmtagagtgcggtggcgagatctcggctcactgcaccctccgcctcccaggttcaagcaattctcctgcctcagcctcccaagtagctgggactacaggtgc

SEQ ID NO: 56113 - DNA, 201 bp, Homo sapiens
ggccaggctggtctggaacccctgacctcaggtgatccgcctcggcctcccaaagtgctgggattataggcatgagccactgcgcccggcccctggccctytcttgagctgctgcaaagccagcaaaccccttactaggctcctggaagggggatgagagccccagaccattcagccttagctcagccttgaaaatagctg

SEQ ID NO: 56114 - DNA, 201 bp, Homo sapiens
aatttcggagatgccacctatgaagctcctgcccagagcacccctgggcctccaaagagatgttacccatctggggaagaggagctgggctgggccacctyctcagcttcggagacagactctggtgcattcgcttacccgtttcgcacctttgcataagacactgacaatgcatgtgagtctgtgaaagcttctgagaag

SEQ ID NO: 56115 - DNA, 201 bp, Homo sapiens
gccttggaaacgattcccccagtcattctgggaacatgttgtaagcactgactgggaccaggcaccaggcagggtctagaaggctgtggtgagggaagacrcctttctcctccaacccaacctcatcctccttcttcagggacttgggtgggtacttgggtgaggatccctgaaggccttcaacccgagaaaacaaaccca

SEQ ID NO: 56116 - DNA, 201 bp, Homo sapiens
cgcctccagctgggcctgaccctccatgtcctgccctcaaaaaactgggtggagaaataattgtttctttaaaggatatgagttagaatcaccccctgttraattttccctcctagatccccttcttaaatgtccaacatgggtcaaaagaaaatgacctccttgccttccttctttcctagttgcatctttcttttcttg

SEQ ID NO: 56117 - DNA, 201 bp, Homo sapiens
tcattaattcacccacccattcactcattaattcacccacccatttgctcacttactcagtaatttaccctcattcgttcattcactcactcattcatgcrttcactcaactcactcattaattctccctgtctctaattcactcactcctaattcacccactcatcaattcccccacacactcactcattaattggtgct

SEQ ID NO: 56118 - DNA, 201 bp, Homo sapiens
ctccgggagggggtgggggtgagggaaacaggagaatgtgatgggaaaatccgagatggagccagcctgggccagaaacactgggagctgtgggagacggmgaggggcagggtgggatcacagggagcaggagcggggaattggaggtgaatctggccctcccaaacttccagtccattctgctcccaggggaaccgggaa

SEQ ID NO: 56119 - DNA, 201 bp, Homo sapiens
tcaacccaaggtgacttcccatcctccctccctcccaacccttccaggcaatgactacattgtccctcggcactgcccggagctggcggagatgagccggrtgtccatacgcatccttgacgagctggtgctgcccttccaggagctgcagatcgatgacaatgagtatgcctacctcaaagccatcatcttctttgaccc

SEQ ID NO: 56120 - DNA, 201 bp, Homo sapiens
atcctgatcgaccttctctacctgcagggtcccccagcgatgcaccccatgcccaccaccccctgcaccctcacctgatgcaggaacatatgggaaccaaygtcatcgttgccaacacaatgcccactcacctcagcaacggacagatgtgtgagtggccccgacccaggggacaggcaggtgggcaaactctgggatttt

SEQ ID NO: 56121 - DNA, 201 bp, Homo sapiens
catttcacagttcaggcaggtagaggcagaggggagcattaagctgacttgcccagcgtcactgagttggctacgggcagccttcccaagggtacagatgrcaaacactgttccttctctctttcaggtggccctgctcagagcccatgctggcgagcacctgctgctcggagccaccaagagatccatggtgttcaagga

SEQ ID NO: 56122 - DNA, 201 bp, Homo sapiens
cagcccccttgcgagttaggaggccggctcccaccccagaaggtggccaggttttcatgccttcctagagaaagctggggctcgtggcctccaccacaggragacgcagaccctcagaaacaagtctgtgaagtcacaaccagccccagtttacagatgtgaaactgaagctccaaaaagtcaggaggtcactgagtgggg

SEQ ID NO: 56123 - DNA, 201 bp, Homo sapiens
cagtcacagacacccccaccccctactccatccctgttctccctcctcacctctctgtgcctcctcacagccgtccagaatgagcgggaccggatcagcaytcgaaggtcaagctatgaggacagcagcctgccctccatcaatgcgctcctgcaggcggaggtcctgtcccgacaggtaccggggtgatcctgccaccca

SEQ ID NO: 56124 - DNA, 201 bp, Homo sapiens
gccaggttttcatgccttcctagagaaagctggggctcgtggcctccaccacaggaagacgcagaccctcagaaacaagtctgtgaagtcacaaccagccscagtttacagatgtgaaactgaagctccaaaaagtcaggaggtcactgagtggggaggtgatggagtgggaacagcccccagatctggctgaggccgaag

SEQ ID NO: 56125 - DNA, 201 bp, Homo sapiens
tgagtggggaggtgatggagtgggaacagcccccagatctggctgaggccgaagccctggagagatccccgcaaggctcccttagatgcctgacattctgytcttcctgaagcctcactcccttctctcctggcgcagacacgtccccatcagaaggcaccaacctcaacgcgcccaacagcctgggtgtcagcgccctgt

SEQ ID NO: 56126 - DNA, 201 bp, Homo sapiens
aaccgagtattaactctgagccataaccaggagcctgctatgggttctgagcttttataggatgtggtggaaatagcagggctctggtactccagaggtcraggttcccaactcagctctaacaccaaccagcagagcgacccaggaccacatgttgcctctctgagcctcagttttcccatgtttagcaggacaggactg

SEQ ID NO: 56127 - DNA, 201 bp, Homo sapiens
ggatggacaaatgatgtgatgagtgggttgatgaaaagatggatgaatggatggataagaaggggtgggctgaggtagcctggaatagcagcatcttcaartgctctaaacaggacaagtgaagagataggggatgtcaacaatcttccatcagggcaatactgtatatctgtttttaagtgccaggtgagcctaattttt

SEQ ID NO: 56128 - DNA, 201 bp, Homo sapiens
cggtttgaaaggaaggcagagagggcactgggaggaggcagtgggagggcggagggcgggggccttcggggtgggcgcccagggtagggcaggtggccgcsgcgtggaggcagggagaatgcgactctccaaaaccctcgtcgacatggacatggccgactacagtgctgcactggacccagcctacaccaccctggaatt

SEQ ID NO: 56129 - DNA, 201 bp, Homo sapiens
ctatgggttctgagcttttataggatgtggtggaaatagcagggctctggtactccagaggtcaaggttcccaactcagctctaacaccaaccagcagagygacccaggaccacatgttgcctctctgagcctcagttttcccatgtttagcaggacaggactgggctcttagagagttcatagcacctttccagctcctg

SEQ ID NO: 56130 - DNA, 201 bp, Homo sapiens
ggcagcctttgaggactcgtgattcgctccctgagttgggcacatttcaggcccatgattttgaaaaacattgaaattggcttgtggacatccgccccccsacccccactgcatggtactggagccacgacagagtccaggcccccctttttacagatgggtacactgaggctcagagcagggtgtaacttacccagagct

SEQ ID NO: 56131 - DNA, 201 bp, Homo sapiens
agaagaaatgctcaataagcatttgttggatgagtgaaatgatgggcttaaaacagcgctacaatgatgatcatcaatgtcagccagatcccactctcttsccttccttcctctctgccctcctcactgcgttgtctttggtccttgtatttgccccattataacccaaactggctgtcccagcttcagctgtcatgtctg

SEQ ID NO: 56132 - DNA, 201 bp, Homo sapiens
acggcgacattcgggcgaagaagattgccagcatcgcagatgtgtgtgagtccatgaaggagcagctgctggttctcgttgagtgggccaagtacatcccrgctttctgcgagctccccctggacgaccaggtgaggatgggcgtggatggtgggcagtagtgggcagtgggcggggcagccagggggctgctggcccacc

SEQ ID NO: 56133 - DNA, 201 bp, Homo sapiens
tttaacctagatctatctgacccacaaggtctgtggtttattcccctaaagagaggtcaggggaagagaggctaagaagcttatctactctctcatttaaycttcacgacaaacgacaagttagaccccttgtacagaaggagtaaccaaggcttcgaaataaaaacttgccttgtgcagacagctggccctgggcttgga

SEQ ID NO: 56134 - DNA, 201 bp, Homo sapiens
gacagctggccctgggcttggaatataaatagtcactggtatacaggcaccagagaccaatacccacaggctaacacccactcagtccacagaaagaagcytaatattttttataagcatagaaataaaaaccaaaccaatactgtgacatttgctctgtgacttcctgtatttattatgtgctcatatgaaagcacctaa

SEQ ID NO: 56135 - DNA, 201 bp, Homo sapiens
tctctcctggcgcagacacgtccccatcagaaggcaccaacctcaacgcgcccaacagcctgggtgtcagcgccctgtgtgccatctgcggggaccgggcyacgggcaaacactacggtgcctcgagctgtgacggctgcaagggcttcttccggaggagcgtgcggaagaaccacatgtactcctgcaggtgaggagcct

SEQ ID NO: 56136 - DNA, 201 bp, Homo sapiens
cagatctggctgaggccgaagccctggagagatccccgcaaggctcccttagatgcctgacattctgttcttcctgaagcctcactcccttctctcctggygcagacacgtccccatcagaaggcaccaacctcaacgcgcccaacagcctgggtgtcagcgccctgtgtgccatctgcggggaccgggccacgggcaaac

SEQ ID NO: 56137 - DNA, 201 bp, Homo sapiens
agcatatctggaggggtggacagttctccacagggaggtaggggaaaagaggaggcccggaaacccctcctggagggaagagccccatcggtcccaggccmgcctcagaggagagggggcaggcagctggctgaggtcagcctgccaccctgcttccttctgtgtcttggagccactcagccagtatgaggctgcagctcc

SEQ ID NO: 56138 - DNA, 201 bp, Homo sapiens
ctcttcctctttgccaaacatggctggacataatttaattcccacaacaacctctgaggctgtcattcttgtggttctgtttcacaaatgaggaaacaagrccggtcatggtggatcacgcctgtaatctcagcactttgggaggctgaggcaggtggatcacctgaggtcaagagtttgagaccagcctggccaacgtgg

SEQ ID NO: 56139 - DNA, 201 bp, Homo sapiens
cctgtatcctctgtagtgctcaacacgaggctggactggcagaattgttctgcaaaatgggaaggatcactgatgctgagtcagaggcagcagcctcccgsaatttgaaggggcgggggacctagttcaaggcctggcatgcaggaggtgctcaataaacatgtgtggcctgaatgaactaatgaataagcatgattcagt

SEQ ID NO: 56140 - DNA, 201 bp, Homo sapiens; identical to SEQ ID NO: 16283

SEQ ID NO: 56141 - DNA, 201 bp, Homo sapiens
cagagtgtgtagggggaagccggtaaaaggtgcgatccgagaggagaggaagggccctggggacttgtgaggttggaaggcactggttttgagcagcaggsgacatgacttgaacggatccctctgtctctgagaggaacacagactgcaggcgcaaggcagaagcagagcccaggaggaggctgatctaatccaggagag

SEQ ID NO: 56142 - DNA, 201 bp, Homo sapiens
ggaccactgccctgccctgggctgctccccgcccccatcactttttccaagcccaggaactgtgtgctcctgaggcagaggccaagcccctgaactgggaktcccaaagacaagaccacctccagctctggaaccagaaagatctgggctcaaatccggcatagatccttccaacctgtgtgaatgtggcaaggcaatttc

SEQ ID NO: 56143 - DNA, 201 bp, Homo sapiens
gacttgaacggatccctctgtctctgagaggaacacagactgcaggcgcaaggcagaagcagagcccaggaggaggctgatctaatccaggagagacagcrggcctgggagcagggagggagcagcaggtctgtttgtcaggatcacgacagcactggggtgtgaggggaagccaaggaaggtggccaggcttgatgccag

SEQ ID NO: 56144 - DNA, 201 bp, Homo sapiens
ccgggcctcttcatttactcccacaaaggctggaattttgagcagcccctgtctgtctgtttgtccttccagccacccctgagaccccacagccctcacckccaggtggctcagggtctgagccctataagctcctgccgggagccgtcgccacaatcgtcaagcccctctctgccatcccccagccgaccatcaccaagc

SEQ ID NO: 56145 - DNA, 201 bp, Homo sapiens
ccgcccccatcactttttccaagcccaggaactgtgtgctcctgaggcagaggccaagcccctgaactgggagtcccaaagacaagaccacctccagctcyggaaccagaaagatctgggctcaaatccggcatagatccttccaacctgtgtgaatgtggcaaggcaatttcctctctgagcctcagtttcctcacctat

SEQ ID NO: 56146 - DNA, 201 bp, Homo sapiens
cgggtagggaaactgagccccagagagaggctgcgattgccaccggcacacagagtggcaggttccagacaggaagccgggtctggtgcagcttcaacctycctcctttctgaatcagccaagcctcattccacagtgaggcctcttggactccaagggctatcccatccactgtcgggatggtggaaggatcatcttcta

SEQ ID NO: 56147 - DNA, 201 bp, Homo sapiens
cctcttggactccaagggctatcccatccactgtcgggatggtggaaggatcatcttctatctcaggccaggactgacccagatgggagcaggcagtggarcctggggccccggtgggcgtaggctccagatccctcagtgcctggaacagagcagcagtgggagggagggagacagcgcctggccttgctgatgctgagg

SEQ ID NO: 56148 - DNA, 201 bp, Homo sapiens
agatcccctcctcaatgctcaagaccaattttaaacccatagccgagtcttcactgtcttgcgcgcccctgctgatgggtggatcactcttatagcctctscattgtgttgggggcagttgtgatatgtggaaagttcttccaccagctgagttagaggccatctcccctcattccacatgctgatgtgggcctgttctct

SEQ ID NO: 56149 - DNA, 201 bp, Homo sapiens
cactacagaggagctcacctcctccacctccattctccccagccaggccctggagcagctgacgggaggggcctcagatattacagaagggacactgagtscggtttcacatggcccagtttgcagcaagggcaggaatcgaacctggcgccctggggcactttctaattcatcctactgcctgcatcccacaggccaagc

SEQ ID NO: 56150 - DNA, 201 bp, Homo sapiens
atgatgattttttgccctgcttctcctctaaggctgacagactccttggggctctaaagctgacagaggagggggcagggggcaggtaacaggtgaaggcmcagagggagcccttctccctcatccctgcctcctccctccctccgtttttaccctgagcttccttcagagctggagggcacccactatccagccccctcc

SEQ ID NO: 56151 - DNA, 201 bp, Homo sapiens
gtttttaccctgagcttccttcagagctggagggcacccactatccagccccctccccacatctgattccagggagggggctctgtgcaggggacagagartgcgggagggcccggacatctccagcattttcttccctgtatctctcgaagatcacctcccccgtctccgggatcaacggcgacattcgggcgaagaaga

SEQ ID NO: 56152 - DNA, 201 bp, Homo sapiens
tttatctctctgatcctcagtctcctcatctgtaaaataaggataagaatagacttgacttccacttcaacgagaagtgaaacgagatatcctaccactgygctttgcacataaaggctctataaatgtcagctgtcatcataaagagccaaaagtggcatttggagtaaatctgatttgtttttaagagatagggttttg

SEQ ID NO: 56153 - DNA, 201 bp, Homo sapiens
ttacagatgggtacactgaggctcagagcagggtgtaacttacccagagctgcatagcttgtctttgatggccaaggttagagctcagtctctcacagctscttcctgcttcctcggctctcagaactgagaagtgaaaaccaaagttggcctgaggggactctctctgggcctttttttctctatctctgcctcggtctc

SEQ ID NO: 56154 - DNA, 201 bp, Homo sapiens
ataagacactgacaatgcatgtgagtctgtgaaagcttctgagaagtctcgtccaggcagttgtttgactttgcagaggccgaggcttctcaaactccttyggcaagattctcctggaacacctattaatactgcacattgggacactgtgaaaacgctggtttggcttgtccccagcctcatacaggggctggacccggg

SEQ ID NO: 56155 - DNA, 201 bp, Homo sapiens
attttgggaaattgacatagggttagcaaacctcccccacccccatataaaaatattaatacttttttttttttctgagatggagtctggctctgtcgccraggctgcagtgcagtagtgcaatctcggctcactgcaacatttgcctcctaggttgaaacgattctcctccttcagcctcccgagtagctgagattacag

SEQ ID NO: 56156 - DNA, 201 bp, Homo sapiens
gagcttccttatatgcaccttgttcctttcaactcacttttgttctcttggttttttggggtcctcttaacaccctcatgaagtctatagatgggaatggyacaccctagtttactaacccaggaataggtacccaacaggcactgccaatattggatgggctggttgattggccacgcctgaggaagatggcgtcccaag

SEQ ID NO: 56157 - DNA, 201 bp, Homo sapiens
aaggggtggggtggaggcaggcggggggggggggaggcggggggggcggtggagcgggggagatcccctccccaaccctggcaggtttaaaaaaaaaaaaagggaagaagtgaaaagacttttgcagacctccagagatgatgcataaggttggctggggtggagatggaaagatggaaaatctagattctgtttggaggg

SEQ ID NO: 56158 - DNA, 201 bp, Homo sapiens
cctgtctcactctcctgagtagctgggactacaggcacatgacaccacatctggcttatttttgtatttttagtagacggggtttcaccatgttggccacrtgaaactggtctcaaactcctggcttcaactgatctgcctgcctcagccccacaagtgctgagattacaggcgtgagccacttcacccagccagtgggca

SEQ ID NO: 56159 - DNA, 201 bp, Homo sapiens
tttcattcttttgcatgtggatatacagtttcccaaacatgaatttggttttgatagtactttgttaattaagacttttgcacctggtagacgctctttgdcctctaacccactggaatcctctcaccatccttccctgacagttgaccatttagcttgggcttaatacttccaatgacggaatactcactacttaataaa

SEQ ID NO: 56160 - DNA, 201 bp, Homo sapiens
acaaaggctggaattttgagcagcccctgtctgtctgtttgtccttccagccacccctgagaccccacagccctcaccgccaggtggctcagggtctgagycctataagctcctgccgggagccgtcgccacaatcgtcaagcccctctctgccatcccccagccgaccatcaccaagcaggaagttatctagcaagccgc

SEQ ID NO: 56161 - DNA, 201 bp, Homo sapiens
caagtaagctgggactacaggtgtgcagcatgcctggctaatttttaaatttttctgtagagacaaagtttcactatgttgcccaggctggtcttaaactyctgagctcaagcaatcctcctgcctctgcctcacaaagtggtgagattacagacttgagccactacacctggcctctttgtccatttttaaagtttttgg

SEQ ID NO: 56162 - DNA, 201 bp, Homo sapiens
tactattccatagtgtatatgtaccacattttcattatccattccactgctgatgggcacttaggttgattccatgtctttctactgttttgttttgtttragatggagtctcactctgtcacccaggctggagtgcagtggcgcaatctcagctcactgcaacctctgcctcccaggttcaagccattctcctgtctcag

SEQ ID NO: 56163 - DNA, 201 bp, Homo sapiens
cccatataatcttactctcattccaataaaccatttcccctctccccccaccatcccacccagggatcatagcacacaaaagtccttttgtctccagagayagtaaaatctcctccctcagaccttgccctgcagctggggcccactccctgcctggctggagagcttttcctttgaagacccgggatggaaaacaggccc

SEQ ID NO: 56164 - DNA, 201 bp, Homo sapiens
ctgataacgcccgcctaaccttgaggagccctatccgcagctgctgacagcagccctttcattccgcccgccggccactcggcgccctgatgggtgggtgygggtgctggcaggaggctgccgtgggaggggtgtgggcgggtggggtggacggcccggtcagggaagccgtgctctgagctggccccgtccacatggtgg

SEQ ID NO: 56165 - DNA, 201 bp, Homo sapiens
aaggacacagcagttcaaggacagagtcagcgcgaggtctctcagctctgagcacatgttctttccccttccaggtttctagttttatgggtagtagtttyatgatgcccatttcacagttcaggcaggtagaggcagaggggagcattaagctgacttgcccagcgtcactgagttggctacgggcagccttcccaaggg

SEQ ID NO: 56166 - DNA, 201 bp, Homo sapiens
gatggctctcagtgggctggctatgtccttctgtgagcttgctgggcccctacctatgactccagtcttagaagtcttgccttgtaccccctgcagagaakggtttcatcaagctgattctctgccaggggccagtgctcatacatttgctctgagaaggaccagccctgagacctaacatccacatccaagttcttgtaa

SEQ ID NO: 56167 - DNA, 201 bp, Homo sapiens
gggttctgtacactgagttcacagcctcatctcatgttaacgacagccaggagaggccgttttcatttaacagatgaggcaagtcaagatttgaagagacratatggccgggcgcagtggctcacacctgtaatcccagcactttgggaggctgaggcgggcggatcacctgaggtcaggggttcaagatgagcctggcta

SEQ ID NO: 56168 - DNA, 201 bp, Homo sapiens
gtgagggagactagtcaggagtggccctgtcctcaggcttgcattggagggctccaggactcagttttcaactgggtaccccactcagatgcaaggaaatrtggatgcaagtcaccaaattcccagcattgaagtcagagcacgatcagggttatccctggaattacctgtgcatccttttttcttttgacagagtcttgc

SEQ ID NO: 56169 - DNA, 201 bp, Homo sapiens
ttacctgtgcatccttttttcttttgacagagtcttgctctgtcactcaggctggagtgcaatgatgtgatctcggctcacttcagcctccacccgccacrttcaagcaattctcctgcctcaccctccagagttgctgggaccacaggcgtgcaccaccacacccagctaatttttgtatttttagtagagacagggttt

SEQ ID NO: 56170 - DNA, 201 bp, Homo sapiens
cttcctcttttctttcatatttgcttcttttcctcaaaaaaatttatcaaaataatatctagaaccggatgtggtggctcacatctgtaatcccagcactwtgggaggcagaggcaggaggatcacttcaggccaggagttcgaggccagcctggccaacataacaagacctcgtctctatagaaactaaaaaaaattagc

SEQ ID NO: 56171 - DNA, 201 bp, Homo sapiens
cctgtaatcccagctactcaggaggctgaggcaggagaatcgcttgaacctgggaggcgggggttgcagtgagccaagatcatgccattgcactccagcckgggcaacaagagcaaaacttcatctcaaaaaaatacatatatgtgtatatatatataatatatattatatatatataatatatagtgatatatatagtat

SEQ ID NO: 56172 - DNA, 201 bp, Homo sapiens
ggaattattattatctccattttacagataaggaaactgaggcatgattaacttgctcaaggtcacacaaccggaaaatggcagagcttggatttgaactkcagaccacctgtcaatcccaatttctctctctcaagcccacattcttacctaccacctgctatcccacacttaccagagggtgagatttctagttctagt

SEQ ID NO: 56173 - DNA, 201 bp, Homo sapiens
agcctgtatcctctgtagtgctcaacacgaggctggactggcagaattgttctgcaaaatgggaaggatcactgatgctgagtcagaggcagcagcctccmgcaatttgaaggggcgggggacctagttcaaggcctggcatgcaggaggtgctcaataaacatgtgtggcctgaatgaactaatgaataagcatgattca

SEQ ID NO: 56174 - DNA, 201 bp, Homo sapiens
tagaaatgtgggtgaatgttctttctgccacttcctttgtccatgaaagaggaaataaatgcattacctccatgaaggttgagattaaatattgtatgacygcttaagttcctttccaggctaaggatctagaatttattcactgatttttttttcattcattcatccagccatctaacaaaaaatatacatatagttatc

SEQ ID NO: 56175 - DNA, 201 bp, Homo sapiens
tgttctttctgccacttcctttgtccatgaaagaggaaataaatgcattacctccatgaaggttgagattaaatattgtatgaccgcttaagttcctttcyaggctaaggatctagaatttattcactgatttttttttcattcattcatccagccatctaacaaaaaatatacatatagttatcaataaatatatattta

SEQ ID NO: 56176 - DNA, 201 bp, Homo sapiens
aaggcagatgtggtaacaattgtatgaagaggaatacaagtgtctagggcttgggggccacacactaaacctggcatcagaaggcccagatctgggacccrgctcatttgttttctagcactaggttgtttttcatccttgtataacaccatggcccaggtactactctaagcactttataaaaattaactcctggccggg

SEQ ID NO: 56177 - DNA, 201 bp, Homo sapiens; identical to SEQ ID NO: 16300

SEQ ID NO: 56178 - DNA, 201 bp, Homo sapiens
ccaatatcaggctatggctgttcccacccttcattcttaaaatatggcccctctccagcccttcccctatctcccctcccacatcaccttcccatcctacrtcaattcagtcttcagcccctatgattcacaaacctggttgcacataggaaactttttaaaacaattttggggctccactccagacccagtgaatcagtc

SEQ ID NO: 56179 - DNA, 201 bp, Homo sapiens
gaatcagtctcctggggtgagttccaagagtctgtaattttttgagctccttgtgtgacttagggtatgcagttcagttgaggtatggaaaccattgcctwactttctcccatttagtaaacagaggaactaaatatccagagtgcatcttgcctcaacccagaagcctcccgtattcattaattcattgttcatttgttc

SEQ ID NO: 56180 - DNA, 201 bp, Homo sapiens
agttccagaccagcctagtcaacatggtgaaaccctgtctctactaagcatacaaaaattagctggacgtggtgccaggcgcctgtaatcccagctactcrggaggctgaggcaggagaatcacttgaacgcaggtggtggaggttgcagtgagccgaggttgtaccactgcactccaacctgggcaacagagggaaactt

SEQ ID NO: 56181 - DNA, 201 bp, Homo sapiens
gaggctgaggcgggcagataacttgagattaggagttcgagaccagcctggccaacatggcaaaaccccgtctctactaaaaatacaaaaactagccgggyatgatggcacacgcctgtaattccagctacttgggaggctgaggcatgagactcacttgaacctgggaggtagaggttgcattaagctgagatcatgcca

SEQ ID NO: 56182 - DNA, 201 bp, Homo sapiens
tgccttccctccactagtcagcaccaggaaatgttttcgataacgttgcaacggaggccttgttcatgctgccgccatcggggacaagcgcggggggcggsgggtggaggccagaggagactatttcagtcctaaattgtgcttaataaacccatatcaaaaccataaacccttggctgccataaattcctctacccttgg

SEQ ID NO: 56183 - DNA, 201 bp, Homo sapiens
tccaggtttctagttttatgggtagtagttttatgatgcccatttcacagttcaggcaggtagaggcagaggggagcattaagctgacttgcccagcgtcrctgagttggctacgggcagccttcccaagggtacagatggcaaacactgttccttctctctttcaggtggccctgctcagagcccatgctggcgagcacc

SEQ ID NO: 56184 - DNA, 201 bp, Homo sapiens
atgtcataatagcatccaaggagtttaccaccttctaccacctactagctgtgtgaccttgagtgaatgactcaattctcttttttttttttttttgagayggagtcttgctctgctgcccaggctggagtgcaatggtatgatcctggctcactgcaacctctgcctcctgggttcaaacaattctcctgcctcagcctc

SEQ ID NO: 56185 - DNA, 201 bp, Homo sapiens
aagaccagcctgggcaatatggcaaaaacccacctctacaaaaaacacaaaaattagctgggcctggtggtacacgcctgtagtcccacctactcgggagrctgaggcaagaggattgcttgagcccaagaggtgaaggttgctgtgagccgagattacaacaccacactccagcctgggtgacacagcgtaatcctagtg

SEQ ID NO: 56186 - DNA, 201 bp, Homo sapiens
ccacctactcgggaggctgaggcaagaggattgcttgagcccaagaggtgaaggttgctgtgagccgagattacaacaccacactccagcctgggtgacasagcgtaatcctagtgctttgggaggtcaaggcagaaaaattgccaccacacctggacttaaaaaatatttttactgaagtataacattcaaaacagaaaa

SEQ ID NO: 56187 - DNA, 201 bp, Homo sapiens
agatggaggacgtgtaggaggtgaagatggagattgggcagaaaccaaatcataaacatatggctttgtcagccttttcagaaatttggattttattctcwttgcaactattgtaaggagagtgaaaaccagactaagtatttttattctttgagacaaagtctccctcaatcatccaggctggagtgcagtggcacaatc

SEQ ID NO: 56188 - DNA, 201 bp, Homo sapiens
ccccttgcgagttaggaggccggctcccaccccagaaggtggccaggttttcatgccttcctagagaaagctggggctcgtggcctccaccacaggaagaygcagaccctcagaaacaagtctgtgaagtcacaaccagccccagtttacagatgtgaaactgaagctccaaaaagtcaggaggtcactgagtggggaggt

SEQ ID NO: 56189 - DNA, 201 bp, Homo sapiens
attctaggaaccacatttactgatcatcaagctactggctgccgtttattgagctcttatcatatgccaggcacaatactaagtctttgtgtgtatttacycatccccttgagcccattgttgtttttcccattccatggggcctctcctgaagcctcagtagatgagcccgtcttccagtctggtgctgtttttgggaca

SEQ ID NO: 56190 - DNA, 201 bp, Homo sapiens
gtgaaacatgggaagtgctatacaacagtacctggcacgtgataattgttaattatcaacaattgttatttatcactgaaatagatgtactgtagagatckcttgcaagcgttgaaattccatcatcgtcatattactcaccataggctattattaaaccatatcccatgtggtatttttactccctgacatatgtttgaa

SEQ ID NO: 56191 - DNA, 201 bp, Homo sapiens
ctcccaaacccagttttcaatggggttaagcctgtctcatccacttcaacttccattttgtggactgggaaagattatgaatgggaacctgatgcatgtgygaacagttggaggcaagaaaaagattgagaactacagtctaaggttccaacatttctgtggttgtattagtcagtgattccattatcccaaaagcctaag

SEQ ID NO: 56192 - DNA, 201 bp, Homo sapiens
ggtttggggtggaaaaacatctctgacagaagcaacaacgtgagcagaagcatagagatagaaaaacacaggggacacatagatgctataagtaggtcagytggctgcagcagagatgtgggggatgaggctgaaaggtgaggcgggaccaaatggttgaaggacttgcactccaaggagctttgagagccattgattaca

SEQ ID NO: 56193 - DNA, 201 bp, Homo sapiens
ggtttcaccatattggccaggctggtctggaacccctgacctcaggtgatccgcctcggcctcccaaagtgctgggattataggcatgagccactgcgccyggcccctggccctttcttgagctgctgcaaagccagcaaaccccttactaggctcctggaagggggatgagagccccagaccattcagccttagctcagc

SEQ ID NO: 56194 - DNA, 201 bp, Homo sapiens
ttagtttctattactcatctcctaaatatccaagaaatggtattttttgagccagctggtccggggtttcatcaactgctgctccttctcccaggaaagamtatccctgtcacccatcccattgccgctggggacagccaggcctgggccttggtttgggagaagcagtccaagtctgcatatcaaataaatgatggagga

SEQ ID NO: 56195 - DNA, 201 bp, Homo sapiens
gatggaggagatgggtggtaggaccttccagacctcataaaacttaggctttatgatctgggactcacagaaggttgagcaataaaagaccttagggattmtctggtttaattaattctctcattttatagaggaagaaattaagtcaaggtggggcagggtgggaggggagaactttcccgggcctcttcatttactccc

SEQ ID NO: 56196 - DNA, 201 bp, Homo sapiens
aggacagagtcagcgcgaggtctctcagctctgagcacatgttctttccccttccaggtttctagttttatgggtagtagttttatgatgcccatttcacrgttcaggcaggtagaggcagaggggagcattaagctgacttgcccagcgtcactgagttggctacgggcagccttcccaagggtacagatggcaaacact

SEQ ID NO: 56197 - DNA, 201 bp, Homo sapiens
ctgtgccttccctccactagtcagcaccaggaaatgttttcgataacgttgcaacggaggccttgttcatgctgccgccatcggggacaagcgcggggggcggggggtggaggccagaggagactatttcagtcctaaattgtgcttaataaacccatatcaaaaccataaacccttggctgccataaattcctctaccct

SEQ ID NO: 56198 - DNA, 201 bp, Homo sapiens
gtgtttgttccctggtcccttctttttttttttttttagatggaatttcgctcttgttgcccaggctggagtgcaatggcagtatctcggctcactgcaamctccacctcctgggtgtgagtgattctcctgcctcagcctcccaagtagctgggattacaggcatgtgccaccacacctggctaattttgtatttttagt

SEQ ID NO: 56199 - DNA, 201 bp, Homo sapiens
tcctccaccaaggttcaagacagaaccttttgctgggtcacctcaatctgccagcaatggaagatgagtagctgtggggacatttcataaaagcaagtggkttttttgttttgttttgttttgttttttgtttttttttctagaacaaggctgtgcacagtggctcacctctgtaatcccagcactttgggaggctgaggc

SEQ ID NO: 56200 - DNA, 201 bp, Homo sapiens
ttaaattttttaaattttttaaatttggaaacagaccagtcaaactgctgccttttatggttagagaaaatgaggcccagaagaaattgaagcagggaaarcgaagttgcccaagtttacaggcgagttagtggcagcatcagcagtagtgcccaggactcctggcacccagcccaagatcctctttccacctgcctctac

SEQ ID NO: 56201 - DNA, 201 bp, Homo sapiens
agaaaaccagggcaattccagaatccaagagaagagcgtgtttgaaggacagagtgtttaatggtgttaaactctacagagaaacagaaagaagcggggargaaaggagaggtgaagagaggaggggaagagagaggaaagggtccattggattgacagctggaggctcttggcaattgtgttgaaagcagcatcagagag

SEQ ID NO: 56202 - DNA, 201 bp, Homo sapiens
ccttccaggcaatgactacattgtccctcggcactgcccggagctggcggagatgagccgggtgtccatacgcatccttgacgagctggtgctgcccttcyaggagctgcagatcgatgacaatgagtatgcctacctcaaagccatcatcttctttgacccaggtacagtgcacacctcctaagccatccctgactctct

SEQ ID NO: 56203 - DNA, 201 bp, Homo sapiens
gagaaaatgaggcccagaagaaattgaagcagggaaagcgaagttgcccaagtttacaggcgagttagtggcagcatcagcagtagtgcccaggactcctrgcacccagcccaagatcctctttccacctgcctctacggcccccctcacatttgtgtagatgcagtagcttttgcctgtgggatgggagggatgggagat

SEQ ID NO: 56204 - DNA, 201 bp, Homo sapiens
accttccaggctcaagagatcctcctaccccagcctttcaagtagctgggactacaggtgcgtgccaccacacccagctaattcttcattcttattttttrtagagacaaggtctcactatgttgcccaggctggtcttgaactcctagccttaagcaatccttccgacttggcctctcaaagtgctgggattacaggtgt

SEQ ID NO: 56205 - DNA, 201 bp, Homo sapiens
taacattcaaaacagaaaaaggcacaaatcatcaatgtatcgctttatgaaatttcacattttaacaaaagaatgaaataaaataaaatagaaaatatcayagagcatttcatgtagtaagagtaagatatgtatgtttttgaaacttttgttttatttatgtatatttatggatttgtgcttgatgttgtgataatagca

SEQ ID NO: 56206 - DNA, 201 bp, Homo sapiens
gaataaacaacaagacactgggtctgggggtggtagtgaggggtgacctcagagatccattgtggaccctcttttcttttttcctttttttttttttttttgagacgagatctctctctgccacccaggctggagtgcagtggcgcaatcatagttcactgtagcctcaaccttccaggctcaagagatcctcctacccca

SEQ ID NO: 56207 - DNA, 201 bp, Homo sapiens
ggactcctggcacccagcccaagatcctctttccacctgcctctacggcccccctcacatttgtgtagatgcagtagcttttgcctgtgggatgggagggwtgggagatgtgtccagaccctcctaggaggccacatgagtgtgactgttctcggcccaagtctttctcgttcctcagagaatttgcggggcccctgggca

SEQ ID NO: 56208 - DNA, 201 bp, Homo sapiens
agaataaacaacaagacactgggtctgggggtggtagtgaggggtgacctcagagatccattgtggaccctcttttcttttttcctttttttttttttttttgagacgagatctctctctgccacccaggctggagtgcagtggcgcaatcatagttcactgtagcctcaaccttccaggctcaagagatcctcctacccc

SEQ ID NO: 56209 - DNA, 201 bp, Homo sapiens
acttaggaggctggggcaggagaatctcttgaacccaggaggtggagattgccgtgagccaagatcgccactgcactccagcctgggcgacagagcaagaycctgtcaaaaaaataaattaaagaaaatcccaactttcacctcctttaaaaaaagtgaaggtctagcaacactgatacctatgagacaacagtctcctgg

SEQ ID NO: 56210 - DNA, 201 bp, Homo sapiens
aaacttcatctcaaaaaaatacatatatgtgtatatatatataatatatattatatatatataatatatagtgatatatatagtatatagtgatatattaygtataatatatattatatatagtgatatatattttatatatatatagtgatatatattatatatagagagagtgatgaagtggaagatgagccccatgta

SEQ ID NO: 56211 - DNA, 201 bp, Homo sapiens
ttcacctcctttaaaaaaagtgaaggtctagcaacactgatacctatgagacaacagtctcctggagccactttagattctcatgcttcctctaatttgcygtagtccccactattccttagtgtccccatacggaaacttattaatgaacataaatcaccatgtttgctgtattgtttttcttagaggaacgtgtgaact

SEQ ID NO: 56212 - DNA, 201 bp, Homo sapiens
ctgaggcaggagaattgcttgaacccaagaggaggcggttgcagtgagctgagatcatgccactgcactccagactgggcaagacagcgagactctctcamaaaaaataaaaaagtaacgagttcattttcgaatctcttcatttcctgctcctctaaactcaacctttcccagctctgcgactagtcccagaccttccct

SEQ ID NO: 56213 - DNA, 201 bp, Homo sapiens
ctctcttgatgtcaacgtgtacccaatgtttagcttccttttacaagtgagaacatgcagtatttgtttttttgtttctgtgttgattcacttaggatgakgtcctccagctccattcctggtgtggcaaaggacacgactttgttcccttttttatttttttgacactgtccttgaacttggttgaggttttgttccctt

SEQ ID NO: 56214 - DNA, 201 bp, Homo sapiens
gctgaggcaggagaattgcttgaacccaagaggaggcggttgcagtgagctgagatcatgccactgcactccagactgggcaagacagcgagactctctcwaaaaaaataaaaaagtaacgagttcattttcgaatctcttcatttcctgctcctctaaactcaacctttcccagctctgcgactagtcccagaccttccc

SEQ ID NO: 56215 - DNA, 201 bp, Homo sapiens
atcatcaagctactggctgccgtttattgagctcttatcatatgccaggcacaatactaagtctttgtgtgtatttacccatccccttgagcccattgttstttttcccattccatggggcctctcctgaagcctcagtagatgagcccgtcttccagtctggtgctgtttttgggacaaataggagattgaccccaggcc

SEQ ID NO: 56216 - DNA, 201 bp, Homo sapiens
cagagggagcccttctccctcatccctgcctcctccctccctccgtttttaccctgagcttccttcagagctggagggcacccactatccagccccctccscacatctgattccagggagggggctctgtgcaggggacagagagtgcgggagggcccggacatctccagcattttcttccctgtatctctcgaagatcac

SEQ ID NO: 56217 - DNA, 201 bp, Homo sapiens
ctattttacagagggagaaattgaagccctgagaagagacgatgtaaataaagttatcggaatagtgactgagctagttcctaaccccaggtctcctgacrtcaaatctagcctctcttgtcctccacaacagttgctccctctcccctttccctacaggcaatagcactccccagtcatctcagcttcagaggtcagatc

SEQ ID NO: 56218 - DNA, 201 bp, Homo sapiens
cgtgttgatcttgcttatgtatgtaagtgtgtatgtgtgtgtacttgtgtctgtggatgtttgtacatgtgtgctgtgtgtgcgggtcatagagcacatgygtttgtgcatgcggacctgttggagtgccctgttcttcctgcatctttatcctgtatgggcgttttgtcgtgtgcccatatttgtacctgctgtgtatat

SEQ ID NO: 56219 - DNA, 201 bp, Homo sapiens
ggagatgggtggtaggaccttccagacctcataaaacttaggctttatgatctgggactcacagaaggttgagcaataaaagaccttagggattatctggyttaattaattctctcattttatagaggaagaaattaagtcaaggtggggcagggtgggaggggagaactttcccgggcctcttcatttactcccacaaag

SEQ ID NO: 56220 - DNA, 201 bp, Homo sapiens
aaagaccttagggattatctggtttaattaattctctcattttatagaggaagaaattaagtcaaggtggggcagggtgggaggggagaactttcccgggsctcttcatttactcccacaaaggctggaattttgagcagcccctgtctgtctgtttgtccttccagccacccctgagaccccacagccctcaccgccagg

SEQ ID NO: 56221 - DNA, 201 bp, Homo sapiens; identical to SEQ ID NO: 16282

SEQ ID NO: 56222 - DNA, 201 bp, Homo sapiens
gagtatgcagggagctgggcttccagaaaatgaacacagcagttctgcagaggacgggaggctggaagctgggaggtcaggtggggtggatgatataatgygggtgagagtaatgaggcttggggctggagaggacaagatgggtaaaccctcacatcagagtgacatccaggaggaataagctcccagggcctgtctcaa

SEQ ID NO: 56223 - DNA, 201 bp, Homo sapiens
gactatttcagtcctaaattgtgcttaataaacccatatcaaaaccataaacccttggctgccataaattcctctacccttggatcctccacctcatcagscctttgccctggttaatctcaaatctcagcgcaggcagccggagctttaggtttggtttctacttcagttgctaaacagcatcagctcaggtggcagaca

SEQ ID NO: 56224 - DNA, 201 bp, Homo sapiens
ttcttgggtgagaattccattagttgacattgtccattaagtaaaagtggtcattgaagtaaggctgcacagttgggtaaggctatccattagacaattakatgagactacccattgggtcaggatgtctgctgggctagaccatcctctgaaacctccaaagtataaacttgtcattgggcaaagctcttcaaaggataa

SEQ ID NO: 56225 - DNA, 201 bp, Homo sapiens
gtccagaatgagcgggaccggatcagcactcgaaggtcaagctatgaggacagcagcctgccctccatcaatgcgctcctgcaggcggaggtcctgtcccracaggtaccggggtgatcctgccacccacccagggatcccccacactacagaggagctcacctcctccacctccattctccccagccaggccctggagca

SEQ ID NO: 56226 - DNA, 201 bp, Homo sapiens
tgtgatagggactgggcatctgtctttaattttaaaaaatctttttaaaaaatagacatagggtctcactatgttgcccaggctggtctcaaactcctggrttcaagtaaacctcccatctcagcctcccaaagtgctaggattataggtgtaagccaccatgttcggccaacatctgtatattttaaaggtttcagatga

SEQ ID NO: 56227 - DNA, 201 bp, Homo sapiens
cgtccagaatgagcgggaccggatcagcactcgaaggtcaagctatgaggacagcagcctgccctccatcaatgcgctcctgcaggcggaggtcctgtccygacaggtaccggggtgatcctgccacccacccagggatcccccacactacagaggagctcacctcctccacctccattctccccagccaggccctggagc

SEQ ID NO: 56228 - DNA, 201 bp, Homo sapiens
cctcacacagggtttggtgatcaggtgattgagaggcctccttgaggagttttcaaagtgcggtctgagggcacctggtatcagaagtgcccagaagctcrttaaacacttgggccaggtgctccatggctcctgcctttaatcccagcactttgggaggctgatttgcttgaggctggggttcaagacaagcctggacaa

SEQ ID NO: 56229 - DNA, 201 bp, Homo sapiens
tcaactctctcccccaggctggagtgcagtggtacaatctcagctcactgcaacctccgcctcctgggttcaagtgattctcctgcctcagcctcccaagwggctgggatattacaggcacatgccatcatgcccagctaatttttgcattttaagtagagacaggatatcaccatgttggctagggtggtcttgaactcc

SEQ ID NO: 56230 - DNA, 201 bp, Homo sapiens
gagtttatctctccttcacgcagttgtccagggtccccaactccttcctccctagatggaagatgggctttttttttttgagacataaatatatatatatrtgtgtgtgtgtgtgtgtgtgtgtgtatacatatatgtgtgtgtgtgtgtatatacatatatatatatatatatatatttttttttttttttttttttttg

SEQ ID NO: 56231 - DNA, 201 bp, Homo sapiens
cagtgagccaagatcgcaccactgcactccagcctggtaacagagcaacactccgtctcaaaaaaaaaaaaaaaattaactccttggccagacatggtggygcacacttaaatcccagcactttgggaggctgaggcaagaggctcacttaaggttaggagttcaagaccagcctgagctacaaagtgagaaaataaataa

SEQ ID NO: 56232 - DNA, 201 bp, Homo sapiens
cgcttgaacccaggaggcggaggttgcagtgagccaagatcgcaccactgcactccagcctggtaacagagcaacactccgtctcaaaaaaaaaaaaaaaattaactccttggccagacatggtggcgcacacttaaatcccagcactttgggaggctgaggcaagaggctcacttaaggttaggagttcaagaccagcct

SEQ ID NO: 56233 - DNA, 201 bp, Homo sapiens
tcgcttgaacccaggaggcggaggttgcagtgagccaagatcgcaccactgcactccagcctggtaacagagcaacactccgtctcaaaaaaaaaaaaaaaattaactccttggccagacatggtggcgcacacttaaatcccagcactttgggaggctgaggcaagaggctcacttaaggttaggagttcaagaccagcc

SEQ ID NO: 56234 - DNA, 201 bp, Homo sapiens
gaccatcctggccaacatggtgaaatgccgtctttactaaaattacaaaaattagctgggtgtggcacatggctgtagtcccagctactcaggaggctgasacaggagaatcgcttgaacccaggaggcggaggttgcagtgagccaagatcgcaccactgcactccagcctggtaacagagcaacactccgtctcaaaaa

SEQ ID NO: 56235 - DNA, 201 bp, Homo sapiens
cttccaggctcaagagatcctcctaccccagcctttcaagtagctgggactacaggtgcgtgccaccacacccagctaattcttcattcttattttttatrgagacaaggtctcactatgttgcccaggctggtcttgaactcctagccttaagcaatccttccgacttggcctctcaaagtgctgggattacaggtgtga

SEQ ID NO: 56236 - DNA, 201 bp, Homo sapiens; identical to SEQ ID NO: 16269

SEQ ID NO: 56237 - DNA, 201 bp, Homo sapiens
gagggtctccacagttcaaaaatatttggaaaatcagaagaccacaccagtgtgtttcaaactgcaatcttaacccaggaataggtcatgcaatttttttyttattttttttttctagatggagtcttgctctgtcacccaggctggagtgcagcggcacgatcttggctcactgcaacctccgcctcctgggttcaagca

SEQ ID NO: 56238 - DNA, 201 bp, Homo sapiens
ctggagtgcagtggcgcaatcatagttcactgtagcctcaaccttccaggctcaagagatcctcctaccccagcctttcaagtagctgggactacaggtgygtgccaccacacccagctaattcttcattcttattttttatagagacaaggtctcactatgttgcccaggctggtcttgaactcctagccttaagcaatc

SEQ ID NO: 56239 - DNA, 201 bp, Homo sapiens
agtagctgggattacaggcatgtgccaccacacctggctaattttgtatttttagtagagacagggtttcaccatattggccaggctggtctggaaccccygacctcaggtgatccgcctcggcctcccaaagtgctgggattataggcatgagccactgcgcccggcccctggccctttcttgagctgctgcaaagccag

SEQ ID NO: 56240 - DNA, 201 bp, Homo sapiens
tgtgtgttcatttgtctctgtgtgtgagttctgggtctattttcctttgtattcattgagtgggtctgtgtttgtgtcttaggagttgcccgtgttgatcytgcttatgtatgtaagtgtgtatgtgtgtgtacttgtgtctgtggatgtttgtacatgtgtgctgtgtgtgcgggtcatagagcacatgcgtttgtgcat

SEQ ID NO: 56241 - DNA, 201 bp, Homo sapiens
aggcatgtgccaccacacctggctaattttgtatttttagtagagacagggtttcaccatattggccaggctggtctggaacccctgacctcaggtgatcygcctcggcctcccaaagtgctgggattataggcatgagccactgcgcccggcccctggccctttcttgagctgctgcaaagccagcaaaccccttactag

SEQ ID NO: 56242 - DNA, 201 bp, Homo sapiens
ccagaccattcagccttagctcagccttgaaaatagctgcttgcttcctggcccagggaaacggacatgctgcccggaggataggagagttggctgatggmgagtgagcgtgggttagtcgatgctagtgtttgtttacatgcctgggttacctggaagatcatgacacatgcagtcacttggttgttttgagaacgggcc

SEQ ID NO: 56243 - DNA, 201 bp, Homo sapiens
ctatccagccccctccccacatctgattccagggagggggctctgtgcaggggacagagagtgcgggagggcccggacatctccagcattttcttccctgkatctctcgaagatcacctcccccgtctccgggatcaacggcgacattcgggcgaagaagattgccagcatcgcagatgtgtgtgagtccatgaaggagca

SEQ ID NO: 56244 - DNA, 201 bp, Homo sapiens
tggttgttgaggtccctgaatccttgtgcccacactgctgaagactccttgtgtgacacaagtcaggggacatctgggtcttgactccccagatgctccasctggaccctgctgccctcccttgcccaccctcttccattgtagatgccaaggggctgagcgatccagggaagatcaagcggctgcgttcccaggtgcagg

SEQ ID NO: 56245 - DNA, 201 bp, Homo sapiens
gcccacacagagtagtataatagtttgttagggtgggccatgttggtaaggagtgatcttatatttgctagaggatgctgtcttcttccacaggtatggcracaatttctttcacaagctactcaattaaaaactggaataacctagcactacacttctatttatttccattatttttcagctcaccttctagattagtat

SEQ ID NO: 56246 - DNA, 201 bp, Homo sapiens
gactttgggcaaacaacttcatctctttgtgcctcagtctcttcattcatggaaatgggattataaaatcagtagctacctcagagatttgttgtaagaaktaagtgaagaaaagagccatgtttggtacattaaagcaatcaatcaatcgtagataatatgaaagtactggactaactatatgtccctattgaaactccg

SEQ ID NO: 56247 - DNA, 201 bp, Homo sapiens
agcaacagaaagaagacaaaggctatgggtgcaaatataagtaaacgtataactaatgaagctattatctccattttacatatgaagccagtactcaaaawaaaaaaatcaaagtccataatctttcccattctctgggctagataaagattattagcaggaaaattacctagtgcccacacagagtagtataatagtttg

SEQ ID NO: 56248 - DNA, 201 bp, Homo sapiens
aatataaattaagtaatggctctcctcttagtagattttaacttttgctcttgttattctaaaggccaagaaagcagagaactcatcaaatgaggaggaarcgtcaagtgaaggcaacatgagggtgcatgctgtgggtgagtatgcatgaagcaagctgtttgtgactatatcaaggaagaaatggaatctgccactttg

SEQ ID NO: 56249 - DNA, 201 bp, Homo sapiens
gcttgaacccgggaggcagagtttgcagtaagccaagatcccaacactgcactccagcctgggtgatagagtgagactcggtctcaaaaaaaaaaaaaaaatgaaagatgttcaaacaatgagcattcaaatctactcgcaattctcaccacacacacacacacaaaaatgatagtatgtgaggtaatgcattcgttaatc

SEQ ID NO: 56250 - DNA, 201 bp, Homo sapiens
tgcttgaacccgggaggcagagtttgcagtaagccaagatcccaacactgcactccagcctgggtgatagagtgagactcggtctcaaaaaaaaaaaaaaaatgaaagatgttcaaacaatgagcattcaaatctactcgcaattctcaccacacacacacacacaaaaatgatagtatgtgaggtaatgcattcgttaat

SEQ ID NO: 56251 - DNA, 201 bp, Homo sapiens
aatactggagatacagcaacgaaaagaaaatctctgccttcatgagtttacattctgggtgaagagacagactctaaacaaataagtatatatgtgtgtgygtatgtaatgtttgtatatgcatatatttgtacatacatatatatgcatatatgcaattatatatagtaaaatgagcatttatgtaaatataaccaaatc

SEQ ID NO: 56252 - DNA, 201 bp, Homo sapiens
ctctgggaaaggcatctctgaaagtaaggcagcagccccagtcaggggtttatagataaagctcccatctccttgggacagagcacctgggggaaggggcrgctgtgggcagagcagacttaaatgttcctgcctgccagctctgaagagagcagcagatctcccagcacagcactcaagctctgctaaggaacagactgc

SEQ ID NO: 56253 - DNA, 201 bp, Homo sapiens
gcactttagggggctgaggcaggcagatcactttgagctcaggagtttgataccagcctgggtatcatggcgaaaccctatctccaggaaaaaaaaaaaaatcaataggagagatgtaaggtaaaagtgagaaagtttcccagaatgatagacacactgttgaagagaagagcaaaaatgattagcaaatcggagaatcaa

SEQ ID NO: 56254 - DNA, 201 bp, Homo sapiens
ttttttcagacaaatgcaagattattatctgatcattccaaaccaactgctgaaacggtagcacctgacaacactgcaatccccagtttaagggctgaagmtgaagaaaatgaaaaagaaacagcagtatccacagaagacgattcccaccataaggtaaaagtaacatcatttatattaatacaattttttaattctcca

SEQ ID NO: 56255 - DNA, 201 bp, Homo sapiens
agcactttagggggctgaggcaggcagatcactttgagctcaggagtttgataccagcctgggtatcatggcgaaaccctatctccaggaaaaaaaaaaaaatcaataggagagatgtaaggtaaaagtgagaaagtttcccagaatgatagacacactgttgaagagaagagcaaaaatgattagcaaatcggagaatca

SEQ ID NO: 56256 - DNA, 201 bp, Homo sapiens; identical to SEQ ID NO: 16333

SEQ ID NO: 56257 - DNA, 201 bp, Homo sapiens
atacattatatgtagtgaagcatcactatgtaccccatgaatatgtataattgttatttgtcaatttaaaaataaaattaaaaaagaaaatgaagtataarggtataattttttttaatcaataaaacaggccaggcacagtggctcatccctgtaatcctagcactttagggggctgaggcaggcagatcactttgagct

SEQ ID NO: 56258 - DNA, 201 bp, Homo sapiens
ctccagagaaacagaacaaataggagataggtaggtaggtaggtaggtagatagatagatagatagatagatagatagatagatagatgatagatagatagagatatagataatgaggacttagtttacattaatggagccagtcccaagatctgcagtcagcaaattggaaagccaagagagccaattgtatagttcccg

SEQ ID NO: 56259 - DNA, 201 bp, Homo sapiens
gtccaaacatcttatttaaatctaagcatttgttttgttctcataggccagacatagatgtatgatataaagtaaatccattactcaaaatatcagtaatmtattaagattaaaaagcacagaacattgattccaaaagcttccagagaaaattcattcaccagatagttattgagtgtatcctgggtgccagaaattgac

SEQ ID NO: 56260 - DNA, 201 bp, Homo sapiens
gtttactgtggcatacaggggaaaaacaactgggaaggcaaagaaagagaaatagaaatggcctcacatgatacacatactgcagcaaaccctgcaataawtccatttttcaagttcccactgcttcctcccatcttcacgatgtgctatggtgtagtggttatagaggggaattctggggcagactgcctggacttgaat

SEQ ID NO: 56261 - DNA, 201 bp, Homo sapiens
gagattctgcttccacttaacattctgttctaggcatctgcttatatcctcaaaaactctagagaatatttttaaattgttggtataaatgaagtatattsctactaataatgatgacaacaagagtaactagcaaatttgtaaattagcatccagacatgaataacaaaaaccagtttttaattttttcagacaaatgca

SEQ ID NO: 56262 - DNA, 201 bp, Homo sapiens
ttttttgcctcctactatcatttgttaagatgctcacacatagacctaaaatttctctaattcttgataatgtcttatttacaaaagcaaaaatgggagargagaattaaagagctaaagagattatggtaactcatattataatgtactaccatttctggctctcttttctaaaataaagcaataatgtaggttgtgctt

SEQ ID NO: 56263 - DNA, 201 bp, Homo sapiens
ttggttcccttttacagctttataactaattattttttgcctcctactatcatttgttaagatgctcacacatagacctaaaatttctctaattcttgatratgtcttatttacaaaagcaaaaatgggagaagagaattaaagagctaaagagattatggtaactcatattataatgtactaccatttctggctctcttt

SEQ ID NO: 56264 - DNA, 201 bp, Homo sapiens
gctcatctattatagaggcacgttaatattcttggtggtcacaatttttaattgtgggttgtttgtgataaagacatactctaatcccaacctaagagatkaagttattttctcagtaatcagtctgtaagtctacctctgtgtaattgagatattttggaagttggagctcctggtgtgaaagcaattattcagtttagc

SEQ ID NO: 56265 - DNA, 201 bp, Homo sapiens
atgttgtttttagactttttaattacagccattctgactggtgtgaaatggcatcttattgtgagatggttttgatttaaattttcctgatgattagtaaygtggaactttatatatatttgttggccgcttatatatcaagacagggttttggaactgaaatgcatatttgaggattataagcatacagagaataattga

SEQ ID NO: 56266 - DNA, 201 bp, Homo sapiens
gagagaagtaaacatattcaagatatattttaagatataagcatactcaaatatatagcatgtggaaataagacaatatttgataggaaatatgtgggagycgagagcagacaggtgagagactgaaaagagaagtgcaatgcctaggtccctggctcagagcaggcagggtaaatagaggtaaatagaggcatcttccac

SEQ ID NO: 56267 - DNA, 201 bp, Homo sapiens
cttatctgtaaaaatggggttcaggtaacaggtgcaggaatcctcatttattttgtgcccatgcataccatgcattgacacatacccatgctaatcgtcagaaaaccctccaagtgagactaacagggtaaacaactcagatgacgcaagttcccctaagccatttaaagacattatcctaagagtactggggggccacca

SEQ ID NO: 56268 - DNA, 201 bp, Homo sapiens
aggcagaacaatgaaaataataatcatttgcatgtgtaaggtacttcagagtttgcaaagagcttcctcacctcaccttgcaaggagctacctttgacatyggaaggaactggtattcccatcctatatatgaagtttggagagagaaagtaatttgttcaaggtagtatttagtacttggcaaagccagggcccaaagcc

SEQ ID NO: 56269 - DNA, 201 bp, Homo sapiens
atgaatgtacatgctcaataagtagtagttattacaattctttttcatggttttgttattgaaacagcaaggttccagtctaggtcctgctgctcacttcrtagaaagccaatcactgagacaacaagtattgccaatgaagaaggctttaatcaggtgctgcagctgaggagatgggagcacagtctcaaatccatctca

SEQ ID NO: 56270 - DNA, 201 bp, Homo sapiens
tacaggggtagtagagaaacaaataaattaaggggtagggagaagagttaaaggcagaaaaagcagaggattaatctatctgataattacaggggctaggytttaaaaggtgtattgtcttactattaacaacatgaagccaatcattcagatattattaagttactgcaacgtcacaaacgccaggactttaggtgagcc

SEQ ID NO: 56271 - DNA, 201 bp, Homo sapiens
caaggttctccagagaaacagaacaaataggagataggtaggtaggtaggtaggtagatagatagatagatagatagatagatagatagatagatgatagatagatagagatatagataatgaggacttagtttacattaatggagccagtcccaagatctgcagtcagcaaattggaaagccaagagagccaattgtata

SEQ ID NO: 56272 - DNA, 201 bp, Homo sapiens
cttgctaatggttttggcaactggtctgttttgccttattttggttttcggttgctgtaaaacagtatgctctcacattaaatggcttaaaatcacatccytgtatttgctcataattctccaatctggattgggctccactgcatgattcttctgctgattttgtctggagttaattcatctggcttcagtgagctagga

SEQ ID NO: 56273 - DNA, 201 bp, Homo sapiens
tcaaggttctccagagaaacagaacaaataggagataggtaggtaggtaggtaggtagatagatagatagatagatagatagatagatagatagatgatagatagatagagatatagataatgaggacttagtttacattaatggagccagtcccaagatctgcagtcagcaaattggaaagccaagagagccaattgtat

SEQ ID NO: 56274 - DNA, 201 bp, Homo sapiens
attagtcaaggttctccagagaaacagaacaaataggagataggtaggtaggtaggtaggtagatagatagatagatagatagatagatagatagatagatgatagatagatagagatatagataatgaggacttagtttacattaatggagccagtcccaagatctgcagtcagcaaattggaaagccaagagagccaat

SEQ ID NO: 56275 - DNA, 201 bp, Homo sapiens
gcctcataagcggacctcagaataacaggatttctctctctctaatcttctatttttttacctgctactttttctccccaaggcaggactctaatcttccyctgcctttacctaccttgtgtgattgtaggtcataagacccccatttcagaaggggttctgccccatattctggaggaaggaatgttgcatggagaggcc

SEQ ID NO: 56276 - DNA, 201 bp, Homo sapiens
catgtatctatatatgtatatatttatctatatacgtatctacattacatacatatatgtatctatacacacacacacacacacacacacacacacacacatatgtttcatccacggttcctgtctcataattcccatagacctttttataatgttataatgttggtgcattttaggcctcataagcggacctcagaataa

SEQ ID NO: 56277 - DNA, 201 bp, Homo sapiens
acatgtatctatatatgtatatatttatctatatacgtatctacattacatacatatatgtatctatacacacacacacacacacacacacacacacacacatatgtttcatccacggttcctgtctcataattcccatagacctttttataatgttataatgttggtgcattttaggcctcataagcggacctcagaata

SEQ ID NO: 56278 - DNA, 201 bp, Homo sapiens
tacatgtatctatatatgtatatatttatctatatacgtatctacattacatacatatatgtatctatacacacacacacacacacacacacacacacacmcatatgtttcatccacggttcctgtctcataattcccatagacctttttataatgttataatgttggtgcattttaggcctcataagcggacctcagaat

SEQ ID NO: 56279 - DNA, 201 bp, Homo sapiens
taaatatattatatatttatagatacattattagtatatacatatatagatacgtgtatataatacatatatagatacatgtatataagtatatagattayatatgtacacatatagtatacatttagccctcaacctgtgggatctgacactatctccaggtgcacatacatagtatatacacatatgtatactatatat

SEQ ID NO: 56280 - DNA, 201 bp, Homo sapiens
taaacctgctttaaatatctttatctattttttcatccattttgtcaaggtgaccttcctaagaataaaaataagcattgcttgagattttttttttttttgagacagagtctcattctgtcacccaggctggagtgcagtggtgtgaccttgggtccctgcaacctctacctcctgggctggagcaattcttctgcctca

SEQ ID NO: 56281 - DNA, 201 bp, Homo sapiens
gctagtttactgtggcatacaggggaaaaacaactgggaaggcaaagaaagagaaatagaaatggcctcacatgatacacatactgcagcaaaccctgcaataaatccatttttcaagttcccactgcttcctcccatcttcacgatgtgctatggtgtagtggttatagaggggaattctggggcagactgcctggactt

SEQ ID NO: 56282 - DNA, 201 bp, Homo sapiens
gaaaaagttgatctcatagaagtaagaagtagaacagaggatacttgaggctgggaagggtgaggagaagaaaggaatagggagctatttgttaaaggacrtaaaactatagctaataggaagaataagttctagtgctctataccactgtaggatattatatatttcaaatagctagaaagaagacactgttcccaatac

SEQ ID NO: 56283 - DNA, 201 bp, Homo sapiens
ctgctccttggaagccctccaatgctccatggaactattctttggaagccctccaagccctgtccataaagttctaattggctttctagtgactcactgcraagtattaatggacagccaaatacatcagacattagagaaaagctttcaacaggaaaaacaaagatcaaaacaaactaactggggaaaaaaggaacaaga

SEQ ID NO: 56284 - DNA, 201 bp, Homo sapiens
acttcaagaaaatacatttctgttgttttaagccacccagcttgtggtaatttgttatgacagcccaggaaactaatgcaaacctcttatggctctatagraccacgtgattgtacggcactaagataatctaaccctttatatttctgttatcccagttgtctcaattatttgtgtctttatagggctgcctcttatttt

SEQ ID NO: 56285 - DNA, 201 bp, Homo sapiens
ctgagggccaaagagcagcgcactgaaccacagaggattattctcaggcctgaaacatgatggaatttggcctgctctgttttgaacttgcttggaacaartgacccttgtccacttatgtattccttccattttctccatttcagaatgaaactgtttatactatgccattgtatttggggagaggtaactggttttcta

SEQ ID NO: 56286 - DNA, 201 bp, Homo sapiens
acagaagaaaaaagacaaaggggattaccagggcgtggtgaccccaggtatggaccccaggagaaaagctgcccagcagccggagatacaccagtccaaargaagcaagaactccgaggctctgggagtgccacttccaaggggcgaaatggacacgagggatttccttacggggttgttgatgtagctctgttgttgtta

SEQ ID NO: 56287 - DNA, 201 bp, Homo sapiens
aatcccagcactttgggaggccgaggcagatcacctgaggtcaggagttcaagaccagcctggccaacatggtgaaaaaatacaaaaattagccaggcgtrgtggcacacgcctgtaatcccagctacttgggaggttaaggcaggagaatcgctggaacccaggaggcagaggttacagtgagctgagattgggccactg

SEQ ID NO: 56288 - DNA, 201 bp, Homo sapiens
tgtttgtgctactactctggctactttctaaaagtgtcattttgcttcttgtttttttatagaggacatagatgaaaatctcttgttttgaacgaagattwtaaagaactcaactttccagcatcctcctctgttctaaccacttcagaaatatatgcagctgtgatacttgtagatttatatttagcaaaatgttagcat

SEQ ID NO: 56289 - DNA, 201 bp, Homo sapiens
caattagtgccgggataatcctttaacccaaaactcacccatggcttcaccctcaatgaatgggagctgtgggagggtagatcagagtattctttctttaytcctgcagtggaggaaattaaatttagatgcttgttttgctgggttatgtcttaatatgtttccttttctttccttaagttaggcttgaattttatgagc

SEQ ID NO: 56290 - DNA, 201 bp, Homo sapiens
gtatggccagtagatgagaaccaggttgtaccaacatgactgctgggtacacccctatagatttagggtgggggaaggacagttcctgtgaagacagaaamcttgtgaatcaacatcccaaaagctgtcaaccttacccacaaatactttatttcgttggcagtttttatctgtattctatttatatcacatatacagcaa

SEQ ID NO: 56291 - DNA, 201 bp, Homo sapiens
ggtcagatgcccagaaaagtcttaagtcattgactctgagtatatcatatacactcacagggctgggacaccttgatgtcagatggtgactcagcagagarctcaaaatagaagaacgtctttttcacccttcagatgactttagggccaaaccatagagctctccccagagactcattaatactttaaaagctctaaagc

SEQ ID NO: 56292 - DNA, 201 bp, Homo sapiens
ggatcaataatggctttccttgatctgaagtctgaatagaggttaactctgtgtgtgtgcgtgtgtgtgtgtgtgtgtgtgtgtgtgtgtgtgtgtgtgtktttggtggtggtggctgggaggagcgggtgctggagagagaattctgacagcgtgaacacttgtgcaaagaccctggagcaagagggatcgtggcctatt

SEQ ID NO: 56293 - DNA, 201 bp, Homo sapiens
aactgtaaactattttagaaaaaacagcttcagaaacaatgagagtttgaatatctgccaacaaacatttccaaataaagctatactgaaaagacaccgcraattcaaaggcctttttttattcatttttctctcttgttttgttgtaagaaatacagtgggtctttattaatcatgttataaattaataagacctccaat

SEQ ID NO: 56294 - DNA, 201 bp, Homo sapiens
ggctagtttactgtggcatacaggggaaaaacaactgggaaggcaaagaaagagaaatagaaatggcctcacatgatacacatactgcagcaaaccctgcaataaatccatttttcaagttcccactgcttcctcccatcttcacgatgtgctatggtgtagtggttatagaggggaattctggggcagactgcctggact

SEQ ID NO: 56295 - DNA, 201 bp, Homo sapiens
ttatgaagagaatacttctttctataatatccattcttttgctttttcaaattcaccttgttgctttctttctctaagaagattttttttccccagctttmtataactttttcccaagttcaagcaaaatagttattttgcttttctgtttggactctctccaggctctcctaatatctggattcttaaaacattttttca

SEQ ID NO: 56296 - DNA, 201 bp, Homo sapiens
agctaagggtctacttctaagcccactcccatggctctttgcaggagccttcagtatcccatcgtgtaggcctctggtctacagggctgcccacagcatgrtatctggattcctccagagcgagtgaccaggcagaaagagagaaaaagccaagactgaggccccaatgtcttttataacctaacctcagaagttatatat

SEQ ID NO: 56297 - DNA, 201 bp, Homo sapiens
aggaagcaagaaatcaaacagaagaaaaaagacaaaggggattaccagggcgtggtgaccccaggtatggaccccaggagaaaagctgcccagcagccggrgatacaccagtccaaaggaagcaagaactccgaggctctgggagtgccacttccaaggggcgaaatggacacgagggatttccttacggggttgttgatg

SEQ ID NO: 56298 - DNA, 201 bp, Homo sapiens
gaattctcccttcccctgcctttttgttctattcaggtccccagtggattgaattatgcccactcacattgggtagagcaatctgctttattctgtctacsaattcaaatgttaatttcttcagaacacaccctcagagacacacccaggaataatgtctaagtagatatctgggcatcccatggtctagtcaagttgaca

SEQ ID NO: 56299 - DNA, 201 bp, Homo sapiens
tcagaataaacacaatgtcaggtgggaggtggagccatacagaaacctagggactaagtgaaaaatcagtgtgtgcactgagagaactccagtctcttcaytgatttcacagaatgctagcaaccaggtttatatttgcttctcaaggtaagaggtatgaatttctcctctagagaaaagaaaatctccctgtaatatctg

SEQ ID NO: 56300 - DNA, 201 bp, Homo sapiens
tccctggatggatccatcccatctggagctctggaatgagacacagtgagattagtgagtggtatgataagacgagaaactctgaaaggcatgattaagakatggtgaaaggtggctattgcacaagcttgggtaagataagcctgggggatcctctaaatataattaaagtaatccctcaattacacattatagaaaagg

SEQ ID NO: 56301 - DNA, 201 bp, Homo sapiens
tatacttgtttcattttataaaatccaaattcagtttaaacctgtggctacagagtgtgaggaatattataaacatgtttacatgatagtgtgtgaagaaraagaataatgaatattaaatgttaccttaggcataaatatggttacattatcatttgtttgaagaatgaacttttttttcttttaaggctgaaaaatcat

SEQ ID NO: 56302 - DNA, 201 bp, Homo sapiens
aggctgaggcgggcggatcacgagttcaagagatcgagaccatcttggctaacacggtgaaaccccgtctctactaaaaatacaaaaaattagccgggcgyggtggcgggcgcctgtagtcccagccactcgggaggctgaggcaggagaatggcgtgaacccgggaggcggagcttgcagtgagccgagactgcgccact

SEQ ID NO: 56303 - DNA, 201 bp, Homo sapiens; identical to SEQ ID NO: 16342

SEQ ID NO: 56304 - DNA, 201 bp, Homo sapiens
tgggctggtcttgaacttctggcctcaagtgatccacccacctcggcctcccaaagtgctgggattacaggtgtgagccaccgtgcctggcctgtttctgmtacctttgtgatatccaatgctgtgtgtcaccctttcagccaacctgtttgcttgaggttagtgagactgtagtactgcttggagaggggtcatcctaaa

SEQ ID NO: 56305 - DNA, 201 bp, Homo sapiens
gagcactcctttcatttactcattcatttgctcaagaaatctttacaggccaggcgcggtggctcacgcctgtaatcccagcactttgggaggctgaggcrggcggatcacgagttcaagagatcgagaccatcttggctaacacggtgaaaccccgtctctactaaaaatacaaaaaattagccgggcgcggtggcgggc

SEQ ID NO: 56306 - DNA, 201 bp, Homo sapiens
atgtgtaagaaaataagaactaggtaggggtaaggaaacaatcatggtgaataagcggtcaggcatctgctgcagtgatctggtgagtttccattcttttmtacttttttagaagcctgaaggtcctgtcctgaggaaggaacttagataaaacaaatataagtttcacactttaagaccaggagggtcaacttctatgtt

SEQ ID NO: 56307 - DNA, 201 bp, Homo sapiens
tatgaaccttgcctttttctttcagagaatttttcacacagccattgagcaattagagtgctggcatttccttcctaggtcttttgagatttaatccccartagctcctcatggcacagattcacatatcaactaagtaaaaataatagtgatgacagaaataaaatgaatagtgatgcatctggacaacttgaaaacatt

SEQ ID NO: 56308 - DNA, 201 bp, Homo sapiens
gagttctggggtctttatgggcacaggatggggacggggcaggccgtaggtagttttggaaaaggcaatattcaattggtaaaaagacagtattcagaaakaaccaatcgggagagaatggaagttctcactttgggctgtgggtttcaggcttttcggcttgaaggtgggattttgccagcgacccgcccctgtatgcct

SEQ ID NO: 56309 - DNA, 201 bp, Homo sapiens
agaatgatgaggattaatgagttttactacttgggctgagctgctgtatacttgtttcattttataaaatccaaattcagtttaaacctgtggctacagaktgtgaggaatattataaacatgtttacatgatagtgtgtgaagaaaaagaataatgaatattaaatgttaccttaggcataaatatggttacattatcat

SEQ ID NO: 56310 - DNA, 201 bp, Homo sapiens
catttgtctgattctctgacagtcttctgccttcctaatcccaggtcaagaaaatttacctggatgaaaagaggcttttggctggggaccatcccattgaycttctcttaagggactttaagaaaaactaccacatgtatgtgtatcctgtgcactggcagtttagtgaacttgaccaacaccctatggataggtaagaac

SEQ ID NO: 56311 - DNA, 201 bp, Homo sapiens
ctaaaggccatgaaattatttttgatcaatatgtggcaaatacaattagctcagtgagacaaaaatgcccagtgactagtctaaaggacaacgtggaacayaatggaagaacacaaggcgttttaaagtctagatactggattgtcccacaaggtccttcaaaaataaaacacaggcatcttctttataattgaaacttga

SEQ ID NO: 56312 - DNA, 201 bp, Homo sapiens
gcatccagacatgaataacaaaaaccagtttttaattttttcagacaaatgcaagattattatctgatcattccaaaccaactgctgaaacggtagcaccygacaacactgcaatccccagtttaagggctgaagctgaagaaaatgaaaaagaaacagcagtatccacagaagacgattcccaccataaggtaaaagtaa

SEQ ID NO: 56313 - DNA, 201 bp, Homo sapiens
atcactgagacaacaagtattgccaatgaagaaggctttaatcaggtgctgcagctgaggagatgggagcacagtctcaaatccatctcactaactgactwaaactaggggtttacatagcaagggaaaaatgtaacaatgtgtaagaaaataagaactaggtaggggtaaggaaacaatcatggtgaataagcggtcagg

SEQ ID NO: 56314 - DNA, 201 bp, Homo sapiens
tcagcacatttgctcagttcttaaaataagaagctaaaggccatgaaattatttttgatcaatatgtggcaaatacaattagctcagtgagacaaaaatgyccagtgactagtctaaaggacaacgtggaacacaatggaagaacacaaggcgttttaaagtctagatactggattgtcccacaaggtccttcaaaaataa

SEQ ID NO: 56315 - DNA, 201 bp, Homo sapiens
aaagaaaatgaagtataaaggtataattttttttaatcaataaaacaggccaggcacagtggctcatccctgtaatcctagcactttagggggctgaggcrggcagatcactttgagctcaggagtttgataccagcctgggtatcatggcgaaaccctatctccaggaaaaaaaaaaaaatcaataggagagatgtaagg

SEQ ID NO: 56316 - DNA, 201 bp, Homo sapiens
ctatgtaccccatgaatatgtataattgttatttgtcaatttaaaaataaaattaaaaaagaaaatgaagtataaaggtataattttttttaatcaataaracaggccaggcacagtggctcatccctgtaatcctagcactttagggggctgaggcaggcagatcactttgagctcaggagtttgataccagcctgggta

SEQ ID NO: 56317 - DNA, 201 bp, Homo sapiens
atgttttataattttatcttttaattccatttctcaatgaactttttgaagtccccttatcacaattatcaaagctatgtaatattcattaaaaaaaaaaagctgctgtgaagatagcagaatatggctacaccacagctcccaagtttacatgttaaggtccagcttcccacagatactcctccaactttctcattcttg

SEQ ID NO: 56318 - DNA, 201 bp, Homo sapiens
gggtgcagcaaaccactatggcatgtgtatacctatgtaacaaacctgcacattctgcacatgtatctcagaacttaaagtataattaaaaaaaaaaaaaacggcagtgatcctgagctctggggagactgcaatgagcagagccctcctgccaacttgtattggacttgtagcaggattgcaaaattgacttctgtttct

SEQ ID NO: 56319 - DNA, 201 bp, Homo sapiens
ggatgtgaagaaataggaacgctttcatattgttggtgggagtaaattagttcaatcattgtggaagacagtgtggcaattcctcaaggatctagaactayaaataccatttgatacagcaatcccattactgggtatatacccaaagggttacaaatcattctactataaagatgcattcacacatatgtttattacagc

SEQ ID NO: 56320 - DNA, 201 bp, Homo sapiens
ttccaaacaatagaaaaagagggactcctccctagctcattttatgaggccagcatcatcctgataccaaaacctgaaggatatacaaaaaaaaaaaaaaattcaggccaatatcactgatgaacatggatgcgaaaatcctcaataaaatactggcaaaccaaatccaggagcacatcaaaaagcttatctaccacaatc

SEQ ID NO: 56321 - DNA, 201 bp, Homo sapiens
aatcaattgaacccaggaggcagagattgcagtgagctgagatcactccactgcactccagcctgggcaacagagtgagactccgtctgaaaaaaaaaaaatacttagggtgcatatccacggtctccagcagcattttcttcaagatcaaatagatgctggctgagaaattttgagagtctataatgaaaacagaaacca

SEQ ID NO: 56322 - DNA, 201 bp, Homo sapiens
ataaaaacattggggaaaaactcacatcagagttcttactagcaacactggaaattataagaaaatagaccaatgttttaaaaaaaattctgagaaaaaaatactccaatctagaattctatatctattcaaactatgtatcaagtaaagggtaaaatacagatatttttctaatatgcaataccttaaaaattctgtctc

SEQ ID NO: 56323 - DNA, 201 bp, Homo sapiens
agaaagaaaagacaaaaaatagaagggcaaaaatcattaaggaactaacacataaaatgctccccagaactgaaatatataaatttccaaattcaaagggmctaatgagttcctaaactaaatgtaaaagtatccaaactaaggcagagatggtaatatttcagaagactagggccaaatgtaaaaacataaaagcatcca

SEQ ID NO: 56324 - DNA, 201 bp, Homo sapiens
aaaaggtaggaaaatttctccttttatactatattcttgtttgattatttttaagttattgcgattattttccctttcttggttcccttttacagctttayaactaattattttttgcctcctactatcatttgttaagatgctcacacatagacctaaaatttctctaattcttgataatgtcttatttacaaaagcaaa

SEQ ID NO: 56325 - DNA, 201 bp, Homo sapiens
ggtcaagtgactacatctaaaacaatcaggtatggccagtagatgagaaccaggttgtaccaacatgactgctgggtacacccctatagatttagggtggsggaaggacagttcctgtgaagacagaaaacttgtgaatcaacatcccaaaagctgtcaaccttacccacaaatactttatttcgttggcagtttttatct

SEQ ID NO: 56326 - DNA, 201 bp, Homo sapiens
tttcagacaaatgcaagattattatctgatcattccaaaccaactgctgaaacggtagcacctgacaacactgcaatccccagtttaagggctgaagctgragaaaatgaaaaagaaacagcagtatccacagaagacgattcccaccataaggtaaaagtaacatcatttatattaatacaattttttaattctccaaag

SEQ ID NO: 56327 - DNA, 201 bp, Homo sapiens
ggaagaaataaattctcccagggaagctcatcacattgttattataaacccaagattttaggccaggtgcggtggctcacgcctgtaatcccagcacttcrggaggctgagatgggcggatcacctgaggtcaggagctcaagaccagcctggccaacatggcaaaaccccgtctctactaaaaaatacaaaaattagccg

SEQ ID NO: 56328 - DNA, 201 bp, Homo sapiens
aatatggccaaaataatgtctcccactataacacaggacagggtgtggtggaccctttctgaaggattggcaaatgtctgagaaaaagaacaggcaactgyctccctggatggatccatcccatctggagctctggaatgagacacagtgagattagtgagtggtatgataagacgagaaactctgaaaggcatgattaag

SEQ ID NO: 56329 - DNA, 201 bp, Homo sapiens
ggccacatctgtaaggcagaccaacagggaaaacctcactgtgtctgccaggatccagtgacttgtcctccaacaaaaccccttgatcaagtaagtattcygcaaaatagtctttaagtggctccaaaaggttagtgactgaaataaaaatatttgccattgaaatttttgcttaaaaaaggtagatacctaggttatcat

SEQ ID NO: 56330 - DNA, 201 bp, Homo sapiens; identical to SEQ ID NO: 16330

SEQ ID NO: 56331 - DNA, 201 bp, Homo sapiens
gatggtcaggaagcactcactgaatggtagttctgtgaaatggaggtgagggtcacagatgggagtgcatggatggtacacaggtgaagtgcttagcataraacctggcatatagtaaaatctcaggaatgtatatgccattgaatgagctactattaaatggtctaagacaaaaatgtactttttcaataaaataatact

SEQ ID NO: 56332 - DNA, 201 bp, Homo sapiens
cagagcattttctaaaaaaggggagcattttttagaataaaagagatttgagcactcctttcatttactcattcatttgctcaagaaatctttacaggccrggcgcggtggctcacgcctgtaatcccagcactttgggaggctgaggcgggcggatcacgagttcaagagatcgagaccatcttggctaacacggtgaaa

SEQ ID NO: 56333 - DNA, 201 bp, Homo sapiens
ctgctgaccaggcacagtggcaaagagggatggtcaggaagcactcactgaatggtagttctgtgaaatggaggtgagggtcacagatgggagtgcatggrtggtacacaggtgaagtgcttagcatagaacctggcatatagtaaaatctcaggaatgtatatgccattgaatgagctactattaaatggtctaagacaa

SEQ ID NO: 56334 - DNA, 201 bp, Homo sapiens
tctcctaggtatcaggcatttttaccagtaccatttcttctaactctcacaaaactgaattagatgttttattagtcaaggttctccagagaaacagaacmaataggagataggtaggtaggtaggtaggtagatagatagatagatagatagatagatagatagatagatgatagatagatagagatatagataatgagg

SEQ ID NO: 56335 - DNA, 201 bp, Homo sapiens
gcaattgtttcccatattaaatgtgttggccctcaccaaggtacatgagaagcttggaccacgatctgaatcctaaagggacttctgctgggactgaatgyttgcattagcggttcacacaagaactaaatgctcatcaaagtacaccattattccccagaaggtcccaacaccatgagaatgaggctacttggaactgtt

SEQ ID NO: 56336 - DNA, 201 bp, Homo sapiens
cttgaggggaaaagtcttttcccatggtgggaggagaagaattaacagctgtggaccagctgtgggcaagctgtgtcttttccttgcttgaaggcatcttyttaacattttctctctgaaggcataaataagcttccaggttttcaccctattttcaaagaacttttcaaactctagccttaaaatccattagggtttatt

SEQ ID NO: 56337 - DNA, 201 bp, Homo sapiens
ccttgcctttttctttcagagaatttttcacacagccattgagcaattagagtgctggcatttccttcctaggtcttttgagatttaatccccagtagctyctcatggcacagattcacatatcaactaagtaaaaataatagtgatgacagaaataaaatgaatagtgatgcatctggacaacttgaaaacattatttat

SEQ ID NO: 56338 - DNA, 201 bp, Homo sapiens
ttacaattgtctctcacaggtcatgctactggtctgtcctccacacagctgtcacacatacaaatctggttatatcatcacccctgtccacacatgtgtgyacacacacagacatacacacatgcgtgcacacacagacacttacaataattctttgggtccctatagctctatggctggaatttttaattccttgtttaa

SEQ ID NO: 56339 - DNA, 201 bp, Homo sapiens
tgataattcttactccccttttaagttgtaccatttgtaagaaaatagggtagcattccatgtgcctaattccactgttatgtgtgatgaatgtcggaaayactcctggcattaaaaggagcctaaatgtgtggccagaatggactttaatgttccactggacaatttttctgacctcacagcaaaacttaaattacatta

SEQ ID NO: 56340 - DNA, 201 bp, Homo sapiens
tcagtgttcagacagcttattaatgcttaagagaaaaggaaagagaaggaagatagaaagaagaagtacagcaaggcaagaagtgcccaggggagcaggtrtgctaagttgatttaagtggcatggcaatatacagaacttcaaaaataaaatttatcttttaaaatttaaatgtaaattaatgttctaaaaaactatagg

SEQ ID NO: 56341 - DNA, 201 bp, Homo sapiens
tttctctgagaaagagaaaatagtagcacagataccatagtaggacttgagcaaagaaaaataaatatggccaaaataatgtctcccactataacacaggrcagggtgtggtggaccctttctgaaggattggcaaatgtctgagaaaaagaacaggcaactgtctccctggatggatccatcccatctggagctctggaa

SEQ ID NO: 56342 - DNA, 201 bp, Homo sapiens
aggtatggatgactgcgtttacagtctggttcagtgttcagacagcttattaatgcttaagagaaaaggaaagagaaggaagatagaaagaagaagtacarcaaggcaagaagtgcccaggggagcaggtgtgctaagttgatttaagtggcatggcaatatacagaacttcaaaaataaaatttatcttttaaaatttaa

SEQ ID NO: 56343 - DNA, 201 bp, Homo sapiens; identical to SEQ ID NO: 16343

SEQ ID NO: 56344 - DNA, 201 bp, Homo sapiens
aatgtctataccccaaatacaacaaaaagttcagaaaaataaataaatgtaaatatgagaaaatcctgtgttctctttctctgagaaagagaaaatagtarcacagataccatagtaggacttgagcaaagaaaaataaatatggccaaaataatgtctcccactataacacaggacagggtgtggtggaccctttctgaa

SEQ ID NO: 56345 - DNA, 201 bp, Homo sapiens
ttttgtttactacatttcccagaaaggaaatttttccatagttgtaataattgctaaaaatagcagtctacaggcttcctctgatataaacaaattcaacmgaagatacctggccttatttggatgcatggatgtacatactccaggaaatgataggccaagagtaataagaaaaagaaagtaacaagacaaacctctcct

SEQ ID NO: 56346 - DNA, 201 bp, Homo sapiens
tgtatggaggctgcacaagtgaggggccttgaaactcaagcttcctagttttatggcacgtctatcctggccatattcaaatgtctataccccaaatacarcaaaaagttcagaaaaataaataaatgtaaatatgagaaaatcctgtgttctctttctctgagaaagagaaaatagtagcacagataccatagtaggact

SEQ ID NO: 56347 - DNA, 201 bp, Homo sapiens
aataaaaaagcaagcccatttctgacaatgggagatgtcagaacatctcagaatccattaccaacacactaaagactggattttacatcacaattagtgcygggataatcctttaacccaaaactcacccatggcttcaccctcaatgaatgggagctgtgggagggtagatcagagtattctttctttactcctgcagtg

SEQ ID NO: 56348 - DNA, 201 bp, Homo sapiens
cctggttgagataaacggaaacagttctcaaaacagtaatttatgaaaatagatattttatgagtacttgacacaagtctataattgctgagatatttaawaataaaattactaaccacattctattcaaatctctgtcacttctgtataatcactgtactccactgaatgtgtgtaaaatatgtatttgcagcttatagg

SEQ ID NO: 56349 - DNA, 201 bp, Homo sapiens
acacttgggatatttaatctatggttcacatacatatttaatatgttactttaatttaaatattttatacttattaacatgactttttcctttctcacatwtcatgaaacaattttgttaaaactcttcatacgcatctttaacaccaatgtgtatgttcactggatccacgctgtaattatctaatacagagcacatcat

SEQ ID NO: 56350 - DNA, 201 bp, Homo sapiens
accaaagtgtttggccaaacagcatgtacaaatgggtaatatattgtaatgtacacttgggatatttaatctatggttcacatacatatttaatatgttaytttaatttaaatattttatacttattaacatgactttttcctttctcacatttcatgaaacaattttgttaaaactcttcatacgcatctttaacaccaa

SEQ ID NO: 56351 - DNA, 201 bp, Homo sapiens
catcacaataatgaaaactgcataggaccaaacataaggtgcccccaaatacaatgccatcttcatctttctagtgagaacatcctcaaccaaagtgtttrgccaaacagcatgtacaaatgggtaatatattgtaatgtacacttgggatatttaatctatggttcacatacatatttaatatgttactttaatttaaat

SEQ ID NO: 56352 - DNA, 201 bp, Homo sapiens
aaaacttgtgaatcaacatcccaaaagctgtcaaccttacccacaaatactttatttcgttggcagtttttatctgtattctatttatatcacatatacarcaaccttatgggagaaaaatgtccttggtgagcctgagagttaaatcttcatgcacaagctactcaattaataggatgccatgtatttcattgcagagtc

SEQ ID NO: 56353 - DNA, 201 bp, Homo sapiens
aactgctgtcatgaagacctgttgttgctaagaggtcagatggttcaagagaaactggaaatttggattttgacatgaaacctctggaatttaaaatactrgtttaaaatgcacagtgcctaccaaaccaaacctatctgcaggccacccctaactcacagattgccagtaaagacctctaaatcagatgaacattaatac

SEQ ID NO: 56354 - DNA, 201 bp, Homo sapiens
agtattaaaacatcttatctttcattaactttttattacgtttctgtttcagttcctccagtgttttctaggtcatgcaattatgaaaataagttagcatktttatcttacatctcaaacaactaatgtattcagtgttctatcccatgcaaaattccagaaatgcagcaaggagcaaaactagagaggggctgagctctt

SEQ ID NO: 56355 - DNA, 201 bp, Homo sapiens
cataagatcattgtattttttttttttttgagacagagtcttgctctattgcccaggctagagtgcagtgacatgacctcagctcactgcaacctccaccwcctgagttcaagtgattcttgtgcctcagcctcctgagtagctgggactacaggcatgtactaccatgcctggctgatttttgttgttttagtagagatg

SEQ ID NO: 56356 - DNA, 201 bp, Homo sapiens
caacccatttggacgtctcatacgttttctaaatctgatctgtagctccatctgttaggtgagtattgttgcaggtttattgtcctcagctttctgaactrtaaactattttagaaaaaacagcttcagaaacaatgagagtttgaatatctgccaacaaacatttccaaataaagctatactgaaaagacaccgcgaatt

SEQ ID NO: 56357 - DNA, 201 bp, Homo sapiens
catccctgtaatcctagcactttagggggctgaggcaggcagatcactttgagctcaggagtttgataccagcctgggtatcatggcgaaaccctatctcyaggaaaaaaaaaaaaatcaataggagagatgtaaggtaaaagtgagaaagtttcccagaatgatagacacactgttgaagagaagagcaaaaatgattag

SEQ ID NO: 56358 - DNA, 201 bp, Homo sapiens
ggcagaggttatagtgaaccaagattgcgccattgcactccagcctgggcaacagagcaagactctgtattaaaaaaaaaaaaaggaaaaaaaaaaacttyatttgctgagttagaaccaaagacccacaaagacccacaggaattcctatgtgtcacactaaaaatgatgatgataatgacagaggaaaatatgaagaaa

SEQ ID NO: 56359 - DNA, 201 bp, Homo sapiens
attaccatatataaaatattttattttaatacaataaaaatcatggaatatattttagtgggtttagtagtttaaggggaaaagatagcagcaatttaggrttcatacaattaatggaattattttcaattttagaatcctaaaatattagggttagaggatcatctaggtctcactcttcattgttcatcacttgagaaa

SEQ ID NO: 56360 - DNA, 201 bp, Homo sapiens
ttttcaatgattctttacaattagcattcactaggaggatagaatgttttaaattatcatcgctaatagagtccacatatttactttaagcatgaattacyatatataaaatattttattttaatacaataaaaatcatggaatatattttagtgggtttagtagtttaaggggaaaagatagcagcaatttaggattcat

SEQ ID NO: 56361 - DNA, 201 bp, Homo sapiens
cttaataataacatgataaagttgtttttctttcaaaatccaattccagaatacagtgatttggtttgaaactcacaaggtaagttaatttgaattaagtrcgatttttaaaacataaaaatgtctcctttcagaaccaatggaccaataaaaggccagttgatttcctttattgaatctgaatttactcatattgtgctg

SEQ ID NO: 56362 - DNA, 201 bp, Homo sapiens
atatttgtggaataaatgaataaataagtaaacattgaatttaaaatgtagaggaaagaaactgcgtttttcaatgattctttacaattagcattcactargaggatagaatgttttaaattatcatcgctaatagagtccacatatttactttaagcatgaattaccatatataaaatattttattttaatacaataaaa

SEQ ID NO: 56363 - DNA, 201 bp, Homo sapiens
aatattttagaatagtgaaaagtgattttaacaccaaggtaaggaaaccacctcaatatctactaaaaaattttgtttgaaaataatattcattttgaaaygaaaaatatttaataagagaaaatctcaaaccttaaatttctgtatcatttaaggctcttacatgtacagctagctcatctattatagaggcacgttaat

SEQ ID NO: 56364 - DNA, 201 bp, Homo sapiens
acacccagctaatttttttatttttggtagagacagggttttatcatgctggccatgctggtctcgaactcctgaactcaagcgatccccctgccttggcstcccaaagtgctgggattacaggcatgagccactgtgcctggcttcaatcaatttagaagtttattttgccaaggttaaggacatgctggcgagaaaaaa

SEQ ID NO: 56365 - DNA, 201 bp, Homo sapiens
ttccaacctctcctactgcctctcccacatctgccctccaaggtccatccaccttgtgtgggccactagcttcctgacctctgcccctttttttggtgctrccgtcaccacctagaatgcccagtcttttatagctgaaggtcaaagtcttgctcaagcttccagcccagcaaaagctactttctccaagaagctttcctc

SEQ ID NO: 56366 - DNA, 201 bp, Homo sapiens
atactttcctgtgcatacaagttacctgaggattttgttacaatgcagattcagactcagtcggtctcaggtgcgacctgagattctgtatatccaacacmctcctgggagatgtgagatgccggcactgctggtccagacctacactgagttgggaggacctggagagctcctgatggctctggcagctctgccagcctg

SEQ ID NO: 56367 - DNA, 201 bp, Homo sapiens
ccaatgagggtgacaacgactatatcatccccctgcctgaccccaaacccgaggttgctgacgagggcccactggagggttcccccagcctagccaggtarccaccctggcctggggccaaggaaattgtgcacagtgtgtgtgtgtgtgtgtgtgtgtgtgtgtgtgtgtgcgcgcgcgcgcgcgcgctgccaggtttgc

SEQ ID NO: 56368 - DNA, 201 bp, Homo sapiens
catggaatctttaaggccctccctgatctgattccaacctctcctactgcctctcccacatctgccctccaaggtccatccaccttgtgtgggccactagyttcctgacctctgcccctttttttggtgctaccgtcaccacctagaatgcccagtcttttatagctgaaggtcaaagtcttgctcaagcttccagcccag

SEQ ID NO: 56369 - DNA, 201 bp, Homo sapiens
acaacgttatttaattctagctaagtactctggactggtggaggaagtatggaccctctttggtttattgagaaaagtcataagtgggtgacagagaagarttgaagacagaaatgcgccaagctgaaacattctccttggcataaccagaaacacccagaggacttggcaaggcaggaagcttcccacagtgccattcag

SEQ ID NO: 56370 - DNA, 201 bp, Homo sapiens
gtggaggttgcagtgagctgagatcacgccactgcactccagcctgggtgacagaatgaaactccatctcaaaaaaaaaaagaacaaatgaacaaaagagwaaggattaggcctctaaatgccattttttccaggaggacagagtaccttcctactcacggggctttggcatacagcattcattcattaattcattcactc

SEQ ID NO: 56371 - DNA, 201 bp, Homo sapiens
tggcaggaacagggaggcttccaggaggcagcgagtctgaaggagctataggaattagctggatggatagaaatgacaggacaagcagcatcctttgatcrtggggacagagacaggtcctgccaaggtggcctaggccatccctcaggactactgtagcctccacccctcttgctggttatacccctcctccacctaaac

SEQ ID NO: 56372 - DNA, 201 bp, Homo sapiens
ccagaggctccctacccccagccacaggaggctgtgactctggacagggtttggggctgggcatgagcagagctgaagaggccgtcctctctgcctttctyggggagggtgtgcaggagaggctccagaggcttccagtggaggatgcttcattcagtcaacaagcatttattgagcacccactgtgttccaggcagtgtg

SEQ ID NO: 56373 - DNA, 201 bp, Homo sapiens
tgagttcctcttcacaccagtggtggtcgcctgcatgtccatcatggccttgctgctgctgctgctcctgctgctattgtacaagtataagcaggtgagcyggagcggagtggggctgccaggtgcctgagtgagccagatttggatggtacccccaggctgcatggattcacccttcctcctcctcagtcagtccatcag

SEQ ID NO: 56374 - DNA, 201 bp, Homo sapiens
gccacctgtgtcatgggaagtagccaccacaggttttatggccatctcttgtttctctactccttttccccttcattcaacaaatatttgaacacctaccrtgttctgggagtgtggagggcaaagatgggcagctcataatctggtggagatatgcatcaatgaaatcaccacccagtgtgtgtaaaagatcaaccaaga

SEQ ID NO: 56375 - DNA, 201 bp, Homo sapiens
agagatgggcagatgtggccgggtgcagtggctcatgcctgtaatcccagcactttgggaggctgaggcgggcagatcacctgaggatgggagttcgagamcagccttaccaacaaggtgaaaccccgtctctattaaatatacaaaattagccgggcgtggtggcgcatgcctataatcccagctactcgggaggctgag

SEQ ID NO: 56376 - DNA, 201 bp, Homo sapiens
tcaactttctgcgaaggaaggctgaggccatgctgggacccagcctgagccccggccaggaccccgagggaggcgtcgactataagaacatccacctcgaraagaaatatgtccgcaggtagcccctggcaaaggacaagaaaaaggccaggtctgggaggcaggatccgagtctgtcttcaaagccagctcagggttgga

SEQ ID NO: 56377 - DNA, 201 bp, Homo sapiens
ggagcctggactagaatcctgctctcttgacttccagtccaggagtcacccaagccacactgctgtcctggaggtctctgtctcaggggcttgtggggtcrggacaggatcagaacaagaagggtgtacactgcgccctcatcctagatactgtcagctgccacgcctggggaggcaaaagagaaggaggccatctcttca

SEQ ID NO: 56378 - DNA, 201 bp, Homo sapiens
tctcaggggtagattggcattaggaacagtgaagaactttctcacaggcagagctgcccaaaaccagaatgggttgtaagctccctcaccggggacagccragcagagaccaatgctcactcagatggagtgtggcaggagggtttcttatcagaaagggaggttccagttgaccatggggtggtgggtggtcaaggcctg

SEQ ID NO: 56379 - DNA, 201 bp, Homo sapiens
gatgagtgggagaaagctgtgcccagggctggagctctggggctgggcacctgtgtccccagcgtgaagatgaggaagggtaccaggctttcttcattcgwttttactaaatagtgtatgagagacaacagttgtctctgctcataaagcacgtggtctggtggggatgataacggaagcttcctcagaattttggggata

SEQ ID NO: 56380 - DNA, 201 bp, Homo sapiens
tgtccccagcgtgaagatgaggaagggtaccaggctttcttcattcgtttttactaaatagtgtatgagagacaacagttgtctctgctcataaagcacgyggtctggtggggatgataacggaagcttcctcagaattttggggatattagataacgtataaagtgcgctcggcctaggaagaagtgccagggaatggga

SEQ ID NO: 56381 - DNA, 201 bp, Homo sapiens
ggtcatgtggccaagattggggacttcgggctggctagggacatcatgaatgactccaactacattgtcaagggcaatgtaagtgctgggagggcttgggycaggctggggagggggtgaagagtcggggcccaaaataactggggactgtcatcccaggcccgcctgcctgtgaagtggatggccccagagagcatcttt

SEQ ID NO: 56382 - DNA, 201 bp, Homo sapiens
cacacaggaagcaccgggtaagagtagctgctgttgcagtgttgtcaagtgggaccctttaaacccagtctaagatgtgtgtgggtgtgcgggaatggggagaagacaatgggcatggcctcttacctgatcttggcctttgcagggctgaatccctaccctggcatcctggtgaacagcaagttctataaactggtgaag

SEQ ID NO: 56383 - DNA, 201 bp, Homo sapiens
gggccaggggcaatagggttgctgggggcaggggacagagtgctagggccctcccacctgggcccagagtcctgtacttggctcacttgaggtggaccagrtgtcagcctcagatccatcactgtgtgtccttagcccctcccttgctctctctgagctggggaaacggcatcttcatttgagtgggtgcgggaaggacct

SEQ ID NO: 56384 - DNA, 201 bp, Homo sapiens; identical to SEQ ID NO: 16359

SEQ ID NO: 56385 - DNA, 201 bp, Homo sapiens
tcagccagtgggtcagcgtcagagcccagcctcacagctgccccgcaagtggcactccctctccctgcctggagagaggagagtggctaggaggctggggaagcagaagtgagaacatccctgtagaagggccacaggctgagcggaaaccgggggctgagcctgacgccaacaatgtgtttccgcccacacaggctgggg

SEQ ID NO: 56386 - DNA, 201 bp, Homo sapiens
gtgccctgatgggtggcaggaaggtgatgtccatcagcatccggctgaaagtgcagaaaggtgcgtggggcatggggaccggcagccaggcctgaagagtrgggacagagagccggcggccacatgggtggtgactggggactgggtgtgatggggggcagtgggatgtcctctttctttcacttcttcccctcaatggtt

SEQ ID NO: 56387 - DNA, 201 bp, Homo sapiens
gccggcaactactcctgcgtggccagcaacgtgcagggcaagcactccacctccatgttcttccgggtggtaggtaagcatcagggtggtggtggacagtyggtagggatcctgcaggagtgtgagcagaagggttttgaggaggaagctgatgtcagggaaggagacctgctgaggatatctctgctggagtttgtttat

SEQ ID NO: 56388 - DNA, 201 bp, Homo sapiens
gataaggatgacctccaggtctctggctatggtgattgggtgcaggcagtggcagtcactggactcagaccctgaagcaaggcagcagctcatcggagtgkgagcaggctctgagacatttaggtctggccgtgcctcatgtgttgaatgttatgggagatggaggtggcgaggagcatgagaatcatgagcatcactgcc

SEQ ID NO: 56389 - DNA, 201 bp, Homo sapiens
tgaggccggagaatcgcttgaacctgggaggcggaggttgcagtgagcagagactgtgccactgcactccagcctggatgacagagcaagactctgtttcaaaaaaaaaaaaaaaaaaaactagtcaggactctttcagatacaagtaatagaaaccaactcaaactggcctaattaaaaggatttttttccttatagcta

SEQ ID NO: 56390 - DNA, 201 bp, Homo sapiens
caggactactgtagcctccacccctcttgctggttatacccctcctccacctaaacatgttccaccagagaggggtctctgccagcctgggtcagggactyggtgagaattgcatgaaagctgggcaagatcacacacaaactttgcatccgtgttaggggtgcccaggtttcctcaaggccatccagggactctcaaagg

SEQ ID NO: 56391 - DNA, 201 bp, Homo sapiens
gtggaaggactttgacttcttttctgagagtaatgggaagccccaaatgtttacagaggagagaggcatggtcccatttatatttgtaagaggtcactttrgtgaagaatctaggtgtggggggcttggagggaggcagggaggtctctgaggaggctggtgcagaagtccagagtggagaatggtgacgggactggggag

SEQ ID NO: 56392 - DNA, 201 bp, Homo sapiens
acctccggggaccacaagtgctgtctgcatcactggaggcctgtcgagggacagggaacagagctgcctgagggtccagagcaacaggtgggtgtcacagrgaggcagatctgggccagatagggaagcatgggctaactgcttcccacaacagatggatgcaggtgacctgtcagaaatgcgccaaggggcacagggaat

SEQ ID NO: 56393 - DNA, 201 bp, Homo sapiens
gagaggctgtgattaggagaataagggtttggggggccttccatttatggggacagtgtatctctttatggatgaatatcttacagtgaccactagtattaaaaaaaaaaaaaaaagaaggcaaggaaagcaagcaaggagtgggaggggattgccagcaccgccactctctgcctgggtcccgtgacggctggtggcaga

SEQ ID NO: 56394 - DNA, 201 bp, Homo sapiens
gaggcaggagaatggcgtgaacccgggaggcggaggttgcagtgagccgagattgggccactgtactccaacctgggtgacagagcaagactccgtctcaraaaaaaaaaaaaaaaaaaaaaaaggttagccaatgatcttaggttcacttaaaactgtctttccctcccccatccccactggttctatcatctgtcaagt

SEQ ID NO: 56395 - DNA, 201 bp, Homo sapiens
ggaggcggaggttgcagtgagccgagattgggccactgtactccaacctgggtgacagagcaagactccgtctcagaaaaaaaaaaaaaaaaaaaaaaagkttagccaatgatcttaggttcacttaaaactgtctttccctcccccatccccactggttctatcatctgtcaagtgtccatatgatccatatctaggaat

SEQ ID NO: 56396 - DNA, 201 bp, Homo sapiens
ttttaagagatgggctctcactatgttgtccaggctggactcgaacttctgggctcaagggatcctcctgcctcagcctcctggataactggcacgggtgygtcccacagtgcccagatactacgatctttattttgtaccaccagtctatttgtctatctgtgagccaacatcaaactgtcttaactatctttataatat

SEQ ID NO: 56397 - DNA, 201 bp, Homo sapiens
ttctcttctagctgtggcaggagttgaatgaggtgatacccggatctgccttgtaaagaaaataactagcccacattccagacagggattatctttgctgrtgcaaaagcctctgtctggaggtcagaagatctcagctccctgtgtctcaggcctgctccttatgggaacttgagtggattacaccacatcaggcctcag

SEQ ID NO: 56398 - DNA, 201 bp, Homo sapiens
gaactgtgagtcaattaaacctcctttcctttagaaatcacccagtctcgggtatgtctttattagcagtatgagaacagactaatacagtaggtataggaaaaaaacatggcatatacagggtttagtactatctgcagtttcaggcatacaccagggttactggaatgtatcccctgtggagattgctgtaaatgcata

SEQ ID NO: 56399 - DNA, 201 bp, Homo sapiens
gcttacctttattccatttccagcactttttattttttaatgtatatccaactttctagctggtatcatactccttttacctaaagaacttcccttaggatttttttttttttttttttttttttggtagtatgggtctgctggcaatgaattctcttagtttttgtttgtcaaagataatctttatcccttctctttttt

SEQ ID NO: 56400 - DNA, 201 bp, Homo sapiens; identical to SEQ ID NO: 16354

SEQ ID NO: 56401 - DNA, 201 bp, Homo sapiens
cttacctttattccatttccagcactttttattttttaatgtatatccaactttctagctggtatcatactccttttacctaaagaacttcccttaggatttttttttttttttttttttttttggtagtatgggtctgctggcaatgaattctcttagtttttgtttgtcaaagataatctttatcccttctcttttttt

SEQ ID NO: 56402 - DNA, 201 bp, Homo sapiens
ttttattgctagtttgttgggtgggttttgttttgttttgtttttaatgaaagcatgttgggttttacagttacatcaagtgacatgatcatatgaggatwtttttcattctattaatgtgatgtattaccctgattttcatgtgttaaaccactgttgtatttcttggacaaatcccacttcatcatggtatataatcat

SEQ ID NO: 56403 - DNA, 201 bp, Homo sapiens
accagattatcagagatatcagggccctcagaggttgtcttgtccaaggtcttcaatacacaaatagtgaaacaggcttggagaagggaaggtcacacaayaaggcagagtcaagcaggaacatgctctcagtgctatgttcatgagacgacctctctcagcccagagcaggccttgccctgccttctcccactgggcgcc

SEQ ID NO: 56404 - DNA, 201 bp, Homo sapiens
caatggttccacgatcatctatggggcaggactgacaaggtgtcggggcagggagacaaaccacatgtgagcaaataactcagtgggcaaggtcatctcargtcattggacatgctacaaaaataaacattcaacatggtagctgaataaggagtgtgtagggcggggagcctcactgagaaggaaacactttattagagc

SEQ ID NO: 56405 - DNA, 201 bp, Homo sapiens
ggatggtacccccaggctgcatggattcacccttcctcctcctcagtcagtccatcagctaacagctctttagtgggtgcctactgtatgccaacatgagycagctgctgggtggcctctgaggctctgccctaatagcgtttactgtctagtgcgagagacaggtgctaatcaaatagccattaaagcaagggcacacct

SEQ ID NO: 56406 - DNA, 201 bp, Homo sapiens
tcccagctcaaaaaacaaacaaaaagccgtgaaagcaagagcatggattatagagtgagaggctatgaggagaggaatggcattctgaggcagcgcagccytgggatcctgtctcagcccaggggtgtcctggcacccagcacggggcagaggaaatggatatacaagcgtggtgtcccctgggccaggcctgagccctgc

SEQ ID NO: 56407 - DNA, 201 bp, Homo sapiens
ctaaaaattcccttttaagtacatatagtgccctgggcggctgagaaaatcaaacatacaaacaacagaaacaacgttatttaattctagctaagtactcyggactggtggaggaagtatggaccctctttggtttattgagaaaagtcataagtgggtgacagagaagaattgaagacagaaatgcgccaagctgaaaca

SEQ ID NO: 56408 - DNA, 201 bp, Homo sapiens
caatacggtaccaaagatataatcacctaggtttacaaatatttttaggactcacgttaactcacatttatacagcagaaatgctattttgtatgctgttragtttttctatctgtgtacttttttttaagggaaagattttaatattaaacctggtgcttctcactcacagactttgtggtctctctcgggtttgggttc

SEQ ID NO: 56409 - DNA, 201 bp, Homo sapiens
gcaccttagtgccattttttgtttatttggggattggggtccagtagctccctactggacttcatttgttcattctttcatgcattcctttatggaaacaygaaaagacaatgatcacccagtgattatgggggaagcacaaggtgtcctgggaacactgaagagtccccccaacccaggcttcgagaaggtggcctctaa

SEQ ID NO: 56410 - DNA, 201 bp, Homo sapiens
gcaggttggcaccttacttccctgggatccccagagttggtccaaggagggagagtgggttctcaatacggtaccaaagatataatcacctaggtttacaratatttttaggactcacgttaactcacatttatacagcagaaatgctattttgtatgctgttaagtttttctatctgtgtacttttttttaagggaaaga

SEQ ID NO: 56411 - DNA, 201 bp, Homo sapiens
actgagcatagctcccatagtttttcaaccctcgcccgcttccaccctccctgctctagtagcccccagtgtctgttggtgccatctttatgcccatgcayactcaatatttagctcccacttataagtgagaacatgcggtatgtaggttttctgtttcggtgttaatttgcttaggataatggccttcagctgcaccac

SEQ ID NO: 56412 - DNA, 201 bp, Homo sapiens
ccaagaccccttgaagatggctttagaagggccccaaacttagctagctccccccaagctcaggctggccctgccccagactgcgacccctccctcttggrttcaaggctttgttttcttcttaaagacccaagatttccaaactctgtggttgccttgcctagctaaaaggggaagaagaggatcagcccaaggaggagg

SEQ ID NO: 56413 - DNA, 201 bp, Homo sapiens
gcatcaaggctgcctcccaggatttgggatggggcagtgatggggaccctggcctgtgtgtcctggcccatggcagggaggagagcaatatctctatcatrttcagggagcctgggtgttcaggggtctctcccccggtctcagtcatcccagggcccccagccttgacactggtgcctgcagagctggtgcggattcgag

SEQ ID NO: 56414 - DNA, 201 bp, Homo sapiens; identical to SEQ ID NO: 16352

SEQ ID NO: 56415 - DNA, 201 bp, Homo sapiens; identical to SEQ ID NO: 16353

SEQ ID NO: 56416 - DNA, 201 bp, Homo sapiens
aatccctcaacaatctgactttcataataaccgttaccaaaaagtcctgaccctcaacctcgatcaagtagatttccaacatgccggcaactactcctgcrtggccagcaacgtgcagggcaagcactccacctccatgttcttccgggtggtaggtaagcatcagggtggtggtggacagtcggtagggatcctgcagga

SEQ ID NO: 56417 - DNA, 201 bp, Homo sapiens
gtaagtaacgcacaaaagatagttttataaccagactgctgggatccaaatcctatctccaccatttggtagctgtttgactatggacaagcttaaggcayttgatctctctgagctttagttttcccatctgtgaaatgagaatgacaatagtacttacctacataaagttttgcagtactaaaggagacagtgaatgta

SEQ ID NO: 56418 - DNA, 201 bp, Homo sapiens
gataggggtggtggttcttccttgggtggcttgtgtaaggggtcagaggggagagacaagaggttggcctctctggcccagggctcaggagaggggaattyggggtgaaataggtatagggctagaggagggattgggaagaggccagtgagggtctcctggaccagagccctcccagacacaggctgccaagtctcagga

SEQ ID NO: 56419 - DNA, 201 bp, Homo sapiens
ggatggtattggaggaccctagagagagaggggggctctctcttcattactgcgatgagatcctgggctgaagaggggctgtgtccagccttagtgtgcaktgtgtgtgtgtgtgtgtgtgtgtgtgtgtgtgtgtgtgtgtgtgtgtgtgttgggagagaagagtagagattggggcacattctggaagtgatgagggag

SEQ ID NO: 56420 - DNA, 201 bp, Homo sapiens
tgcaaaatgtcattaggagaaactagttagtagctgggcgtggtggcatgcaactgttgtcccagctactcgggaggctgaggccggagaatcgcttgaasctgggaggcggaggttgcagtgagcagagactgtgccactgcactccagcctggatgacagagcaagactctgtttcaaaaaaaaaaaaaaaaaaaacta

SEQ ID NO: 56421 - DNA, 201 bp, Homo sapiens
tgtctcaggcctgctccttatgggaacttgagtggattacaccacatcaggcctcagtttccccagggataaatggagctagatgccacactaagacaaargttgataaaaatctgactaccactatccaacagttactatgccccagggctgtctggttgcttcacacacattagctcattttaccctcccaaaagccca

SEQ ID NO: 56422 - DNA, 201 bp, Homo sapiens
agacatttcccaagcaagaactggccatttgctataatttttaaaattttatttattttgacagtgaactgggggactttttaaaaaatgtatttattacytaaacaacacatgttcattatggacaaattgtaaaatagagattaaagaaagaataaaacaaaaaatttcccagaatcagccaaagatgatttttattgt

SEQ ID NO: 56423 - DNA, 201 bp, Homo sapiens
cacaaggtagaatgtaatttacttaatactactgaaccatacacttaaaaatggttgaaatggtaaatttcatgtatgttttatcacaattaaaatatatrtatatatttggatgggaggttgggtgggtggatggatgggtagatggatggacagatgaacggatggataagatctcaagttccaccctccctcctggct

SEQ ID NO: 56424 - DNA, 201 bp, Homo sapiens
cctcttcacaccagtggtggtcgcctgcatgtccatcatggccttgctgctgctgctgctcctgctgctattgtacaagtataagcaggtgagccggagcrgagtggggctgccaggtgcctgagtgagccagatttggatggtacccccaggctgcatggattcacccttcctcctcctcagtcagtccatcagctaaca

SEQ ID NO: 56425 - DNA, 201 bp, Homo sapiens
cccacatcctcttcactgatagcaggtctgacctacagtgagccgccatagctttcctttgaagaaataattcttgggctacattttttttaaggttgtcttttttttttcattttttgttttttttttcttgagacggagcctcactctgtcacccaggctggagtgcagtggtgcgatctcggctcactgcaacctctg

SEQ ID NO: 56426 - DNA, 201 bp, Homo sapiens
ggcggaagcagaggatagcttcctgtagggggctggcccctaccctgccctgcctgaagctccccccctgccagcacccagcatctcctggcctggcctgrccgggcttcctgtcagccaggctgcccttatcagctgtccccttctggaagctttctgctcctgacgtgttgtgccccaaaccctggggctggcttagga

SEQ ID NO: 56427 - DNA, 201 bp, Homo sapiens
aagtcaacacctcctcaaccatctcctgtgacagccccctggagccccaggacgaaccagagccagagccccagcttgagctccaggtggagccggagccrgagctggaacagttgccggattcggggtgccctgcgcctcgggcggaagcagaggatagcttcctgtagggggctggcccctaccctgccctgcctgaag

SEQ ID NO: 56428 - DNA, 201 bp, Homo sapiens; identical to SEQ ID NO: 16350

SEQ ID NO: 56429 - DNA, 201 bp, Homo sapiens
gctcagtgacaggctcatcccttctctctctctctctgccatctgtgtgtctgcatttttccttctccttcttttggcttctggtcactccgggtcttggrgtatgccctgctttctcccctgggtctctgcatttggtccccatgtatctgtgtggtgctctctgtcctgccctctccctgtctttgggactgtggttct

SEQ ID NO: 56430 - DNA, 201 bp, Homo sapiens; identical to SEQ ID NO: 16357

SEQ ID NO: 56431 - DNA, 201 bp, Homo sapiens
cagctccaatgccactgctctggaaggcctcacagactctccatcttctgttccccagcgccatctgattgtgcttatgttacaacacttaggggcttgcytccaaatgtgttggactttaagaagttaatgtcacattgatgaccttgcatgttgttgatctgatgagagtaagggaggccagatgtgcttggagaccat

SEQ ID NO: 56432 - DNA, 201 bp, Homo sapiens
ctccactccattccttcacactctggttggccccagagagtcctgatttttcaccctctctgcccctatgctattccctctcctgggatttcctttctgcytgaagggttgctgctcctccttcaaggcccagctccaatgccactgctctggaaggcctcacagactctccatcttctgttccccagcgccatctgattg

SEQ ID NO: 56433 - DNA, 201 bp, Homo sapiens
agggacttggtgagaattgcatgaaagctgggcaagatcacacacaaactttgcatccgtgttaggggtgcccaggtttcctcaaggccatccagggactytcaaaggcagtggcctcagccagagggagcatgagaatccgctagagagcttgttacctgtgcaggtacccccctcccacccctaagtcagcaggcctgg

SEQ ID NO: 56434 - DNA, 201 bp, Homo sapiens; identical to SEQ ID NO: 16360

SEQ ID NO: 56435 - DNA, 201 bp, Homo sapiens
tgccctgccttctcccactgggcgccttgggactgcccacacccctgctcttgggggtcagaaacaaggtccaggaactgcctgccagccccgactgccaygtgctcccttcctcttctgcagaagcccaagtaccaggtccgctggaagatcatcgagagctatgagggcaacagttatactttcatcgaccccacgcag

SEQ ID NO: 56436 - DNA, 201 bp, Homo sapiens
tgaggccatgctgggacccagcctgagccccggccaggaccccgagggaggcgtcgactataagaacatccacctcgagaagaaatatgtccgcaggtagyccctggcaaaggacaagaaaaaggccaggtctgggaggcaggatccgagtctgtcttcaaagccagctcagggttggatggctcatgaatgggtggctat

SEQ ID NO: 56437 - DNA, 201 bp, Homo sapiens
cccttttaagtacatatagtgccctgggcggctgagaaaatcaaacatacaaacaacagaaacaacgttatttaattctagctaagtactctggactggtygaggaagtatggaccctctttggtttattgagaaaagtcataagtgggtgacagagaagaattgaagacagaaatgcgccaagctgaaacattctccttg

SEQ ID NO: 56438 - DNA, 201 bp, Homo sapiens
ttagtttttgtttgtcaaagataatctttatcccttctctttttttgagataaaattcacataacataaaattaaacattaaccattttaaggtgtacaayggcatttaggacaaatacaatgctgggcagccatcacctttatctagttccaagacatttcatcaccccaaaacaaaaccacctcctcataagcaatcac

SEQ ID NO: 56439 - DNA, 201 bp, Homo sapiens
cacccacagacccaccttccagcagatctgctccttccttcaggagcaggcccaagaggacaggagagagcgggtgagtggggtgaggcttggggtgggtsgccggtaaagcacgttgggctgggcctgatggatctggactgacagtttctggtccctcccaccctcaggactataccaatctgccgagcagcagcagaa

SEQ ID NO: 56440 - DNA, 201 bp, Homo sapiens
agggggcaggggctcgttcaaggtggtcccttgatggcacagcaccatccctgccaagctaccacccatctcagagtcaggacggcccaaggggcgcatcytagacctcacttctgtctgctgtccctctctcccaccaggtcagggaatcccagtgatagagcccagtgtccccgagctggtcgtgaagccaggagcaac

SEQ ID NO: 56441 - DNA, 201 bp, Homo sapiens
gtggtgaggtggggacaggctctgaatgttctaggtatggaaagaggacggaagctcagcctcagacatggatttcccactgggggcctgcctaaggccargtgctgggcatgtgtaggagggatgctgagccaagaggcagggaggagatggtgggtgcgtgtgatggctctcgcggtggccaggtaacagtggaggtgg

SEQ ID NO: 56442 - DNA, 201 bp, Homo sapiens
tatctgtcgctatctgcttaggaataaaaggcaaggcagcttcttgcatgactcagtttccagcttgatttttccttttggcagagtgaattagggtcccragtttttattttcccttcacaggggcatggtgtgtgggaggggggccagatggttttccagggtccagtcccaagagaaagaagagatggggaggctgga

SEQ ID NO: 56443 - DNA, 201 bp, Homo sapiens
gatcctacatctctttttttttctttcccatatgaattaagctgaggacttggccgtgaacattccattcatttgtttcttcattcggtggtagaaatacrtccactttgtacacagggttaaaagagtccattcctggggagtagaaagatggcatcacagcagggaagactgaggcaggaggctgaggaccccaggggg

SEQ ID NO: 56444 - DNA, 201 bp, Homo sapiens
acctgggcttgagacagcaatcagtccctgtaacaagggccagggtcagagtgaagcagctagcccaatgccactgggatctgaagccactaaacctgccyagggggtcaaaggaccccagctgtgtgggcagaggaggccattagggctctttcctggcatttcatcctgcagagccctgggctggccaagagccaaagg

SEQ ID NO: 56445 - DNA, 201 bp, Homo sapiens
ctgggcttgagacagcaatcagtccctgtaacaagggccagggtcagagtgaagcagctagcccaatgccactgggatctgaagccactaaacctgcccagggggtcaaaggaccccagctgtgtgggcagaggaggccattagggctctttcctggcatttcatcctgcagagccctgggctggccaagagccaaaggtc

SEQ ID NO: 56446 - DNA, 201 bp, Homo sapiens
tgggcagggtgggaaggatgttgggggagccccaggggcacatggatcgggatctctactcctgccagcactcagcatgagaaggctgctctgagggcagycccggtcaatacctccggatctaggtccagctctgacactgttttgccatgtaacctcagctgactcgctgtcctctctgggccttagtttcccctctta

SEQ ID NO: 56447 - DNA, 201 bp, Homo sapiens
gagtgtgagcaggctctgagacatttaggtctggccgtgcctcatgtgttgaatgttatgggagatggaggtggcgaggagcatgagaatcatgagcatcmctgcccctagagtatgtgcaaggcactggacttgcagcagattgtgagctctgctgtggaccccaatctgcactgggagctttggcagggtaaaggggaa

SEQ ID NO: 56448 - DNA, 201 bp, Homo sapiens
gtggggacaggctctgaatgttctaggtatggaaagaggacggaagctcagcctcagacatggatttcccactgggggcctgcctaaggccaagtgctggrcatgtgtaggagggatgctgagccaagaggcagggaggagatggtgggtgcgtgtgatggctctcgcggtggccaggtaacagtggaggtggagtctcac

SEQ ID NO: 56449 - DNA, 201 bp, Homo sapiens
tgctagaaatgacacttgtccctcttcctggcagttgcactgcataggagggctacaaccccaggtggcaggcttggcagtattcacaattcactcaatcycgtttgctgatcagagtcttggggagaagggatgcacattctgatgaatacaaaatcaaaacgtgaattaagccatcctgaaaggacttgagagaggaaa

SEQ ID NO: 56450 - DNA, 201 bp, Homo sapiens
gggatggcaggcaggattctggtttctgggaggactggtgagagcaagcaggaccccagcctgaggacctgggcttgagacagcaatcagtccctgtaacragggccagggtcagagtgaagcagctagcccaatgccactgggatctgaagccactaaacctgcccagggggtcaaaggaccccagctgtgtgggcagag

SEQ ID NO: 56451 - DNA, 201 bp, Homo sapiens
agtcaggacggcccaaggggcgcatcctagacctcacttctgtctgctgtccctctctcccaccaggtcagggaatcccagtgatagagcccagtgtcccygagctggtcgtgaagccaggagcaacggtgaccttgcgatgtgtgggcaatggcagcgtggaatgggatggccccccatcacctcactggaccctgtact

SEQ ID NO: 56452 - DNA, 201 bp, Homo sapiens
gcagaagtgagaacatccctgtagaagggccacaggctgagcggaaaccgggggctgagcctgacgccaacaatgtgtttccgcccacacaggctgggggkcgcctggcagcccctcggaggcttgaatcagctctcacttccctcctttgcccctattttaggccctggaaaaatgctgacgctgcagaggcaacgggcc

SEQ ID NO: 56453 - DNA, 201 bp, Homo sapiens
tatgaattaagctgaggacttggccgtgaacattccattcatttgtttcttcattcggtggtagaaatacgtccactttgtacacagggttaaaagagtcyattcctggggagtagaaagatggcatcacagcagggaagactgaggcaggaggctgaggaccccagggggacagaggcctgggtgagaggctgagcaagc

SEQ ID NO: 56454 - DNA, 201 bp, Homo sapiens
ccagcagcatcctcagcaccaacaacgctaccttccaaaacacggggacctatcgctgcactgagcctggagaccccctgggaggcagcgccgccatccayctctatgtcaaaggtgaggagtctgagcctcctcccaagaggcctgacccggcaggccccactacaatgggccctaaaattaacaatcgtaacaattcag

SEQ ID NO: 56455 - DNA, 201 bp, Homo sapiens
caaggacctggaagagctgctaatgtaatgcagtcctcacaacaaccctgcaagtcgggtctatgatgatgcattttctagaagtgcagggaggttatccraggtcacacagcctcacatagtgggactagactggagcccaggtgcgcctgactctggagccaccacgctgaagcatccgctgaactgtcctggcgtggt

SEQ ID NO: 56456 - DNA, 201 bp, Homo sapiens
gaagtgcagggaggttatccaaggtcacacagcctcacatagtgggactagactggagcccaggtgcgcctgactctggagccaccacgctgaagcatccrctgaactgtcctggcgtggtgtgacctcagatgaatgatcagcctctctgagcttccttgtcacctatgtccaggtactccttggcccagtggagggagg

SEQ ID NO: 56457 - DNA, 201 bp, Homo sapiens
atgggccctaaaattaacaatcgtaacaattcagctctgcatttactgagtgctggctatgagcaaggacctggaagagctgctaatgtaatgcagtcctyacaacaaccctgcaagtcgggtctatgatgatgcattttctagaagtgcagggaggttatccaaggtcacacagcctcacatagtgggactagactggag

SEQ ID NO: 56458 - DNA, 201 bp, Homo sapiens
accctaaggccgtggcgcttctggtccctgatgaggaggagatggcccactgaccatccttctctggcccaggcaatcacactgagcttgagtatttgggktttttttttttttttcctgagacagagtctctctctgtcaccaggctggagtacagtggcacaatctcggctcactgcaacctccacctcccgggttcaa

SEQ ID NO: 56459 - DNA, 201 bp, Homo sapiens
tgggcagaggaggccattagggctctttcctggcatttcatcctgcagagccctgggctggccaagagccaaaggtcctgggccctagttctgccttgacmccccctcagggaccttgggtgagtcctttcatgtccctgggccttaggaatctggattagattatctttcaacagcagcaatgggcataaatatgaattc

SEQ ID NO: 56460 - DNA, 201 bp, Homo sapiens
aaatagaaagtaaatacaaatgtgatgagcaagaaaccaagctggggagtggcgggcatggaggtgctggggaggctaattcatatcagctggtcacagargccttgctgaggaatttttgagctaaagatctgaaggatgagaacagcctcccatttgaagtgtgggaggaaaggcattccaggagggaaaggtgggtgc

SEQ ID NO: 56461 - DNA, 201 bp, Homo sapiens
aagcactccacctccatgttcttccgggtggtaggtaagcatcagggtggtggtggacagtcggtagggatcctgcaggagtgtgagcagaagggttttgwggaggaagctgatgtcagggaaggagacctgctgaggatatctctgctggagtttgtttatccaaggcctggctaaggagccactctccaggagctttcc

SEQ ID NO: 56462 - DNA, 201 bp, Homo sapiens
agcactccacctccatgttcttccgggtggtaggtaagcatcagggtggtggtggacagtcggtagggatcctgcaggagtgtgagcagaagggttttgakgaggaagctgatgtcagggaaggagacctgctgaggatatctctgctggagtttgtttatccaaggcctggctaaggagccactctccaggagctttccc

SEQ ID NO: 56463 - DNA, 201 bp, Homo sapiens
ctctataatgaaaaggaggaggatgggatttctggtagaggaaattgcttgagcaaaacctccaaggttggaatgactatggtgtgttcagggatgttagsagacccagatgggtggagcgttgagtgtgtgtgtgtaggaaggaagaggggaggtggctggatgagcacagtgagacctgatttgattgagagccttgaa

SEQ ID NO: 56464 - DNA, 201 bp, Homo sapiens
ctcctgcctcagcctcccgagtagctgggattacagatgcccaccaccacacccagctaatttttgtatttttagtagagacagagtttcaccatgttggycaggctggtctcgaactcctgacctcaggtgatctgcctgcctcggcctcccaaggtgctaggattacaggtgtgagccatcgtgcctggcctgaaataa

SEQ ID NO: 56465 - DNA, 201 bp, Homo sapiens
tcagcctcccgagtagctgggattacagatgcccaccaccacacccagctaatttttgtatttttagtagagacagagtttcaccatgttggccaggctgrtctcgaactcctgacctcaggtgatctgcctgcctcggcctcccaaggtgctaggattacaggtgtgagccatcgtgcctggcctgaaataatcattcat

SEQ ID NO: 56466 - DNA, 201 bp, Homo sapiens
cctctcagttcccttctggtcctttctggccaggtctctgtcttcctctcatttaaagcagaagttctgaatctggaatgtgtaggccctttggagggggytggtccatggatcggtttaatgggtccataagccacagagacattgaggaaaggaacacgagatcccctaaaacacagtagtctgggcccattcagcaca

SEQ ID NO: 56467 - DNA, 201 bp, Homo sapiens
aatgggtggctatgcagccctcacctgccacctgtgtcatgggaagtagccaccacaggttttatggccatctcttgtttctctactccttttccccttcmttcaacaaatatttgaacacctaccgtgttctgggagtgtggagggcaaagatgggcagctcataatctggtggagatatgcatcaatgaaatcaccacc

SEQ ID NO: 56468 - DNA, 201 bp, Homo sapiens
aaggaagatctcactagaaagctgatatttgagcaaaggcttaaattgctgaaggagcaagccatgcggccattttggagaagggagctccatcctgcagygggactgtgcttgccatgttcaggggacaagtgggccagtgtggctgcggggagagagtgagaaaaaaagtggtctcagatgaggtcagagagctaaagt

SEQ ID NO: 56469 - DNA, 201 bp, Homo sapiens
atcgggatctctactcctgccagcactcagcatgagaaggctgctctgagggcagccccggtcaatacctccggatctaggtccagctctgacactgtttkgccatgtaacctcagctgactcgctgtcctctctgggccttagtttcccctcttataccatgggtctgggtgttctctaacagcccctcctcctctgaca

SEQ ID NO: 56470 - DNA, 201 bp, Homo sapiens
ctgaaggagcaagccatgcggccattttggagaagggagctccatcctgcagcgggactgtgcttgccatgttcaggggacaagtgggccagtgtggctgyggggagagagtgagaaaaaaagtggtctcagatgaggtcagagagctaaagtgggaaggtgagatgaaaggaggctaccgcagtggtccaggctggagct

SEQ ID NO: 56471 - DNA, 201 bp, Homo sapiens
gtgtgtaggaaggaagaggggaggtggctggatgagcacagtgagacctgatttgattgagagccttgaacgccacgctgaataatggaggcaatgggackccatagagggcttttgagtagacatatatcagtgtagaagggtgaatttcagatttttagacagaatagagtaaggagaggagctcttagaaatcatcta

SEQ ID NO: 56472 - DNA, 201 bp, Homo sapiens
tggatgagcacagtgagacctgatttgattgagagccttgaacgccacgctgaataatggaggcaatgggacgccatagagggcttttgagtagacatatrtcagtgtagaagggtgaatttcagatttttagacagaatagagtaaggagaggagctcttagaaatcatctagtccagggcttgtggcagagccctgagg

SEQ ID NO: 56473 - DNA, 201 bp, Homo sapiens
tcaatgtcacacagctcccaagtggcacaggtgaaacttgactgcagatctaagttactgatctgagcaaggaagtggaaattatgttctccaaaacatcrctagaactagtagtatagattctgggaagaggagactcaggggccacaagcctggcttgctagaccctcagaagggctgtatgattccaaaggcatgtgg

SEQ ID NO: 56474 - DNA, 201 bp, Homo sapiens
aataaaataaacccctttaaggctgttatctgactgcaatcctggcaggggccatactaggctggggctcaccaacaccacctgattctctcctgcaggcrcaccttcaccctctctctgccccgcctgaagccctctgaggctggccgctactccttcctggccagaaacccaggaggctggagagctctgacgtttgag

SEQ ID NO: 56475 - DNA, 201 bp, Homo sapiens
acatgccaagagcccactggtggtctagtttaagcaccagaaacttggacttcagtgaatctgggtccaaatcctgcctctgccaagctctggctatgggrtgatgagaaagttggtgtgtctgagtctcttctccatttgtaaaatgggatcattaacagcctgttgtgagggattccgtaccacaacgcacatagagga

SEQ ID NO: 56476 - DNA, 201 bp, Homo sapiens
gtgacgatggggaggaggaaacgggagcctgtgagggggtaggggaggagacagagtatgagagagtcatttgggcagcagctgcaaggatgagtgggagmaagctgtgcccagggctggagctctggggctgggcacctgtgtccccagcgtgaagatgaggaagggtaccaggctttcttcattcgtttttactaaata

SEQ ID NO: 56477 - DNA, 201 bp, Homo sapiens
tgaggtcgggcatcatctccttgactacacacccaaagcggttgtttggcccagcccacccacctccagggacaggaccttactcactctcggggccaccygttccttctctgagcagctccaatgtttgcaaagttcttccttacatggaactgaaaactgcctcgcagtgcccacagagctgccaggacagtcatgcag

SEQ ID NO: 56478 - DNA, 201 bp, Homo sapiens
ctggccagcccccttggctgtggtttaggaactctgtatcccctctccacgggaccatttttggaacatgtcacctccacacttcctgtccaggaaattcwgctgcccctggagcccatgcaaggctgcgagaagacttgcagctaccctcctcccctacacccattcacagaccctttagctccaggccgaggtgtccac

SEQ ID NO: 56479 - DNA, 201 bp, Homo sapiens
ccactcaccttatcatagccctcaaggccttcctgtttctggaatctgccccccacttccctcaagccatgatggctgccttcctatagctcaaacttgcyaggatcattcccatgtcaagcatacagcatttccatgcactgttcctggaaaattcttcctctgatggtcacatggtgggctctttaggggccttccctg

SEQ ID NO: 56480 - DNA, 201 bp, Homo sapiens
tggacagatggatgagctcgtctgtgcccaggcaaatgctaggaagagtatacacacactcttacaagcagttgaggcggggagagaggctgtgattaggwgaataagggtttggggggccttccatttatggggacagtgtatctctttatggatgaatatcttacagtgaccactagtattaaaaaaaaaaaaaaaaga

SEQ ID NO: 56481 - DNA, 201 bp, Homo sapiens
cagctccaatgtttgcaaagttcttccttacatggaactgaaaactgcctcgcagtgcccacagagctgccaggacagtcatgcagagattccagagaagrgcctagggccccctgcggccctttctgccttgggctggccagcccccttggctgtggtttaggaactctgtatcccctctccacgggaccatttttggaa

SEQ ID NO: 56482 - DNA, 201 bp, Homo sapiens
ggccaggagaggctgaagaatcccctcctcgccttgttgctgtcttttgggctgggaaggcacccacgggcaggatttggatcctcagaggcttgggaagytcttctccctgggtcccgtttcagactctctcccaagctataacgcagaggctctgaagttcacctgcagtccgcccttccgaatcagagcctggaagtt

SEQ ID NO: 56483 - DNA, 201 bp, Homo sapiens
tggagaaaaattagaaggaactagagtgtccatttgttagaggaatggtgagataaattatggtacatccatacgatgagatacagtgaagcaattttaaraatatggtaaatctctatgaactaatatggaaagatttctaagatgtgttgaatgattaaatagcataggatactatttttaaaactataaagtagggat

SEQ ID NO: 56484 - DNA, 201 bp, Homo sapiens
ttttaaagatcagtgatatcccatgtcagcaagtgtacggtgatgctgcatttctcacacactgttggtgagaatgcacatcctcacggccttcttagggraacaatttaacaatatctccatgttttaacgtacctaccctttgacccggcgatcccacttctatgaatggatcctgctccaatgagagtgtatttacac

SEQ ID NO: 56485 - DNA, 201 bp, Homo sapiens
ttctgaggctggggtccctgaactgcacttggaggtgcacccctctagaggcctccaggccattaaggacccatggcctataggatcaagccctggcaccstgccaggttgtcaggtactcttagtacttggacctcaccccctttctactcccatctccactccattccttcacactctggttggccccagagagtcctg

SEQ ID NO: 56486 - DNA, 201 bp, Homo sapiens
aggcagatagtaatccttaaaggctgaggattggaacccagatctttctaatccctaaactaccttggtataacatctccattccttctggctgcagctckcaatccctcaacaatctgactttcataataaccgttaccaaaaagtcctgaccctcaacctcgatcaagtagatttccaacatgccggcaactactcctg

SEQ ID NO: 56487 - DNA, 201 bp, Homo sapiens
aacccaaaccaatcaccgggccagaggggacagagtaccctcactggttggcctgggttacacacctactccagagctatatttggaagccgcattgactratttatgaccagaagaaagggaaatggatgaggacacgtgaaattgtgtgtgtatgtgtgtgtgtgttttcttgctgccaaaaatttttcaaaaacttgg

SEQ ID NO: 56488 - DNA, 201 bp, Homo sapiens
ctgtctggaggtcagaagatctcagctccctgtgtctcaggcctgctccttatgggaacttgagtggattacaccacatcaggcctcagtttccccagggrtaaatggagctagatgccacactaagacaaaggttgataaaaatctgactaccactatccaacagttactatgccccagggctgtctggttgcttcacac

SEQ ID NO: 56489 - DNA, 201 bp, Homo sapiens
gaaacattgactcatcttattttaccctcacaagaagctggaggcaggaagtatactagtcagtatcttacccatcaggaagctgaggctcagcaaggttaaaaaaaaaaccccaaggggctgagggatagggttggcactgggccccaggggcttctgtccctagagcccatggcctccactgcctgcctgcccacacaa

SEQ ID NO: 56490 - DNA, 201 bp, Homo sapiens
gcccatggcctccactgcctgcctgcccacacaaagaccatgtgcaatgtgatcagaagctgagaggaccaggccagagggctgtgggagttcagaggtgkacggacttttcaggctggtgggtaagggagactgcctggaggaggtggcttggcattggtgggacgggctttggaggatgaggatgcagcaggggagatg

SEQ ID NO: 56491 - DNA, 201 bp, Homo sapiens
tgggtaagggagactgcctggaggaggtggcttggcattggtgggacgggctttggaggatgaggatgcagcaggggagatgacactaagggaaagggtayctctgggggagagggcagagtgtgcagaggtgcaggtgagggaaggaccagggtggggttgggggtctgaagggttggaccccaccctgtcggtccaagg

SEQ ID NO: 56492 - DNA, 201 bp, Homo sapiens
taaacaaatggaactactgaggcacaaggaaacttgctcacagagccgaggttagaactcagctatgctgagtccaagtccagtggcctcactgcccccaktctcatgctcctgttcatggaggggagcactcagcacctccctcaccccacacccttggctgctctaggccctgtactggtcatcacggagtactgttgc

SEQ ID NO: 56493 - DNA, 201 bp, Homo sapiens
aactagcccacattccagacagggattatctttgctggtgcaaaagcctctgtctggaggtcagaagatctcagctccctgtgtctcaggcctgctccttwtgggaacttgagtggattacaccacatcaggcctcagtttccccagggataaatggagctagatgccacactaagacaaaggttgataaaaatctgacta

SEQ ID NO: 56494 - DNA, 201 bp, Homo sapiens
atgaggatgcagcaggggagatgacactaagggaaagggtacctctgggggagagggcagagtgtgcagaggtgcaggtgagggaaggaccagggtggggytgggggtctgaagggttggaccccaccctgtcggtccaaggccatcagtgggtttgaacaagggagtggtgtgatcaaggactgaatgacccatcttgtg

SEQ ID NO: 56495 - DNA, 201 bp, Homo sapiens
aagccttggtgtaactggatccagccattcaaaggatggcatcaggaacctcttgttctagccctgagctctgctttgctctgtgtggcctcattttcagrccagcattgcccaaatggctaccagcagtgccagtctcatgtcctactgcttgctccatagtgccagcaaaagtcccagagctgaccttcaagggctcag

SEQ ID NO: 56496 - DNA, 201 bp, Homo sapiens
cagagggacagaggaacaagaagtggtaagaaaaaacagtcttagccacagaggctcctagagatggaagtggccaggagaggctgaagaatcccctcctygccttgttgctgtcttttgggctgggaaggcacccacgggcaggatttggatcctcagaggcttgggaagttcttctccctgggtcccgtttcagactct

SEQ ID NO: 56497 - DNA, 201 bp, Homo sapiens
cctcagaggcttgggaagttcttctccctgggtcccgtttcagactctctcccaagctataacgcagaggctctgaagttcacctgcagtccgcccttccraatcagagcctggaagttagttccttctcatttctaattgcagtcttttctctctaactaccagctagaagttcttcctgatggttagctggaagctttc

SEQ ID NO: 56498 - DNA, 201 bp, Homo sapiens
cggaaagagttgctctgctgacccagggcctcagtgtcctccaccgccccagcccagcttccactttccccctcaacttggtcttccatcagcatttcttrtgggcaacccttagcatggtactccccctcagcagctgacccctgggcaagaaacaggggcagccattcctcctccccacatcccagggcttgcctcccc

SEQ ID NO: 56499 - DNA, 201 bp, Homo sapiens
aactccaaactggctgtcttagctgaaggcacagctcagactccagagaggggtgcagactcacccgagatctcactcccagtcagtagctgacacagaaycaggactcatgcttgtgccgctgaactttgtgggggtgggtggggggaggtggttctctgtcaccttgacacatggcctttgccccagcctttagacaaa

SEQ ID NO: 56500 - DNA, 201 bp, Homo sapiens
cctcagtgtcctccaccgccccagcccagcttccactttccccctcaacttggtcttccatcagcatttcttatgggcaacccttagcatggtactccccstcagcagctgacccctgggcaagaaacaggggcagccattcctcctccccacatcccagggcttgcctcccctggctgggtggtaacagcatggagagcc

SEQ ID NO: 56501 - DNA, 201 bp, Homo sapiens
ctcactgcccggccaggcatggtagctcatgcctgtaatcccagcactttgagagaccgaggcaggcaaactgcttgagctcacgagttcaagaccagcckaggctgcgacaaagccccgtctctacaaaaattagccaggtgtggtgccacatgcttgtagtcccggctgcttgggagactgaggtgggaggattgcttg

SEQ ID NO: 56502 - DNA, 201 bp, Homo sapiens
ctgcagagctggtgcggattcgaggggaggctgcccagatcgtgtgctcagccagcagcgttgatgttaactttgatgtcttcctccaacacaacaacacyaaggtcagtccctgcagatcacaaggtgaagtctggccatcctcccagcacaccaggtttcccatggtggagtcctgggcccccaactccaaactggctg

SEQ ID NO: 56503 - DNA, 201 bp, Homo sapiens
gcagggagggtggatggagagagaagaggcagagatcagattgcaaaggcccctgtaagccctgctacagggtatggccttgatctgctctatggagctgsaatagtaatgggagcaaataccccatagtactccaattcagacactagagctcaatcctcaggcctagagataggtgtggtcgaacctttgtggtccagg

SEQ ID NO: 56504 - DNA, 201 bp, Homo sapiens
caaaaagtctgggggtgcagaaaggccacctatggccatggcctggccacagtttggcttcctgtcacctgaagaccagctcagtgacaggctcatccctyctctctctctctctgccatctgtgtgtctgcatttttccttctccttcttttggcttctggtcactccgggtcttggggtatgccctgctttctcccctg

SEQ ID NO: 56505 - DNA, 201 bp, Homo sapiens
ctcagtgacaggctcatcccttctctctctctctctgccatctgtgtgtctgcatttttccttctccttcttttggcttctggtcactccgggtcttgggrtatgccctgctttctcccctgggtctctgcatttggtccccatgtatctgtgtggtgctctctgtcctgccctctccctgtctttgggactgtggttctt

SEQ ID NO: 56506 - DNA, 201 bp, Homo sapiens
tggagtgtggcaggagggtttcttatcagaaagggaggttccagttgaccatggggtggtgggtggtcaaggcctgagctgagcagtgcagtgatgatgastgacctctgccccccaaccctctctcctatgtagggacagtggcttctccagccagggtgtggacacctatgtggagatgaggcctgtctccacttcttc

SEQ ID NO: 56507 - DNA, 201 bp, Homo sapiens
tggccacaccaagcaggaagcacaaactcccccaagctgactcatcctaactaacagtcacgccgtgggatgtctctgtccacattaaactaacagcattratgcagtcagcctctggttctttgtgccacatgagtacctgcaaattccctggaacgtctttctttccttccctccttcacatgaagtgacgagctcaca

SEQ ID NO: 56508 - DNA, 201 bp, Homo sapiens; identical to SEQ ID NO: 16344

SEQ ID NO: 56509 - DNA, 201 bp, Homo sapiens
agctctctactactaggctctagtagaaagaactgctatttcccgaggactaggcacaaggacttgtactcagttcttaaatacgctgctcctataccctsataaccacctgactgtccacactttaacgatacacagctgaagctttggtctgattccaaagcctgtgcaagaatgtttggtgtgataaggcctggatag

SEQ ID NO: 56510 - DNA, 201 bp, Homo sapiens
tctccggtgatcccaggacatcttgcaactcccccagtggcctggttcctctcctggctctgacaataggctgtgagttgcagaagggagggaccacagcygacctgttcaccaccatgtccccagggccagggacagtgattgagaaatatctgttgcatgcccttcacctgcattattgtctcactggatctgagtcaa

SEQ ID NO: 56511 - DNA, 201 bp, Homo sapiens
caggtgttgggggcagggggacagtgatagactagaccagagcagtgcttttcatactttcctgtgcatacaagttacctgaggattttgttacaatgcasattcagactcagtcggtctcaggtgcgacctgagattctgtatatccaacacactcctgggagatgtgagatgccggcactgctggtccagacctacact

SEQ ID NO: 56512 - DNA, 201 bp, Homo sapiens
ttttaccaaaaataaaataaacccctttaaggctgttatctgactgcaatcctggcaggggccatactaggctggggctcaccaacaccacctgattctcycctgcaggcacaccttcaccctctctctgccccgcctgaagccctctgaggctggccgctactccttcctggccagaaacccaggaggctggagagctct

SEQ ID NO: 56513 - DNA, 201 bp, Homo sapiens
agcccagcaaaagctactttctccaagaagctttcctcattcttcagctgaaaatgatttctcttcgcattcctttgtctgtgcctcttatgggccctcayatctgttcagcattcttagcctcccataccctgtgcactcttacgcctccaggcctttactgtgctgtttctccttcttggaacattccttcctcctccc

SEQ ID NO: 56514 - DNA, 201 bp, Homo sapiens
attctgggctagaaggcaggggaccttggcatgtggctggccacaccaagcaggaagcacaaactcccccaagctgactcatcctaactaacagtcacgcmgtgggatgtctctgtccacattaaactaacagcattaatgcagtcagcctctggttctttgtgccacatgagtacctgcaaattccctggaacgtctttc

SEQ ID NO: 56515 - DNA, 201 bp, Homo sapiens
ttacccaaggccgttgggccctgaatattttaccaaaaataaaataaacccctttaaggctgttatctgactgcaatcctggcaggggccatactaggctrgggctcaccaacaccacctgattctctcctgcaggcacaccttcaccctctctctgccccgcctgaagccctctgaggctggccgctactccttcctggc

SEQ ID NO: 56516 - DNA, 201 bp, Homo sapiens
gtatatgacagtgatttgaggggcatttttctatagcatgttacctacatcatctcatttaatgccctcagcaaccactgtatgcagctagcattagtctrttttacagagttgtaaactgaggttctgagaggttgggacagttgcccttgtctacagctggtcaaaggcagagtctggtttttaaccctgaaggaggac

SEQ ID NO: 56517 - DNA, 201 bp, Homo sapiens
agactgcccccactgcatgccagtctgggggacagagatcctgtcttggaaaaaaaaaaatcccaaaagggaacccactcaccttatcatagccctcaagrccttcctgtttctggaatctgccccccacttccctcaagccatgatggctgccttcctatagctcaaacttgccaggatcattcccatgtcaagcataca

SEQ ID NO: 56518 - DNA, 201 bp, Homo sapiens
gtatgtggatgggctactattattcagccttaaaaaggaagggaattctgacctgtgctgcagcatgaatgaaccttgaagacattatgctgggtgaaatraggcaatctcaatagacacatgctgtgtgagtccactgaggtgcagtgcctagagcagtgcaattcacagagacagcagaatcatggttgccaggggctg

SEQ ID NO: 56519 - DNA, 201 bp, Homo sapiens
ctcttgttgcccaggctaaagtgcaatggcttgatcttgggtcactgcaacctctgcctcccaggtttaagcacttctcctgcctcagcctcccaagtagmtgggattacaggcacctgccaccacacccagctaattttatacttttagtaaagacagggttttgccatgttggtcaggctagtctcgaactcctgacct

SEQ ID NO: 56520 - DNA, 201 bp, Homo sapiens
tgggttttacaacttacatcgtaaattaatcaaagtctacctttaaatgataaaatgttactttaaatatagcatgagggccggtgctgtggctcacacckgtaatcccagcactttgggaggccgaagcaggcagatgacctgaagtcaggaattcgagaccagcttagccaacatggtgaaaccctgtctctactaaaa

SEQ ID NO: 56521 - DNA, 201 bp, Homo sapiens
acccatggaggtaagggccttggggttcctggggccaaggtcttggggcctctggggaatctcagggccccagggctaccttgttccgtcttctccttctyaggatcctactgctccaagtgtcagggggatcccggtcacagcatcccttaaactcctgggcccatctcctggaatagtcaggagctgcacgggcagctt

SEQ ID NO: 56522 - DNA, 201 bp, Homo sapiens
atagggagcatcggagcccttggaggaggagatgaatgtgcaagctcctaggccctgcttccagggagccggatcctctgggtctggagtgaagccccccrcctacctcttatgaagcttccattcaaggatgcttggacactctccccagggcccccaaaggtgccccgggctttgctgggactccaagtgccccacatc

SEQ ID NO: 56523 - DNA, 201 bp, Homo sapiens
cggatcctctgggtctggagtgaagccccccgcctacctcttatgaagcttccattcaaggatgcttggacactctccccagggcccccaaaggtgccccrggctttgctgggactccaagtgccccacatcctcttcactgatagcaggtctgacctacagtgagccgccatagctttcctttgaagaaataattcttgg

SEQ ID NO: 56524 - DNA, 201 bp, Homo sapiens
ttccattcaaggatgcttggacactctccccagggcccccaaaggtgccccgggctttgctgggactccaagtgccccacatcctcttcactgatagcagstctgacctacagtgagccgccatagctttcctttgaagaaataattcttgggctacattttttttaaggttgtcttttttttttcattttttgttttttt

SEQ ID NO: 56525 - DNA, 201 bp, Homo sapiens
gtggagaagctgcaggggaaatgcaggagaggaaggttgcagtgtgacctccagaaggcctttctgaacgagcttcctggaggtgtagtgcatgcaagccrtggctgggcaccaggccaggccgctgcagagaggtttcttgcactggcagagggtgagactgcatgaccccagaggctccctacccccagccacaggagg

SEQ ID NO: 56526 - DNA, 201 bp, Homo sapiens
tcgatctcctgacctcgtgatccacccaccttggcctcccaaagtgctgagattacaggcatgagccaccgtgccccgccaaagccatctgttttaaacaratggaactactgaggcacaaggaaacttgctcacagagccgaggttagaactcagctatgctgagtccaagtccagtggcctcactgcccccagtctcat

SEQ ID NO: 56527 - DNA, 201 bp, Homo sapiens
ctcacagagccgaggttagaactcagctatgctgagtccaagtccagtggcctcactgcccccagtctcatgctcctgttcatggaggggagcactcagcmcctccctcaccccacacccttggctgctctaggccctgtactggtcatcacggagtactgttgctatggcgacctgctcaactttctgcgaaggaaggct

SEQ ID NO: 56528 - DNA, 201 bp, Homo sapiens
taaaggttcaaaacacttttctgaaaaagaaagtacatatatacactcataaatatacatacaaacacacacatacacaccacacacacacctgagtacaygggaatgatcattttcctggatcaatgttatatcaggatttttcaatttcaagaaggaactttaggctgggtatagtggctcatacctataatcccagta

SEQ ID NO: 56529 - DNA, 201 bp, Homo sapiens
aaggagatgcttaatgcttctactctgggcagatcagagcctgctcagggaattgtgttcatgcgacaggggatcatctcatgagaagcagctgacagcayggggagagctgtagatcttgggggctgtgatgggagtggcatcacttggaggtgacagccaagtgggtgtacccagagttgtggaatggtgcttgggggg

SEQ ID NO: 56530 - DNA, 201 bp, Homo sapiens
gatcacatagagctctctaggccagagtaacagttcgtattttattctgactgatgagggaccttttggatggttttgaatgggaaatctgtggaagggtrtggacaaggtggcactgggttagctccaggacaggttatgtactagatgacagagtgggcccaggtagatcttggaacggaaaccccccccccttaacag

SEQ ID NO: 56531 - DNA, 201 bp, Homo sapiens
agttttggggggctagacttaggtcactgggcaacctccggcatagctgcccacgggtcaggtgctaccccgtgggctagggagggaggctgggtcttctstcagtattttttaagcaccctaccacatcctgggcatcagctgttgagggtataagggcgagcttgtataaagaatgacaaagatgtcgttcctccctag

SEQ ID NO: 56532 - DNA, 201 bp, Homo sapiens
aacttcccatacagggactgatccagctcagttttggggggctagacttaggtcactgggcaacctccggcatagctgcccacgggtcaggtgctaccccstgggctagggagggaggctgggtcttctctcagtattttttaagcaccctaccacatcctgggcatcagctgttgagggtataagggcgagcttgtataa

SEQ ID NO: 56533 - DNA, 201 bp, Homo sapiens; identical to SEQ ID NO: 16383

SEQ ID NO: 56534 - DNA, 201 bp, Homo sapiens
aggtgggggaacatatttcccagggattaaaactacctggtcttcccaaacactggagcaattttcggagcttctggaaccaatgtttcttcagcaccttygctatcttcctgatggagatcatatgaaatgttcccatattctcttaaaaatgggaaaatttcaagcagaaactggcagaagtctctgcgaataccaaac

SEQ ID NO: 56535 - DNA, 201 bp, Homo sapiens
tacggcccccacgtcacttcacaggtggtaaaatctacaaggtgtgcccccatcaggtaagaaaataactagggggagcttggagtgaatttgctaatgtygaacttcccatacagggactgatccagctcagttttggggggctagacttaggtcactgggcaacctccggcatagctgcccacgggtcaggtgctaccc

SEQ ID NO: 56536 - DNA, 201 bp, Homo sapiens
tacctgattgttggccacttctggttaaggccactctctccagctttccagtgacaggtaatgctttacattacaaccaactaatattctaagattcttaraaatggacaaaccacttgttgcttattttgattgtttctggacagttactacctgtgtggaaaaattcagggtgctaaacaacagtgtcactttatggcc

SEQ ID NO: 56537 - DNA, 201 bp, Homo sapiens
agaattttccggaagttggttaaggtggtgaatttcactattactcaaattttaaaccacccttgtattcctgggacaaaccccatttgacagtgatgtaktatccctctcatagattgttggatttcatttgctaaaaagtttgctcagaatttggctcagaatttccttatacagtctctgtccacttttcatatcagg

SEQ ID NO: 56538 - DNA, 201 bp, Homo sapiens
cattaaattaatgttatgacccctcattggattgtgacctgtagtttgaaaactgtgtcatggaccaggttggaataggaaaacgggtctgccatctcccytgtcatgtgttctttgtcagttaacttcctttctttaacagttttacatttgccctgacaggaatatcaactggcttttactttgagaactgttttgttt

SEQ ID NO: 56539 - DNA, 201 bp, Homo sapiens
ataatcaggaataaggtttgcatgtttagaggtagatagagctgcttgtgtaatacagtaccacattattttgttagcactggtggttggaaactatgctraaagcaaaaatgcaagtaaagccaaagatggtggaggagaccaaggctttgggtgcttgggttaaaggactaacaaggaagcatttagaattatgtctgt

SEQ ID NO: 56540 - DNA, 201 bp, Homo sapiens
ttattcttttcagagctgacctgcttacccctgggtccagagctccagagcttaaaggcagagcacggggcaagccctcattactggctgcagcaagaccyatgagagcaattttgccagccccagttaacgtggggcgaggcagcagcatgggactgcccagggccaggcaggccttttccctgagtggtaagggctggg

SEQ ID NO: 56541 - DNA, 201 bp, Homo sapiens
agcagctaaaagacctgaccaaaattgcacaagctggcagagtataaagaaatcttttacatacaggcccttactacatgtttgagtgaatcaatgaaggsatttgcttaagttgatgaaacataggaggaatgggccagaacttctgattcctggccaagcatttttttttaacctgtttccatatagaattgttataat

SEQ ID NO: 56542 - DNA, 201 bp, Homo sapiens
tccaaccctgagctggctttgaagacagactcggatcctgcctcccagacctggcctttttcttgtcctttgccaggggctacctgcggacatatttcttytcgaggtggatgttcttatagtcgacgcctccctcggggtcctggccggggctcaggctgggtcccagcatggcctcagccttccttcgcagaaagttga

SEQ ID NO: 56543 - DNA, 201 bp, Homo sapiens
tctctgttttttagcccagcaccagagagctgatgttggttggtcagatgactgtttagatctgtgctgtctctagctcctagcatatgttgctatttcasttaattacaattggccaggtgtggtggtggctcatgcctgtaatcccagcactttgggaggccaaggcaggaggattgcttgagcctaggagtttgagac

SEQ ID NO: 56544 - DNA, 201 bp, Homo sapiens
caggccttgaccacccaccaccccatggtcaactggaacctccctttctgataagaaaccctcctgccacactccatctgagtgagcattggtctctgctyggctgtccccggtgagggagcttacaacccattctggttttgggcagctctgcctgtgagaaagttcttcactgttcctaatgccaatctacccctgaga

SEQ ID NO: 56545 - DNA, 201 bp, Homo sapiens
tcccattccctggcacttcttcctaggccgagcgcactttatacgttatctaatatccccaaaattctgaggaagcttccgttatcatccccaccagaccrcgtgctttatgagcagagacaactgttgtctctcatacactatttagtaaaaacgaatgaagaaagcctggtacccttcctcatcttcacgctggggaca

SEQ ID NO: 56546 - DNA, 201 bp, Homo sapiens
acttcctagatcactgaagataaagtgagctaatgcggttagagtgatagccgccttttttaactgtaacccatagtgagaaatacattttgtgtcatgaygcagaatgatattcgtacatatgcaagtgtgtataactgaaacaacattcccaaaacagtatttttctttattttctatcttatttcatttttgaatttt

SEQ ID NO: 56547 - DNA, 201 bp, Homo sapiens
gggtacagagctgtcaaattcaaggccctgtggcagtgcctggctgtctgacttcccttcaccaagccttggcttccctgtgtgtataatgacggggtagrctgttgtgttgctgatgttctgtgactcccacagtttgaccttctttatcctgaccttctagttcacctggcctgaattcctgggctctaatgaggtaaa

SEQ ID NO: 56548 - DNA, 201 bp, Homo sapiens
tataggatgtataggtttatagtctttctttgaacaaaagtacggttgtgctagatgttgttttggaatgtgctttttaaacttaggggtacattgtgggyatcttcctgtgccagcaagtagagaagtacatgaccatttttatagggatgtatggtgctccagtttacacttttgtgattcagtctttgtgtacagccc

SEQ ID NO: 56549 - DNA, 201 bp, Homo sapiens
cccccaacttttagctgccacttggctcattacagcagtaccagtatgggggtgggaggggtgaggctgtggagtgaaggcggcgtatagggcagagactragaggtcctgtgagattcttagaggagccatcctgctccaaggggcctgagctgagtgtggtctgtgagcatctgctgctcctctcagagagggagatct

SEQ ID NO: 56550 - DNA, 201 bp, Homo sapiens
agtttgtatgttctccccgtgtcgccccatccatggaggagttgaagtttggaggaggggagagtggtactccctgtcgtcaactcctcagcagaactgayagttgttgggctgcagcaagggctgggcgatatccccttgctcgcagcaggtcaggtgctcactagagctctcctcctccagctcactgctgctgctgcc

SEQ ID NO: 56551 - DNA, 201 bp, Homo sapiens
ttaccagacaagcctggtaattgaagagaccttggtgaatggctcaccagacctccccactggaagcctggctgtgccccacccccaggttggggagagtrtatcagtggtaacagtcatgagggtaagtggctttggtactgaagtctttggctttgtctggagttacttaaagggcagctagcaccatacagtgtgatt

SEQ ID NO: 56552 - DNA, 201 bp, Homo sapiens
aaagtgtgattcaaatgaagatgacactgctgttgacaggggctgaccttatctgaattaggtcaagagagtagagtttttccagtcccttttgcaggaaraaaaaagaacttacacatatatatatatctttctctctccatgtggtcttagtccatttatctctgcttgtctcccccttcctggcttcctcatcctcag

SEQ ID NO: 56553 - DNA, 201 bp, Homo sapiens
catctgttctggaaggtggccactgttactgtccctgttctcacatgaggaaatggaggcactggcgggcaggggttggcctaggagacacagtacatggwgatgttaggattcaaagagggctggctgagcctagagtgttctcatcaccagatgggttccaccttagtcattccttcttgtcaaaatgcattctcattt

SEQ ID NO: 56554 - DNA, 201 bp, Homo sapiens
attattgtcattactccctggggctcactggctccatgagcatgctggggactccagaaaagtgtcttaacctcagtcagagcctgatctttctgctcccytgcagccactggcctgaatggaccgggggcaataatagcataagtaatccaacatctgttctggaaggtggccactgttactgtccctgttctcacatga

SEQ ID NO: 56555 - DNA, 201 bp, Homo sapiens
tagatgtcagaactgataattaggaagaagggaagaataacaaaggttgagtgccccagccaggatgcattataggaagtgaaggcctctggctttgcctyggaggagtcattattgtcattactccctggggctcactggctccatgagcatgctggggactccagaaaagtgtcttaacctcagtcagagcctgatctt

SEQ ID NO: 56556 - DNA, 201 bp, Homo sapiens
accatggataacactgtatggcatgcctgttgtgatctgaagatacactggtttagaaaacactcatcttatccaaccctctccttttattaaaaggggawgctaaggcccagaggaggaaatggacttttccgggtcccacagcagattagtggcagagcccttgtctctgtgtcttggtatattgtaccagacagtatt

SEQ ID NO: 56557 - DNA, 201 bp, Homo sapiens
tattattattttttaaattatataaaattaaaaaaaaaacttaatgaactcttccattttttttttctgccaattacctgactttaggaatgaacccagcwgggcacagtgtaatcccactcatgcctgtaataccaacagtttgagaggccaaggtgggcagatcgcccgagtccaggattttgagaccagcctggccaa

SEQ ID NO: 56558 - DNA, 201 bp, Homo sapiens
aggtgaacaacttagggcttttaggccctgtatggcagtatgtcaccctctttctagacacacagaagtagcctttgaataatgtaaaactaaatgtaaamctaaaaaatgccaacatttggttgatgaaacctggagaagcttttcaataagaattcattagaagatgaacagttttattcaaacgaaggcatttaatgc

SEQ ID NO: 56559 - DNA, 201 bp, Homo sapiens; identical to SEQ ID NO: 16381

SEQ ID NO: 56560 - DNA, 201 bp, Homo sapiens
cagtcactaagacgccagtcgtcaaaagtggtgtgcagcctgaggtcactctggggacaactgacaatgacagtcctggagcagacgtaccaacaccatcygaggggacaagtacctccagtccactccctgctcctaaaaaacctacagggtaagtcagtgtgtttgtataatatagggctttggaaatgccccatgttt

SEQ ID NO: 56561 - DNA, 201 bp, Homo sapiens
cctgtgagattcttagaggagccatcctgctccaaggggcctgagctgagtgtggtctgtgagcatctgctgctcctctcagagagggagatctcactctstgccagtctgtctagccccaaagagcctggttttctcagtatcagtgtagctcctggggacttcataggcataaagtcagtccatttccatgaagataag

SEQ ID NO: 56562 - DNA, 201 bp, Homo sapiens
cacggcgtgactgttagttaggatgagtcagcttgggggagtttgtgcttcctgcttggtgtggccagccacatgccaaggtcccctgccttctagcccaraatgacgggactgggcagaacacccccaacttttagctgccacttggctcattacagcagtaccagtatgggggtgggaggggtgaggctgtggagtgaa

SEQ ID NO: 56563 - DNA, 201 bp, Homo sapiens; identical to SEQ ID NO: 16388

SEQ ID NO: 56564 - DNA, 201 bp, Homo sapiens
tgcactgtcacattggtaagtatgcagctaggtggtggtgggttgacatggaggttgttttgattttgtggttgaaggtcagtaggaggctgggggagagrgtggtggtagctgggagggagaacagggtcaggtatagattgttaatgatgaagatcccatccctgatgcaaataatagctactggatgaatctgctggg

SEQ ID NO: 56565 - DNA, 201 bp, Homo sapiens
gctgtctgacttcccttcaccaagccttggcttccctgtgtgtataatgacggggtagactgttgtgttgctgatgttctgtgactcccacagtttgaccwtctttatcctgaccttctagttcacctggcctgaattcctgggctctaatgaggtaaatgtggaggacttttgggccacgatggagacagaggtgattga

SEQ ID NO: 56566 - DNA, 201 bp, Homo sapiens
gctattgggcctttgagtgcctcactgtccgagactacaatgacatgatctgtggcatctgtggtgtggcccccaaagtggaaatggctcagaggagtgargagaatgtgctagcactgaagagcgtggaggtaagtgcctcttagccaccgtgagggacctgcggaattttctcattttggcacctcccttcctatatga

SEQ ID NO: 56567 - DNA, 201 bp, Homo sapiens
tatacggcccccacgtcacttcacaggtggtaaaatctacaaggtgtgcccccatcaggtaagaaaataactagggggagcttggagtgaatttgctaatkttgaacttcccatacagggactgatccagctcagttttggggggctagacttaggtcactgggcaacctccggcatagctgcccacgggtcaggtgctac

SEQ ID NO: 56568 - DNA, 201 bp, Homo sapiens
tcttaaaccagtaaagaggtacatgagatattcagaaaatcaacttaaattcattattatagaataattttaattttgtatgctttatcttttctttcttttttttagctatataagtaaaatatacattccttataaaacatttgaggccaggcatggtggctcttgcctgtaatcccagcactttgggaggctgaggtg

SEQ ID NO: 56569 - DNA, 201 bp, Homo sapiens
gtcttaaaccagtaaagaggtacatgagatattcagaaaatcaacttaaattcattattatagaataattttaattttgtatgctttatcttttctttcttttttttagctatataagtaaaatatacattccttataaaacatttgaggccaggcatggtggctcttgcctgtaatcccagcactttgggaggctgaggt

SEQ ID NO: 56570 - DNA, 201 bp, Homo sapiens
gacttctcaggtgaaagttgtggaggtcaagcccgatatgtttcctccatataagtacagctgcactgtcacattggtaagtatgcagctaggtggtggtrggttgacatggaggttgttttgattttgtggttgaaggtcagtaggaggctgggggagagggtggtggtagctgggagggagaacagggtcaggtataga

SEQ ID NO: 56571 - DNA, 201 bp, Homo sapiens
tcctgtcttttacttcccaagtaagaaaccaggcaactaaaccattttgtttgtgttatctcatctagaggctgtttccagattgattcaaatccgcttgyctagtagtagtgttaataataatgcagctaagatttattgagcattttattactatgccaagttcttaatctgtgctaagtgctttactatatgacttaa

SEQ ID NO: 56572 - DNA, 201 bp, Homo sapiens
tccagtgaataagtatcaaaaaatatatatagtaaatatattgaacataaactaaatgcatgttttagacacctgggagatagtagttaaacaaagtttckgtcctcatggagctcactttctggtttggaggacacaggaaacaaatatctgtccaggagtagtgagtgctgtgaagcacagtaaagctgggtaagagag

SEQ ID NO: 56573 - DNA, 201 bp, Homo sapiens
gtcatccatattgtgtttatcagtgatttattcctttttattgtggagtagttttctgtggtgtggatgtaccacaggttgtttagctgttccccatgggrggatatttggtttgctaccggtgtttggcagttacaaatagagctgctacaaatatttgtgtaccagcttttgtgtgaacctaagttttcatttctcttg

SEQ ID NO: 56574 - DNA, 201 bp, Homo sapiens
gaaaggagagggacgaaagggttgcatcctcttaccgctgaggcctgatacaagacctgtaagttgatttactgtttcggtaaatagagaatgccaacctragactttgcagattagaccaccgctgctttctcaggctccttggaaagcttttagttaatcaaagctttatttctagcagtctaggcagccctcctctct

SEQ ID NO: 56575 - DNA, 201 bp, Homo sapiens
gggctcatttggagaatagctctacaaattccccgggaaagcattccctcaagtcgtttcaggacatgggagctcaggagtttggctaaggttcaaaagcrctaaataatttgttctgatccacagctaccaagtggcccatccaacaggacttctcaggtgaaagttgtggaggtcaagcccgatatgtttcctccatat

SEQ ID NO: 56576 - DNA, 201 bp, Homo sapiens
cagatacttgtttatgtatcaaaactatcattcatagagccttcattgcaccataggcattgtgctaagtgctttacttataatatcttacttaatctgtrtaatggctctaagagattactatttttatgccccatttcacagatgaggaaattgagactcagaaagattaagtaaattgccttgggtcccacatacaca

SEQ ID NO: 56577 - DNA, 201 bp, Homo sapiens
agtaatttttttttccagctattttttccactggttcagtgatgaaggccttgggaaaaccaagccccttgttctgtttccttttctttttttgggaaaastttcatcgttttatccttcttgactctgggcttgcttgtttccattttgataatgccctgcactctcttgtcctcttcggttgcagcaatacgtggagct

SEQ ID NO: 56578 - DNA, 201 bp, Homo sapiens
agtcttaaaccagtaaagaggtacatgagatattcagaaaatcaacttaaattcattattatagaataattttaattttgtatgctttatcttttctttcttttttttagctatataagtaaaatatacattccttataaaacatttgaggccaggcatggtggctcttgcctgtaatcccagcactttgggaggctgagg

SEQ ID NO: 56579 - DNA, 201 bp, Homo sapiens
tagtcttaaaccagtaaagaggtacatgagatattcagaaaatcaacttaaattcattattatagaataattttaattttgtatgctttatcttttctttcttttttttagctatataagtaaaatatacattccttataaaacatttgaggccaggcatggtggctcttgcctgtaatcccagcactttgggaggctgag

SEQ ID NO: 56580 - DNA, 201 bp, Homo sapiens
actttggctggcttttcctggaaaaataagaataccttgtataccttgtatgcaaatatgtatgtgtgtgtgtgtatatatatttttcccattttttttttaacacaaatcatagcacaacatacatacttctacatcttgttttttatttttatgtttatttttattgtttgagacaggatctctctttgtcattcagtc

SEQ ID NO: 56581 - DNA, 201 bp, Homo sapiens
gactctgaatgcacttaagtcaccagtttggctcctggttctctcagataagactccctctgtgaggacttgtggtctgaagccaagcacactgaagcagytgggccagcccattcaacagccatctggccctggtgaggtgaaggtaaggcccattttccagagtgggagctgtttgagggtctggctgcttccatttaa

SEQ ID NO: 56582 - DNA, 201 bp, Homo sapiens
aactttggctggcttttcctggaaaaataagaataccttgtataccttgtatgcaaatatgtatgtgtgtgtgtgtatatatatttttcccattttttttttaacacaaatcatagcacaacatacatacttctacatcttgttttttatttttatgtttatttttattgtttgagacaggatctctctttgtcattcagt

SEQ ID NO: 56583 - DNA, 201 bp, Homo sapiens
ttaaaagcatatgtgtgtatatataatactattatttccactgcagtgctaattggataaaagctaagacaccaaggactttttaaagccaggtctagctraaatagcagctgccatttttagtgagtttgaatatttgtagcacataataatgcatgagttaatttgatccagtgcaaagtatgtgacatatgtgcaagt

SEQ ID NO: 56584 - DNA, 201 bp, Homo sapiens
cagcctttatgtttcctagtttacagtgccctttatgatatacatggtgggtagaaaacctttctgaagacaaccactatttaaaaacatttttaaaagcrtatgtgtgtatatataatactattatttccactgcagtgctaattggataaaagctaagacaccaaggactttttaaagccaggtctagctaaaatagca

SEQ ID NO: 56585 - DNA, 201 bp, Homo sapiens
agagctcttaagaggtcacctgttactggctcttttttttttttttttttttccagacagggacagggtctcgctctgtcacccaggcatgaatacagctmatgcagcctcagcctcctggggtcaagtgatcctgccacctcagcctctcgagtagctgggaacacaggcacacaggctgcataccaccatgcctggcta

SEQ ID NO: 56586 - DNA, 201 bp, Homo sapiens; identical to SEQ ID NO: 16401

SEQ ID NO: 56587 - DNA, 201 bp, Homo sapiens
atagccacccattcatgagccatccaaccctgagctggctttgaagacagactcggatcctgcctcccagacctggcctttttcttgtcctttgccagggrctacctgcggacatatttcttctcgaggtggatgttcttatagtcgacgcctccctcggggtcctggccggggctcaggctgggtcccagcatggcctca

SEQ ID NO: 56588 - DNA, 201 bp, Homo sapiens
agagaacagcggtgagtcaggagcaggagcgggcaggagcgggcggaccgcagctccgcaccacctatgaccgtgtcttcctcaaagagcaaaacattatwtttttttgtgtgtgattattttatttttatttttttaggctcatcagctattgttagtgttagtgtattttatgtgtgactcaagacagttcttccaatg

SEQ ID NO: 56589 - DNA, 201 bp, Homo sapiens
taccatccaaagaaaagccattattaacattttggtgtacttctttccagtctttttttctgtgaataagttctgtatctgtttttttcttcttctttccyttcttttttttttccagtagagatggggtcttcctttgttgctctggcctcaaacagtctcctgtctcggcctcccaaagtgctgggattacagcactgt

SEQ ID NO: 56590 - DNA, 201 bp, Homo sapiens
gccctggtagttctcatttgttctttttctagtttcttaaggtagaagctgatgtcattgattcaaaacctttcttttcttttcttttctttttttggtarataaggtttcactctgttgcccatgttagagtgcagtggcacaatcatggctcactgcatccttgacttcctgggatccacctacctgccccagtctctc

SEQ ID NO: 56591 - DNA, 201 bp, Homo sapiens; identical to SEQ ID NO: 16386

SEQ ID NO: 56592 - DNA, 201 bp, Homo sapiens
accttagaagactggattaaaagctgacttattttagggtttttttcagtggcggtgtgcaggatatctcactcagatgttccagggcagaaagccagttstaatagacttcaaatatctgcagaaagcgtggacctgacttgagttccacctctgccagcactgggggagggcttggtgcagagctggcttccactgttt

SEQ ID NO: 56593 - DNA, 201 bp, Homo sapiens
atcagggagaagctccattgaagagagacctgcttgagaaagacctatttttaatgagtatttcagaacattgttcctggaagcctctgactggtatacaraattaccttgtacccagaagccaccgagaattaaagacagataactttaagcagtgcagatacttgtttatgtatcaaaactatcattcatagagccttc

SEQ ID NO: 56594 - DNA, 201 bp, Homo sapiens
cagtatcttatgtgtgtctcaggcatcatgctggttgggaatcagtaaataagcagaatcctacccttactgaagcggggagggtggtggtttagcagctrtcagatgatgaattctgcagtcaaggggtgcactcagagaacacaaagcggggagtgatttatgctgccttggcaaaaaggatcagggagaagctccatt

SEQ ID NO: 56595 - DNA, 201 bp, Homo sapiens
aaccatagtaccaacatcttttttggtgagggcctcagactgcctccactcatggtggaaggcaaggggagccagcatgcatagagatcacatacagaaaraggaagcgaaactcattcaccacctcccttgctcctgccccacgataatctactcatgagggatctgcccccctgacccaagtacctccctttaggacct

SEQ ID NO: 56596 - DNA, 201 bp, Homo sapiens
acaaagtgtgtctatctgtaattaggagatagaattgagttctgtgtaggtagaagctctgagcattcctttctccttccagttcattttagctatttgcrcggtttgcagtggaagtgggtgttactctctagatctaggatgatgaaggaacttaacttctcaggtgacataggaaattatctagggacctcttgccaa

SEQ ID NO: 56597 - DNA, 201 bp, Homo sapiens
agtttttccagtcccttttgcaggaaaaaaaaagaacttacacatatatatatatctttctctctccatgtggtcttagtccatttatctctgcttgtctyccccttcctggcttcctcatcctcagaactctaagctctctgcactgactgctgtggttccggacatcccaggtttccgcaagatcctcccacgctcaga

SEQ ID NO: 56598 - DNA, 201 bp, Homo sapiens
tagtttctccattggtaaagtaaggtgggcaaggtagattagatctgggcagtttactcttaagagacaggagccttagagaagactgataattgagtttyaaggagtttataaatccctgaaattgcatgcaaaatgggtccgtagctttcatcagattctcttgctccactggatgcctgctgctggaagtaagctttc

SEQ ID NO: 56599 - DNA, 201 bp, Homo sapiens
actggggctgggagtgaccctgagttggaagcttccctctcccgagctttagtttctccattggtaaagtaaggtgggcaaggtagattagatctgggcaktttactcttaagagacaggagccttagagaagactgataattgagttttaaggagtttataaatccctgaaattgcatgcaaaatgggtccgtagctttc

SEQ ID NO: 56600 - DNA, 201 bp, Homo sapiens
aagcttagaggtttatttgtatatggagagaggcctttttgatgatgaatctcaccctggtctccagagtctgtttccgtgcttgaggtgatgttctgagkttattgtccttgtgagaaaggaaagtggaaccaaagtatgtgggcactaatggcttggtgggaaaaacactggggctgggagtgaccctgagttggaagc

SEQ ID NO: 56601 - DNA, 201 bp, Homo sapiens
aagagtgttccatttggctggaggagatggcgtgggggcatggggtgggagaaggggtgttacggaaaataagacgtgaaaagcatcttggaaccatgtcrtggaaggtcttgtcagtttgttctttagtcagtggggtcctactgaatgtccttgagccggggagaggcctagaggaaagttatttcaagaggggaattt

SEQ ID NO: 56602 - DNA, 201 bp, Homo sapiens
agtgaggagacagtcaccatcgagcaaacctcttggtcgaattattatgagtctccgtccacgcagtgccttctctgtagcagcccattattcaaaggggracaaaagtaagcaccccttaactctgcccctagctaccccatcccatttggctcatactgctcttttcttcagaaaacattaaaactataactgtgaaga

SEQ ID NO: 56603 - DNA, 201 bp, Homo sapiens
acattccacttggctccttagggctgctattattattattactattaccaggaaaaatgggcattttcagaggtccccagaatttccatatgagttttttraagtgaacagaaaatggtggcacttgaggcagcaaatggaaggactaaaataaggatgagaagagaaatgtcactggtctgccttggggaaagaggggat

SEQ ID NO: 56604 - DNA, 201 bp, Homo sapiens; identical to SEQ ID NO: 16394

SEQ ID NO: 56605 - DNA, 201 bp, Homo sapiens
tagagaagtactttagtaaagcagcttattttgtttagcctagtgtttcccacagggttttccctttatttttaacataacacatattaacgtcctaatgsacaaatgtgtgacattgggatcacccttttgtagggcaggcagcatagagcagggaaataaatgctagacagctgagagacctggtccaaaaggagttct

SEQ ID NO: 56606 - DNA, 201 bp, Homo sapiens; identical to SEQ ID NO: 16398

SEQ ID NO: 56607 - DNA, 201 bp, Homo sapiens
gaggttgcagtgagccgtgattgtgccactgcactctagcctgggcaacagagtgagactctgtttcacacacacacacacacacacacacacacacacacacacacaaatcagcaatctttttgtgcatgataaaatcctacgtaatcctggagtgatttgatttttaaaactacacactaatgtagatcattatcaaga

SEQ ID NO: 56608 - DNA, 201 bp, Homo sapiens
tggaggttgcagtgagccgtgattgtgccactgcactctagcctgggcaacagagtgagactctgtttcacacacacacacacacacacacacacacacacacacacacaaatcagcaatctttttgtgcatgataaaatcctacgtaatcctggagtgatttgatttttaaaactacacactaatgtagatcattatcaa

SEQ ID NO: 56609 - DNA, 201 bp, Homo sapiens
agtggaggttgcagtgagccgtgattgtgccactgcactctagcctgggcaacagagtgagactctgtttcacacacacacacacacacacacacacacacacacacacacaaatcagcaatctttttgtgcatgataaaatcctacgtaatcctggagtgatttgatttttaaaactacacactaatgtagatcattatc

SEQ ID NO: 56610 - DNA, 201 bp, Homo sapiens
tgatgtgggaggatcacttgagccggggaagtggaggttgcagtgagccgtgattgtgccactgcactctagcctgggcaacagagtgagactctgtttcwcacacacacacacacacacacacacacacacacacacacaaatcagcaatctttttgtgcatgataaaatcctacgtaatcctggagtgatttgattttt

SEQ ID NO: 56611 - DNA, 201 bp, Homo sapiens
cttgaggcagcaaatggaaggactaaaataaggatgagaagagaaatgtcactggtctgccttggggaaagaggggatggcacacagaacaggtcaggacytgagatggagcctggtcactccagatcaaggctggaccttgaaaggcaggcaggttttgaatggaaggggaaggcatgccatacttaagtctctcccact

SEQ ID NO: 56612 - DNA, 201 bp, Homo sapiens
tttacaaatgccaaactaattttggaaagcatgaatctttttgtgcatccagggacccttagcaagagattacgagtgacttgtagaagtaccttctttgktcatagggagacttggccccattgcatgttagactcattctgaccacacagctcctggatatctgcttccagtcccaaggctcatgccaagacctaagag

SEQ ID NO: 56613 - DNA, 201 bp, Homo sapiens
cagctgggccagcccattcaacagccatctggccctggtgaggtgaaggtaaggcccattttccagagtgggagctgtttgagggtctggctgcttccatktaatgtatcaaagctataggtaaaggcacatcccatttcttacacgttggcagacctctgggtggaggttaacatgaatgatttatctgttttttaagta

SEQ ID NO: 56614 - DNA, 201 bp, Homo sapiens
aaattttctgtgtgtccaaattccatggattagtggggttggttggttggttttttggctatatgtagctagaatagttatcaagttttttttttttttttcatgtcaaatgggtaatgtgctgacgttataatgaggtttgagggaggcacatctcacccatgtgcatgaataccagattgtcatacttgtgagctataa

SEQ ID NO: 56615 - DNA, 201 bp, Homo sapiens
agaccagcctggacaacatagcgagatttcatctctattattattttttaaattatataaaattaaaaaaaaaacttaatgaactcttccattttttttttctgccaattacctgactttaggaatgaacccagctgggcacagtgtaatcccactcatgcctgtaataccaacagtttgagaggccaaggtgggcagatc

SEQ ID NO: 56616 - DNA, 201 bp, Homo sapiens
gtggtggtgggttgacatggaggttgttttgattttgtggttgaaggtcagtaggaggctgggggagagggtggtggtagctgggagggagaacagggtcmggtatagattgttaatgatgaagatcccatccctgatgcaaataatagctactggatgaatctgctgggttgttttggtctctttccaggtgagatttat

SEQ ID NO: 56617 - DNA, 201 bp, Homo sapiens
gtaatccaacatctgttctggaaggtggccactgttactgtccctgttctcacatgaggaaatggaggcactggcgggcaggggttggcctaggagacacrgtacatggtgatgttaggattcaaagagggctggctgagcctagagtgttctcatcaccagatgggttccaccttagtcattccttcttgtcaaaatgca

SEQ ID NO: 56618 - DNA, 201 bp, Homo sapiens; identical to SEQ ID NO: 16389

SEQ ID NO: 56619 - DNA, 201 bp, Homo sapiens
aaatctgattcatggtgtttctaatacatggtattagaaactgcacagaagcatgtggcaaggcctggacttgaacatgacactcagcctttggtgggctkgtgactgccaactggcagtccagagggctcatttggagaatagctctacaaattccccgggaaagcattccctcaagtcgtttcaggacatgggagctca

SEQ ID NO: 56620 - DNA, 201 bp, Homo sapiens
attgatgcagtcatggtaagcatctgaggtcttggttctgaaaaaccttagaagactggattaaaagctgacttattttagggtttttttcagtggcggtrtgcaggatatctcactcagatgttccagggcagaaagccagttctaatagacttcaaatatctgcagaaagcgtggacctgacttgagttccacctctgc

SEQ ID NO: 56621 - DNA, 201 bp, Homo sapiens
tgttcttgtaactgaagacccttatttgtatcaatggttctcaactggtaacaattgtgcccgcaatgaacaccagaagccaattccacttttaactttgkctggcttttcctggaaaaataagaataccttgtataccttgtatgcaaatatgtatgtgtgtgtgtgtatatatatttttcccattttttttttaacaca

SEQ ID NO: 56622 - DNA, 201 bp, Homo sapiens
gatcctcctgcctcagcttcctgagtagctggtactataggcatatgacatcataccatcatacctggctttaactgaaacagctttttttttttttttttgaagatagagtcttgctctattgtccaggctggatagcacgatctcagctcactgcaacctctacctccctggttcaagtgatccttatgtctcagcctc

SEQ ID NO: 56623 - DNA, 201 bp, Homo sapiens
tggcttcggccctgaagctgattgctcatcttcctgggaagaagcgagtgagaactgtacactctctgcagactggcttcctaattaaccctgcgcccccsacccttcatctcccaggtggtctgcggctccaagtatcttgtgcgaggtgagagtgcccgtgaccatgtggacctgcttgcctcttcccgccactggccg

SEQ ID NO: 56624 - DNA, 201 bp, Homo sapiens
tataaagattgtcccttcccccggactctgctattcatgtactgctgtcagattacttacacatctcttcttgtcagtctccctaaagcattaattagagwcttgctggtataggctctgggcagtattaaaactatgagttaccagtcctggatactggatttggaaagagaatctttattaaagcatcctgtagaaaga

SEQ ID NO: 56625 - DNA, 201 bp, Homo sapiens
gtgacttcatttaaggacagaagtaggaagggagcagcatgccatgggctctggcaggatggccatggcttcggccctgaagctgattgctcatcttcctrggaagaagcgagtgagaactgtacactctctgcagactggcttcctaattaaccctgcgccccccacccttcatctcccaggtggtctgcggctccaagt

SEQ ID NO: 56626 - DNA, 201 bp, Homo sapiens
gaattgtggtacagcagtcactaagacgccagtcgtcaaaagtggtgtgcagcctgaggtcactctggggacaactgacaatgacagtcctggagcagacktaccaacaccatccgaggggacaagtacctccagtccactccctgctcctaaaaaacctacagggtaagtcagtgtgtttgtataatatagggctttgga

SEQ ID NO: 56627 - DNA, 201 bp, Homo sapiens
ttccctctcctgcagtaaataagctctgtgcacttgacttggaatttttctccatgttaactcactcttaggggctattatgtgttagaatctgagaatgctttaccaaagagctcttaagaggtcacctgttactggctcttttttttttttttttttttccagacagggacagggtctcgctctgtcacccaggcatga

SEQ ID NO: 56628 - DNA, 201 bp, Homo sapiens
caaagtgctgagactacaggcatgagattacaggccatacctggcctgttttgtttttttgagatggagtctctcactgtgttacccaagctagtcgacarctcctgggctcaagcgatcctcctgcctcatcctcccaagtgcctgcaactacaggcacgtgccaccgcacccagctggtgtgtattctattttttgcca

SEQ ID NO: 56629 - DNA, 201 bp, Homo sapiens
tgaggaaatggaggcactggcgggcaggggttggcctaggagacacagtacatggtgatgttaggattcaaagagggctggctgagcctagagtgttctcrtcaccagatgggttccaccttagtcattccttcttgtcaaaatgcattctcatttctcttctagagtgtgtcctgcccagagctcttggaccagcattat

SEQ ID NO: 56630 - DNA, 201 bp, Homo sapiens
taaaaaatgccaacatttggttgatgaaacctggagaagcttttcaataagaattcattagaagatgaacagttttattcaaacgaaggcatttaatgctrtagtgaaaggaacctgtagccagaaaacttagattcaggctagttttacacttgagatcttaagttaacttcttcctttcatggaccttagtttccttat

SEQ ID NO: 56631 - DNA, 201 bp, Homo sapiens
tgagtttccagctaaggaaaaatagattttgaaaaagcgacttactaaattcacacagccaattatcccattgccttttccactaaaccacacttctcagkcattgctgtgctgtttagctgcagaatgtaagacaagcttgtccaacctatggcccaggatggctttgaatgaagcccaacacaaattcataaactatct

SEQ ID NO: 56632 - DNA, 201 bp, Homo sapiens
actacctggtcttcccaaacactggagcaattttcggagcttctggaaccaatgtttcttcagcaccttcgctatcttcctgatggagatcatatgaaatsttcccatattctcttaaaaatgggaaaatttcaagcagaaactggcagaagtctctgcgaataccaaaccaccaatgattgcccctttttggcctaaatg

SEQ ID NO: 56633 - DNA, 201 bp, Homo sapiens
ggtggtaaaatctacaaggtgtgcccccatcaggtaagaaaataactagggggagcttggagtgaatttgctaatgttgaacttcccatacagggactgawccagctcagttttggggggctagacttaggtcactgggcaacctccggcatagctgcccacgggtcaggtgctaccccgtgggctagggagggaggctgg

SEQ ID NO: 56634 - DNA, 201 bp, Homo sapiens
cacattgggatgagtacactgtctgttattaaacttaatccaggcttccagtgttgagtggcctgggtgttctttattactctgtttcagtgaaactgtcyttctcttcattgcccataggattccagtgagagtagctcctctgcaccagccacacagttcatcatgttgcctctgcctgcctactcggttgtggagaac

SEQ ID NO: 56635 - DNA, 201 bp, Homo sapiens; identical to SEQ ID NO: 16391

SEQ ID NO: 56636 - DNA, 201 bp, Homo sapiens
gcttcctgaccgacttgttccttggcgagagagaacagcggtgagtcaggagcaggagcgggcaggagcgggcggaccgcagctccgcaccacctatgacygtgtcttcctcaaagagcaaaacattatatttttttgtgtgtgattattttatttttatttttttaggctcatcagctattgttagtgttagtgtatttt

SEQ ID NO: 56637 - DNA, 201 bp, Homo sapiens
attaattaaccctttccctattgatgggcatttagttgtggggtttttgttttgcctttttcaagatatataacttgaataaaatagagatggggctttgytatgttgtccaggctggtcttgaactcctgggctcaagcgatcctcccaccttgggagactacaggtctcccaaagtgctgagactacaggcatgagatt

SEQ ID NO: 56638 - DNA, 201 bp, Homo sapiens
cctttcctttagccatggacgcatcatatgatggtactgaggtaactgtcgtgatggaggaaattgaggaagcctattgttacacctctcctgggccaccyaagaagaagaaaaagtataaaatacatggagaaaagacaaagaaacccaggttagccaacacattttggttgctgctagcatttataaacagaagttgct

SEQ ID NO: 56639 - DNA, 201 bp, Homo sapiens
tctctgaagccatcagtgtattcacaatgtattccccaaaaaggcagttctctaactgcagtggggagattgaactggatagtagtcagaatcttccttgrcctttcttgaccaatgcgaaacaggtctcaaatgaccatatttcctgtgcttatacatgaaagactgtcagtgatcactgtgggcttatccctccttcag

SEQ ID NO: 56640 - DNA, 201 bp, Homo sapiens
agaaaaagtataaaatacatggagaaaagacaaagaaacccaggttagccaacacattttggttgctgctagcatttataaacagaagttgcttggagagytgcattgaggaaaacttttaagactctttgaaaaagagtgttatgattgaagtcctgtgtcgagggatggggagtgggaagtggagggatttctgccagc

SEQ ID NO: 56641 - DNA, 201 bp, Homo sapiens
aaatcatttccattgtatatagtttgtttaaaaaatacaaaagaaaaatggaataaattgttatccaaactcatataccatccaaagaaaagccattattracattttggtgtacttctttccagtctttttttctgtgaataagttctgtatctgtttttttcttcttctttcccttcttttttttttccagtagagatg

SEQ ID NO: 56642 - DNA, 201 bp, Homo sapiens
catttaaacctcagtagtaataatacgtacttaatacgattgctgagagtattaaatgaaatattggtaaagtgtttagcattgtgtggtgcctagctcartgcatagcaactatcactttcttcattcttctggtacctaactgtaatgttgggcaattgtctttccccatttgaacttagtttctccatttctaaagag

SEQ ID NO: 56643 - DNA, 201 bp, Homo sapiens
ataggaagaacaggcgattttacagaggaagaaactcagggcccaagagttaaggttccttaccaccaggtcactcagtgtattagtggcaaaattggaasccaaagcctggtcttcctctttttggtgccataccacttcacgctcatccttgacttaataccactgtcataattggaagccataattgaagccttttcc

SEQ ID NO: 56644 - DNA, 201 bp, Homo sapiens
gaaagccagttctaatagacttcaaatatctgcagaaagcgtggacctgacttgagttccacctctgccagcactgggggagggcttggtgcagagctggyttccactgtttgctgttttgtgggcctagccttggcctctggtgactggcggcagcaccctcccaccagcactgttgtctcttgcaggcagtggcagtgc

SEQ ID NO: 56645 - DNA, 201 bp, Homo sapiens
tcaacagaatttgggtgggtagaaaaggaaagagaggacattattttagtgaaaatggcttaggttaggttcgtgattatcacatgtttaactcagcatgrtccaaacttgtatgtgtagaaaaaccttgtatagcagcataccttaaacttctctggggcaattttcacatctctttgagaaatactgggatggtgactt

SEQ ID NO: 56646 - DNA, 201 bp, Homo sapiens
gaagaagtggagacaggcctcatctccacataggtgtccacaccctggctggagaagccactgtccctacataggagagagggttggggggcagaggtcastcatcatcactgcactgctcagctcaggccttgaccacccaccaccccatggtcaactggaacctccctttctgataagaaaccctcctgccacactcca

SEQ ID NO: 56647 - DNA, 201 bp, Homo sapiens; identical to SEQ ID NO: 16378

SEQ ID NO: 56648 - DNA, 201 bp, Homo sapiens
ttcctgcttggtgtggccagccacatgccaaggtcccctgccttctagcccagaatgacgggactgggcagaacacccccaacttttagctgccacttggstcattacagcagtaccagtatgggggtgggaggggtgaggctgtggagtgaaggcggcgtatagggcagagactaagaggtcctgtgagattcttagagg

SEQ ID NO: 56649 - DNA, 201 bp, Homo sapiens
gaaagacgttccagggaatttgcaggtactcatgtggcacaaagaaccagaggctgactgcattaatgctgttagtttaatgtggacagagacatcccackgcgtgactgttagttaggatgagtcagcttgggggagtttgtgcttcctgcttggtgtggccagccacatgccaaggtcccctgccttctagcccagaat

SEQ ID NO: 56650 - DNA, 201 bp, Homo sapiens
ccccacgtcacttcacaggtggtaaaatctacaaggtgtgcccccatcaggtaagaaaataactagggggagcttggagtgaatttgctaatgttgaactwcccatacagggactgatccagctcagttttggggggctagacttaggtcactgggcaacctccggcatagctgcccacgggtcaggtgctaccccgtggg

SEQ ID NO: 56651 - DNA, 201 bp, Homo sapiens; identical to SEQ ID NO: 16380

SEQ ID NO: 56652 - DNA, 201 bp, Homo sapiens
cccccacgtcacttcacaggtggtaaaatctacaaggtgtgcccccatcaggtaagaaaataactagggggagcttggagtgaatttgctaatgttgaacmtcccatacagggactgatccagctcagttttggggggctagacttaggtcactgggcaacctccggcatagctgcccacgggtcaggtgctaccccgtgg

SEQ ID NO: 56653 - DNA, 201 bp, Homo sapiens; identical to SEQ ID NO: 16384

SEQ ID NO: 56654 - DNA, 201 bp, Homo sapiens
ttcccatacagggactgatccagctcagttttggggggctagacttaggtcactgggcaacctccggcatagctgcccacgggtcaggtgctaccccgtgrgctagggagggaggctgggtcttctctcagtattttttaagcaccctaccacatcctgggcatcagctgttgagggtataagggcgagcttgtataaaga

SEQ ID NO: 56655 - DNA, 201 bp, Homo sapiens; identical to SEQ ID NO: 16385

SEQ ID NO: 56656 - DNA, 201 bp, Homo sapiens
taggagacacagtacatggtgatgttaggattcaaagagggctggctgagcctagagtgttctcatcaccagatgggttccaccttagtcattccttcttrtcaaaatgcattctcatttctcttctagagtgtgtcctgcccagagctcttggaccagcattatactgtggacatgacagaaactgagcactctatccag

SEQ ID NO: 56657 - DNA, 201 bp, Homo sapiens
tgaggctccaaggcccgctctgacccaggcagtttattcttttgctttgggtgttgggtgagtgtgtgatgctgagcaccagccgtggtcccttagcattygcccttatgtttttaatcttgtccttctactccaggaccagctctgcttctccttgttggccctctacgaatctgtacagaatggagctagagctatacg

SEQ ID NO: 56658 - DNA, 201 bp, Homo sapiens
gtgtggaatcccctttggggcagaagactccaaggtgagtgtcaagggcagtggtggatatcggggcttctggagtaggctgattggtccactttttaggkcagggatatgaatatctgtgatggcatctgccttggacacaaggtgctggcagtcagggatgcctaggagatggtcaacagctagatgtgacatgtatgt

SEQ ID NO: 56659 - DNA, 201 bp, Homo sapiens
ccaatactatcctctaagaaagcactatgtagagattgcgctttggttttcttccctttgttccagaatttccagatttctcttcttattcttttcagagytgacctgcttacccctgggtccagagctccagagcttaaaggcagagcacggggcaagccctcattactggctgcagcaagacccatgagagcaattttg

SEQ ID NO: 56660 - DNA, 201 bp, Homo sapiens
ccagacctcaggttctagctcacagtttcatatggcaagaccagtgctctttccagagttcagtccatgctgtttcctgtgtgactgagtgaataagctayattggctaaagtgtgattcaaatgaagatgacactgctgttgacaggggctgaccttatctgaattaggtcaagagagtagagtttttccagtccctttt

SEQ ID NO: 56661 - DNA, 201 bp, Homo sapiens
gccttcttgatacttagaagacctggcctggagtcccagctttactgtttactaattttgtgtttagggaaagtttacctccctgagtttcatcctaaatyttctcatttgttaaatgggaataataatcttatctaacataatagtgttgtttttaagataaaatcagataatgtgtttgaaaacattttctaaacctga

SEQ ID NO: 56662 - DNA, 201 bp, Homo sapiens
ggatcctgtaagtaatttttttttccagctattttttccactggttcagtgatgaaggccttgggaaaaccaagccccttgttctgtttccttttcttttyttgggaaaagtttcatcgttttatccttcttgactctgggcttgcttgtttccattttgataatgccctgcactctcttgtcctcttcggttgcagcaat

SEQ ID NO: 56663 - DNA, 201 bp, Homo sapiens
tcgacttcttgcttttgatttattgaagaatccttttgtagttgactttagtgttcattttaaaagatacttctgaaatttttttttgttctgtttaattktaggtctcatttaactgttcactttgaacttttctgttttccttattgggtgcctttaagtttaaattgaaaaaataaaacataaatgactttttcttgg

SEQ ID NO: 56664 - DNA, 201 bp, Homo sapiens
cagtgatatgccttctagtctataaaatgagtatcattcaggccttccaggtttctttgtgcttggatttgttaagtccaggccatgctgtgtgtatttgycaccatttagtcttgttctcctaacatggctgcttcaaagggtggcttgagaatgccatttccccattacctctccaataaaggctccataaaagattca

SEQ ID NO: 56665 - DNA, 201 bp, Homo sapiens; identical to SEQ ID NO: 16396

SEQ ID NO: 56666 - DNA, 201 bp, Homo sapiens
tccttatttgttgcctcagtgctgtttatgataatgaagcgtgcaactagccggttgttgttgttgttggttggttttttttggtttttttttttttttttgagacggagttttgctcttgtcacccaggctggagtgcagtggcacaatctcggctcactgcaacctccacctcccgggttcaagagattctcctgcctc

SEQ ID NO: 56667 - DNA, 201 bp, Homo sapiens
tttgccttggaggagtcattattgtcattactccctggggctcactggctccatgagcatgctggggactccagaaaagtgtcttaacctcagtcagagcmtgatctttctgctcccctgcagccactggcctgaatggaccgggggcaataatagcataagtaatccaacatctgttctggaaggtggccactgttactg

SEQ ID NO: 56668 - DNA, 201 bp, Homo sapiens
tcaggaataagattataacttattataacaccatctgaggatgttatttaaatgtttgtttgcttgactttcagtccctatttagataaatgcttagaaakgagaagctaggttttatcaacctcttgactacccatatcttagcatagtagtacttactggttgaatgaagtcctgggtcgagggatggggagtgggaag

SEQ ID NO: 56669 - DNA, 201 bp, Homo sapiens
aagagctacattatttattattatgccattgttgttatttaaacatttaaaacaaagcattaataaaattacaaaattagaaataaggctgggcgtgatgkctcatgcctgtaatcccagcagtttggaaggctgagacgggtggatcacctgaggtcaggagttcgagaccagcctgaccaacgtggagaaaccccgtct

SEQ ID NO: 56670 - DNA, 201 bp, Homo sapiens; identical to SEQ ID NO: 16402

SEQ ID NO: 56671 - DNA, 201 bp, Homo sapiens
tggatggtttaattaatgcaggtctccttcactaactgaagaagccaatgaagtttgtctacattatatattgcacaaattggcaggatatttaaatatgyttttatttttatacgcatctgtgaagaatctgaattgaacagtaagaattagaaaactatcttttgaatgactgaatatagacctattcataaagaaatt

SEQ ID NO: 56672 - DNA, 201 bp, Homo sapiens
ggtaagaatttttttttttatgagcaatgcattcttgatttttctacccaatattaaaatgatttctgctctatttcattggatggtttaattaatgcagktctccttcactaactgaagaagccaatgaagtttgtctacattatatattgcacaaattggcaggatatttaaatatgtttttatttttatacgcatctg

SEQ ID NO: 56673 - DNA, 201 bp, Homo sapiens
tattaaaatgatttctgctctatttcattggatggtttaattaatgcaggtctccttcactaactgaagaagccaatgaagtttgtctacattatatattrcacaaattggcaggatatttaaatatgtttttatttttatacgcatctgtgaagaatctgaattgaacagtaagaattagaaaactatcttttgaatgac

SEQ ID NO: 56674 - DNA, 201 bp, Homo sapiens
tcttacattaggaagaatccactatctcactaatggaagaaaagattctttgagtgctgttctctgaaacacaccaaaaagatccagaaatgtttccttcmctctttaactgaaaaatgactttttttgttgtttacagtaagaaaatggcagcgtgtaatgataacttccagatctgaaaatgttaaattctaggagatg

SEQ ID NO: 56675 - DNA, 201 bp, Homo sapiens
aaactcatatagtataaaactataatactactttttcttaacttagatgtaaaccttaaagataaattcttctgtttgttaacacctttcagacttatgtrtatgaaggagtagaagccaaaaggatctttaaaaaggattgagcattattcttggcgcacagtccaaaatacaaattggacagaagatctatattgtacc

SEQ ID NO: 56676 - DNA, 201 bp, Homo sapiens; identical to SEQ ID NO: 16407

SEQ ID NO: 56677 - DNA, 201 bp, Homo sapiens
tgctctatttcattggatggtttaattaatgcaggtctccttcactaactgaagaagccaatgaagtttgtctacattatatattgcacaaattggcaggrtatttaaatatgtttttatttttatacgcatctgtgaagaatctgaattgaacagtaagaattagaaaactatcttttgaatgactgaatatagacctat

SEQ ID NO: 56678 - DNA, 201 bp, Homo sapiens
gtacagaacgagaattaagaattaataagaataagaattaattaattgcttgacatagagtagttaggtgatttcctgaactttaagcttccacatcacartatgaagttggttcaagataagaaatataataaattctcgcccaaggacagacctgaatctctagctgcctagaggctgactcaactgaaatcatggcgt

SEQ ID NO: 56679 - DNA, 201 bp, Homo sapiens
aaagaccgcatgttctcacttataggtgggaattgaacaatgagaacacttagacacaggaaggggaacatcacacaccggggcctgttatggggtggggrgagggggtagggatagcattaggaggtatacctaatgttaaatgacgagttaatgggtgcagcacaccaacatggcacatgtgtacatatgtaacaaacc

SEQ ID NO: 56680 - DNA, 201 bp, Homo sapiens
atcattttcaacaaattttttaaaaactttttttagcctcaacatttttctatttaaattacatgtttgtaatgacaatttaactactgaatgttttatcrtaagttatgtctttctttaattagtaccacaatcacacaaattaaaacaagcacagagttgttaacatctccatgaaactaattttaaccatgactatat

SEQ ID NO: 56681 - DNA, 201 bp, Homo sapiens
tttttaaaaactttttttagcctcaacatttttctatttaaattacatgtttgtaatgacaatttaactactgaatgttttatcataagttatgtctttcyttaattagtaccacaatcacacaaattaaaacaagcacagagttgttaacatctccatgaaactaattttaaccatgactatatttctggacacgtaaca

SEQ ID NO: 56682 - DNA, 201 bp, Homo sapiens
aaagataaattcttctgtttgttaacacctttcagacttatgtgtatgaaggagtagaagccaaaaggatctttaaaaaggattgagcattattcttggcrcacagtccaaaatacaaattggacagaagatctatattgtaccagaactatttatttcaccccatcaagtataaggttactgattgattggtccttttat

SEQ ID NO: 56683 - DNA, 201 bp, Homo sapiens
catgtttgtaatgacaatttaactactgaatgttttatcataagttatgtctttctttaattagtaccacaatcacacaaattaaaacaagcacagagttrttaacatctccatgaaactaattttaaccatgactatatttctggacacgtaacatgaaagattcagaaagaagtgctgctcatctgccttaaaattcag

SEQ ID NO: 56684 - DNA, 201 bp, Homo sapiens; identical to SEQ ID NO: 16405

SEQ ID NO: 56685 - DNA, 201 bp, Homo sapiens; identical to SEQ ID NO: 16404

SEQ ID NO: 56686 - DNA, 201 bp, Homo sapiens
gacaatttaactactgaatgttttatcataagttatgtctttctttaattagtaccacaatcacacaaattaaaacaagcacagagttgttaacatctccrtgaaactaattttaaccatgactatatttctggacacgtaacatgaaagattcagaaagaagtgctgctcatctgccttaaaattcagcgtatggaaatt

SEQ ID NO: 56687 - DNA, 201 bp, Homo sapiens
ttctaactcctaaatctctaggagattacagatagcttacagatagctcctgatgtggtagagaggatccagaagatgttcagaggagggaaaccatattytcccttcttacattaggaagaatccactatctcactaatggaagaaaagattctttgagtgctgttctctgaaacacaccaaaaagatccagaaatgttt

SEQ ID NO: 56688 - DNA, 201 bp, Homo sapiens
tacaggtgttaatatagtgaaaaggaagcttgcagctcatgacaatttgaagctgacaattacacaagaaggaaataaattcacagtcaaagaatcaagcrcttttcgaaacattgaagttgtttttgaacttggtgtcacctttaattacaatctagcagacggaactgaactcagggtaagaatttttttttttatgag

SEQ ID NO: 56689 - DNA, 201 bp, Homo sapiens
attatattacctccaacatagtctgcactttgaacttagaaaaacaatcttcagacggcatgcattctaattcttgaaataagtatgcccacaaactgtartttaagacagaataggtatgcttctcatgttttaattcagttgaatttcagaagatctcaggaatgtacagaacgagaattaagaattaataagaataag

SEQ ID NO: 56690 - DNA, 201 bp, Homo sapiens
tatgtaatttgttcataaaatatacatatcaggtattattattgtcttcattttattgatgagaaaactgaggctcagagagattgagtaagtaatgtgaygaagattctgcagagtaatgtatgtttagtcagcactgaaacccaagtcaatgggtcttgtttctaaaacacatgttcttttcactctaccatacgttta

SEQ ID NO: 56691 - DNA, 201 bp, Homo sapiens
caccatttatatcctttctagaattaaatttccactatttattagtattggagaacagcctattatttgttaagtgacttccatttcaacaaccgtttttygggaaaaccaaccttgtcattacaccaccctgcttggccaaaagagggtccctgacccaagagcagccaatctaccacaatttggccagatcatgagctc

SEQ ID NO: 56692 - DNA, 201 bp, Homo sapiens
gaaaaacaaaggggcatttaagaaaaaagaatactgtatatgtggaattaaagatgtgcttccttataaatatatgaatatacattttaatccttcatttratatttctagaatttgatttacttaacactgaaatgaacagtttgttaatcttattaaggttgctcagctctaagattctataattctgtactctactta

SEQ ID NO: 56693 - DNA, 201 bp, Homo sapiens
ttaagaattaataagaataagaattaattaattgcttgacatagagtagttaggtgatttcctgaactttaagcttccacatcacagtatgaagttggttyaagataagaaatataataaattctcgcccaaggacagacctgaatctctagctgcctagaggctgactcaactgaaatcatggcgtttgacagcacttgg

SEQ ID NO: 56694 - DNA, 201 bp, Homo sapiens
catactctgtagcccaatggcctaggttcaatcctcactctgtgactttaggtgaatcactgtgccattttacagtctcctcttctgcaaagtagagatartagtatcagtttcatagggtcaccatgaagattaaatgaaaaagtgtgtctacagaactcagaacagtgcctgacatgtgtaagaccctaataaatgcca

SEQ ID NO: 56695 - DNA, 201 bp, Homo sapiens
agctctaagattctataattctgtactctacttaatttttctcaagttatggaaaaacaactttaatcagttctcttgatcggattgaacctgaacttctrtagaagcaatctgaatgttcttgtgcaaaggcaatgctaccgagttttcttcccaccctcaaaataaacaaacaaaacataacttggaaaaataaacact

SEQ ID NO: 56696 - DNA, 201 bp, Homo sapiens
tgacaattacacaagaaggaaataaattcacagtcaaagaatcaagcgcttttcgaaacattgaagttgtttttgaacttggtgtcacctttaattacaayctagcagacggaactgaactcagggtaagaatttttttttttatgagcaatgcattcttgatttttctacccaatattaaaatgatttctgctctatttc

SEQ ID NO: 56697 - DNA, 201 bp, Homo sapiens
ggccagaagcagaccttgcaggtgccactgtagtcaccattttgaaccttgtgtgtaggctgatgagaacattcagagccctcctgcccacctcaaacaaraagtcctctcgagagaactagcaaagctggttcacaaggtctgtcaggacagaattatccagcacatgccttcccacaatatttttttaacagtgagatt

SEQ ID NO: 56698 - DNA, 201 bp, Homo sapiens; identical to SEQ ID NO: 16411

SEQ ID NO: 56699 - DNA, 201 bp, Homo sapiens
cagatgtttgctctttccaagaaattgatacacatgctgatttctgtgccttttttacttgttctttccgtagaatgtacaccctccactctaacaccctwctctaaccatccttgaacacctatgtaacatcacctttatcagaaaacttctcagccagatacagaaatcattccaatgacctgacctgtgttcacacag

SEQ ID NO: 56700 - DNA, 201 bp, Homo sapiens
tgtctacatgtgggctctggctgcccagagggtcctgccctgcccacagagaatcccccacttgacagcactcagggaccacacccaacactctacttttrctcttctctgacctcttgaaatgttcgatttcttccaccctctgttttaatgttgtctttgataaacaaatatgaaatgcttataatccttgcctgtgtc

SEQ ID NO: 56701 - DNA, 201 bp, Homo sapiens
aaaaaaaaaaaaaaatgtgaaaaacgagtgaaaaaaaaaaacaaaattaataaatgtaagccaataataaaaataatgaaaatcatgaaatagaaaaataaacaacagagacaatcaacggtcaatttttctgtactccctgcacaaaacttcatttcaaaataattttatatttaaatatatatccagaaccacagagat

SEQ ID NO: 56702 - DNA, 201 bp, Homo sapiens
aaaaaaaaaaaaaatgtgaaaaacgagtgaaaaaaaaaaacaaaattaataaatgtaagccaataataaaaataatgaaaatcatgaaatagaaaaataaacaacagagacaatcaacggtcaatttttctgtactccctgcacaaaacttcatttcaaaataattttatatttaaatatatatccagaaccacagagatc

SEQ ID NO: 56703 - DNA, 201 bp, Homo sapiens; identical to SEQ ID NO: 16421

SEQ ID NO: 56704 - DNA, 201 bp, Homo sapiens
aaaaaaaaaaaaatgtgaaaaacgagtgaaaaaaaaaaacaaaattaataaatgtaagccaataataaaaataatgaaaatcatgaaatagaaaaataaacaacagagacaatcaacggtcaatttttctgtactccctgcacaaaacttcatttcaaaataattttatatttaaatatatatccagaaccacagagatct

SEQ ID NO: 56705 - DNA, 201 bp, Homo sapiens
aaccagagaacatcccactctcaggctgttacccacatcaccaccagcagcctcttccctgactcccccactccaggaccttcttggagttgcctgacaaygggaagaggttgggagtagacaaaacatggcagaggcatcaggagagcaagtggtcctgcttgtaccccaggaaggaatttctccagcttcgaatttttc

SEQ ID NO: 56706 - DNA, 201 bp, Homo sapiens
gcaaaaaaaatggggtggaggaaaatgaggcatctgtgtgagtatataaccatttgacatctctttttagccctctccagggtcaccctagaatcagatcygctccccagcatcttctgtttcctggtgagtgattcctgctactttggatggccatgacgggctggagctgccttgtgacaggagcaggagggtttctgg

SEQ ID NO: 56707 - DNA, 201 bp, Homo sapiens
catccaaagtcatcaagaaataaatattaaatagtataaaatggcatagtatgaaagatactgggtgggatttccagagactagattctggccctgacccrgaacttgagaagcagccacctcagcctccaggcctcttttcttctcatctagaaaatcccacatcagttctttgtcttgtctgcaactcttttatgttct

SEQ ID NO: 56708 - DNA, 201 bp, Homo sapiens; identical to SEQ ID NO: 16410

SEQ ID NO: 56709 - DNA, 201 bp, Homo sapiens
tccttagtatcctttgtgagggcaaaataaaaggaagttaaggtaaagatgagtgtataagtgggtgtgtgtgacagagagagaggaaaacaataaggggragagagagtcggggagagagagtcggggagagagactcagagagagagacaatgagaaagacagagaaataatgaaaaatatatagtgagagagagagca

SEQ ID NO: 56710 - DNA, 201 bp, Homo sapiens; identical to SEQ ID NO: 16412

SEQ ID NO: 56711 - DNA, 201 bp, Homo sapiens
aaaaaaaaaaaaaaaatgtgaaaaacgagtgaaaaaaaaaaacaaaattaataaatgtaagccaataataaaaataatgaaaatcatgaaatagaaaaataaacaacagagacaatcaacggtcaatttttctgtactccctgcacaaaacttcatttcaaaataattttatatttaaatatatatccagaaccacagaga

SEQ ID NO: 56712 - DNA, 201 bp, Homo sapiens
tccactctaacaccctactctaaccatccttgaacacctatgtaacatcacctttatcagaaaacttctcagccagatacagaaatcattccaatgacctracctgtgttcacacagaactccagaacaagaccaagctgacagtgctggaaggagacattctggatgagccattcctgaagagagcctgccaggacgtct

SEQ ID NO: 56713 - DNA, 201 bp, Homo sapiens
aacacctatgtaacatcacctttatcagaaaacttctcagccagatacagaaatcattccaatgacctgacctgtgttcacacagaactccagaacaagaycaagctgacagtgctggaaggagacattctggatgagccattcctgaagagagcctgccaggacgtctcggtcatcatccacaccgcctgtatcattgat

SEQ ID NO: 56714 - DNA, 201 bp, Homo sapiens; identical to SEQ ID NO: 16413

SEQ ID NO: 56715 - DNA, 201 bp, Homo sapiens
tgacctgtgttcacacagaactccagaacaagaccaagctgacagtgctggaaggagacattctggatgagccattcctgaagagagcctgccaggacgtytcggtcatcatccacaccgcctgtatcattgatgtcttcggtgtcactcacagagagtctatcatgaatgtcaatgtgaaaggtatggtaggctggggag

SEQ ID NO: 56716 - DNA, 201 bp, Homo sapiens
acgaccaaatctcagacagaaccacagaagaatgtaccctgagtctgttacaaccaccatatttgggagtggggggtggggcacatagatctgtgttcgtrgttggcacctcttagggatatatcctgacagtgacaatatgctcttcatggacaggtacccagctcctgttagaggcctgtgtccaagctagtgtgccag

SEQ ID NO: 56717 - DNA, 201 bp, Homo sapiens; identical to SEQ ID NO: 16416

SEQ ID NO: 56718 - DNA, 201 bp, Homo sapiens
tacttttctaaaatgagatgggagagaaacagatgtttgctctttccaagaaattgatacacatgctgatttctgtgccttttttacttgttctttccgtrgaatgtacaccctccactctaacaccctactctaaccatccttgaacacctatgtaacatcacctttatcagaaaacttctcagccagatacagaaatca

SEQ ID NO: 56719 - DNA, 201 bp, Homo sapiens
agtacgaccaaatctcagacagaaccacagaagaatgtaccctgagtctgttacaaccaccatatttgggagtggggggtggggcacatagatctgtgttygtggttggcacctcttagggatatatcctgacagtgacaatatgctcttcatggacaggtacccagctcctgttagaggcctgtgtccaagctagtgtgc

SEQ ID NO: 56720 - DNA, 201 bp, Homo sapiens
tgttcacacagaactccagaacaagaccaagctgacagtgctggaaggagacattctggatgagccattcctgaagagagcctgccaggacgtctcggtcrtcatccacaccgcctgtatcattgatgtcttcggtgtcactcacagagagtctatcatgaatgtcaatgtgaaaggtatggtaggctggggaggagatgc

SEQ ID NO: 56721 - DNA, 201 bp, Homo sapiens
attttggtatttttcttatggctgtagtacgaccaaatctcagacagaaccacagaagaatgtaccctgagtctgttacaaccaccatatttgggagtggsgggtggggcacatagatctgtgttcgtggttggcacctcttagggatatatcctgacagtgacaatatgctcttcatggacaggtacccagctcctgtta

SEQ ID NO: 56722 - DNA, 201 bp, Homo sapiens
cagtgctggaaggagacattctggatgagccattcctgaagagagcctgccaggacgtctcggtcatcatccacaccgcctgtatcattgatgtcttcggwgtcactcacagagagtctatcatgaatgtcaatgtgaaaggtatggtaggctggggaggagatgcagcaaggtggggaattaaggatcacaaagaagggc

SEQ ID NO: 56723 - DNA, 201 bp, Homo sapiens; identical to SEQ ID NO: 16418

SEQ ID NO: 56724 - DNA, 201 bp, Homo sapiens
ctatgtaacatcacctttatcagaaaacttctcagccagatacagaaatcattccaatgacctgacctgtgttcacacagaactccagaacaagaccaagytgacagtgctggaaggagacattctggatgagccattcctgaagagagcctgccaggacgtctcggtcatcatccacaccgcctgtatcattgatgtctt

SEQ ID NO: 56725 - DNA, 201 bp, Homo sapiens
gtttccagcatctccccacaacccactgcttgctcagtgactccaggatggtccttgtgacaaagttttattagagcccagcaaaatgagaaaagtaccawcaatttcatatatattgaagagtttatattgcctatatacaatggtgtatgtgtgtgtgtgatgtgaattcttcaactgcccattttgcctaaggactgg

SEQ ID NO: 56726 - DNA, 201 bp, Homo sapiens
agactcttgatacccagacaccccttgcctcccaggccagaagcagaccttgcaggtgccactgtagtcaccattttgaaccttgtgtgtaggctgatgaraacattcagagccctcctgcccacctcaaacaagaagtcctctcgagagaactagcaaagctggttcacaaggtctgtcaggacagaattatccagcaca

SEQ ID NO: 56727 - DNA, 201 bp, Homo sapiens
ctcaataagtttgtaattttattaacatcagttaaattatcctcctgctgaattatctattgggctttcctgaataaaaagtgattgcattcaatttttaycagcacttaaatactgtgtgtatttttgaatgtttactgtctttattattaactaaatcatgaaaattcttatctaaatatcctatttaattagtttata

SEQ ID NO: 56728 - DNA, 201 bp, Homo sapiens
ttcaattagctatacagcatgtgtgaccacacaccaggcaagctatgtcattttttaaacatatatatatatatatatatatatatatatatatatttaaaatatatatatgctattttcatagtaagtataaaattgaaatagcctcaaataaattgaggaaaaacatttatagaacattaagaacttgcaaactttgat

SEQ ID NO: 56729 - DNA, 201 bp, Homo sapiens
cttcaattagctatacagcatgtgtgaccacacaccaggcaagctatgtcattttttaaacatatatatatatatatatatatatatatatatatatttaaaatatatatatgctattttcatagtaagtataaaattgaaatagcctcaaataaattgaggaaaaacatttatagaacattaagaacttgcaaactttga

SEQ ID NO: 56730 - DNA, 201 bp, Homo sapiens
gtataacttgctgaacagaactttatcctctggattttctaacaaaaataatcttaaactccttctatagaaaagtactaactgcatgtagggattctctyatttgaggtcctggagagcctgaggttttcttttagtaatcctttccattaccaagattccttactcattaggccatgcaaatgacaatggcattagaga

SEQ ID NO: 56731 - DNA, 201 bp, Homo sapiens
gatcttcaattagctatacagcatgtgtgaccacacaccaggcaagctatgtcattttttaaacatatatatatatatatatatatatatatatatatatttaaaatatatatatgctattttcatagtaagtataaaattgaaatagcctcaaataaattgaggaaaaacatttatagaacattaagaacttgcaaactt

SEQ ID NO: 56732 - DNA, 201 bp, Homo sapiens
aacatacctatcagacttcaaaaaatgttaatatgtgctatgagaaaacaagatactaaaggtataacttgctgaacagaactttatcctctggattttcyaacaaaaataatcttaaactccttctatagaaaagtactaactgcatgtagggattctcttatttgaggtcctggagagcctgaggttttcttttagtaa

SEQ ID NO: 56733 - DNA, 201 bp, Homo sapiens
ttgcctgtcttattactactctatttgctgcctagaacagtgccaggtgcatagaaagagctcaataaaactctgtaaaatcatggattattagatgggtktggcatccagaggggagatcaaggctagagatataaatttggcaaagcattggtatatagaaatgtattaagtcatgaatgtggatgatactgaaagaaa

SEQ ID NO: 56734 - DNA, 201 bp, Homo sapiens
tgatcttcaattagctatacagcatgtgtgaccacacaccaggcaagctatgtcattttttaaacatatatatatatatatatatatatatatatatatatttaaaatatatatatgctattttcatagtaagtataaaattgaaatagcctcaaataaattgaggaaaaacatttatagaacattaagaacttgcaaact

SEQ ID NO: 56735 - DNA, 201 bp, Homo sapiens
atgatcttcaattagctatacagcatgtgtgaccacacaccaggcaagctatgtcattttttaaacatatatatatatatatatatatatatatatatatwtttaaaatatatatatgctattttcatagtaagtataaaattgaaatagcctcaaataaattgaggaaaaacatttatagaacattaagaacttgcaaac

SEQ ID NO: 56736 - DNA, 201 bp, Homo sapiens
cacagaatttaaaaaaataataataattcctctgtctaaggaatattccctataaaaagtaaacactaacatacctatcagacttcaaaaaatgttaataygtgctatgagaaaacaagatactaaaggtataacttgctgaacagaactttatcctctggattttctaacaaaaataatcttaaactccttctatagaaa

SEQ ID NO: 56737 - DNA, 201 bp, Homo sapiens
tgtgactaacaatgggccctcttttgccatcgttctctcttttcacacctaataataactccaggaagccttctcaggtgaagttaggtggcctttctaaycgctcctacaggtctctttgaattcccctgttcactgcacttacgacactacataataatcataatgaatttgtagtatctttgcatatagggacttatt

SEQ ID NO: 56738 - DNA, 201 bp, Homo sapiens
catgatcttcaattagctatacagcatgtgtgaccacacaccaggcaagctatgtcattttttaaacatatatatatatatatatatatatatatatatawatttaaaatatatatatgctattttcatagtaagtataaaattgaaatagcctcaaataaattgaggaaaaacatttatagaacattaagaacttgcaaa

SEQ ID NO: 56739 - DNA, 201 bp, Homo sapiens
atcatgatcttcaattagctatacagcatgtgtgaccacacaccaggcaagctatgtcattttttaaacatatatatatatatatatatatatatatatatatatttaaaatatatatatgctattttcatagtaagtataaaattgaaatagcctcaaataaattgaggaaaaacatttatagaacattaagaacttgca

SEQ ID NO: 56740 - DNA, 201 bp, Homo sapiens
agtattataaaaagtaacagttgtcaaagatcgaaacaagcacaccaggggtgcaatcctggcttcagtatggtctagttccatgattttgagcaactcarttgatgtctgtgaacctcagtttcttcatatggaaactacagatttaatacaaggaatgtcaataaaaataaaactttgcagggttctcgttcagataaa

SEQ ID NO: 56741 - DNA, 201 bp, Homo sapiens
tacagttgtgtcataattagaactagtaactaatagtttgataaatactagtttttaaataaatgctagttgtgttatccaaggtccttgctttcaaatgytgggaacaatttgatgaatatttataatttgcccatcatgtgctagcactgtgctaggctttgggttacacagaatttaaaaaaataataataattcctc

SEQ ID NO: 56742 - DNA, 201 bp, Homo sapiens
ttcatcatgatcttcaattagctatacagcatgtgtgaccacacaccaggcaagctatgtcattttttaaacatatatatatatatatatatatatatatatatatatttaaaatatatatatgctattttcatagtaagtataaaattgaaatagcctcaaataaattgaggaaaaacatttatagaacattaagaactt

SEQ ID NO: 56743 - DNA, 201 bp, Homo sapiens; identical to SEQ ID NO: 16446

SEQ ID NO: 56744 - DNA, 201 bp, Homo sapiens
acttcatcatgatcttcaattagctatacagcatgtgtgaccacacaccaggcaagctatgtcattttttaaacatatatatatatatatatatatatatatatatatatttaaaatatatatatgctattttcatagtaagtataaaattgaaatagcctcaaataaattgaggaaaaacatttatagaacattaagaac

SEQ ID NO: 56745 - DNA, 201 bp, Homo sapiens
attattatttttcactttgtgtggcatttttttcagtatgtatgtatttatttatttttattgtggtaaaatatacattaaaaaatttaccattctatccrtctttaaatgtacagttctgtggctttaagtaggttcacattgttttgcagtcatcactgccatctatttctggaacgttttcatcttcccaaactgaag

SEQ ID NO: 56746 - DNA, 201 bp, Homo sapiens; identical to SEQ ID NO: 16449

SEQ ID NO: 56747 - DNA, 201 bp, Homo sapiens
ggagtgcagtggagtgatcatgcatcactacagcctccatctccagagctcaaccaatcctcctgcctcagtgcccaagcagctgggaatacaggcacgtsccaccatgcctggttaattttttttttttttttttttttttttgtagagacgaggtttagccatgttgcccaggctagtcttgaatctctgggccaaagc

SEQ ID NO: 56748 - DNA, 201 bp, Homo sapiens
gagtttctaaaatgtcaaaataaaaaatatagtaaactgtttatttatgatgccttctcttagttcattatccacaagtctttgagttttatgaatcatawtagaatcctttcccctctctattttatatgttcaacaagctaggcatttgctcataaccaaagatgtctgcttttccctagaacaaaccttttacctatt

SEQ ID NO: 56749 - DNA, 201 bp, Homo sapiens
attcaagctgtagtcggcatccgtgccaaaatgggggcacgtgcataaatggaagaactagctttacctgtgcctgcagacatccttttactggtgacaamtgcactatcaagcttgtggaagaaaatgctttagctccaggtaaaaaaaaagtatacgcatctttggatttgctcattgtcataaatagaaacacgtttt

SEQ ID NO: 56750 - DNA, 201 bp, Homo sapiens
catgtgacaattggatctcaaggatctttgtgtgatgcttaatagttgtttcttttattcaggagtacagttttctcacttagattctgaaaaaaaaaaaacaaacaaacaaacaataaatttaacaatgctgctaaaagcaaatgggaaactttatgaacatgcatgtgcccacatgcaattacattaatttttgacatt

SEQ ID NO: 56751 - DNA, 201 bp, Homo sapiens; identical to SEQ ID NO: 16454

SEQ ID NO: 56752 - DNA, 201 bp, Homo sapiens
tttaacacattttttaaccatcctagtatccccaaactcagatctctattttctttacttggtgtcttttctggaatccatccttctgtgatgcagtttgraaattgttcccaggcacaaaactagattgaatgtggagctaacatcacatattttccctcaagaatcatatcactgcattgtctactgcccaacatctga

SEQ ID NO: 56753 - DNA, 201 bp, Homo sapiens
tcagggaaatttttctttattttcttttgcttatgcagatgtgcccactgcccccacccctcacccttgcctaattcaggattagaaaaaaaaaaaaaaaactctaggcacagaaatacactctcttctttattcacacctatgtgtgcagttaaaaggagaataaaaatcttgtccagcaggcagaacttcatcatcaga

SEQ ID NO: 56754 - DNA, 201 bp, Homo sapiens
tgtgaaaattcatagaatttgaagattaatttgaggaaaattgacatatttgcattgggtttcccattaattaacatgattcattggctttttctttaaarcttttcaataaagtttaaaatttttacttattaaatctaacacttcttttgctgaatttattcttaggtacattattcttgttgttattttttgctactg

SEQ ID NO: 56755 - DNA, 201 bp, Homo sapiens
acacctactggaatagaaacagtttacaacgcccggaatatgctcaagtcacagttttgcaaggaagggggaaacaaaaaataaaattaggtaaaaaagartatgttcaattcccacaggaaggggaatatcacactctggggactgtggtggggtagggggaggggggagggatagcattgggagatatatctaatgcta

SEQ ID NO: 56756 - DNA, 201 bp, Homo sapiens
gtgaaaatgcagacactaataatatttgcctcatatggtcatttttagaatcatttgagataatgcaatactatatttagcctagtgccttgtgccttatragcattcaataaatgttaattatcatgcttatttctatttttactatcactattacttttactctatatctggtcaacaatcctgtccttaattgcttat

SEQ ID NO: 56757 - DNA, 201 bp, Homo sapiens; identical to SEQ ID NO: 16459

SEQ ID NO: 56758 - DNA, 201 bp, Homo sapiens
tttccccttttgaaccaaggtaaattaacatgtagccaaactcctaggactgttatactttctaagctttctaacttggtagcttttataacactctgaartctcataagctattctttaacttctccccccatttttatgttggatttatatgatgagcaaatggaaatctgatgaaagatcttacttattcttaacaac

SEQ ID NO: 56759 - DNA, 201 bp, Homo sapiens
tgacacctactggaatagaaacagtttacaacgcccggaatatgctcaagtcacagttttgcaaggaagggggaaacaaaaaataaaattaggtaaaaaaragtatgttcaattcccacaggaaggggaatatcacactctggggactgtggtggggtagggggaggggggagggatagcattgggagatatatctaatgc

SEQ ID NO: 56760 - DNA, 201 bp, Homo sapiens
cagttctagattaccttataaaaatattcatcatattatcaaaaggaaaccaatttttaaaaatctaaatgaatagaactttattgggggaaaaaaggagyactaagtccaacatcaaagtaatagttctgatatgttttacatttgttatgtcattttctcttttcaaacatatatatttgtacataatgaggagtgagt

SEQ ID NO: 56761 - DNA, 201 bp, Homo sapiens
tcagtttgccaaagcaggaacattgaccccaacaatagttcaactaactgcctgagctcatccttacaaactctatatacagtccctttccaaattgcttygcttcctacttagctttaactatgagagtgcagatagtatttcactagacagaatgatttagtgaaataaatgagggtaaatgattagcatgcttttcag

SEQ ID NO: 56762 - DNA, 201 bp, Homo sapiens
tgacagcttttcaatttactctctcctctccttcttctcactgattttaaagttttttcttacgtttttggttactattttcaatctattgattatctccygcatatcactgtctattcccttttttaatggaataacattttccaagatcacatgaatgatatatgtctcaaattcttttgaccctgaggtcaatagaaa

SEQ ID NO: 56763 - DNA, 201 bp, Homo sapiens
ttcagatggaagggatcttgtagctcattttgcaactgacaaatagcctcagacatactcggttacctgtcatgttatagcagaaactgaaacgtaagtcyctaaaggccggtctgttataatgctattgctccacatgttcacggtttacccatgtaggtgactgttgtctccatatagttgtacgtggcaaactccagg

SEQ ID NO: 56764 - DNA, 201 bp, Homo sapiens
gctcttcatttgcttcctttctattcttgacactttacctctcacctaggtaaatttttacttcttgaacattcaggatctttcctagactgggtagcacrgagggaactatatcttgatgacatgctcctactgaagtctcaaataggatcctagaagagttaaaatccccccacacatcctcgtgtgtgtgtttgtgtg

SEQ ID NO: 56765 - DNA, 201 bp, Homo sapiens
atttgagatcttatactttctcaagtcagagacgcatgggtgggtattaggtgaggtgtgaggggttattactagagtcacctgataatcttatttcttcragagaatgttaattttcagaagcagctatgtctgtcttgtcctattttgttttcctcttgttcccttttaaatctctacgttaaagggcatgatgggaaa

SEQ ID NO: 56766 - DNA, 201 bp, Homo sapiens
tagcctcagacatactcggttacctgtcatgttatagcagaaactgaaacgtaagtctctaaaggccggtctgttataatgctattgctccacatgttcasggtttacccatgtaggtgactgttgtctccatatagttgtacgtggcaaactccaggataataacaagggaggctagcccacatgacatgggctaaaatc

SEQ ID NO: 56767 - DNA, 201 bp, Homo sapiens
atcacgagcacccaaaccaatctgcctcttgattatgatgattggtgggaaggggcagcagccacagtcaatattgtatataaatcaaaaattaagaatgyattactttttattttcttaaattagagcattgtctataatacagtctaaaactacagaccaagtaatatacatcataccaaaaatcactcatatcattct

SEQ ID NO: 56768 - DNA, 201 bp, Homo sapiens
cacttactctttaaggaattgtatgagactcaaggttttcatttcttaaactttattaaatctgtcttcaacacacacctttgttattaacaggaatgctrtttaaaagtctatgaagattgatttctggattgcaattttagtattaatatatctagtattttctgcattataacaatgaatttacctcttagaagtaga

SEQ ID NO: 56769 - DNA, 201 bp, Homo sapiens
agaaactgaaacgtaagtctctaaaggccggtctgttataatgctattgctccacatgttcacggtttacccatgtaggtgactgttgtctccatatagtygtacgtggcaaactccaggataataacaagggaggctagcccacatgacatgggctaaaatcacagctctaccccttttagatatgggactttgagagag

SEQ ID NO: 56770 - DNA, 201 bp, Homo sapiens
ctgaactctagttctgttttcagccctcactctctttgtgacaatttccttgccaatacgagacacaaagaatgcattgctaattctttagtaataaaaamtttaccacagtagcccctagcatactgcccttctggattcaaggtgagctctttttatttttttcttttctttaaacaaaccataagtatttatctttat

SEQ ID NO: 56771 - DNA, 201 bp, Homo sapiens
atgatgccttctcttagttcattatccacaagtctttgagttttatgaatcataatagaatcctttcccctctctattttatatgttcaacaagctaggcmtttgctcataaccaaagatgtctgcttttccctagaacaaaccttttacctattaacttggaaaatccaaagaatcaatacaagctttttttcagtacat

SEQ ID NO: 56772 - DNA, 201 bp, Homo sapiens
tgcaaacccttgatatggtcaaaagaagtccttcgtactttcatttgattggcaaataataataataatagtagcaaacacttatatggcatctgttactmgtactctactattgtcagtgaatatattcactcatttaatcattactataactccataaagaagaggaagatttttatcattatttctttacagagggat

SEQ ID NO: 56773 - DNA, 201 bp, Homo sapiens
ctatggttgggggcggagcagcttactctgcaatcatccccgaccatcatgcttcagtacgcgggaaaatgaatgtcagccaaattattgttcaggactgraaaaaatgaggctgtcccagtgcttaactgtctctcttctctttctgcttccttctagcccaggaacagcaaagtttgatacacaccaaccaggctgaaa

SEQ ID NO: 56774 - DNA, 201 bp, Homo sapiens
caaaacaaaaatcttggacatgaatggaaattcattaatttagctcaatgccctgaagaaaaacaatgcaaaattcaatctaacaatatagactcacccamattaatgccaaatatacttcctgtggagtagagaagcttaagtattatagtcaaagccacatatggcttagggagcataattaacatgtgccagagatgc

SEQ ID NO: 56775 - DNA, 201 bp, Homo sapiens
aataaatttaacaatgctgctaaaagcaaatgggaaactttatgaacatgcatgtgcccacatgcaattacattaatttttgacatttaatactaaaaaakttaatcacattttctttcaaattagtgatgttgaaactataaaatatgaaaaaagcttaatttttctcattttatatatattattttcatatactgagga

SEQ ID NO: 56776 - DNA, 201 bp, Homo sapiens
aatttattgatttctacaaattatattgatgtcgtctttcttttgccatggatgataccagctaaatgatgtccttgtcagagaggtaatttaatataggsaaccctctcaacctcctttaatgatttacccatcagatttagagtcactgggtgacatgaggtctcaataagtttgtaattttattaacatcagttaaat

SEQ ID NO: 56777 - DNA, 201 bp, Homo sapiens
gaaaagaattcttttttgacaacagttttttccctaacaattatgatcttctttaggaattggtgtgcttatgtacataccaggttatctcccacagtgayattggacaaccaggtcacttatgtcccaggtgggaaaggaccttgtggctggaccggtggatcctgtcctcagaggtatgtaatatttcttgaaaatagc

SEQ ID NO: 56778 - DNA, 201 bp, Homo sapiens
tcccttctctctctctgtccttctctctctctctcagagaaatactatatgacaaaaatagtaggtagcataatttcaaaactttgaagatgaaaaattcmatgggaaaatgatagtggttgtcataatttcaattagatcacgaatatccaatttgtttcaagttgtttgatactgatctggaggaaatacagatctttt

SEQ ID NO: 56779 - DNA, 201 bp, Homo sapiens
ttcaaaactttgaagatgaaaaattccatgggaaaatgatagtggttgtcataatttcaattagatcacgaatatccaatttgtttcaagttgtttgataytgatctggaggaaatacagatctttttaaatataacaatataggaaatcatatgaattgaagtagaataaattatctccatataactttaaaattggaat

SEQ ID NO: 56780 - DNA, 201 bp, Homo sapiens
ctatataaagtgattcaaactaaattatgagtctctttatctttgattaacgaatacctcagtaaacaataaaattctcagaacatagctacaactacatrcatatatctagctgcatattttaaatgctgaggtattgaatttggaagcagaagatgagccatcagctctgtaactgcgagcaagttattttggatttct

SEQ ID NO: 56781 - DNA, 201 bp, Homo sapiens; identical to SEQ ID NO: 16458

SEQ ID NO: 56782 - DNA, 201 bp, Homo sapiens
aaagaattcttttttgacaacagttttttccctaacaattatgatcttctttaggaattggtgtgcttatgtacataccaggttatctcccacagtgataytggacaaccaggtcacttatgtcccaggtgggaaaggaccttgtggctggaccggtggatcctgtcctcagaggtatgtaatatttcttgaaaatagcca

SEQ ID NO: 56783 - DNA, 201 bp, Homo sapiens; identical to SEQ ID NO: 16450

SEQ ID NO: 56784 - DNA, 201 bp, Homo sapiens; identical to SEQ ID NO: 16452

SEQ ID NO: 56785 - DNA, 201 bp, Homo sapiens
aatttattatttctgaattagtaatgaggttgcatatgctttaaaacttttagtgaccttttgtgggttttgttcaatgatttgcctactgatacattctmcgttttttaacttatttttttctgatctgtaagtgaagaccattttcttatttttatttattttttatttaaaaaattagagatggggtatcactatgct

SEQ ID NO: 56786 - DNA, 201 bp, Homo sapiens
agttccagccaaagaactgactaccaaaaatcaaatttcgaaacaactagaggaaagtaagaaatcttcttttctttttgttctttctctgtctatcaggwctagaagattgcaagtgaaatttacctcactcccagaaaattatttcaaattcaagatgaaattggatcatatttataatttcaccatttcagttagata

SEQ ID NO: 56787 - DNA, 201 bp, Homo sapiens
gtcacattgtcctattaacagctatagcagtttacactccagccagcattgcatgaaaaggcccattttcccttatattgacatgactggatattttctaygtatctttttaaatgttgccaccttatatttaaataatgttattattgctaaatttattatttctgaattagtaatgaggttgcatatgctttaaaactt

SEQ ID NO: 56788 - DNA, 201 bp, Homo sapiens
ttgccaagtttctcttcagagagtatcaatttacgctcccttgagcaacttatgaaagggccaagtgttatacctgtgtgcacatatatacacatgggcaygttaactttgcccaaaaagtttgtccaaaaaattaaaaaatatttaaatatgagacttttaacagacaatgatgacactatggatatcttttatttttat

SEQ ID NO: 56789 - DNA, 201 bp, Homo sapiens; identical to SEQ ID NO: 16460

SEQ ID NO: 56790 - DNA, 201 bp, Homo sapiens
ttatttttatcattttaataggcgtgcagttatatctcattgtaattagggaagcagatttcacagctatatggatgagggttgtttagaggcaggcaaarcgatgttaagacggctataatcatctagatatgagaaaatgagagcatcaattagaaaagttaatggggatggaatggaaatcaaagagcagggagatta

SEQ ID NO: 56791 - DNA, 201 bp, Homo sapiens
ataggcgtgcagttatatctcattgtaattagggaagcagatttcacagctatatggatgagggttgtttagaggcaggcaaagcgatgttaagacggctrtaatcatctagatatgagaaaatgagagcatcaattagaaaagttaatggggatggaatggaaatcaaagagcagggagattacttttgagaagttacat

SEQ ID NO: 56792 - DNA, 201 bp, Homo sapiens
gaatcaacaagaacctcctgctgatccaaagttggcatgtcacatatttttccatctttctaatcagtttttgccatttcttttaggctaaactttagctyttacaaacataaggttggttactgctaaaaacatctattcactgtgtttggcatggatctagtcatacaaaacaaggcactcaattaagaaatgtgactt

SEQ ID NO: 56793 - DNA, 201 bp, Homo sapiens
aaaccccgtctctgctaaaaatacaaaaaatagcctggcatggtggtgcacacctgtagtcccagctacttgggaggctgaggcaggagaatagcttaagyccaggaggcagaggttgcagtgagccaagatcatgctactgcactccagcctggacgacagagcgagactccatctcaaaaataaaacaaataaataaat

SEQ ID NO: 56794 - DNA, 201 bp, Homo sapiens
tgcattttgatttatcttatagctaaactctgcaggtttctcattttagctttgatttattcttttctttattttgatcttgttagtgtttccttatagtycctgagtacagcaatacagtaataagttattttctcttatatttaaatattttaaagctaaatagcaatcttacaaggtttctgatctatagtatggcaa

SEQ ID NO: 56795 - DNA, 201 bp, Homo sapiens
agcaaaaaatggaatgctgctcctggacattaaatagcaggcagaatccttgatcctgaagattcagagtagagccaacagcaatgcagataaatctaatkttttccacagtttcttaagttctccttatagcacagctttgatccctgattcatgaacagggccaaggttacaggtgactgtgattttttatatttggga

SEQ ID NO: 56796 - DNA, 201 bp, Homo sapiens
tgttggatttatatgatgagcaaatggaaatctgatgaaagatcttacttattcttaacaacaagctatagaggcatgccttattaaaatatcaggaatgstaattttcaatttttaaataaagtgttattagaagtgactcaatataaaaataagactaccatctagttttgttccagttcagttatttgaaataatgtg

SEQ ID NO: 56797 - DNA, 201 bp, Homo sapiens
ctcctggacattaaatagcaggcagaatccttgatcctgaagattcagagtagagccaacagcaatgcagataaatctaattttttccacagtttcttaarttctccttatagcacagctttgatccctgattcatgaacagggccaaggttacaggtgactgtgattttttatatttgggaaaattaaaattatagagct

SEQ ID NO: 56798 - DNA, 201 bp, Homo sapiens
tctaagagtctttcacaataaaattatgatgcatttagtgaagaacactctgtaccataagtggttgttgcaccaaactgcctacttcaatttacctagtmaatctcagtaaagcttaacatgtacaccgaacattcaccatgcaagttttcacttgatattgagggatcagctggaaatctgtctcctcaagccacacag

SEQ ID NO: 56799 - DNA, 201 bp, Homo sapiens
attttgatttatcttatagctaaactctgcaggtttctcattttagctttgatttattcttttctttattttgatcttgttagtgtttccttatagtcccygagtacagcaatacagtaataagttattttctcttatatttaaatattttaaagctaaatagcaatcttacaaggtttctgatctatagtatggcaaaaa

SEQ ID NO: 56800 - DNA, 201 bp, Homo sapiens
tgtctttgtgcacatggacaagtatgtctggagtatatatatactgccagaagaaatgtttggctcaaagtaaattaacctttttaatactgataaatatygtcacattgtcctattaacagctatagcagtttacactccagccagcattgcatgaaaaggcccattttcccttatattgacatgactggatattttcta

SEQ ID NO: 56801 - DNA, 201 bp, Homo sapiens; identical to SEQ ID NO: 16451

SEQ ID NO: 56802 - DNA, 201 bp, Homo sapiens; identical to SEQ ID NO: 16456

SEQ ID NO: 56803 - DNA, 201 bp, Homo sapiens
caccacatctgactaatttttgtatttttagtagagacgggctttcactatgttggccaggctggtcttgagctccgacctcaagtgatccacctgcctcrgcctcccaaagtgctgggattacaggtgtgagccaccgcacctggcctgtactcaatattttaaatagatcatttctctaaattgttttccccaatgaaa

SEQ ID NO: 56804 - DNA, 201 bp, Homo sapiens
ccttgacatggaaggaacaacttattcttttaagggatctaagaaggctctcttcaattcattaataagaggttgcttaatgggtactgatccctaagaartgggattatgactaagaatcaacaagaacctcctgctgatccaaagttggcatgtcacatatttttccatctttctaatcagtttttgccatttctttta

SEQ ID NO: 56805 - DNA, 201 bp, Homo sapiens
gataaacatgatgtctctaactatagcctaacatattcatttttagttaaagtgagtcatattaatttacttccattgtgttatctacttcaagaataaaracgcagttaggggatcaagatagctagttgcatggttgtctcaatactattgatggagacattgaggataaatctgaagtgcattattatcccccaaatt

SEQ ID NO: 56806 - DNA, 201 bp, Homo sapiens
taaatgtagttaagaggtatttttattattacgtgttattaatgtttaatttcaaactttttatcttttagagatgcttaaagtctcatataattaaaacyatgtattattaattatttctttctctaggtctaaaatccaaaagcattaatgtactgataagagacatagtaagagaacaatttaaaatttttcaaaatg

SEQ ID NO: 56807 - DNA, 201 bp, Homo sapiens
ccattaaacataaaactacatacttgaacttggatagatagtcaagttgtgaagatcactgacattatttaaatctgaatctatcttacagtatttcagayatcaatacaaaacaaatatttctagtgtatatttggctatgtgtttttaaaatttttctgactagacctctataaaataattaaatttgctcctatggaa

SEQ ID NO: 56808 - DNA, 201 bp, Homo sapiens; identical to SEQ ID NO: 16447

SEQ ID NO: 56809 - DNA, 201 bp, Homo sapiens
gataactaataggttatcttctgtacaaaatggctgaatataagcccgttaaattttgaaagctatctgcttcaatttagagtttagatgtgttttagaartcccccaaatacgtgtacgcatttggtaattcaatagaagtgctcacaggatctggcatatccatagtgttcacatctgtggcttattatggcaaaaagt

SEQ ID NO: 56810 - DNA, 201 bp, Homo sapiens
tgtgctctttttttctagtcacacacacatacacaaaattagtaacgtgtacattaattctgcccatacaagcccatcagatactcagcacttagttttaytgggggctggtcacataagcatcctctgcctaggacataccaaaactccatactctcagaagggaagcagatattcagcataaatcatattgtttgtaca

SEQ ID NO: 56811 - DNA, 201 bp, Homo sapiens
taaccaactgcaaaattttccaagtaggcctttctaaagatatcagtctctggcctactatgttcactcttctctgcagattatcttaaagatattcttcrtgtcagaactggttaggaggcctgtctgctggggatggcctccccaatttgtgtcaataaaacatatcagtgttgaaggaaatagtaaatgaactacttt

SEQ ID NO: 56812 - DNA, 201 bp, Homo sapiens
cctccaaactaccatcccttttcacggaaaggaggcctgaataattttatttttttttccaagcagaattagagtcctgcatttcccactccaatgtggtkttgcattgccctatggttgggggcggagcagcttactctgcaatcatccccgaccatcatgcttcagtacgcgggaaaatgaatgtcagccaaattattg

SEQ ID NO: 56813 - DNA, 201 bp, Homo sapiens
actctaatattaataatcacaattctgaacaataagaaactgattctattgaagaaaagaatagcatttccccttttgaaccaaggtaaattaacatgtarccaaactcctaggactgttatactttctaagctttctaacttggtagcttttataacactctgaaatctcataagctattctttaacttctccccccatt

SEQ ID NO: 56814 - DNA, 201 bp, Homo sapiens
caaagaactgactaccaaaaatcaaatttcgaaacaactagaggaaagtaagaaatcttcttttctttttgttctttctctgtctatcaggtctagaagawtgcaagtgaaatttacctcactcccagaaaattatttcaaattcaagatgaaattggatcatatttataatttcaccatttcagttagataaagttattg

SEQ ID NO: 56815 - DNA, 201 bp, Homo sapiens
tggtaaagtatttcgaaggcaatggcaacaactgctatctgaccactagtgactgaaaaatgcctttgatttcaagacacattcttgatttcagagatgtrtgtcttaaaatgtgtgaaatttggtctttcattcattgtcacactccaagatcactgcacttcatttcctccagccacactggcttcctttctgtttatt

SEQ ID NO: 56816 - DNA, 201 bp, Homo sapiens
caactctctagatctcagaagatatccaatcctgtctataggatgcaacataaaattgtcacctcattggattggaggtgctgtcctggatacagtgggcygaaatgtcaactaagaggtacactctaatattaataatcacaattctgaacaataagaaactgattctattgaagaaaagaatagcatttccccttttga

SEQ ID NO: 56817 - DNA, 201 bp, Homo sapiens
attttgatcttgttagtgtttccttatagtccctgagtacagcaatacagtaataagttattttctcttatatttaaatattttaaagctaaatagcaatmttacaaggtttctgatctatagtatggcaaaaataaatgtttgtctgtgaaaataattttgatgaaaagaattcttttttgacaacagttttttccctaa

SEQ ID NO: 56818 - DNA, 201 bp, Homo sapiens
ctgttatactttctaagctttctaacttggtagcttttataacactctgaaatctcataagctattctttaacttctccccccatttttatgttggatttrtatgatgagcaaatggaaatctgatgaaagatcttacttattcttaacaacaagctatagaggcatgccttattaaaatatcaggaatgctaattttcaa

SEQ ID NO: 56819 - DNA, 201 bp, Homo sapiens
cacgttttctgtgaaggttaaactaatggcaccattttgactgtgtgagaactgttagaacatgctcaaatgtattaagtaaaacaagatggcttttttayttatttaaattcataagtattggtgctttggatttacttcaggagtgcaccatttctgatttttatacagaaatgtatgtgcagcataaaaatgtgttat

SEQ ID NO: 56820 - DNA, 201 bp, Homo sapiens
attgagacacgtgcacctttgctaagtttgatggatggcctttctcttctgctaagactttttgtaactgagataaaaatgacgaagatataaggaaagacaaaataagataaaaacatgaaaattaactcttgccattttttcctctaacagatttttccaaaggatcttacagatatgcacccatggtggcattttttg

SEQ ID NO: 56821 - DNA, 201 bp, Homo sapiens
gcctccagaatacaatctagatttgttacccagttagtcacacgatgccatcctagatctgcctcctgcctacctccccaacctcatcttccgccacttcsggctattcaaataagtggttctctggtacaatatgtgctgtttgttaaacccacctttcttccctgtctgcccctgtgactaacaatgggccctcttttg

SEQ ID NO: 56822 - DNA, 201 bp, Homo sapiens
gctggcaatgggcatatgaaatatttctagagcaacaggaagataagccttatttgatataaacagttttgacaaatggggaagcataatagcactgaaasttaagaatgtgtccattaatatggaaatgaaaacattttacagagcattggaatcaggatgaaacataaagaaaagtgcaaatgttgtgtgggcatgtta

SEQ ID NO: 56823 - DNA, 201 bp, Homo sapiens
ctctcagctcctacattacactcccttggcaggtacagtctcttatcacaagtgggaagataagcgtgaccagttcacttcccagctcgtgaggcttcacrggctattggttgcctccagaatacaatctagatttgttacccagttagtcacacgatgccatcctagatctgcctcctgcctacctccccaacctcatct

SEQ ID NO: 56824 - DNA, 201 bp, Homo sapiens
tcacagatcacaaaaaccctacagaaacaggaaaccgaacttcctgagtacgctacaaaacacagaaacctgtttcctctacacatctcaaactggcaaarctcagtcttagcagattcagtgtggaagcagctatcaaaaaggccataaggattttgtccccaaatttcacatgagctaccttgcttcaaactactgaga

SEQ ID NO: 56825 - DNA, 201 bp, Homo sapiens
atatcttgaacccaggaggaggaggttgcagtgagccgagatcatgccactgcactccagcttgggcagcagagcgagactctgtctcaaaaaaaaaaaaatgatagtgaaagatatacctatagagcagtgcaatgttctgttatattttatactttttttgatattttggtatgtgcataagaataccatgttattatg

SEQ ID NO: 56826 - DNA, 201 bp, Homo sapiens
acaaaaataatcttaaactccttctatagaaaagtactaactgcatgtagggattctcttatttgaggtcctggagagcctgaggttttcttttagtaatyctttccattaccaagattccttactcattaggccatgcaaatgacaatggcattagagaaaagcctaggtccttcacttttggacacagtgctgctgcaa

SEQ ID NO: 56827 - DNA, 201 bp, Homo sapiens
tcaattagctatacagcatgtgtgaccacacaccaggcaagctatgtcattttttaaacatatatatatatatatatatatatatatatatatatttaaaatatatatatgctattttcatagtaagtataaaattgaaatagcctcaaataaattgaggaaaaacatttatagaacattaagaacttgcaaactttgata

SEQ ID NO: 56828 - DNA, 201 bp, Homo sapiens
gcaatcctggcttcagtatggtctagttccatgattttgagcaactcagttgatgtctgtgaacctcagtttcttcatatggaaactacagatttaatacraggaatgtcaataaaaataaaactttgcagggttctcgttcagataaaaatgaatgaaaagtgcttagatgcatgctcctcacagaataggtgctcaaca

SEQ ID NO: 56829 - DNA, 201 bp, Homo sapiens
tgatgatgaatattatgattataacagccgatactaaataaatgcttgttatattgtaggcattgccccaaaaactttacatttattattccggctgatamtttaatgtgaaacaaataatcgatttccctccaattgctcaactctctagatctcagaagatatccaatcctgtctataggatgcaacataaaattgtca

SEQ ID NO: 56830 - DNA, 201 bp, Homo sapiens; identical to SEQ ID NO: 16457

SEQ ID NO: 56831 - DNA, 201 bp, Homo sapiens
caccatgtttcttcattcgctccccacccccttctcccttcataacacttcagagtgccagattcctcagtccttggaactcaaacttccagagagaccayacttcatcacatacctatggcacatgttccagaaatgattctggccaggtgtccacccctgaatagatggccacaggcaggagaatgggatgtctgattg

SEQ ID NO: 56832 - DNA, 201 bp, Homo sapiens
actcaaacttccagagagaccacacttcatcacatacctatggcacatgttccagaaatgattctggccaggtgtccacccctgaatagatggccacaggyaggagaatgggatgtctgattggtctgatttgggaaacatcctatccaccacttggataggatcaactttacccaaacaggactgatcaggatccacatg

SEQ ID NO: 56833 - DNA, 201 bp, Homo sapiens
ttcactgctctgccatcttggggtgtgaccctcatcctcatagtccaagatggcagctagaggactagccatcacatctttattccaggaagcacaatgtwgtaaaagatgtacacaaaggagtcaaaagcaaggtttttacaagagctttattgagatataatttacaaagcgtacaacttatccatttcaagtttacac

SEQ ID NO: 56834 - DNA, 201 bp, Homo sapiens
gtctgattggtctgatttgggaaacatcctatccaccacttggataggatcaactttacccaaacaggactgatcaggatccacatgggaggttcgctcckttggaggaggagatgccagcagaccgtggaggactggctgtgaggcacgaggatgagcgggaggcaagggcggctcctgcttccacagaggcgagcagga

SEQ ID NO: 56835 - DNA, 201 bp, Homo sapiens
atttgttcttttttttttttttaagacagagtctcactctgtcaaccacgctgtgcagtagcacgatcctggcttactgcaaactccgcctccaggttctyctgcctcagcctcccaagtagatgggattacaagcatgcgccgccgcaccctgctaatttctatatttttaatagagacagggtttcgccatgttggcca

SEQ ID NO: 56836 - DNA, 201 bp, Homo sapiens
cacactttcattggcatcctaggatgctcggggccctattttcaaggctgtgtatgttgaatacacatttcagtgatgctttagtctattccacagtgatkctcaaattgtggcccccaggccaacagtatcaccatgccccgggaacttgtttgaaagacaaattctccatcccactcaagacctcctgaatcagaaact

SEQ ID NO: 56837 - DNA, 201 bp, Homo sapiens
gactggccacacatgatgagaaaactgtgagaaaagaagcaggagagactttggaagagggcttggcaggccggaaagcgctaggtgcacacgacgggcagtgggggctcaaacacaggtgggagcccaggggaggagggagcgattagtcatgctggggaggctccaagggccctttgtccttcctagatggctactcag

SEQ ID NO: 56838 - DNA, 201 bp, Homo sapiens
acagtgattctcaaattgtggcccccaggccaacagtatcaccatgccccgggaacttgtttgaaagacaaattctccatcccactcaagacctcctgaawcagaaactctgggtatggggcccggcagtctgggttttaacgcaccctctgggtgattctgaaacaggcaccaaagtttgagaacgtctgcctataaatg

SEQ ID NO: 56839 - DNA, 201 bp, Homo sapiens
acaaggagaaatgcccagcgaaggggtaggggaagctccttataaaaccatcagatctcgtgagaactcactgtcacaagaacaagctgggggaaaccackcccatgattcaatgatcttcacctggtccctcccaggacatgtggggattatgggaactacaattcaatatgagatttaggtggggacacaggcaaatca

SEQ ID NO: 56840 - DNA, 201 bp, Homo sapiens
tccaaggtgctgtggtagatgcaacatcttttttttattgtttgcccaaagtaaatcttttaacagatcacaatatcaaaaatctcaatgtatctctctctctctctctctctctctctctctgtggtcgtatctttcaaatgtcagttgccaaagaatcactgggaagccaaacacatttgcagaattcctggacctacc

SEQ ID NO: 56841 - DNA, 201 bp, Homo sapiens
ccaaggtgctgtggtagatgcaacatcttttttttattgtttgcccaaagtaaatcttttaacagatcacaatatcaaaaatctcaatgtatctctctctctctctctctctctctctctctgtggtcgtatctttcaaatgtcagttgccaaagaatcactgggaagccaaacacatttgcagaattcctggacctaccc

SEQ ID NO: 56842 - DNA, 201 bp, Homo sapiens
caaggtgctgtggtagatgcaacatcttttttttattgtttgcccaaagtaaatcttttaacagatcacaatatcaaaaatctcaatgtatctctctctctctctctctctctctctctctgtggtcgtatctttcaaatgtcagttgccaaagaatcactgggaagccaaacacatttgcagaattcctggacctacccg

SEQ ID NO: 56843 - DNA, 201 bp, Homo sapiens
aaggtgctgtggtagatgcaacatcttttttttattgtttgcccaaagtaaatcttttaacagatcacaatatcaaaaatctcaatgtatctctctctctctctctctctctctctctctgtggtcgtatctttcaaatgtcagttgccaaagaatcactgggaagccaaacacatttgcagaattcctggacctacccgc

SEQ ID NO: 56844 - DNA, 201 bp, Homo sapiens
gcggatcacctgaggtcaggagttcaagaccagcctggccgacatggtgaaatcccgtctctacaaaaatacaaaaattagctgggcgtggtggcgcacamtggtagtcccagctactcggggggctgaggcagaagaatcagttgaacccaggaggtggaggttgcagttagccaagatcgcggcattgcactccagcct

SEQ ID NO: 56845 - DNA, 201 bp, Homo sapiens
agaaaacaggactccactggcctggatcagctgaagaaagcaagtgggactccttacaacagggtgggcagtgttaaggaaaccaacaaggactgaggcgrctccctgcctctaacagcaggacagatggagccagggaagggactagctgtgggaaaaccagagccatggaggaggggctgctgataatcgtgggagggc

SEQ ID NO: 56846 - DNA, 201 bp, Homo sapiens
gggtagaatgataggcaaattgtcttttcttttcttcctttttttttttttaaagaaaaacacttacaaaaatccaaataagagtaaataattaggactgsgtgtggcggctcacacctgtaatcctaacactttgggaggccaatgcaggaggattgtgtgagcccaggattttgagaccagcctgagcaacatacagac

SEQ ID NO: 56847 - DNA, 201 bp, Homo sapiens
aattagctgggcgtggtggcgcacactggtagtcccagctactcggggggctgaggcagaagaatcagttgaacccaggaggtggaggttgcagttagccragatcgcggcattgcactccagcctggatgacagagagagagactccgtctcaaaaaataataataataatagaaaagaaaaggaaggatgctccagcgc

SEQ ID NO: 56848 - DNA, 201 bp, Homo sapiens
aaatgggactgtactgttaaaccaaaatgtggccacgaaaataccgacacatacaggtgttacatacaaaggctaacaaaatcactttccctttttcttcytcactcgcgcctgctctgagttaattcactttcattcagccttgccggcactggctgccttctttgggcagcaacaccctggacaacaccatcctgggcc

SEQ ID NO: 56849 - DNA, 201 bp, Homo sapiens
aatgtttttttattctcctggtgaaatgatttgtggccatgccatgcagagccacattggagcctgaggcaaaaggaaaaatcagtaatagtgaacctgtstttatttatatatttattttttagatgggtctcactctgctacccagactggagtgcagtaacatgatcacagcccattgcagcctcaacctcctgagct

SEQ ID NO: 56850 - DNA, 201 bp, Homo sapiens
ccatgccccgggaacttgtttgaaagacaaattctccatcccactcaagacctcctgaatcagaaactctgggtatggggcccggcagtctgggttttaaygcaccctctgggtgattctgaaacaggcaccaaagtttgagaacgtctgcctataaatgtatttgatccaatccatcaagttcaaagggaccacctacta

SEQ ID NO: 56851 - DNA, 201 bp, Homo sapiens
gtgccttctggatggctctgtctgaatgattcacttctgcctatggtgggtggaagttcatggttttactcccacatggtgaccacagtgcatggcaattytctagtcaacaggtggggttggggcctctgctacacacaagaggcttctttcttcaagtttaagacttctgatgctcacaagaccctcccatgcccttac

SEQ ID NO: 56852 - DNA, 201 bp, Homo sapiens
taactagcacaaaacattaaggaaatattcttccagtgctcaaaaacaatgatttgattgagcaaagaattcatgtcattgttgaatgattgagtttcaaygtgtccttatttcatttttgtcttcttcattaatgtaaataaacctgtcagccaacctacacttgtcatttgccaccataggttgactagtgagacaagg

SEQ ID NO: 56853 - DNA, 201 bp, Homo sapiens
tgctgagtatccaccaatgcaccactgcctgaggggtgtctacataaaaagagacctaacagcccagagcagcacttgttaaggacccaaggcatggtccmgaccccaaggaagggaagggggtcagggatggatagacaatctggaaagttctccaaggtggtctgagaaggcttcatgggggacagagagccgtaaagc

SEQ ID NO: 56854 - DNA, 201 bp, Homo sapiens
gttcttacaggttttgggataggcggtggagtttggagcaatgttttgcgggcagggggtggatctcacaaagtacattctcaagggtggggagagaattrcaaagaaccttcttcagggtgggggagattacaaagtacattgatcagttagggtggggcagaaacaaatcacaatggtggagtgtcatcagttaaggct

SEQ ID NO: 56855 - DNA, 201 bp, Homo sapiens
atgggtagccaatgctaaggcctcctgcccccatgggcctaagtagccctgtccacactggggatctgcccgctacctcatagcctcaggtagatgtctgktctctctttgcaaatgtcccccgcaacccatcacattcataaaggcaacaaattggggaaaacgagaggtcctctgtctttttagggcttcaccactgct

SEQ ID NO: 56856 - DNA, 201 bp, Homo sapiens
tggggaaaacgagaggtcctctgtctttttagggcttcaccactgctgttttcccaactaaagaaatatgtacatatgtttaagtatactttaccatgcgyagaatgggaaaaacagaagttattctagagaacatctcgctcaactcgtttattttactaataagaaaatagaaactatggaggtcaagtggcataccca

SEQ ID NO: 56857 - DNA, 201 bp, Homo sapiens
ccacctccgtgattcacacaattccttttccactctatcccgggcccatgtctccatcctgcccctgatgctggctctgcaggcattttctacatggctgyctgtgtacatgccgtgtggttagtcttaaatcaagggctcctagagtgcataggacataccagtttatactttttctcatcaggaatatgtgtagctgga

SEQ ID NO: 56858 - DNA, 201 bp, Homo sapiens
aacaaggctgtttatttcacctgggtgcaggcgggctgagtctgaaaaaggagtcagcaaagggtggtggattatcgttagttcttacaggttttgggatrggcggtggagtttggagcaatgttttgcgggcagggggtggatctcacaaagtacattctcaagggtggggagagaattgcaaagaaccttcttcagggt

SEQ ID NO: 56859 - DNA, 201 bp, Homo sapiens
ccaccaagcaggctttgtgtgagcaacaaggctgtttatttcacctgggtgcaggcgggctgagtctgaaaaaggagtcagcaaagggtggtggattatcrttagttcttacaggttttgggataggcggtggagtttggagcaatgttttgcgggcagggggtggatctcacaaagtacattctcaagggtggggagaga

SEQ ID NO: 56860 - DNA, 201 bp, Homo sapiens
gaatgagaaggcacaggactgacaccagaccccagggctctctcagacgcctcccttgaacccctgtttcacagaaccaccttctcccctctcctcatccrctattcctcttatgctcacccccttagacatgctaagggatacaaacacaccctgtaagctatcaagcccccacacaaatgagtgggatcacttctgtag

SEQ ID NO: 56861 - DNA, 201 bp, Homo sapiens
ccaaggagcttacttaaggagcaataggttgtcccctttgcctcttctggtctttcgcgtttctgagcgtggtgtggaaactgagtcaggagctaaatcarttaggtcactggttctcaaacttgagtgtgcatcacaacccactgaagagctttttaaaacacagattgtggcccccactctagagctcctgattcaata

SEQ ID NO: 56862 - DNA, 201 bp, Homo sapiens
tgatgggagctgaggtgtggggacccatcccctcaggtacactgcctcatagtatttcttctccccgcttggctgagcctcctctcttcagatggctaaarcaggcacaacccccacgttgccacacagtcccataaactcctatggatacaggtcagtctctctccaaaactccatcctcatatccccagcaccacatgg

SEQ ID NO: 56863 - DNA, 201 bp, Homo sapiens
ggtacactgcctcatagtatttcttctccccgcttggctgagcctcctctcttcagatggctaaagcaggcacaacccccacgttgccacacagtcccatwaactcctatggatacaggtcagtctctctccaaaactccatcctcatatccccagcaccacatgggacctagaatagcaacgtctcagccagcatacagc

SEQ ID NO: 56864 - DNA, 201 bp, Homo sapiens
gaacccctttggctttactcccttcctgggctgggggaaagggtggggatataagctggtacttccaaagcagaaagctggggtttggggctgacagagcygaccttgagcttgagctccatggagtacccagcccaggtcaaatggggtcaggaagccatctgtgccttctggatggctctgtctgaatgattcacttct

SEQ ID NO: 56865 - DNA, 201 bp, Homo sapiens
aacccctgacctcaagtgatccgcccccaccttggcctcccaaagtgctgggattacaggtgtgagccactgtgcccggcctataagtttcatttaaaacmagcttgtccaaccttcagcccaggactgccttggtccagaagctttgaatgcagcccaacacaaattcataaactttcttgaaacgttatgagatttttt

SEQ ID NO: 56866 - DNA, 201 bp, Homo sapiens
gttgtccataagcttcattcattcattcattcattttatgtatttatttattttcgaaatggagtctcgctttgtcacccaagctggagagcagcggcgcwatctcggctcactgcaacctctgtttcctgggttcaagcgattctcctgccttggcgtctcaagtagatgggattacaggtgcctgccaccacacctgac

SEQ ID NO: 56867 - DNA, 201 bp, Homo sapiens
atggcctcccaaccagagagtagccttcaacatctcagcctcgtactgcgtgccagacactctaccaagccctccacttaggtaataatcacgtcttccamcctcactctcaccctgtaagggagctcttagaataacgctgctctccacggctgggaaacccaggctctgatgggtgacatcacttgttcaaggtcactc

SEQ ID NO: 56868 - DNA, 201 bp, Homo sapiens
gaaacccaggctctgatgggtgacatcacttgttcaaggtcactcagccagtaagggccaggctgggctgcaaactcaatggcccactgcagagctcacamaggtccatttcctactcgccatgatgttttccagggagagtttagagaagctctggagctgggaaaagagggcagctgttagagaacagcgagcgagaat

SEQ ID NO: 56869 - DNA, 201 bp, Homo sapiens
gggagtgggtggagcgcctgatttgtctcccaggcgacacggaaagggaggcagtgagacgtgctacctggtcgcttccggctctgatgaaccactgccarccagttattagggaggagggcagcacttgcaaaaatttcaggtctctgagagcccagagcctgagaagtgtggaggatactaattacacccaggtggaag

SEQ ID NO: 56870 - DNA, 201 bp, Homo sapiens
aaatgctctgtcgggttggggttgtctaattgcctgcctctctcagaagagaggggaatttatgagagttctatttccagtcaggtctaaagtagagatawcattgcacaatttctagactttgttttgctgccaaaattttagtctgaggctgaagaatccaacagccgtcctgcctgttttgtttgtaaattcacaaac

SEQ ID NO: 56871 - DNA, 201 bp, Homo sapiens
agcggcaaatgatatgaaagcgattcagatcttcctgagagttaatgtggcatctaatttgcaaccggggagccaggcttgcaatgaaatgctctgtcggrttggggttgtctaattgcctgcctctctcagaagagaggggaatttatgagagttctatttccagtcaggtctaaagtagagatatcattgcacaatttc

SEQ ID NO: 56872 - DNA, 201 bp, Homo sapiens
aggatttctctgtgtatcggaacttttgctctccagtcaggtttccctcccttgagtcaagcaggtctaggaatgacagaaatttcttgtgggtgcgcacrgcatctgaagagtagttggtgtgagggcaggatctttcgggccaaagggtccctccactggctgtcccttagggctggaggagatggcagcacgcaggtg

SEQ ID NO: 56873 - DNA, 201 bp, Homo sapiens
catggaagaaattcagtggaaggtggttttcttcccccaaaggcacaaaatcagggatgagtagggttgtggagatggtgaagagaaagagaagaaattaytggccctacagcaagaccaagtataataactggctaaacctaatgagaagacattcaatttccacagtactcatataaatgcaaaataaaatcaaagaaa

SEQ ID NO: 56874 - DNA, 201 bp, Homo sapiens
taaatgtcccctctcctgctctgtttccacttagataaattaatcctcagcatgagaggaaccaaagccagcaccttagaagtcaggctcctgtcagctcrgtttgctcacctgcacacagcccttgacttcctcctcctgtgtgggaggagcacagccctgactcagaggccactccaggcaatcctctcctcccaggca

SEQ ID NO: 56875 - DNA, 201 bp, Homo sapiens
atccaatcaagtgcccttggacaaagcctgaaaccaggtaagagcctgacttttctccagagatgggcatgaacttttctttttaaaacgtgtgtcacaargaatccaggggtttctgactgtatgggacagagcttgcttcagagcgtgccaggtggttctatacacgacctcacaggttcacagggacacgtagccgtt

SEQ ID NO: 56876 - DNA, 201 bp, Homo sapiens
tcacctgcacacagcccttgacttcctcctcctgtgtgggaggagcacagccctgactcagaggccactccaggcaatcctctcctcccaggcaatcctawaaggaacccactggctgagctctggcctctcggcagagggggcaggcctgaagaaccctttccaagaccagctgagctctgctggtccgctgggccctgc

SEQ ID NO: 56877 - DNA, 201 bp, Homo sapiens
tcgctgctctgtcaacgttgggatattttagtgtcttggagattagtgagtaaagctgatcatgatacctcagagtctgcatttaaatcttgctctaaatyggtgcatcctttttatgtgtagtttttctattactgttatgcctcactgttttaacagaggtttctatttatatggggggaggagcattacttgggagag

SEQ ID NO: 56878 - DNA, 201 bp, Homo sapiens
tggcagacgtttcaacagaatacacttgtgattatgacagctcatttcctcatgcttttttgttcatcttgctggtcactggggaagcctggtcacagacyggcgtgtggcccccatggatttaacccacaatagcctggggatgagcagccctcccactgaagaagcagggccagaggtcagagtccacacccagcgagg

SEQ ID NO: 56879 - DNA, 201 bp, Homo sapiens
aatgctcagctcacaggaatgagaaggcacaggactgacaccagaccccagggctctctcagacgcctcccttgaacccctgtttcacagaaccaccttcycccctctcctcatccactattcctcttatgctcacccccttagacatgctaagggatacaaacacaccctgtaagctatcaagcccccacacaaatgagt

SEQ ID NO: 56880 - DNA, 201 bp, Homo sapiens
tgtaattcatcagccacgttagtgcctccgtttccacatttgtgaaacgtgtatgttttagtctgggacccatttgggttgagggagggagctctgcatcmaaaacttcaccccaaactccatacacactcagaaatggcccaagatatccaggaaggtctgcacatgtgcgaggaaggccttcctcccaggcttccgtga

SEQ ID NO: 56881 - DNA, 201 bp, Homo sapiens
ttccccctcaaaaaaaaaaaaaaaattaagatggagtctccctctgtcacccaggctggagtgcagtggttcaatctctccagggattacaggtctgcgcmactgcacccggctcatttttgtatttttagtagagatagggtttcactatgttggccaggctggtctccaacccctgacctcaggttatccacccgcctc

SEQ ID NO: 56882 - DNA, 201 bp, Homo sapiens
aacggtaactaaaatacctttttcaaatgacagaacagagagtgggggccagtaatctgcactctcagacaaaactgacaagtgggagaaaggcttgtctmccctgaaggacaaaaaccaggcttgggactggccacacatgatgagaaaactgtgagaaaagaagcaggagagactttggaagagggcttggcaggccgg

SEQ ID NO: 56883 - DNA, 201 bp, Homo sapiens
gggggccagtaatctgcactctcagacaaaactgacaagtgggagaaaggcttgtctcccctgaaggacaaaaaccaggcttgggactggccacacatgaygagaaaactgtgagaaaagaagcaggagagactttggaagagggcttggcaggccggaaagcgctaggtgcacacgacgggcagtgggggctcaaacaca

SEQ ID NO: 56884 - DNA, 201 bp, Homo sapiens
aaaaaccaggcttgggactggccacacatgatgagaaaactgtgagaaaagaagcaggagagactttggaagagggcttggcaggccggaaagcgctaggkgcacacgacgggcagtgggggctcaaacacaggtgggagcccaggggaggagggagcgattagtcatgctggggaggctccaagggccctttgtccttcc

SEQ ID NO: 56885 - DNA, 201 bp, Homo sapiens
tttcaggccttctggatttcttctccccaccccacccccaaccccagtagttatgccatagttctggacaaatacaatagccaggcatggggtcaggggartgtgacctagtcctctgtcatcagtccacattggtggccactgaggggcccatcctcccatcaacatgacctgctggccccagagactcactgctctccc

SEQ ID NO: 56886 - DNA, 201 bp, Homo sapiens
attttcaggccttctggatttcttctccccaccccacccccaaccccagtagttatgccatagttctggacaaatacaatagccaggcatggggtcagggragtgtgacctagtcctctgtcatcagtccacattggtggccactgaggggcccatcctcccatcaacatgacctgctggccccagagactcactgctctc

SEQ ID NO: 56887 - DNA, 201 bp, Homo sapiens
atgagaaaactgtgagaaaagaagcaggagagactttggaagagggcttggcaggccggaaagcgctaggtgcacacgacgggcagtgggggctcaaacasaggtgggagcccaggggaggagggagcgattagtcatgctggggaggctccaagggccctttgtccttcctagatggctactcagacgccagtctgcgag

SEQ ID NO: 56888 - DNA, 201 bp, Homo sapiens; identical to SEQ ID NO: 16470

SEQ ID NO: 56889 - DNA, 201 bp, Homo sapiens
gtgagggaagctaagagcacagatgctgctatttgaccttaagcaagtcactttcatctatctgagctccagttttcttatttataaaatgggggtgatamtaacaatgcctacatcatagcgttgtgatgagtaaatgagatgatgcaatgcattcaacaatgcaaaaatgtattatcatttaacgatgccatgtattta

SEQ ID NO: 56890 - DNA, 201 bp, Homo sapiens
tggattaaccattgtctaaacaggaaaggcaaatatgcagcaagtattccataaatcccttatccttttcccaaaccagacactcatcttgccacaagccyggacatggcctcagaatccatctcaacagagggatccaggcagttcttatcaatcaaatggaattaacatgccgtattaaacctgtttgcaatcttggag

SEQ ID NO: 56891 - DNA, 201 bp, Homo sapiens
ggattcgtggattaaccattgtctaaacaggaaaggcaaatatgcagcaagtattccataaatcccttatccttttcccaaaccagacactcatcttgccmcaagcctggacatggcctcagaatccatctcaacagagggatccaggcagttcttatcaatcaaatggaattaacatgccgtattaaacctgtttgcaat

SEQ ID NO: 56892 - DNA, 201 bp, Homo sapiens
tcagttcattcatcccacaaaagtttattaagcacctactgtgtgcaaggcactgttaggattcgtggattaaccattgtctaaacaggaaaggcaaataygcagcaagtattccataaatcccttatccttttcccaaaccagacactcatcttgccacaagcctggacatggcctcagaatccatctcaacagagggat

SEQ ID NO: 56893 - DNA, 201 bp, Homo sapiens
ggcttgctgtatagctaccaacctccggtagaaatagtaccatttaggagttagtagattgattgatgaagagatgaatttccacatgctgggtacaaggratggatagtcaagtggctagttaccgtgatctaattttttgaaattctcctatgacaaagcttgaaactcaggtcttgaatcctcagaggtgatttccat

SEQ ID NO: 56894 - DNA, 201 bp, Homo sapiens
ttgttgtgaacataaataaacatttggtgcttcagagataacccctttagtaaacccaagagatatccccactcacatgagcaaattatatacaaaatccmaatgggaagattagtttatgccaaggataggattgtgtaatctagaaacttggcaatacaggcataccaggacactggagctggcagtaccctctgctgg

SEQ ID NO: 56895 - DNA, 201 bp, Homo sapiens
aaagattggctgcaatagtaacaataaaaaaagctaacatttactgaaggctataccagttatcccaccaagtgctcaactaccaatcctcacagcagccrgctgcaggaattatcattgctcccactttatagataaggaaactgaagtttatagaggcagagaaacttgcccaaagtcacaaagctggcaactcccaga

SEQ ID NO: 56896 - DNA, 201 bp, Homo sapiens
cctattgtgaactgcacatgctagagatctaggttgcatgctccttatgagaatctaatgcctgatgatctgaggtggaacagtttcatcctgaagctatsccccctgcccccacactggtccatggaaaaactgtcttccatgaaacccatccctgatgcccaaaatgttggggactgctggtgtatagggtactgtagt

SEQ ID NO: 56897 - DNA, 201 bp, Homo sapiens
caccacattggccaggctggtctcgaactcctgacctcaagtgatctgcctgccttggcctcccagaatgctgggattacaggggtgagccactgggcccygccacctatgttcttaatccccgtgcaactctgcctcctatctatgtgccgaagaaaggaacaacactcccctccagacctctgcctttcacacccattg

SEQ ID NO: 56898 - DNA, 201 bp, Homo sapiens
caggagagactttggaagagggcttggcaggccggaaagcgctaggtgcacacgacgggcagtgggggctcaaacacaggtgggagcccaggggaggaggkagcgattagtcatgctggggaggctccaagggccctttgtccttcctagatggctactcagacgccagtctgcgagcaccccacgctcagctgctccatg

SEQ ID NO: 56899 - DNA, 201 bp, Homo sapiens
agcccaggggaggagggagcgattagtcatgctggggaggctccaagggccctttgtccttcctagatggctactcagacgccagtctgcgagcaccccasgctcagctgctccatgcttcagccaccatgcaacccatctggataatggactgttatgaagcatgttggcagccatcgattaggactaaactctatgctc

SEQ ID NO: 56900 - DNA, 201 bp, Homo sapiens
tctcttgttattgtacccaaatccacacattctcctcagtgttgtctgggaaatacatcaatccactgtgaatggtttagatagaatagaatccatcaatktcaccagcttcattcctcctcagatgatgagccactttctccactccacctccagggctggccccagtcttcctaaatgttcattaactcctattaggta

SEQ ID NO: 56901 - DNA, 201 bp, Homo sapiens
ggtgtgattagaactcctagcgggtgactcatagagagtgattagaagtaaaaaggttctggaaattcccccacactctttaaggcagcctttgtcaggtrtcttagtttcgtgaaaggtagactgatgttttccatctggtatacaaaacattttctaagtagttatagaaccttgaacaagccacttagctctctgggc

SEQ ID NO: 56902 - DNA, 201 bp, Homo sapiens
gtacagaccatcaggatggtgtatgggctttattttcctggtaaacacatttctgaccaatcattaccatttgctcttttgtgctaaacttcaaagtgacrgaaccaaatgtaggtattcagcttgcccaagcttgggctggtttttctcagtcgtcttcacccctgtgtttgaaagggttcctggggtagttctcccagc

SEQ ID NO: 56903 - DNA, 201 bp, Homo sapiens
caccagcagttcccagctgaccatccagccctcatcccaaacttcaccccacccaacaaagctcagtacagaccatcaggatggtgtatgggctttatttkcctggtaaacacatttctgaccaatcattaccatttgctcttttgtgctaaacttcaaagtgacggaaccaaatgtaggtattcagcttgcccaagcttg

SEQ ID NO: 56904 - DNA, 201 bp, Homo sapiens
tgcccaagtgtcctaagtgttctaggaataagcgacagactctgatctcatggaggctcagacccctgggcttcagggctctattccttccacccctaaaygtgacctgaagtggcccctgcctccctcagtcctagaggctgctgctcaattacagtgaagaatctcttatagactcacggtgacttaaacgctatttgg

SEQ ID NO: 56905 - DNA, 201 bp, Homo sapiens
attctaatatttatacaaatcatataacgatttcacagaaccaaacacttacaagtagaattctactaaaactacttgtgataacagtgaaagctagacaygtggtcattttaataatggaattacaaattaaataaacataattattatatcttactaatgcttgcaacaaaagctaattttaaaaacttggaatgtctc

SEQ ID NO: 56906 - DNA, 201 bp, Homo sapiens
gaaataaagtctaaaacatcaaagcgaaagatcagatgagatttaatgaagacccagtgtaaagaataaatgaatcttactccttatctggaatggctgcyttatttagaagccaaaattacataaagaatctcacacaaagcttaaataaagtttagatttaaggggggtatgtttcactctcataaactgagcttttaa

SEQ ID NO: 56907 - DNA, 201 bp, Homo sapiens
ctccggtgatggaagtctgaacagttacatctgctggtggtgttgcctggagacacgtttcagagaatagaaatgttctctgccttgatggtggtggtggytacggtggttgtaaacataatagacactcacaacactcacagagctatacacttaggattcgtcacctaaaaaaaaaaagaaagaaaaagaaaagaaaag

SEQ ID NO: 56908 - DNA, 201 bp, Homo sapiens
atatatttaacagatgcaattggaaataataacacaaaatggtatctcgggccaagccaacagccaaagcagtctagttgttgtttccaaaacacatagtrgtgtcctctttagtggacaatgtcagctccaatatgaggaaggggcagggcttacagggctgagccaggcagaaaccgatgacactggcctcatgccaag

SEQ ID NO: 56909 - DNA, 201 bp, Homo sapiens
caaaactaatctccggtgatggaagtctgaacagttacatctgctggtggtgttgcctggagacacgtttcagagaatagaaatgttctctgccttgatgktggtggtggttacggtggttgtaaacataatagacactcacaacactcacagagctatacacttaggattcgtcacctaaaaaaaaaaagaaagaaaaag

SEQ ID NO: 56910 - DNA, 201 bp, Homo sapiens
ttgggttaaggggtgataacgtccttcttgccctgtgttccagccatcacccagaccataaaatgctcccacgagcgatcggtgcaccttttcatcgactycttgctgcacgccggcacgcagagcatggcctacccgtgtggtgacatgaacagcttcagccagggcctgtgcctgagctgcaagaagggccgctgcaac

SEQ ID NO: 56911 - DNA, 201 bp, Homo sapiens
gacaggcacatctgccatttttctctgtcttcttcagttccttccaggttctctctgccttgcttaggagctgcccctgtttgcagagctcttcatcaatrgactgaatatttacagaatagcgcagttttgattaaacagttcatttcactggagactggggtggtgtattgtgtctcctccggagttattcttggcatc

SEQ ID NO: 56912 - DNA, 201 bp, Homo sapiens
agcgattctcctacctcagcctcccgagtagctgggattacaggcactcgccaccatgcctagctaattttttttgtatttttagtagagatggggggggsggtggtctcaccatgttggccaagctggtctcgaactcttgacctcaaatgatccaccagccttggcctcccaaagtgctggggttacaggtgtgagcca

SEQ ID NO: 56913 - DNA, 201 bp, Homo sapiens
tcagccctcaacaagttaagcaggttatataagaagtccaggcatggatgacgatgatcataatcatgatggggaggatgacaaagatgactaggaacgcyctgtcatctctctctctctctctctctctctctttccttcctggttgtgtgagtttgcagggagacgggaggttgtgaagaacaataaccagaagagagt

SEQ ID NO: 56914 - DNA, 201 bp, Homo sapiens
ggagcacagggccgcgccactcaggcctcgttctgaagacgatcagagtcaaagcaggagaaacccagcaaaggtgactgctgattcaatctcctattaaygtccattaagcacccacttgtgccaggcagtctcacaatttaatactcacattcatcatgtgaggtgagtattattaggccctagtgatggagtacagaa

SEQ ID NO: 56915 - DNA, 201 bp, Homo sapiens
gcaaaactaatctccggtgatggaagtctgaacagttacatctgctggtggtgttgcctggagacacgtttcagagaatagaaatgttctctgccttgatsgtggtggtggttacggtggttgtaaacataatagacactcacaacactcacagagctatacacttaggattcgtcacctaaaaaaaaaaagaaagaaaaa

SEQ ID NO: 56916 - DNA, 201 bp, Homo sapiens
gaggcagagaaccagtgacactacacgcaaaccaaggccatgctgcaaacagaacaccaaggcaccctcgtcttaggatgcattatattcggggtagatgytgaattctagtaacacattccctggggtgttttcaaatccagacacactggagccttgttccagcctcactgtgggcgaaggccccgggctcacctccag

SEQ ID NO: 56917 - DNA, 201 bp, Homo sapiens
gatgtggatatcggcgagctgatcatgatcaagttcaagtgggaaaacagtgcagtgtgggccaatgtctgggacacggtccagaccatcatcccatggarcacagggccgcgccactcaggcctcgttctgaagacgatcagagtcaaagcaggagaaacccagcaaaggtgactgctgattcaatctcctattaacgtc

SEQ ID NO: 56918 - DNA, 201 bp, Homo sapiens
gagaggaggggtccattcagatggttggagggcttagaattttatttttagtttacatgggcttgagcatttaagcaccaatcacatacagggcactgtgrtaggcgccagatactacctgagctagctcttacctacagcagaaaactcttggtccacaagacaactcttagtgtttggttctttttgtgaacataaata

SEQ ID NO: 56919 - DNA, 201 bp, Homo sapiens
catttgctatggactgaatgtttgagtcaccccaaaattcatatgctgaaatctaatccccaatgtgatggtgtttggaggtggggcctttgggaggtgaycaggtcatgagggtggagccctcataagtgggattagtgcccttataggggataaaggatcagaactctctgccatgtgcggatatgagaaggcaactat

SEQ ID NO: 56920 - DNA, 201 bp, Homo sapiens
ataagctccacctaaaacttaatgctgtgtttgcttcctgttttctattcagaatgacattttgttcagaaaacacagatgacctactacttcgcccaacmcaggaaaaaatcttcgtgaaatgtgaaataaagtctaaaacatcaaagcgaaagatcagatgagatttaatgaagacccagtgtaaagaataaatgaatc

SEQ ID NO: 56921 - DNA, 201 bp, Homo sapiens
aaaccagggctggggtgggacaccagagggtcctccagagaaggcagaggaagaaagacagggaaaaaaaacttggagcgcataaatactccccaaccacrgtcagccaggaggtgccaccttacttcatgcacagacatctgtcacttgaggcccagagctttgagctcccctacttgcacacaacattttcacatacag

SEQ ID NO: 56922 - DNA, 201 bp, Homo sapiens
gtcaggccagctacaactactttattccagacgcaaaccaaaaactatctgagacacatgtcaatcaatttagtttattttgccaaggttaaagacattaycgtgacacagcctcaggaggtcctggtgacctgtatccaaggtggtcaggctacagcttggctttatacattataggaagatataagacatcaatcagta

SEQ ID NO: 56923 - DNA, 201 bp, Homo sapiens
gatttgtctgatttattacccatttgttgggggtgtgctgtttccaacagttccttcttccattagttttggttccattaatctgaattttctcagtctawtctagcagagttgcagtgctggacattaacatatgtatgcatcaaacccatccttagggctgtaggaggtactgcatgcaggttatgggagctataattt

SEQ ID NO: 56924 - DNA, 201 bp, Homo sapiens
cattctttgataggtaggttggaactacttataatgagcatattggctttttttgtatgcaaacagatggtcttgaaagtagcttgagaggtactcaaaaytgatttgctcaagtaaatcaagcattccctcataaccttattcctttttttttttctttttgagacaggatctccctctgttgcctagactgggtcacag

SEQ ID NO: 56925 - DNA, 201 bp, Homo sapiens
agcattccctcataaccttattcctttttttttttctttttgagacaggatctccctctgttgcctagactgggtcacagtggtgcagtcatgattcgctsctacctcaaactcctgggctcaagcaaccctcctgccacagcctcctgagtggctgaaactacaggcacaggccaccacatccacataatttttgtattc

SEQ ID NO: 56926 - DNA, 201 bp, Homo sapiens
attttagagatggggtttcactatgctgcccaggcctcctggcctcaggcatcataaccttgtgtctaccactggagagtttccgcaaacctctttccccrctagctaatgcccagcctgtgtgtcattgttagcaccatgaactactgtggttttactgagaaaaggttacggcgaggttttctagggaaggatcagccc

SEQ ID NO: 56927 - DNA, 201 bp, Homo sapiens
aaacctgtgctcaaggacagggaggcaaaggtcaataagatgcactccctccctggggaggagacctaaaacagaccgcaggtgccctgctgcgtggctgkctcaggctctcagagtgtgaaggagagcacctcactcagcactggcagaggccggcaggcctaagtgggccttcaccatatgccaggcctggctaggagc

SEQ ID NO: 56928 - DNA, 201 bp, Homo sapiens
cctcaggcatcataaccttgtgtctaccactggagagtttccgcaaacctctttccccgctagctaatgcccagcctgtgtgtcattgttagcaccatgarctactgtggttttactgagaaaaggttacggcgaggttttctagggaaggatcagccctacgtgtttcttcttcctgctagttcactgatgtataataat

SEQ ID NO: 56929 - DNA, 201 bp, Homo sapiens
ataataatatccaaaagctaaaaagcacatctctcttcccctctccttgctcccgcgtaacccttacccctgctttcccattagggctggatgccgcgggrcctttgtttgagggaagtgcccccagcaatcgtctttctccagatgatgccagttttgtggatgccattcatacctttacccgggagcacatgggcctga

SEQ ID NO: 56930 - DNA, 201 bp, Homo sapiens
tgcatttggaaacagacaagtgttatacaaaattacataatatgataggaatgctgtcaatggatatctattattatatttaccagtcaaaattttagttsttataactggtatcaccaattaaaaaattttataagaaaggggtttttgtaccattggatctattgaatcattaaaaaaaaagagtttagaaaaagaaga

SEQ ID NO: 56931 - DNA, 201 bp, Homo sapiens
ttcatcagagggctaagcaacacacacctttaaaaagtgagtgagttttggccaggcgaggtggcttatgcctgtaaccacagcactttgggaggccagargcaggcagatcacttgaggttaggagttggagaccagcctggccaatatggtgaaaccccttctctactaaagatacaaaagttagccaggtgtggtggt

SEQ ID NO: 56932 - DNA, 201 bp, Homo sapiens
cgcgtaacccttacccctgctttcccattagggctggatgccgcgggacctttgtttgagggaagtgcccccagcaatcgtctttctccagatgatgccarttttgtggatgccattcatacctttacccgggagcacatgggcctgagcgtgggcatcaaacagcccataggacactatgacttctatcccaacgggggc

SEQ ID NO: 56933 - DNA, 201 bp, Homo sapiens
attcaatctcctattaacgtccattaagcacccacttgtgccaggcagtctcacaatttaatactcacattcatcatgtgaggtgagtattattaggcccyagtgatggagtacagaagctcagaaaggtgaagtgactatcccaactttacatagccacaggtgccaggacaaggattcacacccaggtctttgaataca

SEQ ID NO: 56934 - DNA, 201 bp, Homo sapiens
cagaggtttctatttatatggggggaggagcattacttgggagagagtgcatgctgcaggcatactatgttaaacctacagagagctgaactgtccagacrccgttgccaaagccccactgtctccacagcggcttcttcctagaagctaagctagagaaagttaactagatttgttatagtgggacttctcggagccttt

SEQ ID NO: 56935 - DNA, 201 bp, Homo sapiens
ccagggcctctgtgaagccctggggcagtagggggatgtctgacaaagcttcctaactgaggagccccacttcctctcgctctgggcacccctgccaaatragcgggcacctctatgttccagcagccctcgctgcccagcttctgagctgcaagccagcttccttccacagaattctctgcaccttggcttccggtggct

SEQ ID NO: 56936 - DNA, 201 bp, Homo sapiens
cctcttttcctgattaactcccacttttcctgtaagacacagtcccaaacaggtcctcctgcaagccattgctgccttcatcccagcactcccacagggcrttcagtgtcaccgggagttcccgtgtggccctgagcactctccaccactgctctgcagctcggctttctaattgtctgtgtttctctgctctgctaggcc

SEQ ID NO: 56937 - DNA, 201 bp, Homo sapiens
tctgtgccctctgcctagagtgttctttctcctcctcttttcctgattaactcccacttttcctgtaagacacagtcccaaacaggtcctcctgcaagccrttgctgccttcatcccagcactcccacagggcattcagtgtcaccgggagttcccgtgtggccctgagcactctccaccactgctctgcagctcggcttt

SEQ ID NO: 56938 - DNA, 201 bp, Homo sapiens
tcatgcgagactcgcctgtttgaagcagctgctcatgggatactgctatctatataatgttatgttatccaatgtggtagccacaaaccatatgtggctayttaaatccaaatctaagttactttaaattaaatggaaccaaaaattcagtttgtcagttacacaagccacctttcaagtgctcaaatacgtggctgctgc

SEQ ID NO: 56939 - DNA, 201 bp, Homo sapiens
agccttttagtgatgctaaaaattctattactatggaagaaggagagaaaggatattattggcaatagatgaagtcaaaccatgtgagaacttgtctccargaggaaatcctgcctccccagtgtctagcccacccatgatttcaagcatagttcacaatttgaaccctccagagattttggtgtctacttcatgacttag

SEQ ID NO: 56940 - DNA, 201 bp, Homo sapiens
caggcttcagagacaattgattgtaaatgttacttatcagacttaaaaaggtgccagacttagttcattctctcccagatcagtgaaaagacctggatagkgaagggaattctctacagaatgtagattttcccaccacaagacagctgttcagggccctttcaaaatatgtcaaagaaatatattttagggtaaaatagt

SEQ ID NO: 56941 - DNA, 201 bp, Homo sapiens
tttcccatttgatcctcacagcaacccccagacagggagagacacacgcacacacagagacacggtcagggcaaagtcacacaatttgtgagcaggaagcrtcgcattgaatcccagcctttgctccttttactgcacttggcctcggcgtaggaccaaggccctcgactgagtgcctctccctcctgcggcattccagct

SEQ ID NO: 56942 - DNA, 201 bp, Homo sapiens
tgtacaccagaactcgggtaaacactgcgagagtacagcagtagcaagagagaattgggaaacagtcgccgagtgaaacgaggcaatttatcgcccacttycattctcactctctcacaaggaacctttaccagtttgggagcctgtttttaagggagggggagggaaacggatctgtacggagtaaatcctgtttcgcca

SEQ ID NO: 56943 - DNA, 201 bp, Homo sapiens
gtcactttgctgttacgactaaactgattgtgtctgattttctttgtgtattcaaggggcaaaggaattgctagtaataaaacgtattcctttcttatcaygctggatgtggatatcggcgagctgatcatgatcaagttcaagtgggaaaacagtgcagtgtgggccaatgtctgggacacggtccagaccatcatccca

SEQ ID NO: 56944 - DNA, 201 bp, Homo sapiens
gactaggccctttggtgggggaagaggggacggtttcttcaggggcatctcacccctgggaagtgcatcctctctgctgggggcagtaaaaaggctttacrtgggccactgtggctcatgcctgtaatcccaacactttgggggcccaagcagggtgattcacttgagcccagaagtttgagaccagccgggcaatataaa

SEQ ID NO: 56945 - DNA, 201 bp, Homo sapiens
ctcagaagtccccttggcttctttcctggaggtgcttcagctctgctgttgccgtgtttctgaaactgtgcaggctccagacagcaacgttgtcacagccyttctcctgtcccaagagtgtggccaccttgccgccaagggctaggaggagaaacctcgaccatttctgaaacgatccttgggttggcctctctgtccatt

SEQ ID NO: 56946 - DNA, 201 bp, Homo sapiens
ccaaagggctcagaagtccccttggcttctttcctggaggtgcttcagctctgctgttgccgtgtttctgaaactgtgcaggctccagacagcaacgttgwcacagcccttctcctgtcccaagagtgtggccaccttgccgccaagggctaggaggagaaacctcgaccatttctgaaacgatccttgggttggcctctc

SEQ ID NO: 56947 - DNA, 201 bp, Homo sapiens
agctggggagccttcagaagggcaggatgcagtcccctgtccaaagggctcagaagtccccttggcttctttcctggaggtgcttcagctctgctgttgcsgtgtttctgaaactgtgcaggctccagacagcaacgttgtcacagcccttctcctgtcccaagagtgtggccaccttgccgccaagggctaggaggagaa

SEQ ID NO: 56948 - DNA, 201 bp, Homo sapiens
ttatgcatctttatccaatcaagtgcccttggacaaagcctgaaaccaggtaagagcctgacttttctccagagatgggcatgaacttttctttttaaaaygtgtgtcacaaagaatccaggggtttctgactgtatgggacagagcttgcttcagagcgtgccaggtggttctatacacgacctcacaggttcacaggga

SEQ ID NO: 56949 - DNA, 201 bp, Homo sapiens
ttcttcctgctagttcactgatgtataataatatccaaaagctaaaaagcacatctctcttcccctctccttgctcccgcgtaacccttacccctgctttmccattagggctggatgccgcgggacctttgtttgagggaagtgcccccagcaatcgtctttctccagatgatgccagttttgtggatgccattcatacct

SEQ ID NO: 56950 - DNA, 201 bp, Homo sapiens
gcacctcatttctgagcaggcacgaagaacagggtgggcgccacaacacactggaccgcaaaaggctttcatccaggcagctcttctcctgcccccatccygctgctgtcttccaggaatctgtgcaactctctcgaagccatgttcacctaattgggtacagcctgggtgcacacgtgtcaggatttgccggcagttcca

SEQ ID NO: 56951 - DNA, 201 bp, Homo sapiens
gtggaaagagcatgggtttgggtatgtcttccctcatgaaaaccgtggagccagaagcagtagtgttacagtgatgtcatcccctgaggctcagtttcctygtaggtaaggtgggaatggaaatgactgctgcataggctgtgagatgattttgtgagatgtaagcgcccaacagatggtggtgatgacgatgttggaatc

SEQ ID NO: 56952 - DNA, 201 bp, Homo sapiens
gctgtgatcctgaaatgggtagtattggctgtgcagattaggaacctgaggctcacagaagttacacagcttgaggacattgctcaaaattgtcccagtcyagatttgactgggatttgtctgatttattacccatttgttgggggtgtgctgtttccaacagttccttcttccattagttttggttccattaatctgaat

SEQ ID NO: 56953 - DNA, 201 bp, Homo sapiens
tagggctggatgccgcgggacctttgtttgagggaagtgcccccagcaatcgtctttctccagatgatgccagttttgtggatgccattcatacctttacscgggagcacatgggcctgagcgtgggcatcaaacagcccataggacactatgacttctatcccaacgggggctccttccagcctggctgccacttcctag

SEQ ID NO: 56954 - DNA, 201 bp, Homo sapiens
ctagcagggtgggatggggagtgggggctcagggagcctgggctggggagaggcatccgccctcttcaacagaatgattgggactttctggcagcataagmaataaccggcaggagaccaagaaggcgccgtttagctggctcatgtgtgagtgagtgatgaaactcaccctctggcttggcgccttatggaactatcaac

SEQ ID NO: 56955 - DNA, 201 bp, Homo sapiens
gctagcagggtgggatggggagtgggggctcagggagcctgggctggggagaggcatccgccctcttcaacagaatgattgggactttctggcagcataarcaataaccggcaggagaccaagaaggcgccgtttagctggctcatgtgtgagtgagtgatgaaactcaccctctggcttggcgccttatggaactatcaa

SEQ ID NO: 56956 - DNA, 201 bp, Homo sapiens
cgggacttacaatctgcatttctaacaaattcctggtgatgttgccgctgctggtccgaggccctcactctgagaatcactttgagcccctgcgttatcartaggggccatattgcccccaagagggtgaaattgtatcttgaggtgggtgatgaaaaaagtttttattataaagcagatatatatatatacacacacaca

SEQ ID NO: 56957 - DNA, 201 bp, Homo sapiens
tgggtggcctcaacaacagaaatgtattttctcacagttctggaagtgagaagtctgaggtcaaggggtcagcagggtgggtttcttctgaggcctctctycttgtcttctgatggctgcgtctcttctgtctgcacacagtcttctatgtttctgtgtccgatctcctctttttataaagaccccagtcatattggatta

SEQ ID NO: 56958 - DNA, 201 bp, Homo sapiens
cagcctggatgacagagagagagactccgtctcaaaaaataataataataatagaaaagaaaaggaaggatgctccagcgctcctgaagtcctcccagcaraagaaagggctgcccagcacaccctgccatagcaaccgtgcttttcggtcatccgtggttctccacggcagaattccaggcatccccgggccctctcctc

SEQ ID NO: 56959 - DNA, 201 bp, Homo sapiens
cagtctagcagtctgccaggactgccaggacagaggaccacagactgggtggcctcaacaacagaaatgtattttctcacagttctggaagtgagaagtcygaggtcaaggggtcagcagggtgggtttcttctgaggcctctctccttgtcttctgatggctgcgtctcttctgtctgcacacagtcttctatgtttctg

SEQ ID NO: 56960 - DNA, 201 bp, Homo sapiens
agtcacagccagctggaccccacctcgcaaggatgtggttcaataggtctagagcgggacttacaatctgcatttctaacaaattcctggtgatgttgccrctgctggtccgaggccctcactctgagaatcactttgagcccctgcgttatcaataggggccatattgcccccaagagggtgaaattgtatcttgaggtg

SEQ ID NO: 56961 - DNA, 201 bp, Homo sapiens
gtggctctccatactcagagggtggtttctggatgtcagagatttcgccacacaccagctctgtgccaggccttgtgctaggaccccaacatggtcactcratattcacacagtctagcagtctgccaggactgccaggacagaggaccacagactgggtggcctcaacaacagaaatgtattttctcacagttctggaag

SEQ ID NO: 56962 - DNA, 201 bp, Homo sapiens
ctgaaaaaagccaatagtctcccctatctcaaatccaggatcctcggaagggtttgttaagtcacagccagctggaccccacctcgcaaggatgtggttcmataggtctagagcgggacttacaatctgcatttctaacaaattcctggtgatgttgccgctgctggtccgaggccctcactctgagaatcactttgagcc

SEQ ID NO: 56963 - DNA, 201 bp, Homo sapiens
ctaaaaccaaatctagggctctgtcccaccaatctccacctggtgcctggaattcctctatttttgttttttgttctgttttgttttaaagtttcactcayccccctccttaaacccaaatatccctgggacaggatggaaatccataaacaggtgcctgagtaagacatcattcacagagccttttcctcctgacagctg

SEQ ID NO: 56964 - DNA, 201 bp, Homo sapiens
aatactatcttggttgtcaggtttaaaagaccaaatgaatgtcactgcctggcagactacttaaaacaataagaggtgctaaagttactttaaaccaaccytctccaccctctccttccccacctcagtttcataccccagagaccaaattcctgatggattcctaaatgatatctctgccaaatactggtgccaggtgct

SEQ ID NO: 56965 - DNA, 201 bp, Homo sapiens
ggggtttcaccgtgttagccaggatggtctcgatctgttgacctcgtgatccgcccccctcagcctcccaaagtgctgggattacaggcgtgagccaccgygcccggcctcattatatgcttttaattgcatttagcactgggctaaacacacagtagacttccaattaatacatatcatattaaactgaattgaagatcg

SEQ ID NO: 56966 - DNA, 201 bp, Homo sapiens
gatatttcgaaagagctgaagctttttcctccatccaagaatcctctatcttccaggttgtttttatgagctgaagaggaccctccacggctcctcggtgrcttagtagtatcaagacaacacctgagaaagctcctttcatgcaaatctctgtctcacgcatgtgaagagaccaccaagcaggctttgtgtgagcaacaa

SEQ ID NO: 56967 - DNA, 201 bp, Homo sapiens
tttttttttttttttttgagacgtagtcttgctctgtcacccaggctggagcgcagtggcgcgatctcagctcactgtaagctccacctcctgggttcacrccattctcctgcctcagcctccccagcagctgagactacaggcacccaccaccacgccccgctaattttttgtatttttagtagagaacggggtttcacc

SEQ ID NO: 56968 - DNA, 201 bp, Homo sapiens
tgcccctggctacccaaagtcaagcccagaaacacagatgtgagcacaaacccaggcagcccatagaaggcacagccctgtgatgtcaagcttaaaaattytgggctacttttaaggtcaccagggatatttcgaaagagctgaagctttttcctccatccaagaatcctctatcttccaggttgtttttatgagctgaag

SEQ ID NO: 56969 - DNA, 201 bp, Homo sapiens
tggcagctagaggactagccatcacatctttattccaggaagcacaatgtagtaaaagatgtacacaaaggagtcaaaagcaaggtttttacaagagcttyattgagatataatttacaaagcgtacaacttatccatttcaagtttacacaattcaatggcttttggtataaaagagtgttttttaggtgtcccagagcc

SEQ ID NO: 56970 - DNA, 201 bp, Homo sapiens
ttcctccagcattatccaggagctggagaaggaagaagggtgagcggggagaaaggaaactagtgcgaccctccctctgtcccctcctcaggtggacggcrtgctagaaaactggatctggcagatggtggccgcgctgaagtctcagccggcccagccagtgaacgtggggctggtggactggatcaccctggcccacga

SEQ ID NO: 56971 - DNA, 201 bp, Homo sapiens
ttggcagaaaagatgcgcccatcttgacatgccacgccatggaaacgcgccaccttgccaggctctaccaggcctcttggcagaggtgtccgtctctggtscagcaccacagacaggacagctgtcgggctgcctggcagagttggatggccactcacccacccctccaaagtggctcatggtcatagtgaggctccccca

SEQ ID NO: 56972 - DNA, 201 bp, Homo sapiens
atgagcatcccttaattctacaaaaagcaaaataaaatatgaaacagttaaaagtctattgcaacactataatttgaaggggaaaaaaaaggctaaggacmtacagtaggccactgggcagacaaaggagatcattctgagcctgagtcctcagtatttggtgacccagtagagaggcaagagagggcataagctctaagc

SEQ ID NO: 56973 - DNA, 201 bp, Homo sapiens
gcagcctatgcctctcaacctggatcaagggcaatgtggagaaaccacattattgcttgactgtagtgcagtattccaacaatcattttaaatgtgcactygtgtaaccatgatcaccatcaagatgtaggatatttccatctctctttagagattcccttttgccctttgctagttaatccccaccccattccctggacc

SEQ ID NO: 56974 - DNA, 201 bp, Homo sapiens
agacatattgcccagcacggcttcaatggtgagaatgaagtcatgggccgggagcaccggcctacatttcaatggggcctctggaattcagcggaatctascaacatacgggactcagggaagagttcagcaaggataggggcccagggtgtatggtcaccaagcccacccagagagaaggaatgctggagtgggcaaggg

SEQ ID NO: 56975 - DNA, 201 bp, Homo sapiens; identical to SEQ ID NO: 16472

SEQ ID NO: 56976 - DNA, 201 bp, Homo sapiens
ggtcacctccataaggacagccagagcttctgccaggaaagaaagaacgttgatgctattcgttttccaaaagagcgtatctcctccggctaatctgaacrtatttcttacagggctcttgaatgcccctttgtagctgagtgggtgaaacggcatcaccaacatttggccctgctgctccactgagagccggcgccgttc

SEQ ID NO: 56977 - DNA, 201 bp, Homo sapiens
taaattttaagaaataagagatttttaaatttaaaatcactgcttaaattatctctctctttctctctctgtctctctctctagtttatcattaccagttmaagatccagttcatcaaccaaactgagacgccaatacaaacaacttttaccatgtcactactcggaacaaaagagaaaatgcagaaaattcccatcactc

SEQ ID NO: 56978 - DNA, 201 bp, Homo sapiens
aatttattaggaatcatttatgtaagattatgtagaaaatgttactagtcgtgagatatctatccatctcaatgatttgacttttacagcaatgcgatggracgtgctgagggaccatttggtcaactttccacctaatggtggtgtgattagaactcctagcgggtgactcatagagagtgattagaagtaaaaaggttc

SEQ ID NO: 56979 - DNA, 201 bp, Homo sapiens
gacagcttggaggttaaaagcaagatggagtcaactatgtcagatttctctgtcatcatttcacaaaggcagtttcactgtgacctgctaatactgtgggraaaagaaaaaaacagtactcattgggccttaggcatattctaggttctttgcaatacttaattttgtttttaatctcaaaccagtctgagacaggattta

SEQ ID NO: 56980 - DNA, 201 bp, Homo sapiens
attagaatggtcatcgtggtgccaggagatctgcagtggtgaccttccctggtatcagctatttaaatattatcaggaaagagaaatgtggaagcaaagtyctatccattttaagcatgtgaccttttaccctaactgaaccttaattgactcatttgcctctagcaattcaaagattcccagacacccggaggacaaaga

SEQ ID NO: 56981 - DNA, 201 bp, Homo sapiens
tgacctctggccacatgacccctgagcagtaagggatgacagaaaatttgcctatatcttagcagaattcaggcccctttcataatcctgaccttctggcytttcactggttttgcaaaagtggttgagtttggggagtggctattatccttgctgtaaggttcaactataaactaaattcctcccaaagttagcttggcc

SEQ ID NO: 56982 - DNA, 201 bp, Homo sapiens
ggagcaagtctctttgaagttttcttatgaattgctatgcttaacactaaatcatgggaaagattaacacccatgaaactgaagcaggagcacataacagragcttaatatgaatcttccatcttaaaaatatcttattctacatctgaaaagagaaccatttggaaattccacgtcatactcacttatagacttaacagc

SEQ ID NO: 56983 - DNA, 201 bp, Homo sapiens
atcttaggctctacaatagtgatgttatctacagaagcaattaggcaagtcacaaatcttgtgacctctggccacatgacccctgagcagtaagggatgayagaaaatttgcctatatcttagcagaattcaggcccctttcataatcctgaccttctggcttttcactggttttgcaaaagtggttgagtttggggagtg

SEQ ID NO: 56984 - DNA, 201 bp, Homo sapiens
aagctgagcattacttgtaattggtagaaaaataatcattgcaaaagctaattaaccatccaccctgagcggctccttggcaggcctgaaaatatgatcargaaaattcttttcctatgagtgaggcattatcaaagcagggcagagcctatgggttatccgttgactaggactgacctttccgtgactgccaaaaacttt

SEQ ID NO: 56985 - DNA, 201 bp, Homo sapiens
ccttcactcagcgaaagcatagctggctgagtctctagacagagagtgtgttgttcaggctaaactatctccctaccatggacataaaatgacatgggtakagaacacactaaattcttcaaggtaacaaatttaaattcttcaaaaagggagtggctatttaaaatatctctagttcatttttagcattactgaaattca

SEQ ID NO: 56986 - DNA, 201 bp, Homo sapiens
ctcattgtgtgtgtcctgtgattacaactgtgtgaaaatacatgtgtttgagaaaaaatgctggaagaagatgcatgaaaatgtttatacgtccgttgagyttgtatctgaacttttgtctcttcccctctttatgtaatgttatagtatgtatatggtatattgactttcatgatttaaataatcagaaaataaatttac

SEQ ID NO: 56987 - DNA, 201 bp, Homo sapiens
agccctcatcccaaacttcaccccacccaacaaagctcagtacagaccatcaggatggtgtatgggctttattttcctggtaaacacatttctgaccaatyattaccatttgctcttttgtgctaaacttcaaagtgacggaaccaaatgtaggtattcagcttgcccaagcttgggctggtttttctcagtcgtcttcac

SEQ ID NO: 56988 - DNA, 201 bp, Homo sapiens
agccgcggtaagaaaggcagtcgggtcttacattcaggtacctacttggggcgagaagaccaaatccagtcactccagccctggaggagtcagggcgcccrcccggctgccccacagaaggtgcaattcctaaacatggtcacaaagtagcgcagtgacatctcagctgcttcggagttccaggagagggtttctggctca

SEQ ID NO: 56989 - DNA, 201 bp, Homo sapiens
cttatggacattctatgagccaaagcaattttgaagtctaatcatttggagggaaaatatttgtcatgtcattttaaagggtacaaaacaacacagaggaraatgaaagggttagaaaataattggagcgcttctccctttacccttgtagaagacagctctccggttttcagctccactcattctgtcctccattggaag

SEQ ID NO: 56990 - DNA, 201 bp, Homo sapiens
caagagctctattcattccgctgtgtctgctctcttactatatcagaaaagggaacagccaccaacttcctgtgttgaccctagaccaggacttcttgatsacagcacacttaacatttggggctggataattctttgttgtgagaggctgtcctgtgcattgaagggtgttgagcagtatccctggcctctacccactaa

SEQ ID NO: 56991 - DNA, 201 bp, Homo sapiens
ggcaagggtgcctgtcccccagcaggccactcctggcaacaggccaacgccacgccctgaggatgaacagagggcaccaacaggaacccccacttctcacyccagccccatgtgcccaggcaaaccctctcccggggtaccagctcttctgagagttgagtccggatgcctgtggttattcttccttctctggaagtttcc

SEQ ID NO: 56992 - DNA, 201 bp, Homo sapiens
tgttttacaaagaaatgttgcaaatctctctaatatctggcttcccaagacagctggattatcttacctgtttctgtactcagtctgttgtgatgtattgytttgtttgaaatgtaggaagaaaatctggcctcccatagaggaaaagggaggacatcctaaggcgatctccctggggccttggcctgcaaaccactgcgc

SEQ ID NO: 56993 - DNA, 201 bp, Homo sapiens
agaccactcccataaagggccataccctagtgttttctgacaatctagggatgaattccctattacatctcaggatgggagaaaaacaggatttgggagtyctggtttaatcactaaatgaacttaatcttgacttctggttttgtcatctgcaaaaggcaagtggtcctgatggctacttaataaagctgtctgtgagcc

SEQ ID NO: 56994 - DNA, 201 bp, Homo sapiens
ggatttcctttccccatccccacccctggcacctctaacacattaaagctcatcacagcagttattttaaggaaattcagcagaggtacttgcagggcccraggtcatcttgtgttggccctggatagatcatgaaatcctgttgccaaggagcatggtgggaatgtggcaggaaggctaaagtcaggaaagccacctcag

SEQ ID NO: 56995 - DNA, 201 bp, Homo sapiens
ggtaccagctcttctgagagttgagtccggatgcctgtggttattcttccttctctggaagtttcctcgttccagggaccgcctctattctgaaccacatraggatccacttaataggttgtggcttctcgatgaaggtctcactcttcatcccaccccatcagtttaattgaggaaattactcagactctcccaatggga

SEQ ID NO: 56996 - DNA, 201 bp, Homo sapiens
gaggggaatttatgagagttctatttccagtcaggtctaaagtagagatatcattgcacaatttctagactttgttttgctgccaaaattttagtctgagrctgaagaatccaacagccgtcctgcctgttttgtttgtaaattcacaaactagattgatggcgaaagacagatcaaatgccttatcaggaaggtagtaga

SEQ ID NO: 56997 - DNA, 201 bp, Homo sapiens
ttaatgaatttgatctttccttagtgacttgggtgcctattaaaatgcctactgtaacacgctgtcataaaggagtgctctcaggatcccggcagtgcccrggattttgcctgacactacatgactcagagggtctacttcccttagtttcagtcagttgtcacatcctgctcttgtcaaggggtctgccttgacaagccc

SEQ ID NO: 56998 - DNA, 201 bp, Homo sapiens
gaatactaatttgcctttggatctagccctgccgcccactcgagatggatggtccacaaatctcaatgtgattcctaacatgagttaagctgtccaaccctgtgacgttatcaggggatttgtgattaatacatagtgacaccatttaactgtggcagaggttcttacccttggaagctcattagaatcatctagggaact

SEQ ID NO: 56999 - DNA, 201 bp, Homo sapiens
catcagcatcacctgggaacttgttagacatgttagggtctcaccccagacctaatgaatcagaaactctgagaatgagggcccacaatctgggttttagsaagatctccagaagattctgatgcacacccgtttgagaaccaaagctccatggaatactaatttgcctttggatctagccctgccgcccactcgagatgg

SEQ ID NO: 57000 - DNA, 201 bp, Homo sapiens
ttagcagtggttcaaagaaaacagaaatttgttttcatttcgcaaaatattccaaagatatatgtaacccaaaaaccggctagacagctttggtcagtgargtcctccaggccccagctccttccagttcactgctctgccatcttggggtgtgaccctcatcctcatagtccaagatggcagctagaggactagccatca

SEQ ID NO: 57001 - DNA, 201 bp, Homo sapiens
ctgacttatgcaagtaactaccacagaaggcctgctgtgcagcctatgcctctcaacctggatcaagggcaatgtggagaaaccacattattgcttgactrtagtgcagtattccaacaatcattttaaatgtgcactcgtgtaaccatgatcaccatcaagatgtaggatatttccatctctctttagagattccctttt

SEQ ID NO: 57002 - DNA, 201 bp, Homo sapiens
aaacagcctgtcctctcaggcctgcaaaccaggagcagccaggcccagccctgacttatgcaagtaactaccacagaaggcctgctgtgcagcctatgcckctcaacctggatcaagggcaatgtggagaaaccacattattgcttgactgtagtgcagtattccaacaatcattttaaatgtgcactcgtgtaaccatga

SEQ ID NO: 57003 - DNA, 201 bp, Homo sapiens
tcaaacacagaactgactggctccaaagccagtgcccgccccactggccactccactaccctgcctctgccattgctccctatggcaacctggaaactgtsgggtacctgcccgtggtctgaagtgggcaggcagcagtcagctgggcctccagatatgggtggtgaagggaggatacaggtccaaaagaatatcttaggg

SEQ ID NO: 57004 - DNA, 201 bp, Homo sapiens
atctggaaggaactatgttgggttgagacatgagaaggaagagatcttaggcaagtttggaaagggaaacaacacattgaatgccaacccctggactagayatttcatcaacttcgttcatcctcactaccacccacacaagacggtcttcctatttccaacttagaagaaggaagttgaggctcctactggttaagcaag

SEQ ID NO: 57005 - DNA, 201 bp, Homo sapiens
ccagccccattcatcattcagcagaagacaggctgggctggcccaacttggtcctgtacccccaccaccccagaaccccactggtccatagtgaggatccsttctctttgactctcctccttctctgtgactcgcctaagcctgatcctacaccttctctcccagccactgcctcagcttcctccacccccagcttgggac

SEQ ID NO: 57006 - DNA, 201 bp, Homo sapiens
cttagcatccgtttctttacattttaaggtggagcataagaagaactgcagtgaaacagatcagatggggggcaggtgggatttctctttacctttccccsgctatttcttggtggatttatcccgttatcttcgctgctatttgctccttgctatcttttattcttctcttttgaaactggccgagtcagaaggaaataa

SEQ ID NO: 57007 - DNA, 201 bp, Homo sapiens
gaaggatcagccctacgtgtttcttcttcctgctagttcactgatgtataataatatccaaaagctaaaaagcacatctctcttcccctctccttgctccygcgtaacccttacccctgctttcccattagggctggatgccgcgggacctttgtttgagggaagtgcccccagcaatcgtctttctccagatgatgccag

SEQ ID NO: 57008 - DNA, 201 bp, Homo sapiens
ttaaaatcactgcttaaattatctctctctttctctctctgtctctctctctagtttatcattaccagttcaagatccagttcatcaaccaaactgagacrccaatacaaacaacttttaccatgtcactactcggaacaaaagagaaaatgcagaaaattcccatcactctgtgagtaggaggtgtagccccctagggtg

SEQ ID NO: 57009 - DNA, 201 bp, Homo sapiens
tagatggcagatggcagttggctccactagaagtgccacctggtgagcacgggcccacagtgggtgtgaggcgggacaacgggggcacacttccctcctgygtgtgtacctcacactgtgctaggatgattatggttctggcatacaaagtcacttatttttcatgcaacctggtccctaaacttaagaaaatgcctttat

SEQ ID NO: 57010 - DNA, 201 bp, Homo sapiens
caatacaaacaacttttaccatgtcactactcggaacaaaagagaaaatgcagaaaattcccatcactctgtgagtaggaggtgtagccccctagggtgaygacatttatttttcttgcagaacataaatggactctgtaattttcaagagtcaggccagctacaactactttattccagacgcaaaccaaaaactatctg

SEQ ID NO: 57011 - DNA, 201 bp, Homo sapiens
gccaaagaactggttttgcttgtttgtttcatttgccagtcagaagcgtgggggataatttagtggaatcccttcacagataggttttaacttgaaataaytcaactataggtgcttggcaaacaatcaaatagtgaacaggcccaagagagaaggaaataatttagatggcagatggcagttggctccactagaagtgcc

SEQ ID NO: 57012 - DNA, 201 bp, Homo sapiens
aatgctggagtgggcaagggtgcctgtcccccagcaggccactcctggcaacaggccaacgccacgccctgaggatgaacagagggcaccaacaggaaccyccacttctcaccccagccccatgtgcccaggcaaaccctctcccggggtaccagctcttctgagagttgagtccggatgcctgtggttattcttccttct

SEQ ID NO: 57013 - DNA, 201 bp, Homo sapiens
caatttaatactcacattcatcatgtgaggtgagtattattaggccctagtgatggagtacagaagctcagaaaggtgaagtgactatcccaactttacayagccacaggtgccaggacaaggattcacacccaggtctttgaatacacaccagggtctccccactgcccgtggctaacgctgcctgcctctggagcctga

SEQ ID NO: 57014 - DNA, 201 bp, Homo sapiens
tacgagcccagactcagcatatttaggagatggctcctaccacccagcaattagagaggggaggcaacgcaggcggaggacatctaccaatgcagcacatragcaagacacagggcctgagaataactgaaccctggcccacagatgccaaagaactggttttgcttgtttgtttcatttgccagtcagaagcgtggggga

SEQ ID NO: 57015 - DNA, 201 bp, Homo sapiens
atgctgcatgtttgcttatgatgggtgaggagagggaggagtcaatggtggctctgaagattctaggtattcacagggtcgggaagcacttgtttgtcacmggtttgttgggtgccggaggggaagaaagtcccgtgcaacagccacatgcaatgttcatcactcccctggctctcaggctgcttcagggctccagaccct

SEQ ID NO: 57016 - DNA, 201 bp, Homo sapiens
tagcattcagcaccctcactacaggccaagggtcattccgtagttgggttccgcaagaatgataggaacctaacagctttggcaggggtaatagcatcagytatgcatcatccactgatcacttgggctgacatgtagaatgcattggaagaggacggcggggttaagcagggagaccccgggggaggcagcagcaaggag

SEQ ID NO: 57017 - DNA, 201 bp, Homo sapiens
gccagactcagcctcccaaagtgctgggattaccaggcgtgagccaccgcacccggccaaggacatttttcatttgtcactgtgggtagggctggagaacrggtgatctcacggctcactctcaattccttcgccccccaagtagggaaggaaaccagggctggggtgggacaccagagggtcctccagagaaggcagagg

SEQ ID NO: 57018 - DNA, 201 bp, Homo sapiens
caatttgattattctgtggcttggtgtagtttccctcatattttttgtgttttgagatcattgatcatcttggatctatgtatttagtgctttcatcaaaygtagatatttttccaccattattatttctttaagcatttcttctgtcccctttcttgtctcctttggaattttcaattacatatatatgaggcctcttaa

SEQ ID NO: 57019 - DNA, 201 bp, Homo sapiens
atatgaggcctcttaaaattgcccgacagctccctgatgttctgttaatttattttcagcctttattctctgtgtttcaaatggatggtttctgttgctgygaattcaagtccactaatcttttcttctgcaatgtgtaatctgttattcatcccacctaatgtatttcatatctcagacattgatttttgaatctctaga

SEQ ID NO: 57020 - DNA, 201 bp, Homo sapiens
gaccagttatgtggcaggtggggagagctattctaaggttccttctaactccaaggggctcagatcggatatttggcaagtaagcaattggcacactgacsctgcagtttacaaagtgattcctacgatcctgagggtagaagaagattttgctcctggcagaggttttgcaggatgtgggtggggttggagaggaggctg

SEQ ID NO: 57021 - DNA, 201 bp, Homo sapiens
aagaacagggtgggcgccacaacacactggaccgcaaaaggctttcatccaggcagctcttctcctgcccccatcccgctgctgtcttccaggaatctgtkcaactctctcgaagccatgttcacctaattgggtacagcctgggtgcacacgtgtcaggatttgccggcagttccatcggtggaacgcacaagattggga

SEQ ID NO: 57022 - DNA, 201 bp, Homo sapiens
tctgtaaaatgaggcagaaaactatgaaagtgcctccaatctaagttccccaggctcctaagacaaggcctggcccatagaaggcacacagtacatgttgyttgagcaaataagtcagtttcttgtatggtatctggcatgtgatcagcataattaatggttgcttaaaaattaacagtctgttccccaccagtaacattc

SEQ ID NO: 57023 - DNA, 201 bp, Homo sapiens
ccatcttaaagtggcctggtcacagggtcagagcttcagcagacagaggcgccctgggataagttgccaaatatgggttgagcaacagtggcactggaacraggtaggaggcggggaaaggggatggaaggtaaaatcctgcccctgtcctcaaggtacttacagtcaatgtgaggaaggctgacagccataaaatgatga

SEQ ID NO: 57024 - DNA, 201 bp, Homo sapiens
aaggtagacattgtcgagaggcctcagcgttctccagaccatcagagtgccacgggattgtctcgtgtatctagttatattaagagaagaggagtcccacrcaagcctgttccagaaaacccaccctccaggcatcagcacctgggcattttaaattatctcatttgagatagaaatatttctataataaattacactaac

SEQ ID NO: 57025 - DNA, 201 bp, Homo sapiens
attatagataagaatactgggttcaaaagagatcacttggcttacccttgtctatactgcacctgcatgaatcatggacctgaacccaggtcacggccacytcccagacccttgctctctctgcttccccagcagcgcctctcagagtgaacacctatgtccatgacagtgattcccaaagtgttgtccccaaaccagcag

SEQ ID NO: 57026 - DNA, 201 bp, Homo sapiens
gtaatggcatggaaacatgctatgagatcaagccaaaagaaaagaaaaagtagaatgcaaaattttacatttgcattaaggaaaaaacacgttagaagaamatgcacttaaataaattgctctgtgtgatagtatgatagctgattatgtatttatcctcaatgctttctgtaccttcctgttgttctgaagttgtattac

SEQ ID NO: 57027 - DNA, 201 bp, Homo sapiens
tgtacccaaatccacacattctcctcagtgttgtctgggaaatacatcaatccactgtgaatggtttagatagaatagaatccatcaatttcaccagcttsattcctcctcagatgatgagccactttctccactccacctccagggctggccccagtcttcctaaatgttcattaactcctattaggtattccgaaactc

SEQ ID NO: 57028 - DNA, 201 bp, Homo sapiens
agaagtcacagaaacttttgggggcaataatgatgaagttcagaaacaaaagcctattgctggcccctaagcactcacagtttaacaccagggatcttagyacagaggatgggtttccaagagtcgttgagcctcctgagatggtgcccaaggctgtgtgtgtgtgcattttgagtggggagcaggtgtcataactttcag

SEQ ID NO: 57029 - DNA, 201 bp, Homo sapiens
ctgcagaaagcagagctcatgcagagccggccctttctgtcctaactcctgttagccaagccagccccctaaaaacagacctcagaacagcagagggaaayattcagaatcaaaggtgatgggaggaaaaaggaagaggaaacaggtaaatgaaagaaggaggatgaggattggaaagctgactacttaaacttttagcac

SEQ ID NO: 57030 - DNA, 201 bp, Homo sapiens
gtcagagcttcagcagacagaggcgccctgggataagttgccaaatatgggttgagcaacagtggcactggaacgaggtaggaggcggggaaaggggatgraaggtaaaatcctgcccctgtcctcaaggtacttacagtcaatgtgaggaaggctgacagccataaaatgatgacctatgacaacgagggtcgttccaca

SEQ ID NO: 57031 - DNA, 201 bp, Homo sapiens
tagtgggtaatgaagcacctaaaaggctgctttttttgtttgtttgtttttcctgagacggagtcttgctctgtcgcccaggctggagtgcagtggcacartcttggctcgcagcaacctctgcctcccgggttcaagcagttctcctgcctcagcctcctgagtagccgcgattacagacacacaacaccacgcccagct

SEQ ID NO: 57032 - DNA, 201 bp, Homo sapiens
cccatcttaaagtggcctggtcacagggtcagagcttcagcagacagaggcgccctgggataagttgccaaatatgggttgagcaacagtggcactggaaygaggtaggaggcggggaaaggggatggaaggtaaaatcctgcccctgtcctcaaggtacttacagtcaatgtgaggaaggctgacagccataaaatgatg

SEQ ID NO: 57033 - DNA, 201 bp, Homo sapiens
tttttggtttttctgagtctcgctctgttgcccaggctggagtgcagtggcgtgatctcagctcactgcaatccccgcttgcagggttcaagcgattctcmtgcctcagcttcccaagtagctgggattacaggcatgcaccaccatgtccagctaatttttctgtttttagtttagtcggggtttctccatgttggccag

SEQ ID NO: 57034 - DNA, 201 bp, Homo sapiens
agagtggcctctaggacaaatttcagcttgtacaattctggaatacagaaagggtagctggctagcgacctttttccatactccaccaggcactgtgtagrggctaagggaaagcttcccctttgccctctgaaagctcactgaaaactcacagaagacagattagtagaagaaaaggcatacgaatttattttaacatgt

SEQ ID NO: 57035 - DNA, 201 bp, Homo sapiens
ggtgctgggctacagcagggctggcaggagcagacggaggccacatgccaactccagcctctgctacatatggtcccagcccccctactcaccagccatgyggcctcaggcaagtgggataatccccgtgtctcagtttcctcatctttaaaaagtgggataataaaagattcatgtactttatagggttgttgtgaggat

SEQ ID NO: 57036 - DNA, 201 bp, Homo sapiens
gaaaaagacacacacatacatatcccatatgaaagttgtggacatcatgatacttcaattctaaatatttatacgctagtatttctttctttttttgagayagagtctcactctgtcacccacgctggagtgcagtggtatgatcttggctcactgaaacctccacctcctgggttcaagcgattctcatgcctcagcctc

SEQ ID NO: 57037 - DNA, 201 bp, Homo sapiens
gctacaaaaaccacagtcatgcagaagctggaggaaccaccaaggcaaagagaatggaaattcccttatgctagacagcacaggtccccagttttctgggrcatctgaaacttgatgtgacagcactgggagaggccaacagtccacgaataggccaggacctaaggggaaaggctaccactctacagccggccatcaggg

SEQ ID NO: 57038 - DNA, 201 bp, Homo sapiens
aatgcatttgttcttttttttttttttaagacagagtctcactctgtcaaccacgctgtgcagtagcacgatcctggcttactgcaaactccgcctccagsttctcctgcctcagcctcccaagtagatgggattacaagcatgcgccgccgcaccctgctaatttctatatttttaatagagacagggtttcgccatgtt

SEQ ID NO: 57039 - DNA, 201 bp, Homo sapiens
gggaggaggtaaagtgataaataggatgtggtcacggtgtcctaggcagtagcccctcacaatgccagtggatgtcaggatcacgaatcagggaggtctgwttcggtagaagacatgagttggggaggtctgatttggtacaagagatccagaacttgtgtccagctggagtaaggagagtaaggtatagcagagacagga

SEQ ID NO: 57040 - DNA, 201 bp, Homo sapiens
ctctgtcaaccacgctgtgcagtagcacgatcctggcttactgcaaactccgcctccaggttctcctgcctcagcctcccaagtagatgggattacaagcwtgcgccgccgcaccctgctaatttctatatttttaatagagacagggtttcgccatgttggccaggctggtcttgaactcctgacttcaagagatccccc

SEQ ID NO: 57041 - DNA, 201 bp, Homo sapiens
actcggcacaagagaggccaggctggggtgggaagaatggagagacagtgcctgccagtgacaggctggggcagggcgagaacaccagggaacatgcacaycgatcctgatttgagcaagtgttctcagaggcagctctataaattccttcaccacccctaagaattttgtactttgtcgcctgcctctaaacaatgcctt

SEQ ID NO: 57042 - DNA, 201 bp, Homo sapiens
aaccacgctgtgcagtagcacgatcctggcttactgcaaactccgcctccaggttctcctgcctcagcctcccaagtagatgggattacaagcatgcgccrccgcaccctgctaatttctatatttttaatagagacagggtttcgccatgttggccaggctggtcttgaactcctgacttcaagagatcccccctcctcg

SEQ ID NO: 57043 - DNA, 201 bp, Homo sapiens
gacaaggccaaaacagcactgggcgatgtgggctgagcagcccttggcttcgaaaacatgatttttttattattttttgagacggagtttcactcttgttrcccagaatggagtgcaaaggtgcgatcttggctcaccacaacctccacctcccgggttcaagcatttctcctgtctcagcctcctgagtagctgggatta

SEQ ID NO: 57044 - DNA, 201 bp, Homo sapiens
atgtgatgagaggcagaacagagcagttaagatgcaggctctgcacataccacaacgtggatgaatctcacttaatgttgggtgagaagagccaggcccaraagagcatctattgtgtgaatctactaactcgaagttcaagagcaggcaaaactaatctccggtgatggaagtctgaacagttacatctgctggtggtgt

SEQ ID NO: 57045 - DNA, 201 bp, Homo sapiens
atgattcgctgctacctcaaactcctgggctcaagcaaccctcctgccacagcctcctgagtggctgaaactacaggcacaggccaccacatccacataayttttgtattcttttttattttagagatggggtttcactatgctgcccaggcctcctggcctcaggcatcataaccttgtgtctaccactggagagtttcc

SEQ ID NO: 57046 - DNA, 201 bp, Homo sapiens
ctgttccagagaattcagagcaaattatagcctcaattcctattgcctgccctcaaacgaatacctcatgttggtgtgccaaatgggactaaaagatggayttttctagcaagaaagagtcttattttttaatctataatttacaaagtccaatttgggcgagttaaggagtgaagaatcacagccttaatttgctgtaat

SEQ ID NO: 57047 - DNA, 201 bp, Homo sapiens
cacaagattgggagaatcacaggtaaccatgcctaataactcacacactgatctccactccataggggcatccaacaaggacctgcttttccaacaggctyatcattaaaacaccccaacacttattgtgagggatcagcgctcatgagaggacttgtgacattctttcaaacatgaccaatgtcatggattgctgttcca

SEQ ID NO: 57048 - DNA, 201 bp, Homo sapiens
atagaataaagtagaaatgtatgtacttgtgtagaatattctccaagatataagtgaaaagacaaggtgccaaccagtatgcatggcttcatccagcttaygtaaaaagggagatgtacacatgtgcacttgtatgtgcctatcctgtctccagaacaatagcaacggctgacttggggcagcagggaaagagcctggggt

SEQ ID NO: 57049 - DNA, 201 bp, Homo sapiens
gaacccaagcacgctgtcttgggactggattttctttccccatgaagaatgtaaatttcttaatcacaggccctgtttattttacacacagtcagcatctrcaagtctttgttaactgattacaggtttctgtaattctaggcatgttaagcgtagggtcaagcataaactctgtccctacctttccagaacatatgctct

SEQ ID NO: 57050 - DNA, 201 bp, Homo sapiens
aggagagcacctcactcagcactggcagaggccggcaggcctaagtgggccttcaccatatgccaggcctggctaggagcttccctggaagattccaggtracgcccagcaaccctcaaaggaaaatgctagtattgtccccattttaaaaatgggaaaacaggcttaaaaagtcagatgtctggcccaacatcacacagc

SEQ ID NO: 57051 - DNA, 201 bp, Homo sapiens
cctggcacagagaaagcattcaatatatatcagcttttaaaaatgctgaagatcaatttgaatatatatgtatatataaagagatataaataggatcacaygtaaggaactgattctacttttaggaaactacactaagaaaatactaatagattccgataaatatttatacataaagaacatcatcagagaattgtttgt

SEQ ID NO: 57052 - DNA, 201 bp, Homo sapiens
gtaattagcacctacagctaaatataaggcagtgttctagcattggaggaacaaggaaatgggaagaaatacaaagaagaataagacacaggcctttgacycaaatccaactggatatccctttatactacgtctagcattttgcttaagtgggacctaaaaagttactccaagctgcctcccctagggtcttctggctgt

SEQ ID NO: 57053 - DNA, 201 bp, Homo sapiens
gattccgataaatatttatacataaagaacatcatcagagaattgtttgtaatagggcaaataaaaccttgaaacagcatacattttcaacaatagtggartaagtaaataaattacggcactttttccaagtatgttttgaagaatttttgatgctatgagaaaatgataatgataagtgaagaaggatttaaaaccatt

SEQ ID NO: 57054 - DNA, 201 bp, Homo sapiens
tagatttctcttgcccagaacaacctggccaaatggaagatgggaggctgaaatcctcactccaaggaggggcctccttttcttggcacaaaggcaccgcrccaagctacacagctaaggcagtgtgctacctaaagcaggtgcacagaattcacagagaggtaccaaataggctggcaaagaccttggtggataagtacc

SEQ ID NO: 57055 - DNA, 201 bp, Homo sapiens
ctttgagaagcgaagttctaaaggtcacaaaacaacttctcatttcttcagtgaactggtaattagcacctacagctaaatataaggcagtgttctagcaytggaggaacaaggaaatgggaagaaatacaaagaagaataagacacaggcctttgactcaaatccaactggatatccctttatactacgtctagcatttt

SEQ ID NO: 57056 - DNA, 201 bp, Homo sapiens
gtttctgggtctgtaaaataataggacccacttcctataaatgttgagaagattaatgggaatgatgcatgtaaaatgctcggtacatgataaaagcccartgattactcattatcccactcaatgcttggggaaaggcaaagcagctaatattaccccagattatagataagaatactgggttcaaaagagatcacttgg

SEQ ID NO: 57057 - DNA, 201 bp, Homo sapiens
ctattatagagaccccactgggctgttttgagggtgaaatgagaccacgtaagtgaacgcactttgaaactatccattgctggtcacaaaactaacgtgtrtacgcatctatttactaaatagtcatataatactcacccgattcatatgctactcccagtgtttttctctactttttattacaaaagtgttcaactacag

SEQ ID NO: 57058 - DNA, 201 bp, Homo sapiens
gattactattatagagaccccactgggctgttttgagggtgaaatgagaccacgtaagtgaacgcactttgaaactatccattgctggtcacaaaactaaygtgtgtacgcatctatttactaaatagtcatataatactcacccgattcatatgctactcccagtgtttttctctactttttattacaaaagtgttcaac

SEQ ID NO: 57059 - DNA, 201 bp, Homo sapiens
tagaggagctgatgggcacgtcacatttttctcaatgctggatgacattccatcaccttcctcatcttcatggaattttttttttttttttttgagacaargtctccctttatcacccaaactggagtgcagtggtgcaatcatgcctcactgcagtcttgacctcccaggctcaagggatcttcccacctcagactcctg

SEQ ID NO: 57060 - DNA, 201 bp, Homo sapiens
tcagaatgccacttctttctgccaagacctcaggcattgctatggcccagccccatctttattgatgtcggggctctgtccccttgcagagcccatcccaytgccacccacatctgggacagcaaaagacttctcagtttcctccagagttcagtttcttccaaaaagctcggcacatcttagctgccagtgtgaactgtg

SEQ ID NO: 57061 - DNA, 201 bp, Homo sapiens
cttcagccagggggttgcctagactcgcccaggcctcagacgaggggaaagggccaaggccggctgccactttctcatcatgtgcctgcctcccttcccamatagaagggtcaagcccaaattagaagggtgggatgatggctggtgcctgaggacagagctggggctaggaggacaaactcctgggctcctcttcatgtc

SEQ ID NO: 57062 - DNA, 201 bp, Homo sapiens
ctacgtgagccacgttgtagctggagagagaattgaaagaggaagccgagctgagaccaccacagttccggggctggagcccagctttgcagaatgcctgyatagcagtttgaccccaacagatgaggctgttagggacagaaatgaaaagcactgagagaggggaagtgtgggtggagcttatggacattctatgagcca

SEQ ID NO: 57063 - DNA, 201 bp, Homo sapiens
ctttttccttagaatatataaagctagtggtcctgggtataaacatgtaaaagttcaagttctggagtcaggttgtgtgagccgacgccccagccatataygacttactagctgtgtgatccgagaaaagtcacttaacttctctgtccttcagtttcctcttctctaaaatgagataataatcgtatcatttgtttgagg

SEQ ID NO: 57064 - DNA, 201 bp, Homo sapiens
cagcagccctgctgagacacacaggagccggctggccggccgctagcagggtgggatggggagtgggggctcagggagcctgggctggggagaggcatcckccctcttcaacagaatgattgggactttctggcagcataagcaataaccggcaggagaccaagaaggcgccgtttagctggctcatgtgtgagtgagtga

SEQ ID NO: 57065 - DNA, 201 bp, Homo sapiens
atgtagactttcttccagggaggaaagcagctttgctatctcctacctttttaaacaaaatctgccttgattttgtctgccaagatatgtctttggatggsgtaaagcacttctgagggaagctacgtgagccacgttgtagctggagagagaattgaaagaggaagccgagctgagaccaccacagttccggggctggag

SEQ ID NO: 57066 - DNA, 201 bp, Homo sapiens
aggaaatttgaaagtgagtagtaagtccacaccaggcccagacagggggcctgtgctgaaaggtgcaggaagcagcagccctgctgagacacacaggagcyggctggccggccgctagcagggtgggatggggagtgggggctcagggagcctgggctggggagaggcatccgccctcttcaacagaatgattgggacttt

SEQ ID NO: 57067 - DNA, 201 bp, Homo sapiens
atggctgaagattgagtgccagcctttgatccaagatctggatctggcaggacacctcaccgctcactaacatttattgagcacccaccattgtgcccagkgctaccctccatgagttcgctgacaggtggaggaagcacacacctggataaataaatcaccccgctgcagggcaagtgtattaggatcagggaggcagta

SEQ ID NO: 57068 - DNA, 201 bp, Homo sapiens
atttatcccgttatcttcgctgctatttgctccttgctatcttttattcttctcttttgaaactggccgagtcagaaggaaataaacaaatgcaagggtgygtagaaagagcattagatggtaggtccagaaacttggactctacatccagcatctagtgatgtgattgattgatatctgttttagcttttcggcacctca

SEQ ID NO: 57069 - DNA, 201 bp, Homo sapiens
aggccctgctgtgacccgggtcctgggcttggcactgggcatacagtggaaactgcaaatctctctttgttctatttgagcttcagcaactctccggaagscttccgcgttagaaaaaaggcttacaaatacacaggaaatttgaaagtgagtagtaagtccacaccaggcccagacagggggcctgtgctgaaaggtgca

SEQ ID NO: 57070 - DNA, 201 bp, Homo sapiens
aagcagtcacattctgaggtactgagggttagaacttcaatgtatgaatttgagggaacacaaagttcagcccattacacccagcaaacactttgctaggmcctgctgtgacccgggtcctgggcttggcactgggcatacagtggaaactgcaaatctctctttgttctatttgagcttcagcaactctccggaaggctt

SEQ ID NO: 57071 - DNA, 201 bp, Homo sapiens
tttaaaaggatttcctttccccatccccacccctggcacctctaacacattaaagctcatcacagcagttattttaaggaaattcagcagaggtacttgcrgggcccgaggtcatcttgtgttggccctggatagatcatgaaatcctgttgccaaggagcatggtgggaatgtggcaggaaggctaaagtcaggaaagcc

SEQ ID NO: 57072 - DNA, 201 bp, Homo sapiens
agggtgtgtagaaagagcattagatggtaggtccagaaacttggactctacatccagcatctagtgatgtgattgattgatatctgttttagcttttcggsacctcaggttttgggctgtttttttttttttttttttttaatctgttaattgaagtgattggtctagatttgtggtctttgaatgtgtgtcagccatgga

SEQ ID NO: 57073 - DNA, 201 bp, Homo sapiens
acgtgtcaggcagagcaggattactcggcacaagagaggccaggctggggtgggaagaatggagagacagtgcctgccagtgacaggctggggcagggcgwgaacaccagggaacatgcacatcgatcctgatttgagcaagtgttctcagaggcagctctataaattccttcaccacccctaagaattttgtactttgtc

SEQ ID NO: 57074 - DNA, 201 bp, Homo sapiens
cacacaattccttttccactctatcccgggcccatgtctccatcctgcccctgatgctggctctgcaggcattttctacatggctgtctgtgtacatgccrtgtggttagtcttaaatcaagggctcctagagtgcataggacataccagtttatactttttctcatcaggaatatgtgtagctggaggattaagaaatac

SEQ ID NO: 57075 - DNA, 201 bp, Homo sapiens
tggcgagatctcggctcaccgcaacctccgcctcccgggtgcacaccattctgctgcctcagcctccccagtagctgggactacaggtgccagccaccacrcacagctaatttttatatttttagtagacatgggatttcactctattagcagccaggatggtcttgatctcctgacctcgtgatccgcccaagtcaaaac

SEQ ID NO: 57076 - DNA, 201 bp, Homo sapiens
gcacgtgtcaggcagagcaggattactcggcacaagagaggccaggctggggtgggaagaatggagagacagtgcctgccagtgacaggctggggcagggygagaacaccagggaacatgcacatcgatcctgatttgagcaagtgttctcagaggcagctctataaattccttcaccacccctaagaattttgtactttg

SEQ ID NO: 57077 - DNA, 201 bp, Homo sapiens
aagtccttgctgtccttagtagctagggagctttaaaaataaatacataagcacctgtttccgtttttttactcctacagaagcagggaaattgctggagaaaaaaaaaaaatgtaagtccatatattctgtactgtgtcccttggaagaataaaattttaaatgaggtcatcaggaagtgcttcctaaatgtgaagttca

SEQ ID NO: 57078 - DNA, 201 bp, Homo sapiens
agacctcactttggagaatgctcagtgaggggcaaacatttgctggtgacattgtagttctgtcctttgctaagcttgagtgaaaatcttttggagaatcracttttttctttcttttttttttttgatgtcccttagagagctcacaataaataaataaatcaaaacaaagctaaaagttcataaaaaagtctcaggcat

SEQ ID NO: 57079 - DNA, 201 bp, Homo sapiens
agaatgctcagtgaggggcaaacatttgctggtgacattgtagttctgtcctttgctaagcttgagtgaaaatcttttggagaatcgacttttttctttcttttttttttttgatgtcccttagagagctcacaataaataaataaatcaaaacaaagctaaaagttcataaaaaagtctcaggcatggtccagattttca

SEQ ID NO: 57080 - DNA, 201 bp, Homo sapiens
tctaccaagccctccacttaggtaataatcacgtcttccaacctcactctcaccctgtaagggagctcttagaataacgctgctctccacggctgggaaacccaggctctgatgggtgacatcacttgttcaaggtcactcagccagtaagggccaggctgggctgcaaactcaatggcccactgcagagctcacacaggt

SEQ ID NO: 57081 - DNA, 201 bp, Homo sapiens
cacacagtccacaagagcccaagttcccactcaggcccattctcttagctctgtgccacccagctctgcaaatgtagccacccaaagccaatcaagccagwggtagagttctaaaaccaaatctagggctctgtcccaccaatctccacctggtgcctggaattcctctatttttgttttttgttctgttttgttttaaag

SEQ ID NO: 57082 - DNA, 201 bp, Homo sapiens
gcgagatctcggctcaccgcaacctccgcctcccgggtgcacaccattctgctgcctcagcctccccagtagctgggactacaggtgccagccaccacacmcagctaatttttatatttttagtagacatgggatttcactctattagcagccaggatggtcttgatctcctgacctcgtgatccgcccaagtcaaaactt

SEQ ID NO: 57083 - DNA, 201 bp, Homo sapiens
tgaatttcgttttacaaacaaggacaatccaaagaggccaagttacctgcccaaggccacacagtccacaagagcccaagttcccactcaggcccattctyttagctctgtgccacccagctctgcaaatgtagccacccaaagccaatcaagccagtggtagagttctaaaaccaaatctagggctctgtcccaccaatc

SEQ ID NO: 57084 - DNA, 201 bp, Homo sapiens
cactctgtcacccaggctggaatacagtggtgtcatctcggttcactgcaacctctacctcccagattcaagcgattctcctacctcagcctcccgagtarctgggattacaggcactcgccaccatgcctagctaattttttttgtatttttagtagagatgggggggggggtggtctcaccatgttggccaagctggtc

SEQ ID NO: 57085 - DNA, 201 bp, Homo sapiens
cagattcaagcgattctcctacctcagcctcccgagtagctgggattacaggcactcgccaccatgcctagctaattttttttgtatttttagtagagatgggggggggggtggtctcaccatgttggccaagctggtctcgaactcttgacctcaaatgatccaccagccttggcctcccaaagtgctggggttacaggt

SEQ ID NO: 57086 - DNA, 201 bp, Homo sapiens
tcaggaagtccagctggctttttctcctgtctgtctctcaaatgtgtcccctggctcccctccattgccactgccctcttcagtgtctggcctgtgctccyacaacaacaggcttgaagctggctgccctctcccctccatcttccacaccataatccaggtgatccttctaagaggcaaaggtaatcatgtttcttccct

SEQ ID NO: 57087 - DNA, 201 bp, Homo sapiens
agatcaagagtcttgacgatccccaagctagtccactcagtccagttttcctgccagactatagctgttttgcattccttatcttgtgttgaagcaaaccrggtaaggaaactccccaccttttttattaatgactcattttcagccaaaacacattgcagccacatcaggtacatgtgcccactcagcaaagacgtactg

SEQ ID NO: 57088 - DNA, 201 bp, Homo sapiens
gaggcatgcgaatcacttgatcctgggagatggaggttgcagtgagccaagatcctgtcactgcactccagcctgggcaagagagtgagactcttgtctcaaaaaaaaaaaaaaaaatcttgccccttccctcaaggggctcacagcctgtgggagagggaaaatagatataattatatttaaagaattataaaacaaatt

SEQ ID NO: 57089 - DNA, 201 bp, Homo sapiens
ggatcagaaggtcaaggctgcagtgagccatgattgcaccactgcactcaaacctaggcaacagagctagaccctgtctcaggaaaaaaaaaaaaaaaaargaggcttttcacgaatttcacattccaccctccaccatctttgatgtaggtaatttatcagcattttgtagaggaggaaacaaggtctcccctacgttga

SEQ ID NO: 57090 - DNA, 201 bp, Homo sapiens
cagagaaatagcttgtctccaaggccacagagcagctggcaggggagagtttggggcaagggatttccttagggaaaacaccaattcgttctggtcatgcmcagtcacatgggtcccaaccatcaccttcccaggccaaggtcttaggttcccctggaacccctttggctttactcccttcctgggctgggggaaagggtg

SEQ ID NO: 57091 - DNA, 201 bp, Homo sapiens
ccaacaccattttagttactcacatggagctaagacaatcatacaaaactcaggcatggggtcagcccaccagcagtgtggacctcaccctgccggctgcrttccaaatgacagtggcatggtgccacagaaaaaacatgaggtgtgcagctggacccccagaagccctgactctgccaggtgctagctctgggacatctt

SEQ ID NO: 57092 - DNA, 201 bp, Homo sapiens
tgcctctgcccaacacactcccgttctttcaacacccaactcaactattaccttctctccatcagatcttccctgaaccaccccccagaaacaaaggtgastgtcccctctggttccccacagccaccccaccacttacccctgtgctcaggcactcctggagcactgcattgcaaccattggctcacacatctgtctcta

SEQ ID NO: 57093 - DNA, 201 bp, Homo sapiens
cattcattctcactgctgtagcattccactgcgggaccatgccacacttcctttatccattctactgtggattggccaggactgtttttgcaatggagccrtgggaattggaagctgtcagtgctgagatagaggttgaagggagggatggcctcccccaggcttctgggtattgtccagattttccttgagcaatctcat

SEQ ID NO: 57094 - DNA, 201 bp, Homo sapiens
ctcccgccagcactccaccacagcctgcctactgtctgcccgtttggactagcagctggtgctgtgggatctttaactccactgaaattatgtcacaaaaytggggcatcgtagggaacctaggaaaacagacaagaaataaagactccatatgtgcctggcccacacccgagtttggctcactatgcacacattagatcc

SEQ ID NO: 57095 - DNA, 201 bp, Homo sapiens
aaagagaatttctagaccacaagtttcagtgtggagagctgcaggcttagagaattgcagggatgtttgaagccctgcccacagttccaggaaacaccctktgtatatgagctcctttcccacacaaatgtgagaaggaggctatgaccctggaaattgaacacagggcaacagaaaccctgccgaaactattcttgcatt

SEQ ID NO: 57096 - DNA, 201 bp, Homo sapiens
tcctcctgcctcagcctcccaaagcactgggatcacaggcatgaaccaccatacccaccctaaggaatatagttttttgagcatgttggagtactcagaaytctcagctcagctcttggcccacttgggtctcaaccatttagagtactgattaccaaaggaagagcacaaaggaagaaaatcagcttttctcctcttcct

SEQ ID NO: 57097 - DNA, 201 bp, Homo sapiens
gatctgcccacctcagcctcccaaagtgctgggattacaggcctgaaccactgtgcctggccgagatatcccattttggataggggagcctgggacatatyctcaacttccgtgggtctggccactacttatcagaagtttctgctcaccttacacaactgtgagtgatggccaggagcagcctcagtggcccaaggggaa

SEQ ID NO: 57098 - DNA, 201 bp, Homo sapiens
atctccccctcattgcaatgtaccaagctgcctccaataagatcaagagtcttgacgatccccaagctagtccactcagtccagttttcctgccagactayagctgttttgcattccttatcttgtgttgaagcaaaccgggtaaggaaactccccaccttttttattaatgactcattttcagccaaaacacattgcagc

SEQ ID NO: 57099 - DNA, 201 bp, Homo sapiens
ctctcctgtgtattcacaaggcaaagatccccaaggttttgaccaatacccaatgttgttttggtgccagcttgcacagcaccagggctcttgcctctcakagagaattgtgccccctctctccactatgtggcacagcacattgagctcaacaacgttctatcagactgatgttgccataacactgcatatcttcaccca

SEQ ID NO: 57100 - DNA, 201 bp, Homo sapiens
ggctggttcagctatagatttggctaaaattacctgtgtacttactagacgccaggcagttagggggctttgcttaaatcactctcctgcattcttcacayagcacttgatgaaggaggaaagtgagtcttggaggttaagtgacttgtccaaggttacacagctgggaagggagaaagacatggctccatcccaggttcc

SEQ ID NO: 57101 - DNA, 201 bp, Homo sapiens
gtgttgcaaactctccttagaccactcagctaataatttcctctctggtatagctgaaacatgggcttgcctgaagggcagaggcagaagaagcctccaarcctcccaaggtcctgtgattctcattgatgcctacttctagtggttctggtgtccctctcagagcccacatgggtatctgagccttcagagatatctcat

SEQ ID NO: 57102 - DNA, 201 bp, Homo sapiens
ttttcttctgcaatgtgtaatctgttattcatcccacctaatgtatttcatatctcagacattgatttttgaatctctagaagttcagtttagacttcttrtatctcccatatttcttcttagcatgcttacattttcttctaccatcttgaataaatgaaatatagttataagaactgttttaatgttcttgtggactaa

SEQ ID NO: 57103 - DNA, 201 bp, Homo sapiens
tgccagggaatcagtgatgagccccaggaaatgctttttgtctaaaaatatgccatttccgaaaggaaaacagtcattagagggtgtgagaagccctcgtrgtgaggaaagcaaaactgtaagactcaatgggaggccagtggaacaacagagaagcccattacccacccacttcctgtgcgattaacaagacgtttggag

SEQ ID NO: 57104 - DNA, 201 bp, Homo sapiens
ttcattcccacctgcattatatgacttgattcttacagtagccctgtaaagaatattgggtaggaattcttattcccattttagagacgtaaacattcacyatccgcggaccatggggaacacagctgacatcaattgcaagtcagtttctgtggtttactgcagcaagggagagctcactccagacttgggcttgtgctg

SEQ ID NO: 57105 - DNA, 201 bp, Homo sapiens
gttgggaattcttgagattttggggtggccctggatggggtacataaaaagaagtggccagagggaaggacaggaagggccatcctcagaagttttgtccycatcctggaggcagggcagaccactgatgaggggggttgtttttaaaaggctgcctttcccagatggattgatagacttatctcagcctggctaaaaccc

SEQ ID NO: 57106 - DNA, 201 bp, Homo sapiens
atgtattcagtgtgttctagaactcggatctcttcttagtgtcactgtgaaattttccattacttcatctcacttcctgttctctcataagcgcgaacacrgggctgtaatcatcgtctgaccaccacatgttagtgcactgtgtttcttgctgacacctggctaggctttgaggatgagtttccatcccaacatctacca

SEQ ID NO: 57107 - DNA, 201 bp, Homo sapiens
aaatgtaggggtcaagggtgcctaaagttcatggcttggggatgtcactcacagagctggggacagatagaggaaagacacttttgagggaaaatatgtaktcagtgtgttctagaactcggatctcttcttagtgtcactgtgaaattttccattacttcatctcacttcctgttctctcataagcgcgaacacggggct

SEQ ID NO: 57108 - DNA, 201 bp, Homo sapiens
cttttgtctcttcccctctttatgtaatgttatagtatgtatatggtatattgactttcatgatttaaataatcagaaaataaatttactacgaaatgatraaataaaggagtttgactagatcagtgatcctggaactgtagtgggtaatgaagcacctaaaaggctgctttttttgtttgtttgtttttcctgagacgg

SEQ ID NO: 57109 - DNA, 201 bp, Homo sapiens
caacactttgggaggccaaggcgggaggatcacctgaggtcaggagtttgagaccagcctggcaaacatggcaaaaccccatctccagtaaaaatacaaawattagccaggcatggtggtgcacacctgtaatcccagctacttcggaggctgaggcaggagaacagcctgaacccaggaggcagaggttgtggtgagcca

SEQ ID NO: 57110 - DNA, 201 bp, Homo sapiens
cttaggggtctatttccagaagcattcctcatttcattttttccccagtggggcttggctaggggtggggaggcatggggaaaaagtgaagagaagagaasgaaatgcatggaatgcaagcggaggcctctttgtctacagcgttttcacctccacttgtgcaggttcatattcagggcctggtgaagtcagttctggcac

SEQ ID NO: 57111 - DNA, 201 bp, Homo sapiens
aaacacaaagcatcaacgaaaaaaaaaaaaaagtaaaagtacatagaaaaggagacacagaggaatacagaaaagcaaaaacctccttcaaactggtggaygtttcatcccaaaggacgctcgacctttctcaggcatcctgccactgaagaagtcaattactcacggcccacagtccctaggttccgctcagcacagtct

SEQ ID NO: 57112 - DNA, 201 bp, Homo sapiens
catgctgggtcatcacagttggcacagcagggagagaggcagaaagaggctgggccccgagacagggcagaacagtccccatttcatcatgaggggaatgyaaccacccaggcctcagcctgggtgtccctgacagccacgggctccacgtagaacagaggtcacagcgattctcacagccaggaaggtactgtgcgctgg

SEQ ID NO: 57113 - DNA, 201 bp, Homo sapiens
tcttggtcctgctgtcccctgaaaccaaaagcccaagacatattatttgagaagcctgaatgattttattctcagaaagaatgatcagggtccttattaawtgggctgaattgagttcactgaccaaaaaggtcagagcggccttgtgtctgctcctcagccgcaggggagcccaccttctaccagaaggaagggatgaga

SEQ ID NO: 57114 - DNA, 201 bp, Homo sapiens
caaggttgcatgcctgtgagcctcgactcatgttgctccctcagccacccctgacccccgcaacaaaacacacacacacactcaatcatcctgcaaggccrgggtcaacatcacattccctgaaaagccctccctgaatgccacaccctccctcaagcggcatccactactccctctgtgattcccccaaccctgccccac

SEQ ID NO: 57115 - DNA, 201 bp, Homo sapiens
aaggcccagcacaagtgtctttgctctgtaaatccattaggagtgccctgcaaattggttctcaaacaaggcacacacacagaacaattctctgtaaacawtttttacctcctactatgtcaggctcacagtgcccatcccgctaagtccagcataacgcagtctgcagggcagagccagtgctatgggtttaggggtgag

SEQ ID NO: 57116 - DNA, 201 bp, Homo sapiens
gacctgatttacacatatttctccactgttttaaggtttagaaagtccctaagaggaaaaacattaagataattgttctcgggagggggcgggggggaacrtttggaaaaatctggagacatttttggttttcaaaacctggggcagtgggtgggtgttgctggcatctagttggtgaaggccaggaatgctgctaaacat

SEQ ID NO: 57117 - DNA, 201 bp, Homo sapiens
acacctgtactcccagcactttgagactgaggcaggcagatcacctgaggtcaggagttcaagaccagcttggccaacatggcgaaaccccatctcttctaaaaaaatataaaaattagccaggcctggcacctgtaaccccagctactcgagaggctgaggcagggagaattgcttgaacctgggaggcagaggttacgg

SEQ ID NO: 57118 - DNA, 201 bp, Homo sapiens
tgggagaaagcttccattgacctcaccaccctctccagctcatgctctgttctccagagccaagctttcacacagggttgtctacgtgtatggagtggtgaaaaagagttccttgggctttggagtcagacaaacctgagtcttcaatagttgacctaacctctctaggtcttatggcttcatccataaaatggacaattc

SEQ ID NO: 57119 - DNA, 201 bp, Homo sapiens
ttttatttacgtcacaaatgcttctacagcacctactatgggccaggcatcatgctaataagggctttaccaatattaattcatttaatcctcacagcaacccactgagatgaatactattcttatcctttggtactgtggggaaactgaggcacagagcagggaaataacttgcccaaggttacacagccagtcagctcc

SEQ ID NO: 57120 - DNA, 201 bp, Homo sapiens
acagcttggaggttaaaagcaagatggagtcaactatgtcagatttctctgtcatcatttcacaaaggcagtttcactgtgacctgctaatactgtggggaaaagaaaaaaacagtactcattgggccttaggcatattctaggttctttgcaatacttaattttgtttttaatctcaaaccagtctgagacaggatttac

SEQ ID NO: 57121 - DNA, 201 bp, Homo sapiens
cttggaggttaaaagcaagatggagtcaactatgtcagatttctctgtcatcatttcacaaaggcagtttcactgtgacctgctaatactgtggggaaaaraaaaaaacagtactcattgggccttaggcatattctaggttctttgcaatacttaattttgtttttaatctcaaaccagtctgagacaggatttactatt

SEQ ID NO: 57122 - DNA, 201 bp, Homo sapiens
tccctcatccctggcctgacctaagagggctggggtaccacaggactgttgaccccactgagagctcagggtgccagaaacactgcctgccacgtgattcytattggtccttccagagatgctaacaggcctggaggctggaggtctctctgcccacactttcacacatgacctggagcagggggtcccagctctgtagct

SEQ ID NO: 57123 - DNA, 201 bp, Homo sapiens
acagacaagaaataaagactccatatgtgcctggcccacacccgagtttggctcactatgcacacattagatcctgccattcacaatttaaaatatatatwtatttttttgtgtatatatacatatatacacacctagaaaaaaagtatgtattttgtatatatacaaaatttattacgtataaataaaatttatacaaaa

SEQ ID NO: 57124 - DNA, 201 bp, Homo sapiens
cacattagatcctgccattcacaatttaaaatatatatatatttttttgtgtatatatacatatatacacacctagaaaaaaagtatgtattttgtatatatacaaaatttattacgtataaataaaatttatacaaaatttattacgtataaataaaatttatacaaaatttattacgtataaataaaatttatacaaaa

SEQ ID NO: 57125 - DNA, 201 bp, Homo sapiens
ttattccaggaagcacaatgtagtaaaagatgtacacaaaggagtcaaaagcaaggtttttacaagagctttattgagatataatttacaaagcgtacaamttatccatttcaagtttacacaattcaatggcttttggtataaaagagtgttttttaggtgtcccagagcctctgtgaaattctcccagttacatccatt

SEQ ID NO: 57126 - DNA, 201 bp, Homo sapiens
attcacaatttaaaatatatatatatttttttgtgtatatatacatatatacacacctagaaaaaaagtatgtattttgtatatatacaaaatttattacrtataaataaaatttatacaaaatttattacgtataaataaaatttatacaaaatttattacgtataaataaaatttatacaaaatttattacgtataaat

SEQ ID NO: 57127 - DNA, 201 bp, Homo sapiens
aaaaagtatgtattttgtatatatacaaaatttattacgtataaataaaatttatacaaaatttattacgtataaataaaatttatacaaaatttattacrtataaataaaatttatacaaaatttattacgtataaataaaatttatacaaaatttattacgtataaataaaatttatacaaaattttgtatatatttgt

SEQ ID NO: 57128 - DNA, 201 bp, Homo sapiens
atcatacaaaactcaggcatggggtcagcccaccagcagtgtggacctcaccctgccggctgcgttccaaatgacagtggcatggtgccacagaaaaaacrtgaggtgtgcagctggacccccagaagccctgactctgccaggtgctagctctgggacatcttgggcaagccatttggcccgagtctttttccccaccta

SEQ ID NO: 57129 - DNA, 201 bp, Homo sapiens
gaaggaagaaaacagctcaagaagaggctaaaacatgagcagcaaccatagcattcagcaccctcactacaggccaagggtcattccgtagttgggttccrcaagaatgataggaacctaacagctttggcaggggtaatagcatcagttatgcatcatccactgatcacttgggctgacatgtagaatgcattggaagag

SEQ ID NO: 57130 - DNA, 201 bp, Homo sapiens
ctcaaatgatccaccagccttggcctcccaaagtgctggggttacaggtgtgagccatcacacccagctgataagtagctttaaacacaagtgaggattcyattccatcaggaatggctgctttatgcagaagaactctaagattacatcaggctaagggtgacagaatgctgtaatccattagccttatctgtcatggtc

SEQ ID NO: 57131 - DNA, 201 bp, Homo sapiens
tttattatgtgagatatcaatatttccttcattagaaattaaaactgagaaatctttaaaatctgctaacactttttaaaatgataataaacccttgcatrttaacacatataatgtaattttatgaaaaataacttgtattttccaaataagttttaaatggagaagagtgacattgttttacaaagaaatgttgcaaat

SEQ ID NO: 57132 - DNA, 201 bp, Homo sapiens
ttcacacgtttcctctcttaaaaatcactgaggaccccaaacagtgtttattatgtgagatatcaatatttccttcattagaaattaaaactgagaaatcyttaaaatctgctaacactttttaaaatgataataaacccttgcatgttaacacatataatgtaattttatgaaaaataacttgtattttccaaataagtt

SEQ ID NO: 57133 - DNA, 201 bp, Homo sapiens
ctggcagttaagtgccttgccggcggtcgcatagctggtcagggcagagcagggagaggtacctgcagcctcaatctgtctactgaggccgcagtgctctstgtcgagcccacacccagtgatttgacagccagaggtttctagaaaaacattctgctcagttcctctcacagagagggagatttagacagttgttcctgc

SEQ ID NO: 57134 - DNA, 201 bp, Homo sapiens
aatcatcctcggattaaaagtcttctaagagtgcctgcagctagcagtgaagtctcttgcgtatctgatatggaaacagtcatgctaaaagttattcagcrgcaaatgatatgaaagcgattcagatcttcctgagagttaatgtggcatctaatttgcaaccggggagccaggcttgcaatgaaatgctctgtcgggttg

SEQ ID NO: 57135 - DNA, 201 bp, Homo sapiens
cacctggctgtttttctctaagttttctacaatgttttattttgctttttaagacagaaagtccacgcaaaccagtcaggaatagatgtgaaaaatggggatggggcctttgaaccaggagcaatatgagaaggtgagaaggatggcctgggccggctgggtctgcgagactacctggaaaagccacgggaatcacagccc

SEQ ID NO: 57136 - DNA, 201 bp, Homo sapiens
acacacacagcattttaaaacctagaaggaaatcacaaccataatacaatagttatctctgattatgggaatacaggtaattttggtgattttctctatgytttcttttttttctttttcttttttttttttgagacggagtctcaatctgttgccccaggctggagtgcaatggcatgatctcagctcactgcaacctcc

SEQ ID NO: 57137 - DNA, 201 bp, Homo sapiens
gtagagggttgttcaaatattataattctggtacaaccacacgttaggattctctcttgccaattattgatgtcgtgggggagtgttcaagacaaaacatwgagttataaaatcaggattctaaattatatatatacacacacatacacacaattaaactcaaacatacacatggagacacacacagcattttaaaaccta

SEQ ID NO: 57138 - DNA, 201 bp, Homo sapiens
gctcctaaccgcttctgctgtgcagtaacaagccacgctcagggcatgggcccaacttgagtttcttccatccacgggtccagactggaaaggaagcagcratcttctcttcttttctcactgagtataaggcacccaattcatcttctggcagctgacctggaggacggagtggccctgattttccttttacaggtacaa

SEQ ID NO: 57139 - DNA, 201 bp, Homo sapiens
ctctcccaccttcacttgtcgcgaaggccatgtttctctttggcttgtcctcagagaggtggaaaacagcaggtttctaacctctgaactaccctcttccstcaccccctgggtttcactgccaggtgccggcctgtggcagatgtatgcccctgagtccctttatacaaccgcactctgagattttatctccctgggatg

SEQ ID NO: 57140 - DNA, 201 bp, Homo sapiens
tccagaaatactttagtatacaaagtgctgtcacgtgatgacgtctcatttcagcatctcaacaaccgcacctggaaggccttattattttgtatatttayggatgaagagactggatctcaaatagcttaagagacttccctaacataactcagctaatgcctggaagacccaaaactagaatccagggctcctgactct

SEQ ID NO: 57141 - DNA, 201 bp, Homo sapiens
ccccattttccaggtgagaaaactgaagcacagagaaaaataacttgcccaaggttactcagctagaaactaggagagcctagatttgaacccaagatgcyccatgcacatagaaggcacttggtaaatatctagtaaaggaatgcatcttaccctggaatggcatgacaggccctcaggggagctctccagcttcacccg

SEQ ID NO: 57142 - DNA, 201 bp, Homo sapiens
atatgtctcctcctcctattactgctaatattaataacaacaacaactgcagtaacgaacatttgttgagtccttactatgttccagacactgctctaagygctttagatctattaacgtatttctccttcataacaatcctggaaggagagcattattaaccccattttccaggtgagaaaactgaagcacagagaaaaa

SEQ ID NO: 57143 - DNA, 201 bp, Homo sapiens
ccagggattacaggtctgcgccactgcacccggctcatttttgtatttttagtagagatagggtttcactatgttggccaggctggtctccaacccctgacctcaggttatccacccgcctcagcctcccaaagtgctgggattacaggcataagccaccgcgcccggcccttttaaagtaaatcttgattgatggacatg

SEQ ID NO: 57144 - DNA, 201 bp, Homo sapiens
tttaaggtggctcagcctatgtatattcacatgtctccacctactcccaatgtgatcattacctagaggcctctcatacttttttttttttttttttaatrcctgaagtttttttgtttattcctttttgttttccagctctacccaccagtatttttttgttgatgacagatcttctcctaaaatgacaaagaatttaga

SEQ ID NO: 57145 - DNA, 201 bp, Homo sapiens
ccactgccaaccagttattagggaggagggcagcacttgcaaaaatttcaggtctctgagagcccagagcctgagaagtgtggaggatactaattacaccmaggtggaagcctggccacagctcacctcctaaggaaagagcgagcccattaaatagccaggaaggaatggagttcacaggggattagatttctagattat

SEQ ID NO: 57146 - DNA, 201 bp, Homo sapiens
gtacattaacttgccgtgaatatatttaccagtttttacaataccatttttaaatctctacagaagccaattttcttacaagaaaattaccctaccaagattttttttagaacaagcaaacccaaatttctttcttaccctaacccagttcatccagctctgacactgtggcctgaggacagacactgatgctatcttgga

SEQ ID NO: 57147 - DNA, 201 bp, Homo sapiens
agggtttcactatgttggccaggctggtctccaacccctgacctcaggttatccacccgcctcagcctcccaaagtgctgggattacaggcataagccacygcgcccggcccttttaaagtaaatcttgattgatggacatgatgaagtccgtgaggtacaaatgcactgccttttacaaaagtaactggttccttggagg

SEQ ID NO: 57148 - DNA, 201 bp, Homo sapiens
taccaaaatgcactcttcattatcaaaattctgtccaacctagtatatgtctcctcctcctattactgctaatattaataacaacaacaactgcagtaacraacatttgttgagtccttactatgttccagacactgctctaagcgctttagatctattaacgtatttctccttcataacaatcctggaaggagagcatta

SEQ ID NO: 57149 - DNA, 201 bp, Homo sapiens
tttcctcagatggacatttttcagaagaaagccaatgacactagcaagtccatgacccatttcaagatatgacaggacatcattttccaagtggagaaaasaaaaattctcagaaagccctgtataccacagaaatccatacaccagtttcaagtctcatccaacagaccagccagagtgcagggccacagggcaccctgg

SEQ ID NO: 57150 - DNA, 201 bp, Homo sapiens
caggaatggatggggaagtgggggaagtcaggctgtgtttattgggcaaggagaaggggtctctgagcccaaagaccttcttgggaaatgcagctcctgcmctccacagcaaataatgctcaatgaccagtcagggagagcttgtctgggctctcttcaagctatggggagcatctagaaaatgccttgaaaccgtcagat

SEQ ID NO: 57151 - DNA, 201 bp, Homo sapiens
acagggcattcagtgtcaccgggagttcccgtgtggccctgagcactctccaccactgctctgcagctcggctttctaattgtctgtgtttctctgctctrctaggccgtaagcttctccctgggaaggattctgtcctattctcatctaatagactactgtgggccactatccattatgtaatcagtgctccaaaatgtt

SEQ ID NO: 57152 - DNA, 201 bp, Homo sapiens
atttaccctgcttggtggccaagaatcacttctgtccctattactagtgatatcatgtctgcatttggaaacagacaagtgttatacaaaattacataatmtgataggaatgctgtcaatggatatctattattatatttaccagtcaaaattttagttcttataactggtatcaccaattaaaaaattttataagaaagg

SEQ ID NO: 57153 - DNA, 201 bp, Homo sapiens
taggggaaggggagatgggggaaatgtggcaatttgagggatggtaaatgatttttagggggagacgagtggacttggggaacttacaatggccatggacraagtctgttgggacttcagagcagacaagggctggtaaatgattctctttgaaatactgaatgagcaccaaaacagaagacgatggtttgtgacaaaata

SEQ ID NO: 57154 - DNA, 201 bp, Homo sapiens
ctatgacaacgagggtcgttccacacacatcctccagaccccggcacaagacctccgcctttcatctccattatattgggcaaaacacaaagcatcaacgaaaaaaaaaaaaaagtaaaagtacatagaaaaggagacacagaggaatacagaaaagcaaaaacctccttcaaactggtggatgtttcatcccaaaggacg

SEQ ID NO: 57155 - DNA, 201 bp, Homo sapiens
gatgagccactttctccactccacctccagggctggccccagtcttcctaaatgttcattaactcctattaggtattccgaaactctcaggttttctgagycagcatagaatggttggaaaagcaattgctgtagaatcaagaagactgaaattggaatactggagcaactacctactagccacaggcaggttactctctc

SEQ ID NO: 57156 - DNA, 201 bp, Homo sapiens
acattcataactcataacctcctcctctctggatataaccacatcagaatcgagcttcattagtgtgatataaaagaggtctttgcatatacacacacacatatatatatatatatatatatctcaaaatatcaccaaaacccatactttaaaaaacaaaaagggcctttggagatcatcagccaatccccttattctata

SEQ ID NO: 57157 - DNA, 201 bp, Homo sapiens
ccacctctgtgcaggccttgtgctgggaccacacagatgcataagacacgtacagcttagagcctagtcatgaaatgggaaataaacagccccatcctcamggtctgaacaggggattggggagcacagagaagggccccaccccgaccagctgtcaagagaactatccatacattctaattcctccaaggttgagggcta

SEQ ID NO: 57158 - DNA, 201 bp, Homo sapiens
cattcataactcataacctcctcctctctggatataaccacatcagaatcgagcttcattagtgtgatataaaagaggtctttgcatatacacacacacatatatatatatatatatatatctcaaaatatcaccaaaacccatactttaaaaaacaaaaagggcctttggagatcatcagccaatccccttattctataa

SEQ ID NO: 57159 - DNA, 201 bp, Homo sapiens
gtgatgctagggtgtcacaagaggtgaaggacaatacaaagtttagtaactattgtgcacattcagaaattgagacacagaattactttcaagaaaaaagkaaatgggagggtcaggtgtccaggtcagggcaaaattcaagatggtgggagtgggagaaacattcctcaccatggccttgggcagaatctgcttatctcc

SEQ ID NO: 57160 - DNA, 201 bp, Homo sapiens
agagtgggaagcattagagaccaatcatgggagagatgaggctgctggcagtgtttggcacttgggaaaaagaacagcaccgtctaaaggagaattttatyaagtttcagtgaacaatgtgcaatttaaatctttttgtaggaaatcgtcagttaaaggtcaatttccataagtatgtggatctatgtattttggaaatgc

SEQ ID NO: 57161 - DNA, 201 bp, Homo sapiens
tgccccattgtcttctggtaggcctcgtttctgggaagacgtctattgaattcttatctttgtcactgagtatgcagtttgactttttacctctagcttcttttttttttttttttttttttttggtcactggttttcagcaatttgattattctgtggcttggtgtagtttccctcatattttttgtgttttgagatcat

SEQ ID NO: 57162 - DNA, 201 bp, Homo sapiens
gctccaattggtacttattctaacaacgctctcttctctaggttctaattacatgtcaggcattgttctgagctctttacaaatatcttatttaatcctcmtaacaacctcataagataggcactatttttatccccattttattttcatatgaccctcttaacatttgaggcagctatcctaaaatgaagaaaggtgtag

SEQ ID NO: 57163 - DNA, 201 bp, Homo sapiens
gcctggtattgataagagcccaccgtgctagtttttaccaatggtccctaagcgattttccctgcagcagtcagggtttacaggtaaaactgggcccaggscaataaaggggtacagtctaaggactctgggagtttcctgatgaatactagaggtctttggaggcagacaactttttctttgcagcgggacttcacatta

SEQ ID NO: 57164 - DNA, 201 bp, Homo sapiens
ttagatggtaggtccagaaacttggactctacatccagcatctagtgatgtgattgattgatatctgttttagcttttcggcacctcaggttttgggctgtttttttttttttttttttttaatctgttaattgaagtgattggtctagatttgtggtctttgaatgtgtgtcagccatggaaaccttcctacaaacagaa

SEQ ID NO: 57165 - DNA, 201 bp, Homo sapiens
tgttgttaacatattaatatctatccaaactcttccctctgcatgtttaaattttaagaaataagagatttttaaatttaaaatcactgcttaaattatcwctctctttctctctctgtctctctctctagtttatcattaccagttcaagatccagttcatcaaccaaactgagacgccaatacaaacaacttttaccat

SEQ ID NO: 57166 - DNA, 201 bp, Homo sapiens
tcattagaatcatctagggaacttataacagaaaggcccaccccagaccagttcagatctaaagacagcctggactgacaaccacagaactacagagctgmcacccagactccatggaactctgctaggctggtaatatttttaattcattaagggtttatgtgtttaacaacccaggtccagtaaattggctcctttcct

SEQ ID NO: 57167 - DNA, 201 bp, Homo sapiens
cctgaaaggacctctcagcaagagtgacacattgccaagtaatgcacattgttccacatggagttggtgaggataacagcacttccttccagaaatacttyagtatacaaagtgctgtcacgtgatgacgtctcatttcagcatctcaacaaccgcacctggaaggccttattattttgtatatttacggatgaagagact

SEQ ID NO: 57168 - DNA, 201 bp, Homo sapiens
acccactcatccctgaccgtaggctcttgttcacagcggccaaaacgtgcatgtctctcaggggcttcctgcttgtggagcagaacctttgcttgcgggcyccttgtgtctgtgagctcctcagaaccgctcttgagctcacagtgcctgatttgcacgtattggtttccgctccgttgcttattctggtcccctcataga

SEQ ID NO: 57169 - DNA, 201 bp, Homo sapiens
gtagaccaatgaagcatgaatccaactcacagagggtggttagaactaaaagctgaaatggacttccgtgatcacctgacccactcatccctgaccgtagrctcttgttcacagcggccaaaacgtgcatgtctctcaggggcttcctgcttgtggagcagaacctttgcttgcgggctccttgtgtctgtgagctcctca

SEQ ID NO: 57170 - DNA, 201 bp, Homo sapiens
caaataaaatcatttaaaatgtctgatattaaacacttctgacccgaaaagcaaaaagccttttaacagatagttacattgatacaagagtccacaatgayaggtttcaaagatgaaagtaatggatcagtaaatagaacagtagagaaaacacagatgaaaggcaaataaccccacctgaaaaatccaaagctttcattt

SEQ ID NO: 57171 - DNA, 201 bp, Homo sapiens
taactttcaagtttgaggtcaatacaaataaaatcatttaaaatgtctgatattaaacacttctgacccgaaaagcaaaaagccttttaacagatagttayattgatacaagagtccacaatgacaggtttcaaagatgaaagtaatggatcagtaaatagaacagtagagaaaacacagatgaaaggcaaataaccccac

SEQ ID NO: 57172 - DNA, 201 bp, Homo sapiens
tgtatatatatatgtatatgtgtgtgtgtgtgtgtatatatatatacatatatatatacatatatatgtatatgtgtatatatatatatatgtatatgtayatatatatatgtatatgtatatatatatatagtgaacagacagagtccttggtctcatgaagtttacattatcacatgtttaaatatgcatactactttg

SEQ ID NO: 57173 - DNA, 201 bp, Homo sapiens
gcgcccaacagatggtggtgatgacgatgttggaatcaggtgactctagcctcttcactgtcacgcttgctctcgtctgaacgtgcttccatgtctccatrttgctcttgtgtccacaagcaaaagcaataatccattgccatttaaccagcacaaaactgaatgaggctgtcaccttccttttctgaaacacatgcttca

SEQ ID NO: 57174 - DNA, 201 bp, Homo sapiens
cttccctcatgaaaaccgtggagccagaagcagtagtgttacagtgatgtcatcccctgaggctcagtttcctcgtaggtaaggtgggaatggaaatgackgctgcataggctgtgagatgattttgtgagatgtaagcgcccaacagatggtggtgatgacgatgttggaatcaggtgactctagcctcttcactgtcac

SEQ ID NO: 57175 - DNA, 201 bp, Homo sapiens
cagtcaggtctggcagccctgggagccattctgtctctctaaggcagaggctttacccattttttgacaacacatcttatccccaatatctatttatttgyttataaataatatagcactagtatattccgtagtaccacctgcaaattatatagtacttatatgctataaacattatacgtgcacaaacatgaactgtct

SEQ ID NO: 57176 - DNA, 201 bp, Homo sapiens
tagatggtaggtccagaaacttggactctacatccagcatctagtgatgtgattgattgatatctgttttagcttttcggcacctcaggttttgggctgtttttttttttttttttttttaatctgttaattgaagtgattggtctagatttgtggtctttgaatgtgtgtcagccatggaaaccttcctacaaacagaat

SEQ ID NO: 57177 - DNA, 201 bp, Homo sapiens
aggtattcacccgctccactcccatctccttgacctctttcttgccctgtttctcggcgacctaggcattgggtcctggtcagttttccacttttccatcwctcccttaggacccctcaacctctctgctcatcaaaaaagtccaataaaggcattcatctctttgaatacttaattttacagtacctcttgcataacttt

SEQ ID NO: 57178 - DNA, 201 bp, Homo sapiens
agatggtaggtccagaaacttggactctacatccagcatctagtgatgtgattgattgatatctgttttagcttttcggcacctcaggttttgggctgtttttttttttttttttttttaatctgttaattgaagtgattggtctagatttgtggtctttgaatgtgtgtcagccatggaaaccttcctacaaacagaatc

SEQ ID NO: 57179 - DNA, 201 bp, Homo sapiens
gatggtaggtccagaaacttggactctacatccagcatctagtgatgtgattgattgatatctgttttagcttttcggcacctcaggttttgggctgtttttttttttttttttttttaatctgttaattgaagtgattggtctagatttgtggtctttgaatgtgtgtcagccatggaaaccttcctacaaacagaatct

SEQ ID NO: 57180 - DNA, 201 bp, Homo sapiens
ctcccaggaagcagttgcaggcggtcatgctacagtgagttgctgatagtaggaggggaagaaagaggaagggggagtggaagatgactcagtggggggtgagccagtgcctggaagagaggaatgtgtgagcagaatgaggaagttagcaaaagctggttgaaggtaggaggtggaaagacaagttcagccctcaacaag

SEQ ID NO: 57181 - DNA, 201 bp, Homo sapiens
tcccaggaagcagttgcaggcggtcatgctacagtgagttgctgatagtaggaggggaagaaagaggaagggggagtggaagatgactcagtggggggtgagccagtgcctggaagagaggaatgtgtgagcagaatgaggaagttagcaaaagctggttgaaggtaggaggtggaaagacaagttcagccctcaacaagt

SEQ ID NO: 57182 - DNA, 201 bp, Homo sapiens
ccaggaagcagttgcaggcggtcatgctacagtgagttgctgatagtaggaggggaagaaagaggaagggggagtggaagatgactcagtggggggtgagccagtgcctggaagagaggaatgtgtgagcagaatgaggaagttagcaaaagctggttgaaggtaggaggtggaaagacaagttcagccctcaacaagtta

SEQ ID NO: 57183 - DNA, 201 bp, Homo sapiens
ccagggcaataaaggggtacagtctaaggactctgggagtttcctgatgaatactagaggtctttggaggcagacaactttttctttgcagcgggacttcmcattataagccatgatgaggctgcaattgcgatttatcagtgctgccttccttccccaggcaacgtactaggaagaatcatggtttactgaaggcaggct

SEQ ID NO: 57184 - DNA, 201 bp, Homo sapiens
caggaagcagttgcaggcggtcatgctacagtgagttgctgatagtaggaggggaagaaagaggaagggggagtggaagatgactcagtggggggtgagccagtgcctggaagagaggaatgtgtgagcagaatgaggaagttagcaaaagctggttgaaggtaggaggtggaaagacaagttcagccctcaacaagttaa

SEQ ID NO: 57185 - DNA, 201 bp, Homo sapiens
aggcagacaactttttctttgcagcgggacttcacattataagccatgatgaggctgcaattgcgatttatcagtgctgccttccttccccaggcaacgtrctaggaagaatcatggtttactgaaggcaggctaccctccccatcaaagcctagtggactgggcaagcaatcggttgggattcattacttggaggcatgt

SEQ ID NO: 57186 - DNA, 201 bp, Homo sapiens
tcaacaagttaagcaggttatataagaagtccaggcatggatgacgatgatcataatcatgatggggaggatgacaaagatgactaggaacgctctgtcatctctctctctctctctctctctctctttccttcctggttgtgtgagtttgcagggagacgggaggttgtgaagaacaataaccagaagagagtttgcgtc

SEQ ID NO: 57187 - DNA, 201 bp, Homo sapiens
caacaagttaagcaggttatataagaagtccaggcatggatgacgatgatcataatcatgatggggaggatgacaaagatgactaggaacgctctgtcatctctctctctctctctctctctctctttccttcctggttgtgtgagtttgcagggagacgggaggttgtgaagaacaataaccagaagagagtttgcgtct

SEQ ID NO: 57188 - DNA, 201 bp, Homo sapiens
tatgaggagttctacccggttttgtcagtctttttaattttagccattctaaagggagagaagtgatattccgttgtgttttaaatttgcatttctcccaygactaatgatgttaagcacattttcttgtacacatgtgccctttgtgtatcttcttttaaggatatctgttcagttctctcaccctaccttgaacctaca

SEQ ID NO: 57189 - DNA, 201 bp, Homo sapiens
ttgcaccattgcactccaccctgggcaacagagtgacatttggtctcaaaaaaaaaaaaaaaaaaaaaaagaaatcttagcaggattacatctgtaacccyggcactttgggaggccgagggaggtgaatcacatgaggccaggtgttcaagaccagcctgaccaacatggtgaaaccctgtctctaccaaaacatacaaa

SEQ ID NO: 57190 - DNA, 201 bp, Homo sapiens
ggaaaaagtacattaggtcaaccccaaaatctgccatcgataacatcagagtatgtccatggctttattagttttctagtgaatatttaagagaaaaaggwgctaggtcatagaacattgagaaggctatacatctccccttggctataggtgcaatacattccaagagggagagatggtagtcatgcctcctattttttt

SEQ ID NO: 57191 - DNA, 201 bp, Homo sapiens
cttagtttcagtcagttgtcacatcctgctcttgtcaaggggtctgccttgacaagcccacccttgcctgttctgtgtgctactgctaacctcctgtgggmtgagaaccaaggtgatcctctgagttgaggctgctttgggttaaggggtgataacgtccttcttgccctgtgttccagccatcacccagaccataaaatg

SEQ ID NO: 57192 - DNA, 201 bp, Homo sapiens
acaatagtcaccctcaaatcttcgatgagctgtcataggggagaacaaaggagggctgccccaggactttccttcttacagaactgaaatcaccccagtgwagaactccaggaagtcttacactgatggctttcactgacttgggttttgtttttctctgaagttacaaaaatatttgcgaacataagaatctaacttaaa

SEQ ID NO: 57193 - DNA, 201 bp, Homo sapiens
agagccccactttctttaacaattgctcgtggatatgagctcttaaagagtctttcctccatctagacttgactgatgctttatcttctctcgacctcttccctaaagcccctacgcagggcattcctccgctgcaacacagcaaccacttttaatagttgcttttcaagcttgcatcccccaccccaccatggggctggg

SEQ ID NO: 57194 - DNA, 201 bp, Homo sapiens
attctctggcccaaaatgtcaactgtgcatggctgagaaacgtcatagcaagcccttcctccagcattatccaggagctggagaaggaagaagggtgagcrgggagaaaggaaactagtgcgaccctccctctgtcccctcctcaggtggacggcgtgctagaaaactggatctggcagatggtggccgcgctgaagtctc

SEQ ID NO: 57195 - DNA, 201 bp, Homo sapiens
tccccacgcattagctcattgattatctcgattccatgagtaagcagcgtgagaaaatataattatctccatgtttcagatagaatgtggctcaaagaggycacacagcccattggggcccacaagggattgcagtccgtgcaggaagaagcctccttcctgaatctgcatgttacacacagggggacataggaagccaga

SEQ ID NO: 57196 - DNA, 201 bp, Homo sapiens
caaaaacacacagctggtgagattgttccccagtccaagtctgaggcccactgataccacaggtataaaacccgggaggcacaggcaaggcctttctcggwgtggaagccccagagtgccccagcctctcctcctgctgatcccttcccatagctctaggcttcaacgacacaaggtttttctctacttcacaaacacacc

SEQ ID NO: 57197 - DNA, 201 bp, Homo sapiens
tgacctgccactccttgacatggacggctctattctaacagtgccactctctcatgtcactgtccctctgcctggttcctcctcctctcttatctgcctgsagagtcccactccttggatgagtctcacccagagcatccctcccccatctcctcaggctgggtgtagggtgaccagctgtcctagtatgactgggcctaa

SEQ ID NO: 57198 - DNA, 201 bp, Homo sapiens
tcactggataactgcagattcaccttcactacctcctgggtggatgagcttgggtgagttagtggatgtcttggaagctcagttttctcgtcgaaaacagyggcctcaaggagctgcagtgaagatgcaggcagtggaggagcggagggcacgcagcatacacagcctcctagtaggtgcccaaggaatgcagccgctagc

SEQ ID NO: 57199 - DNA, 201 bp, Homo sapiens
gggaagcatcaagagaaggaagaaggggaaacaagagcagtaggcatgaaccaggctgagcttctcccatttgccaacggccccactgcccgaccaccatrcactgctgatgtgaactcacaaggatccctttgttattaaggaagaccaaagaattgcattagggcatcattatctcacccaccagctaccaaaaccaac

SEQ ID NO: 57200 - DNA, 201 bp, Homo sapiens
caaacaggtgtttagtcttctctggagtcatattaagcaatttttacatttatggaaaagcaaacactccccccacatagggtgtggcccacactgggatkgaaaatcagcctcgtgctctgcaccgtgttctggtggcttctgcagctgtcacaggaaggaatccacacccgtccccaaggacgcctgcacgggaacaga

SEQ ID NO: 57201 - DNA, 201 bp, Homo sapiens
gtgattctcctgcctcagcctcctaagtaggtgggattaccagcgtgcaccaccacgcccagctaatttttgtatttttagtagagacggggtttcgccaygttggccaggctggtctcgaactcctgacctcaagtgatccacccgcctctgcctcccaaagtgctggaattacaggtgtgagctactgtgcccagccca

SEQ ID NO: 57202 - DNA, 201 bp, Homo sapiens
ggaagtggagaacagctcatggtgagaggaaaggctggggccgacttgggatgtggatgtgcaaaaggaaaggtgaaggctggatgggaggcagggtgggyacagttaaggtgggccctgggccaggatggcctcccaaccagagagtagccttcaacatctcagcctcgtactgcgtgccagacactctaccaagccctc

SEQ ID NO: 57203 - DNA, 201 bp, Homo sapiens
ggaagctaagagcacagatgctgctatttgaccttaagcaagtcactttcatctatctgagctccagttttcttatttataaaatgggggtgatactaacwatgcctacatcatagcgttgtgatgagtaaatgagatgatgcaatgcattcaacaatgcaaaaatgtattatcatttaacgatgccatgtatttaacaac

SEQ ID NO: 57204 - DNA, 201 bp, Homo sapiens
aatcaatttagtttattttgccaaggttaaagacattatcgtgacacagcctcaggaggtcctggtgacctgtatccaaggtggtcaggctacagcttggytttatacattataggaagatataagacatcaatcagtacttgtaagatgtacactggtttggtccagaaaggcaggagaactcaaagtggtttggggttg

SEQ ID NO: 57205 - DNA, 201 bp, Homo sapiens
agtgtctggattaagataaggggttgtggagaccaaggttcttattatgcagaagaagcctccaggtagcaggcttcagagacaattgattgtaaatgttwcttatcagacttaaaaaggtgccagacttagttcattctctcccagatcagtgaaaagacctggatagggaagggaattctctacagaatgtagattttc

SEQ ID NO: 57206 - DNA, 201 bp, Homo sapiens
gcattagagaccaatcatgggagagatgaggctgctggcagtgtttggcacttgggaaaaagaacagcaccgtctaaaggagaattttattaagtttcagkgaacaatgtgcaatttaaatctttttgtaggaaatcgtcagttaaaggtcaatttccataagtatgtggatctatgtattttggaaatgcattgaaatgt

SEQ ID NO: 57207 - DNA, 201 bp, Homo sapiens
caatgtgcaatttaaatctttttgtaggaaatcgtcagttaaaggtcaatttccataagtatgtggatctatgtattttggaaatgcattgaaatgttacrtgggtctgggaccacacaagctacccactggtggtctgctatacctaggtactaggaaggtcaaggtactgagtaggtcacagtcttgccaccgggatgc

SEQ ID NO: 57208 - DNA, 201 bp, Homo sapiens
tgccaccgggatgctttgctaactttattgagtgaaagtagtaagaaatgcctggtattgataagagcccaccgtgctagtttttaccaatggtccctaakcgattttccctgcagcagtcagggtttacaggtaaaactgggcccagggcaataaaggggtacagtctaaggactctgggagtttcctgatgaatactag

SEQ ID NO: 57209 - DNA, 201 bp, Homo sapiens
ttttttaaagaaaaacacttacaaaaatccaaataagagtaaataattaggactgggtgtggcggctcacacctgtaatcctaacactttgggaggccaakgcaggaggattgtgtgagcccaggattttgagaccagcctgagcaacatacagacctcatctctacaaaagaggaggaggaagaagaagaaggaggagga

SEQ ID NO: 57210 - DNA, 201 bp, Homo sapiens
agttgaccctggtgtcgtagactcaagttcctctggaagcggtgagtgctgagtctggcaggaggggtgtgggagggatgggggatgtgggggccaccccrgcccataatggcaagccagcatcagcactggagggagatgggggctgcgggcaatggatgacacgtgcagatcacgccatctgcgtgtcacttggaaact

SEQ ID NO: 57211 - DNA, 201 bp, Homo sapiens
ggccagaacacgtgggcaaggggccaggaggaggcctccggtcccctcttttctcagctccctccagccaggacacagctgggctcactgtggagctgtckgcagcagaaggacctgctgcctgatactctcccctcttaatgagaggggtcttgggaagcagaacaacaggccactgataccagatggcctgagcttaag

SEQ ID NO: 57212 - DNA, 201 bp, Homo sapiens
caaaaccagcctggccaacatggcataaccctgcctccacaaaaaatataaaatttagccgggcgtggtggcgggcgcctgtaatcccagctactcgggargctcaggcaggagaatcgcttgaacccaggaggcggaggttacagtgagccgagaccacaccactgcactccagcctgggcgacagaggaagactcagtc

SEQ ID NO: 57213 - DNA, 201 bp, Homo sapiens
cagcatcacttgacgctggccagaacacgtgggcaaggggccaggaggaggcctccggtcccctcttttctcagctccctccagccaggacacagctgggytcactgtggagctgtcggcagcagaaggacctgctgcctgatactctcccctcttaatgagaggggtcttgggaagcagaacaacaggccactgatacca

SEQ ID NO: 57214 - DNA, 201 bp, Homo sapiens
gtaacttctaccccttccctgcccagacacggattctcgtgacgcacgcactccacatcctgccccaggctgattggatcatagtgctggcaaatggggcyatcgcagagatgggttcctaccaggagcttctgcagaggaagggggccctcgtgtgtcttctggatcaagccagacagccaggagatagaggagaaggag

SEQ ID NO: 57215 - DNA, 201 bp, Homo sapiens
tgtcttcaagtgggccgaggccagcttgctggagttgtctgaatgctgcagtagggcaggactggttcctccccatagctgtaaaccaccatgccaggccyggccacttatgctttgacaggctggctatgcacagggcttgggtctgtatgcacagcatcacttgacgctggccagaacacgtgggcaaggggccaggag

SEQ ID NO: 57216 - DNA, 201 bp, Homo sapiens
atcccagcactttgggaggccgaggcaggcagatcacctgaggtcaggagttcaaaaccagcctggccaacatggcataaccctgcctccacaaaaaatayaaaatttagccgggcgtggtggcgggcgcctgtaatcccagctactcgggaggctcaggcaggagaatcgcttgaacccaggaggcggaggttacagtga

SEQ ID NO: 57217 - DNA, 201 bp, Homo sapiens
gccatggcatttgtaaactgtcatggcactggtggagtgtagcagtgaggatgacgggaggtcactctcgtagccatcttggttttggtgggatttggccrccttctttactgcaacctgttttatcaggaaggtctttgtgacctgtatcttgtgccgacctcctatctcatcctgtgacttacaataccctaaccgtct

SEQ ID NO: 57218 - DNA, 201 bp, Homo sapiens
ggactcacgggcacggctcaccagctctatcctcaggaactcgaagaccatcaagttccatggctgggagggagcctttctggacagagtcctgggcatcygaggccaggagctgggcgccttgcggacctccggcctcctcttctctgtgtcgctggtgtccttccaagtgtctacatttctggtgacgtcactctagtc

SEQ ID NO: 57219 - DNA, 201 bp, Homo sapiens
atgatatgctaaacaaggggtggattattcatgcctttccttcttagaccatatagggtaacttcctgatgttgccatggcatttgtaaactgtcatggcrctggtggagtgtagcagtgaggatgacgggaggtcactctcgtagccatcttggttttggtgggatttggccgccttctttactgcaacctgttttatca

SEQ ID NO: 57220 - DNA, 201 bp, Homo sapiens
ggaactcctgggctcaagtgatcctctggcctctgcctcccaaagtgctggggttacaggtgtgagccactgtgcccagccaagaaactgaagtcttaaasagttaagagacttgtttgtgttttcatatctagcctgggacacaacctgggactcaaatctaggccaatctgagtctgaagcttacactgtttctcatct

SEQ ID NO: 57221 - DNA, 201 bp, Homo sapiens
ccacgcaggagagaaggtgagtggttctctcacaatgtcttcttcatggagtttaggccaaaggactccagggacaaggccctaaaccctgggcaccagcyacctccacagtgtccccacctcaggtcccctagctttcagacccattaccccctaaaatgaactcctcaccttccccaaacctgcttccatctggtgact

SEQ ID NO: 57222 - DNA, 201 bp, Homo sapiens
ttctatcaccttcacagagaggcctttcctgaccaccttatctaccaccacagccaccctactattgttagtgcaccctacacctgcacctgctttttctytttttcttttttttttttctgagacggagtctcgctctgttgcccaggctggagtgcagtggcacaatcttggctcactgtaacctccacctcctgagtt

SEQ ID NO: 57223 - DNA, 201 bp, Homo sapiens
ggtactccccacatccccaaactgggcttgagggacagacagaggcagagactgtcggacccctgctagtgggacctttgaagaccctgtgtccaaaccamcatggtgtgtggagtccctccaccaaggagggacacgcagctctacaagagccagactcagctaaggtgaacttgcaaccttgggcaagagtctttcctt

SEQ ID NO: 57224 - DNA, 201 bp, Homo sapiens
catgattgacagcaccccaacccagccctttcccacaggaaaccagaagtagaaaacatggtagtcagataaaaaccatggctagggctaggcatggtggytcacacatctaatcacagcactttgggaggctgaggtgggcagatcacttgaggtcaggagttcgagaccagcctggtcaacatggtgaaactccgtcta

SEQ ID NO: 57225 - DNA, 201 bp, Homo sapiens
cacagggctactgccaaacaagttgccacaaacttgggagcccagcacaattgaaatttgttctgtcgcagttctgaggcctgaagtctaaaatcaaggtktcagcagtgttaactctttgtggaggtttttttggtttttttgtttgtttgtttgtttgttttttctgagacggagtcttgctctgtcaaccaggctgga

SEQ ID NO: 57226 - DNA, 201 bp, Homo sapiens
ggagcactcggacgaggctatctgggcagccctggagacggtgcagctcaaagccttggtggccagcctgcccggccagctgcagtacaagtgtgctgacygaggcgaggacctgaggtatggtcgtcccaccatggctgggacctgcaggtgggagaggaggggatggccatgccctccccaagggccttcaggaaatgc

SEQ ID NO: 57227 - DNA, 201 bp, Homo sapiens
tccaaaagttctagtgaagtcccaggtctccctgtcattggcctgacttgggttatgtgttcatccctgaaccaactgcagtggtttggattggccatggrtgaaatttgccccaccccagaggagaagttagccccaccccaggcatacagattagcactgggaggaaggatgtgcatttctctcacagggctactgcca

SEQ ID NO: 57228 - DNA, 201 bp, Homo sapiens
aaacgcacgtcccagctaattgtcccaatcgttcccagcgtgggccagaaacagctcctgtgtctggcacgtgcccttctccggaagacccagatcctcaycctggacgaggctactgctgccgtggaccctggcacggagctgcagatgcaggccatgctcgggagctggtttgcacagtgcactgtgctgctcattgcc

SEQ ID NO: 57229 - DNA, 201 bp, Homo sapiens
aggtactccccacatccccaaactgggcttgagggacagacagaggcagagactgtcggacccctgctagtgggacctttgaagaccctgtgtccaaaccmccatggtgtgtggagtccctccaccaaggagggacacgcagctctacaagagccagactcagctaaggtgaacttgcaaccttgggcaagagtctttcct

SEQ ID NO: 57230 - DNA, 201 bp, Homo sapiens
cctagatttctggcttcaggtatggctggatgtaggggtccaaacaagaaatcgctttatttccctcctctgtgacagcttcctgtccagcttagctgctscccctggcagtaagatgatattccacagctccagcttggctacctccaacaaccaagtaccacttttccaaaagttctagtgaagtcccaggtctccctg

SEQ ID NO: 57231 - DNA, 201 bp, Homo sapiens
gctcagttatcactgattgaagaaatgaatgagtgagtgaatgcctgaaggatgttcctggaagaactcagagtggggtgttgagagaggttgctggagaygtggcaggagccagatcaggggaaatggatggtcagagcggttaaggccacatagtcagtgggtgtcaaagtgggtatctgggccgtgttgcgtgacagg

SEQ ID NO: 57232 - DNA, 201 bp, Homo sapiens
agcaaggctgttgggggaaacagaggtaacttgactttgtacagtgttaaatgctgtttttccaacctcaagttcatagtaggtgctcagttatcactgaytgaagaaatgaatgagtgagtgaatgcctgaaggatgttcctggaagaactcagagtggggtgttgagagaggttgctggagacgtggcaggagccagat

SEQ ID NO: 57233 - DNA, 201 bp, Homo sapiens
aaagagagttaaatcacttgcccaaggtcacaagattagaacttgagtatgtccagctccagagtctatgcttgcagttgctatggagacagcccaagaargactttgatgcctagcaagctacaccgtgctagctagggtttctaataatccaaaaaaacagtgtgctggatacatggcaaggttctggaagtaaagttg

SEQ ID NO: 57234 - DNA, 201 bp, Homo sapiens
aactccatctcaataataacaacgacaacagcagtaataataataatagaagtgcacaatcaacgtaatgtgcttgaatcgtcctgaaaccatcccccggrccatccccctgcccccaggtccatggaaaaatcgtcttctacaaaactggtccctggtgccaaaaaggctggggaccactgccctacaggtatccaaata

SEQ ID NO: 57235 - DNA, 201 bp, Homo sapiens
gaataagttaaagtaatcaatagtgcacaagggaaattatagttaatgatcatttacttgtatatttcaagatagctagaagagaaggatggttgtgttcscaatacaaaagataaatatttgaggtgatgactatctcagttaccctgatttgatcattacatattgtctacagcaggggtccccaacccccgggccatg

SEQ ID NO: 57236 - DNA, 201 bp, Homo sapiens
tgcgtgcccacattgtgttgctgtgcatgctagcatgcttgtatgagtgtgcaaatgtgcatgcatgtgtgcacgctttgtgtgcatgtgtacatgcacaratgtgcacaggatagttcctcaaatagctagacaaggactgggaaaaagaacagccccacaggtcctcttggagactcccagagcaggaaagctcagctc

SEQ ID NO: 57237 - DNA, 201 bp, Homo sapiens
  misc_feature (1)...(201): n = A,T,C or G, or insertion/deletion polymorphism (see Tables 1-2)
gtgcccggcctgggagaagaaccttctaggcggtgggaatggcatcagcaaaggtcctggggcaggagagtgcctggacctgggtttctcaacctcagcanggttgatattttgggctgaaactcctttgttgggggctgtcgtgtgcattgtgggatgtttagctgaccccagtctctacccactagatgccagcagcac

SEQ ID NO: 57238 - DNA, 201 bp, Homo sapiens
acagaggttaactaagcaaagaatgatccgcacatcgggcagtccctgaaccagaatacgtccagagaggctctggtacagccacggggtcaaagattaayagacagaaaaaggaaggtgaaggacagaaaacagaagtgaggtacagaaacagccggattggttacagctcagcgtttgctttattggaacatggtttga

SEQ ID NO: 57239 - DNA, 201 bp, Homo sapiens
aggatcataattaacagtagcactcctgccccagaggggctgaggcattaaacaagcccatatgtagaaagcacttaaaagggtgccgggcacacaactgyaccctgtaggtatttgtaatattatcattagttacttttccataaaggataagacagtagatgctttttacactggaggccacaccatctctcctgcaaa

SEQ ID NO: 57240 - DNA, 201 bp, Homo sapiens
ccaggctggccaagacgatgccaagggagggctggctgagaggagccccaaggttcagccctatcagctgtgctcacttctgtgcctcctgtatcagtccraggtcatgatcatctatagtctccaactctatcgcttggtctttgtggccaaaaatctcagacagccctgaaactccctaagaagagaaggaatatgccc

SEQ ID NO: 57241 - DNA, 201 bp, Homo sapiens
gttccagggcagcacagtggtccgggcattccgaacccaggccccctttgtggctcagaacaatgctcgcgtagatgaaagccagaggatcagtttcccgygactggtggctgacaggtaggaagagccagggcagagaagaccttgcaattcatccatatccttagagggtgagacctgaggtcatattgtatggtagcg

SEQ ID NO: 57242 - DNA, 201 bp, Homo sapiens
tgtctccaacgtgaggatcataattaacagtagcactcctgccccagaggggctgaggcattaaacaagcccatatgtagaaagcacttaaaagggtgccrggcacacaactgcaccctgtaggtatttgtaatattatcattagttacttttccataaaggataagacagtagatgctttttacactggaggccacacca

SEQ ID NO: 57243 - DNA, 201 bp, Homo sapiens
ccaggtgaggctggtggagggggtgggcaaagatgggaggcatggtgggacccggctctgacccaccgcccctccccgccaggaccccatcctgttccctsgctctctgcggatgaacctcgacctgctgcaggagcactcggacgaggctatctgggcagccctggagacggtgcagctcaaagccttggtggccagcct

SEQ ID NO: 57244 - DNA, 201 bp, Homo sapiens
tccctcgtccaggtgaggtgggtgcaagggctggagccatcctgggagagtgcgtgggctacacctggctccagcttccctacccctgccatttgcagagragagggaagacagagtgggagggagagggatggtgtggagctggaaaagaggcgggtaggggcaagaacagaggcgggcagagagtacagcaaatacatc

SEQ ID NO: 57245 - DNA, 201 bp, Homo sapiens
ggctacacctggctccagcttccctacccctgccatttgcagaggagagggaagacagagtgggagggagagggatggtgtggagctggaaaagaggcggrtaggggcaagaacagaggcgggcagagagtacagcaaatacatctggaaggggtcagcctttggagggcaatgtgcagacctttccacacacacctcaga

SEQ ID NO: 57246 - DNA, 201 bp, Homo sapiens
tgacctcaggtgatccacccgccttggcctcccaaagtgctgtgattacaggcatgagccactgtgcccggcccctcgtggaggctctgatggagaatacrccccaggcttctctcctggtttctggtggtcgccggcagtcgctggcattccttggcttgtagatacaccctcccatctgtgtcaccatcttcatatctc

SEQ ID NO: 57247 - DNA, 201 bp, Homo sapiens
gtgatcctcccaccttggcctcccaaagttctgggattacagggcatgagcccctgtgccccacggcacagttaaatattaagggccagagcctttcacgygtaatgtttttatcctgccgtaatttcttcctctccaattatctggaagccaaaaaggcattgcaaggtctcaaaggctattatatgaagctagattctt

SEQ ID NO: 57248 - DNA, 201 bp, Homo sapiens
cgtaatttcttcctctccaattatctggaagccaaaaaggcattgcaaggtctcaaaggctattatatgaagctagattctttcaattgctgggaccagcraccaactaaaattagcttaaccaaaagaatagaatttaatggcttatatttccttgggggcatgggcccagttgtcatcaggacacagtgactctctcca

SEQ ID NO: 57249 - DNA, 201 bp, Homo sapiens
gaggtgtccttcctaggggagatggtacctgagggtaggtgagagttagccagaaaagagcattccagacacaaggaactgcttgagcaaggctgttgggkgaaacagaggtaacttgactttgtacagtgttaaatgctgtttttccaacctcaagttcatagtaggtgctcagttatcactgattgaagaaatgaatga

SEQ ID NO: 57250 - DNA, 201 bp, Homo sapiens
agaaatagaactaccggggcgcagtggctcacgcctgtaatcccagcactttgggaggctgaggtaggtggatcacctgagagtttcaaacaagtcggacsaacatggtgaaaccccatctctactttaaaaatacaaaagccaggcatggtggcgcatgactgtaattccagctacttgggaggctgaggcaggaaaact

SEQ ID NO: 57251 - DNA, 201 bp, Homo sapiens
aagcacttagcatccagtcctaacccaagtttatctcacctcccccttccacttgagtccaatttcctctttgtattggtcagcttttgctgtgacaatgytatgtaacaaacaacccccagatcccagcagcttacaacagcaggtgtttcttccttatggatctgtgatttaactactacagctttgccttggatgatt

SEQ ID NO: 57252 - DNA, 201 bp, Homo sapiens
agaatcgcttgaacccgggaggcagaggtttcagtgagccaagattgtgccactgcactccagcctgggtgacagagtaagactccgtctcaaaaaaaacmaaaaaaaacctaaggtgttctggatttataaacccctctgaccctgagggtgtccgaagggcttgtggtaggcaataatttccagcactagagaggcagc

SEQ ID NO: 57253 - DNA, 201 bp, Homo sapiens
gagaatcgcttgaacccgggaggcagaggtttcagtgagccaagattgtgccactgcactccagcctgggtgacagagtaagactccgtctcaaaaaaaamaaaaaaaaacctaaggtgttctggatttataaacccctctgaccctgagggtgtccgaagggcttgtggtaggcaataatttccagcactagagaggcag

SEQ ID NO: 57254 - DNA, 201 bp, Homo sapiens
gataaaggataagagatggatggatgaatggatggatgggattgggtggaagaaaggataagaacagcagcatagcactaatgtaacagtaacataacagygttgagtttactgggaggatcaaatgagatcctgcaaagaaatgatttaatagagtgcctggtccattgcaaacactcaatacatgtctgctgctcttat

SEQ ID NO: 57255 - DNA, 201 bp, Homo sapiens
aggcagcaggcaggatttggtctctgggccacagtttgcctccccctggattatgtagccatgggacacagacagaacaagaaccctgcggggtcacccasaagccagtgagtagcagggcaatttgttcagtgggagagatttcttcctgcagcctctgcccctgggggggcgggggatggtgcctgggggcctctccga

SEQ ID NO: 57256 - DNA, 201 bp, Homo sapiens
taaccagcctcatgtttttagggagaagatgcatggggctcctgctgcctcccacctgagaggtggtgtaggtttccagcctgggactggagggtgggttwggctgggctggggctctgccggggaggttctcaggatacatctctacctcctgaaggtggggacctgcacagcatagaccagtatctcctgcagacgggg

SEQ ID NO: 57257 - DNA, 201 bp, Homo sapiens
tgggattggagatggatggatggatgcatggatggatggatgggtgggatggggtggataaaggataagagatggatggatgaatggatggatgggattgrgtggaagaaaggataagaacagcagcatagcactaatgtaacagtaacataacagcgttgagtttactgggaggatcaaatgagatcctgcaaagaaatg

SEQ ID NO: 57258 - DNA, 201 bp, Homo sapiens
cgtgttccaataaaactttatttataagaaaaggcagcaggcaggatttggtctctgggccacagtttgcctccccctggattatgtagccatgggacacrgacagaacaagaaccctgcggggtcacccagaagccagtgagtagcagggcaatttgttcagtgggagagatttcttcctgcagcctctgcccctggggg

SEQ ID NO: 57259 - DNA, 201 bp, Homo sapiens
tggtggcgcatgcttgtaatcccagcttcttgggaggatgaggcgggaggattgcttgagcccgggaggcagaggttgcagcgagctgagattgcaccacygcactccagcctgggtgacagagagagactccatctcaaaaaacaaacaacaaaacccatggctaccactgtccccgacaattgtcctaggtcttctcta

SEQ ID NO: 57260 - DNA, 201 bp, Homo sapiens
cctgggggcctctccgatgcagaggccggccaggtcaggggtctcctgtaaatggcctcttgtgccctgcagctgccgggaaggattgcatcacgatacamagtgccaccttcgcctggtcccaggaaagccctccctgcctccacaggtacagaacgacacccgtagtaaccagcctcatgtttttagggagaagatgca

SEQ ID NO: 57261 - DNA, 201 bp, Homo sapiens
caggcatgagacactgtgccggccacagtgaaattaataacacccccttcactctgggaaggctgggatttgatgataatttatttcagaaattcactaaytttttccataaatgaccagattgtgcatattttaggcctgtgggccacacagtctctgtcacaactgctcaaagcatgaaatagagaaatgaatggatgt

SEQ ID NO: 57262 - DNA, 201 bp, Homo sapiens
ctgtcgcagttctgaggcctgaagtctaaaatcaaggtgtcagcagtgttaactctttgtggaggtttttttggtttttttgtttgtttgtttgtttgttttttctgagacggagtcttgctctgtcaaccaggctggagtgcagtagcacgatctcggcttatggctcactgcaacctctgcctcctgggttccagtgtt

SEQ ID NO: 57263 - DNA, 201 bp, Homo sapiens
atggtgcctgggggcctctccgatgcagaggccggccaggtcaggggtctcctgtaaatggcctcttgtgccctgcagctgccgggaaggattgcatcacsatacaaagtgccaccttcgcctggtcccaggaaagccctccctgcctccacaggtacagaacgacacccgtagtaaccagcctcatgtttttagggagaa

SEQ ID NO: 57264 - DNA, 201 bp, Homo sapiens
caccaccatcaaggtcaccactcgggttgcatcgtttcccatgaactagaaagctttgtcctcacgcctcctatgcacagagcttggtagacaggaagctkttgccacacatcttgagacaccgacacccaaaacctgagttctttgctcttcttgctgggtgacctgcggcttcggttttcctaggcccgggtgtccttt

SEQ ID NO: 57265 - DNA, 201 bp, Homo sapiens
ctgcgggcaatggatgacacgtgcagatcacgccatctgcgtgtcacttggaaactggcaccgtgctgctcttctttctgctagccattcagcgaccactsactgagcgcccactttgtaccatcctgggtgtacaacagggaacactctaacacagtggtccccaagctttttggcaccagggactggttttgtggaaga

SEQ ID NO: 57266 - DNA, 201 bp, Homo sapiens
ttcactcagtgcttctcaaagtgtgaccccaggaccagcagtagtatcacctggggactagttagcaaagtacattcttaggccccagcccaggactactkcctcagatactatgtgggtcggcccatgaatctaggttttaattaaccctccaagtaattctgatgtacacaaatgtttaggaaccactggcttacctct

SEQ ID NO: 57267 - DNA, 201 bp, Homo sapiens
ttccctacccctgccatttgcagaggagagggaagacagagtgggagggagagggatggtgtggagctggaaaagaggcgggtaggggcaagaacagaggygggcagagagtacagcaaatacatctggaaggggtcagcctttggagggcaatgtgcagacctttccacacacacctcagaacatgcatacttgtccatc

SEQ ID NO: 57268 - DNA, 201 bp, Homo sapiens
cattgctgggacccctgtgtgtacaaagctggtgtgatgaccagtccttgtgcccagagaagcatctccctgcagatgagagtaaccactcaccctgctgycgcttccctttgcaggtggcttgcggccaatgtggagctcctggggaatggcctggtgtttgcagctgccacgtgtgctgtgctgagcaaagcccacctc

SEQ ID NO: 57269 - DNA, 201 bp, Homo sapiens
aatgaggcagaaggactcacgggcacggctcaccagctctatcctcaggaactcgaagaccatcaagttccatggctgggagggagcctttctggacagartcctgggcatccgaggccaggagctgggcgccttgcggacctccggcctcctcttctctgtgtcgctggtgtccttccaagtgtctacatttctggtgac

SEQ ID NO: 57270 - DNA, 201 bp, Homo sapiens
gagtgagggtcagaggtgctgagaggcagacaggtttgggacgcagtttggtgagatgaatgggatttgctgaagggtggctgtcagggtgcagggaagarttctcaactgtccctgtcttcatctctctttttccctccgatcccaggaggagcaaatgaggcagaaggactcacgggcacggctcaccagctctatcct

SEQ ID NO: 57271 - DNA, 201 bp, Homo sapiens
cctcagcctcccaagttgctggaattacaggcgtgagccactatgcctggctaatttttgttaactattaacagtatgtaatgtcagttcatgacatctaygaaaaaaatatatatatacactcataagcatttgttatggaggaggcattattctaagagctttatatgtttttgttcgttttggtttgttgttgttgct

SEQ ID NO: 57272 - DNA, 201 bp, Homo sapiens
tgcccacgtggggctgcacacactgcgctccaggatcagcatcatcccccaggtgaggctggtggagggggtgggcaaagatgggaggcatggtgggaccyggctctgacccaccgcccctccccgccaggaccccatcctgttccctggctctctgcggatgaacctcgacctgctgcaggagcactcggacgaggctat

SEQ ID NO: 57273 - DNA, 201 bp, Homo sapiens
  misc_feature (1)...(201): n = A,T,C or G, or insertion/deletion polymorphism (see Tables 1-2)
gctcctctgactcagtttcccctcctgctccaggctccctggaggctgcccacatgtgcagctcagcccccctggcctcagggcgggcagatcgagttccnggactttgggctaagataccgacctgagctcccgctggctgtgcagggcgtgtccttcaagatccacgcaggagagaaggtgagtggttctctcacaatg

SEQ ID NO: 57274 - DNA, 201 bp, Homo sapiens
agtttgagaccagcctggccaacatggtgaaatcccgtgtctactaaaaatacaaaaattagccgagcatggtgacaggcacctgcagtcccagctactarggaggctgaggcaggagaattgcttgaacctgggaggtggaggttgcagtgagctgagatcgcaccactgcactccagcctgggcaatagagcaagactt

SEQ ID NO: 57275 - DNA, 201 bp, Homo sapiens
tggatgatggatggatggatggcaggatggggtggaaaaaaggataagggatggatggacggacagacagatggatgggatggggtagaaaaaaggatgasagatgatggagaggtgtaaatagaaggatgaggaaagatggaggaactaaaggaagggtggggagaaagatgggagagagatatcaggataagggaaaga

SEQ ID NO: 57276 - DNA, 201 bp, Homo sapiens
atcctccgcctcaacctcccaaagtgttgggatcacaggcatgagccaccaggcccggcctggtctcaaactcctgggctcaggcaatcctccgcctcaamctcccaaagtgttgggatcacaggcatgagccaccacgcccggcctggcttcatctttaaaggacagttgcctcgttttcatgttgattcgtcctcattc

SEQ ID NO: 57277 - DNA, 201 bp, Homo sapiens
ccaggctacagtcgaacttgcgtaggcctcccaaagtgctgggattacaggtgtgagcagccacgccgggcccatctcacccatttttcagtgtatagttwctgtagtgttaggtacattcacactgttacacaacagaactacaactctgtacccatgaaaccctaactctccttgtcccctcccccagcgcccagccac

SEQ ID NO: 57278 - DNA, 201 bp, Homo sapiens
tccctgagaaggaccgtaccacttcagaagcccagacagaggttcctctggatgaccctgacagggcaggatggccagcaggaaaggacagcatccaatayggcagggtaaccaccagcttcacccacccctccccacccactgtgccacctccaggggcccaagtcctcccaccaaatgtagcacttggcagtgatactc

SEQ ID NO: 57279 - DNA, 201 bp, Homo sapiens
ctgagggttaggcacatacaccccaccattgggagagatactgactttgtcttcatttcctctaaatgacaggtccatcaagtcagtccctgagaaggacygtaccacttcagaagcccagacagaggttcctctggatgaccctgacagggcaggatggccagcaggaaaggacagcatccaatacggcagggtaaccac

SEQ ID NO: 57280 - DNA, 201 bp, Homo sapiens
agaacaacagggctaccaagatcaaaaactctgctgtcccccgatgcctggaacctagaggcattaggttctcccctaggttctagtgatgcctagagccrtggggctgcgcactcatcaccattagcaatgcgctgtgtctttagagagagccttatgtagcttatgactgcggagaggacatgtgttagcaggactggg

SEQ ID NO: 57281 - DNA, 201 bp, Homo sapiens
aaaccattatggatagagaacctgctgaagtccccccatggtgccctgctgagggataatttaccaaaattggtccagttagccaagatgattaggccccyataaggccagttcatggaatgaacaatatgccttccaattgatggatgtcttcaagtgggccgaggccagcttgctggagttgtctgaatgctgcagtag

SEQ ID NO: 57282 - DNA, 201 bp, Homo sapiens
tatgtggttagctcatgccagctgagacgcttggagtcagccagctactcgtctgtctgctcccacatggctgagacgttccagggcagcacagtggtccvggcattccgaacccaggccccctttgtggctcagaacaatgctcgcgtagatgaaagccagaggatcagtttcccgcgactggtggctgacaggtaggaa

SEQ ID NO: 57283 - DNA, 201 bp, Homo sapiens
gtatgtggttagctcatgccagctgagacgcttggagtcagccagctactcgtctgtctgctcccacatggctgagacgttccagggcagcacagtggtcygggcattccgaacccaggccccctttgtggctcagaacaatgctcgcgtagatgaaagccagaggatcagtttcccgcgactggtggctgacaggtagga

SEQ ID NO: 57284 - DNA, 201 bp, Homo sapiens
cctcagtgctggcctcgtgggcttctctgtctctgctgccctccaggtactccccacatccccaaactgggcttgagggacagacagaggcagagactgtyggacccctgctagtgggacctttgaagaccctgtgtccaaaccaccatggtgtgtggagtccctccaccaaggagggacacgcagctctacaagagccag

SEQ ID NO: 57285 - DNA, 201 bp, Homo sapiens
tctgtcgcagttctgaggcctgaagtctaaaatcaaggtgtcagcagtgttaactctttgtggaggtttttttggtttttttgtttgtttgtttgtttgttttttctgagacggagtcttgctctgtcaaccaggctggagtgcagtagcacgatctcggcttatggctcactgcaacctctgcctcctgggttccagtgt

SEQ ID NO: 57286 - DNA, 201 bp, Homo sapiens
tctgaggaggtgacttaggaggaagtgaggttaacagcaggaagaaaaggcctgggagttgaaggttcatccctggtgtgttagaggaacagcaagaagaygggtgtggctggagagggtgggtgaaggcaggggtgctgggagacaaggttggggatgggatggcagggctagagctgctaatggctcatagggaggagc

SEQ ID NO: 57287 - DNA, 201 bp, Homo sapiens
ttctgtcgcagttctgaggcctgaagtctaaaatcaaggtgtcagcagtgttaactctttgtggaggtttttttggtttttttgtttgtttgtttgtttgttttttctgagacggagtcttgctctgtcaaccaggctggagtgcagtagcacgatctcggcttatggctcactgcaacctctgcctcctgggttccagtg

SEQ ID NO: 57288 - DNA, 201 bp, Homo sapiens
tgcaaacactcaatacatgtctgctgctcttattagccctatttcccagattggaaaaccaagactcaagggggtagaatgatctgttcaaggtcacgggmacagcaaaggcagtattggtcttcccactgcacagtcatgtcctttcacaaagacaaagagaaatgtctgctcccactatagaaaaagagattattttat

SEQ ID NO: 57289 - DNA, 201 bp, Homo sapiens
gttctgtcgcagttctgaggcctgaagtctaaaatcaaggtgtcagcagtgttaactctttgtggaggtttttttggtttttttgtttgtttgtttgtttgttttttctgagacggagtcttgctctgtcaaccaggctggagtgcagtagcacgatctcggcttatggctcactgcaacctctgcctcctgggttccagt

SEQ ID NO: 57290 - DNA, 201 bp, Homo sapiens; identical to SEQ ID NO: 16503

SEQ ID NO: 57291 - DNA, 201 bp, Homo sapiens
agcccccgcacccggccctatggatctcattgtgatttccccagttttgcttgcacgtgggtgtgcgcatgtttgcctctgtgcagtcgtatcccctgttyagtctctcgcatccatcacgatggttgacagttgagatactgaacaaccccctcaccacgaggcgctctcgtgttgcccttttgcaaccacacccaccct

SEQ ID NO: 57292 - DNA, 201 bp, Homo sapiens
ttcctgagtagctggaagctgggattacaagtgtgcagcctggttaatttttgtatttttagtagagatggggtttcaccatgttggccaagctggtctcraactcctgacctcaaatgatctgcccgcctcggcctcccagagtgttgggattacaggtgtgagcccccgcacccggccctatggatctcattgtgattt

SEQ ID NO: 57293 - DNA, 201 bp, Homo sapiens
tcctgacacccatcaatccatggatctcaattatttatttatttatttatttgtttattttattttgagacagagtcttgctctgttgcccgggctggagkgcagtgctgccgtctcggctcactgcaacccccatctccgaggttcaagcagttctcctacctcagcttcctgagtagctggaagctgggattacaagtg

SEQ ID NO: 57294 - DNA, 201 bp, Homo sapiens
tgttggccaggccaggctggtcttgaacccccgacctcatgtaataagcccgcctcagcctcccaaagtgctaggattataggcatgagccaccgcgcctrgccgccttatttatttatttatttatttatttatttatttatttatatttattgagacagtgtctcactctgtcacccaggctggagtgcagtggcacga

SEQ ID NO: 57295 - DNA, 201 bp, Homo sapiens
gtgtaatggcgcaatctcagctcactgcaacctccacctcctggcttcaaacgattctcttgccttagcctctcgagtagctgggactacaggtgcctgccaccacacgtggctaatttttgtatttttagtagagacggggtttcactacgttggtccaggctggtctcaaactcctgagctcaggtgacacacccgcct

SEQ ID NO: 57296 - DNA, 201 bp, Homo sapiens
agtagagacagggtttcaccatgttggccaggccaggctggtcttgaacccccgacctcatgtaataagcccgcctcagcctcccaaagtgctaggattayaggcatgagccaccgcgcctagccgccttatttatttatttatttatttatttatttatttatttatatttattgagacagtgtctcactctgtcaccca

SEQ ID NO: 57297 - DNA, 201 bp, Homo sapiens
gtagcttagggtgccagagaaaggggtcccatgaggctggcaggcagtgagtgggggcgagataagaagcttggaatttctttctttctttctttctttcytttttttttttttttttttttttgagacagagtttcgctcttgtcgcccagagaagagtgtaatggcgcaatctcagctcactgcaacctccacctcctg

SEQ ID NO: 57298 - DNA, 201 bp, Homo sapiens
agtagcttagggtgccagagaaaggggtcccatgaggctggcaggcagtgagtgggggcgagataagaagcttggaatttctttctttctttctttctttyttttttttttttttttttttttttgagacagagtttcgctcttgtcgcccagagaagagtgtaatggcgcaatctcagctcactgcaacctccacctcct

SEQ ID NO: 57299 - DNA, 201 bp, Homo sapiens
atgaaatagagaccactgagaaaccataccatggttggtatggacaggatgctctgagaagtgacatttgagcttccccaaagaatgtgtgaaggaatcartcatacaaagggcaggagaaagagcgctccaggcagagagagcagcaggtgcaatggctccgaggtgggaagtagcttagggtgccagagaaaggggtcc

SEQ ID NO: 57300 - DNA, 201 bp, Homo sapiens
agatggggaggggagagctgagtgcgagcccacgggtctggctttgttcttgtcgtctgtgagctgcccatcactcagacctgcaccccctccccctatcstctcaatggacagtggctccgtccctccaatgttcaggccacaggccctgggtcagttcaatgcctttttctctcacatcccatctgtcagcagatttgc

SEQ ID NO: 57301 - DNA, 201 bp, Homo sapiens
cagtgagtagcagggcaatttgttcagtgggagagatttcttcctgcagcctctgcccctgggggggcgggggatggtgcctgggggcctctccgatgcaraggccggccaggtcaggggtctcctgtaaatggcctcttgtgccctgcagctgccgggaaggattgcatcacgatacaaagtgccaccttcgcctggtcc

SEQ ID NO: 57302 - DNA, 201 bp, Homo sapiens
ttctgatcatgtaaaaggatgctgtttcatggaagggcttactgtgcaagacagccatgctggggccccaggggtcagttcccacctgggtcaggggctcmctgggctcacaacctggaatctcaactcctccaccctccacgaagggtgctactccatgccaagggcttattctgtgacaagcctacacacttttttttt

SEQ ID NO: 57303 - DNA, 201 bp, Homo sapiens
ctgggtcaggggctcactgggctcacaacctggaatctcaactcctccaccctccacgaagggtgctactccatgccaagggcttattctgtgacaagccyacacactttttttttttttttttttttttttgagacagagtcttgctctgtcgcccaggctggagtgcagtggcgcgatcttggctcacttgcaagctct

SEQ ID NO: 57304 - DNA, 201 bp, Homo sapiens
cccaagtctgaccaccttcggggtctgcagctgtgttacagaaaaggggtcctgatccagatcccaaaagagggttcttggatctcgtgcaagaaagaatycagggcgagtccataaagtgaaagcaagtgtttgtttgtttgttttttgagacggagtctcactctgccacccaggctggagtgcagtggtgcgatcgtg

SEQ ID NO: 57305 - DNA, 201 bp, Homo sapiens
cataaacaggccaggcacggtggatcacgcctggaatcccacccaggtgttgtacacatctgtatttaaggcccacgtgacaccagccttgaatgtcttargaagactgtagatttgattcttgaagcagcagtgagtcattgtaggtttgtttgcaacggcatgactgaagtgaaagctgtgctttcgctgttgggggaa

SEQ ID NO: 57306 - DNA, 201 bp, Homo sapiens
ctcgtagccatcttggttttggtgggatttggccgccttctttactgcaacctgttttatcaggaaggtctttgtgacctgtatcttgtgccgacctcctrtctcatcctgtgacttacaataccctaaccgtctgggaatgcagcccagtaggtctcagcctcattttacccagtccctattcaagatggagttgctctg

SEQ ID NO: 57307 - DNA, 201 bp, Homo sapiens
ctgcccaaggacatgcgcccagcacacgcttccaacccagctgtgagggccagggagccgcatggaaagcaggacttctatggagaaaacctcagcgcagrcacactgggctctcacagctgccgagagcctgggctggtgtccagagagcctctctgtctccctctcccccacagggttctggtcatggacaaggggcag

SEQ ID NO: 57308 - DNA, 201 bp, Homo sapiens
attcaagatggagttgctctggttcacgtgcctctgagagctgggctcctcgggatctcctgacatcctgccccttctatccccagctcctggggccctcygccctcactgccatcgctgtcttcctgagcctcctccctctgaatttcttcatctccaagaaaaggaaccaccatcaggtttggcttttgggaaagggac

SEQ ID NO: 57309 - DNA, 201 bp, Homo sapiens
agggccagggagccgcatggaaagcaggacttctatggagaaaacctcagcgcagacacactgggctctcacagctgccgagagcctgggctggtgtccaragagcctctctgtctccctctcccccacagggttctggtcatggacaaggggcaggtggcagagagcggcagcccggcccagctgctggcccagaagggc

SEQ ID NO: 57310 - DNA, 201 bp, Homo sapiens
ccagtccctattcaagatggagttgctctggttcacgtgcctctgagagctgggctcctcgggatctcctgacatcctgccccttctatccccagctcctrgggccctccgccctcactgccatcgctgtcttcctgagcctcctccctctgaatttcttcatctccaagaaaaggaaccaccatcaggtttggcttttgg

SEQ ID NO: 57311 - DNA, 201 bp, Homo sapiens
gcacgtgggtgtgcgcatgtttgcctctgtgcagtcgtatcccctgttcagtctctcgcatccatcacgatggttgacagttgagatactgaacaaccccstcaccacgaggcgctctcgtgttgcccttttgcaaccacacccacccttctcctgcctcgcccaccctgtccccaacccctggttcttctccttttaata

SEQ ID NO: 57312 - DNA, 201 bp, Homo sapiens
cttgcacgtgggtgtgcgcatgtttgcctctgtgcagtcgtatcccctgttcagtctctcgcatccatcacgatggttgacagttgagatactgaacaacmccctcaccacgaggcgctctcgtgttgcccttttgcaaccacacccacccttctcctgcctcgcccaccctgtccccaacccctggttcttctcctttta

SEQ ID NO: 57313 - DNA, 201 bp, Homo sapiens; identical to SEQ ID NO: 16570

SEQ ID NO: 57314 - DNA, 201 bp, Homo sapiens
agctcaagcagtcctcctgtctcagcctctcaaagtgctgggattacaggcatgagccacctcgtctagccaatactgctaattctaatagtcacaacgtyaccagtttttcactgggcaccttcatactctgtggttcctaatgcaagccaatgacatcattcaggcatgagccaccatgcccggctggctgatactacc

SEQ ID NO: 57315 - DNA, 201 bp, Homo sapiens
ggctggaccgcagtgatgtaatcatagctcactgcagcctcgacctcctgggctcaagcaatcctcctacctcagtctctcaagtagctgggactacaggygtgtgccaccatgcccagctaatgtttgtattttcagtagagatgggttttgccatgttgcccaggttggtctggaactcctgggctcaagtgatcctct

SEQ ID NO: 57316 - DNA, 201 bp, Homo sapiens
aaagaaactgaattcttttaaaatttattttattttgattttgagaaagtggctcgctcactcacccaggctggaccgcagtgatgtaatcatagctcackgcagcctcgacctcctgggctcaagcaatcctcctacctcagtctctcaagtagctgggactacaggcgtgtgccaccatgcccagctaatgtttgtatt

SEQ ID NO: 57317 - DNA, 201 bp, Homo sapiens
gtttgagtccaattaggttacagttcactatgtacggggaaaacctttaggccaaacttaaaatatgtaaggaggcagctttgggctaacctcaatttaayagaaggtaggtagacatgtatatgtagatatacaggtatgtagatgaatggataaatggatggatggatagatagataatattcctatttttacagctga

SEQ ID NO: 57318 - DNA, 201 bp, Homo sapiens
gtttcttttcttttcttctttcttttcttctctttctttctttcctttcttgacagagtcttgctctgtcacccaggatggagtgctgtggtccaatctcrcctcactgcaagctccacctcccaggtttaagtgattctcttgccttagcctccaaagtagctgagactacaggtgtgcgccacctcacctagctaattt

SEQ ID NO: 57319 - DNA, 201 bp, Homo sapiens
gatggtgagtcattatatattacaatgcaataataatacaagtaggccgggcgcagtggctcacgcctgtaatcccagcactttgggaggccaaggtgggyggatcacctgagggcaggagttcgagaccagcctggccaccatggtgaaaccccatctctactaaaaatacagaaactagccaggcgtggtagtgggtgc

SEQ ID NO: 57320 - DNA, 201 bp, Homo sapiens
aggcgggctgaaccctaaccaaggtcatgtctcccctcttgcgtgtccagaataaacctcacggtgccccagggctgtctgctggctgttgtcggtccagygggggcagggaagtcctccctgctgtccgccctccttggggagctgtcaaaggtggaggggttcgtgagcatcgaggtgaggccacccccagcctgtctg

SEQ ID NO: 57321 - DNA, 201 bp, Homo sapiens
tagcgagggaaggctttgcattcaagccgagatcataaggaaggagtgtctgggagaagagctgttcttttttttttttttttttttttttttttgaaacrgagtcttgctctatcacgcgggctggagtgcaatggcatgatctcggctcactgcaacctccaccttccggattcaagcaattctcctgcctcagcctcc

SEQ ID NO: 57322 - DNA, 201 bp, Homo sapiens
ctcttcttgctgggtgacctgcggcttcggttttcctaggcccgggtgtcctttgaccgtctggtcaccttcctctgcctggaagaagttgaccctggtgycgtagactcaagttcctctggaagcggtgagtgctgagtctggcaggaggggtgtgggagggatgggggatgtgggggccaccccggcccataatggcaa

SEQ ID NO: 57323 - DNA, 201 bp, Homo sapiens
cagtgaaataataataataattagtagtagtagcagtagtatttttgagacagtcttactccgtcatccaggctggagtgcagtggtgcaatcttggttcwctgcaacctccgcctcctgggttcaagcaattctcctgccttagcctctcaagtagctgtgattacaggcgcccaccaccacgcctggctaatttttgta

SEQ ID NO: 57324 - DNA, 201 bp, Homo sapiens
catctccaagaaaaggaaccaccatcaggtttggcttttgggaaagggacggaccaggcaggaagtagggaggaagccacaggtcctggtgtgggagatgsggaggggagagctgagtgcgagcccacgggtctggctttgttcttgtcgtctgtgagctgcccatcactcagacctgcaccccctccccctatcctctca

SEQ ID NO: 57325 - DNA, 201 bp, Homo sapiens
aagcccgcctcagcctcccaaagtgctaggattataggcatgagccaccgcgcctagccgccttatttatttatttatttatttatttatttatttatttatatttattgagacagtgtctcactctgtcacccaggctggagtgcagtggcacgatctcagctcactgcatgctcaaactcctggactcaagtgatgctt

SEQ ID NO: 57326 - DNA, 201 bp, Homo sapiens
accttagtctctgtgatattccctgatcccccacagcacactctggccccagggcctttgcactgctgttccctctgctggaaagctctccccaggagtcyccagggctcatccctcacttctatcaccttcacagagaggcctttcctgaccaccttatctaccaccacagccaccctactattgttagtgcaccctaca

SEQ ID NO: 57327 - DNA, 201 bp, Homo sapiens
gggcttgtcaagagaatgggtccaaataacctgtgcagaaatctcagaaagtcacagcaacttaaaaatcatttattctaccccccacttccacattttcyagatatagaaaccaaagctgagagggggaagataaccatcccaaaatcaccacgttggtgggggagcagggttgccagagaaaacacaggacattcagtg

SEQ ID NO: 57328 - DNA, 201 bp, Homo sapiens
agagggggaagataaccatcccaaaatcaccacgttggtgggggagcagggttgccagagaaaacacaggacattcagtgaagtgtgagtttcagacaaamggaagaatttctcagtgtatgtcccaaatatttcacgagacttagactaaaaccttattcactctttatcttcaaatgtaactgggcattctgtatgatg

SEQ ID NO: 57329 - DNA, 201 bp, Homo sapiens
aatctgacaacccttgcgagggatgaaatgaagattaggaaaataattaaacgcaataagagaaaatgccaaatgagaacaactctattcccattttgcakacaagagaattgcacctaagggagatgacttgccccaaggccacactcaaaactctcagggtcaggatttgaaccaggtcccctgattccataggtctca

SEQ ID NO: 57330 - DNA, 201 bp, Homo sapiens
tatacagaaaggcagctgtgtacctgctggatgaccccctggcggccctggatgcccacgttggccagcatgtcttcaaccaggtcattgggcctggtggrctactccagggaacagtaagtttgggaacatgtgtcagacagtacagggcaaaggcagaggaagcacttagcatccagtcctaacccaagtttatctcac

SEQ ID NO: 57331 - DNA, 201 bp, Homo sapiens
agagaatgtgtgcttcgggcaggagctggacccaccctggctggagagagtactagaagcctgtgccctgcagccagatgtggacagcttccctgagggartccacacttcaattggggagcaggtgagagtttgggggtctttttgggacagggagacattgcagttgggagtcatttgggtccccgactcatcatgggc

SEQ ID NO: 57332 - DNA, 201 bp, Homo sapiens
tgtgagcccccgcacccggccctatggatctcattgtgatttccccagttttgcttgcacgtgggtgtgcgcatgtttgcctctgtgcagtcgtatccccwgttcagtctctcgcatccatcacgatggttgacagttgagatactgaacaaccccctcaccacgaggcgctctcgtgttgcccttttgcaaccacaccca

SEQ ID NO: 57333 - DNA, 201 bp, Homo sapiens
accccatgtgtggggatgcctgaacacaggcacctcactcctgcactgcttcagggacctgtttctgggcacacccacacatcaccatgtgccgacaaacrcacgtcccagctaattgtcccaatcgttcccagcgtgggccagaaacagctcctgtgtctggcacgtgcccttctccggaagacccagatcctcatcctg

SEQ ID NO: 57334 - DNA, 201 bp, Homo sapiens
catcaccatgtgccgacaaacgcacgtcccagctaattgtcccaatcgttcccagcgtgggccagaaacagctcctgtgtctggcacgtgcccttctccgraagacccagatcctcatcctggacgaggctactgctgccgtggaccctggcacggagctgcagatgcaggccatgctcgggagctggtttgcacagtgca

SEQ ID NO: 57335 - DNA, 201 bp, Homo sapiens
acagcaaaggcagtattggtcttcccactgcacagtcatgtcctttcacaaagacaaagagaaatgtctgctcccactatagaaaaagagattattttatmataaacagtggctaataataacaataaaatagactaaaagtagccaccaccatctgtttttagcattgacatagtccatgccctctcttgttgaattccc

SEQ ID NO: 57336 - DNA, 201 bp, Homo sapiens
tagctcatgccagctgagacgcttggagtcagccagctactcgtctgtctgctcccacatggctgagacgttccagggcagcacagtggtccgggcattcygaacccaggccccctttgtggctcagaacaatgctcgcgtagatgaaagccagaggatcagtttcccgcgactggtggctgacaggtaggaagagccagg

SEQ ID NO: 57337 - DNA, 201 bp, Homo sapiens
aaccctctggtcagagcaggcctttcctcccaaccccgggcaggtgggcatcgttggcaggaccggggcagggaagtcctccctggccagtgggctgctgyggctccaggaggcagctgagggtgggatctggatcgacggggtccccattgcccacgtggggctgcacacactgcgctccaggatcagcatcatccccca

SEQ ID NO: 57338 - DNA, 201 bp, Homo sapiens
aataagcccgcctcagcctcccaaagtgctaggattataggcatgagccaccgcgcctagccgccttatttatttatttatttatttatttatttatttatttatatttattgagacagtgtctcactctgtcacccaggctggagtgcagtggcacgatctcagctcactgcatgctcaaactcctggactcaagtgatg

SEQ ID NO: 57339 - DNA, 201 bp, Homo sapiens
taataagcccgcctcagcctcccaaagtgctaggattataggcatgagccaccgcgcctagccgccttatttatttatttatttatttatttatttatttwtttatatttattgagacagtgtctcactctgtcacccaggctggagtgcagtggcacgatctcagctcactgcatgctcaaactcctggactcaagtgat

SEQ ID NO: 57340 - DNA, 201 bp, Homo sapiens
tctacctcgcagattcaagtgattctcctgccccagcctgccaagtagctgggaccacaggcatgcacaaccatgcccagctaatttttttttttttttttgtatttttagtagagatgagatttcaccatgttggccaggcaggtcttgaaccgctgacctcaggtgatctgcccaccttggcctcccaaagtgctgatt

SEQ ID NO: 57341 - DNA, 201 bp, Homo sapiens
ctgccctccaggtactccccacatccccaaactgggcttgagggacagacagaggcagagactgtcggacccctgctagtgggacctttgaagaccctgtrtccaaaccaccatggtgtgtggagtccctccaccaaggagggacacgcagctctacaagagccagactcagctaaggtgaacttgcaaccttgggcaaga

SEQ ID NO: 57342 - DNA, 201 bp, Homo sapiens
atacaagcaatcatgtcagttcccttttttatacaaagcgattttgtttctcttcctttgctatctctagtcctttcagcatggtgaaaacaagaaacggyggcatacctgagccatctccatgttttttattttttatttttatttatttatttatttgagatggagtctcactctgtcacccaggctggagtgcagtgg

SEQ ID NO: 57343 - DNA, 201 bp, Homo sapiens
ttgggaggccgaggcaggcagatcacctgaggtcaggagttcaaaaccagcctggccaacatggcataaccctgcctccacaaaaaatataaaatttagccgggcgtggtggcgggcgcctgtaatcccagctactcgggaggctcaggcaggagaatcgcttgaacccaggaggcggaggttacagtgagccgagaccac

SEQ ID NO: 57344 - DNA, 201 bp, Homo sapiens
tacaggtatgtagatgaatggataaatggatggatggatagatagataatattcctatttttacagctgaggaaactgaggcacagaggttaagtcagccyactcatccacagataaaacattcaaagagtctttagcatctgaattgtgcataatttatattctgccagttggactgacaaatctgatggtatacagtag

SEQ ID NO: 57345 - DNA, 201 bp, Homo sapiens
cccctggcctcagggcgggcagatcgagttccgggactttgggctaagataccgacctgagctcccgctggctgtgcagggcgtgtccttcaagatccacrcaggagagaaggtgagtggttctctcacaatgtcttcttcatggagtttaggccaaaggactccagggacaaggccctaaaccctgggcaccagctacct

SEQ ID NO: 57346 - DNA, 201 bp, Homo sapiens
gggcttctttttgctctgcatgctctggttctactgaaggaagagagggacctgttggttgtatccaaatcccaatcccctgggcccaggtcctcagactrtcccattcctgcctcccctctttactcccctgggtctggcctcccagaaaaggttgggaaaccaggggggctgttgcaagccctcaagtggccttgccaa

SEQ ID NO: 57347 - DNA, 201 bp, Homo sapiens
cccatccatccttctcagagcctgtatgtggttagctcatgccagctgagacgcttggagtcagccagctactcgtctgtctgctcccacatggctgagaygttccagggcagcacagtggtccgggcattccgaacccaggccccctttgtggctcagaacaatgctcgcgtagatgaaagccagaggatcagtttcccg

SEQ ID NO: 57348 - DNA, 201 bp, Homo sapiens
acccctcccactgggggctctctctgcctccctctccctcatgtgtgctacaggtgaaggccacagtgcacctggcctacctgcgtgccgtgggcaccccyctctgcctctacgcactcttcctcttcctctgccagcaagtggcctccttctgccggggctactggctgagcctgtgggcggacgaccctgcagtaggtg

SEQ ID NO: 57349 - DNA, 201 bp, Homo sapiens
ctgtggcctacgtgccccaggaggcctgggtgcagaacacctctgtggtagagaatgtgtgcttcgggcaggagctggacccaccctggctggagagagtwctagaagcctgtgccctgcagccagatgtggacagcttccctgagggaatccacacttcaattggggagcaggtgagagtttgggggtctttttgggaca

SEQ ID NO: 57350 - DNA, 201 bp, Homo sapiens
ccggtccctgctgatgtacgcctttggactcctggaggtcagcctggtggtggcagtggctaccccactggccactgtggccatcctgccactgtttctcmtctacgctgggtttcaggtacggagaggtcagggaggcttccgggaccggctgaggtcaactcagccagtcccctgtctctggggaagactccatatatg

SEQ ID NO: 57351 - DNA, 201 bp, Homo sapiens
ggtgctgtggcctacgtgccccaggaggcctgggtgcagaacacctctgtggtagagaatgtgtgcttcgggcaggagctggacccaccctggctggagaragtactagaagcctgtgccctgcagccagatgtggacagcttccctgagggaatccacacttcaattggggagcaggtgagagtttgggggtctttttgg

SEQ ID NO: 57352 - DNA, 201 bp, Homo sapiens
ccagcctgtctgctaggatgtccccatcctgaaagtcccacttcctcgctgccttcccaccctccccatcccagccaagttcactttcactcattctctcyacctctcacccaccactgagagcccagctcccactgctcctcaaaacctatcccacctctgtccccatcatcctcctgtgaccaaagtaagttgtgtttt

SEQ ID NO: 57353 - DNA, 201 bp, Homo sapiens
ttctgcctgactttaaagtgccaagtgaccctgcccacacggtcctctggtcacactgagtgtcctctgagtcatgctattccctgtgcctgggttttagstgcccccgccacccccctaccccccagcccccaccccccacccccatctcaagcccctcccctccctcttctccagctccatccccccatcctctgcctg

SEQ ID NO: 57354 - DNA, 201 bp, Homo sapiens
gctgtctgctggctgttgtcggtccagtgggggcagggaagtcctccctgctgtccgccctccttggggagctgtcaaaggtggaggggttcgtgagcatygaggtgaggccacccccagcctgtctgctaggatgtccccatcctgaaagtcccacttcctcgctgccttcccaccctccccatcccagccaagttcact

SEQ ID NO: 57355 - DNA, 201 bp, Homo sapiens
ggtcagaggtgctgagaggcagacaggtttgggacgcagtttggtgagatgaatgggatttgctgaagggtggctgtcagggtgcagggaagaattctcarctgtccctgtcttcatctctctttttccctccgatcccaggaggagcaaatgaggcagaaggactcacgggcacggctcaccagctctatcctcaggaac

SEQ ID NO: 57356 - DNA, 201 bp, Homo sapiens
ggaggctcaggcaggagaatcgcttgaacccaggaggcggaggttacagtgagccgagaccacaccactgcactccagcctgggcgacagaggaagactcrgtctcaaaaagtaaaaccttctccaggcagctgcccctctgatgatgcccccgccccatggtgaagcacaagagaccctgaattcttctgcctgacttta

SEQ ID NO: 57357 - DNA, 201 bp, Homo sapiens
cccggcctccccactttacttctctccttctgcccacccgccaggtcctggctctgtccagcggctccagaaaggccagtgcggtgggtgatgtggtcaakctggtgtccgtagacgtgcagcggctgaccgagagcgtcctctacctcaacgggctgtggctgcctctcgtctggatcgtggtctgcttcgtctatctct

SEQ ID NO: 57358 - DNA, 201 bp, Homo sapiens
cgggcatcagaggcttcctccgtggggcacattatcccaggggcactcctgcagaagtccaggtacaggatgatggtggttggaccaggagtgagggtcaraggtgctgagaggcagacaggtttgggacgcagtttggtgagatgaatgggatttgctgaagggtggctgtcagggtgcagggaagaattctcaactgtc

SEQ ID NO: 57359 - DNA, 201 bp, Homo sapiens
gactcacgggcacggctcaccagctctatcctcaggaactcgaagaccatcaagttccatggctgggagggagcctttctggacagagtcctgggcatccraggccaggagctgggcgccttgcggacctccggcctcctcttctctgtgtcgctggtgtccttccaagtgtctacatttctggtgacgtcactctagtct

SEQ ID NO: 57360 - DNA, 201 bp, Homo sapiens
actgttgccccacgtgtcccccccaccccccaggtcgcactggtggtgtttgctgtccacactctggtggccgagaatgctatgaatgcagagaaagcctytgtgactctcacagttctcaacatcctcaacaaggcccaggctttcctgcccttctccatccactccctcgtccaggtgaggtgggtgcaagggctggag

SEQ ID NO: 57361 - DNA, 201 bp, Homo sapiens
tcatgtctcccctcttgcgtgtccagaataaacctcacggtgccccagggctgtctgctggctgttgtcggtccagtgggggcagggaagtcctccctgcygtccgccctccttggggagctgtcaaaggtggaggggttcgtgagcatcgaggtgaggccacccccagcctgtctgctaggatgtccccatcctgaaagt

SEQ ID NO: 57362 - DNA, 201 bp, Homo sapiens
ccagtttcaccctgtagatgctgactcaggccactgttccttttgtggccacagggcatgaatctctccggaggccagaagcagcggctgagcctggcccrggctgtatacagaaaggcagctgtgtacctgctggatgaccccctggcggccctggatgcccacgttggccagcatgtcttcaaccaggtcattgggcct

SEQ ID NO: 57363 - DNA, 201 bp, Homo sapiens
agtagcagggcaatttgttcagtgggagagatttcttcctgcagcctctgcccctgggggggcgggggatggtgcctgggggcctctccgatgcagaggcyggccaggtcaggggtctcctgtaaatggcctcttgtgccctgcagctgccgggaaggattgcatcacgatacaaagtgccaccttcgcctggtcccagga

SEQ ID NO: 57364 - DNA, 201 bp, Homo sapiens
agaagccagtgagtagcagggcaatttgttcagtgggagagatttcttcctgcagcctctgcccctgggggggcgggggatggtgcctgggggcctctccratgcagaggccggccaggtcaggggtctcctgtaaatggcctcttgtgccctgcagctgccgggaaggattgcatcacgatacaaagtgccaccttcgcc

SEQ ID NO: 57365 - DNA, 201 bp, Homo sapiens
tggggtttcaccatgttggccaagctggtctcgaactcctgacctcaaatgatctgcccgcctcggcctcccagagtgttgggattacaggtgtgagcccycgcacccggccctatggatctcattgtgatttccccagttttgcttgcacgtgggtgtgcgcatgtttgcctctgtgcagtcgtatcccctgttcagtct

SEQ ID NO: 57366 - DNA, 201 bp, Homo sapiens
tcactgatttgtaggatcgcagaggtgggagatcaccaccatcaaggtcaccactcgggttgcatcgtttcccatgaactagaaagctttgtcctcacgcytcctatgcacagagcttggtagacaggaagctgttgccacacatcttgagacaccgacacccaaaacctgagttctttgctcttcttgctgggtgacctg

SEQ ID NO: 57367 - DNA, 201 bp, Homo sapiens
ctggaagcggtgagtgctgagtctggcaggaggggtgtgggagggatgggggatgtgggggccaccccggcccataatggcaagccagcatcagcactggrgggagatgggggctgcgggcaatggatgacacgtgcagatcacgccatctgcgtgtcacttggaaactggcaccgtgctgctcttctttctgctagccat

SEQ ID NO: 57368 - DNA, 201 bp, Homo sapiens
gttcctctggaagcggtgagtgctgagtctggcaggaggggtgtgggagggatgggggatgtgggggccaccccggcccataatggcaagccagcatcagyactggagggagatgggggctgcgggcaatggatgacacgtgcagatcacgccatctgcgtgtcacttggaaactggcaccgtgctgctcttctttctgct

SEQ ID NO: 57369 - DNA, 201 bp, Homo sapiens
aggtggaggttgcagtgagctgagatcgcaccactgcactccagcctgggcaatagagcaagactttatctcaaaaataaataaataaataaataaataawgcattgttcatcacactgtattacatttactcaattgcactgtttcctagaccggatgatgggcacactggagcaaggactctttaatttctatacttcc

SEQ ID NO: 57370 - DNA, 201 bp, Homo sapiens
caaaacagcaacatgatataatgtgttagcaatataacagtaacattacagtaacagaacaaggaagaattaattagttgatgaatagggtagaagaaatkgtgagagatggacagatgaatggatggaatgggatggaagaatgagagatggagggatgggattggagatggatggatggatgcatggatggatggatgg

SEQ ID NO: 57371 - DNA, 201 bp, Homo sapiens
gcgactggtggctgacaggtaggaagagccagggcagagaagaccttgcaattcatccatatccttagagggtgagacctgaggtcatattgtatggtagmgaggtcacccagagagtcagggacatagttgaggctagatcccacaggcagtctatcagttctcaccgtgggcagatggaacatgaccgagagattctca

SEQ ID NO: 57372 - DNA, 201 bp, Homo sapiens; identical to SEQ ID NO: 16489

SEQ ID NO: 57373 - DNA, 201 bp, Homo sapiens
cctgtagatgctgactcaggccactgttccttttgtggccacagggcatgaatctctccggaggccagaagcagcggctgagcctggcccgggctgtatamagaaaggcagctgtgtacctgctggatgaccccctggcggccctggatgcccacgttggccagcatgtcttcaaccaggtcattgggcctggtgggctac

SEQ ID NO: 57374 - DNA, 201 bp, Homo sapiens; identical to SEQ ID NO: 16491

SEQ ID NO: 57375 - DNA, 201 bp, Homo sapiens
atgtctgtggcttctcctcttccctctcccatccatccttctcagagcctgtatgtggttagctcatgccagctgagacgcttggagtcagccagctactsgtctgtctgctcccacatggctgagacgttccagggcagcacagtggtccgggcattccgaacccaggccccctttgtggctcagaacaatgctcgcgta

SEQ ID NO: 57376 - DNA, 201 bp, Homo sapiens
agacagatctcgggtacagcagaaagatctccccaataaatgcccacaaaccctctggtcagagcaggcctttcctcccaaccccgggcaggtgggcatckttggcaggaccggggcagggaagtcctccctggccagtgggctgctgcggctccaggaggcagctgagggtgggatctggatcgacggggtccccattgc

SEQ ID NO: 57377 - DNA, 201 bp, Homo sapiens
cgggtacagcagaaagatctccccaataaatgcccacaaaccctctggtcagagcaggcctttcctcccaaccccgggcaggtgggcatcgttggcaggaycggggcagggaagtcctccctggccagtgggctgctgcggctccaggaggcagctgagggtgggatctggatcgacggggtccccattgcccacgtgggg

SEQ ID NO: 57378 - DNA, 201 bp, Homo sapiens
ttgtatggtagcgaggtcacccagagagtcagggacatagttgaggctagatcccacaggcagtctatcagttctcaccgtgggcagatggaacatgaccragagattctcaacagcaggtgggcggggggtacaggaagaagcttctgttgccaggcaactggatcaacctcttttgccttggtgataaagcagccatat

SEQ ID NO: 57379 - DNA, 201 bp, Homo sapiens
ggtacagcagaaagatctccccaataaatgcccacaaaccctctggtcagagcaggcctttcctcccaaccccgggcaggtgggcatcgttggcaggaccrgggcagggaagtcctccctggccagtgggctgctgcggctccaggaggcagctgagggtgggatctggatcgacggggtccccattgcccacgtggggct

SEQ ID NO: 57380 - DNA, 201 bp, Homo sapiens
accctctggtcagagcaggcctttcctcccaaccccgggcaggtgggcatcgttggcaggaccggggcagggaagtcctccctggccagtgggctgctgcrgctccaggaggcagctgagggtgggatctggatcgacggggtccccattgcccacgtggggctgcacacactgcgctccaggatcagcatcatcccccag

SEQ ID NO: 57381 - DNA, 201 bp, Homo sapiens
ctttcctcccaaccccgggcaggtgggcatcgttggcaggaccggggcagggaagtcctccctggccagtgggctgctgcggctccaggaggcagctgagrgtgggatctggatcgacggggtccccattgcccacgtggggctgcacacactgcgctccaggatcagcatcatcccccaggtgaggctggtggagggggt

SEQ ID NO: 57382 - DNA, 201 bp, Homo sapiens
ttgagcccaggagctcgaggccaacctgggcaacatagtgagaccccaactccacaaaaaatgtaaaaggtaaaaaaaaaaaaagacgtagctcaggcatyaaccacctccaggtagccttcctgatggtgtcatacccaggtgggctcaggctgcctctgttctccgggcatcagaggcttcctccgtggggcacattat

SEQ ID NO: 57383 - DNA, 201 bp, Homo sapiens
ggctccaggaggcagctgagggtgggatctggatcgacggggtccccattgcccacgtggggctgcacacactgcgctccaggatcagcatcatcccccasgtgaggctggtggagggggtgggcaaagatgggaggcatggtgggacccggctctgacccaccgcccctccccgccaggaccccatcctgttccctggct

SEQ ID NO: 57384 - DNA, 201 bp, Homo sapiens
ggtgggcaaagatgggaggcatggtgggacccggctctgacccaccgcccctccccgccaggaccccatcctgttccctggctctctgcggatgaacctcracctgctgcaggagcactcggacgaggctatctgggcagccctggagacggtgcagctcaaagccttggtggccagcctgcccggccagctgcagtacaa

SEQ ID NO: 57385 - DNA, 201 bp, Homo sapiens
ctctccagcctgggcaatagagtgagaacctgaaaagaaagaaggaagggaagggaagaggaggggaggggagaagaaagagagaaagaaagagagggagggagggagggagggagggaggaaggaaggaagggagggagggagggagggaggaagacagaaagaaaaagagaaagaaggaaagaaagaaagaaaagaaga

SEQ ID NO: 57386 - DNA, 201 bp, Homo sapiens
atgacagcatcatacaggcatttcaggggtacataataaatgtcaatcctcatagccagttctgagagatctcctggtgtcactttaatttgtagcaacaygcccaagaccacatatcaagtgagaaatataatagaataataagtctaaagttgccatcattgaggtttctattcagctatttatctctgaaacacttag

SEQ ID NO: 57387 - DNA, 201 bp, Homo sapiens
gtggcaggcactaagacattcatgagggatctacccgctgtgatccaattatccccactcggccccacctccaacactggggactacatttcaaaatgagrgtcagggggacaaaaaacccaaatcattatcagtgatcattgttcatttatttgtttcaaactctcaaccaaatttaagtaaatgggtcagtattttatc

SEQ ID NO: 57388 - DNA, 201 bp, Homo sapiens
gcacctttttttagccacataaaatgtattatttaatattatttaacttcagcttgtttttttaactatatttatgtggggcattaatatttaactgtaaracatttgtcaccaggcagctgtgattgcaagtagaggagtaatttcaaacaagaatgcttaaaagttagctatgccttgataaaataggtttatcattaa

SEQ ID NO: 57389 - DNA, 201 bp, Homo sapiens; identical to SEQ ID NO: 16621

SEQ ID NO: 57390 - DNA, 201 bp, Homo sapiens
ggacaaaaaacccaaatcattatcagtgatcattgttcatttatttgtttcaaactctcaaccaaatttaagtaaatgggtcagtattttatcttttcatwcatgtacaagacagaccttatttggtaacagcaacaatcctcacacatctctcttccttccttccaggattttaatgccttttgtaaagacctgcctaat

SEQ ID NO: 57391 - DNA, 201 bp, Homo sapiens
cttatttggtaacagcaacaatcctcacacatctctcttccttccttccaggattttaatgccttttgtaaagacctgcctaatggttctgccttcagtgsagacaatatggaagagtgtgacagatgttatcattgctccattgtgtacgagcgtaggacgatgcttctcttctgtcagcctgcaactgagccaggattg

SEQ ID NO: 57392 - DNA, 201 bp, Homo sapiens
acagaggaggagtaaaggatacaggtatactagatagtcagtttatattttttaggaataaaaataagtttggcaactataatttaaccatcccaatttcytctccctattcaccccaaaatagcaaaatgagcaaaataaagcaccccttgctaaatttttaagacatttctgtgcccactctccagtttcttgctttgg

SEQ ID NO: 57393 - DNA, 201 bp, Homo sapiens; identical to SEQ ID NO: 16626

SEQ ID NO: 57394 - DNA, 201 bp, Homo sapiens
cggaaggtaaacagggagtatcacctcacgtggccacagaaggagccaaagaaaggtgagggggaggtgccacacacttttgaaggacgagatctaatgakaactcactcactatacagtaccaactgcggggtcggggggcaggggtggcagtgggggtggttgctaaaccattcctaagaactctgcccccatgatcta

SEQ ID NO: 57395 - DNA, 201 bp, Homo sapiens
gaaacaagaggctccaatcacatggccttcagccttcccagtttcgcttttggacaacccaaatccctagtgaaaggggcatggaatctgaacaggagtgsaggaaattgaagtcagctaaagacttttctttttatccacaaaggaaagttgcttttgtcttactgaatgaataggaccctaggagtgggcatgagggct

SEQ ID NO: 57396 - DNA, 201 bp, Homo sapiens
accgggtggaccggctttctgaaacatgggcatattctccgccacctgccccctactctcctcttatcccaggccggcgtcaggaggaggaacgcgcatcrgttcccaagcagtaggaagaactggaaggccttgaaaggcaatgcgcttcctttagaataacagtttgggcttggagtttcaacaggagaaagaatgtcg

SEQ ID NO: 57397 - DNA, 201 bp, Homo sapiens
ttatgtggggcattaatatttaactgtaaaacatttgtcaccaggcagctgtgattgcaagtagaggagtaatttcaaacaagaatgcttaaaagttagctatgccttgataaaataggtttatcattaatagattgcattcccatgacatgataagaccagatcaaggacagaccttacagaattgcaaacccatttggg

SEQ ID NO: 57398 - DNA, 201 bp, Homo sapiens
gccgggcacggtggctcaagcctgtaatcccagcactttgggaggccgaggtgggcggatcacgaggtcaggagatcgagaccttcctggccaaaaccgtraaaccccgtctgtactaaaaatacaaaaagaaattagccgggcgtggtggcaggcgcctgtagtcccagctactcggaaggctgaggcaggagaatggcg

SEQ ID NO: 57399 - DNA, 201 bp, Homo sapiens
actcacagccttatcagggcagctggctaggtacagagatggacgctgagaaaacacagtcaactgacaaagagggaggaacagacaaggctttgaagagkgaaaggagtcgaaaaagactttgaaaggataaatgaaaattcaccaaatacgtaaaggatacacaaagaacaccaatttaattttatcactaaaggttgt

SEQ ID NO: 57400 - DNA, 201 bp, Homo sapiens
atgcacctttttttagccacataaaatgtattatttaatattatttaacttcagcttgtttttttaactatatttatgtggggcattaatatttaactgtmaaacatttgtcaccaggcagctgtgattgcaagtagaggagtaatttcaaacaagaatgcttaaaagttagctatgccttgataaaataggtttatcatt

SEQ ID NO: 57401 - DNA, 201 bp, Homo sapiens
caatgcacctttttttagccacataaaatgtattatttaatattatttaacttcagcttgtttttttaactatatttatgtggggcattaatatttaactrtaaaacatttgtcaccaggcagctgtgattgcaagtagaggagtaatttcaaacaagaatgcttaaaagttagctatgccttgataaaataggtttatca

SEQ ID NO: 57402 - DNA, 201 bp, Homo sapiens
agttctgcgggctgtacaggaagcacagtgccagcatctactttaggcaaggacctcaggaagcttccacttatagtggaaggagaaggaggagcaggcaygtcacatggcaagaaagggagcaagagagagaatgtggaggtcccagactcttttagttaatcagatctcaagcaaactaactgagtgagaactcacgtt

SEQ ID NO: 57403 - DNA, 201 bp, Homo sapiens
aggaagcttccacttatagtggaaggagaaggaggagcaggcacgtcacatggcaagaaagggagcaagagagagaatgtggaggtcccagactcttttarttaatcagatctcaagcaaactaactgagtgagaactcacgttaccaagagggtggcaggcactaagacattcatgagggatctacccgctgtgatccaa

SEQ ID NO: 57404 - DNA, 201 bp, Homo sapiens
ctttagatctgttgttttagcaactaataatctgctgtgcacatttcagttggtatttggaaaacatttaactctgtagctttgtagaaatgatattcccrcttgaacatagaggaaattgtacttattgagagtttaactcaagagttagtgcacaacaaaagttcattagtgcccatttcatgttctggaaagataaaa

SEQ ID NO: 57405 - DNA, 201 bp, Homo sapiens
catccacctttcctactctgagaagcacctttttttccattctcccatcaatggaggcagtttcatgtcctcagttgtaagagctgtcccaagctagcacytgggcttcatgtaacctcctcactcggcctccatctaatccctgaacccctcccccagccctgtatgccgcttttcagggcacaccctttctttctcctt

SEQ ID NO: 57406 - DNA, 201 bp, Homo sapiens
tgcgcccaccgtgaccctaagagaagaggcggacgccctggcacgtccttccctcctgcttcccccgcccaaagcgctcccggttcccggggcgtcaggtyggctgacagttcggggtccctgcgtcctgtctcctcagctgggcttcgaggatgtgatcgcagagccggtgactacgcactcctttgacaaagtgtggat

SEQ ID NO: 57407 - DNA, 201 bp, Homo sapiens
agttagtggtgaccaaagctaggaaaatatgcagtagtggaactttgaaccatgtcacaatattaaaacaggtcagattttagatcctttaaacaaacaawcaacaacaataaaacacagaagtctggtggtgttggatcctagaccagaagtacgggccattaggaatcagtgaattagttggattccatactacagtca

SEQ ID NO: 57408 - DNA, 201 bp, Homo sapiens; identical to SEQ ID NO: 16623

SEQ ID NO: 57409 - DNA, 201 bp, Homo sapiens
gtgaaactctgtctctactaaaaatacaaaaattagccaagcatagtagcaagtgcccatgatcccagctactcagggaggctgaggcaggagaatcactygaacccgggaggcgaaggttgcagtgagccgagatcacttcactgctctccagcctgggcaatagagtgagaacctgaaaagaaagaaggaagggaaggg

SEQ ID NO: 57410 - DNA, 201 bp, Homo sapiens
tagcatttctgtgatcaacccctcaataaattttagtgtacttgttgatatcatctcagaagtcatttttaattagatcagacctccattttaaaaaaccytatgaacagattccaaattctcctcacttttttttttttaacaaaagttttattggagatagaaccaccatgtacacagggaaaagagcacaaaaattca

SEQ ID NO: 57411 - DNA, 201 bp, Homo sapiens
tctccccactctccacattattgggagtgttagaaaatctgtagcaactattatgtagcataatatctttctagaatgaatatatgtgtgtgtaggtatayagtatacatataatatatggaaatgtgcatacatctacattttaatctatacatttatctgcatttatctatcatctatctacctatgtaatctaatctg

SEQ ID NO: 57412 - DNA, 201 bp, Homo sapiens
cagggtgtttgaacttatatttacaagagacattggtttgcaatttttcttcctcaaaattttcttgtcagatttctgatattgaggaaatgttggcttcrtaaaataaggaagataatgttctgtattgtggttgtttttataatcttttctcccttctctattctttttgtgctcacttagttctgtctttggagtgac

SEQ ID NO: 57413 - DNA, 201 bp, Homo sapiens
acatacgaaacacagtcaaaaattgactgtagccatcaaaaattgactgtaacctctctgagttcccccatgcctgcaagcctgagtaatttttgtctcarcatcttttccagtgccttctaacacatggtttctgtgtttattgagactttttagttgctattctgcaagctgctccattccacttgaagcgagtacata

SEQ ID NO: 57414 - DNA, 201 bp, Homo sapiens
taaaaatacaaaaagttagccaggcaaggtggcaagtgcctgtagtcccagctacttgggaggctgaggcaggagaatggcgtgaacccggaaggtggagyttgcagtgagcagagatcacactattgtactccagcctgggtgacagagtgagactctgtctcaaaaaaaaaataaaataaaaaaataaaggccatactg

SEQ ID NO: 57415 - DNA, 201 bp, Homo sapiens
ctcttacatgatgccacctctgaggtttggctgaattgctttgcagatcattagcaccattccctatgcccatgcgatttccctgctgatgaacatccccrttattgggccaggttagtggggctttggggagttgatccagtttttcaaactgaaaaagctagaatgtaggttaatttaattctgcctctagatacatca

SEQ ID NO: 57416 - DNA, 201 bp, Homo sapiens
tgtgtaatgatcaagttaggtgtttaggatatgcatcactttgagcatttatcatttctatattttgagaacagacctgtgttctagctatcttgaaataygcaatactttgacattaacacactgctatgttctctaatgacatccctggaaacctcctaggggcagccagatctttcatgatagtggttgtcagtcctc

SEQ ID NO: 57417 - DNA, 201 bp, Homo sapiens
tccctagttgtccattagctctgtattcagctttctttatattttccttcatctttacttgtgtattaatcatgttttttattttctatatttttatgaawtcttcaacatcttggggattttgtggtcctagaagggactgctgctcccaaagtcagacagttcctagagatagcaaatgtcttgtccacagcatgtctc

SEQ ID NO: 57418 - DNA, 201 bp, Homo sapiens
gtgaagtgcatggcatagagctgatactccataaatatttgttgagtgaagggtgcctagtaaaataagatattaagtagataggaagtgtattcattttygtttttctgtgtatccagccatccttccagtcattctgccttcgatccatccatctatttaatcatttatcaaatagttactgcatactctttgtgactg

SEQ ID NO: 57419 - DNA, 201 bp, Homo sapiens
accacaccaaatatccaacaatgatagattggattaagaaaatatggcacatatacaccatggaatactatgcagccataaaaaatgatgagttcatgtcstttgtaaggacatggatgaagctggaaaccataattctcagcaaactatcgcaaggacaaaaaaccaaacactgcatgttctcacttataggtgggaatt

SEQ ID NO: 57420 - DNA, 201 bp, Homo sapiens
aagacagttatgcagccaaaggacacatgaaaaaatgctcatcatcactggccatcagagaaatgcaaatcaaaccacaatgagataccatctcacaccarttagaatggtgatcattaaaaagtcaggaaacaacaggtgctggagaggatatggagaaataggtacagttttacactgttggtgggactgtaaactagt

SEQ ID NO: 57421 - DNA, 201 bp, Homo sapiens
aagcaatggggagaggattccctatttaataaatggtgctggtaaaactggctagccatatgtagaaagctgaaactggatgccttccttacaccttatakaacaattcaagatggattcaatacttaaatgttagacctaaaaccataaaaaccgtagaagaaaacctaggcaataccattcaggacagaggcatgggca

SEQ ID NO: 57422 - DNA, 201 bp, Homo sapiens
tccaagggatgtgaaggacctcttcaaggagaaccagaaaccactcctcaatgaaataaaagaggacacaaacaaatggaggaacatttcttgctcatggktaggaagaatcaatatcatgaagacggccatactgcccaaggtaatttatagattcaatgtcatttccatcaatctaccaatgactttctgcacagaatt

SEQ ID NO: 57423 - DNA, 201 bp, Homo sapiens
gaaaatctagaagaaaagaataaattcctcgacacatacaccctcccaaaaataaaccaggaagaagttgaatccctgaatagaccaataacaggctctgraattgaggcaatagttaataacttaccaaccaaaaaaagttcaggaccagatggactcacagctgaattctatcataggtacaaggaggagctggtacca

SEQ ID NO: 57424 - DNA, 201 bp, Homo sapiens
acaaacacctctatgcaaatacactagaaaatctagaagaaaagaataaattcctcgacacatacaccctcccaaaaataaaccaggaagaagttgaatcyctgaatagaccaataacaggctctgaaattgaggcaatagttaataacttaccaaccaaaaaaagttcaggaccagatggactcacagctgaattctatc

SEQ ID NO: 57425 - DNA, 201 bp, Homo sapiens
agagcaaacacattcaaaagctagcagaaggcaagaaataactaagatcagagcagaactgaaggagatagagatgcaaaaaacccttcaaaaaatcaatgaatccaggagctggtttttttaaaagatcaacaaaattgatagaccactagcaagactaataaagaagaaaagagaagaatcagttagatgcaataaaaa

SEQ ID NO: 57426 - DNA, 201 bp, Homo sapiens
aactcctgggctcaagcaattcttccacctcagcctcctaagtatatgggacaacaggtgcatgccaccatgcccaactaattttttttttttttttttttgtagagatagggtctttccaggttgcctaggctagtcttgaacttctgggctcaagcgatcctcccatcttggcctcccaaagtgctgggattacaggca

SEQ ID NO: 57427 - DNA, 201 bp, Homo sapiens
gggatcaattcaacaagaagagctaacgatcctaaatatatatgcacccaatacaggagcatccagattcataaagcaagtccttagagacctacgaagasacttagactcccacacaataataatgggagactttaacaccccactgtcaacattagacagatcaaggagacagaaggttaacaaggatatccaggaact

SEQ ID NO: 57428 - DNA, 201 bp, Homo sapiens
tgtatttcctgaatttgaatgttggcctgtcttgctaggttggggaagttctcctggatagtatcctgaagcgtgttttccaacttggttccattctcccygtcactttcagatacaccaatcaaacatatgtttggtcttttcacttagtcccatatttcctggaggctttgttcgctccttttcattcttttttctcta

SEQ ID NO: 57429 - DNA, 201 bp, Homo sapiens
catattggaggtggggccttgtgagaggtgattggatcatgggggtggatttttcatgaatagtttagtaccatcccttttggtactgtcctcatgatagsaagtgagttttcatgaaatctaaagtgtgtagcacctcccacctcccttttttgctttgacttttgccatgtgagtgaaagctcctgttttgccttctgc

SEQ ID NO: 57430 - DNA, 201 bp, Homo sapiens
atcttagcattgtggcattaacatctgggaaagatagatgatttctttattttacagatgagaaaagaaatgcctgaatatagagctggaattcaagcccrttagctggtggtttttcccaccaaacccccaaatccagtttctggcagtactttggtgactgcccaaaagcacacactcaatggaaatccaagtcccttg

SEQ ID NO: 57431 - DNA, 201 bp, Homo sapiens
taggataggggtgtttgctgcttcagcaaggtaattaaggttaagatgacaaaatgattggattttggggtgtatgaaccattaaaaaattacagttttgsctgtgctgagctagcatgtcctgaactctgtctaaaggataattgtgtgattatctcaactactcacggaagtatcttaactactctggtgtatgggtac

SEQ ID NO: 57432 - DNA, 201 bp, Homo sapiens
tgaaatggaaaatattcatccaagacaccagaccatggggaattttagaacatcagagttaaagggaaagtcataaaaacattcagagataaattaggtcmcctgtgaaggatcaggaatcagaatggcattagaattctcaagagcagctgtcatcttgtgtatttgtagataaagaatattttcagatctgcatttggc

SEQ ID NO: 57433 - DNA, 201 bp, Homo sapiens
aaggataattgtgtgattatctcaactactcacggaagtatcttaactactctggtgtatgggtacttatccataaaatgctgagttacattttatggtawctttgtacccctcccagttataaaagagtgattctatttctgaggcttcctgctaggagtagaaatagcagggaatggctttgtgatctatttcatgttg

SEQ ID NO: 57434 - DNA, 201 bp, Homo sapiens
caatattttttcttagggtcaatagttttatcttttacaagcaacttttttttttcttcaacttttatatttatctatgagcagattctggctctgcatarcatattagccacacacttgtttttctggggtcagaatcacactgaagtgatgataaacatattacaaatgagaattactcctgttaaagttggagtataa

SEQ ID NO: 57435 - DNA, 201 bp, Homo sapiens
actcaaacaaatttacaagaaaaaaaaaagatccccatcaaaaagtgggcaaaggatatgagcagacaattctcaaaagaagacatttatgcagccaaaaacacatgaaaaaatgctcatcatcactggccatcagagaaatgcaaatcaaaaccacaatgagatatcatctcacaccagttagaatggcgatcattaaaa

SEQ ID NO: 57436 - DNA, 201 bp, Homo sapiens
aaaatgctgagttacattttatggtatctttgtacccctcccagttataaaagagtgattctatttctgaggcttcctgctaggagtagaaatagcagggwatggctttgtgatctatttcatgttgttcaaatttccttaccctctgttcttatctgtaaaatgggaattaaagcaattcatggcattctatatttcaag

SEQ ID NO: 57437 - DNA, 201 bp, Homo sapiens
tctccttcatcctgtataggtggttaatgtccaaactctctgtcttcatgtctgtagtgtctcttcaatttctatattcttattcattcctgtgcttgttyactagatcaagttgactattacctcacatctggaatataataatggctggccccatcttgtcttgtcaatctgttctctttctccataatcttggatatg

SEQ ID NO: 57438 - DNA, 201 bp, Homo sapiens
ttcaaggctatggagaagaattaatgtacaaaaatgagataattgacatgaagctattttaatattctgaaaataatatatgagtatagaaaattatcatmtttgatcccttgttcagaattttctaacttaaatctttctatcagtatagaggactactttgtacgtataatcaaatgctcctcttacagagggagataa

SEQ ID NO: 57439 - DNA, 201 bp, Homo sapiens
tgtcatccccatcaagctaacaatgactttcttcacagaattggaaaaaactactttaaagttcatatggaaccaaaaaagagcccgcattgccaagtcartcctaagccaaaagaacaaagctggaggcatcacaccacctgacttcaaactatactacaaggctacagtaaccaaaacagcatggtactggtaccaaaa

SEQ ID NO: 57440 - DNA, 201 bp, Homo sapiens
acaccttttgctgaagagtgctttccccattgtatgttcttggcacctttgtcaaaaatcaattgattatagatgtgtgggcttatttcagggttctctaygcttttcctttaatcagtgtgtctatttttatgctaatgctatgcagttttgcttactatagctttgtaacatattttgcagttcagtggtgtgatgcct

SEQ ID NO: 57441 - DNA, 201 bp, Homo sapiens
tgttatttgtttgcctgcatcttgtggttcattgattagttctataacgattgcttaaatagtgaggcaagaaacacttcatgagcactttatgtacttaycatgtgtatagatctggatgaagcaccatggagaatttataattgaattgttaaacaattataatatgtgagcaccattgttaggtactaagaatttatc

SEQ ID NO: 57442 - DNA, 201 bp, Homo sapiens
aagaaacaaattatttgtactctccaccttctctactgctaggtcaattgttctgaggtctaattaatttaagaatctcattaaaatatggacactgccasaaaaatgacactatatgagttctccatttttgtacacatttaggggggtttccttaatgctatgaattgtctccattaattccaggttaaggagaattgt

SEQ ID NO: 57443 - DNA, 201 bp, Homo sapiens
catattttatatttccattcattagttgttggttttgattgtttctgttttggctgttatgaataatgctggtatggacatttgtgtacaagtttttgtgyatagataagtttttatttctcttgggtatatacttggctgcagaattgctggattatacagcaactgtatgcttaatctttggagaaaccgtggctggat

SEQ ID NO: 57444 - DNA, 201 bp, Homo sapiens
attatagtgtgaggtatgggtacaacttcattctttgcatgtgcattcagttgtcctagtaccatttgttgaaaagactattcattccccattgagtgatygtggtacatttgttgaaattcagttgactacaaacacgaggatttatttttagactctaaattctatttcattgatctatatagctttctttatgccagt

SEQ ID NO: 57445 - DNA, 201 bp, Homo sapiens
taattgtgtgattatctcaactactcacggaagtatcttaactactctggtgtatgggtacttatccataaaatgctgagttacattttatggtatctttktacccctcccagttataaaagagtgattctatttctgaggcttcctgctaggagtagaaatagcagggaatggctttgtgatctatttcatgttgttcaa

SEQ ID NO: 57446 - DNA, 201 bp, Homo sapiens
catgtgcattcagttgtcctagtaccatttgttgaaaagactattcattccccattgagtgatcgtggtacatttgttgaaattcagttgactacaaacaygaggatttatttttagactctaaattctatttcattgatctatatagctttctttatgccagtatgacagtactttttttttttgagacagggtctcgct

SEQ ID NO: 57447 - DNA, 201 bp, Homo sapiens
tgcctgtttacatttgttccatcaacctgaattttcccataccctttctgtctttagtctccccctctgctggtactacacacagttactttaactactcrttatatagaagatgttttctggttcctattttctcccttcctctatcaatcaattgtctacaagcttttcagacagatgttattttgcactgatgacctg

SEQ ID NO: 57448 - DNA, 201 bp, Homo sapiens
atggtgggtgacttttttttttcctgaaaaatgttttctaaaatttattttaatttatttttagattgatacataacttttatgcatatttatggggtacrtgtaatattttgttacatgcacagaatgtgtaatgatcaagttaggtgtttaggatatgcatcactttgagcatttatcatttctatattttgagaacag

SEQ ID NO: 57449 - DNA, 201 bp, Homo sapiens
ccctcccatgctaggcagacagaattatgcaacaccttctaccttcattcagaattagatatcaacacagtcaaaaaaaattttttttcaattttttttttattatactttaagttctgggatacatgtgcagaatgtgcagttttgttacataggtatacacgtgccatggtggttcgctgcacccatcaacctgtcacc

SEQ ID NO: 57450 - DNA, 201 bp, Homo sapiens
gggaggaggtcaatgtatctctggatctcgtgcaccacagcatctgtgtagggcatgtgactcctgtcctgcatacaggggctccggtttctgccaactakacattcaatctcttcctggactttagctgataagacacaagtaagaaatgatggaaaaggaggaaaatggcacatttgttgtagcaattcaggttacaag

SEQ ID NO: 57451 - DNA, 201 bp, Homo sapiens
gttctgtctttggagtgactcataaattttggttaagtgccagttatgatgtatgaaaaaatgcagaatgtcagatgaggttcatcttcttccagaaagggttcatccctcccatgctaggcagacagaattatgcaacaccttctaccttcattcagaattagatatcaacacagtcaaaaaaaattttttttcaatttt

SEQ ID NO: 57452 - DNA, 201 bp, Homo sapiens
gagtgaagggtgcctagtaaaataagatattaagtagataggaagtgtattcatttttgtttttctgtgtatccagccatccttccagtcattctgccttygatccatccatctatttaatcatttatcaaatagttactgcatactctttgtgactgttcatgacctaatgttcaaggaacaaatcccctatgtctctta

SEQ ID NO: 57453 - DNA, 201 bp, Homo sapiens
ggtaaagggatcaattcaacaagaagagctaacgatcctaaatatatatgcacccaatacaggagcatccagattcataaagcaagtccttagagacctaygaagagacttagactcccacacaataataatgggagactttaacaccccactgtcaacattagacagatcaaggagacagaaggttaacaaggatatcca

SEQ ID NO: 57454 - DNA, 201 bp, Homo sapiens
ggaaaggaacaaacagtaccagccactgcaaaaacataccaaattgtaaagaccatcgaggctgggaagaaactgcatcaactaacgagcaaaataaccarctaacatcataatgacaggatcaaattcacacataacaatattaaccttaaatgtaaatgggttaaatgctccaattaaaagacacagactggcaaattg

SEQ ID NO: 57455 - DNA, 201 bp, Homo sapiens
tgaaggacctcttcaaggagaactacaaaccactgctcactgaaataaaagaggacacaaacaaatggaagaacattccatgctcatgggtaggaagaatsaatatcatgaaaatggccataccacccaaggtaatttatagattcaatgtcatccccatcaagctaacaatgactttcttcacagaattggaaaaaacta

SEQ ID NO: 57456 - DNA, 201 bp, Homo sapiens
gccaatatcatactgaatggacaaaaactggaagcattccctttgaaaactggcacaagacaaggatgccctctctcaccactcccgttcaacatagtgtyggaagttctggacagggcaatcaggcaggagaaggaaataaagggcattcaattaggaaaagaggaagtcaaattttcgctgtttgcagataacatgatt

SEQ ID NO: 57457 - DNA, 201 bp, Homo sapiens
aatcaataaaagtaatccagtatataaacagaaccaaagacaaaaaccacatgattatctcaacagatgcagaaaaggcctttgacaaaattcaacaacccttcatgctaaaaactcaataaattaggtattgataggacgtatctcaaaataataagagctatctatgacaagcccacagccaatatcatactgaatgga

SEQ ID NO: 57458 - DNA, 201 bp, Homo sapiens
ttccctagttgtccattagctctgtattcagctttctttatattttccttcatctttacttgtgtattaatcatgttttttattttctatatttttatgaaatcttcaacatcttggggattttgtggtcctagaagggactgctgctcccaaagtcagacagttcctagagatagcaaatgtcttgtccacagcatgtct

SEQ ID NO: 57459 - DNA, 201 bp, Homo sapiens
gaaaactctgaagactcttccaaaagggcctctggaagggataaatgaccagtaaagtttcaggatacaaaataaatgcacaaaaatcaatagcatttttrtatatcaataatgttcaagctgagagccaaatcaagaacgcaatcccatttacaatagccacaaaatattaaatccctaggaatacatctaaccaaggaa

SEQ ID NO: 57460 - DNA, 201 bp, Homo sapiens
tttttagattgatacataacttttatgcatatttatggggtacgtgtaatattttgttacatgcacagaatgtgtaatgatcaagttaggtgtttaggatrtgcatcactttgagcatttatcatttctatattttgagaacagacctgtgttctagctatcttgaaatacgcaatactttgacattaacacactgctatg

SEQ ID NO: 57461 - DNA, 201 bp, Homo sapiens
ttaaattatgaaataattttttaggaaaagcacaatcaacagtctgaatttactgttgaaagcttgatagccactgtaactgatatgtttggggctggaayagagacaacgagcaccactctgagatatggactcctgctcctgctgaagtacccagaggtcacaggtatgatgataccataggtgagcagggtgattttc

SEQ ID NO: 57462 - DNA, 201 bp, Homo sapiens
ttgagtatttaaaaaatatatcttggccatttgtatgtctttttttgaaaaatgtctactcaaatcctttgcccatttaattaattaattaattaattaawagagacagggttttgctctgttgtaggatggagtgtagtgatgggatcatggtccctgcagccttgagctcctgggctcaagccatccttctaccttaga

SEQ ID NO: 57463 - DNA, 201 bp, Homo sapiens
agttcattcagtcccttgtcctaagcatctccattgcccttactctctccttcatcctgtataggtggttaatgtccaaactctctgtcttcatgtctgtmgtgtctcttcaatttctatattcttattcattcctgtgcttgtttactagatcaagttgactattacctcacatctggaatataataatggctggcccca

SEQ ID NO: 57464 - DNA, 201 bp, Homo sapiens
cattggaattttgatagggatttcaatgaaaccataaatttctttagatagtatggacattttaacaatatcaactcttccaatccatgcatatggtatcycttttttatttgtgtcttcttcatttttttaattaatattttatattttttggtgactttcacttttttggttaaatgtactcctaaatactttatttct

SEQ ID NO: 57465 - DNA, 201 bp, Homo sapiens
ctcctgcctcagcttccgacagtgctgggatttaaggcatgagccactgtgcccagtctaaattacctataattccttatacaatgtaaatgccatgtaartggttgttatactgtattttttagggaataatgacaagaaaaagaagtctgtacatgtccaatatgaacacttttttttttctgaattttattctttttt

SEQ ID NO: 57466 - DNA, 201 bp, Homo sapiens
tatttaagagactgtcccctttccattgcatattcttggtacctttgtctaaaatcaattgtagttgcatgggttcttttccagctctctgttatattctrttggttgatgtgtccatttttatgccagtaccatgctgttttaattactattaatttgtagtatagcttgaaatcaggtaatgtgatgcctccagctttc

SEQ ID NO: 57467 - DNA, 201 bp, Homo sapiens
ataatactggtactttttccagtggtctagagagagactcctgtatacttagtcctctctgctcccagaattggtaagttaagtagatagctgtggggaamcttagagttagggtgttaatgtgtggtctaaatcctcctttccacagggagaagctggatgttggggattcattctcaattgtatggtgtagtgcctggg

SEQ ID NO: 57468 - DNA, 201 bp, Homo sapiens
gagtgcagtggtgtgatctcggctcactgcaacctccgtctcctgggttcaagtgattcttatgcctcagccttccgagtagctgagattacaggcgcatkccatcacgcccggctaatttttgtgtttttagtagagatgagatttcaccatgttgcccaggctggtctcgaactcctgacctcaggtgactgcctgtct

SEQ ID NO: 57469 - DNA, 201 bp, Homo sapiens
ttacaatttagcatgtttttgcagtggctggtagcagtttttgctttccatgtttagtgcttccttctggtgctcttgtagggcaggcatggtggtgacaraatctctcagggtttgcttgtctgtaaaggattttatttctccttcacttatgaagtttagtttggctggatatgaaattctgggttgaaaattcttttc

SEQ ID NO: 57470 - DNA, 201 bp, Homo sapiens
attatgatgttagctggttattttgctcattagtttatgcagtttcttcctagcatcaatggtctttacaatttagcatgtttttgcagtggctggtagcrgtttttgctttccatgtttagtgcttccttctggtgctcttgtagggcaggcatggtggtgacagaatctctcagggtttgcttgtctgtaaaggatttt

SEQ ID NO: 57471 - DNA, 201 bp, Homo sapiens
aacatttcaagtggtaaggtagaatcaaaatgataaaggcctgctgctttctttgcttcacagtcatttgctatatttttttgcctgaaggaaaatggtartggaagtgttttgtgattaaagattttgagaagtcagtcactgtatatgctatgtattttgcttagattagccatgatcattaaacgtcttaaaaaagca

SEQ ID NO: 57472 - DNA, 201 bp, Homo sapiens
tgctatgttctctaatgacatccctggaaacctcctaggggcagccagatctttcatgatagtggttgtcagtcctcatatggagggtggaggtttgaagsagagagccaagggaggttttgtgcacctatgcttgttgtgtttgtacacaatgactatgcatacgctgtgagtataaaaggctcatttaatcctattgtg

SEQ ID NO: 57473 - DNA, 201 bp, Homo sapiens
atcccagagcccacagaaattgttcaaactatctattcccaggcttactcagtctaccctccctatctcactcatttcttcctgtgaaaaccccaatgaargctcagccccatggtttctttttgctcttgctgcctcctgaccaaccctggtacttccccatgtggctccccgcactccatggtgtggagtgcccctcct

SEQ ID NO: 57474 - DNA, 201 bp, Homo sapiens
gacagtttgttataatttctgtttttttacatttgctgaggagtgctttaattccaactatgtggtcagttttggaatacgtgcgatatggtgctgagaasaatgtaaattctgttgatttggggtggagagttctgtagatgtctattagatctgcttggtgcagagctgagttcaattcctggatatccttgttaactt

SEQ ID NO: 57475 - DNA, 201 bp, Homo sapiens; identical to SEQ ID NO: 16638

SEQ ID NO: 57476 - DNA, 201 bp, Homo sapiens
tagtttagtaccatcccttttggtactgtcctcatgatagcaagtgagttttcatgaaatctaaagtgtgtagcacctcccacctcccttttttgctttgrcttttgccatgtgagtgaaagctcctgttttgccttctgccgtgattgcatcacgcttcctgtacagcctgcagaactaggagccaattaaacctctttt

SEQ ID NO: 57477 - DNA, 201 bp, Homo sapiens
cagactgggaacagaatgtgaagagtcaggtcaagccatttggcctttatcccataggacagatgggtgttgtttaaagttgtaaaatgagagactgacakgtttagacatgtacttttgaaagtacactaggaaaaaaaatctttggctaaacattgtgccagaagtacaaaggggaacacactatatgagccttctctt

SEQ ID NO: 57478 - DNA, 201 bp, Homo sapiens
tcatgactaagtcctcaaaagcaatcacaatgaaaaaaaattgatatgttacttaaaattgataatttagttacaaattaaactaaagagcttctgcatawcaaaagtaactattaacaaagtaaacagacaacctacagaatgggaggaaatatttgcaaactatgcatctgacaaaggtctaatatcctataaggtaat

SEQ ID NO: 57479 - DNA, 201 bp, Homo sapiens
cattaagtagttctgatttttaaaaaacaaaaacaaaattttctgcttctcctcccttcaaagcttcaaggaaatagaaacaaggaaacaaaacaaaaacraaaaaaaccagtgatggtaaagagaagccttttgcttgaattatcaattcgaaaaacagtaattttgccattttgtatatataaacaatcttgggacatt

SEQ ID NO: 57480 - DNA, 201 bp, Homo sapiens
gagggcaaccaaatagctgtattcgcttgtcagctgagctcatataaagaagtcagtgaggagctgagaaaatataggcaatggctgctcaataagaattwtaagttccgaataccacatataggtagacaccagtgtgcaagttgatgcaactagaaagaaacagatgactttttaaaatacctggccacaggtctttga

SEQ ID NO: 57481 - DNA, 201 bp, Homo sapiens
ctctatctaaaagttgcttacgagtaacttgaatcttgtgtaatagtctgcatctcacagaccatcatggatgagttagaacactgttgttgatggtccartatgaagagagggcaaccaaatagctgtattcgcttgtcagctgagctcatataaagaagtcagtgaggagctgagaaaatataggcaatggctgctcaa

SEQ ID NO: 57482 - DNA, 201 bp, Homo sapiens
ttcttcctatccgtaagcatggaatgttcttccatttgtttgtgtcctcttttatttcattgagcagtggtttgtagttcttcttgaagaggtccttcatrtcccttggaagttggattcctgggtattttattctctttgaagcaattgtgaatgggagttcactcatgatttggcactctgtttgtctgttattggtgt

SEQ ID NO: 57483 - DNA, 201 bp, Homo sapiens
agacatgaagtccttgcccatgcctatgtcctgaatggtattgcctaggttttcttctagggtttttatggttttagatctgacatttatgtctttaatcmatgttgaattaatttttgtataagatgtaaggaagggatccagtttcagctttctacatatggctagccagttttcccagtaccatttattaaataggga

SEQ ID NO: 57484 - DNA, 201 bp, Homo sapiens
tgttctgcttctttagtattttttttttgtggctattctcaggtgtttacatttccaagtaagtgttgaaagtatcattttgtcaatttcccaaaacactrtgctgggatttttatcatgatgacattaaatctttagatcaatttagaaataattgatgtcctgacaggttgaatctttcaattcatggatatgattatg

SEQ ID NO: 57485 - DNA, 201 bp, Homo sapiens
ttcaattcatggatatgattatgctctttatttatttgggctttcttctattgtgtcagtaatgttttgtcttcagttcagtggctttctcatgtattacrttttttttctgaaatgatatttctatgtaattgtaagttgtgtatttaatatataatataaaatatatataatatgaaataaatatatataatattaaaa

SEQ ID NO: 57486 - DNA, 201 bp, Homo sapiens
ttgtcctgtctatagatataatatatatattagttaaaatacacacaaatgtgcacacagagacatacacagctgggttttatttgctatgattttcaggrtgtttgaacttatatttacaagagacattggtttgcaatttttcttcctcaaaattttcttgtcagatttctgatattgaggaaatgttggcttcgtaaa

SEQ ID NO: 57487 - DNA, 201 bp, Homo sapiens
tgtccttattgttcaactcccacttataagtgagaacatgcggtgtttggttttctgatcttgtgatagtttgctgagaatgatggtttccagcttcatcmatgtccctgcaaaggacatgaagtcatcattttttatggttgcatagtattccatggtgtatatgtgtcatattttcttaatctagtctatcattgatgg

SEQ ID NO: 57488 - DNA, 201 bp, Homo sapiens
ccctagttgtccattagctctgtattcagctttctttatattttccttcatctttacttgtgtattaatcatgttttttattttctatatttttatgaaakcttcaacatcttggggattttgtggtcctagaagggactgctgctcccaaagtcagacagttcctagagatagcaaatgtcttgtccacagcatgtctct

SEQ ID NO: 57489 - DNA, 201 bp, Homo sapiens
tttggttttctgatcttgtgatagtttgctgagaatgatggtttccagcttcatcaatgtccctgcaaaggacatgaagtcatcattttttatggttgcayagtattccatggtgtatatgtgtcatattttcttaatctagtctatcattgatggacatttgggttggttccaagtctttgctattgtgaatagtgccac

SEQ ID NO: 57490 - DNA, 201 bp, Homo sapiens
catgcacagaatgtgtaatgatcaagttaggtgtttaggatatgcatcactttgagcatttatcatttctatattttgagaacagacctgtgttctagctrtcttgaaatacgcaatactttgacattaacacactgctatgttctctaatgacatccctggaaacctcctaggggcagccagatctttcatgatagtggt

SEQ ID NO: 57491 - DNA, 201 bp, Homo sapiens
gtccctgcaaaggacatgaagtcatcattttttatggttgcatagtattccatggtgtatatgtgtcatattttcttaatctagtctatcattgatggacwtttgggttggttccaagtctttgctattgtgaatagtgccacaataaacatacgaaacacagtcaaaaattgactgtagccatcaaaaattgactgtaac

SEQ ID NO: 57492 - DNA, 201 bp, Homo sapiens
ttctattgattggaatagtttcagaaggaatggtaccacctcctccttgtacctctggtagaatttggctgtgaatccatctggtcctggactttttttttgttggtaggctcttaattattgcctgaatttcagagcctgtgattggtctattcagggattcagcttcttcctggtttagtcttgggagagtgtatgtgt

SEQ ID NO: 57493 - DNA, 201 bp, Homo sapiens
aaaagtttataataacataaggtatttttttgatggctagatagaacaataaccgaggattctataagaggtcaggctttgttcaaataaattgaagataktgcctggtgataatagacaccatttcttagagcaggaaattccttttttttctttgaatattgaaataaggaaataaaaggactccatctgtcaatttaa

SEQ ID NO: 57494 - DNA, 201 bp, Homo sapiens
ttacttttattttaggcaaaccaatctatcttcttatttgtgttaatttgtgttagattttttcttgtataacatagatgacttttgcctgtttacatttrttccatcaacctgaattttcccataccctttctgtctttagtctccccctctgctggtactacacacagttactttaactactcattatatagaagatgt

SEQ ID NO: 57495 - DNA, 201 bp, Homo sapiens
acatatatgtgcatgcatgtctgtgtgtatatagtttttaattttaattttaattttaaaagaagtatagaaatttaatatgtttttcttccaatgttatkttttctcatatttttttctttttttaattatactttaagttctagggtacatgtgcacaatgtgcaggtttgttacatatgtatacatgtgccatgtagg

SEQ ID NO: 57496 - DNA, 201 bp, Homo sapiens
tcagacagtccaatttttttaattttttaaaattatactttaagttctgggatatgtgtgcagaatgggcaggtttgtcacatgggtatacatgtgccatrgtggtttgctgcacccattaacccgtcatctatattaggtatttctcctaatgctatccctccctttacccccaatcacccaacaggccctggtgtgtga

SEQ ID NO: 57497 - DNA, 201 bp, Homo sapiens
gtttccattccagtttgggcctatgaaggtttataacaggtctcagtatctagcagtgtatgtcttccaaatttgttctgcttctttagtattttttttttgtggctattctcaggtgtttacatttccaagtaagtgttgaaagtatcattttgtcaatttcccaaaacactgtgctgggatttttatcatgatgacatt

SEQ ID NO: 57498 - DNA, 201 bp, Homo sapiens
tgctcttgtagggcaggcatggtggtgacagaatctctcagggtttgcttgtctgtaaaggattttatttctccttcacttatgaagtttagtttggctgkatatgaaattctgggttgaaaattcttttctttaagaatgttgaatatcggcccccactctcttctggcttgtattgcccagatcaatgtcctgtagttt

SEQ ID NO: 57499 - DNA, 201 bp, Homo sapiens
catactctttgtgactgttcatgacctaatgttcaaggaacaaatcccctatgtctcttattttcaggaaaacggatgtgtatgggagagggcctggccckcatggagctgtttttattcctgaccaccattttgcagaactttaacctgaaatctcaggttgacccaaaggatattgacatcacccccattgccaatgca

SEQ ID NO: 57500 - DNA, 201 bp, Homo sapiens
cctaaatatatctgctattctccatactctgtatcacttgtattgaccaccacatatgctaatacctatctactgctgagttgtcagtatgttatcactakaaaacaaagaaaaatgattaataaatgacaattcagagccatttattctctgcatgctctagataaaaatgattattatttactgggtcagttcttagat

SEQ ID NO: 57501 - DNA, 201 bp, Homo sapiens; identical to SEQ ID NO: 16635

SEQ ID NO: 57502 - DNA, 201 bp, Homo sapiens
tctattgataaaagagattggactaggtgatttccatcacttcttcccactctttgacttctttataacttagtttgtctgttttgctattttcagggcaygaccataataacatccctgacttctgtgctgcacaatgacaaagaattccccaacccagagatgtttgaccctggccactttctggataagagtggcaac

SEQ ID NO: 57503 - DNA, 201 bp, Homo sapiens
acaaaaaataaaaaaattagctgggtgtagtggcatgtgcctgtagtcccagctacttgggaggctgaagtgggaggattgctggtgtccaagaggttgasgctgctgtgagctatggtcgtaccactgtactccagcctgggtgacagagcaaggccctgtctcaaaaaaaacaaaaaaaaaagaggaaagaaaagaaat

SEQ ID NO: 57504 - DNA, 201 bp, Homo sapiens
agattcagctacccaggcccaagatggcccccgcgaatgacacatatgaaagcatcttcagtcacttccgagagtatgagattgccattcgcaaggtgccrggaaacttcacggtatggggttccccaaggccccagggccagaactcccttggcttccctgtcccctgggctggaagcacccttgtgtgccattgggaac

SEQ ID NO: 57505 - DNA, 201 bp, Homo sapiens; identical to SEQ ID NO: 16644

SEQ ID NO: 57506 - DNA, 201 bp, Homo sapiens
caaatgatacatttgtggcaagccagtctccaaaactcagcttgcaaagattgggcagcattttccaaacctcggcctggtctctggcctggagttcaggycgcattgaagattgcccaccatagcctccatagctggcactattgcatgatggctgagggatcagctgggaaggaaccagctccgtctgcaaggcagggg

SEQ ID NO: 57507 - DNA, 201 bp, Homo sapiens
tccatttagtgactctgacagttggcagtgtgaacctagagatccacaatggcttcatcctcgggaagattcagctacccaggcccaagatggcccccgcraatgacacatatgaaagcatcttcagtcacttccgagagtatgagattgccattcgcaaggtgccgggaaacttcacggtatggggttccccaaggcccc

SEQ ID NO: 57508 - DNA, 201 bp, Homo sapiens
gacagttggcagtgtgaacctagagatccacaatggcttcatcctcgggaagattcagctacccaggcccaagatggcccccgcgaatgacacatatgaargcatcttcagtcacttccgagagtatgagattgccattcgcaaggtgccgggaaacttcacggtatggggttccccaaggccccagggccagaactccct

SEQ ID NO: 57509 - DNA, 201 bp, Homo sapiens
tgtccatcatattccattggttgatgcatctgattttagggtatatgtatttttaatgtgctccccaagaagtccttacattctgctgcattgacaaaccygtggccaagttttaggcctaggttctaattaagcttaattctggaggcaaagtctcggcggggacacccaggccctcctcagccctcaagtctcatggta

SEQ ID NO: 57510 - DNA, 201 bp, Homo sapiens
aagagactgttcttttcccattgtgtgttcttggcccctttgttgaaaatcaattgtgggtttatttctgggctgtccatcatattccattggttgatgcrtctgattttagggtatatgtatttttaatgtgctccccaagaagtccttacattctgctgcattgacaaacccgtggccaagttttaggcctaggttcta

SEQ ID NO: 57511 - DNA, 201 bp, Homo sapiens
ggtcatttgtatgtcttcttttaactgtctattcaagtcctttacccattttaaaaacaggtttatttgttttcttgttattaagtagtatgagttccttrtatattttggatatgaaccccttattcaatgaacatttgtaaatattttccacccattcatagattgtgtcttcactctagtggttgtttcttttgctgt

SEQ ID NO: 57512 - DNA, 201 bp, Homo sapiens
agtcttgctctgtcacccaggctgcagtgcaatgtcttgatctcatctcacttcaacctccgcctcccgagttcaagagattctcttgcttcagcctcctkagtagctgggattacaggcacgtgccaccatgcccggctaatttttgtatttttaatagagatggggtttcaccatgttggccaggctggtctcggactc

SEQ ID NO: 57513 - DNA, 201 bp, Homo sapiens
ctgctctcagcatggggagggagactgggagggcctggtgcaatccaaaacgcgtgcacctgggatgctggtgccagccactgtgttaggtgctgcttcayatagctctgcatccttaataggagagaggtcctactgtcctcattttagagatgagggaactgaggctcagtattagcaacttcctagggttgcacagct

SEQ ID NO: 57514 - DNA, 201 bp, Homo sapiens; identical to SEQ ID NO: 16652

SEQ ID NO: 57515 - DNA, 201 bp, Homo sapiens; identical to SEQ ID NO: 16654

SEQ ID NO: 57516 - DNA, 201 bp, Homo sapiens; identical to SEQ ID NO: 16640

SEQ ID NO: 57517 - DNA, 201 bp, Homo sapiens; identical to SEQ ID NO: 16643

SEQ ID NO: 57518 - DNA, 201 bp, Homo sapiens
gatttcatgggaccagagtcctatgtccagaatcaccgtgccccatggtgacaggccacaaacacatctctctgggcctgcagatttcaccgtgaccaacrtcatcatcttctttgcctttgtcctgctgctctccggagccctcgcctactgcctggccctccagctgtatgtgcggcgccgaaagaagctacccagtgt

SEQ ID NO: 57519 - DNA, 201 bp, Homo sapiens
ccagaagtgctggtcctcgggctgctgccagagtgggccagaggagagaggacactggggggcggtggggatgctgcgccactggagaggggatgctggcrggggacagggaggggctcatggaggaggccaagccctcctcccctcccagggtgtgtcctcttgctacattgtactgacaaatgatacatttgtggcaag

SEQ ID NO: 57520 - DNA, 201 bp, Homo sapiens
ctgatcacagagagcacagggcagtgatttagggagacacactagctctagaatcagacacatgtggattcatgtgcccactctgccccttacgggctccrctggcctcgggcgagtcatagcctctctgaacctccctttcttctttggtaaaattggggtcatcaatgcctgccccccctcccagctgtggtactgaca

SEQ ID NO: 57521 - DNA, 201 bp, Homo sapiens
ccagccctccgtctgtgtggtttgaagcagaatttttccaccacatcctccactggacacccatcccaaatcagtctgaaagtacctgctatgaagtggcrctcctgaggtgaggaaaagggaagagggagggggagggaggagtgaatccccgccttgtcctctactctcctagcatgggaagatacctgccttgttaat

SEQ ID NO: 57522 - DNA, 201 bp, Homo sapiens; identical to SEQ ID NO: 16649

SEQ ID NO: 57523 - DNA, 201 bp, Homo sapiens
tggaaggggaatctccagagcgatcctgggatctctagggaaaacaagacgagagacaagtgcagtggcacaatctcagctcacttgcagcctcaccctcycaggttccagtgattctcctgccttagcctcccgagtagctgggattacaggcatctgccaccatgcctggctaatttttgtatttttagtagagacggg

SEQ ID NO: 57524 - DNA, 201 bp, Homo sapiens
cagccctccgtctgtgtggtttgaagcagaatttttccaccacatcctccactggacacccatcccaaatcagtctgaaagtacctgctatgaagtggcgstcctgaggtgaggaaaagggaagagggagggggagggaggagtgaatccccgccttgtcctctactctcctagcatgggaagatacctgccttgttaatg

SEQ ID NO: 57525 - DNA, 201 bp, Homo sapiens
gtactgctttaggcaaggtattcaggaaggctttgctgaagaagtgacatctgagctgagacctaagccatgtacaggacacagccatataaagtgccgaragcatttcaagcaggagggagagtgtgtgcaaaggccctgaggcagcacggtgcttgatgtgttctgggacagaaagaacaccagtgtggctagggcaga

SEQ ID NO: 57526 - DNA, 201 bp, Homo sapiens; identical to SEQ ID NO: 16656

SEQ ID NO: 57527 - DNA, 201 bp, Homo sapiens; identical to SEQ ID NO: 16655

SEQ ID NO: 57528 - DNA, 201 bp, Homo sapiens
gctccccaagaagtccttacattctgctgcattgacaaacccgtggccaagttttaggcctaggttctaattaagcttaattctggaggcaaagtctcggsggggacacccaggccctcctcagccctcaagtctcatggtattcccccccaccccaactccatttagtgactctgacagttggcagtgtgaacctagaga

SEQ ID NO: 57529 - DNA, 201 bp, Homo sapiens
tggttgatgcatctgattttagggtatatgtatttttaatgtgctccccaagaagtccttacattctgctgcattgacaaacccgtggccaagttttaggyctaggttctaattaagcttaattctggaggcaaagtctcggcggggacacccaggccctcctcagccctcaagtctcatggtattcccccccaccccaac

SEQ ID NO: 57530 - DNA, 201 bp, Homo sapiens
ggcaccagaacttattcctcctgtctcactgtaacttggtacccctctccttgttccctatccacttctcccacctgcctccttccagcttctggtaaccrcttctactctctacttctatgaattgaattctaaaagaattctacttagattctatacataagtgagatcttatggcatttatctctttgcacctggctt

SEQ ID NO: 57531 - DNA, 201 bp, Homo sapiens
ccatttcataagtgaggaaactgaggcacagagagattgttacacacagagggccacacagccaggaagagtcagggagggaacccactttcctactgctrttagccatgggtgttccacaagagagaaagaaggaaaggccagaagtgctggtcctcgggctgctgccagagtgggccagaggagagaggacactggggg

SEQ ID NO: 57532 - DNA, 201 bp, Homo sapiens
ctttggagaatgttagataaaaatagcccaagttgtttgagatttaaaagggaactggagttgtttatcctacagaagagaggtcttggggtgggttgggrcagctgagtcaccaggtccaggcctgtgaacttgttttttcagggagggttcagggagaggaagcgaatccatgaacactcagcatagggcagcaagcag

SEQ ID NO: 57533 - DNA, 201 bp, Homo sapiens
tcgccagagctgctaaagtcagcaaatactgctccaggctgtcagtcaggtgccggggctgtagggggagggagataatagaggacatggaggccacggtyttgcctaggaggatcttgcatcctggctggggagatagagtgtgcacagaggagactgtaacaagcaactcttattggacagcagatgagatgtccagtg

SEQ ID NO: 57534 - DNA, 201 bp, Homo sapiens
cagcctcctaacctctggagaagtgggagagttctgtgtccaggtgaaaccatctgtcgcttcccgaagtaacaaggggatgtggtctaaagaggagtgcrtctccctcaccaggcagtgtgagtcagctgggctgctctcagcatggggagggagactgggagggcctggtgcaatccaaaacgcgtgcacctgggatgc

SEQ ID NO: 57535 - DNA, 201 bp, Homo sapiens
ccatctccaactgtagccagaccctgtcctatgaccttaccgcagtgaccttggacctgtaccacagcaatggctaccgggccagagtgcgggctgtggayggcagccggcactccaactggaccgtcaccaacacccgcttctctgtggatgaaggtgcttttcctcccttgacttagaacatggctctgaagtcccttc

SEQ ID NO: 57536 - DNA, 201 bp, Homo sapiens
gtgactcctgcttctctcactctgccctctcttccccagctcttcaagaagcccagccccttcatcttcatcagccagcgtccctccccagagacccaagrcaccatccacccgcttgatgaggaggcctttttgaaggtgtccccagagctgaagaacttggacctgcacggcagcacagacagtggctttggcagcacc

SEQ ID NO: 57537 - DNA, 201 bp, Homo sapiens
gtagtgggaattgctggatcacatggtagctctatttttagattttcgaggaacatccatactgttttccataatggctgagaaattcaccaccagcgacrtgcaagggtttcccttttcaccacatccttgccaatgcttgttacttccatcttttggataatagccaatctaacaggtgtggagtggtatctcattgtg

SEQ ID NO: 57538 - DNA, 201 bp, Homo sapiens
cggtataagaaagaaagcaagagacagatgacagagtcctcccccccaaaaaataaataaaaaacaggtgcatgattagagagatgtagagaagttagaamactagggagcgggagcagagtcgctgtcaaatggagagaacttagaggatcaaggaggagagaaagggaaccaaccagccgttggccttgcacatacttc

SEQ ID NO: 57539 - DNA, 201 bp, Homo sapiens; identical to SEQ ID NO: 16686

SEQ ID NO: 57540 - DNA, 201 bp, Homo sapiens; identical to SEQ ID NO: 16658

SEQ ID NO: 57541 - DNA, 201 bp, Homo sapiens
tgaaaagcttcatgctgtgttttccagtgttcctggcaaggcaaaatatttacctgtggatttatttttgctgagtgcaaggggtctgtaggcacttatgkagttgtaaagtcacatgaagctttaaggtttataatcaaatactttttataacttttctccaaaattttaccctcccaaaagaataaaatatatttcaat

SEQ ID NO: 57542 - DNA, 201 bp, Homo sapiens
taaagaaatcaaatgttaggcacgaagacaggccctaggtgaacttgagtgtaagtcactgacccttacctgctgagagtcccagcgtccctgccaggtakctgtcttcttcacaaatgtatgtgatgcaaatttggcatgcctgtgcccctttcggaataacggagtcaatcaaagctcgagtcttatccataactgtag

SEQ ID NO: 57543 - DNA, 201 bp, Homo sapiens
gttgcctccttgtattttctttgagtaagatcacctggttgcctgttaccaggctgtgggtcatgctgtgaggcctggaaatcctccacttgcaaccctcytcaggcccaatacagggctcaggaactgagctggccaaatctcatgaccacttggacctaccacgtggtgaggatgagagttctggtggattcccagtca

SEQ ID NO: 57544 - DNA, 201 bp, Homo sapiens
cattgaacagaggctaggaggaaaacatcttctcagccattggtagtagtaacaaatcaaactgtgtctttccagacagccctggtgtggtgtggtttaargattcagtaggagtttctggaaacctatctttaccaactacagaagagtttgaggatgatgctattaagaaagcccacatagagaaggattttatcgctt

SEQ ID NO: 57545 - DNA, 201 bp, Homo sapiens
ctttgattgactccgttattccgaaaggggcacaggcatgccaaatttgcatcacatacatttgtgaagaagacagttacctggcagggacgctgggactytcagcaggtaagggtcagtgacttacactcaagttcacctagggcctgtcttcgtgcctaacatttgatttctttactagtcatgttaattggaagaaaa

SEQ ID NO: 57546 - DNA, 201 bp, Homo sapiens
aaagtggaacaaacagggatgccactgttcatgatgttctttgtctcttgcagctcctcaggcagtgcaggacaacccagctatgcccacatcctcaggcycagaagggaatgtcaagctttgctccctagaagaagctcaaaggatatggaaacaaaagtcggcagaggtgccatgctcagaacccaaggatagagtggg

SEQ ID NO: 57547 - DNA, 201 bp, Homo sapiens
ctctcaaggagtactttcttcctttccaggtaatgctgtttttaaaggaagagcattctttgacccacatcttccttgacattaattttgtaggatcaaaygtgggtaaatgggctatggagaattctcatagattggtcatataattttctttttgtaatctattctgcttttgtagaaactgtttccacagcttcatta

SEQ ID NO: 57548 - DNA, 201 bp, Homo sapiens
cacaaagtggaacaaacagggatgccactgttcatgatgttctttgtctcttgcagctcctcaggcagtgcaggacaacccagctatgcccacatcctcargctcagaagggaatgtcaagctttgctccctagaagaagctcaaaggatatggaaacaaaagtcggcagaggtgccatgctcagaacccaaggatagagt

SEQ ID NO: 57549 - DNA, 201 bp, Homo sapiens
ctacaaaatctggggtacagcgtagatgtgaaaaaaaatctcactgcttcggtaagttctattatacaacagaaacaatggttatgcccttcgtataactraataatattagaaagcttggttgtaagaccaagaaatgtaatctcttgataatctaaaatacaaacttgccatgagagagtgctggatactacatggtcc

SEQ ID NO: 57550 - DNA, 201 bp, Homo sapiens
taacttaattcagttacttttctaagcaaggtttaaataaaaattatttaaatcctttcattcaccacctttggcagtttcctgagaggacttgcattctyttggtcacctctggcccaaaggccctgtctctgctcaaatagttaagttttctaaaatattttctaaaatgagatatcttctttcagaagaagcttggtt

SEQ ID NO: 57551 - DNA, 201 bp, Homo sapiens
acaaacacaaagtggaacaaacagggatgccactgttcatgatgttctttgtctcttgcagctcctcaggcagtgcaggacaacccagctatgcccacatsctcaggctcagaagggaatgtcaagctttgctccctagaagaagctcaaaggatatggaaacaaaagtcggcagaggtgccatgctcagaacccaaggat

SEQ ID NO: 57552 - DNA, 201 bp, Homo sapiens
gcacaggcatgccaaatttgcatcacatacatttgtgaagaagacagttacctggcagggacgctgggactctcagcaggtaagggtcagtgacttacacycaagttcacctagggcctgtcttcgtgcctaacatttgatttctttactagtcatgttaattggaagaaaactttcttatttctggcttcagggccatat

SEQ ID NO: 57553 - DNA, 201 bp, Homo sapiens; identical to SEQ ID NO: 16699

SEQ ID NO: 57554 - DNA, 201 bp, Homo sapiens
agtcggcagaggtgccatgctcagaacccaaggatagagtggggtgaaagaaacacttcaggcagttctgaaatgcagtggcttattcttagagccaaccycattgagcagttctggagaatcatacttctgctccccttacataaaggatttctatatcctagaatcccaggtttatagaaagaggtccaaattggatcc

SEQ ID NO: 57555 - DNA, 201 bp, Homo sapiens; identical to SEQ ID NO: 16700

SEQ ID NO: 57556 - DNA, 201 bp, Homo sapiens
attcctagaagaactggagctgaggttgacatcacaggcatgacaatgctgctacaaaatctggggtacagcgtagatgtgaaaaaaaatctcactgcttyggtaagttctattatacaacagaaacaatggttatgcccttcgtataactgaataatattagaaagcttggttgtaagaccaagaaatgtaatctcttga

SEQ ID NO: 57557 - DNA, 201 bp, Homo sapiens; identical to SEQ ID NO: 16701

SEQ ID NO: 57558 - DNA, 201 bp, Homo sapiens
tattatacaacagaaacaatggttatgcccttcgtataactgaataatattagaaagcttggttgtaagaccaagaaatgtaatctcttgataatctaaartacaaacttgccatgagagagtgctggatactacatggtcctttgtaacataagagtcatgcagcacaagcctggtataactgaattgggaaatgtttta

SEQ ID NO: 57559 - DNA, 201 bp, Homo sapiens
caaaatatttacctgtggatttatttttgctgagtgcaaggggtctgtaggcacttatgtagttgtaaagtcacatgaagctttaaggtttataatcaaayactttttataacttttctccaaaattttaccctcccaaaagaataaaatatatttcaatgatggcgatacactcagagaacacattgaacgtatagaaaa

SEQ ID NO: 57560 - DNA, 201 bp, Homo sapiens
agctcagctgccatctgggcatttgcaatgtccatgcatactcttgaagcagcattcaattctgttcccccttttcaatgtatggttcatggggtttggtrtcttgataggactaaggaaggggaagctgtcataaaccaggaagggaaatatttaattggaaagaacaaggctgttcattcaaattgcatttcctacaga

SEQ ID NO: 57561 - DNA, 201 bp, Homo sapiens; identical to SEQ ID NO: 16703

SEQ ID NO: 57562 - DNA, 201 bp, Homo sapiens; identical to SEQ ID NO: 16704

SEQ ID NO: 57563 - DNA, 201 bp, Homo sapiens; identical to SEQ ID NO: 16705

SEQ ID NO: 57564 - DNA, 201 bp, Homo sapiens
ccacaccaggtaacaggtttctacacaggacatctttgttggggctatcaatagaaaaagtgacaataacccactagaggtggtgattaacaactcaagaycaactcaagctttgttccaagttatacacagaattccctttatccaagagagcaattttgcatatctgttcaatgcattactaattaaagaattcatcta

SEQ ID NO: 57565 - DNA, 201 bp, Homo sapiens; identical to SEQ ID NO: 16706

SEQ ID NO: 57566 - DNA, 201 bp, Homo sapiens
tttccagacagccctggtgtggtgtggtttaaagattcagtaggagtttctggaaacctatctttaccaactacagaagagtttgaggatgatgctattargaaagcccacatagagaaggattttatcgctttctgctcttccacaccaggtaacaggtttctacacaggacatctttgttggggctatcaatagaaaaa

SEQ ID NO: 57567 - DNA, 201 bp, Homo sapiens
tcccctgtatagctagctgagtctattaaatatcagaatgcataattaacttaaatcacagtcagtaataccactttgggaatgcacatttagatatttcrtttccaaatcccaatcactcccctctaccccattccgccttttccttatttgctactaaatttatgatttcaaacatccctcagctggagtataaatact

SEQ ID NO: 57568 - DNA, 201 bp, Homo sapiens
attcaccacctttggcagtttcctgagaggacttgcattctcttggtcacctctggcccaaaggccctgtctctgctcaaatagttaagttttctaaaatrttttctaaaatgagatatcttctttcagaagaagcttggttctacattgggttgaacatgccctgatgtagaactcaataatttttttttcccaatgatc

SEQ ID NO: 57569 - DNA, 201 bp, Homo sapiens
gaacagcaagcgagacactttggggccctaaattaaagtgggttttacctagaagcatgaagtgtgtgagacagaatatatttgaatttttctaaacgtaygctttggagtaagaatcttgctattattgactgacccagacatttagtattttgtaaaacagttccactagttcctcctcgggctttccttgaattgctg

SEQ ID NO: 57570 - DNA, 201 bp, Homo sapiens
agcagaacagcaagcgagacactttggggccctaaattaaagtgggttttacctagaagcatgaagtgtgtgagacagaatatatttgaatttttctaaaygtatgctttggagtaagaatcttgctattattgactgacccagacatttagtattttgtaaaacagttccactagttcctcctcgggctttccttgaatt

SEQ ID NO: 57571 - DNA, 201 bp, Homo sapiens
atatcttactgtcaatgttatttaatttcgattaatcttttatgaagtacataaattgagaatttgataatataattaccccatgtagactgagtattgcmtatcctgggttatctcaaacacttgcgtgacctcagatacctcttgtgtatggagttattaccatcccctgtatagctagctgagtctattaaatatcag

SEQ ID NO: 57572 - DNA, 201 bp, Homo sapiens
acttccctgaatgcttggctattgcaattggaagcatagaaagcagatccagacaagtttatcttccaataatgctcttctttccaaaagagttttggagytctttggagagtggacaaacccaggagcctaatccaatctattaagacccacagccttgagaaaacaatcatttagtttcaccccgctcctgccctgcag

SEQ ID NO: 57573 - DNA, 201 bp, Homo sapiens
tgccatgttgagatcattcattagtccaatttgcccagacatcaaatatttataggagaagagtaagagcaagattctgaaaagcagaacagcaagcgagrcactttggggccctaaattaaagtgggttttacctagaagcatgaagtgtgtgagacagaatatatttgaatttttctaaacgtatgctttggagtaaga

SEQ ID NO: 57574 - DNA, 201 bp, Homo sapiens
tttcaatgatggcgatacactcagagaacacattgaacgtatagaaaagtgaagatttctaatgggctcattcctccagttgcctccttgtattttctttsagtaagatcacctggttgcctgttaccaggctgtgggtcatgctgtgaggcctggaaatcctccacttgcaaccctcctcaggcccaatacagggctcag

SEQ ID NO: 57575 - DNA, 201 bp, Homo sapiens
tgattattctataattttttccaatatatctattctaattcgttcttctccacatcagcacatttcatgctgcctttgtttatctaactgattgtataacmatttttcaaatttgtttttaaaattaaatattattttttgccttaatagcttctaaaagatcctccacacatctagaaaacttatttctattttaaaaca

SEQ ID NO: 57576 - DNA, 201 bp, Homo sapiens
agtttttttctattgttttcacacttctttatgaagaaatccaacattttatccaacaaatgattattctataattttttccaatatatctattctaattmgttcttctccacatcagcacatttcatgctgcctttgtttatctaactgattgtataacaatttttcaaatttgtttttaaaattaaatattattttttg

SEQ ID NO: 57577 - DNA, 201 bp, Homo sapiens
aaggggcacaggcatgccaaatttgcatcacatacatttgtgaagaagacagttacctggcagggacgctgggactctcagcaggtaagggtcagtgactyacactcaagttcacctagggcctgtcttcgtgcctaacatttgatttctttactagtcatgttaattggaagaaaactttcttatttctggcttcagggc

SEQ ID NO: 57578 - DNA, 201 bp, Homo sapiens
agagcacaagacctctgacagcacgttcctggtgttcatgtctcatggtattcgggaaggcatttgtgggaagaaacactctgagcaagtcccagatataytacaactcaatgcaatctttaacatgttgaataccaagaactgcccaagtttgaaggacaaaccgaaggtgatcatcatccaggcctgccgtggtggtga

SEQ ID NO: 57579 - DNA, 201 bp, Homo sapiens
aacatgactagtaaagaaatcaaatgttaggcacgaagacaggccctaggtgaacttgagtgtaagtcactgacccttacctgctgagagtcccagcgtcrctgccaggtaactgtcttcttcacaaatgtatgtgatgcaaatttggcatgcctgtgcccctttcggaataacggagtcaatcaaagctcgagtcttatc

SEQ ID NO: 57580 - DNA, 201 bp, Homo sapiens
tgttcatgatgttctttgtctcttgcagctcctcaggcagtgcaggacaacccagctatgcccacatcctcaggctcagaagggaatgtcaagctttgctycctagaagaagctcaaaggatatggaaacaaaagtcggcagaggtgccatgctcagaacccaaggatagagtggggtgaaagaaacacttcaggcagttc

SEQ ID NO: 57581 - DNA, 201 bp, Homo sapiens; identical to SEQ ID NO: 16693

SEQ ID NO: 57582 - DNA, 201 bp, Homo sapiens
gatgtttctgttttcatctatgtgtaataaacacgtatttttctaccaatgcctctttcattttctacctcccaccactctctaaattaaagaacatcttkaacattatttaatgtcagtcagtcagtcagtgttatgggagaaatttttagtggggagtgttttacagattggggtaaagttttccagagatgataagtg

SEQ ID NO: 57583 - DNA, 201 bp, Homo sapiens
ttttctcaaatttggaaccatctctctatttctacttctattattttattaaagaacccctattcccatagtgcactcttaaacttatatctgaaagcaawgtagaggctaggaatgcaaattatttatcaagttcagatattactctactgaatttattaaggttgggtatcatgaatattttcttaaatgtttcacagc

SEQ ID NO: 57584 - DNA, 201 bp, Homo sapiens; identical to SEQ ID NO: 16698

SEQ ID NO: 57585 - DNA, 201 bp, Homo sapiens
gaggatgatgctattaagaaagcccacatagagaaggattttatcgctttctgctcttccacaccaggtaacaggtttctacacaggacatctttgttggkgctatcaatagaaaaagtgacaataacccactagaggtggtgattaacaactcaagaccaactcaagctttgttccaagttatacacagaattcccttta

SEQ ID NO: 57586 - DNA, 201 bp, Homo sapiens
tccttttactagaacaagtctcagttaaaggcttcatttagctgagatagctgggtttctaaatagaattttattattaatatatactttatgacctttakaactggctaaaatgtgtcattaaagaatgtgtctgtcattacatacagagctattgctgctgcttttctcttatgacttcctttgcataattttatgcct

SEQ ID NO: 57587 - DNA, 201 bp, Homo sapiens
tacttccttttactagaacaagtctcagttaaaggcttcatttagctgagatagctgggtttctaaatagaattttattattaatatatactttatgaccwttataactggctaaaatgtgtcattaaagaatgtgtctgtcattacatacagagctattgctgctgcttttctcttatgacttcctttgcataattttat

SEQ ID NO: 57588 - DNA, 201 bp, Homo sapiens
ctccacgatatctttcacttacttccttttactagaacaagtctcagttaaaggcttcatttagctgagatagctgggtttctaaatagaattttattatyaatatatactttatgacctttataactggctaaaatgtgtcattaaagaatgtgtctgtcattacatacagagctattgctgctgcttttctcttatgac

SEQ ID NO: 57589 - DNA, 201 bp, Homo sapiens
aacctatctccacattctgctgtgccaatcccaaccacatcatagtgatctcctgaagaaaaataattatctacttccttaatttcacaaaacatttgcaragatatctgtctccacgatatctttcacttacttccttttactagaacaagtctcagttaaaggcttcatttagctgagatagctgggtttctaaataga

SEQ ID NO: 57590 - DNA, 201 bp, Homo sapiens
caatgatcagaaacaatgacactacccaaaaacaccatatattttcagcctgagtacgtatagcagagtttaatattagacagaactgttcgttagtatcstttgatcccagccttccacatgacattcaccgctctctaagtagctctttgtaggcctctggcttctcattatcaatctggctgatttatgtgtctttct

SEQ ID NO: 57591 - DNA, 201 bp, Homo sapiens
aggtttaaataaaaattatttaaatcctttcattcaccacctttggcagtttcctgagaggacttgcattctcttggtcacctctggcccaaaggccctgyctctgctcaaatagttaagttttctaaaatattttctaaaatgagatatcttctttcagaagaagcttggttctacattgggttgaacatgccctgatgt

SEQ ID NO: 57592 - DNA, 201 bp, Homo sapiens
caggtccctgggaagaaagagttttggaaggggctggctcttctggaagccataattagcatctgtggaagtttacttgagtagaagcaaggaaaaggggrgagagggaggagagaaggaactagaagattcttgcagactttagaaaggaaaggcaagcccagaaaggaactgaggctttaggggaagcctgatgtcatt

SEQ ID NO: 57593 - DNA, 201 bp, Homo sapiens; identical to SEQ ID NO: 16666

SEQ ID NO: 57594 - DNA, 201 bp, Homo sapiens; identical to SEQ ID NO: 16667

SEQ ID NO: 57595 - DNA, 201 bp, Homo sapiens
caactcaatgcaatctttaacatgttgaataccaagaactgcccaagtttgaaggacaaaccgaaggtgatcatcatccaggcctgccgtggtggtgagtrctgatgcctttgagaacaccagacaatcaaatactatcctactctgtatgcatccaagaatttttggtttcttttggtttgtcttttaatgtcaaagaac

SEQ ID NO: 57596 - DNA, 201 bp, Homo sapiens
ctttgctccctagaagaagctcaaaggatatggaaacaaaagtcggcagaggtgccatgctcagaacccaaggatagagtggggtgaaagaaacacttcargcagttctgaaatgcagtggcttattcttagagccaacctcattgagcagttctggagaatcatacttctgctccccttacataaaggatttctatatcc

SEQ ID NO: 57597 - DNA, 201 bp, Homo sapiens
aatttgtttttaaaattaaatattattttttgccttaatagcttctaaaagatcctccacacatctagaaaacttatttctattttaaaacaaaggttacrttaatttctttaacaaggacatcacattgttggattgtgttgaacctgtgatgaaataaaaggctcaaggattttctcacataaactctgtgaaaacatt

SEQ ID NO: 57598 - DNA, 201 bp, Homo sapiens
ctttttccattatattatgttttggatttttccagagtacccaaacccagcagatgcatactgctccaaaataaatggaactcaatactggctctgtcaastgtctcttgccaatcaattgtccttctaatcttttgaggggcagttctctcagttgtaccaagtcactgtcatccccaaacttttcaatgattccaggcc

SEQ ID NO: 57599 - DNA, 201 bp, Homo sapiens
gcagttatttatagatccaggccctgtgtcaagttctgtaatagatgaatagacagtttatgctcttggagagttaacagtaaaaacagaaacagaaacayaccccactgataaagtgttatataacaccccattaagttccacaatgatgtgatttgtgaaatggaggggcagtagggcaaggtagaggatatttttatt

SEQ ID NO: 57600 - DNA, 201 bp, Homo sapiens
tcagtgcctgtcatttctaaatgccatcagtatccacctaattttctaagctagaatcttataatcacctcctattccttcttctccttcacttgttaccygccccacatctaatcagtcactaaattctgtcagttctaccttttaatgaccctggagcctgctggcatcttgccattgtcatttccagtactacatttc

SEQ ID NO: 57601 - DNA, 201 bp, Homo sapiens
gtgaaatgacacttacagtgactatttaaaaataatttggagcatgaatatttgaagctcagttctttttacaaaggaaatgtataacctttgctcttcattttttttggcagttatttatagatccaggccctgtgtcaagttctgtaatagatgaatagacagtttatgctcttggagagttaacagtaaaaacagaaa

SEQ ID NO: 57602 - DNA, 201 bp, Homo sapiens
aagaatgggtagtttctgctattctctgaaccagatgagtatcttagtatcaccagtgggtattggcttgggggtagagcagagaatgaagaaattaaggtgtgtgtgtgtgtgtgtgtgtgtgtgtgtgtgtgtgtgtgtgtgtgttaagggggattggcctggaaggatttcaacaggatagcttgtcttgcttcatag

SEQ ID NO: 57603 - DNA, 201 bp, Homo sapiens
aactaaagttggaacctaggtctgtctgactccaaaactttcctctcttgtgtgattctcagacagggacaattttgtcccccctttctggggacatttgkcaatgtctggagatattcttggttattataatggggatgttactggcgtctagtgggtacaggtcaggtgtgctgctaggcatcttccaatgcacagaaa

SEQ ID NO: 57604 - DNA, 201 bp, Homo sapiens
ttctgctgaagaatttggccttcacgatgacaggctggtttgggaacttttcccttcccagaactctatagtagcccgatggcaccacatcagtgatgggagctgttccaggcttgtttttagcagcattcacctgtgtctgcttcctgaccaaagcccacaatttgtcaaggttgacagctgggtagaagctcaggttcc

SEQ ID NO: 57605 - DNA, 201 bp, Homo sapiens
ccagcctgagatgggcctgtaggcctgtgggccaaggacctgccatctggagcatttggcaaagttgaggggcccatgtgtcttcgagacccgaatctcasgctgaacagggctccgccctggacccacctgagctgcactgccctgctgacggtcaggtgcggcctggaggtcccgatcaaggttgagggtgggtggctg

SEQ ID NO: 57606 - DNA, 201 bp, Homo sapiens
acagagaacagaaggccaagagccagcttctgcgttctcaactttattcaacattagacttaccttatttctttcagtgtgtagggacaagatgtactgctgtgtgtgtgtgtgtgtgtgtgtgtgtgtgtgtgtgtgtgtgtgtgtgtctataccttcctatccattggcaagttaacctccatctggtttatttggcca

SEQ ID NO: 57607 - DNA, 201 bp, Homo sapiens
tattagattgcaaggtcttcacggaaagaatctacatctgatccatctccataattccattgtcttgtttagaatttggcacccagtagttgctggaaaaraaaatgtttactgaggctgggcatgatgactcatgcttgtaatctctgcatttagggaggctgaggtgggaggatggcttgagcccaggagtttgagaca

SEQ ID NO: 57608 - DNA, 201 bp, Homo sapiens
cagagaacagaaggccaagagccagcttctgcgttctcaactttattcaacattagacttaccttatttctttcagtgtgtagggacaagatgtactgctgtgtgtgtgtgtgtgtgtgtgtgtgtgtgtgtgtgtgtgtgtgtgtgtctataccttcctatccattggcaagttaacctccatctggtttatttggccat

SEQ ID NO: 57609 - DNA, 201 bp, Homo sapiens
gacacccatgatcgctagttcccacatggggagaaaaacagatactggcagcttaaaccggggagccaccaaagcctggtgtgctccagacccctgcccamccaatctcttccttctattctgagtggctcccattttaagacatccctcctcatggcccctcaccctcaccccagctgtttcgcactgggatttccagaa

SEQ ID NO: 57610 - DNA, 201 bp, Homo sapiens
agtgggttaggagtcccctcctacttttaattcaatcataaaatacttcttgagcacttactatgtgtcatacattgtgctaatctttaggataacatatatatatatatatatatatatatatatatatatatatatataaataaataaaatgctggatccttctttcaatgaccttatttgtagtagaatacaaatgat

SEQ ID NO: 57611 - DNA, 201 bp, Homo sapiens
ggttaggagtcccctcctacttttaattcaatcataaaatacttcttgagcacttactatgtgtcatacattgtgctaatctttaggataacatatatatatatatatatatatatatatatatatatatatatataaataaataaaatgctggatccttctttcaatgaccttatttgtagtagaatacaaatgatacac

SEQ ID NO: 57612 - DNA, 201 bp, Homo sapiens
aaatacttcttgagcacttactatgtgtcatacattgtgctaatctttaggataacatatatatatatatatatatatatatatatatatatatatatataaataaataaaatgctggatccttctttcaatgaccttatttgtagtagaatacaaatgatacaccatgtactaagagcggtgccattacgggtatagttg

SEQ ID NO: 57613 - DNA, 201 bp, Homo sapiens
ctggatccttctttcaatgaccttatttgtagtagaatacaaatgatacaccatgtactaagagcggtgccattacgggtatagttggatatagatatacmtatatggaaactcagaaaagagaggcattacttaaggttgtaggaatcagagaaggcttcatggaagaggggttatttgaactggactctgaaagataag

SEQ ID NO: 57614 - DNA, 201 bp, Homo sapiens
tttgtgtgcattttttctgtaaaatgtgtctgtagcattcaaagggttctctgacctccaaaaagtaaaacccctgccttggtgattagaacatagctacyagggacaatgaaatagaagataacccaggaaaggcaagggaagtgagtgcctcgtaggagagaaagggttcattttgagctcacatttattgattgtgca

SEQ ID NO: 57615 - DNA, 201 bp, Homo sapiens
taaagaaaagactcgtcgcgtgtgcagctgtattctatggtttcgcggtgcatatgaagatatatccagtgacttacatccttcccataaccctccacctkcttccagatcgcgacaatgacaaaagcctccgtcaattccggtacactttccaggcttgtttgtacgagctcctgaaaaggctgtgtaatcgggctgtgc

SEQ ID NO: 57616 - DNA, 201 bp, Homo sapiens
gaaggcagggagctgcagaggagatccatccaatgctacacataggagctcggcccagagagggaaagtgacctgtgcaagttcccagagagagttgacarggttgttgggccccgaacccaggagttctaaggcctagctccatctctgctctccccgccagaatttttttgtggagagtggaggagcaaggtcctaaga

SEQ ID NO: 57617 - DNA, 201 bp, Homo sapiens
gtgaggtcacctcccaagtggggtataggtctgacctcttagcactgcattctccctggaccagcctcctcagctccacttctgatcccagttccaactgstagagccaggcacactccttctccacgtgtctaaacctcccggttgaccctgtgataaaaaagatatgggcaactggtaagaggagagggtgagtgtatt

SEQ ID NO: 57618 - DNA, 201 bp, Homo sapiens
tcccctcaacataaacaaagctaggacttcagtaaaggatccctgaatgtcaccatagaaagtgcaggggtagaagtggggtggagaaggcagacatcctsacccaccatgggtatagacagaatcttcaagacagtctttcaatctcccatccaaagcttttatctccgccataggatctctgcaaagtgcttgtccaaa

SEQ ID NO: 57619 - DNA, 201 bp, Homo sapiens
ttgaagtttaattccagtgagtgccccaggcagggtgaggcagatggggaagaagctggtgcagatttggaccccaaagaggccagtgcttaaagcctgcytctgttgcttaccaatacaaattctgactaaagatgtctggccagtctgctcttgctgtggtgtttgaattttttttctccccactgggactgctttagg

SEQ ID NO: 57620 - DNA, 201 bp, Homo sapiens
ttttggcttgggcaactagatggatggtaatgttcttcactgaattatgaagactgatggaaggagtagttttagggaggaagacggtttggaatcgatcrtgtcaagtgtgagatgtcagcagtcttagtgaggaagtcagagggacagtcagatatatatttgggaatcaccagattataaatgttgcttaaagacaag

SEQ ID NO: 57621 - DNA, 201 bp, Homo sapiens
gtgtgagatgtcagcagtcttagtgaggaagtcagagggacagtcagatatatatttgggaatcaccagattataaatgttgcttaaagacaagggcctgrgtgagattgcttggggggcctaagaccgagctctgggcactgtaatattagataatctagctgggcagcaatgggcaaaggaaactggggagaagtcagt

SEQ ID NO: 57622 - DNA, 201 bp, Homo sapiens
atgtactgctgtgtgtgtgtgtgtgtgtgtgtgtgtgtgtgtgtgtgtgtgtgtgtgtctataccttcctatccattggcaagttaacctccatctggttkatttggccatgctatgctttcttcccattcccctgctgtctattctaagcccccagactcaagcctctagactcttggatgaaacagtgagaagaaaaca

SEQ ID NO: 57623 - DNA, 201 bp, Homo sapiens
gattataaatgttgcttaaagacaagggcctgggtgagattgcttggggggcctaagaccgagctctgggcactgtaatattagataatctagctgggcarcaatgggcaaaggaaactggggagaagtcagttaagtcagagaaatgctgtattatttttaaagtgtgggatttttttttttattttttttgagacagag

SEQ ID NO: 57624 - DNA, 201 bp, Homo sapiens
cagataagaaaactgaactcagaaacaagtgactttccaaggccaaatagctggttaatggcaggattggggtgggaccccagatcttctgattctaatcttttttttttgcaagtcctttttagtgctatacaatgacaggtgattacagtggaaaacctcacttatttagcaaatgtcattcacttagcaaactactta

SEQ ID NO: 57625 - DNA, 201 bp, Homo sapiens
atgtcaggctggggctagaggatgggagggaaagggggaaggagaccagggagtgggagacagaggcaacagtgattcagctggagagtcaggccccaggmcacacacacacacacacacactgccctctttttccccacctcaggatttgtgtgcatctggctccatttctatttgtttattttccttggggcaagacag

SEQ ID NO: 57626 - DNA, 201 bp, Homo sapiens
tgtaaacctgggtcccctcgcactctgaagtggctcctcctgaaggtctgtgtgaactaggtgtctcctgtgaggcagataaaaactgcagccctcagggkggccttggcccgtccagatcaggctttcagtcattcccttactctttcttaacaaactatactaggcactggggaaacagatgaaaggcagagtcagtgg

SEQ ID NO: 57627 - DNA, 201 bp, Homo sapiens
acttggaagcccagaagtgcttctttttcatcccaatgcaactgatctccttctggaggaccctaaggtcgctattcaagttggaactggtatccaaaaamagataatatggttggtgagatgaggctgagtagctgtttgctctctccaccgaggccggggggaggagtgggaccagactgctgtggaggcaacttgggc

SEQ ID NO: 57628 - DNA, 201 bp, Homo sapiens
ttgtgtggctgcaagcagcccaaagagaaagccatggattccagaagagttccaatcctggcatttgggcatggagggtgatgctttggttttgatgcttctgaatgaaaatgaggagtggggttaccagctgctctaggggatggtgaagttccatgagaggcttccgaaatctctgcaatgtgcttcaccccattattc

SEQ ID NO: 57629 - DNA, 201 bp, Homo sapiens
acctcaggtgattcacccatctcagcctcccaaagtgctgggattacaggcgtgagccactgtgcctggccaaccttcttaactcttacactatgcccatstgagatcaaataaatccccttaaaagctagagcacttaccacagctgcatttgtatattatttgtcaatttatttgactaatgtctgtgtagcttactag

SEQ ID NO: 57630 - DNA, 201 bp, Homo sapiens
acaaagaggctagcagtggccgaaatctccagtacccttgagtctagagccttaaccctgggatgtgtggtcttacatacagcgtaccatagtggcacctkctgagagcatgaggtccaagagaatgaacctggggcacacaaaagcagttgctacaattaaaaagttctggaccaggagctgggagacctggattctggt

SEQ ID NO: 57631 - DNA, 201 bp, Homo sapiens
tgaggcaggagaatggcgtgaactccggaggtggagcctgtagtgagccgagatggcaccactgcgctccagcctgggcgacagagcaagactccatatcaaaaaaaaaaaaaaaaaaaagataatccaaagaatttaaattgtaatcatgtttcatgtatttgttttattacttacttttatagcacttagtcccagtgg

SEQ ID NO: 57632 - DNA, 201 bp, Homo sapiens
atatcctcaaggttctttgtaagcttattcctttaatcaccaggcatttcttccctcaaatctcaaataaatggatttctcttctacccttgtctgtcagyagcctgagaaaggtctggttgttaatatccaggcctgaattttctctgatgagaggcaaaagaccctatgatcactgactcttgttccccagaagtggaa

SEQ ID NO: 57633 - DNA, 201 bp, Homo sapiens
gtatgttttattttgcgggggtgccccggggtggtggggtgcgcaacagatgatttccagagctttggctcgattccttccccaggggcctggccagcttkggggtggagtgtagctgattgtttatccgcttctgactctggccaccgcagagaacaaagctgcctggctgtgggaggtggcacaacagctgggagcagc

SEQ ID NO: 57634 - DNA, 201 bp, Homo sapiens
tccagaaggaaaggagcagggccacttctgctagagtgagaagggcagattgggttctataaactcaccctccagatggagacgccccttcccattccatycctcctctcatcagaactaacccagggcacctgtgttagggaacagatgaaggatggaacttcctgatttgggggaggagagctgaacccaggaatgggt

SEQ ID NO: 57635 - DNA, 201 bp, Homo sapiens
catcttgcaccaatttcccctactcagcctcactctagcctactggataatgcagtttcctgaagttaccacactattaagcctttgcccatgctgggttttgtgtgtgtgtgtgtgtgtgtgtgtgttttgagacagagtctcactctgtcgcccaggatggagtgcagtggcatacactcggctcactacaacctctgc

SEQ ID NO: 57636 - DNA, 201 bp, Homo sapiens
ctctccttcattttctcttccccaaccctcattaagaacacttggaagcccagaagtgcttctttttcatcccaatgcaactgatctccttctggaggacyctaaggtcgctattcaagttggaactggtatccaaaaacagataatatggttggtgagatgaggctgagtagctgtttgctctctccaccgaggccgggg

SEQ ID NO: 57637 - DNA, 201 bp, Homo sapiens
cacacacacacacacactgccctctttttccccacctcaggatttgtgtgcatctggctccatttctatttgtttattttccttggggcaagacaggaggyggattaatgaataaagacatcaagtttgaaaagaaccccaaatccagctccattcttcttccaaccttgagggcttacataaccatgcagtgcttttctt

SEQ ID NO: 57638 - DNA, 201 bp, Homo sapiens
gtccctatttctatccacctattcatttgtctttaccaaacagtgattggttcagaaagaccttcaaacctaagataattggattagttaatagctatagyaggcactgttcttattttccaggaatctgcctccctttctgatctcatttccagatccctcaatcaaaaggctcttttctacagggaagaagtagggaga

SEQ ID NO: 57639 - DNA, 201 bp, Homo sapiens
tgagagggcaggtgcatcaaagaggcagcacccacttgtcacaggaaccaggaagtcctcctccctctccagccggcgaaacagggggtccccaagatgcyatcctgtgggcaggtctctacagaacattgtttctttcttgcaggggacagaaggcaccgcttggggattgaggtggaggaaggggcagtggtcctagtc

SEQ ID NO: 57640 - DNA, 201 bp, Homo sapiens
ctagaaatggcagagctacttaatggctaatcaaggtagataaaatcagtggattcccaccacacctcaataaaagccaaaagagagtgttaagaacagaycggtcagtcatcagtctcaagtgtagcagagactgctggggtcaagggctgagaagacacccttggatttaatgatggaaggtcagctgtgacactggag

SEQ ID NO: 57641 - DNA, 201 bp, Homo sapiens
taagaattaaaaaaaaaaattatagagccagcaagggaggaggcaggaaacagaaatcgaatttcatcattccagtatagttgtccctttttttgtatttstgacttggttttataattatatttacttactaattattgttttttaacattctttattgtggcttactcttcatacttagaattgaaattgttggacatc

SEQ ID NO: 57642 - DNA, 201 bp, Homo sapiens
attttcttacaaaaccataattctgctatctattatgatttaacattctgtcattttcaaatttcttcaggtgttttttgttacatcttaaagaacagacrttcttggatctcaaagattccgaggaaggaaagaacatggtggataatccataattaagaagtttgaatcttttcctagtcttaaaaacaaagtgagaac

SEQ ID NO: 57643 - DNA, 201 bp, Homo sapiens
ctccaggtagcgggagcctgtaagtacttggacacccagggcagaggtgacgtggaatccacggaacgggggaaacagttgaggaagatggagtacagtgrtcaaggatgagagtcaagagtggatggattcctgagaaacaccaacagttaaggtgcagaggagagattacagcaagagagatgatccaaagtaaacaca

SEQ ID NO: 57644 - DNA, 201 bp, Homo sapiens
tcttctgaggagacaggacgctgagtctgaacatgttaaaattggaatgctccaggtagcgggagcctgtaagtacttggacacccagggcagaggtgacrtggaatccacggaacgggggaaacagttgaggaagatggagtacagtggtcaaggatgagagtcaagagtggatggattcctgagaaacaccaacagtta

SEQ ID NO: 57645 - DNA, 201 bp, Homo sapiens
gcccagcctgcctatgctgttttttctgcctagtgtgcatatttctctcctggccttcagatgacctgtcactcgtttttcaggacccaactcataggacmcttcctctttcaagaggaatgccagatgagcttttggagagagaaggttagccattaagggggaaaaaaagaaagatagggccagagttgtaacatttgg

SEQ ID NO: 57646 - DNA, 201 bp, Homo sapiens
ttccaagtagacacagcctctgacagccccttccttattctaccccttaccttctatcatgtggtagatgagaccagtcccttgaaagatctccctcttcrcagtggtgagggtgactttgagctggtgctgatcctaagtgggacagtggagtccaccagtgccacctgtcaggtgcgcacttcctacctgccagaggag

SEQ ID NO: 57647 - DNA, 201 bp, Homo sapiens
atcttgcaccaatttcccctactcagcctcactctagcctactggataatgcagtttcctgaagttaccacactattaagcctttgcccatgctgggtttkgtgtgtgtgtgtgtgtgtgtgtgtgttttgagacagagtctcactctgtcgcccaggatggagtgcagtggcatacactcggctcactacaacctctgcc

SEQ ID NO: 57648 - DNA, 201 bp, Homo sapiens
tcttgcaccaatttcccctactcagcctcactctagcctactggataatgcagtttcctgaagttaccacactattaagcctttgcccatgctgggttttgtgtgtgtgtgtgtgtgtgtgtgtgttttgagacagagtctcactctgtcgcccaggatggagtgcagtggcatacactcggctcactacaacctctgcct

SEQ ID NO: 57649 - DNA, 201 bp, Homo sapiens
gcctcactctagcctactggataatgcagtttcctgaagttaccacactattaagcctttgcccatgctgggttttgtgtgtgtgtgtgtgtgtgtgtgtrttttgagacagagtctcactctgtcgcccaggatggagtgcagtggcatacactcggctcactacaacctctgcctcccaggctcaagttgattctcatg

SEQ ID NO: 57650 - DNA, 201 bp, Homo sapiens
atggcttcatcttttagtccttatggagtcaggtcaggggacacaaagatgagtaatatatggtctctgccttcaaggagctcaaagtctgttgggagagaaaaaaaaaaagaaaaaagactactggcacgcagtgacaaatgctgggctaaggcctgcccaggaaggggacagctgctgggagaggtgtgtgcaggggca

SEQ ID NO: 57651 - DNA, 201 bp, Homo sapiens
aaagaaaaaagactactggcacgcagtgacaaatgctgggctaaggcctgcccaggaaggggacagctgctgggagaggtgtgtgcaggggcagggtgggcctcaagacagggaaggtgggattccaagggaacacaggaatcggccaagtgggaagtcagggaggaacatgtaaagctctggtgccatcaaaacccagag

SEQ ID NO: 57652 - DNA, 201 bp, Homo sapiens
ccaggaaaatctatgtccagtgtcccagataggaaggcatgcagctctccctagcaaatggaagttccccagaaagattgggggaacactgggaagatggrgctgtctgcaacgtcagcatttcttcacataaatgaaatgactccacattcaaggccaggaaagaaggaatatagtgtatgccccacctcatctctgtca

SEQ ID NO: 57653 - DNA, 201 bp, Homo sapiens
ttgtctttcagttgacttgtggctgaatttactgttacttctctaatatcagttgttttctgcattaccaccctctcccctaaccatctgtactatgaatrgaaaaggaaaaagatggaaaaattatacctaggattgtccctaaatgcaacctcttggttccccccacccctcatgttttattataaacgattttaagag

SEQ ID NO: 57654 - DNA, 201 bp, Homo sapiens
tctcattaaattccggagccttgcccctgaatccactgcgcattgtcccgaaggcagggagctgcagaggagatccatccaatgctacacataggagctcrgcccagagagggaaagtgacctgtgcaagttcccagagagagttgacaaggttgttgggccccgaacccaggagttctaaggcctagctccatctctgct

SEQ ID NO: 57655 - DNA, 201 bp, Homo sapiens
ctcagctccacttctgatcccagttccaactgctagagccaggcacactccttctccacgtgtctaaacctcccggttgaccctgtgataaaaaagatatrggcaactggtaagaggagagggtgagtgtattagagtctagagcactggtttttaaactttttgacctcaggaccactttacattctaaaaagttactga

SEQ ID NO: 57656 - DNA, 201 bp, Homo sapiens
gatccacccgcctcggcccctgcacagtgcctggcacatagcaagtgctcaataaatatttggtaagacaagaacacataagcgacattcaaatgaatgtyaattcctccctcccatggggtgagggttaggagtcagctggatttctacgataacctccattatgctgtcttgctccctccagatgacgtcagttgccaa

SEQ ID NO: 57657 - DNA, 201 bp, Homo sapiens; identical to SEQ ID NO: 16752

SEQ ID NO: 57658 - DNA, 201 bp, Homo sapiens
ggcctgtaggcctgtgggccaaggacctgccatctggagcatttggcaaagttgaggggcccatgtgtcttcgagacccgaatctcaggctgaacagggcyccgccctggacccacctgagctgcactgccctgctgacggtcaggtgcggcctggaggtcccgatcaaggttgagggtgggtggctgagggcaatgggag

SEQ ID NO: 57659 - DNA, 201 bp, Homo sapiens
acctatttataaatttgccttttcttctaagttgattggtgagaactgagggcaaaggaagctaagattaagtgaatagtatttacatttgaaaaatacaraacgaaagaatgattttttattatatctgattacttaaaaacataatttttataatataaaattgatgtgtactcattgtggatgctttgaaaaaaaata

SEQ ID NO: 57660 - DNA, 201 bp, Homo sapiens
ggtgcggcctggaggtcccgatcaaggttgagggtgggtggctgagggcaatgggagtagagcttagggtccctgctaacaaggaagtggaggcaagaaarggatcctagttttcaacatttgaaattttggaggacacagactttcattctattacattgagaaatcctgctctattccatgttgactctaatgaaaagc

SEQ ID NO: 57661 - DNA, 201 bp, Homo sapiens
ttccatgatatgctgtttgcaagctggagaaccaggtaagccagtggtgtaattcagttcaagtccagaggcctgagaaccaggagagccgatggtgtaayggtccaagaccaaaagtctgagaactggagcttggggttggggatggggtggggaactgctggtgtcaagtcctagagtctaaaggcctgaggaccagga

SEQ ID NO: 57662 - DNA, 201 bp, Homo sapiens
cgtctggaatgaaaaagggggataaaggtcagagtctagtctgaggcagccccattgtcctgagcatacctctgagcaggggcttgcaaggtggcagacawgtgaggtcacctcccaagtggggtataggtctgacctcttagcactgcattctccctggaccagcctcctcagctccacttctgatcccagttccaactg

SEQ ID NO: 57663 - DNA, 201 bp, Homo sapiens
agactttggcttatttcctatataattctttttttcttataccacctcttaagattgatatgttcatttgcaggtaagcattaattattagataaagaggkatgattctcaagattgtgtgtgttctgaacagagggaactacatgacattttcttctgtaattgcctttgtaacgtctttagaatgtggttcctaaatat

SEQ ID NO: 57664 - DNA, 201 bp, Homo sapiens
gagggcaatgggagtagagcttagggtccctgctaacaaggaagtggaggcaagaaagggatcctagttttcaacatttgaaattttggaggacacagacwttcattctattacattgagaaatcctgctctattccatgttgactctaatgaaaagcaattcatcagacaaaataaatgcatccatgaccccatggggag

SEQ ID NO: 57665 - DNA, 201 bp, Homo sapiens
caatgggagtagagcttagggtccctgctaacaaggaagtggaggcaagaaagggatcctagttttcaacatttgaaattttggaggacacagactttcaktctattacattgagaaatcctgctctattccatgttgactctaatgaaaagcaattcatcagacaaaataaatgcatccatgaccccatggggagtcaga

SEQ ID NO: 57666 - DNA, 201 bp, Homo sapiens
acaattttgccacccacaatctggcatttctgccagtccttcagaaaatgtcccagtgcttccaggaagttttaacatgttgtttctcctccaccactgcytatttctttttgttcaagtcccatctgtactcttcctaacactgccctagactctaactcagaccaaatttccccagatgatgcaaacagatgatgatga

SEQ ID NO: 57667 - DNA, 201 bp, Homo sapiens
cctccacctccaaaccctctctcaccaaattgtgtaatttctttgtttactgctggcttcatcatgcacttttccttcatagcctattttaagaagttgayttgctgaactgctttttagccaagctatttgtaaatcaagctacacaaagtatgtggccataatttccaaaaggcaaatgatcattgttcaattgctgtt

SEQ ID NO: 57668 - DNA, 201 bp, Homo sapiens
ggacacagactttcattctattacattgagaaatcctgctctattccatgttgactctaatgaaaagcaattcatcagacaaaataaatgcatccatgacyccatggggagtcagattgggcttaagagaagtcctaggggcttggggccattcatgagccactggcattggtaggatagaaagactattctgtctagtcc

SEQ ID NO: 57669 - DNA, 201 bp, Homo sapiens
tttatttgtatgttacagataagaaaactgaactcagaaacaagtgactttccaaggccaaatagctggttaatggcaggattggggtgggaccccagatyttctgattctaatcttttttttttgcaagtcctttttagtgctatacaatgacaggtgattacagtggaaaacctcacttatttagcaaatgtcattcac

SEQ ID NO: 57670 - DNA, 201 bp, Homo sapiens
gggggaaaaaaagaaagatagggccagagttgtaacatttggtaaactctgttaatggacttgatatgttatggttatttgtgcatttgtctctttctctyagatttactgttttgtgtttatatccttagtatacagcataagtgctcaataaatgtttgttaaataagtgaagtaggtatggggagggaacaactgttt

SEQ ID NO: 57671 - DNA, 201 bp, Homo sapiens
gttggggatgctttgtgtttttgtttttctatctctcaacataacaaatattaggagagaggaaccaggtttattttactggtgtctggcagcaaaggcayggatgagtcactgctagtgaagggtaggaattagtggtgtgtgtgtatgggggtggcggatggtcacagaagtcttttccttggtaaagtggttttaatc

SEQ ID NO: 57672 - DNA, 201 bp, Homo sapiens
ttttaatcagaagcccataaaccttggttgtgtgcaaaatgtgtgtgtatttgtgtgcattttttctgtaaaatgtgtctgtagcattcaaagggttctcwgacctccaaaaagtaaaacccctgccttggtgattagaacatagctaccagggacaatgaaatagaagataacccaggaaaggcaagggaagtgagtgcc

SEQ ID NO: 57673 - DNA, 201 bp, Homo sapiens
accctgctccacagaagatctggctatcagatccagggtccaagggctcaagtgattaaaattctttctgtgctggaaaagtacaagttactgcttgggcragggtgccaggcaccttgtattaagtgaattgtctcctatttcagtggcttgccccactttctgctatcagaacaaatagcaatactgaatttgagcctg

SEQ ID NO: 57674 - DNA, 201 bp, Homo sapiens
tactctactgcatccacccggtccttctgtctcttctccacctttccttttcttcagtagactctaatttagcttggggaaggcaacccagaaagctccarcattttctaacctcttttctaattagaagatagagttagcatataagaagctgcaagtttcaacttgacaatatctctagaactgagaacagggccaaaa

SEQ ID NO: 57675 - DNA, 201 bp, Homo sapiens
tttccaagtagacacagcctctgacagccccttccttattctaccccttaccttctatcatgtggtagatgagaccagtcccttgaaagatctccctcttygcagtggtgagggtgactttgagctggtgctgatcctaagtgggacagtggagtccaccagtgccacctgtcaggtgcgcacttcctacctgccagagga

SEQ ID NO: 57676 - DNA, 201 bp, Homo sapiens
tttttactgttattaggtattgttagattgaaccctttgatattgccaatagggaacccatgtattaaatggatgatttcatagaattcaacctaatagtraaaggagtgagctggagtcggggaaggggctgtgaggttatgagacaggcaactgcgcaggcaagggtggccccaggggactggggagccccaccccctg

SEQ ID NO: 57677 - DNA, 201 bp, Homo sapiens
gaactctcccgtcacctctgtattattatgccccttttgcagataagggaaatagaaactcatgcatttaagtgatttgccccaaatcacaaaacctagawatggcagagctacttaatggctaatcaaggtagataaaatcagtggattcccaccacacctcaataaaagccaaaagagagtgttaagaacagaccggtc

SEQ ID NO: 57678 - DNA, 201 bp, Homo sapiens
ggaacagagctaggcatttgggatataagagtgaggggaaaaacaggcactaatcatgcaaccatgaaatttagagcctataagcaaagactcatgctatsatgaggacaaacacaatgttataagagctcctagtaggtacccattaggcagggttctccagagaaacagaacaaagaggatgtgtgagtgtgtgtgtgt

SEQ ID NO: 57679 - DNA, 201 bp, Homo sapiens
gagacttcttctgtcggtcaagacaacccccacatctcattcctgctcccatggtcctgcctatcgctcttgtattcttcatcctgcctctccctctcccrgcccaggtttgcccccacaacttctctcaggtttatatgcccttctcttcttgtgtctcctgattggcttgttcatcccatcagcctggatgcccacagc

SEQ ID NO: 57680 - DNA, 201 bp, Homo sapiens
aggtgcccctgctgggttctggttgaggcgatttgcccagggtggagcctttcgcctctgcacaggctgctcctccttcccttcccagcacacttcccttycctatgccttgtggtcaactcctgcttgttctttaaggtacaggtcaggtgttacctccttcagagagacttttgtggcctattcctgccccataccttg

SEQ ID NO: 57681 - DNA, 201 bp, Homo sapiens
agattggagaggaaagggagatttaaaatctaagtgttttagcacccaatggtgggtggttggctgggcagctcctgggaatgggagtttgccatgtcacytcggtctctccagcaggctgagttcaatgcttttcttccctcatttgagtttagcctacatgtttgccaccattctttagggagagagtgcatctggtgg

SEQ ID NO: 57682 - DNA, 201 bp, Homo sapiens
gctttggttatttaactcctggggtgccttgtgccctgaggacaccatgctgatcttgctctctggctggtgggtgggtccctttactggctgactctggkggggcagcaggggagatgttactctatcattcctatgctgatttatggcttcatcttttagtccttatggagtcaggtcaggggacacaaagatgagtaa

SEQ ID NO: 57683 - DNA, 201 bp, Homo sapiens
actcatggggtgggatgggaagatggggttggggaggctctgccctcaagagctttggtgccatgcacccatccagccccagagagaggggcagcagtggrgcaggggcagaagtctaacagtcactcctgacagctggggccaacagtgagcctggagagaccttggctgtggaggggggatggaggtggcaggtgtgcc

SEQ ID NO: 57684 - DNA, 201 bp, Homo sapiens
gctgaggcaggagaattgcttgagcacaggagttcaaggctgcagtgagctatgatggcaccaatgcactccagcctgggtgacagagcgagatcctgtcmcaaaaaaaaaaaaaaaaaaaaaaaaaaattatggaggtgaggctctctaaggccagagtagctaaggcccatgaaaattataatgtgacctgagctacac

SEQ ID NO: 57685 - DNA, 201 bp, Homo sapiens
ttgactctaatgaaaagcaattcatcagacaaaataaatgcatccatgaccccatggggagtcagattgggcttaagagaagtcctaggggcttggggccrttcatgagccactggcattggtaggatagaaagactattctgtctagtccctgacctgcctttgatcgtatggttcttactctactgcatccacccggtc

SEQ ID NO: 57686 - DNA, 201 bp, Homo sapiens
gatgtagttaaaatataatttaataattaaatatggatgttttcataacttttcaaccacacagttttaatgttttgatttagtcgattcatttattaggyaaatattttcattgggaacattcatattcaccgaatacatgtataggctgctaagtgaaggctttaatggagtgggaattcatgaatacttgaccttatg

SEQ ID NO: 57687 - DNA, 201 bp, Homo sapiens
aaagttttatcaaatcaagagttattcgacctgctataaaggcaaaactcttacttgaaatcttttttgataggaaaaaagggatgtttttcaagttgagytccctggatgagaagtggagttagtggggctgtgaggagcccctaacttctattcaattggcaaaacctccccttccacttcatagagaggagtctgagg

SEQ ID NO: 57688 - DNA, 201 bp, Homo sapiens
tgccacccacaatctggcatttctgccagtccttcagaaaatgtcccagtgcttccaggaagttttaacatgttgtttctcctccaccactgcttatttcyttttgttcaagtcccatctgtactcttcctaacactgccctagactctaactcagaccaaatttccccagatgatgcaaacagatgatgatgatgatgat

SEQ ID NO: 57689 - DNA, 201 bp, Homo sapiens
ttgattgaagatgaggctcctgagaccaagtgacttaaccaagtctataccaagttatttatggtaaaatcaggactaggactcagacctttaactgaacwtggagattccaagatctcccttctgctttctctgtatgaaaggaatttttcttattttgatttatacctgagactagtataattccacatcaaccagctc

SEQ ID NO: 57690 - DNA, 201 bp, Homo sapiens
aaaagaatgggtagtttctgctattctctgaaccagatgagtatcttagtatcaccagtgggtattggcttgggggtagagcagagaatgaagaaattaaggtgtgtgtgtgtgtgtgtgtgtgtgtgtgtgtgtgtgtgtgtgtgtgttaagggggattggcctggaaggatttcaacaggatagcttgtcttgcttcat

SEQ ID NO: 57691 - DNA, 201 bp, Homo sapiens
cctctccaagaagggctaaactccccagagatcaccctgctccacagaagatctggctatcagatccagggtccaagggctcaagtgattaaaattctttmtgtgctggaaaagtacaagttactgcttgggcaagggtgccaggcaccttgtattaagtgaattgtctcctatttcagtggcttgccccactttctgcta

SEQ ID NO: 57692 - DNA, 201 bp, Homo sapiens
agaatgggtagtttctgctattctctgaaccagatgagtatcttagtatcaccagtgggtattggcttgggggtagagcagagaatgaagaaattaaggtgtgtgtgtgtgtgtgtgtgtgtgtgtgtgtgtgtgtgtgtgtgtgttaagggggattggcctggaaggatttcaacaggatagcttgtcttgcttcatagc

SEQ ID NO: 57693 - DNA, 201 bp, Homo sapiens
gaatgggtagtttctgctattctctgaaccagatgagtatcttagtatcaccagtgggtattggcttgggggtagagcagagaatgaagaaattaaggtgtgtgtgtgtgtgtgtgtgtgtgtgtgtgtgtgtgtgtgtgtgtgttaagggggattggcctggaaggatttcaacaggatagcttgtcttgcttcatagcc

SEQ ID NO: 57694 - DNA, 201 bp, Homo sapiens
atgggtagtttctgctattctctgaaccagatgagtatcttagtatcaccagtgggtattggcttgggggtagagcagagaatgaagaaattaaggtgtgtgtgtgtgtgtgtgtgtgtgtgtgtgtgtgtgtgtgtgtgtgttaagggggattggcctggaaggatttcaacaggatagcttgtcttgcttcatagccat

SEQ ID NO: 57695 - DNA, 201 bp, Homo sapiens
gggtagtttctgctattctctgaaccagatgagtatcttagtatcaccagtgggtattggcttgggggtagagcagagaatgaagaaattaaggtgtgtgtgtgtgtgtgtgtgtgtgtgtgtgtgtgtgtgtgtgtgtgttaagggggattggcctggaaggatttcaacaggatagcttgtcttgcttcatagccattc

SEQ ID NO: 57696 - DNA, 201 bp, Homo sapiens
ttctgtgtgtttgaggggctgggagccatcccctgttaactgggcatggaaggaaggccaagtctgccattaagtctctttttgagcctgtatatatttgyataaggtccattaactatattaagtggtcatagataaaccagatacttataggcaactctaataaactacatgcagctttgtagattatttgcaataaaa

SEQ ID NO: 57697 - DNA, 201 bp, Homo sapiens
aagctccagcattttctaacctcttttctaattagaagatagagttagcatataagaagctgcaagtttcaacttgacaatatctctagaactgagaacarggccaaaaatgtcaccctctgaaattgacagtaaaatagatgagattattcactgtgataatcttcccagaaaataacccacctaagaaattcttggtaa

SEQ ID NO: 57698 - DNA, 201 bp, Homo sapiens
agataatctagctgggcagcaatgggcaaaggaaactggggagaagtcagttaagtcagagaaatgctgtattatttttaaagtgtgggattttttttttwattttttttgagacagagtctcactctgttgcccaggctggagtggagtgcagtgataccattatggctaacttcagccttgacctcctgggctcaagcg

SEQ ID NO: 57699 - DNA, 201 bp, Homo sapiens
gttgtattcttccagatcattgtatatatactgtagagtttggagtcatactattcattttaatttaaaataaacttaaaaaaaacttagcaatgtattgkgactatctttctttctttcttttctttttctttttttcttttttttttttttggagacaggatcttattctgtcacccaggctggagtgtagtggcacaa

SEQ ID NO: 57700 - DNA, 201 bp, Homo sapiens
aagtgctgggattataggcgtgagccaacgtgcccagctgggcccctatcttttaataataataaatattcttcaagactttctacagactttaaatgacygccaagaatttcacagtatgaatgtacgaatttagctatttatcagtgttcgcattgtttctggtttttgtttttgtttttgtgttctgctagtgtgtca

SEQ ID NO: 57701 - DNA, 201 bp, Homo sapiens
tattcttggttgggacaccaagagccttataaactttgcttaagcacaacagagaatattcacaaagtctcttaatctcatccaattcccatgagaaggarcactgttacatagtgatgacagtggatctcaactgcatcatgaattcttcccaagagactcctgaaacatttattttatggtaaagatgccttccagcaa

SEQ ID NO: 57702 - DNA, 201 bp, Homo sapiens
gactagtgttttatttgactagagatggagggctccatctctctaatcttgaagtcctgagatatgtgcctgcttgttcaatgtcacctaaggctttttaktcagtgttgaaggatggggctgtcttatgatcacacagatatgttttattgtcttaagggcctgacaaatcagggataccttctagttaaattcctcttt

SEQ ID NO: 57703 - DNA, 201 bp, Homo sapiens
actgacctggtggctcatgcctgtaatcctagctacttgggaggtcaaagtgggaagattgcttgagcccaggagtttgaggctgcaatgagctgtgatcrtgccattgcactccagcctgggcgacagagtgagaccctgtctgtaaaacaaaacaaaactaaacaagaatagatttagtacaggaccctaaaatgtgcg

SEQ ID NO: 57704 - DNA, 201 bp, Homo sapiens
tttctgtctctctccctaaaaacatgggggtggtaatctctttgttttatctggtaggttttccagataaaagattatacaggtttggaatcttaatatcyaacccccaactccaagccctgccccaacaacaacagctaattattttacatcttgatgatggtaaatttttcatgattaaccaattttgggcacctattc

SEQ ID NO: 57705 - DNA, 201 bp, Homo sapiens
tgtcttatgatcacacagatatgttttattgtcttaagggcctgacaaatcagggataccttctagttaaattcctctttaagggcctgaagtctccttaktactcagcatgcagttcagatgtttccctttctcctgggaaacaaataggattctcaaattgtgactttgttaattgttcttaagcaaattgcattaaaa

SEQ ID NO: 57706 - DNA, 201 bp, Homo sapiens
cgagaacatggtgtccgagagtaacagtgagactgtgcacacatgtagtgttcacaacccatgcagtgttctcacacatatgatcacatggaactctcccrtcacctctgtattattatgccccttttgcagataagggaaatagaaactcatgcatttaagtgatttgccccaaatcacaaaacctagaaatggcagagc

SEQ ID NO: 57707 - DNA, 201 bp, Homo sapiens
tgaggaagctgagctctagagagattaagagattgactgaagttcccctagctagtaagtgacacagacaggatggcaaatagcgggaaaggagaatacayagggacctttgtgactcagacatgccaggataagaaataggtttcatttgttgggctaactccatttgattgaaaatgactctctgtatcaccatattga

SEQ ID NO: 57708 - DNA, 201 bp, Homo sapiens
gagtttctgtggataatgctccaaggttggctccacagaaactggcacttttggaccccagggtgaggaaaaggatcttgtaggaagagataagttgagaygaagaagaagaccagggttgttgctctgattctgatgtaaaataacatgagctaccagctagcagtgtgatcttgggaaagttacccccctcttctaggc

SEQ ID NO: 57709 - DNA, 201 bp, Homo sapiens
caaatcaagagttattcgacctgctataaaggcaaaactcttacttgaaatcttttttgataggaaaaaagggatgtttttcaagttgagttccctggatragaagtggagttagtggggctgtgaggagcccctaacttctattcaattggcaaaacctccccttccacttcatagagaggagtctgagggattgaaggg

SEQ ID NO: 57710 - DNA, 201 bp, Homo sapiens
tcatcatttatgaattgaatactttccatgcagaaggtattgcatataaaatcagcttctggctctgagttatttgcactttttcttcagagacaggcacrgttggtggtgagctagattcatgagcccttggattagtatccaggttggcacacactgtgctgatgctctagctggaccctaacattgatgaggtcagtg

SEQ ID NO: 57711 - DNA, 201 bp, Homo sapiens
ataaaatacttcttgagcacttactatgtgtcatacattgtgctaatctttaggataacatatatatatatatatatatatatatatatatatatatatawataaataaataaaatgctggatccttctttcaatgaccttatttgtagtagaatacaaatgatacaccatgtactaagagcggtgccattacgggtatag

SEQ ID NO: 57712 - DNA, 201 bp, Homo sapiens
aaaagaattttctctctctcattgacttgttttataaaatcagagatatgatctcatggaagaaaatcttccaattgatttgacaaaaatgcttagttaargaatgagtagatgatgtgtttgttttattccacaactaaattgtaagttcttaaagggaagggagctagattcctatttttgtagattacaaagattcag

SEQ ID NO: 57713 - DNA, 201 bp, Homo sapiens
acagagacaggcctaaagaacttcactttctttttcttttcttttttttctaacataaaaggctgggcaattattcaggcattgcccatgccactcctgamcttgtgcaattgtccagaaagtccctgagcccagagctgggtgcaggctgtgcctacagcaaagtccttgggggtaaccggtagcctgtgggggaggggt

SEQ ID NO: 57714 - DNA, 201 bp, Homo sapiens
tttctaagggtttatatgcttcacatagtttaagccatgtatgtatttttattatgaatcctaccaatgtctaacactacttaataaaccctaataatatmcttcttaatctaatttgctagaataaatccagataaatattattttattaagtttgtctggcactcctcatattggccccattatttctatatgtggtca

SEQ ID NO: 57715 - DNA, 201 bp, Homo sapiens
ctctgtctctgctgtctttcctctggagtgggaggcttttcctcctcttgcccttggacatcaggctccaggttctttggcttttggactctgggacttgyaccagtgacctcccagggctctcaggcctttggccccagactgggggctgcacggtcagcttccctggttctgagttccctggttctctttagcttacag

SEQ ID NO: 57716 - DNA, 201 bp, Homo sapiens
gtgttaagcatttaaaaaatatacttattgtgtatttgtatgtctccttttgagaaatgtctattccgattctttgcccacttttaatataattatttgtytttttttggtattgagttgagtttcttgtatattttagatattagtcccttgtcaaatgaatagtttgcaaatattttcttttgttatttttgagaaagc

SEQ ID NO: 57717 - DNA, 201 bp, Homo sapiens
ccaggggcctggccagcttgggggtggagtgtagctgattgtttatccgcttctgactctggccaccgcagagaacaaagctgcctggctgtgggaggtgkcacaacagctgggagcagcagataacagctggaggtggcagatacaaaggctggcaaccacaggcactacagctggaggtggcaatcacaacagccagag

SEQ ID NO: 57718 - DNA, 201 bp, Homo sapiens
ggagtgcagatacccctttgatacactgatttcctttcctttggataaatacccagtagtggaattgctggattgcatggtaggtctactttaagtttttygagaaatcttcatactcttatcgtagtaactatgctaacttacattcccgccaacagtgtataacagttccccttctccacatccttgtcagcatttgtt

SEQ ID NO: 57719 - DNA, 201 bp, Homo sapiens
aatccttgtatacagtatattcctatttccttagtctaaactttgagaagtagacttgctgagtcaaagagttctgacgcatattgccaaatttttctacrggctgaattaatgtccacttctaccaaaaataaatgcctttgttaacactgggtctcaaaaacaatttcaaaaatgtttgtcaaatcaatagggaaaatg

SEQ ID NO: 57720 - DNA, 201 bp, Homo sapiens
ctcctgaccttgtgcaattgtccagaaagtccctgagcccagagctgggtgcaggctgtgcctacagcaaagtccttgggggtaaccggtagcctgtgggrgaggggtactgttatgacctccttttacaactttcgcaagggcaggcaatctggatcagtggagttagctaatcataacttcctcagttattttataact

SEQ ID NO: 57721 - DNA, 201 bp, Homo sapiens
actcatgctatgatgaggacaaacacaatgttataagagctcctagtaggtacccattaggcagggttctccagagaaacagaacaaagaggatgtgtgagtgtgtgtgtgtgtgtgtgtgtgtatacacatatgtagatatagggagagaaatttatgataaggaaatggctctcatgactatggagactggcaagtcca

SEQ ID NO: 57722 - DNA, 201 bp, Homo sapiens
ctcatgctatgatgaggacaaacacaatgttataagagctcctagtaggtacccattaggcagggttctccagagaaacagaacaaagaggatgtgtgagtgtgtgtgtgtgtgtgtgtgtgtatacacatatgtagatatagggagagaaatttatgataaggaaatggctctcatgactatggagactggcaagtccaa

SEQ ID NO: 57723 - DNA, 201 bp, Homo sapiens
attaaccaattttgggcacctattccgccatatatggttttatttaattttcacagcaacacttcaaagttgatattcatattctaaatttatagatgaaygaagaggctcaaagattaaacaacttgctaataagtgatttttacccatgctttttccattatattatgttttggatttttccagagtacccaaacccag

SEQ ID NO: 57724 - DNA, 201 bp, Homo sapiens
aatgactctcagagcccctgtggggtttccagcggcctcaaaggaatcccttgatcatttccacagaccccagtaagagcattgctgaatgtctcctcctygtggacctcactatttgctgcttattctaactcttcttgttgggccagcttctgcaggggtgagggagaccctgagacctactaggtgggaggcccagat

SEQ ID NO: 57725 - DNA, 201 bp, Homo sapiens
cagttgcagaaactctgttagatagagaactaagctgatattggtttgctcatcagcaaatattattgagtgctaatctccatgatgtttcctcccatcawaattgcatgggagaacctcagggcccttctactccttctcctttcccctcatctaaaatgcttcccctctggctactggattctccttaagccgcctcat

SEQ ID NO: 57726 - DNA, 201 bp, Homo sapiens
tgggcttctgggtctagaaagaacctccgaaggtcactttgacccttgcactacccctaggcagagtgagcctacctcctttcacttcccaccctcctacyggccccactcctgctacgaactctggatcactggaaagtaaccccacagccttcttagctagggtttggagttggggatctctatcaattataagtcctt

SEQ ID NO: 57727 - DNA, 201 bp, Homo sapiens
agtttgggctcttaatttatagttctttatagatgtttgtaatttctctatatgatagtttattttggacacttgtgttgtttatgaatctattctcataktagtctagtaaatgttacacactttgcagctctagatttttccttgcttaaattgttggcaaaatctctctagttttatctttctgtgtgtttgaggggc

SEQ ID NO: 57728 - DNA, 201 bp, Homo sapiens
tgctgggcatggaaagaattagaaatagattccaaagaaatgacaaagcaagacatatgaacaaaatctagtgaaaaagaaagtgattaaagtagtcaagkttctagcaggaaacagatggtatactcaaagggccagtggacatgttttaatgaagaaattatttgcaaaggtatgggcaagtttaataaatcaacaaga

SEQ ID NO: 57729 - DNA, 201 bp, Homo sapiens
cctcccagtactttctttggtacctctgcttactgcctcttgtgatgccactagtcagaatgccttggaaaagagctgtagttctcctaatgttatggttwatagggcaggccatgtggctggctcctgcctatgttctagagtttcaaggaaagaacacctttctgtttatttggttagctggtttgttctttcttctta

SEQ ID NO: 57730 - DNA, 201 bp, Homo sapiens
tcaaccagctcctgttaaatttcctgtgaaaggaagttggatgcaatatcacaattgaccaatagatgtcactatatgccatattattgtgcatgtggccrcctgtctgaaatttgcttgaatttcttaattggggtggggtctgcagacttctgggaatcactggatctgtttgggagacacaaaagaactatgagaatt

SEQ ID NO: 57731 - DNA, 201 bp, Homo sapiens
ctgtaatattagataatctagctgggcagcaatgggcaaaggaaactggggagaagtcagttaagtcagagaaatgctgtattatttttaaagtgtgggatttttttttttattttttttgagacagagtctcactctgttgcccaggctggagtggagtgcagtgataccattatggctaacttcagccttgacctcctg

SEQ ID NO: 57732 - DNA, 201 bp, Homo sapiens
attcgtttcagccagcatgcagttgtggcctcccacaatggcaagccctgcctcatgatccgagttgccaatatgcgcaaaagcctcctcattggctgccrggtgacaggaaaactgcttcagacccaccaaaccaaggaaggggagaacatccggctcaaccaggtcaatgtgactttccaagtagacacagcctctgac

SEQ ID NO: 57733 - DNA, 201 bp, Homo sapiens
ccatccagaggaaggcaagtttttggctcgggcggctgagaagaccgcgcggggctggagacaggtagcagtacgggggcggggcttcatgccggatgtgrtagtctgcagtcgtttcggttggcagcctggcgggtgggagatgcggcggccacctgctgcaaagaaccgaagggaaggttagaagtacgaaggcagttt

SEQ ID NO: 57734 - DNA, 201 bp, Homo sapiens
cacccccaaccctatctacaattccaacagagctgtcttttagccacctttttttgggaaggagtgggggcatggtgaggggaaggggtggggagaagaaygggtctaggagccttaagtgggcttctgggtctagaaagaacctccgaaggtcactttgacccttgcactacccctaggcagagtgagcctacctccttt

SEQ ID NO: 57735 - DNA, 201 bp, Homo sapiens
cctagcccttcctggccctgggaggtagatggaacagttatcattttcccagcaaggctctgagaggtaagatgatggtgtccaggcagctggtggcaagkctgggactagaatggaggtctctcaccgctagtttttttgtgtttttcccccaactatttgtctcttggtttcactcagatgaccccacccccaacccta

SEQ ID NO: 57736 - DNA, 201 bp, Homo sapiens
tcaagcccagagattgttctgtcttgccgtgtggggagcagttctgcaaagtgtccccggccttctcttcctggggctcgtaggaagtctgtgattgggcraccctgcttctcatgaggtgctcagtcccgctcactgccctcctctcagctctcccaccacccaaggcccaggagcccctccccagatcatgccttctgg

SEQ ID NO: 57737 - DNA, 201 bp, Homo sapiens
tagagatgaggtctcactttgttgcccaggctggtttcaaactcctaggctcaagctatcctcctgcttcagcctcccagagtgttaggattacaggtgtragccactgcacccggccaaagtttgggctcttaatttatagttctttatagatgtttgtaatttctctatatgatagtttattttggacacttgtgttgt

SEQ ID NO: 57738 - DNA, 201 bp, Homo sapiens
cctgcaccacggacggtcgctccgacggctaccgctggtgcgccaccaccgccaactacgaccgggacaagctcttcggcttctgcccgacccgaggtacytccaccctgtctaccaggttcagccccgccctctcatcatgtattggcccccaaaacgcggctcttccctcccatcagtttgtctttccactctcattgg

SEQ ID NO: 57739 - DNA, 201 bp, Homo sapiens
gagtgtccccacctctgagcctctgtttctccttcagggaaatggctcttgcaatccaagtcctcctgccagggccattgtgagggtctaagtagacaaamaaaaaaaaaaaaacaaaaaaaaaaacagtctggaagcaatttatagatgagagcgtggacggcagagagcattgtgtatgttgaagtctctgcgatatgg

SEQ ID NO: 57740 - DNA, 201 bp, Homo sapiens
accatactggctgtccaggacctttaacaaattccatgagattagagagggggtaggagtgaagggcaatggtcttgggagtgaccccagatgaattccarggtcaaagaaattaagaggatctgacactccacccccgtgttctcatctcttcccactcctcctgttatttactctgctccacccacactggctgctctt

SEQ ID NO: 57741 - DNA, 201 bp, Homo sapiens
caatgtcttgcaggatacacacctttctacttcatctcagatttcagtgtctcctccacatcctgccagagcctctctggcctggctgcccctcccctctytggcaggtttgggagaaagaggcttggagttcccccatcctagatagcgggacagattcctcatctcgtgaggctgaccctgatctgggggcctgttatt

SEQ ID NO: 57742 - DNA, 201 bp, Homo sapiens
tctggttagttacctactttccctcccccgcccggtcaatccccatcagtcaaggaggctcaagagaccatcgataacccacgaaacgtcttgtgcgtttyagaaaaatacgccccctggcggacgcagtttagcaaacgtaggggcggctgagtttctgccccctcctctccacgccctcgcgtcgctctacccagcgcc

SEQ ID NO: 57743 - DNA, 201 bp, Homo sapiens; identical to SEQ ID NO: 16760

SEQ ID NO: 57744 - DNA, 201 bp, Homo sapiens
ctccaagaagcttttcttcttctctggttagttacctactttccctcccccgcccggtcaatccccatcagtcaaggaggctcaagagaccatcgataacycacgaaacgtcttgtgcgttttagaaaaatacgccccctggcggacgcagtttagcaaacgtaggggcggctgagtttctgccccctcctctccacgccc

SEQ ID NO: 57745 - DNA, 201 bp, Homo sapiens
gaggtgggaggatctcttgagcccaggagttcgaggctgtagtgagctatgattgcaccactgcattccatcctgggccatagaggatgtcgcttaaaacraaaaagaagaagaagaaagtcctgtggtttgggaagggaggctgagtgaggaggggcctgtgtgccagaggaggcttcactgagaagcttaggggagcag

SEQ ID NO: 57746 - DNA, 201 bp, Homo sapiens
cgattctctgagggcagggggagccggccgcagggccccttccttatcgccgacaagtggcccgcgctgccccgcaagctggactcggtctttgaggagcsgctctccaagaagcttttcttcttctctggttagttacctactttccctcccccgcccggtcaatccccatcagtcaaggaggctcaagagaccatcgat

SEQ ID NO: 57747 - DNA, 201 bp, Homo sapiens
cccccacaacagcagctgcagtcagacacctctgccctcaccatgagcctctggcagcccctggtcctggtgctcctggtgctgggctgctgctttgctgyccccagacagcgccagtccacccttgtgctcttccctggagacctgagaaccaatctcaccgacaggcagctggcagaggtgggcaaacacctagtctag

SEQ ID NO: 57748 - DNA, 201 bp, Homo sapiens
gcgcctccttaaagcccccacaacagcagctgcagtcagacacctctgccctcaccatgagcctctggcagcccctggtcctggtgctcctggtgctgggytgctgctttgctgcccccagacagcgccagtccacccttgtgctcttccctggagacctgagaaccaatctcaccgacaggcagctggcagaggtgggca

SEQ ID NO: 57749 - DNA, 201 bp, Homo sapiens
cctgtctctacaaaaaaattaaagaaatagccaggcacagtgatgtgcacctgtagttccagctatgcagaaggctgagatgggaggatcgcttgagtccrggaggtccaggctgcagtgggctgataccgtctctccgaaaaagaaaaagaaaaaagactccctccatgagtgtctggagggagtcctttggccccagct

SEQ ID NO: 57750 - DNA, 201 bp, Homo sapiens
gcccagctggccgcctcttccttggtctggtgtcccaggcaccgcccacgggtctagcctcttctcaggagtgctctacagcgccccctaggccaccaagwttgtttagctccctgtcgggtcggcccctgactccttattggactcatccatctggctcatccaaggccttgggtctctccagctgactcgacggtgatg

SEQ ID NO: 57751 - DNA, 201 bp, Homo sapiens; identical to SEQ ID NO: 16755

SEQ ID NO: 57752 - DNA, 201 bp, Homo sapiens
ggcttgccctggtgcagtaccacggccaactacgacaccgacgaccggtttggcttctgccccagcgagagtgagtgagggggctcgccgagggctggggrcgcccaccacccttgatggtcctgggttctaattccagctctgccactagtgctgtgtggcctgcaattcaccctcccgcactctgggcccaattttctc

SEQ ID NO: 57753 - DNA, 201 bp, Homo sapiens
cttatgcctgcctgtctcctgcagagaaagcctatttctgccaggaccgcttctactggcgcgtgagttcccggagtgagttgaaccaggtggaccaagtrggctacgtgacctatgacatcctgcagtgccctgaggactagggctcccgtcctgctttggcagtgccatgtaaatccccactgggaccaaccctgggga

SEQ ID NO: 57754 - DNA, 201 bp, Homo sapiens
ttcgacgtgaaggcgcagatggtggatccccggagcgccagcgaggtggaccggatgttccccggggtgcctttggacacgcacgacgtcttccagtaccraggtgagggctgaggaggatcccttcgtgagacaccacactaagctcctcttagtgagtggtcaaattctgagcgaggaagaaaaagcccttggaaatgg

SEQ ID NO: 57755 - DNA, 201 bp, Homo sapiens
gatgaaacgagaggcttatagagaacttattacggtgcttgacacagtaaatctcaaaaaatgcattattattattatggttcagaggtaaagtgacttgyccaaggtcacatagctggaaaatggcagagccgggatggaaatccaggacttcgtgactgcaaagcagatgttcattggttagtgaactttagaacttca

SEQ ID NO: 57756 - DNA, 201 bp, Homo sapiens
atccaggggtgagaaggagctgaggatgtctaaggaggggagatccctgggtggtcagaaagcactggtgtctggaaagcatttaatgctttattaaatgytagtccctgctgggcatgacggctcacacttgtaatcccagcactttgggaggctgaggtggtaggatcgctgaagctcaggagtttgagcccagcctag

SEQ ID NO: 57757 - DNA, 201 bp, Homo sapiens
tgtaccagcgagggccgcggagatgggcgcctctggtgcgctaccacctcgaactttgacagcgacaagaagtggggcttctgcccggaccaaggtaggcrtggtcccgcggctccggggctggggttcccggcagtggtggtggtggggtggccagggctgggggctcggcccggcgctcacgtctcaggctccctctcc

SEQ ID NO: 57758 - DNA, 201 bp, Homo sapiens
gacagtgcacagggccagggcgccaggctgggagagcttcgcgcaggcgggatttcagcccgcacttatttcggagcccttgccttgggcagcgcacaatytgcgcagcagtactcggctaaccctcttcctctcgacctgtttcttcagagcacggagacgggtatcccttcgacgggaaggacgggctcctggcacacg

SEQ ID NO: 57759 - DNA, 201 bp, Homo sapiens
cagacagtgcacagggccagggcgccaggctgggagagcttcgcgcaggcgggatttcagcccgcacttatttcggagcccttgccttgggcagcgcacartctgcgcagcagtactcggctaaccctcttcctctcgacctgtttcttcagagcacggagacgggtatcccttcgacgggaaggacgggctcctggcaca

SEQ ID NO: 57760 - DNA, 201 bp, Homo sapiens
tggacttcctttttgcgagagccagtgacctgatcttagcacgggattgggagtcagaaggcctaggcagctggtcactcaccagctgtgtgaccgtgagmaacttaaagcacttctctgagccatgggtatgaacgttaatttgcaaagttgagatgagagcattagagtaatagaatcataatagctaaactgtgtgtg

SEQ ID NO: 57761 - DNA, 201 bp, Homo sapiens
agatggttgtcaagatcttgttcctatttctgtatatgtgggagaattagaatcactcctcttatgcctgcctgtctcctgcagagaaagcctatttctgycaggaccgcttctactggcgcgtgagttcccggagtgagttgaaccaggtggaccaagtgggctacgtgacctatgacatcctgcagtgccctgaggact

SEQ ID NO: 57762 - DNA, 201 bp, Homo sapiens; identical to SEQ ID NO: 16769

SEQ ID NO: 57763 - DNA, 201 bp, Homo sapiens
tgctaggctctgtggcagtgctttgggcactgaggtctgtgccctccagcatctcacagaacctcacagcatctcacaggttggggggatggaggtgatakgtgaaaaccttagaaagttctagaaatggcagaagagatggttgtcaagatcttgttcctatttctgtatatgtgggagaattagaatcactcctcttat

SEQ ID NO: 57764 - DNA, 201 bp, Homo sapiens
ccaaccctggggaaggagccagtttgccggatacaaactggtattctgttctggaggaaagggaggagtggaggtgggctgggccctctcttctcaccttygttttttgttggagtgtttctaataaacttggattctctaacctttagaagcagactttatttatatatgtatgcacgtatgtatgcatgtatgtattta

SEQ ID NO: 57765 - DNA, 201 bp, Homo sapiens
ggacgggctcctggcacacgcctttcctcctggccccggcattcagggagacgcccatttcgacgatgacgagttgtggtccctgggcaagggcgtcggtkagattctgagtcctcctggcccctgattcccttcattctctcccactcatcacccgccgccctaactccggtcccccctcctcctgcagtggttccaact

SEQ ID NO: 57766 - DNA, 201 bp, Homo sapiens
gcagcgcacaatctgcgcagcagtactcggctaaccctcttcctctcgacctgtttcttcagagcacggagacgggtatcccttcgacgggaaggacgggytcctggcacacgcctttcctcctggccccggcattcagggagacgcccatttcgacgatgacgagttgtggtccctgggcaagggcgtcggtgagattct

SEQ ID NO: 57767 - DNA, 201 bp, Homo sapiens
ctttccactctcattggtcctcaggacgaccgtgactccgcccacctacaccacatttccaccactatccctgacttccaatggccccgccccagccactraggttcggccttttctgcccagctggccgcctcttccttggtctggtgtcccaggcaccgcccacgggtctagcctcttctcaggagtgctctacagcgc

SEQ ID NO: 57768 - DNA, 201 bp, Homo sapiens
gccgccctaactccggtcccccctcctcctgcagtggttccaactcggtttggaaacgcagatggcgcggcctgccacttccccttcatcttcgagggccrctcctactctgcctgcaccaccgacggtcgctccgacggcttgccctggtgcagtaccacggccaactacgacaccgacgaccggtttggcttctgcccc

SEQ ID NO: 57769 - DNA, 201 bp, Homo sapiens
gcagtaccacggccaactacgacaccgacgaccggtttggcttctgccccagcgagagtgagtgagggggctcgccgagggctgggggcgcccaccacccytgatggtcctgggttctaattccagctctgccactagtgctgtgtggcctgcaattcaccctcccgcactctgggcccaattttctcatctgagaaatga

SEQ ID NO: 57770 - DNA, 201 bp, Homo sapiens
ccaaaccgacgtgaccctcctcccctgcagggcgccaggtgtgggtgtacacaggcgcgtcggtgctgggcccgaggcgtctggacaagctgggcctgggmgccgacgtggcccaggtgaccggggccctccggagtggcagggggaagatgctgctgttcagcgggcggcgcctctggaggtgagcgccgccgcggccgc

SEQ ID NO: 57771 - DNA, 201 bp, Homo sapiens
atccatgggtcaaagaacaggacacacttgggggttataatgtgctgtctccgccttctccccctttcccacatcctcctcgccccaggactctacacccrggacggcaatgctgatgggaaaccctgccagtttccattcatcttccaaggccaatcctactccgcctgcaccacggacggtcgctccgacggctaccgc

SEQ ID NO: 57772 - DNA, 201 bp, Homo sapiens; identical to SEQ ID NO: 16759

SEQ ID NO: 57773 - DNA, 201 bp, Homo sapiens
actagggctcccgtcctgctttggcagtgccatgtaaatccccactgggaccaaccctggggaaggagccagtttgccggatacaaactggtattctgttytggaggaaagggaggagtggaggtgggctgggccctctcttctcacctttgttttttgttggagtgtttctaataaacttggattctctaacctttagaa

SEQ ID NO: 57774 - DNA, 201 bp, Homo sapiens
actactcggaagacttgccgcgggcggtgattgacgacgcctttgcccgcgccttcgcactgtggagcgcggtgacgccgctcaccttcactcgcgtgtasagccgggacgcagacatcgtcatccagtttggtgtcgcgggtgagaacgtgaggagggaaaatccaagagacctgggcggggtcagggaagggaggacca

SEQ ID NO: 57775 - DNA, 201 bp, Homo sapiens
tgtattgtcctttttatttattgctttgttcagttttctagtttttggttggatttttttgtttatgttcataaggaatatcagtcttttttttttttttktggggggggtctgtctttggttttggaatcagagtgagccacataaaatgagttgagtactcttccctcctgttttcttaaaatagttttataggacatc

SEQ ID NO: 57776 - DNA, 201 bp, Homo sapiens
gccttctgggctgaagcgatcctcccacctcaaccacctgagtagttgggactacaggttcacgccaatatgctgggctaattttttttttttttttttttagagatggggttttgccgtgttgcccaggctggtctcaaactcctgggttgaaacgatccacctgcctcagcctcccacagtgctgggattacagatgtg

SEQ ID NO: 57777 - DNA, 201 bp, Homo sapiens
tcatctttaagtatgatgttaactggagtttgtagttgcattttatcgggttaaggaagttcctgtctcttcctagtttgctgagaattttatcatgagtrggtgctgaaatttgttagatgctttttctgtacctaatgagatgattttgtggcttttctcccctttgaatgcggtgaattacattgatgattttagaat

SEQ ID NO: 57778 - DNA, 201 bp, Homo sapiens
gcatctgaccctaaaccaaacttcacagactgtaataggcatacacaagtgtgcattaatggggtaagcatttaactatatgttttaaaatttaattttaraaaacttgtttttcagaagaattattgatgcttaaagctacatagttaaagtaattaatcttggtctctgtttaagtaatattccctcacaaaaccatga

SEQ ID NO: 57779 - DNA, 201 bp, Homo sapiens
ataaaagtggcaagtgtgaatatctttaccttcttcccaatcttaggagagaagcattcagtctttcatctttaagtatgatgttaactggagtttgtagwtgcattttatcgggttaaggaagttcctgtctcttcctagtttgctgagaattttatcatgagtaggtgctgaaatttgttagatgctttttctgtacct

SEQ ID NO: 57780 - DNA, 201 bp, Homo sapiens
tttcttggcttgttgtggtatctgtaacatcatacttaatgttacagagttgcataaaagtggcaagtgtgaatatctttaccttcttcccaatcttaggrgagaagcattcagtctttcatctttaagtatgatgttaactggagtttgtagttgcattttatcgggttaaggaagttcctgtctcttcctagtttgctg

SEQ ID NO: 57781 - DNA, 201 bp, Homo sapiens
gttatctctcctcatctgtcaaattaattcacagacctttaaaactttcctccgctaggaagtcagttccttcccatgtctgcctgttgaaatcttgatcygtgttgttatatgatgtaaatgaatatggcccttaataaaaattaagaaaatatgaccatcatagttttatttataataccaaaaagttttaagcagcgt

SEQ ID NO: 57782 - DNA, 201 bp, Homo sapiens
ccgtgttgttatatgatgtaaatgaatatggcccttaataaaaattaagaaaatatgaccatcatagttttatttataataccaaaaagttttaagcagcstagatggccctacagtatgaaaataccacggaatgctctgcagtcatttaaataccaagttttgcagtgctcattttatactgttaagctgaaagaaagg

SEQ ID NO: 57783 - DNA, 201 bp, Homo sapiens; identical to SEQ ID NO: 5714

SEQ ID NO: 57784 - DNA, 201 bp, Homo sapiens
tttcctttctaaaactctaatgctgagaataattctagtgctacacctttttcagaaactgagttgaattttataggttgaaaacataaagcaagataatrttggtgaatagtatagagttgctaaatgctgcatctagattcagaagaaaggcaagaggtatcaggaagaataaaggtgatagtagaggacacatttttt

SEQ ID NO: 57785 - DNA, 201 bp, Homo sapiens; identical to SEQ ID NO: 5715

SEQ ID NO: 57786 - DNA, 201 bp, Homo sapiens
tcataacatgtaatttaacatatgtgttagagactatttagtagttttaaagtagtttattttactgttactagttttaaaagtatgtgagcttatttttratagacttttatgacagtctgtcctcaattctagtccctgcttacaaagctataaattgttatggctagacctccactgattttccttcttttctaagac

SEQ ID NO: 57787 - DNA, 201 bp, Homo sapiens; identical to SEQ ID NO: 5716

SEQ ID NO: 57788 - DNA, 201 bp, Homo sapiens
atacaaaaaattagccgggcgtggtggcaggtgcctgtagtctccagttactcgggaggctgaggcgggagaatggcgtgaactcaggaagtggagcttgyggtgagccgagattgtgccattgaactgcagtctgggtgacagagcgagactctgtctcaaaaaaaaaaaaaataaaataaaataaaataaaataaaata

SEQ ID NO: 57789 - DNA, 201 bp, Homo sapiens; identical to SEQ ID NO: 5709

SEQ ID NO: 57790 - DNA, 201 bp, Homo sapiens
gagcttatttttgatagacttttatgacagtctgtcctcaattctagtccctgcttacaaagctataaattgttatggctagacctccactgattttcctycttttctaagacagtgacccctaaaagagcaaattcttttcctactcaaggtgtaaaacaattgtaagatcctttttaaaggagagtccacaagcttcca

SEQ ID NO: 57791 - DNA, 201 bp, Homo sapiens
tttcaaataaattagctgtctgtcagagaaaagctcaataatatttgttaaaggaggacactaagtccagttactcagcagtataacattcagtgttcagyattcaaagaacattactagatgacaagaaactgaaaaacgtgattcataataaggagaaaagccacctaaatagaaacacaacgtctgttaattacagat

SEQ ID NO: 57792 - DNA, 201 bp, Homo sapiens; identical to SEQ ID NO: 5710

SEQ ID NO: 57793 - DNA, 201 bp, Homo sapiens
agtagagacggggtttcaccgtgttagccaggatggtctcaatctcttgaccttgtgatctgtccgcctcggcctcccaaagtgctgggattatagacatragccaccgtgcctggcctgattctttgtatttttttagtctcaattttgtttatttctgctctgatcttcattatttcttttcttctactaatttggggt

SEQ ID NO: 57794 - DNA, 201 bp, Homo sapiens
ctgtgcaccaataagaacctgctttagattttcatgctggcttacagctctcatactgtttcaggcaaagttagtggttattgaaaataccaccaggatgrgctgtctgtccgtctgtctgtccttccatccatctgtatttttttttctttatgctctctcatcaactgactgtcaaggatgggctatctagagacacat

SEQ ID NO: 57795 - DNA, 201 bp, Homo sapiens; identical to SEQ ID NO: 5711

SEQ ID NO: 57796 - DNA, 201 bp, Homo sapiens
ccgcctcggcctcccaaagtgctgggattatagacataagccaccgtgcctggcctgattctttgtatttttttagtctcaattttgtttatttctgctcygatcttcattatttcttttcttctactaatttggggtttggttcgttcttgctttttcctgattcgttgaggtgcattgttaggttgtttatctttctac

SEQ ID NO: 57797 - DNA, 201 bp, Homo sapiens
gcctcccaaagtgctggcattacaaaatgagccactgtgcctggccctcttttcacagtttttgacttaaaatctgttttatctgatacaggtatagctastcttgcttactttgtttctggttgagtgaaatatcttcttctgttcctttacttttagtctatatatgtctttagaggtaaaatgattttcttgtaagca

SEQ ID NO: 57798 - DNA, 201 bp, Homo sapiens
atttgcattatgcttacgatttcctaatgtgaaaatctaaagtgcttcaatgagtttttttttttgtttgtttgtttgttttgtttttgtttttgtttttktttttttttacagagcctcgttctgttgcttacgctggagtacagtggcacggtcttggctcgccgcagcctccgcctcctgggttcaagcggttcttct

SEQ ID NO: 57799 - DNA, 201 bp, Homo sapiens
gggaatatttgcattatgcttacgatttcctaatgtgaaaatctaaagtgcttcaatgagtttttttttttgtttgtttgtttgttttgtttttgtttttktttttgtttttttttacagagcctcgttctgttgcttacgctggagtacagtggcacggtcttggctcgccgcagcctccgcctcctgggttcaagcggt

SEQ ID NO: 57800 - DNA, 201 bp, Homo sapiens
ttggatctttaaattttccgattttgggaatatttgcattatgcttacgatttcctaatgtgaaaatctaaagtgcttcaatgagtttttttttttgtttktttgtttgttttgtttttgtttttgtttttgtttttttttacagagcctcgttctgttgcttacgctggagtacagtggcacggtcttggctcgccgcag

SEQ ID NO: 57801 - DNA, 201 bp, Homo sapiens
tgttttggatctttaaattttccgattttgggaatatttgcattatgcttacgatttcctaatgtgaaaatctaaagtgcttcaatgagtttttttttttktttgtttgtttgttttgtttttgtttttgtttttgtttttttttacagagcctcgttctgttgcttacgctggagtacagtggcacggtcttggctcgcc

SEQ ID NO: 57802 - DNA, 201 bp, Homo sapiens
ttgttgttgagacggggctttgctatgttgcccaggctggtctctaattcctgggtttaagcgatctgcccgcctcggccccccaaagtgttaggattacwggtgtgagccactgcacctggcccctcccatatactttaaaccatctccagatttcttataatacttaatataatgccagcacttcatttgtgtggattc

SEQ ID NO: 57803 - DNA, 201 bp, Homo sapiens
gcctgagagacattgatcctctccacgccagcctccaacttgagctgctccaccaggcactgcagggcgctcgcgctagccccagaggacatggtggcggygctgggctccgagggcccagccttgtttttaagctttattaggataggtttgaagtagcctttattctaggaatagtttgttcctatttccaaggagtgg

SEQ ID NO: 57804 - DNA, 201 bp, Homo sapiens
gttgtttgtctttcaatggttgtcttattattgatttgtaagaggtttttaaaaagatattccgaatataagttctttgtcagaccatatgtattgcaaawgttttctcccagactgtggcttgcctttttttttttttttaaagctatttctcagcggaagttttgaatttttaagaagcccttttaatgaaaaaatttt

SEQ ID NO: 57805 - DNA, 201 bp, Homo sapiens
ctagcaaagggtatgtgataatatattattctagttctgatttacatttctttgttgactaatgatgttatgtaggtttccatatgcttgtttgccacctrtgtatcttctttgtgaagtattttttcacattgttgtttgtctttcaatggttgtcttattattgatttgtaagaggtttttaaaaagatattccgaata

SEQ ID NO: 57806 - DNA, 201 bp, Homo sapiens
tgtttagtacagacggggtttcaaacatgctggccaggctggtcttgaactcctcaccttcagtgatctgcctgtctcggcctcccagagtgctgggattrtaggcatgagccactgtgcctggcctggtttttatatgtttgactttgtaagaaagtgctaaacagttttccaaagtgatgttgtcattttccattccca

SEQ ID NO: 57807 - DNA, 201 bp, Homo sapiens
tgttggatcatatggtatttctgtgtgttttttttttttttttttttgagggaataccaaattgttttcctggaatacagtgatcattataaggcaatatrtactgcagtttttctgactgttgagtcgaagtctaaacaattaaagaatctggttgttttcagatagctttttattgagggcttgttaaaaaactaaaaa

SEQ ID NO: 57808 - DNA, 201 bp, Homo sapiens
tttgactgttccagaattacatatcaatggaattagactctgcattcttttgtgtcttaacaaaagtgcgtgttttcaatagttggcttttttttttttttaatttctgagtagtttgccattatatgaatacatctttctctttacttgttgatagacatttaggttatgttcagtttttggctattataaataaagctg

SEQ ID NO: 57809 - DNA, 201 bp, Homo sapiens
gtataaggcacatgtgatgtgttacattacagataaaatgctatagatattcaaaggagggagaacttcttgctgaggcactaaaaaaggacctgaaaccrggaaatctcatgtaatgtggtctcatttatacaggtcattttagggtactttttttttttttttgagacagagtcttgctctgttgcctgggctggagtg

SEQ ID NO: 57810 - DNA, 201 bp, Homo sapiens
ccggctaatttttgcatttttagtagagatgggggtttccccttgttccccaggctggtctcgaactcctgacctcaggtgatctactggccttagcctcycagagtgctgggattacaggcgtgagctactgtgcctggctgagctttttttcccccccccaaagtttatagccctagaatttcttttcttttctttttc

SEQ ID NO: 57811 - DNA, 201 bp, Homo sapiens
gttatttggcaagaggaatgtgagtacagcctcaaactaaaagggtgccaagactgacgtgaaatgaaggaaaagagaaaatagacaatgtttaaaaatgkacacagttttcaagctagtaaatgtatgctactgacccctacttacataaaatatattcatgttaggtatatagttagaggtgcattttggcaaatgtat

SEQ ID NO: 57812 - DNA, 201 bp, Homo sapiens
tttatgtatactcttctcttaaattagccagaccctaaaagtgcagaaaaatgtatattatcagagatttaaaaatatgcctatttactttttttttttttaactgataaagatttgaagtgtggagtcttctatgcttaattcaagtttgacagtactgcattggaccaatttgcacatgacaaatcttcactaaggcag

SEQ ID NO: 57813 - DNA, 201 bp, Homo sapiens
taaccactactaaatctgggctttctgtctccaatctgcctctcttactgccatagcgtgtactcgtatggctctttatttaaatctataggccaggtacrgtagcttatacctttaatcttagcactttgggaggttgaggagggaaaattgctggagactagcagttgaagaccaacctggacaatctagcaagacctg

SEQ ID NO: 57814 - DNA, 201 bp, Homo sapiens
tattcactgaattcttaagccacaggatttttgtttctctttaatgatatttattacttttttgaatttctcattcatatgaattgttttcctagtttcaytgaattttttatctatattttcttgtgtcttttccctcaaatcattattttgaattcctttttaggcaatttattgatttccttttctttgggacctgtt

SEQ ID NO: 57815 - DNA, 201 bp, Homo sapiens
aacacaagagtataaaatttgcctcaaactattattttctcctaaattttaagtgtaaaactttgacctacagtttggccagataatttccagctaaatcygtcctcttgaggagattataaatgtaacgtagcattgtgtctctattattatggtctctacaatgttttaaaaatgataaactagacaaaacgttgccag

SEQ ID NO: 57816 - DNA, 201 bp, Homo sapiens
tcctgggttcaagtgattttcctgcctcagccacccaagtagctgggactacaggtgtgtaccaccatgcctggctaatttttgtatttttagtagagacrgggtttcaccatgttggtcaggctggtctcgaacccctgacctcaggtgatctgccctcctcaacctcccaaagtgctggaattacaggcatgagccacc

SEQ ID NO: 57817 - DNA, 201 bp, Homo sapiens
gtcagtatgagatgattttcttattatgaaatcgatattggccaggtgcggtggctcacacatgtaatcccagcactttcccaggctgaagtgggtggatyacctgaggtcaggagttcgagactagcctggctaacatggtgaaaccgcatctgtacaaaagtacaaaaattagctggtcatgatggcagatgcctgtaa

SEQ ID NO: 57818 - DNA, 201 bp, Homo sapiens
gcgttacccagcctaactagagaaggtctgtataacatgttatggtaatgatttcagttttttttccctctttgtatttgcacaactggaaatctgatctkcaacttatatttgaatctgaccttcagcttatatttggcatttcttttccagtggacccatcaacttgtgccagtacagggtctgtgcagtggagtaggc

SEQ ID NO: 57819 - DNA, 201 bp, Homo sapiens
tgttagccagattttaatgtgaatttgaatatattggatttctaaaacaagaatgagaagcaacagccttagtgtaatattatttttatatatatatatawaatgtaatgaaaaactaaagatattctattaaagtcagggacaaagtgaacatgcctacacttgttattcagcatggtttggtactcctagttagtgtag

SEQ ID NO: 57820 - DNA, 201 bp, Homo sapiens
agccactgtgcccagcctgtatattctttgttcctttctttttctcttattgtttatcattgtggtttggtggttttctttagtggtaacatttgacttcyttttctcatttgtgtatctgctctaccagttagctttatatttctgtgtgttttcatgatggtgatcatcatctttttgcttccagatgcagaattcctt

SEQ ID NO: 57821 - DNA, 201 bp, Homo sapiens
ggagatctacctaggtttcaaaccaaatacttgagcagttgacttaacttaggtttccttaaaacatgttactctttttttaaattcctgtgcttgttgcrtggtaagttctagtaaatacctgtcaaactgaagttgtcttctggtaccatggtgcagtggaaagagcacatgtttgagaatcacgtaaggattcaaata

SEQ ID NO: 57822 - DNA, 201 bp, Homo sapiens
gacagctttggagatggattggcactgatgcttataaattggttcggaaatcagaatttaattttggcaagaatttataaaatttaagaatttattttttkaaaatatttatttatttatttatttatttttttgagacggagtctcgctctgtcaccccggctggagtgcagtggtgctatctcggctcactgccagctc

SEQ ID NO: 57823 - DNA, 201 bp, Homo sapiens
aaaaacttctgctttatccagagtaagagaagcttttgtattcctattcttattagtttattctttgatttgttttgtatattttaagatcttaagtagtrctgtattttcctttgtatttctttctccttttttaaaagtcagtatcttaagtcaatacttttacaatttccatagcttcttttgtttttcttctatgtt

SEQ ID NO: 57824 - DNA, 201 bp, Homo sapiens
gtgattgcccaggtatttatgattatgcgctattttagtagttcccatattgttttataatgcctattctttcctttaaaaatttaagttagtgtattctstttttgggaaaaagtatgtgttttcagttgtgatgtgataaaatgtgtaagataagtacatggataactgaaagaccagttgggatattttagtgtcaaa

SEQ ID NO: 57825 - DNA, 201 bp, Homo sapiens
ggaaatgtacggttgttgtcagagtaactgaaggggctctactggcatttgatggttgggggccagggatgctaaactttctgcattactcaaaatggtcrtgtactgctttgacagactgagggtggccttctaccctgtcttgcgataagtagcaggtctgttatttgaggatgaataaaaacaaaaaacaataggagt

SEQ ID NO: 57826 - DNA, 201 bp, Homo sapiens
taacactttccccggagatacctatgctgttagtcgctgaaaaacagtttgaattaacaagattctgtgttcagaaaattgtaaaatgctagatacggaamaagatttaattggataaagacttaaacatccataaacacaatttccagtctcagtgatagtagttgaaagaacttgttagttgaacacatagtgagtagt

SEQ ID NO: 57827 - DNA, 201 bp, Homo sapiens
caacctccagggttcaaacagtcctcccatctcggcctcccgagtacctgggactacaagtgcataccactgcactggctatttgatttttatttttaatyaattaattaattaatttttttgagacagagtcttgccctgtctcccaggctggagtgcagtggcgccatctcgactcactgcaacctccgcctcctaggt

SEQ ID NO: 57828 - DNA, 201 bp, Homo sapiens
atgtattctcattaggttgcagatagatcgtgtcctagagctaaatcatgagtactctggttttatactaatatactagattattggtattaaacatactstaaaatgtccaactgtaatattttctacaggaatagaaattgtgaattaagaaaaagtgttggccagacacagtggcttacgcctgtaatcccggcactt

SEQ ID NO: 57829 - DNA, 201 bp, Homo sapiens
taaaagtggaattgttggggtaaaggttttttgagggacattgataaaaattatggtactgtctcccagatagatgtaccaagttatactaccacgatttwatatatatatatatatatattaaatcagagtcccatccttagaaatccacatatatgcagccacatgaatgtattagaaacaataatagaagactcatgc

SEQ ID NO: 57830 - DNA, 201 bp, Homo sapiens
cccataagtcttatagactttcttcctttttttttccttcccctaaatgagtaatttcaaacattctatcttgaagttcagagattttcttttgcttgatsaagtctgctgttgaagctgtctattatatatttttattttattcactgaattcttaagccacaggatttttgtttctctttaatgatatttattactttt

SEQ ID NO: 57831 - DNA, 201 bp, Homo sapiens
accacatagcatagcacttaatgaaactttaacaacaaagatataatgatattgtaaggttttcagcatatagtgaggacacagtatacatttgctagatraatgaagcagatttctcaaatgtaataatttatatggaaaagagtaaaacttgtgcatattaactttgaaactggaatgttttcaggttcctgttagtgg

SEQ ID NO: 57832 - DNA, 201 bp, Homo sapiens
tgaaactttaacaacaaagatataatgatattgtaaggttttcagcatatagtgaggacacagtatacatttgctagatgaatgaagcagatttctcaaawgtaataatttatatggaaaagagtaaaacttgtgcatattaactttgaaactggaatgttttcaggttcctgttagtggtattttatcttacttgcccag

SEQ ID NO: 57833 - DNA, 201 bp, Homo sapiens
ttgtgccagctttctgccttgagagatttatgggttgtggtactatgagagggaacctaggtagagtccagggaacttcctcagttgaagagatgaagctragggtcaggggagaccaaagtggctggagttcacagacagaatatcagggtgaagagagagctgcacagaggatccctgagatctgcagaggcttccact

SEQ ID NO: 57834 - DNA, 201 bp, Homo sapiens
ttgggactaaaggtgtacgccaccatgcttggctaatttttaaaattttttgtagagatagggttttgccacattgctcaggctggtctcaaactcctggyctcaaactcctggcctcaagtgacctgcctgtttcggcctcccaaagtgctaggattacagatgtgagccactgtgcccagcctgtatattctttgttcc

SEQ ID NO: 57835 - DNA, 201 bp, Homo sapiens
gtggggtcagtagatctgctgggagcctaggattctgcattgctaacactttccccggagatacctatgctgttagtcgctgaaaaacagtttgaattaasaagattctgtgttcagaaaattgtaaaatgctagatacggaaaaagatttaattggataaagacttaaacatccataaacacaatttccagtctcagtga

SEQ ID NO: 57836 - DNA, 201 bp, Homo sapiens
ttcttgatcagttgtctttcaggaggatgtttgtttaattttcatgtatttgtacagtttccaaagttcttgttcgtggtttctagttttattcttttgtrgtctgacttgatatgatttctatttaaaaaaatttgttgaaacgttttgtttcctaacatatggtctatcctcgagagtatttcatgtgctgatgagaag

SEQ ID NO: 57837 - DNA, 201 bp, Homo sapiens
ctttccagaacttacattctagtgggtgaagtgggatgtggacagaaattaaataatcccacaaataaatgtaaggttgcactatgtaagagacattggtrtatgattctatggagtggtataatggatgaattgaccttctcgaagtctaaggaaagaaggaagccattaacaagatcagaagaggtagtgtcagcatgt

SEQ ID NO: 57838 - DNA, 201 bp, Homo sapiens
aaatgtacggttgttgtcagagtaactgaaggggctctactggcatttgatggttgggggccagggatgctaaactttctgcattactcaaaatggtcgtrtactgctttgacagactgagggtggccttctaccctgtcttgcgataagtagcaggtctgttatttgaggatgaataaaaacaaaaaacaataggagtct

SEQ ID NO: 57839 - DNA, 201 bp, Homo sapiens
gttttttgagtgtctgttttgttgaattctgccctgtttttttttttttgtttttttgtttttttttaagttggaattttgttctgtctcccaggttggartgcagtggcatgatcatagctcattgcaagcttgaactccagggctcaagcagtccttccacctcagcctcccaagtaactagaactacagggctctggg

SEQ ID NO: 57840 - DNA, 201 bp, Homo sapiens
gataaatctggaacttcttgttgggccagaaagtaagaaagtgctcaaagaatgatgaggacatgtccaaaaaacacaataatgtcagtaattgattatakatttataaaaaataggaaaccatgagggaataaataaatgaatacattgaaagtttgatgaagaacaggatatttacatacttccaaattaggtccctac

SEQ ID NO: 57841 - DNA, 201 bp, Homo sapiens
aaagaatgatgaggacatgtccaaaaaacacaataatgtcagtaattgattatatatttataaaaaataggaaaccatgagggaataaataaatgaatacrttgaaagtttgatgaagaacaggatatttacatacttccaaattaggtccctacaaaattttcattgtctacaaaagagaaacaagaatcatggtaaaat

SEQ ID NO: 57842 - DNA, 201 bp, Homo sapiens
cttcttttgagaaatgtctgttcatgtcctttgcccactttttaatgggatttttttttaaactattgagttccttgtatattctgggtatttgtcccttstcagatgaatagtttgcaaatattttcttctattcaacaggctatttctgtttttttttcttgattagcaagtggtcattgattttatttatcttttcaa

SEQ ID NO: 57843 - DNA, 201 bp, Homo sapiens
agcctcctaagtagctgggactataggcgcgtgcactgcacccagctctcttatcgtttttagtgtttgtgctcttgaaatattttctggcacataagctwattttcccccagggtgatgcttgtggggacatacagatcccagtctgtgggaaagtcttagagtagaggattcattcatcaaataagcacagtcaagtat

SEQ ID NO: 57844 - DNA, 201 bp, Homo sapiens
ttgttttcttgagaaatctctatgctgttttgcatagtggctgtactaatttacattcctatcaacagtatagaagagttactgttgcttcacattctcgycagcatttgttatttattatctttttaataacagccattctaactgcggtaagatgatatattgtggttttgatttgcatttccctgatggtaagtaatg

SEQ ID NO: 57845 - DNA, 201 bp, Homo sapiens
ttgaaatattttctggcacataagcttattttcccccagggtgatgcttgtggggacatacagatcccagtctgtgggaaagtcttagagtagaggattcwttcatcaaataagcacagtcaagtattctccattcctgaaaacaactctttagttctggtctccaccttttacctctcagggagacatagcatgaggaag

SEQ ID NO: 57846 - DNA, 201 bp, Homo sapiens
tgcaggtatcctgttgacatactgatttcttttcctttggataaacacccagtagcaggattgccggatcatgtggtaattctatttttgttttcttgagmaatctctatgctgttttgcatagtggctgtactaatttacattcctatcaacagtatagaagagttactgttgcttcacattctcgccagcatttgttat

SEQ ID NO: 57847 - DNA, 201 bp, Homo sapiens
tagttctggtctccaccttttacctctcagggagacatagcatgaggaagaaccctctttagatgagctgtgggcattggaaggagaaaaggacaggaaakaaacccttcgtattgtttagttccctctgtttatccctccccttctccaaggtattcgtagctattctctacaggtgtgaggacagacattgtctcaggg

SEQ ID NO: 57848 - DNA, 201 bp, Homo sapiens
gtattcttcgaaactgtctataccactgtaaggatatttactttttaaaaaggtggaatcatatacactttgctgtactttatcgtgtgctcaagtttttscttttgctttttttcctctctcctacatagtggtctatcttggaaatctttggtgggaagcattcgaagaagggtttgacatgaaggagtaacatggtca

SEQ ID NO: 57849 - DNA, 201 bp, Homo sapiens
atattttacatttactaccctagttagtattcctttccctgattttatagtatatttaaaggggatagcatgtaatttagcatttaactcattctttttttaaaaaggaaaactataaaggtggccgtacttactaatattttcagatgcactatttattttgtttagtttttcttactgtcttttgtctattgccatgtt

SEQ ID NO: 57850 - DNA, 201 bp, Homo sapiens
ttgtatttttgtattgctaatttatcaagagtcaaacacattctcattttaaaattagtttctgctgtcatattttgctataattttatgcatctaagtaktaagtatctggtattctttatgaatgaaagatttagagcactgtttcccaaatgcttaacagaacactagttccattagatgttctgggccttcaatggt

SEQ ID NO: 57851 - DNA, 201 bp, Homo sapiens
taaataggttttcttttttttttctttcttttttctttctttttattttgagacagagtcttaacttcatcacccaggctggagtgcagtggtacagtttsagctcactgcaacctctgccttccaagttcaagtgattcttgtgcctcaacctcctgagtagctggtattacaggtgcgtgccaccatgcccagctagtt

SEQ ID NO: 57852 - DNA, 201 bp, Homo sapiens
ggctggtctcgaactcctgacctcaggtgatctactggccttagcctctcagagtgctgggattacaggcgtgagctactgtgcctggctgagcttttttycccccccccaaagtttatagccctagaatttcttttcttttctttttctttttatcttttcttttcttttttttttttttttgagatggagtctcactct

SEQ ID NO: 57853 - DNA, 201 bp, Homo sapiens
tgacttttgacaatttgactataaatcctcaaggaagacttccattttcagctattattttaataaataggttttcttttttttttctttcttttttctttctttttattttgagacagagtcttaacttcatcacccaggctggagtgcagtggtacagtttgagctcactgcaacctctgccttccaagttcaagtgat

SEQ ID NO: 57854 - DNA, 201 bp, Homo sapiens
ttgacttttgacaatttgactataaatcctcaaggaagacttccattttcagctattattttaataaataggttttcttttttttttctttcttttttctttctttttattttgagacagagtcttaacttcatcacccaggctggagtgcagtggtacagtttgagctcactgcaacctctgccttccaagttcaagtga

SEQ ID NO: 57855 - DNA, 201 bp, Homo sapiens
cttgacttttgacaatttgactataaatcctcaaggaagacttccattttcagctattattttaataaataggttttcttttttttttctttcttttttctttctttttattttgagacagagtcttaacttcatcacccaggctggagtgcagtggtacagtttgagctcactgcaacctctgccttccaagttcaagtg

SEQ ID NO: 57856 - DNA, 201 bp, Homo sapiens
ccttgacttttgacaatttgactataaatcctcaaggaagacttccattttcagctattattttaataaataggttttcttttttttttctttcttttttctttctttttattttgagacagagtcttaacttcatcacccaggctggagtgcagtggtacagtttgagctcactgcaacctctgccttccaagttcaagt

SEQ ID NO: 57857 - DNA, 201 bp, Homo sapiens
gtactttgaacatattatcccattctctccatgcctgtgaaatttctgctgagaaatctgctgctagtctaatagatgctcccttatatgtgacttgatastttcctcttgctgttttttttagaattctctatgtccttgacttttgacaatttgactataaatcctcaaggaagacttccattttcagctattatttta

SEQ ID NO: 57858 - DNA, 201 bp, Homo sapiens
ttaggaacctgctaggttttagcattaaaatgcctagcataatgccttttccataggtgcttaataagcatttatggttttcattagttaagacagttaartttttacttgtaattctcatttataattggttatacctaaatgtgtgatagtaatgacgtttcttctttgtattttagactatccccataaatacggtcc

SEQ ID NO: 57859 - DNA, 201 bp, Homo sapiens
agttttcagtggagctttaagggttgtctatatatataagattatgctgtctacaaacaggaacagtttggcttcctcctttccaatttggatgtcctttrttttcttctcttgcctaattgctctggctcagacttccattactatattgataacagtggtgagagtggacattcttgtcttgttctagttctttttttc

SEQ ID NO: 57860 - DNA, 201 bp, Homo sapiens
gtttttttttttcagtggaaaaatctgtttatttctaggctcattggtgggcagtattacttatgggaattgctctgatcatgctaatggctggatttatyaagatatgcagtgttcatactccaagtagtaatccaaagttgcctcctcctaaaccacttccaggtaagaatatttgagcaagatacatatttatgtaac

SEQ ID NO: 57861 - DNA, 201 bp, Homo sapiens
ttcttccccattgggaggggcctggtgcttgaaaacttcaaagctattcaagaagtattttccacccttcctgctagtgaaaaccttctttgacatgtagkatctgcagatcttcacaaacaccaggctcttttccttctagaagatttctgtctgctgcctctgaatctggtctaggttacagtgaaccagaagtctcca

SEQ ID NO: 57862 - DNA, 201 bp, Homo sapiens
ttcaagaccaggccgcacatgtcatggggtgggctttctgacctgccttaggaattctcacctgtgacactcttaaagaaacaccctgcttggaaggtgcrtgttcatcctccactccataccagttaccttgggtggggtcacctcagggtgcttgttgccttctgagcctcactgcaaaatgccctctcatacttgaat

SEQ ID NO: 57863 - DNA, 201 bp, Homo sapiens
cactcaggctggagtgcagtggtgtgaatacggctaaccccagcctcgacttcgtgggctcaggtgattctcccacctcagcctcttgagcagctgggacwacaagtgtgtgccaccacacctggctagttttttgtattttttttgttgttgttgagacggggctttgctatgttgcccaggctggtctctaattcctgg

SEQ ID NO: 57864 - DNA, 201 bp, Homo sapiens
tgggacaacaagtgtgtgccaccacacctggctagttttttgtattttttttgttgttgttgagacggggctttgctatgttgcccaggctggtctctaaytcctgggtttaagcgatctgcccgcctcggccccccaaagtgttaggattacaggtgtgagccactgcacctggcccctcccatatactttaaaccatct

SEQ ID NO: 57865 - DNA, 201 bp, Homo sapiens
tgagggttttccagagagacagaaccaataggatatacatatgtacagatagatacatgagagaggatttattaggggaattggcttacacgattatacakactgaaaagtcccatgataggcagtctgcaagctggagaccctaggatgctggtagtatggctcattttagtcttaatgtctgggaaccagggaagctga

SEQ ID NO: 57866 - DNA, 201 bp, Homo sapiens
agtataaaacactgtgaaagaaatcgaagaagacagaaaaaaatggaaagatattctatgttcgtatatcggaagaatcagtgttgttaaaatgtccataattacaaaaggcaatgcaattgctaccaaaatgccattgtcattcttcacagaaatagaaaaagccatttgaaatgttttatggaaccagaagaaactcag

SEQ ID NO: 57867 - DNA, 201 bp, Homo sapiens
aaggatatacaggttgagtatccttatttgaaatacttggaaccaaaagtgttttggatctttaaattttccgattttgggaatatttgcattatgcttaygatttcctaatgtgaaaatctaaagtgcttcaatgagtttttttttttgtttgtttgtttgttttgtttttgtttttgtttttgtttttttttacagagc

SEQ ID NO: 57868 - DNA, 201 bp, Homo sapiens
tgtatccctttgtttggtatataataatttttcttaattgtttgcttaataaattaatgcagttaaaaataacattgacatatgattaggagatttatgtrtacacagctgttaattttgaatgttctgtatgttatagtcaatctgtaaagcagttaggaatttagaacacactttgccgtagaaacaatttaaagtgtt

SEQ ID NO: 57869 - DNA, 201 bp, Homo sapiens
cgggagaccttaacacttgggaagttggtacttaaatgccatgcttgtttacatgtcagacacctcagctagactgacagctcttgagagtgcatgttctrtgtcatttatttttgtatccctttgtttggtatataataatttttcttaattgtttgcttaataaattaatgcagttaaaaataacattgacatatgatt

SEQ ID NO: 57870 - DNA, 201 bp, Homo sapiens
taattgaaattgtaggatatgaggatgggagtacggaaggagttcccttaaacagagtttttaatgtttgcaaatttagacaattacttgtgaaaaactayctaaaaatctgtcaagtgaaccatggtttaagacaagaaaacattcatgtattagtcttttattctaaatagttgctatatttatattctagaccgtggt

SEQ ID NO: 57871 - DNA, 201 bp, Homo sapiens
aaaaactccaaatatcagcgtcttgggctcttacctccagtctatgattaattcagaggcaactaattaatgttattctacaacttagaaattgtggaagkcctgatttttattttaatcagagaatcgtaatgggtaaattcaaggtttaaagccctctccctctactttcaccctttatgtcatttgattttggtgctc

SEQ ID NO: 57872 - DNA, 201 bp, Homo sapiens; identical to SEQ ID NO: 5712

SEQ ID NO: 57873 - DNA, 201 bp, Homo sapiens
tttccccatgttggccaggctggtctcaaactcttgacctcgtgatccacctgccttggcctcccaaagttctggaattacaggcatgagccaccgtaccyggccgagccctagaatttctgtggaagatgcctggtggggtgtacattggctgactctctaccctttcccccttcctcctctgcagacctgttcctttcc

SEQ ID NO: 57874 - DNA, 201 bp, Homo sapiens
ttcttttctttctgcctctgagaccagtgtattttttttccgccttccaatcttagtttgaggggctgattattttgtgttttattcacgtttctgcagtmacggggctgtgatcatatataatttttttgagaattccaggactcccattctcttgagatttttaaataagtgaattgtgtggcatctgagggctagggg

SEQ ID NO: 57875 - DNA, 201 bp, Homo sapiens
cggtgcaggcagccgcagcgaggctggcggtctcgccgtcctcgttcagcgctcatcctgctcaccattcctcccccagcccctgcccggtggcggattcygaagtcctctccgccgccgagacccgccgcgcagactcgtgggaagttgtgttgtttgcagctgggctcgtgtattgttctttacccggcgcgccggtcc

SEQ ID NO: 57876 - DNA, 201 bp, Homo sapiens
cggggcgggaccaggacaaaccccgcctcccaagcccaatcccagctctccgccggcggacaggaagcggcggcaggcctagcagcacgggaaccgtcccmcgcgcgcatgcgcgcgcccctgaagcgcctgggggacgggtaggggcgggaggtaggggcgcggctccgcgtgccagttgggtgcccgcgcgtcacgtgg

SEQ ID NO: 57877 - DNA, 201 bp, Homo sapiens
atggttgtgtgtctcttctctacccagttattctttttgctatgatataaagtgggtgagtttattttttattttttattttttgaggtggaggctcactsttgttgcccaggctggagagcagtggcgtgaccttggctcactgcaacctccgtctcccgggttcaagagattctcctgccttagtctcccaagtagctg

SEQ ID NO: 57878 - DNA, 201 bp, Homo sapiens
ttctttttctattttccttttattgtttctttcatggtttttttctccagtgtgtttttacaatgttatgttcatggttgtgtgtctcttctctacccagwtattctttttgctatgatataaagtgggtgagtttattttttattttttattttttgaggtggaggctcactgttgttgcccaggctggagagcagtggc

SEQ ID NO: 57879 - DNA, 201 bp, Homo sapiens
agcgaaacgctgtttttgggaaaaaaaaaaaaaaaaaaaaaaaaaaaaagattagtcaggcatggcatggtggtgcaccagtttccagttactcagaaggmtaaggtgactgggttgcttgaagctaggaggttgagggtacaatgagctatgatcacgtcaccacactccagcctgggcaatgagtgagaccctgtctct

SEQ ID NO: 57880 - DNA, 201 bp, Homo sapiens; identical to SEQ ID NO: 16779

SEQ ID NO: 57881 - DNA, 201 bp, Homo sapiens
cttgaactcctgaccttgggtgatccacctgcctcggcctcccatagtgctgggattacaggtgtgagccatcacgtctggccaatatgaatttcttaatrtaatctaagactgattctgctttgtctaggattgtttccaaatgtcgtttgttttcttctcaattggattctttttctattttccttttattgtttcttt

SEQ ID NO: 57882 - DNA, 201 bp, Homo sapiens
atttggcatttcttttccagtggacccatcaacttgtgccagtacagggtctgtgcagtggagtaggcacttcagtggtcgaaccatcaccctgcaacctkgatccccttgcaacgattttagaggttactgtgatgttttcatgcggtgcagattagtagatgctgatggtcctctagctaggcttaaaaaagcaatttt

SEQ ID NO: 57883 - DNA, 201 bp, Homo sapiens
taaggaaaattaatatgaatttctttctttttttttttttgagacggagtcttgctctgttgcctaggctggagtgcaatggcacgatttcggctcactgyaacttctgcctcccgggttcaagcaattctcctgcctcagcctcccgagtggagacagggtttcaccatgttggccaggctggtcttgaactcctgacct

SEQ ID NO: 57884 - DNA, 201 bp, Homo sapiens
gccagataatttccagctaaatctgtcctcttgaggagattataaatgtaacgtagcattgtgtctctattattatggtctctacaatgttttaaaaatgrtaaactagacaaaacgttgccagctttacagcagtaatttacataaacactgttagactttaagtcatcgtggacactgagtcaagacttgctggttgct

SEQ ID NO: 57885 - DNA, 201 bp, Homo sapiens
ccagtaacatacttatcatttaagtgatgagacttaggatttaaaaattggtactatgtctaataatgtggatctaatctaatatctaatagtatataggraataactagtgatttactttgtttaatcacttaatgtttcctctagtccaagtcaaggtccttgttgtacagcacagtgtgcattcaagtcaaagtctga

SEQ ID NO: 57886 - DNA, 201 bp, Homo sapiens
cccctaaaagagcaaattcttttcctactcaaggtgtaaaacaattgtaagatcctttttaaaggagagtccacaagcttccattgttttcctgatgagamcattacgtttaatcagttgacctgaaaaccttattttacttcctgtttatgtaactttatattctttttgacagcatgattctggaacagagtgcacacc

SEQ ID NO: 57887 - DNA, 201 bp, Homo sapiens
gagtaaggaacttaaatagttaaaaacacttaaaaagtgaaacagtccagactatgtttacacacacacacaaaagcttgcttttaattttatctttatgrattaagtagtttagtttaattgtatctgttgatgcagttttttactcctggcatttacacacccacacacacacagatacttgggtttatgatttaagaa

SEQ ID NO: 57888 - DNA, 201 bp, Homo sapiens
ttataggattgttttctctttatctgtgaagaatgtcattggtatttggataggcattacattgaatctgtagattgcttttggtagtatggccgttttcrcagtattaattcttccagtccatgaacatgaaatgtgtttttttttttttttgacttgttcagtttctttcatcagtgtttcatagttttccttctagaa

SEQ ID NO: 57889 - DNA, 201 bp, Homo sapiens
tttttttttttgagatggagtctcagaaaaacctgtcacccaggctggagtgcagtggcatgatttcagctcactgcaacctctgcctcccaggttcaagyaattatcctgcctcagcctcctgaatagctgggactacaggtgtgtgcctccatgcctggctagttttttgtatttttagtagagttggggtttcactat

SEQ ID NO: 57890 - DNA, 201 bp, Homo sapiens
tactttttttttttttgagatggagtctcagaaaaacctgtcacccaggctggagtgcagtggcatgatttcagctcactgcaacctctgcctcccaggtwcaagtaattatcctgcctcagcctcctgaatagctgggactacaggtgtgtgcctccatgcctggctagttttttgtatttttagtagagttggggtttc

SEQ ID NO: 57891 - DNA, 201 bp, Homo sapiens
agccccctgagtagctgggactataggcatgtgctaccacacccagctaatttttgtatttttttttagagacagagttacgccatttgcccaggcttgtytggactacttttaatagtaatttgtgtggtgaatgttaacaaaaggacatactcaaaggacatactaaaaagaatcctaaaaaatacatattctttagtt

SEQ ID NO: 57892 - DNA, 201 bp, Homo sapiens
agttgttaaagatgagtgattggtacatgggaattcattgtacatattcttttattacttttaggtgtgtttgaaattttctgttgcaaaaaaaggcttartttttttttttcctggttagtgaagcactaacttggtttgtatttgtgtgatatgaatagaacagtcaataaagctcaatgtagcatggcctaagttgca

SEQ ID NO: 57893 - DNA, 201 bp, Homo sapiens
tgctggcatgtgcagagatcacatggtgggagtggaggtggtgggagcgtggggtcaaggagagaggaggtactaggctcttaacagccagctcttgcagraactaagagagtgagaatgcactcacccacccacctccaacccttcaggaagagcattaatctattgatgagggatctgcccccatgacccagacctctc

SEQ ID NO: 57894 - DNA, 201 bp, Homo sapiens
caccatttgtgatgctgctcattttcctgaggtggggagagttctggattgaaaatggtggggcatgttacttgtattttctttttttttttttttttttttgagacagagtgttgctctgtcacccaggctggagtgcagtggcgcgatctccgctcactgcaacctccacctcccgggttcacgccattctcctgcctc

SEQ ID NO: 57895 - DNA, 201 bp, Homo sapiens
tataaattgtgccaagtagagtttaatcaatagtatattatcttctgagctatatacaacagattctccttctgatacttcatttctatgttttttttttwaaaaaaaacttctgctttatccagagtaagagaagcttttgtattcctattcttattagtttattctttgatttgttttgtatattttaagatcttaagt

SEQ ID NO: 57896 - DNA, 201 bp, Homo sapiens
tgtacaggggtgctaaataatttataaacaaggacaaacactgcactagaaccaacttattcattatgatcatcttcatctttcttctcttcctcatcctyttcatcttcctccttttccttcttattttcaacttcctcaccttcctcttctttttttttcagcattgacatctcccttttttttttttttttttttttt

SEQ ID NO: 57897 - DNA, 201 bp, Homo sapiens
caccctagaatctgtctagtgtgagttatggacatcgtgtcattttacccttaaatatttaaaatgaacctcccaaaatttagaaccttctccttataatmacaatgttgttgtactaaggaaaattaatatgaatttctttctttttttttttttgagacggagtcttgctctgttgcctaggctggagtgcaatggcac

SEQ ID NO: 57898 - DNA, 201 bp, Homo sapiens
tcccacagtgctgggattacagatgtgagcctagccctatgatatctgtctttggtaaatttctcattcgtattctaaattttatgatttcttagtattgkgtctgtatattgtacctcacttagctttttaaatattattttgaattctttttctgggatctcataaatttctttttcattggaatctattgctgcagaa

SEQ ID NO: 57899 - DNA, 201 bp, Homo sapiens
gacactgagatatgtataagtagtaaaaaatgaaatcatgtcattcctgtttataccatattttttctattttatagatattgctgttcttttttttttttcttccctagagacagagtctcgcgctgatgcccaggctggaatgcagtggtgcgatcttggctcactgcagcccctgccttctgggtttaagcgattttt

SEQ ID NO: 57900 - DNA, 201 bp, Homo sapiens
tttaatggcagcagaaatacctatggtgttatataaagcagaatatgaaattgtttatagtatgtattcttaattagataaaatgatagtattgaagcatrctaattgtcagaaatgactttttgatgtatagatacctcaagaagaacatgctgctaatggtccagaacttctgaggaaaaaacgtacaacttcagctga

SEQ ID NO: 57901 - DNA, 201 bp, Homo sapiens
ttcattttgaagctactacagatgctccttgactcatcataagttgaaaatatcgtaagtcgaaaatgtatgtaatgttggcaacagagatgatggttcartgtatgatttttcaactttgtgatggtgagaaagtgatacacgtgcagtagaaactgtaaccccatttaagttttaaggagctctcctccacttaatgtg

SEQ ID NO: 57902 - DNA, 201 bp, Homo sapiens
gatagttaagtagaggctgtgtaatgttgatatttaggggagcatataaagaatattgggcttaatcttttagagcaataggaagtcattgaaatacattmttgaggtggatgacatattcaaatttgcgttttgaaaacattgcaatatggagaagagatgtaaggccattagtggctattggttgattaaactgatctt

SEQ ID NO: 57903 - DNA, 201 bp, Homo sapiens
tttctggttgagtgaaatatcttcttctgttcctttacttttagtctatatatgtctttagaggtaaaatgattttcttgtaagcagcatataggtggatrtgtcatgtgtttgggaggccgagccgggagttttgcttgagcaggagtgcaagaccaacctaggcaacatagtgagatcccatttctacaaataaatgaa

SEQ ID NO: 57904 - DNA, 201 bp, Homo sapiens
tttgaagaaatacttaattgaggccaggcacagtggctcctgcctgtaatcccagtacttcgggaagctgagacaggaggattacttgagaccaggagctyatgaccagcctgggcaacataggaagacctccgtctctacaaaaaaattaaaaaattagccaggcatggtgatacatgcttgtagtcccccagctacttg

SEQ ID NO: 57905 - DNA, 201 bp, Homo sapiens
ccagtgaagatatgggagagctgaactacttgatataataaacttgaacacctttatgttatttttttctgcttggaacactttttcatatttcagactgwtttcttatttaaaacctttctttaaatagaattttcacattaaagcatccagttttttttcctttggtctggagtagaaaatctttcacacataaaactt

SEQ ID NO: 57906 - DNA, 201 bp, Homo sapiens
acctcagaaacaaattgatacacctacagtgcattttttacaatggtgccaaaaacatccattggggtaaagacaatctcttcaataaatggtgctgggamaactggatatccgtatgcagaggaatgaaactagacctctatttctcaccgtatacaaaaatcaaatcaaaatgaattaagacttaaatttaagtgctcc

SEQ ID NO: 57907 - DNA, 201 bp, Homo sapiens
ccaaattggaaacaaagaagtcaaaatatccttgtttgcagatgatataatcttatatttggaaaaacccatagactccaccaaaaaactattagaactgrtaaacaaatacagtaaagttgcaggatacaaaatcaacgtacaaaaatcagtagcatttctactgttgtttccagcaacaaacagtctgaaaaagagaag

SEQ ID NO: 57908 - DNA, 201 bp, Homo sapiens
agtgagagaaataaagtgcacccaaattggaaacaaagaagtcaaaatatccttgtttgcagatgatataatcttatatttggaaaaacccatagactccwccaaaaaactattagaactgataaacaaatacagtaaagttgcaggatacaaaatcaacgtacaaaaatcagtagcatttctactgttgtttccagcaac

SEQ ID NO: 57909 - DNA, 201 bp, Homo sapiens
actaagtggtatttatcccagggatgcaagaatggttcaacgtatgcaaatcagtcagtgtgatacatcataatggaatgaaggacaaaacttatacgatmatttcaattgatgctgaaaaagcagttgataaaattcaaaatcctttcctgataaaaatgctcaaaaaattgcgtatagaaggtacgtatctcaacataa

SEQ ID NO: 57910 - DNA, 201 bp, Homo sapiens
cagaccgagattttgatgatggcgtacttggtctggcttgggttggagcaccttcaggtagtttatcatattaaatatgtcttaacttactacttgaaacraaggggagttttcagagaatgttgaattttcaaagtataggagaaagtgatgcctgtataatatcctaatttatgctacttgagttaggcaagactcata

SEQ ID NO: 57911 - DNA, 201 bp, Homo sapiens
aaatcctttccgtttcccaaatattggtgtggagaagtttctggaattgaattctgagcagaatcatgatgactactgtttggcctatgtcttcacagacmgagattttgatgatggcgtacttggtctggcttgggttggagcaccttcaggtagtttatcatattaaatatgtcttaacttactacttgaaacaaaggg

SEQ ID NO: 57912 - DNA, 201 bp, Homo sapiens
gtcaagttctttgtgtttaagtttttaataatcttactgatttttttgtctgcttgttcagaaaggagtggtatgatttccaactctagttacagagtctrcttttttctgttctatcaactttttcttcacatactttgaagctttttttatgtacataaatacttaggcttgttgtgttttcttcttgaattaggaaat

SEQ ID NO: 57913 - DNA, 201 bp, Homo sapiens
taatgttttctgtgtttttagtagagacagggtttcgctatgttagctaggctggtctcgaactcctggcctcgagtgatctgcccacctcggccccccaragtgctgggattataggtgtgaaccacactgtgctgggccaatttacaattattgatgactactgcatacatgctaggcactcagctaggtgcaaggaat

SEQ ID NO: 57914 - DNA, 201 bp, Homo sapiens
cttacctggggaaagccaaatcgttctaggacttcagaggagacacacaggtctctgaaaggatgcaggggctaataaataaaagcttttgtttaatagawgtctggtattagaacagattattcagattctgaaggaggaacctgtggtaggagtatagtagctaagtatcaaaagaaacattctggaagaactcagctt

SEQ ID NO: 57915 - DNA, 201 bp, Homo sapiens
aattaagataaacattcataggtcttatatagaagatgataatgagatggacttggtaactgtgtgtcccggggaagtgtttttagctttcccaattaaamcctatgaatcatgttctatctcaattacaaagattcagaaaatcattactcaggtcttttgccagtgaaagtgaatagtatgttgcttttataaaatttg

SEQ ID NO: 57916 - DNA, 201 bp, Homo sapiens
gagagtacaggtcataaagagacctgtagctcttgttgtatcaaccattatgtcatcctcttactgccaacattttcaaacagactgaggtttgcctttcrgtaaaaacatttactttcatattgtaattccttggcttacctggggaaagccaaatcgttctaggacttcagaggagacacacaggtctctgaaaggatg

SEQ ID NO: 57917 - DNA, 201 bp, Homo sapiens
tctgaatattctaaatatatatgtatagcttttaaagaaacagtatttatatgctaaataaacaaccgaacttaaaaaaaaatcatcctttcacaaaagtrtttgccacagggttccttaatatttatgctttcctatttttcttcaaatgtggttggataaaatgtctatactagagaagtttagtatatacattcagcc

SEQ ID NO: 57918 - DNA, 201 bp, Homo sapiens
gccatcagggaagttcttataaaaatgtttgagctgagtctgaaggataaatagagaaggatactctacgcataggaaatatgtgaaaaggaatggacgtrtgacgttgtaggattggattgaggaaacaaaatttttatgtgactgaaacaagagtatatgtttaggccagttgtggtggctcatgcctgtaatgccagc

SEQ ID NO: 57919 - DNA, 201 bp, Homo sapiens
cccgggaggcggagcttgctgggagccaagatcgtgccactgcactccatcctgggcaacagagtgagactctgtctcaaaaaaaaaaaaaaaaaaaaaaraaaaaaatacttagtgtctactctttgctgccaagcctgtgttaggtgatagcattacagtgaggatcaaacagagataatttcttctttccagaactta

SEQ ID NO: 57920 - DNA, 201 bp, Homo sapiens
ctcagttaagaaaaaaaaaaaaacacaaaccccaattaaaaaatggacagtgcacctggaaagcctttccaagaaggacaggcacaaataagcccagactrtgaggactacagtgaatacgtaactcttcaatgcccagacgtgaaccaacatccacaagcgtccagaccatccaggaaaacatgacttcaccaaagaaac

SEQ ID NO: 57921 - DNA, 201 bp, Homo sapiens
acaagccacagactgagaaaatgtccacaatgtctctgataaaaggcttttttccagaatagtaaagaactgttataactcagttaagaaaaaaaaaaaaacacaaaccccaattaaaaaatggacagtgcacctggaaagcctttccaagaaggacaggcacaaataagcccagactgtgaggactacagtgaatacgta

SEQ ID NO: 57922 - DNA, 201 bp, Homo sapiens
tctgctctgtttatcaataaagctattctactgctatgagatgacttttctctaaatacttcttttttcatgtcagcttattgatctaaagtcttcaattwatgattgttagccagattttcttaatttgacttttaagtttctctgtaaattaatcctagtctattattctaaacttactttgttttacttgccagcatc

SEQ ID NO: 57923 - DNA, 201 bp, Homo sapiens
cagtgagttatgattgtgccactgcactatagcctgggggacagagaggggccctgtctatttaagaaaacaaaacaaaacaaaaaactccaaatatcagygtcttgggctcttacctccagtctatgattaattcagaggcaactaattaatgttattctacaacttagaaattgtggaagtcctgatttttattttaat

SEQ ID NO: 57924 - DNA, 201 bp, Homo sapiens
tatcattcattctcactttttttgggggggactaattttcttcttctttgtcacatttctttatagttagtggtttggtttttttaccccttgttttttttaatagtttgtggtttttaattggatatttcacattttgattaatatttagtgtctttttgtcgttgtttgttttttttaaaattagagatggagtcttgc

SEQ ID NO: 57925 - DNA, 201 bp, Homo sapiens
tataactaataccaattgtactgaaactattccaaaaaatagaggaggagggaaaacttcaaactcattctaggaggccagtattactctgataccaaaascagataaaggcagcaaaaaaagaaaatgacaggccattatgtctcatgcatattggtagaaaaattatcaacaaaatactagcaaactgaatttagcaat

SEQ ID NO: 57926 - DNA, 201 bp, Homo sapiens
aaataaataaaatcagagatgaaaaaggagacatcacaagtggtatagatgaaattcaaaggatcattagtgggtactttgagcaactatatgccaataarttgcaaaatgtagagaaaatggatacattcttagacacatacaacctaccaagattgaaccatgatgttcaaaacctgaacagaccaataacaagtaatg

SEQ ID NO: 57927 - DNA, 201 bp, Homo sapiens
ttcaaacattcaaaaaattgaaataatatcaggtatcttctctgactacacttgaataaaactagaaatcaataacaaaaggagtctttgaaactatacartcacatggaaagtaaacaatatgctcctgaatgaccgataggtgagtgaaaaaattaaaaagaaaattggaaaatttcttgaaacaaacgataatggaaa

SEQ ID NO: 57928 - DNA, 201 bp, Homo sapiens
atatagacactacaataaggcatgaatagaaacaaagttaaaaagcagggggacaaagttaaagtgtaaagtttttattagtcttctttttgcttctatawttatgcaatcactgttgtcatcagtttaaaataaggattgtaaggtagtatttgcaagcctcatggtaacttcaaatcaaaaaacatatgatagatacac

SEQ ID NO: 57929 - DNA, 201 bp, Homo sapiens
tatttaaaaacagttaagagaagttaggaagaagagaaaaaggaacaaaaaactgatgggataaatagaaaataaatagcaaggtggtaagtttaaatctraccatattgatgactgcattaaatataaatggactgctgaggtgtgaagattgcttgaggccaagagttcaagaccaacctggccaacacagcgagaccc

SEQ ID NO: 57930 - DNA, 201 bp, Homo sapiens
gccacacctattcattgataggttgtctatggctgcttttacattatagtggcagaattgaagagttgtgatagagaacaactacatgttgttcaaaagtstaaatgtttactattaggccttttcagaaaaagtttgcaggaatttcctctgcccttggagcaaccattgaaaaaagaagaggaaataatttaacatgtt

SEQ ID NO: 57931 - DNA, 201 bp, Homo sapiens
tttagcctcattcagcttcaggaggagcttctctctttcatagttacacttctgaagtaagtaagacaccactgcattcaccatcaactcccttcaggggygttggggtggagcacaagggagttgatggtgaatgcagtggtgtaattataataataattgactgtgggatttaaactgaataaggaagagaaagaatat

SEQ ID NO: 57932 - DNA, 201 bp, Homo sapiens
taggccgaatattctacacccatgactcattgtttgtgaaagaatatgctgtttggccttttcaggggaactacagtgcatcctatgatttagcatctcartgagggcttattcattagttgaacaaaggctttttctagaaatgaggattatattgttagtaattttagagggaaaatgtcattgtccatttttatagtt

SEQ ID NO: 57933 - DNA, 201 bp, Homo sapiens
taatggttctaaactacttttcctttaaagttggaaatatcttgattgatcatggctgacaaataaaaagtaaaaataaaaatatttttgtgctgattggsaaatgactatataaaatggctattcttgtatgtaaattaagtatttttcttaagtaaattaagtattcttgtatgtaaattaagtatattaagatgaaat

SEQ ID NO: 57934 - DNA, 201 bp, Homo sapiens
agaggggaaacagtaaggttggcccttcgattgtgccagctttctgccttgagagatttatgggttgtggtactatgagagggaacctaggtagagtccarggaacttcctcagttgaagagatgaagctgagggtcaggggagaccaaagtggctggagttcacagacagaatatcagggtgaagagagagctgcacaga

SEQ ID NO: 57935 - DNA, 201 bp, Homo sapiens
gaaaatcattactcaggtcttttgccagtgaaagtgaatagtatgttgcttttataaaatttgtgtgtgggacagagaaaagatgactttgtttaataacwctcccagtagaatttcagctgtgtaaatcgttgagcttttgtcatgagtgcttcagaacagcaatagttattgttttaagttatcaaaagtgacagaata

SEQ ID NO: 57936 - DNA, 201 bp, Homo sapiens
aaagttctgggattacaggcatgagccactgcacctggcttaactttatatttcttattatgccacattctttgtagtatggaagtaatttcacttacatkcaagtatatgtaagatacatttctagaaatggaattcttgtatcaaaggctatgtacatttgtaatttggattttttaaaccagttttcccaccatagag

SEQ ID NO: 57937 - DNA, 201 bp, Homo sapiens
gtacaaattgttgtgtttatcaatagtttgttcctttttattactaaattctatcctattgtatggatataccacagtttaactgttcgtattttttttttaaaaagtatggagttttgtttgttagatagttgagtaacttgtggatcagcttgacccttttgagccttttttttttttatgattaattaagcagaaatt

SEQ ID NO: 57938 - DNA, 201 bp, Homo sapiens
gatagtttttatcagcaaaatgtgaatagaagagaacttgctcagcttgataaaggacatctaaaacaaacctatggctaacatccaaacttgtgtgtgcsgttggaattaccctcacaataagttttaataatatatgtgttaatattaatgcagaattcataatagtgctgggattagggagaagttgtttcatacata

SEQ ID NO: 57939 - DNA, 201 bp, Homo sapiens
aaaaaaaagaaaagaattctatgaaaagctgttgctcttgaaataaagcttaaagttgtttgaaaataaaagtaccatttgagtcagtgccatagtcgttraggaaacaactccagtaatacttactagaagattaaactgttttgataatagatattagggtaaaatacatctcttagcttggctgagaaattaagaatc

SEQ ID NO: 57940 - DNA, 201 bp, Homo sapiens
actccagtaatacttactagaagattaaactgttttgataatagatattagggtaaaatacatctcttagcttggctgagaaattaagaatcagttttctragtttcagaaatcactgaataagttctgatgaattggattgctcacttagcaatgctgtatatatgtcagttatggcatttattttattataactttatt

SEQ ID NO: 57941 - DNA, 201 bp, Homo sapiens
accaaaaactttccttaagtgcaatataattgtttggagaatatacaactttatttttttctgaattgacaaggtaattcttcctgtagccttaagagtamatttccaaactgtttaaaacaaatgattagacatttggttggaagttttctttgtggtttgggatttgagttctccctactcctgaaatatgaaggtttc

SEQ ID NO: 57942 - DNA, 201 bp, Homo sapiens
ctctgcggctgcctgagagacattgatcctctccacgccagcctccaacttgagctgctccaccaggcactgcagggcgctcgcgctagccccagaggacrtggtggcggcgctgggctccgagggcccagccttgtttttaagctttattaggataggtttgaagtagcctttattctaggaatagtttgttcctatttc

SEQ ID NO: 57943 - DNA, 201 bp, Homo sapiens; identical to SEQ ID NO: 5713

SEQ ID NO: 57944 - DNA, 201 bp, Homo sapiens
ccagtggtgtagtttttaatgccagagtttctagagttggtgacctagacagtgaatgtcagaaattacgtatatgcctagtagaaaagcctatatattgkttttcttaattatgttatatttcatgctaaaatgtttcatgttcagttggatcttttgtgagataagtaccctagctcagattttatctagattcatagt

SEQ ID NO: 57945 - DNA, 201 bp, Homo sapiens
aaatgttttctcccagactgtggcttgcctttttttttttttttaaagctatttctcagcggaagttttgaatttttaagaagcccttttaatgaaaaaawttttttcttttatgatttttgcttttgtttcttaaggtagcattgactaccaaggccatgacagttttcttctagatgtttccagttacagttttacatg

SEQ ID NO: 57946 - DNA, 201 bp, Homo sapiens
ggcggaagaatcacttgaacctgggaggcggaggttgcggtgagccgagatcgctgcattgcactctagtctgggcgagagagagtgagactcatcttggraaaaaaaaaaaaagaaagaaagaaaaaaagaaatcagtatcaaggctgtaaggggcctacttcaagtgttcttaacttctgttttccttctaagttgttt

SEQ ID NO: 57947 - DNA, 201 bp, Homo sapiens
atctgtctatcttttttttttttttttgagacaaggtctcactctgttgcccaggctagagtacattgatgcgatcttggctcactgcaacctctgccttytgggctgaagcgatcctcccacctcaaccacctgagtagttgggactacaggttcacgccaatatgctgggctaattttttttttttttttttttagaga

SEQ ID NO: 57948 - DNA, 201 bp, Homo sapiens
ctgctctaccagttagctttatatttctgtgtgttttcatgatggtgatcatcatctttttgcttccagatgcagaattcctttgagcatttcttgtacarttggtctagttgtgtcaaattacctgtttttgcttgtgtagtaaggactttatttctccctcatttctgaaagaaagttttcctgggtgtaatcttggct

SEQ ID NO: 57949 - DNA, 201 bp, Homo sapiens
gctttaagctcattctttgtatgacctctttaaagtatgagggttggaggtggagccaaataatttcccgcaatcactgcatttataaggtatttctttgytgtgaattcttctttgtactgtaaagtaggagttgtgactaaaggttttctccacattcaccacactcctaaggctttactccgtcatggattttctgtt

SEQ ID NO: 57950 - DNA, 201 bp, Homo sapiens
ttgattttatttatcttttcaaaaaaacttggttttgtttatccttcctattgttttttgagtgtctgttttgttgaattctgccctgtttttttttttttgtttttttgtttttttttaagttggaattttgttctgtctcccaggttggagtgcagtggcatgatcatagctcattgcaagcttgaactccagggctca

SEQ ID NO: 57951 - DNA, 201 bp, Homo sapiens
cctgttctgtaacattttgtaggatgaaactaagtgtttaagtgacttaccaaagatttaatacctgttctgtaacattttgtaatacttcgcttattcarctctgctgttgtgtgaaagcagagatagaaaatatgtaaatgaatgagcatagcagtgttgtaaaaacaggtggccagctggaactggcctttgggtaac

SEQ ID NO: 57952 - DNA, 201 bp, Homo sapiens
accatgcttggctaatttttaaaattttttgtagagatagggttttgccacattgctcaggctggtctcaaactcctggtctcaaactcctggcctcaagygacctgcctgtttcggcctcccaaagtgctaggattacagatgtgagccactgtgcccagcctgtatattctttgttcctttctttttctcttattgttt

SEQ ID NO: 57953 - DNA, 201 bp, Homo sapiens
cgaactcctgacctcaggtgatctactggccttagcctctcagagtgctgggattacaggcgtgagctactgtgcctggctgagctttttttcccccccccaaagtttatagccctagaatttcttttcttttctttttctttttatcttttcttttcttttttttttttttttgagatggagtctcactctgtcacccag

SEQ ID NO: 57954 - DNA, 201 bp, Homo sapiens
gctggtctcgaactcctgacctcaggtgatctactggccttagcctctcagagtgctgggattacaggcgtgagctactgtgcctggctgagctttttttyccccccccaaagtttatagccctagaatttcttttcttttctttttctttttatcttttcttttcttttttttttttttttgagatggagtctcactctg

SEQ ID NO: 57955 - DNA, 201 bp, Homo sapiens
ctgatgtaaccctgattgattactgtagtgttcacttcctaataagtttccccgcttctgctctgtttatcaataaagctattctactgctatgagatgacttttctctaaatacttcttttttcatgtcagcttattgatctaaagtcttcaattaatgattgttagccagattttcttaatttgacttttaagtttctc

SEQ ID NO: 57956 - DNA, 201 bp, Homo sapiens
tgcaggaataaagttgttaatttgtgtgcatctctgaaatctgaaattataatcactttgcactagtaagtttccaaaatagtctatattgaaccaacaartcaaatataaacacaaggtctagcaaatcaagaatcttagttatcatggtgtgggacagatagttgtgttatatgccagtatcaattgccaggttggtat

SEQ ID NO: 57957 - DNA, 201 bp, Homo sapiens
gccatcctgggggctcccttatatatcctaagcaaggaattatagtttgatgtgacggaaagactgtttcagatttaaactctgattttgtgtgctcttgstcaagtccacttcatcagtttgttaaattagtaaatttaggtgattgttattttatacagttggtttacattagatacctgaacagtggaagtctccctc

SEQ ID NO: 57958 - DNA, 201 bp, Homo sapiens
taggctcactttaaaaaatatatatatttattaatagagacgaggtctcactgtgttgccaggctggtctcgagctcttgagctcaagtcatcctcctgcygcggactcctaaagtgctaagatgacaggtgtgagccaccatgcctggccaaggctcaactcttataagtgatgagttacagaaaaactagaagaaatag

SEQ ID NO: 57959 - DNA, 201 bp, Homo sapiens
tgcccaggctggagtacagtggcgcgatcttcactcattgcaacctccacctcctgggttccagtgatccttgtgcctcagcctcctgagtagctgggatyataggtgctcaccaccacgcctggctaatttccatatttttagtagagatggcatttcaccatattggccaggctggtcttgaattcctgacctcaagtg

SEQ ID NO: 57960 - DNA, 201 bp, Homo sapiens
taaaaaaaaaaagttatttttggtatcattgattttgaaggtgagccatatttactactgaaaaagcaaatttatattttaggctcactttaaaaaatatrtatatttattaatagagacgaggtctcactgtgttgccaggctggtctcgagctcttgagctcaagtcatcctcctgccgcggactcctaaagtgctaag

SEQ ID NO: 57961 - DNA, 201 bp, Homo sapiens
tcattgcaacctccacctcctgggttccagtgatccttgtgcctcagcctcctgagtagctgggatcataggtgctcaccaccacgcctggctaatttccrtatttttagtagagatggcatttcaccatattggccaggctggtcttgaattcctgacctcaagtgatccacctgcctcgggctcccaaagtgctaggat

SEQ ID NO: 57962 - DNA, 201 bp, Homo sapiens
gaccttttgcctcttggcttcttaggatcttcttttaccaagtttagttatttttcctcagagaagcacagagtcacctagtgcacatctggctgccattygccccagcactgtctccatggaggtcaatgtactgtaatggctatcagaaatacatgattatatgaaaataaaaaaagctttcatgttgtaaagcaactt

SEQ ID NO: 57963 - DNA, 201 bp, Homo sapiens
ggagtgcagtagcgtgatctcagctcactgcagcctccacctcccaggttcaagtgattctcctgcctcagcctcctgagcagctgggattacaggggcaygccaccacgcccggctaatttttgcatttttagtagagatgggggtttccccttgttccccaggctggtctcgaactcctgacctcaggtgatctactgg

SEQ ID NO: 57964 - DNA, 201 bp, Homo sapiens
tttttgtatttttagtagagacggggtttcaccatgttggccaggatggtctcgatctcttgatctcttgacctcgtgatccgcccgcctcggcctcccaragtgttgggattacaggcgtgagccactgtgcccggcctgaatttgtctataccttatagtagtagggcacccctactttagaatgtgtgttagccatac

SEQ ID NO: 57965 - DNA, 201 bp, Homo sapiens
cgtgatctcagctcactgcagcctccacctcccaggttcaagtgattctcctgcctcagcctcctgagcagctgggattacaggggcacgccaccacgccyggctaatttttgcatttttagtagagatgggggtttccccttgttccccaggctggtctcgaactcctgacctcaggtgatctactggccttagcctctc

SEQ ID NO: 57966 - DNA, 201 bp, Homo sapiens
ctctcaatttttgcctgctttcctaacttggcagcttcttcctacatacgttttcctttgtatagacagaaatttattgtcaatgattttattcttacccctagtaatacactgacaagcattaaccattttgactttttgctccatcagctctgacagtttttgtacttcatctgtccaactgcttgttatctctgctgc

SEQ ID NO: 57967 - DNA, 201 bp, Homo sapiens
tgggattacaggggcacgccaccacgcccggctaatttttgcatttttagtagagatgggggtttccccttgttccccaggctggtctcgaactcctgacytcaggtgatctactggccttagcctctcagagtgctgggattacaggcgtgagctactgtgcctggctgagctttttttcccccccccaaagtttatagc

SEQ ID NO: 57968 - DNA, 201 bp, Homo sapiens
ccccatgatccaatcacttcccaccaactcttcccccaatactgggaattgcagttcaacatgagatttgggtggggacacagagccaaaccatgtcactyaccataatgtctgagttatttcactgacttatgtctgacttatttaacttatcatgatgttttcagggttcatccatgttgtagcaaaaatcagagtttg

SEQ ID NO: 57969 - DNA, 201 bp, Homo sapiens
acttcagctcttggaagccatcttctaagagctgctggggaggggctaggcaggcacagaagaatagaggccatagtgggaaagaaaagggatctttgttyctttggtccaactttttcgagtgtaggttacctgccttgaaataacactgccagcttcttcacttgtctttgcacttactactagctgaactgagtttca

SEQ ID NO: 57970 - DNA, 201 bp, Homo sapiens
catagtctcagttcggcttggtcgttgaatgaggctggctttggaattcatctctacagttagtcctgaaaccttcagtactcctctatttgtgaagaacwtcttttgaggcatttcatttggtagaaatagtctcttctgttttctttagattagatgttttagtttgatattacatattaaaatttgagagcgtacaga

SEQ ID NO: 57971 - DNA, 201 bp, Homo sapiens
acttatatgccattgaatacatcatttactcagttttaccagttctaaaatgacagctggtagacagattacctgctgttttgttcagttctcaaacagaattgttaagtgataaaggggagtcaagggagagaggttaaaaaaaatcacttattgagtacctgttgtgttctagatgctttatatgcattttcttgttta

SEQ ID NO: 57972 - DNA, 201 bp, Homo sapiens
ctttttatttattgctttgttcagttttctagtttttggttggatttttttgtttatgttcataaggaatatcagtcttttttttttttttttggggggggtctgtctttggttttggaatcagagtgagccacataaaatgagttgagtactcttccctcctgttttcttaaaatagttttataggacatcaggggaacc

SEQ ID NO: 57973 - DNA, 201 bp, Homo sapiens
tagtctcttctgttttctttagattagatgttttagtttgatattacatattaaaatttgagagcgtacagaacttaacacagggttctcgggataacccrcagcttattgaattcttaacccatagtttaaaagtataacttcaaatgctgggaaaattacatcattgaaatattgcaataggacacttgctattggcat

SEQ ID NO: 57974 - DNA, 201 bp, Homo sapiens
ctacttatatgccattgaatacatcatttactcagttttaccagttctaaaatgacagctggtagacagattacctgctgttttgttcagttctcaaacagaattgttaagtgataaaggggagtcaagggagagaggttaaaaaaaatcacttattgagtacctgttgtgttctagatgctttatatgcattttcttgtt

SEQ ID NO: 57975 - DNA, 201 bp, Homo sapiens
gtattgtcctttttatttattgctttgttcagttttctagtttttggttggatttttttgtttatgttcataaggaatatcagtctttttttttttttttkggggggggtctgtctttggttttggaatcagagtgagccacataaaatgagttgagtactcttccctcctgttttcttaaaatagttttataggacatca

SEQ ID NO: 57976 - DNA, 201 bp, Homo sapiens
caggtgatccgcctgccgccgccacccaaagtgttgggattacagacgtgagccactgcgcccggccattttaaactttcatataagcgataatcataaaraccaaaagcagttgtttaagaagttaggcaatatataaattactatatttcagaatagtatattctaatttatgtatactcttctcttaaattagccaga

SEQ ID NO: 57977 - DNA, 201 bp, Homo sapiens
ggcgtgaactcaggaagtggagcttgcggtgagccgagattgtgccattgaactgcagtctgggtgacagagcgagactctgtctcaaaaaaaaaaaaaawaaaataaaataaaataaaataaaataaaataaaagtttcatgctagtgggttttattatctcttagacattggcttcactgaaatttctttgctacttgt

SEQ ID NO: 57978 - DNA, 201 bp, Homo sapiens
aaataagaaaaaaactttatgtcatagtgatacattctgaagtatttacagggacaataatatgttaggtggggttgttttaaaatactccagaaaaaaaytgtgggagtaagtgagacaagaacagcatattgttgttgatagttgttaaagatgagtgattggtacatgggaattcattgtacatattcttttattact

SEQ ID NO: 57979 - DNA, 201 bp, Homo sapiens
gaacaatgcctagtacataatgtactcaaatatcttttgaatgagaatcattattcattgtttaaaagtacattttgaatgttcagcaaattgtgagaaaytctttttttgttttgtttctgttaaagcatttttagggaatgagattgatattttaaaatcttttctctactgtggaatgagattgataatttaaagtat

SEQ ID NO: 57980 - DNA, 201 bp, Homo sapiens
tggcgtgaactcaggaagtggagcttgcggtgagccgagattgtgccattgaactgcagtctgggtgacagagcgagactctgtctcaaaaaaaaaaaaaataaaataaaataaaataaaataaaataaaataaaagtttcatgctagtgggttttattatctcttagacattggcttcactgaaatttctttgctacttg

SEQ ID NO: 57981 - DNA, 201 bp, Homo sapiens
aagactattgaacaggcaggacaaatagaagataataaaattggagatttaaaccccaaaatatctgtaattatattaaaggtaaatggattaaatgcacygattaaaagataaatattatcagattggatttaacagcaacaaaaccccacaaactgttttacaaaaactgctcctaaaatataaggatgcagaaaagat

SEQ ID NO: 57982 - DNA, 201 bp, Homo sapiens
aggaggtactaggctcttaacagccagctcttgcagaaactaagagagtgagaatgcactcacccacccacctccaacccttcaggaagagcattaatctrttgatgagggatctgcccccatgacccagacctctcttgttaggcccactaacaactttgggatcaaatttggggggacagacatccaaattatacaatg

SEQ ID NO: 57983 - DNA, 201 bp, Homo sapiens
agggtcaggggagaccaaagtggctggagttcacagacagaatatcagggtgaagagagagctgcacagaggatccctgagatctgcagaggcttccactrtagtgttcagcagagctctaatcagcccatatgtggaaactacctgaggctaaagaatcatcccaaaagattagattgaacggtacctggtgctcagata

SEQ ID NO: 57984 - DNA, 201 bp, Homo sapiens
atggcgtgaactcaggaagtggagcttgcggtgagccgagattgtgccattgaactgcagtctgggtgacagagcgagactctgtctcaaaaaaaaaaaaaataaaataaaataaaataaaataaaataaaataaaagtttcatgctagtgggttttattatctcttagacattggcttcactgaaatttctttgctactt

SEQ ID NO: 57985 - DNA, 201 bp, Homo sapiens
ttgataaaggacatctaaaacaaacctatggctaacatccaaacttgtgtgtgcggttggaattaccctcacaataagttttaataatatatgtgttaatrttaatgcagaattcataatagtgctgggattagggagaagttgtttcatacatattcatagatacttgaataatcgtgttagaactagaaggggtcttca

SEQ ID NO: 57986 - DNA, 201 bp, Homo sapiens
aatggcgtgaactcaggaagtggagcttgcggtgagccgagattgtgccattgaactgcagtctgggtgacagagcgagactctgtctcaaaaaaaaaaaaaataaaataaaataaaataaaataaaataaaataaaagtttcatgctagtgggttttattatctcttagacattggcttcactgaaatttctttgctact

SEQ ID NO: 57987 - DNA, 201 bp, Homo sapiens
gaatggcgtgaactcaggaagtggagcttgcggtgagccgagattgtgccattgaactgcagtctgggtgacagagcgagactctgtctcaaaaaaaaaaaaaataaaataaaataaaataaaataaaataaaataaaagtttcatgctagtgggttttattatctcttagacattggcttcactgaaatttctttgctac

SEQ ID NO: 57988 - DNA, 201 bp, Homo sapiens
agaatggcgtgaactcaggaagtggagcttgcggtgagccgagattgtgccattgaactgcagtctgggtgacagagcgagactctgtctcaaaaaaaaaaaaaataaaataaaataaaataaaataaaataaaataaaagtttcatgctagtgggttttattatctcttagacattggcttcactgaaatttctttgcta

SEQ ID NO: 57989 - DNA, 201 bp, Homo sapiens
tgctcggctaatttttaattttttttgtagatagggcttcttgctgtgttgcccgggccggtctcgaactcttgggctcaagctatcctcctacctcagcytcccagaatgctgggattactggtgtgagccaccgggtgtggcctcaattattttttttttatctgtcaccaggaagatgttcagcattttgccatcctg

SEQ ID NO: 57990 - DNA, 201 bp, Homo sapiens
tacaaaaaattagccgggcgtggtggcaggtgcctgtagtctccagttactcgggaggctgaggcgggagaatggcgtgaactcaggaagtggagcttgcrgtgagccgagattgtgccattgaactgcagtctgggtgacagagcgagactctgtctcaaaaaaaaaaaaaataaaataaaataaaataaaataaaataa

SEQ ID NO: 57991 - DNA, 201 bp, Homo sapiens
ggttgaaagtcatactctattactgtctgtacttgtgtcttattagaaattgtataaaagattcaatataacccacaggttcagaaaaaaagaataaaaawagattgtataaaagaatttcaaatcagcatagaaatcttacgtacacatttcaattttttgatttttaaattgtatttcataagttagtggtataaattt

SEQ ID NO: 57992 - DNA, 201 bp, Homo sapiens
tgtgtattataagtagtctagagattatttaaaatatacatgggtatgtgcataggttgtatgcaaataccgcgtcattttgtcagggatttgagcatcartggatttggatatctgtgggaagtccttgaaccaaccccccagggataccaagggacaattttattttattctttatcaggagggataaaattaggaatt

SEQ ID NO: 57993 - DNA, 201 bp, Homo sapiens
agggtagaatgaggcaggcagttccaggattggctgattcggaaactggctagacaaatccatctcagctaccattgtccacaaaaaagggggacctctgraaatccacagcagaccccaacccaggtcttttgggcaggagctgggtcatttccacactgaaaccactctgagggaggggatgaagaaccaccaggtttt

SEQ ID NO: 57994 - DNA, 201 bp, Homo sapiens
tttgaggtttggattggtgaactcagctagaaaacatacttgcatttgcccgaataatgaataaccaagaaaaaaactgacaaacgattttctgcaaactraagcaaagcatttaggccggggagggagagtttgtaacctgactccttccacctttagcgagttggagcttgtgcgagttctttccactctgtgtatttc

SEQ ID NO: 57995 - DNA, 201 bp, Homo sapiens
aaagctttccagccagtgtttccagcagcaagcatcctaacccaggcctcggaatctgaagatacagtgctcaaatatcagtgcttctgagctactaaccrttgtaattgcccaagtagatggccaatgaattgcaataattcataattcagtttttggttattaataagatttattgtatcttacacaaaagagcattat

SEQ ID NO: 57996 - DNA, 201 bp, Homo sapiens
aggtagaagaattgctctcgtttgtctgtccattcatcctcctctcctcactttatctatcccacgcgacttcagggtagactcctgctggcaggcaggakcataagtccgcggacagaacggaggcctggagtggaggaatgtggtttgaggtttggattggtgaactcagctagaaaacatacttgcatttgcccgaat

SEQ ID NO: 57997 - DNA, 201 bp, Homo sapiens
cgtcggcggcacgtgcggggtcgtggacgacgagccccggccgactgggaaagcggagaccgaagacgaggacgaagggactgagggcgaggacgaagggsctcagtggtcgccgcaggacccggcactgcaaggcgtaggacagcccacaggtagaagaattgctctcgtttgtctgtccattcatcctcctctcctcac

SEQ ID NO: 57998 - DNA, 201 bp, Homo sapiens; identical to SEQ ID NO: 16786

SEQ ID NO: 57999 - DNA, 201 bp, Homo sapiens; identical to SEQ ID NO: 16787

SEQ ID NO: 58000 - DNA, 201 bp, Homo sapiens; identical to SEQ ID NO: 16788

SEQ ID NO: 58001 - DNA, 201 bp, Homo sapiens
ttgtaaaaaaatatcaggatcagttactagtgcaaagtaagttttaaaacacctatttgcagaccttataatttaaatgggcctttcaacaggtctgggaraaaaatatgtctcataaaagattaatgtgtttttaggctaaataatctaattagccaatgaatcagagatttatgcctgtttttgtcacctgcagacctg

SEQ ID NO: 58002 - DNA, 201 bp, Homo sapiens
ttagataattctaatgctgatgatttatgtctccatttagacgccttttcatggaagctggggaatgtgggggccttggggagactgttcgagaacgtgcrgtggaggagtccagtacacgatgagggaatgtgacaacccagtcccaaagaatggagggaagtactgtgaaggcaaacgagtgcgctacagatcctgtaa

SEQ ID NO: 58003 - DNA, 201 bp, Homo sapiens; identical to SEQ ID NO: 16793

SEQ ID NO: 58004 - DNA, 201 bp, Homo sapiens; identical to SEQ ID NO: 16796

SEQ ID NO: 58005 - DNA, 201 bp, Homo sapiens; identical to SEQ ID NO: 16797

SEQ ID NO: 58006 - DNA, 201 bp, Homo sapiens
ctactttcattgaccttagctggaggagacataggtcaatagataaataatttttaaaaatatctaatttcttcagatgtctatacgtagtactgaaaaayatgccaaagtgaagggtaaatgcatgaaatgcataatgtgtagagggtactgtgtttaattagcatggtcaggaaagtagagagaaaatgtttacactta

SEQ ID NO: 58007 - DNA, 201 bp, Homo sapiens; identical to SEQ ID NO: 16784

SEQ ID NO: 58008 - DNA, 201 bp, Homo sapiens
cccgaggccttccacgtggagcctgatgatctcattcaggatttgagccctcgcctgtgaaagagtgactcagggcctctgcctgccactcttgctccaakattttactacaattgggtaggattatgtgcgaaattgccttgttcagactgtgggatttcaaagagaacagaagaaatcctgctcacacacagaaagatc

SEQ ID NO: 58009 - DNA, 201 bp, Homo sapiens
agcccaggccctacccgaggccttccacgtggagcctgatgatctcattcaggatttgagccctcgcctgtgaaagagtgactcagggcctctgcctgccrctcttgctccaagattttactacaattgggtaggattatgtgcgaaattgccttgttcagactgtgggatttcaaagagaacagaagaaatcctgctcac

SEQ ID NO: 58010 - DNA, 201 bp, Homo sapiens
gcagaggagcaatggtgacctgggaaggtaccctgagcggctacgctaggatctctgttctgcagacttctgtcccctttcccccttataaggctgacccrggcgggctgaaggcggtggggccccttcgcagaacctgcttgggaggtctttcccgggtttgccccgcctcccagtttgcactccctctcgcggccataa

SEQ ID NO: 58011 - DNA, 201 bp, Homo sapiens
atccatattttattttattattattttttttgagatggagtctcactctgtctcccaggctggagtggagtggcacaatctcggctcactgcaacttctgyctcctgggttcaagcgattctgctacctcagcatgcccagtagctgggattacaggtgcatgccaccacacccggctaatttttgtatttttagtagaga

SEQ ID NO: 58012 - DNA, 201 bp, Homo sapiens
ccgctgcctgtgcgtgcatcctgcgctcacgggagggcggatgtggagagggcagaggagcaatggtgacctgggaaggtaccctgagcggctacgctagkatctctgttctgcagacttctgtcccctttcccccttataaggctgacccaggcgggctgaaggcggtggggccccttcgcagaacctgcttgggaggtc

SEQ ID NO: 58013 - DNA, 201 bp, Homo sapiens
ttttttgagatggagtctcactctgtctcccaggctggagtggagtggcacaatctcggctcactgcaacttctgcctcctgggttcaagcgattctgctrcctcagcatgcccagtagctgggattacaggtgcatgccaccacacccggctaatttttgtatttttagtagagacggggtttcactatgttggccatgc

SEQ ID NO: 58014 - DNA, 201 bp, Homo sapiens; identical to SEQ ID NO: 16789
  misc_feature (1)...(201): n = A,T,C or G, or insertion/deletion polymorphism (see Tables 1-2)

SEQ ID NO: 58015 - DNA, 201 bp, Homo sapiens
ggttgcaacgttgcgctgagttttgtaaccgctgcctgtgcgtgcatcctgcgctcacgggagggcggatgtggagagggcagaggagcaatggtgacctrggaaggtaccctgagcggctacgctaggatctctgttctgcagacttctgtcccctttcccccttataaggctgacccaggcgggctgaaggcggtgggg

SEQ ID NO: 58016 - DNA, 201 bp, Homo sapiens; identical to SEQ ID NO: 16790

SEQ ID NO: 58017 - DNA, 201 bp, Homo sapiens
gtaagttttaaaacacctatttgcagaccttataatttaaatgggcctttcaacaggtctgggaaaaaaatatgtctcataaaagattaatgtgtttttargctaaataatctaattagccaatgaatcagagatttatgcctgtttttgtcacctgcagacctggatatcatgatatcatcacaattccaactggagcca

SEQ ID NO: 58018 - DNA, 201 bp, Homo sapiens; identical to SEQ ID NO: 16791

SEQ ID NO: 58019 - DNA, 201 bp, Homo sapiens; identical to SEQ ID NO: 16794

SEQ ID NO: 58020 - DNA, 201 bp, Homo sapiens
ctcctctgctcctgggagcaaagtggtcgcagcccagtttaggactttctgcaggggttgggtctcagtccggagtggaaggctctgttccaaataatcartcatgcctggaagctggaacttatttcgctggggcagtgggagtggggccagaggctgctgggcagagtgggtggtccttgtgcccggaattggcaagag

SEQ ID NO: 58021 - DNA, 201 bp, Homo sapiens; identical to SEQ ID NO: 16795

SEQ ID NO: 58022 - DNA, 201 bp, Homo sapiens
acgttgcgctgagttttgtaaccgctgcctgtgcgtgcatcctgcgctcacgggagggcggatgtggagagggcagaggagcaatggtgacctgggaaggyaccctgagcggctacgctaggatctctgttctgcagacttctgtcccctttcccccttataaggctgacccaggcgggctgaaggcggtggggccccttc

SEQ ID NO: 58023 - DNA, 201 bp, Homo sapiens
aataaccaagaaaaaaactgacaaacgattttctgcaaactaaagcaaagcatttaggccggggagggagagtttgtaacctgactccttccacctttagsgagttggagcttgtgcgagttctttccactctgtgtatttctttttaatgattttgtgtgcgccttttgtgcgggttgcaacgttgcgctgagttttgta

SEQ ID NO: 58024 - DNA, 201 bp, Homo sapiens
gctgcggcggaaaacaggctactcctttgtaaattgcaagaaagctctggagacttgtggcggggacctcaaacaggtgtgtgtgtggaggggtgcagggyggagtactagagctcgacctcagactcttggggcggtcacgctggggagcataaagttagactgctcttcagtgaccataatggcacagtcctaagtgga

SEQ ID NO: 58025 - DNA, 201 bp, Homo sapiens
ctggagctgaaagggtttgtgtgagctttggagtcagattgttcaggagtcaaattgtggggcccccacactgtctgactttagactttttttttttttttcagacggagtcttgctctgtggcccaggccggcgtgcaatggcacgatgttggctcactgcaacctccgcctcccgggttcaagcgattctcctgcctca

SEQ ID NO: 58026 - DNA, 201 bp, Homo sapiens
ctgtacctttcccttcctcccaacctcgtttgactccatctcaccttccccgacagcattgcctctgcccagtccagccccggtgcacccccctttgcacrctgtccgctccctaaggtcgcttccctgcccgtgtacccttcaccctctggagtttgctgcttcctgctcctcatccctttcttatctcatctaggctgg

SEQ ID NO: 58027 - DNA, 201 bp, Homo sapiens
gttttgcctgtgagcatctgtagcatttgtgtgttctctggctctggttgcccatgtggctggcttctcccaagagcgaacccgactcacagcagtgattygcatgatagcagcagcatctcccagctcttcttttaattgttcatatgtttttcctgcctgagaagaagagagagaaaacacaggatgaggtctttctta

SEQ ID NO: 58028 - DNA, 201 bp, Homo sapiens
gaagttgctctgggtgagtcagtgagtggtgagtgaatatgaaggcctgccttaggacactatggtgcactatagtagacgttaaagcacagtacacatargctacattacatttataagaaatttttttctgtgataataagttaaccttagtttaatgtaacatttttattttataaacttttaacatgttttaaattt

SEQ ID NO: 58029 - DNA, 201 bp, Homo sapiens
aggggagtgcaggtctgggctccgaggggctggtctgacccggggcccagccatcctaccttgccataccacaggtagtgctctgcctgagttcgcagcakaaagacatcattggagtttagggaggaggcaaaggctggaacttccactgctttggtgttagatttgtcatttccatgaatttggaagagtcttactgga

SEQ ID NO: 58030 - DNA, 201 bp, Homo sapiens
gcatctcccagctcttcttttaattgttcatatgtttttcctgcctgagaagaagagagagaaaacacaggatgaggtctttcttataggggagggacatyttaggtctggtctgtgtcttcaggaaaagcaaaagagccagggagtcagaagacatttcaaggataagtaaaaatgaaaatccccccttttgggtccatg

SEQ ID NO: 58031 - DNA, 201 bp, Homo sapiens
tacacattaccctatctttcccctttctttcgtgagcaattcacagcctcagaaaactttctcagcctaatttgttcagcagagaaaggttttcccagaaycagcttgatgtttatcattttaattgctatgtgtatcttccaggtctgcctttccaaattggagctgtctctgaacttcagcttcctgaatccaacttct

SEQ ID NO: 58032 - DNA, 201 bp, Homo sapiens
tccaaattggagctgtctctgaacttcagcttcctgaatccaacttcttgcagaacacctcctcttgactgctctaagcaccttaaaaataacaccttcargatgtagctcttctttactaaacttgtatctgagtctccacttttgataggtggtatctatctagtcacctaaggcagaagcctgagagtttcctagaaa

SEQ ID NO: 58033 - DNA, 201 bp, Homo sapiens
tgggtgagaaaccaggcagacagctatgtatgaggcttattaagaaattctggaagagctgggtgtttcagccttgtcagtttctgggaattaactattgrgtatatgctttgagctattttaaaatttgttttggtttctggattctcctttttcatgacttttagatatgactatggctaatccaggcatacttataca

SEQ ID NO: 58034 - DNA, 201 bp, Homo sapiens
gcacaggcttacaccttgtcactgattgtttcctggaacagttagattacaagttaattatattaattgttgctgaatagagagtaggtattttagaggasgtttgggggccataattggtgaagagtcagatgtggattagtttagagtgagagatggggataaacaagataatagcataagtggtttggagttgggatg

SEQ ID NO: 58035 - DNA, 201 bp, Homo sapiens
aatctggcttaaatgacaaccttggccttgactttgtcttatttgaaagcagttgagtatcccaggattaacaaaccagactgttacggtgtttcttgttrcctggagctgaaagggtttgtgtgagctttggagtcagattgttcaggagtcaaattgtggggcccccacactgtctgactttagacttttttttttttt

SEQ ID NO: 58036 - DNA, 201 bp, Homo sapiens
ccttccgccgcgccgtaggtttgttgcctcaccagtgcgcccgccggagggtgtttatcgcggctagagagatgtcgctgctgcggtcgctgcgcgtgttyctggtcgcgcggaccgggagctacccggtgagaagtcctggtgctggtaccgacctgctgtccctgcagctctcctgtgcgcctgtacctttcccttcct

SEQ ID NO: 58037 - DNA, 201 bp, Homo sapiens
ccacatttcttgtgttgttgttttgtgacgactttatttcttggtttctgttattttacctggggtgggaggtggggggtaattcccgtatgaaatgtgtygtctcaagaaatcaagtagaggcgaggactgtgttcctccggccagcaggtggcaccatactcgtttggtgcgttccgctggagaattctggcccttccg

SEQ ID NO: 58038 - DNA, 201 bp, Homo sapiens; identical to SEQ ID NO: 16828

SEQ ID NO: 58039 - DNA, 201 bp, Homo sapiens
agcagagaaatggaagaggagtgaacagaagctagctgatagactgatgtaggtggagagaaaagaatcaagaaagaaccctggttttttttggtttgagytcctaggtagctcagatgtccattgagcggctacaatgtgccggagctgtcctaggccatttgctgagctgagttttttactcacggagagctccacttc

SEQ ID NO: 58040 - DNA, 201 bp, Homo sapiens
gcagtggcacaatctcggctcactgcaagctctgcctcccgggctcacgccattctcctgccttagcctcctgagtagctgggactgtaggtgcccgccascacgcccggctaattttttgtatttttagtagagacggggtttcaccgtgttagccaggatggtatcgatctcctgaccttgtgatccgcccacctcggc

SEQ ID NO: 58041 - DNA, 201 bp, Homo sapiens
gctccccagtagctgggattacaggcgtgtgccaccatgcccaactaatttttgtatttcgttggagacggggtttcaccatgtttgccaggctggtctcraactcctgacctcaggtgatccacccaccttggcttcccaaagtgttgggattacaggcgtgagccaccacgcctggccaatacttttcttagagataga

SEQ ID NO: 58042 - DNA, 201 bp, Homo sapiens
gtgcgttccgctggagaattctggcccttccgccgcgccgtaggtttgttgcctcaccagtgcgcccgccggagggtgtttatcgcggctagagagatgtygctgctgcggtcgctgcgcgtgtttctggtcgcgcggaccgggagctacccggtgagaagtcctggtgctggtaccgacctgctgtccctgcagctctcc

SEQ ID NO: 58043 - DNA, 201 bp, Homo sapiens
ggctccccagtagctgggattacaggcgtgtgccaccatgcccaactaatttttgtatttcgttggagacggggtttcaccatgtttgccaggctggtctyaaactcctgacctcaggtgatccacccaccttggcttcccaaagtgttgggattacaggcgtgagccaccacgcctggccaatacttttcttagagatag

SEQ ID NO: 58044 - DNA, 201 bp, Homo sapiens
caggagtcaaattgtggggcccccacactgtctgactttagactttttttttttttttcagacggagtcttgctctgtggcccaggccggcgtgcaatggyacgatgttggctcactgcaacctccgcctcccgggttcaagcgattctcctgcctcagcctcctgagtagttgggattacaggcgtgcgccacgacaccc

SEQ ID NO: 58045 - DNA, 201 bp, Homo sapiens
tattgtctacacttagttgtcttaaagaatgttttctttctttcttttttttttttgagatggagtctcaattctgtttccccggctggagtgcattggcrtaatctgagctcagtgcaacctccgcctcccaggtttaagcgattctcacgtctcaggctccccagtagctgggattacaggcgtgtgccaccatgccca

SEQ ID NO: 58046 - DNA, 201 bp, Homo sapiens
atggtatattgtactacaacctgggctatatggaattgccagctgctcctaggctacaaaccgttacaaaatgttactggactgaatactgtaggcagttrtaacacagtggtaagtattgtgtatctaaacatagaaaaagtacagtaaataggcataaaagataaaaaacgatacatctccatagggaacttatcatgt

SEQ ID NO: 58047 - DNA, 201 bp, Homo sapiens
tgaccttgtgatccgcccacctcggcctcccaaagtgctgggattacaggcgtgagccaccgcacccagccctagttaatgctccatatatatatatatawgtatatatatatataaatttttttttttgagatggagttttgctcttgttgcccaggctggagtgcaatggcatgatctcgctcgctgtaacctctgctg

SEQ ID NO: 58048 - DNA, 201 bp, Homo sapiens; identical to SEQ ID NO: 16830

SEQ ID NO: 58049 - DNA, 201 bp, Homo sapiens
tgtacctggaacccaccttccctctgctgctggggaccctccaacacctgtgcaggccccatggcaccatctatctggcctccaagatgagaaaggagcaygggacagagagcttctttcagcacctcctgccccagcatttccaactggagctggctcagcgggatgaggatgaaaatgtcaacatctatagggccaggc

SEQ ID NO: 58050 - DNA, 201 bp, Homo sapiens
ctcctgcagcccagacctacctcttgcttttgcagcaatataaatgtcaccctgggcgcccacaatatccagagacgggaaaacacccagcaacacatcaytgcgcgcagagccatccgccaccctcaatataatcagcggaccatccagaatgacatcatgttattgcaggtaccacctacctggccctctggctccttc

SEQ ID NO: 58051 - DNA, 201 bp, Homo sapiens
tccgccaccctcaatataatcagcggaccatccagaatgacatcatgttattgcaggtaccacctacctggccctctggctccttcctagtgtgtccgggsacaatggaggaggaagtgagggcaaggctccggggtggcggggagggcatgggatgtgtactgcaccagcgacccccgagccttggctggaggccccagc

SEQ ID NO: 58052 - DNA, 201 bp, Homo sapiens
atttctgctctcggcactgacttagcagctgctcaagagctcactatgttggcttggattacacggtctcacccacatctccggcagtttgtgggcaaacytcctgagcagccttgggtgatgaaacctttcatggtagcaggagaatgggactgtgaattctcaatcccctgtccccaccccttccttcctctctcaggg

SEQ ID NO: 58053 - DNA, 201 bp, Homo sapiens
gtgaaagaaagaccaagtgagtctttgcgggagggaacaggccagtgtaaatgaggaggaaaggaggataagatcaaaaagagcaagaggaagagatggargacacatattggggctcaaaatataaactcaggctatttatcaacttaatctggggaagcaaacctgaaggcaagtaccaccctgtcatccctagctcag

SEQ ID NO: 58054 - DNA, 201 bp, Homo sapiens
ttaaagtctaggaggaggaagcacagcagcaactgactgggcagcctttcaggaaagatgcagccactcctgcttctgctggcctttctcctacccactgsggctgaggcaggtgagtgaccatccccaccctcagaggcctgacctcatcccatagattcttgagccaaattgccttggtatatcctaattctgtactgt

SEQ ID NO: 58055 - DNA, 201 bp, Homo sapiens
aaggaggataagatcaaaaagagcaagaggaagagatggaagacacatattggggctcaaaatataaactcaggctatttatcaacttaatctggggaagyaaacctgaaggcaagtaccaccctgtcatccctagctcagagctgctgagaaagaggatacagctgagccccagggccctcccatcccctcgattctggt

SEQ ID NO: 58056 - DNA, 201 bp, Homo sapiens
ctgtcatccctagctcagagctgctgagaaagaggatacagctgagccccagggccctcccatcccctcgattctggttagctgcagtcttgccctccccrtgctgtctgcctaccctgcagagctggtggaccatagctcctgcagcccagacctacctcttgcttttgcagcaatataaatgtcaccctgggcgcccac

SEQ ID NO: 58057 - DNA, 201 bp, Homo sapiens
gtgtttcctgtagaaccctggagccccctcccaatctgctgccccatagactccaagcctcagcaccatctcctccctctcctgcaccctctctcctgccrtccccatcttccagcctttctggagccaccaatctggtacccacattgcaggttcagcaagcatagagctaagtgccaaatgcttccttccaggggagat

SEQ ID NO: 58058 - DNA, 201 bp, Homo sapiens
ggcttggctcctgtaccccaccgatcttccatctcacacacacccagcaattgaaggggcccacccacccctgccttccctgagagcccggagctcagggmagcaggagcagggaggcctgtctcagtctcccttctcctctctacctacagggggattccggaggccccctgctgtgtaacaatgtggcccacggcatcg

SEQ ID NO: 58059 - DNA, 201 bp, Homo sapiens; identical to SEQ ID NO: 16842

SEQ ID NO: 58060 - DNA, 201 bp, Homo sapiens
taccgatcttgcagagttgccatgagagttaaataagttagagtatttaaatgtcttggaattgcccgcacactataagtgctataaaaacatgctttgtrtaaataatttggcagcatgtgtcagaccctacctaggaggtaagaatacagcaataacagtaccatcagctcatgtctagatttttaaacaccagtccca

SEQ ID NO: 58061 - DNA, 201 bp, Homo sapiens
accagcgacccccgagccttggctggaggccccagctgagcgggaacgcctacattcttcctccagctgagcagaagagtcagacggaatcgaaacgtgarcccagtggctctgcctagagcccaggagggactgagacccgggacgctgtgcactgtggccggctggggcagggtcagcatgaggaggggaacagataca

SEQ ID NO: 58062 - DNA, 201 bp, Homo sapiens
ttagccctgtcccttccttagcaaggctttgccctgcagctgacataaacagattatgcatcctctgcctccctcatcagaccagggacccctgtgtacascctctacaacctccttggcaacctcctctgcttccccctccacaggcaagaatgtgcggcggtccatccagggcgtggggcacatgatgtccaccatggt

SEQ ID NO: 58063 - DNA, 201 bp, Homo sapiens
agaaaggggcaggcagagcagctgctgtgcagccagtgcagggaagagggtggtttgagtgtctccctgtgctcccctctttcccgggctgggcctacaayctgcttccatctgcccctctccccacagctgccaacatgaacctggatcgcatcggggagcaggcggaggccatgtttggagtggggtgaggccagggtt

SEQ ID NO: 58064 - DNA, 201 bp, Homo sapiens
attcggttttctcctcagtaaaatggcactaaaaacaagccccttgctggcaagttggtgagaattcagaggtaacaggcatgggggtgttaagacagagktggcctttgacacggtgggtgatcagcatcactttatcttagaggctggagtggcattgacaaattttaaatgcaggaagggtggctggatgggtagatg

SEQ ID NO: 58065 - DNA, 201 bp, Homo sapiens
ccagtctggtcgacagagtgaaactctgtctcaaaaaaaaaaaaaaaaacagaaaagaccttgttaaccaacccagggagaggaggtacagaaggagcacrggctttgaaatcagctctgtgggtttaggcaagttatttaatattcagattcggttttctcctcagtaaaatggcactaaaaacaagccccttgctggca

SEQ ID NO: 58066 - DNA, 201 bp, Homo sapiens
agaggcatgagaatcacttgaacccaggaggcgaaggttgcagtgagccaagatcgtgccatgcactccatcctgggcaacagagtgactgtctctgaaaaaaaaaaaaaaaaaaaaaaaaagacaggatccaaacgtggtatctctgtccaaagctatggagatgccctccatgctgcccccatccaacaggggagcaaa

SEQ ID NO: 58067 - DNA, 201 bp, Homo sapiens
gacattgggctgcgccttatagctgtggactgggctggagagagggagctgcaggtgggctgcctgagctctagtattaatacctcagctctcttcctggratgggggctgcaacaggcttccttcctgctgccagcaggtagaggctgagctggggatctggcctggggggagggcattcacctatgcagagccacataa

SEQ ID NO: 58068 - DNA, 201 bp, Homo sapiens
gaggcatgagaatcacttgaacccaggaggcgaaggttgcagtgagccaagatcgtgccatgcactccatcctgggcaacagagtgactgtctctgaaaaaaaaaaaaaaaaaaaaaaaaagacaggatccaaacgtggtatctctgtccaaagctatggagatgccctccatgctgcccccatccaacaggggagcaaaa

SEQ ID NO: 58069 - DNA, 201 bp, Homo sapiens
catgggaaggcctgggagagctctggatttggggtctgggatgcgggctgagggcagagtgcctgggctttggctgttctctagggggctcagcttgcatccccctctctgtgtgctggctctggaagaggggccctgccagcagccaaccctgtctgaggcaggtggggctgggccctgggtgggtccttgagcctggag

SEQ ID NO: 58070 - DNA, 201 bp, Homo sapiens
aacaagacaaagggaaccagtggcttggagcgagttatcaaaatattggagaaaacaaattagtagtgacagttatatatgtgcctctttactaatacgtwaagtagcgagctgcactggtgggtgtaattagtaccactacttcaaggcagcgacgaatataaacgatattttgtgatttaacaactctgaggtgatgtg

SEQ ID NO: 58071 - DNA, 201 bp, Homo sapiens
tgttggagcattggtgtgtatgtgtgtatgttcatttgtggttctatggagaggggccatgaagggctcccctggaatgatatgggcacccctgggagggygcagcctgcctgcccaaacccagggccctatgtaggtgaccatgttttgcagtgggtcgtgtgggtatagtttggtgtccagtagctcccccacatcttg

SEQ ID NO: 58072 - DNA, 201 bp, Homo sapiens
ttacataaccatagtacatgatcacacctaagaaaattacaacaataccaagtccatatcacatttctctaatgttcccagaatgtctttgtaaagtttgtttttttttttttagaaacgaggatccaattaaggttttttcattccattctgttgctctgtcactttggtctctgtttcagaacaatttttcacctctcc

SEQ ID NO: 58073 - DNA, 201 bp, Homo sapiens
tggttatcttttttttttttttttttgagatggagtttcactctgtcgcccaggctggagtgcagtggcgcgatctctgcttactgcaagctctgcctccygggttcacgccattctcctgcctcagcctcccgagtagctgggactacaggtgcccgccaccacgcccagctaatttttgcatttttagtagagacaggg

SEQ ID NO: 58074 - DNA, 201 bp, Homo sapiens
ttgtgatgtcacgcagtcccgacagctccctgtgaaatatcaataccagtcggcgttggcctttaaaaaaataagtgcctgccatgtaccaggcactgagyactggacttgcattatcgcatggcattctcacagcagccctgacagtgaggttactactctccctcccattccagagcggggagaaatccaggcccaggg

SEQ ID NO: 58075 - DNA, 201 bp, Homo sapiens
caaaaatcagtatatatggggcacgaccacgtgccagggacttccctaagtaccccacatgtgttgacgaatttgatcctcactgcctggaggaggcgccrtgattcttaccccgttttactggtgaggaagctgaaacacaggccagagtcgctgtcccagggctcacagctaggaagcggcagccaggatttgagcttg

SEQ ID NO: 58076 - DNA, 201 bp, Homo sapiens
tgtggtggagcccgcggccggggacctggacaacccccctaagaagttccgtggtaagacctccgcttcctctgcccccgcccctcccaggctgcagggtyctggacctgcgactgaatttattcaactgcattcagccccagtggctggattagatgtggcgctgccctgcagacctcactctgctgtcggcggaatccc

SEQ ID NO: 58077 - DNA, 201 bp, Homo sapiens
gggaagtcagggtagagccggggggaatcaaagaggcagaaactccttttacccaacaaggggaagaaagcctctcagtccctcaagcataggccggggtgggggggtctctgtctcccagacccttggtctagttcactctgtctcctggtgtggcagccctgagcctggcctctggctggctgaactgcccccgcacca

SEQ ID NO: 58078 - DNA, 201 bp, Homo sapiens
cagacccagagcgaggatggtggcagtcagacgcaggcctgggtctttcagggttcagggctgccaatatgttttgccctgcctgtttggggtctcagtgrataagtgacagaccacagccacatgtgacactagtcagtgagtaactgaagccaggttatgtggcagctcagggcaggcagtgcagggaggcctgtggcc

SEQ ID NO: 58079 - DNA, 201 bp, Homo sapiens
ggatcacccagggctgggtaatcatagtgagtaggagatgctgcctcttacccatgggattctctgtctacctgccagcctgacctgcttccctggaggtmaggacccaagaagtatgggggtgaatatagacgaagccccaggtctccaggctcaggatccctaggtcggaaacctcagaggcatagctctcaggaaggg

SEQ ID NO: 58080 - DNA, 201 bp, Homo sapiens
ttacacctcagccgcccgagtagctgggactacaggcgtgtgctaccgcatctggctagtttttgtattttttatagagatggggtctccccttgctgccyaagctaatctaaaactcctgggctcaagtgatcctccctcctctgcctcccaaagtgctgggattacaggcatgagccgccgtgcctggccgttgctgga

SEQ ID NO: 58081 - DNA, 201 bp, Homo sapiens
ccctgccaaggtccagatggaattattttaaagccgaaggaattccatgaaattccatttcacagtcatattgttctatttacttttatgggtggaattgktttttttagtgcttccctagcctgttgcaagggtctgattcagcgcctgtgacctccttcccccttcctgtcccgggtgccagctggaacttggctgtgg

SEQ ID NO: 58082 - DNA, 201 bp, Homo sapiens
ttagtctgtatttcaaactgatctttgtgtacaggtttatctgttggtctgagaattcacagcttactacaaggaagctgagaattgcttggtgccccctccccccccgactcctctgtcctgggaaacgtggctttgcctcccagacacgtgtcagatgccagctctcctcagcggagcctcctgatccctcaatttgcc

SEQ ID NO: 58083 - DNA, 201 bp, Homo sapiens; identical to SEQ ID NO: 16855

SEQ ID NO: 58084 - DNA, 201 bp, Homo sapiens
agctgggactacaggcgtgtgctaccgcatctggctagtttttgtattttttatagagatggggtctccccttgctgcccaagctaatctaaaactcctgrgctcaagtgatcctccctcctctgcctcccaaagtgctgggattacaggcatgagccgccgtgcctggccgttgctggatgctttgaacaaggccctgcc

SEQ ID NO: 58085 - DNA, 201 bp, Homo sapiens
ggagaagtgaggctgcagatgtggtagaactcagcctgtgggcctgatagaactcaagcagggtcccagtagcatcaggcacctagcagaactcagacaayaggccagaaagaaatcaagcatgcattccttgtcacttgtcgtcgtttatttaaaatcaggaagcacctgctacgtgccacggactgtacatgcatgggg

SEQ ID NO: 58086 - DNA, 201 bp, Homo sapiens; identical to SEQ ID NO: 16857

SEQ ID NO: 58087 - DNA, 201 bp, Homo sapiens
tgccctcatcagacttcataatgtcattcaacaaacatttattaggcatctaccatgtgctaggcaaggcactgttttaggcactgcagaatcagtggtamccaaggcacaggtccagcttgttccgttctgtgcagtggggccctttgagccttaagtctgagacacatgtaattccaggagcaggggactgcctttccc

SEQ ID NO: 58088 - DNA, 201 bp, Homo sapiens
agacatcagctggggaacccccaaatcccagccaggggagggttttcctgatttcaggtaagggctgtggtcagagtcccagtttctccctggtaagcaamggagaggagagcccagggcttgctggaccgagagagtgtgacacgtgccccctcccgcccgcagctgaccaatgcaggtgacgatgtggtcgtgttctac

SEQ ID NO: 58089 - DNA, 201 bp, Homo sapiens
gtaagggctgtggtcagagtcccagtttctccctggtaagcaaaggagaggagagcccagggcttgctggaccgagagagtgtgacacgtgccccctcccrcccgcagctgaccaatgcaggtgacgatgtggtcgtgttctacaatgataaggcatcgctggcccacctgctggacatgatgaaggccgcccgcgacggc

SEQ ID NO: 58090 - DNA, 201 bp, Homo sapiens
caaagatgatgatgatgatggcagtgggtagactttacagatcacttacattgggtggccctggcctttacctatgctctcacagcctgaggcataaatayaattcaggaaaagtagtgggaagcatttagaacaccaatttgcttaccacctagacttaatcattgtttacagtggtcacatttgatatttgtatttttt

SEQ ID NO: 58091 - DNA, 201 bp, Homo sapiens
agccagggaagtgggcaggaaccggaggccaggggacaggagcattgtggcagggagagcctggccaggcggccctgcttgcgcccctgacctcccgcccrctgcccaggtgaaaatggcctatgtgaacttcgtgaaccactgctacgtggacacggaggtggagatgaaggagatctacaccagcaaccacatctggac

SEQ ID NO: 58092 - DNA, 201 bp, Homo sapiens
tgtgtgtgttggagcattggtgtgtatgtgtgtatgttcatttgtggttctatggagaggggccatgaagggctcccctggaatgatatgggcacccctgsgagggtgcagcctgcctgcccaaacccagggccctatgtaggtgaccatgttttgcagtgggtcgtgtgggtatagtttggtgtccagtagctcccccac

SEQ ID NO: 58093 - DNA, 201 bp, Homo sapiens
agttctgggttatggagagtgggagacaagcctggggctggcaggccaaatatatgaggcaagggctggctggcggcccatggttgcaccttttctccctytcttcccagctttccctttggtctcctgctccctgtctttcttctccttggccttacagatatgtcctcccatgcacccagcaccgctgtagagacccca

SEQ ID NO: 58094 - DNA, 201 bp, Homo sapiens
cagctgcagcacctgctgaagccggtgaagcgcattcaagaggaggaggccgagggtatctcttccatggtgggtgctggccccgagactggggtgggggkggggcctggaacccagggaggacacttgacccaagggcgtggcctggaacagagtgaggccctagaatatgagccaggctagaatttgggggtacagctc

SEQ ID NO: 58095 - DNA, 201 bp, Homo sapiens
cgccagcccgccccggccgcaccgagcgtcgggatccgaggtgggagcgtacccctccccgctccccggacgcctcagtcctccgcactgagcttggccaygcgcccctaggcgccccccacgccctgggccccggagggccgcagccatgagtgaaatgtccagctttcttcacatcggggacatcgtctccctgtacgc

SEQ ID NO: 58096 - DNA, 201 bp, Homo sapiens
ctgggcatcgggcccacactcaacatcctgggtgccctcaatgtgagtgccagagggagcccccattcccaaacaagctcatgctcactgtgcattcagayggcaagctggcctgctgcttccaggagccactgctctgtcccatcccctcctctctgttgggctcccaagttccttatagaccggtggcagggactgttc

SEQ ID NO: 58097 - DNA, 201 bp, Homo sapiens
tcagctcgatgctcagcagtggagccagctgtgcagctgccgcccagcggaacgcctccagctacaaggcaaccacgcgggccttcccccgcgtcaccccyaccgccaaccagtgggactacaagaacatcattgagaagctgcaggtgggtgtggggctgcctggcatctgcctcgggagctgcttggttgagtcagcag

SEQ ID NO: 58098 - DNA, 201 bp, Homo sapiens
tggatgcccacaaggtcatgctggacctgctgcagatcccctatgacaaggtggctctgacttctgacctctgactccccagggtggcttccccctgaacsccggcctgacctgtatgctaggccctaatgcaggcaacctctcccagcctcgcctggcctcttacactgccctgtttgtttgcaggcacaccttgacccc

SEQ ID NO: 58099 - DNA, 201 bp, Homo sapiens
ggtgtaatggaggaggctaaaaccaggcaccaggaacttaaccgggaaggcggccaggagaaggtggcttttcggcacctgttggacctgctctggggccrtggtgggcttgagggagccctgctcaccctgcccctggcccccaggcgtgctggactcccctctcatctcattgctcttctggatcctcatctgcttctc

SEQ ID NO: 58100 - DNA, 201 bp, Homo sapiens
acccaggcctgcagccaggcccctgcagccccagcggccccagcagtgtggtgtgcctgccccacgccctgagtaggagcagggcccagtgctgaggttgytccctggccactgtccacctccagaaatccttccacaacctgatgatgagtgacaagaagtcagagcgcttcttcaaggtgctgcacgaccgcatgaagc

SEQ ID NO: 58101 - DNA, 201 bp, Homo sapiens
tggcagggagagcctggccaggcggccctgcttgcgcccctgacctcccgcccactgcccaggtgaaaatggcctatgtgaacttcgtgaaccactgctaygtggacacggaggtggagatgaaggagatctacaccagcaaccacatctggacgctctttgagaacttcaccctggacatggctcgggtctgtccctgtg

SEQ ID NO: 58102 - DNA, 201 bp, Homo sapiens
gcagtctaccacacgcctcctcgagtgtccgtggctacagcagcagcacaagggctccgtggaggcctgcatccggaccctcgccatggtgggtgagtgtsccggggcactggccagccccaaaccactcctcctgccgctcacagtggggacgcctgccctcctaataaacactttatccctaagctcgcccatctcctg

SEQ ID NO: 58103 - DNA, 201 bp, Homo sapiens
ctccagctagttttttatgggtatttgcagatgggctcaggcaggagcaggcctgtggattgttagggacagttggggaagaagagaggacaggtgagagrgaggaaggggaagtcagggtagagccggggggaatcaaagaggcagaaactccttttacccaacaaggggaagaaagcctctcagtccctcaagcatagg

SEQ ID NO: 58104 - DNA, 201 bp, Homo sapiens
ggaggtgtgggagtggaggggccccatgtgaggagcccccagccatccctctctcctgcctcaggtctgcagcaagcgtgagaagcgcgtggctgaccccmccttggagaagtacgtgctgagcgttgtgctggacaccatcaacgccttcttcagctccccattctctgagaacagcacttccctgcaggtgagcttctc

SEQ ID NO: 58105 - DNA, 201 bp, Homo sapiens
tttatgtttaataatttgctagaatggctcacagaactcagaaaacagccagatggaagagattaatatggagcaggagatacagagcttccaggccctcyccaggggtgaccccctcccagtacccacatgtgttcaccagcccagctctctgaacctggttttttgtttgcttgtttgtttgtttttttaacggagtcc

SEQ ID NO: 58106 - DNA, 201 bp, Homo sapiens
cagttggggaagaagagaggacaggtgagagagaggaaggggaagtcagggtagagccggggggaatcaaagaggcagaaactccttttacccaacaaggrgaagaaagcctctcagtccctcaagcataggccggggtgggggggtctctgtctcccagacccttggtctagttcactctgtctcctggtgtggcagccc

SEQ ID NO: 58107 - DNA, 201 bp, Homo sapiens
ggctgggagccagaagacctgggatctggaacttgctgttccattaacttgtgtgacctgggcgggtcagtttctcctccatgccctagggacagttttcwcatccacagctgaatgggggcggggggagggttgttcagggtccctcggggatttccccagtctgtcattcccccagtctgtcattccccctcccatggt

SEQ ID NO: 58108 - DNA, 201 bp, Homo sapiens
gggtgtggggctgcctggcatctgcctcgggagctgcttggttgagtcagcagctcccctactttggaggggcaagttctcggggagtgtttcttcctgtyctgcccacacttccaggaaggggctggttggcttctctacactctggggctgctaagggccgacccagcagcaagggactggggaacctccttccagagg

SEQ ID NO: 58109 - DNA, 201 bp, Homo sapiens
ggagccgggatgaagaccaaatatatatttcttattatatcattaacactttgcattgtgcaaggtgttaatcattacaaagaaaacacacaggggctccsttctcaaggaactcacagtgtagacacagcaagtcaagaagtggggagagacactgccaggaccaggtgccggaacatgaaggagggaggcccacagggg

SEQ ID NO: 58110 - DNA, 201 bp, Homo sapiens
gtcagcagctcccctactttggaggggcaagttctcggggagtgtttcttcctgtcctgcccacacttccaggaaggggctggttggcttctctacactcyggggctgctaagggccgacccagcagcaagggactggggaacctccttccagaggaagcctggagaacccagaggcctgctagtggggttggagctcatg

SEQ ID NO: 58111 - DNA, 201 bp, Homo sapiens
gactccacacctaggtatgtgcacgaggtaaggcctgagctcaggccttatgatcctcctcaggacccttgggggcaaacttctcctgcagtttcttccayatgcctttatctatttccttaagctcttccaaggtgtctgcaaaaggggaagacaaaaagagagagggactgaagtctaaaacttgatgacatagattgg

SEQ ID NO: 58112 - DNA, 201 bp, Homo sapiens
ggagggtgggatattgacccctacctccctctgagtccctccagagtcaaaaggccagagagggtccagaacccacccacccagagatctccaggcctccytggggtctgactccccatgcctgtccagtctctccttcctgcctcacacctgtgtgcccctaggtggtccaccacgacccctgccgtggaggagctgggc

SEQ ID NO: 58113 - DNA, 201 bp, Homo sapiens
tggcctgagctgctcttcctggagggcagtgaggcctaccagcgctgcgagagtgggggcttcctgtccaagtgagcgagacactggggcatgggggcagsaggggtgcagcggcaggggacagagaagggcccggtggggactagacaggctcactgggtcagagggcctgggggtgttcctgcctgggatggggtgggg

SEQ ID NO: 58114 - DNA, 201 bp, Homo sapiens
tcccaggataagatgtgcaggggggtggccaagggggtgggcagctccagcctcaccaggtctcgcccacaggccgcgtggcctccttctcgatacctggytcctcatcccgctactcgctgggccccagcctgcgccgggggcacgaggtgagcgaacgtgtgcagagcagtgagatgggcacatccgtgctcatcatgc

SEQ ID NO: 58115 - DNA, 201 bp, Homo sapiens
taatcaatgcatgcacagggcccctccccagcgtcctcttgccctgcccctcactcaggcctggctgctccatgtcctgttgttgtgacccacccagaatytccccagtggagcccaggctctgtgggtttaatgtgctcacttggaggcacaggtctgacctcgcctgtcccagttccctgaaggatggacgggtagaga

SEQ ID NO: 58116 - DNA, 201 bp, Homo sapiens
gggcagctccagcctcaccaggtctcgcccacaggccgcgtggcctccttctcgatacctggctcctcatcccgctactcgctgggccccagcctgcgccrggggcacgaggtgagcgaacgtgtgcagagcagtgagatgggcacatccgtgctcatcatgcagcccatcctgcgctttctgcagctgctgtgtgagaac

SEQ ID NO: 58117 - DNA, 201 bp, Homo sapiens
atcagaaatggccttgtcctgaagactcccagaagttctgccccccaccatcttggggtgagcctggccattgctgggactcccagctccctgcccggctscctgccagctcccctttcacttgctgaccctggaggctggactcgcaaagcccccaccacccccacctcgggaaggaatccctgcatggctccttgcttg

SEQ ID NO: 58118 - DNA, 201 bp, Homo sapiens
cacagtcctccctgtcctgcaggtaccagctgaagctctttgcccgcatgtgcttggaccgccagtacttggccatcgacgagatctcccagcagctgggygtggacctgattttcctgtgcatggcagacgagatgctgccctttgacctgcgcgcctccttctgccacctgatgctgcacgtgcacgtggaccgtgacc

SEQ ID NO: 58119 - DNA, 201 bp, Homo sapiens
ccctgggaagcccaggctgctgatgccctgctatgtgtggcacccacgctaggccagcccttgaactctgcctggctgtaacgtttcgggctgtggctgcygtgagtcccgagctgctgactgggctgagcctggggcacattccctctcctagccctttttccttcttttcctcctcctgttggggcaagggacctgggt

SEQ ID NO: 58120 - DNA, 201 bp, Homo sapiens; identical to SEQ ID NO: 16862

SEQ ID NO: 58121 - DNA, 201 bp, Homo sapiens
gcaagggacctgggtagcccttgtctccaggtctacctcagggaagctcagagcctgcacccccagccccagtgcccccaagacatgtgtgtgggggcagktgccagggaggagagtgatgaggtgactgccctccatttgcatgactggatgcccccttccctagcctacgcctcctctacctgtccatgctccaagccc

SEQ ID NO: 58122 - DNA, 201 bp, Homo sapiens
tgccagggaggagagtgatgaggtgactgccctccatttgcatgactggatgcccccttccctagcctacgcctcctctacctgtccatgctccaagcccrgcttattgttattgtgattaagatatatttcaagtctacacgatagtaaagagaaaaatagggctgggcgcggtggctcacgcctgtaactgcagcactt

SEQ ID NO: 58123 - DNA, 201 bp, Homo sapiens
accccatcctgcagctctttgacctcatctaccgcgaggagacgctgttcaacgtcatcaagagtgtgacccgcaatggccgctccatcctgctgacagcyctgctggccctcatcctggtctacctcttctccatcgtcggcttcctcttcctcaaggatgacttcattctcgaggtcgaccggctgcccaacaaccact

SEQ ID NO: 58124 - DNA, 201 bp, Homo sapiens
gtgggccttgagttgggcactgaaggccgaggagggtgtgaaagaggagaggcctgagcagtggctgagaggtgagaagagtgggcatgatgggggcaggrtggtgaggagacgggctcaggcctggctggggcagaggggtatgcgggggtgatgaaaggaccacgtgacacaggagcagatatggggcatggagccgcc

SEQ ID NO: 58125 - DNA, 201 bp, Homo sapiens
gctggaacatacactcactctggatgcaaatatattctggtttagctgaggacttgctatgtgtgtgtctgctgtctgggtagctgagtgtttgccacagygggggtgaaggcaagcctatgggtgggctggctgtgcaggatgcttctcattaagccggggggagggaggatgggaaggtcatggcacctgaccttttgt

SEQ ID NO: 58126 - DNA, 201 bp, Homo sapiens
ggaacatacactcactctggatgcaaatatattctggtttagctgaggacttgctatgtgtgtgtctgctgtctgggtagctgagtgtttgccacagcggsggtgaaggcaagcctatgggtgggctggctgtgcaggatgcttctcattaagccggggggagggaggatgggaaggtcatggcacctgaccttttgttgg

SEQ ID NO: 58127 - DNA, 201 bp, Homo sapiens
caagctgctcctggctctgatggagagccggcatgacagtgaaaatgctgagcgaatcctcatcagcctgcggccccaggagctggtgaggctgggcaggygggcaggcgggcggaaccaggtggagtgtgttgggatggggatgagggcccggctggccctaccgccctaggaagagagcattggaacaggcactgcccc

SEQ ID NO: 58128 - DNA, 201 bp, Homo sapiens
tgggccataacatctatatcctggcgctgcaggtaccagttccacccgtggcaacggccatcacccccctggccaccataccccgccccagctgccatcaycccccagtcgccattgtcgccccccagccaccatgtcccccagccaccacaccctggtgactgtgctgccatttccctcagctctccaggcacaataaac

SEQ ID NO: 58129 - DNA, 201 bp, Homo sapiens
cacatagggagagaggtggtccagggtgggtttgaacatgggaaggcctgggagagctctggatttggggtctgggatgcgggctgagggcagagtgcctrggctttggctgttctctagggggctcagcttgcatccccctctctgtgtgctggctctggaagaggggccctgccagcagccaaccctgtctgaggcagg

SEQ ID NO: 58130 - DNA, 201 bp, Homo sapiens
cttcttcgaccagtcctccttcctgcacaacgagatggagtggcagcgcaagctccgcagtgaggacccacgggcgggagggtggggcggtctggagctgytcactgatgccctgttataacggcctcctttgcctgcctgtgggtgccctgcgcccaaccccgcctcaccccaaggaagggctcttccatgtgtggcttc

SEQ ID NO: 58131 - DNA, 201 bp, Homo sapiens
cctctttgtatagggcaggagaagaagctgagcaagggtgtggtttcagtggaagatgcgcctcagcctgacccctcggggagctcaggattgtgagctgytcctcggactgtcccctccagaggctgggctgttctatgcctgtgtcagtcactggataggggctgcccctgggaagaggggtatgtcatttcccaggca

SEQ ID NO: 58132 - DNA, 201 bp, Homo sapiens
atggactttcagctcatttccagcttttggcaattgcctgcgatgctgcagtgagcctccttaggctcgtgtgctcgggttcctctggtatgttctgagtkgggggattactaggtgagaggaatgcgcctccatggcatgagaagtgaccctgtggcgactgtgggggcagctcccttcgctctgcccacatccttgcca

SEQ ID NO: 58133 - DNA, 201 bp, Homo sapiens
tcaccccaaggaagggctcttccatgtgtggcttcctcctgagcggggccccacatgcaaggggcagggggtgctcaccagggccctccagcagctcaccrttgccctcctcttcaggcatgccgctgatctactggttctcccgccgcatgaccctgtggggcagcatctccttcaacctggccgtgtttatcaacatca

SEQ ID NO: 58134 - DNA, 201 bp, Homo sapiens
cgatctcagctcactgcaacctctgcctcctggattcaagcgattcttcagcctcagcctcctgagtagctgggattacaggcacgtgccaccacacctgkctaatttttgtatttttagtagagacagagtttcactatgttggtcaggctggtgtcgaactcctgaccccgtgatccacccgcctcggtctcccaaagt

SEQ ID NO: 58135 - DNA, 201 bp, Homo sapiens
cacaggtgagaacacagggctggccggcaggttccccgggccctgccatgcttcctccctgggttggggcagagccttgaggccagctggcctctgagggsaccagatgcagagtgtgcagaagcaccccctgcgccatcctgtgggctctcgccccatcatggagacacaggtgcggtcaaaggggatggtcagggtctt

SEQ ID NO: 58136 - DNA, 201 bp, Homo sapiens
cccatcttaaccatcgttaagcatacagttgagcagcattccgtacattttcatttctgtgcaactattaccaccatccatccacagaccttttttcatcktgcaaaactgaaactcagtacccattaaacaataactccccatttcctcctccccccagcccttgcaactaccattctactctctgtttctatgaatttg

SEQ ID NO: 58137 - DNA, 201 bp, Homo sapiens
tgtgtggtgtgtgtgtttgtgtgcatgtgtgcgtgcatgtgtggggctggggtatgtcttcctctaggagcagcttctgagcccacccttcacttctgtgygtgtctgtgcagcatgcggcgcagatggagcagaagcaaaatgacacggagaacaagaaggtgcatggggatgtcgtgaagtatggcagtgtgatccagg

SEQ ID NO: 58138 - DNA, 201 bp, Homo sapiens
ctcatccatatcccctccagccagccccctggggatgccacatggagctgctgcatttgtggacacctgcagtggggacaagatggactgtgtctcagggstctcggtgcctgaggtcctggaaggtgagggtggtgtgtgtgcaggagtctgtgtggggtaggaggagcaggcagcccgggcctcagcacactctccgct

SEQ ID NO: 58139 - DNA, 201 bp, Homo sapiens
gtgcagtggcgcaatctcggctcactgcaacctctgcctcccaggcaggttcaagcaattctctgcctcagcctcctgagtagctgagattataggcttgygccaccatgtctggctaatttttttgtattttcagtagagaccgggtttcaccatcttggccaggctggtcttgaactcctgaccccgtgatccacctgc

SEQ ID NO: 58140 - DNA, 201 bp, Homo sapiens
gtagagaccgggtttcaccatcttggccaggctggtcttgaactcctgaccccgtgatccacctgcctcagcctcccaaagtgctgggattacaggtgtgrgccattgcgcctggcctatgccacatgtatttttatttttattttgtttttgttttgagatggagtttcactcttgttgcccaggctagaatgcaatggt

SEQ ID NO: 58141 - DNA, 201 bp, Homo sapiens
tattttgtttttgttttgagatggagtttcactcttgttgcccaggctagaatgcaatggtgcgatctcggctcactgcaacctctccctcctgggttcargcgattctcctgtctcagtctcccaagtagctgggcttgcaggtgcctgccaccacggccaactaattttgtatttttggtagagactgagtttctccat

SEQ ID NO: 58142 - DNA, 201 bp, Homo sapiens
agctccaatgctctctgggaggtggaggtcagaaaagccctgcttctggcaccccggactcagccttggatgccacccctccctcttccccaccatcctgragggtgggatattgacccctacctccctctgagtccctccagagtcaaaaggccagagagggtccagaacccacccacccagagatctccaggcctccct

SEQ ID NO: 58143 - DNA, 201 bp, Homo sapiens
ccagtgagagtggccggcccagcccctcaaggtgccatccctatctcaaccccatcctgcagctctttgacctcatctaccgcgaggagacgctgttcaaygtcatcaagagtgtgacccgcaatggccgctccatcctgctgacagccctgctggccctcatcctggtctacctcttctccatcgtcggcttcctcttcc

SEQ ID NO: 58144 - DNA, 201 bp, Homo sapiens
atgacttgatggtggggagcttgttagagatggaggaattatcttaggggctcactggtaccctggcatcccctgctctaagggaagggatactgtgggakataggtctcttctctcctgctgaccgagctgctttgttccccaggctggtggatgaccgctgtgtggtggagcccgcggccggggacctggacaaccccc

SEQ ID NO: 58145 - DNA, 201 bp, Homo sapiens
ggggcagttttattgacgatggcaatgtacaagactccacacctaggtatgtgcacgaggtaaggcctgagctcaggccttatgatcctcctcaggacccytgggggcaaacttctcctgcagtttcttccacatgcctttatctatttccttaagctcttccaaggtgtctgcaaaaggggaagacaaaaagagagaggg

SEQ ID NO: 58146 - DNA, 201 bp, Homo sapiens
caggcccaccctgggttctatccctgggcagtccctgcctgccttcatccttcctgacccaccctcttccccactggcctctggccctgggcctggatgaraaggcaggtgccaaacccactctcccctgcatggcaagtcagactggggttgacaacccctgccttgggccactaaagacaaggccaagtggaaacttta

SEQ ID NO: 58147 - DNA, 201 bp, Homo sapiens
cagcagcagcacaagggctccgtggaggcctgcatccggaccctcgccatggtgggtgagtgtgccggggcactggccagccccaaaccactcctcctgcygctcacagtggggacgcctgccctcctaataaacactttatccctaagctcgcccatctcctgctcccaggtggttgtcagtaagttcttcttggcgtct

SEQ ID NO: 58148 - DNA, 201 bp, Homo sapiens
ccagcaagggaaagcaggcccacgcctgttcttggcaggagagcaaggccaatgccactgctttatcccttaccctaggtgggagcagcagaggccagggmtggagtagctgattagggccaacaaaaagtggaggattgaatgtggcctcaggccagtggctagggagaactggccttgggtacacagggtggacccatc

SEQ ID NO: 58149 - DNA, 201 bp, Homo sapiens
aggggccctggcccgccgccagtgccgaatagcagctgggcccacaggggaagacgggtgccaagctcttccacagcacccatggagggaaggtgccaggyggcctgaccaggcctgttggcatctgcttaaccctagatgacggagcagcggaaacgcaggcaacgcctaggctttgtggatgtccagaactgcattagc

SEQ ID NO: 58150 - DNA, 201 bp, Homo sapiens
tataccgtgttaacaaattatccccaaacctagcagttaaaacaacaagcattcgctatctcagtttctgtgggccagaatgacagtgggaatggtaccayccagcaggaactcctaactccagtgggtgggcggatcccggagtggcagcacttattcaccaaagataaggcagacgtgccatccatgggatggtacagc

SEQ ID NO: 58151 - DNA, 201 bp, Homo sapiens
aagcagcggtgctgcttgtcggagccagtaggggctctgtggctgagctgagtggtttctaaaactcgtatgggcgtgacagttcacacctgtaattccarcactttgggaggccaaggcaggaggattgcttgaggccaggagtttgagagcagcttgggcaacatagcaagaccctatctctacaaaaaattaataaaa

SEQ ID NO: 58152 - DNA, 201 bp, Homo sapiens
acctgcagtggggacaagatggactgtgtctcagggctctcggtgcctgaggtcctggaaggtgagggtggtgtgtgtgcaggagtctgtgtggggtaggrggagcaggcagcccgggcctcagcacactctccgcttgcagaggacagggagctggacagcacagagcgggcctgtgacactctgttgatgtgcatcgtc

SEQ ID NO: 58153 - DNA, 201 bp, Homo sapiens
gactgtgtctcagggctctcggtgcctgaggtcctggaaggtgagggtggtgtgtgtgcaggagtctgtgtggggtaggaggagcaggcagcccgggcctyagcacactctccgcttgcagaggacagggagctggacagcacagagcgggcctgtgacactctgttgatgtgcatcgtcactgtcatgaaccatgggcta

SEQ ID NO: 58154 - DNA, 201 bp, Homo sapiens
gccctccaaagatgtgagcactcctgcccactcccaaacctgtggggcccaagccactgtccagatcagcaactgtggagagtcctgtccttggcctcgcrtcagatattcagggttgaaccccctcccccgaacttgtatccacttttccctgctttccacacctggccaattccatgatattactgcttagctgccccc

SEQ ID NO: 58155 - DNA, 201 bp, Homo sapiens
atttttatttttaagtcatcaagactgaatgacctttccatcctcttctgtaaccacaatgacatcttgggtgttttgttctataggttgagtctaaacaytgaagatgattggaagcagatgcaggcattatttcttgcagagcttttacattactgcaatcgtataacttgctttgctctctgtccttgacttggatcc

SEQ ID NO: 58156 - DNA, 201 bp, Homo sapiens
tgccccctcaccctcccattccataaggaaagactttggcaaccaaactttgccccagggctagggatggtgaccactggctttcctagcccacagcaggygggcagagggcggagctgagtcagctttatcaggaggcctcatgatttggcttgggcagccacattcccgaatgtcaggccttcccctgttgcttgggag

SEQ ID NO: 58157 - DNA, 201 bp, Homo sapiens
ccgagtctacccacttgtttattcattcactcagcatcttctggcatgtgtatgtgtgggcaaggctctgagggaggatctatgtgagagaaaaagttgawtcttacaagttccagttattaagtttccaagaaagatacggaggagtcaggaggagcagggagggctcttttctgacttcactgctctcccggggatgct

SEQ ID NO: 58158 - DNA, 201 bp, Homo sapiens
gcagccacattcccgaatgtcaggccttcccctgttgcttgggagtgagaggccgcctccctggccagacagagggtttctggaatgtgtgaggccaggcrtcctgagggtgggcagaggtgttcagagctgcctctttccctcatcaatgttaggggcagagacacaccgagactcgtagccctacctccccgccagact

SEQ ID NO: 58159 - DNA, 201 bp, Homo sapiens
ttgagttgccgggcggggtggctcacgcctgtaatcccagcactttgggaggccgaggcgggtggatcacgaggtcaggagatcgagaccatcctggctawcatggtgaaacctcgtctctactgaaaaatacaaaaaattagccgggcgtggtggcacgcgcctgtaatcccagctactcaggaggctgaggcaggagaa

SEQ ID NO: 58160 - DNA, 201 bp, Homo sapiens
ctgtaaacccttggggtttctaggtgaggacatgagcccagtcagtgtctggagcttctggtctcagtccagtgcttttcctacccctgaaatgaagtgcyagtcccctcaccagccacctcgggctcaggcaggtgtcacctgtatggcctgtaggacctcgctcattcagccattcgggcttcccctgagttcgagaaa

SEQ ID NO: 58161 - DNA, 201 bp, Homo sapiens
tcgtctctactgaaaaatacaaaaaattagccgggcgtggtggcacgcgcctgtaatcccagctactcaggaggctgaggcaggagaatggtgtgaacccrggaggcggagcttgcagtgagccgagatcgcgccactgcactccagcctgggcgacagagtgagactccgtctcaaaaaaaaaaaaaaaaaaagaaaagt

SEQ ID NO: 58162 - DNA, 201 bp, Homo sapiens
cctcgggctcaggcaggtgtcacctgtatggcctgtaggacctcgctcattcagccattcgggcttcccctgagttcgagaaattctcgcgtttactcctrgagtcctcggttgctgctgcgggagggctgcagctgcggcagggcaggatctccactaagtggctgctgctttaaatagaagtgacccaaatagcccaga

SEQ ID NO: 58163 - DNA, 201 bp, Homo sapiens
cagctgcggcagggcaggatctccactaagtggctgctgctttaaatagaagtgacccaaatagcccagagcgagctgttggaagcgctcatcccgagaasaaatgcctccaacccccggaagctgggtcccctccagcaggtgaccctgcagtggctcttgaaggctgatggtttcattcccgccctctgcaccctcagg

SEQ ID NO: 58164 - DNA, 201 bp, Homo sapiens
tttgagtctaggatgaaggtaccttcctccaggaaggccctggtgttccttctgccagactcctgagggtctcgccagttcaagcccacttgaagcccagstcgtttggggttacttgaaccatctgggggattccaactagtatctttagctcctgacatgagctgttctactgtgggctcagcccttgtctgagactgt

SEQ ID NO: 58165 - DNA, 201 bp, Homo sapiens
ttgcttggtgccccctccccccccgactcctctgtcctgggaaacgtggctttgcctcccagacacgtgtcagatgccagctctcctcagcggagcctccygatccctcaatttgccatctgtctgactcgcgtcttcccggggcgtggggcgtgcttgtcaggcaggcgggcgggaggaaggaaggaaggagatccaggg

SEQ ID NO: 58166 - DNA, 201 bp, Homo sapiens
cctgtgggctcagacacagggccctgcacctctcagcccttccggtctcagctcagcacctcccttgcctggcccctctttcctgcatgagctccctgccyctgccaggaggaacctctgtcctgtttctagatgcgccatatcctctcccacctcctgctctttcctccagttgtgtgcctcgtaacctcttcctccctc

SEQ ID NO: 58167 - DNA, 201 bp, Homo sapiens
gtgtgatctcagctcactgcagcctctgcccccgacccccggttcaagtgattctcctgcctcagcctcctgagtagctgggattacaggtgcgtgccacsatgcccgactaatttttgtatttttagtagagatggggtttcaccacgttggtcaggctggtctcgaactcctgacctcgtgatctgcccgccttggcct

SEQ ID NO: 58168 - DNA, 201 bp, Homo sapiens
aacctggatcgcatcggggagcaggcggaggccatgtttggagtggggtgaggccagggttgagctgcaggggtgtgtggggttgggaggctcgacacccmctcttggtctggtctgggttcctgggctgggggctggctcttcctctctgccattccctctgcagaccctcaccgggctttgtgctcagcccctcccctg

SEQ ID NO: 58169 - DNA, 201 bp, Homo sapiens
agctggaagatcaacctgtttatgcagtttcgggaccacctggaggaggtgttgaaaggggtaaggactgggaacccctgccctgcccagctggccacctrgccctccccaccagggccctcttcctgccttctccacccgccaggcctcaggcccttaccctctccccagctttgcaccccccagcctccctccacctcc

SEQ ID NO: 58170 - DNA, 201 bp, Homo sapiens
tggtcatggctctcccactcccctccctttggcaccaggttctcaaggctcagtcctagttgggctgggcttggcctgctctggcttggcggggacactcsctgaagtgtagttcagagctaggcgaaggcctgggagggtgggggctgagtgccagcctggatgtggaggctggggcctgacctccgcgccctccccacc

SEQ ID NO: 58171 - DNA, 201 bp, Homo sapiens
ttcccatgacacatccctgacgagtagttttgttaagggtgtggcagaagcctccccccacattactgtttttctaaatgaggcctttctaggccgggccyacgcctgcttaacccactggtgatgtttttcagaacaagaacctggactggttcccccggatgcgggccatgtcccttgtcagcaatgagggcgaggggg

SEQ ID NO: 58172 - DNA, 201 bp, Homo sapiens
ctgaaggaaatgctgtattttggttagaggttgggaaaaataaagatgtaacattttctccatctctgttcatgggccccgcttctatccatgaatccccygcatggtggcagtgggatctgtgttaagagtccttgtttctggctaggtgtggtcgctcatgcttgtaatcccagcactttgggaggccgaggtgggcag

SEQ ID NO: 58173 - DNA, 201 bp, Homo sapiens
actggcctctggccctgggcctggatgagaaggcaggtgccaaacccactctcccctgcatggcaagtcagactggggttgacaacccctgccttgggccrctaaagacaaggccaagtggaaactttagtacagggtggtggggccctctgtctctcatccccttcctctgacagctgccaggtaggtcctttgagggga

SEQ ID NO: 58174 - DNA, 201 bp, Homo sapiens
ctgagcagacagacatcacgctgtgttcagggtgtctctgtgggtgtgggcccctcagacagaggcagggcaatctgtggggctgtttggcgtttgggtcrgaggaatggcagtcacacccgggtcatttcttgggcctggcaatgactctgccctgcccaccccaggacatcatcacagccctggaggagcggctgaagc

SEQ ID NO: 58175 - DNA, 201 bp, Homo sapiens
agtggaaactttagtacagggtggtggggccctctgtctctcatccccttcctctgacagctgccaggtaggtcctttgaggggatccccatcactggagmtgggggagtttaaggccctcttgcctagacatcctcttctgcatctggcagtgcctgcatgaagatgaggcagcctctgttagtgggctggtttcccagc

SEQ ID NO: 58176 - DNA, 201 bp, Homo sapiens
ggtcctttgaggggatccccatcactggagatgggggagtttaaggccctcttgcctagacatcctcttctgcatctggcagtgcctgcatgaagatgagrcagcctctgttagtgggctggtttcccagctgcatcaaatccagggtttgtgacacgctaattgagaacaagggtttggtgctgacatcgacatccttaa

SEQ ID NO: 58177 - DNA, 201 bp, Homo sapiens
gctcatcatgcagcccatcctgcgctttctgcagctgctgtgtgagaaccacaaccgggacctgcaggtgagtgcctcgccacacacctgccccttccccygctggccagccggcatgcagactaggcagtgtggctggtgtccctctatggcaggtgtgccctgccctgggcactgctgctttgtggctggtggttcccc

SEQ ID NO: 58178 - DNA, 201 bp, Homo sapiens
atcgacaccttcgctgacctgcgtagtgagaagcagaagaaggaggagattcttaagacgacatgcttcatctgtggtgagggctgcttcctgctctgtgsaggccgcagcggggctggaacgtcatctgatgccagtggcagtagcggtttggcccttcctgccctggggaaccctggcccggagctgatgacttgatgc

SEQ ID NO: 58179 - DNA, 201 bp, Homo sapiens
cagccagtgtctggggctgggagccagaagacctgggatctggaacttgctgttccattaacttgtgtgacctgggcgggtcagtttctcctccatgcccyagggacagttttctcatccacagctgaatgggggcggggggagggttgttcagggtccctcggggatttccccagtctgtcattcccccagtctgtcatt

SEQ ID NO: 58180 - DNA, 201 bp, Homo sapiens
cagaaaaccgactctttcgtgccccggtgggtatgcgccatgtgcctgggagttgactggtggtgctcagggtgggccctcctgtctctgggactctctgsatcccccactcctccgccctcctgcggtcctttagcctctggggtctctgtaggtcccatccctctggggatctagctctgagtctgtcggcggctgacc

SEQ ID NO: 58181 - DNA, 201 bp, Homo sapiens
tctggcgtcaggaccaggacctgcagcgcttacctcaccaggctcccgtctgcttctcctcttggcttctggggacgtctagctaacaccagtctgcctcrctcttttctggaacacactgagtgggtgggagagccttgggtctctggcccctaaggaaccccttgcttgagggctggagtcccttgaactgtcattcat

SEQ ID NO: 58182 - DNA, 201 bp, Homo sapiens
tcagcacctgaccctatacccaccggttattcctaggttatattagtaatgcaacaaagagtaatattaaaagctaaagattaatagtgattgctaattgyccatgatcatctctatatctaatttgtattatgactattcttattctattttttttattatactgaaacagtttgtgccttcagtctcttgccttggcac

SEQ ID NO: 58183 - DNA, 201 bp, Homo sapiens
atttagaacaccaatttgcttaccacctagacttaatcattgtttacagtggtcacatttgatatttgtattttttgctgaagtattttatgataaattatcatacattgcatctttttcacctctaaatattttattatacatccctatgtaactacagtgttgtgatcacaccaattaatagtttcctaatagcattca

SEQ ID NO: 58184 - DNA, 201 bp, Homo sapiens
aggctctttgtaaatttttgctgttaagaacaatttgccctgaacatcctagtgcatgcatgcctgaacacttgtctagttatagttatcctctcaggtartacgttcccagaaatggagatcaaagacaaggtacacctttaactcttaggctgtctaactttttgtgtttctgtggtggtggaggggtataggaacaga

SEQ ID NO: 58185 - DNA, 201 bp, Homo sapiens
aaataaaaaagacacactctctccaacaaactgagtgctctttcggaagtgatgtccactcatgctggcaatgctgaggggcctaggtggggcagcccttkgtggctccatctgcttgtggaattgccatttttcccttttctttctaggaagttctgtcttccttgatctttggttcactctgtttctactcccgatggt

SEQ ID NO: 58186 - DNA, 201 bp, Homo sapiens
tacaaaccttgcttctctctgtccccttcctctaagccccacgcctagaggaggtgggtctagaatggggacattgggctgcgccttatagctgtggactrggctggagagagggagctgcaggtgggctgcctgagctctagtattaatacctcagctctcttcctggaatgggggctgcaacaggcttccttcctgctg

SEQ ID NO: 58187 - DNA, 201 bp, Homo sapiens
gttagacttctgttctgtacctcaaggcagattcttggtcttagcctaatccatgcaactcattttttgaaaatatatatattttttcagattaaaaaaataatatacattccatggagaaaatgtgaaaaactcaaaaaaatgatctgtaataccactatggcttacatgaacattccctatgaccttctagccttttat

SEQ ID NO: 58188 - DNA, 201 bp, Homo sapiens
gtgtgatcagagttcactgtaacctcgaactcctgagctcaagcaatcctcctgtcttggcctcccaaagtgctgggattacagccactgggcccaggttcagtctgtgtttgaccgaccattggtttctttttttttttttttgagatggagtttccctcttgtagcccaggctagagtgcaatggtgcaatctcggctc

SEQ ID NO: 58189 - DNA, 201 bp, Homo sapiens
tgtgatcagagttcactgtaacctcgaactcctgagctcaagcaatcctcctgtcttggcctcccaaagtgctgggattacagccactgggcccaggttcagtctgtgtttgaccgaccattggtttctttttttttttttttgagatggagtttccctcttgtagcccaggctagagtgcaatggtgcaatctcggctca

SEQ ID NO: 58190 - DNA, 201 bp, Homo sapiens
gccagggttggaggggcctggtggaactcccgaggggcttctgtagggtcttcggtgtggggactggataagggcatgcccatttcttagaagggcagacygagaccaaagggaggcctggaggcgtggtgacaagagggccctgcccttcccacctaacctgtcccacctgtctgctcaggtggtcgtgggggacaaggt

SEQ ID NO: 58191 - DNA, 201 bp, Homo sapiens
ggtctctgcctccagccccatctgacctgccggacaagctgggcctcacggcttctgcatccatttcccaacactgccctcattctccaccccacaggctrgtggccccaaggtagccgggctggggtctggggaccctggctaggagaagacaccctgtccttgtgctgtaatggtggctgggctgcttcttcccttcag

SEQ ID NO: 58192 - DNA, 201 bp, Homo sapiens
tccaaggcagctcagaagcaaggctttctggtgctaagtccactgcttttttgcccctgccctgcgctactggggcacagaagtcactaggttctgccatmgtaactgacccaatctttatatcgtcattcattcatgcattcttgcattcactgctgcattcactctgcaggtgttcactgaatgctttgtgtctagtgt

SEQ ID NO: 58193 - DNA, 201 bp, Homo sapiens
agtggcttatgcctgtaatcctagcactttgggaagctgaggtgggtgaattgcctgagcttaggagtttgaggccagtctgggcaacatggtgaaacccygtctctactaaaaataaaaaaaattagccgggcgtggtggcaggcacctgtggtcccagctacacaggaggcagaggcatgagaatcacttgaacccagg

SEQ ID NO: 58194 - DNA, 201 bp, Homo sapiens
gtgcccgcaggaagacaagcagcatgctggaggtggatgacgagggcggccgcatgttcctgcgcgtgctcatccacctcaccatgcacgactatgcgccrctggtctcgggtgccctgcagctgctcttcaagcacttcagccagcgccaggaggccatgcacaccttcaagcaggtgacgggactacctggccctggcc

SEQ ID NO: 58195 - DNA, 201 bp, Homo sapiens
gggtgggccctcctgtctctgggactctctggatcccccactcctccgccctcctgcggtcctttagcctctggggtctctgtaggtcccatccctctggrgatctagctctgagtctgtcggcggctgaccaccattgcatgcctgcctggtgcctggcgcctgccccagttggtctgggtgctcaagcacaggctgcat

SEQ ID NO: 58196 - DNA, 201 bp, Homo sapiens
gtgttggagcattggtgtgtatgtgtgtatgttcatttgtggttctatggagaggggccatgaagggctcccctggaatgatatgggcacccctgggaggstgcagcctgcctgcccaaacccagggccctatgtaggtgaccatgttttgcagtgggtcgtgtgggtatagtttggtgtccagtagctcccccacatctt

SEQ ID NO: 58197 - DNA, 201 bp, Homo sapiens
tgattgtaaactcataaaataaagcacataacaagacaaagggaaccagtggcttggagcgagttatcaaaatattggagaaaacaaattagtagtgacarttatatatgtgcctctttactaatacgttaagtagcgagctgcactggtgggtgtaattagtaccactacttcaaggcagcgacgaatataaacgatatt

SEQ ID NO: 58198 - DNA, 201 bp, Homo sapiens
gtgtgttggagcattggtgtgtatgtgtgtatgttcatttgtggttctatggagaggggccatgaagggctcccctggaatgatatgggcacccctgggarggtgcagcctgcctgcccaaacccagggccctatgtaggtgaccatgttttgcagtgggtcgtgtgggtatagtttggtgtccagtagctcccccacatc

SEQ ID NO: 58199 - DNA, 201 bp, Homo sapiens
tgtgtgttggagcattggtgtgtatgtgtgtatgttcatttgtggttctatggagaggggccatgaagggctcccctggaatgatatgggcacccctgggmgggtgcagcctgcctgcccaaacccagggccctatgtaggtgaccatgttttgcagtgggtcgtgtgggtatagtttggtgtccagtagctcccccacat

SEQ ID NO: 58200 - DNA, 201 bp, Homo sapiens
cagcatcctggtgaggccttctgggtgggctggggctggatgggggcatggggtggttggggcttcccatgagttgttggcagttccccggcaccagtctstctgtccagtccttttgctgctgggctgggagcagtgaaattacagagtcttcatctgcctgacccaagcctggccctcaaggccctgatggccactcct

SEQ ID NO: 58201 - DNA, 201 bp, Homo sapiens
gagctccctgcccctgccaggaggaacctctgtcctgtttctagatgcgccatatcctctcccacctcctgctctttcctccagttgtgtgcctcgtaacstcttcctccctccaaggctaaatcaaaccctacctccttatacaggaggaagtaatttctgggttgatgtatgcatccggcagattcatgctgagccaac

SEQ ID NO: 58202 - DNA, 201 bp, Homo sapiens
gggcatggggtggttggggcttcccatgagttgttggcagttccccggcaccagtctgtctgtccagtccttttgctgctgggctgggagcagtgaaattwcagagtcttcatctgcctgacccaagcctggccctcaaggccctgatggccactcctggtggccatctgacccctttctcctgtacagtggtggttcaag

SEQ ID NO: 58203 - DNA, 201 bp, Homo sapiens
atttcaactacttccatttggcaaatatgtattcctctgttccctgatgcccagccttgaatttaaaagccctaaagatagattttcttttttaaataacrcctttgaccttctccacagtatatggtcaaaatgcatgcgccctgtagcttcagaatttcctctgggctgttctacaagactttccatcaagcaaaactg

SEQ ID NO: 58204 - DNA, 201 bp, Homo sapiens
cctggactctggagctggaccagggctttgcatctcagctgggctactactagctgtgtaactgggcaagtttcttaactgccccatgcctcagtttcctyacctgtaaaatggggataacaacagcccctgcattctaaaataattgtgagatgaaatgagctaatgcatggaaagcacttacactgtttcctggcatgc

SEQ ID NO: 58205 - DNA, 201 bp, Homo sapiens
gcttgcaattcttgctctgtggagccaggttgggtccactctgccatctgatggcccccaggccagaggccctcatttccttctgctaggggctgggtccycaatatcacagccctggccccaacctgagtcctatcttgccccagtgaatgtggggaccaccgggcccagcctccctgcctcatcccctgcaggagtctc

SEQ ID NO: 58206 - DNA, 201 bp, Homo sapiens
ccctgcaggagtctctcttcccagcccgagtggtctatgacctcctgttcttcttcatcgtcatcatcattgtgctgaacctcatctttggggtaatcatygacaccttcgctgacctgcgtagtgagaagcagaagaaggaggagattcttaagacgacatgcttcatctgtggtgagggctgcttcctgctctgtggag

SEQ ID NO: 58207 - DNA, 201 bp, Homo sapiens
ggtgatgccctggggctttccctccttggggagctgggagtccatcccacccatctctaagccttgggagggagctagttccagggtggcggtgctgccakctggggaaggggaagggtgggctccgtccttagagggaccagcctctgagaccctcttcccaccgctggctgtcaccaccccaggttcctggactacctc

SEQ ID NO: 58208 - DNA, 201 bp, Homo sapiens
tcgtgaaccactgctacgtggacacggaggtggagatgaaggagatctacaccagcaaccacatctggacgctctttgagaacttcaccctggacatggcycgggtctgtccctgtgaggggtgtgggtgaagccccccaggaggtgtgggagtggaggggccccatgtgaggagcccccagccatccctctctcctgcct

SEQ ID NO: 58209 - DNA, 201 bp, Homo sapiens
tgaggcaggagaattgcttgaacccggggggcagaggttgcagtgagtcgagattgcgccactgcactccagtctggtcgacagagtgaaactctgtctcaaaaaaaaaaaaaaaaacagaaaagaccttgttaaccaacccagggagaggaggtacagaaggagcacgggctttgaaatcagctctgtgggtttaggcaa

SEQ ID NO: 58210 - DNA, 201 bp, Homo sapiens
cctggccctggccctgagcatgaggcctgcaccaggcacggggggacagtaaacgatgattgaggagctcacagctcaaggggtaacttgggatgcccatytggggttttcagccttgctgagttcctaggtgaagactgagtctcctggcctggctcagtgcctgccatttcttatgatgtggacagcactttacagctt

SEQ ID NO: 58211 - DNA, 201 bp, Homo sapiens
gaggcaggagaattgcttgaacccggggggcagaggttgcagtgagtcgagattgcgccactgcactccagtctggtcgacagagtgaaactctgtctcaaaaaaaaaaaaaaaaacagaaaagaccttgttaaccaacccagggagaggaggtacagaaggagcacgggctttgaaatcagctctgtgggtttaggcaag

SEQ ID NO: 58212 - DNA, 201 bp, Homo sapiens
tgccctggggctttccctccttggggagctgggagtccatcccacccatctctaagccttgggagggagctagttccagggtggcggtgctgccagctggrgaaggggaagggtgggctccgtccttagagggaccagcctctgagaccctcttcccaccgctggctgtcaccaccccaggttcctggactacctctctga

SEQ ID NO: 58213 - DNA, 201 bp, Homo sapiens
cagaagaggaagtgtggctcacgtggactgacaagaataacgagcatcatgagaagagtgtgaggcagctggcccaggaggcgcgggccggcaacgcccaygacgagaatgtgctcagctactacaggtgccccgccccagctcctcccctccctcttcctgtgcctttgggccttctcagtaggccgtcagtcaatccct

SEQ ID NO: 58214 - DNA, 201 bp, Homo sapiens
agaggcagaagaattgcttgaacccaagaagcagagtttgcagtgagctgagattgtgccactgcactccaagctgggtgacagagcaagactctgtctcaggggaaaaaaagaaagagaaaagtgacacacaccccatgcacccactgctgagctttgtcaaatcctttttgctacgtttatttcagatctttttacttt

SEQ ID NO: 58215 - DNA, 201 bp, Homo sapiens
gaggcagaagaattgcttgaacccaagaagcagagtttgcagtgagctgagattgtgccactgcactccaagctgggtgacagagcaagactctgtctcaggggaaaaaaagaaagagaaaagtgacacacaccccatgcacccactgctgagctttgtcaaatcctttttgctacgtttatttcagatctttttactttt

SEQ ID NO: 58216 - DNA, 201 bp, Homo sapiens
agctgcaggtgttcctgcgaactacactgcgccagtctgccacctcggccaccagctccaatgctctctgggaggtggaggtcagaaaagccctgcttctrgcaccccggactcagccttggatgccacccctccctcttccccaccatcctggagggtgggatattgacccctacctccctctgagtccctccagagtca

SEQ ID NO: 58217 - DNA, 201 bp, Homo sapiens
ttttttactcatgcctaacacaaagctttgaccaggggtctgttttaatgcttttgctattaatgcatagggatgtaactgtgcacaatataggttttttktttttttttttgagacagagtctcgctctgttgcccaggctggagcacaatggtgcaatcaaggctcactgcaacctctccctcccgggttcaagtgttt

SEQ ID NO: 58218 - DNA, 201 bp, Homo sapiens
gagctgggcactggaatggcttgtaccgcttcaagcacctggctacaggcaactacctggctgctgaggtgagcgggaggtagagggcatgctggggctcrtgtgtgcatgtacacgtgggtgtgcgggaacatgtgtgcacatacttgcatatgtggcacatgtgcctatggaccctgacttctctgcactcatgcattt

SEQ ID NO: 58219 - DNA, 201 bp, Homo sapiens
caaaaaaaaagatgaaaaaaagtatattcattttagttgcatattgtggacaaccatgagaaaatagtctcctacaaattacatagtaatttgtcttaaayattaaaaaaggttatttatttatttattaagacagggtcttgctttgttgcccaggtcagagtgcagtgacaccatggttcactgcaaccctgacctcct

SEQ ID NO: 58220 - DNA, 201 bp, Homo sapiens
tcaagcacctggctacaggcaactacctggctgctgaggtgagcgggaggtagagggcatgctggggctcgtgtgtgcatgtacacgtgggtgtgcgggarcatgtgtgcacatacttgcatatgtggcacatgtgcctatggaccctgacttctctgcactcatgcatttatccaatattatcaaataaaggcatgactg

SEQ ID NO: 58221 - DNA, 201 bp, Homo sapiens
acatcttgggtgttttgttctataggttgagtctaaacattgaagatgattggaagcagatgcaggcattatttcttgcagagcttttacattactgcaaycgtataacttgctttgctctctgtccttgacttggatcctctactctggtgcttgattgagcagcagaaccatgtggggtagaaagggagtgggggagag

SEQ ID NO: 58222 - DNA, 201 bp, Homo sapiens
tgggactacaggtgcgtgccaccatgcttggctaatttatttattttttgtagagacagggtttcactgtgttgcctaggctggaaaataagcgaactctyggactcaagcaatctgcccgcttcaacctcccagaatattgggattacaggtgtgagccactgtgcctggcaaaagtcacttatttttaattgtggtaag

SEQ ID NO: 58223 - DNA, 201 bp, Homo sapiens
atccaatattatcaaataaaggcatgactgtaaataagcctaataaatatcactgtgctcctactatgtgccaggcactattctaggcacaggggatacaragtgagcaaaatttcccgtctgtctgtaatgcgcacacttgtgtgtgttggagcattggtgtgtatgtgtgtatgttcatttgtggttctatggagaggg

SEQ ID NO: 58224 - DNA, 201 bp, Homo sapiens
cccttttaactcttttcatggtttcttctgctagctacccctgtgtctccaaatgttatgattattctatttctttttctttttttttttttttttgagayagggtcttgctctgtcatccaggctggagtgcagtggcgcaatcatggcttgctgcagccttgacctcccaggctcaagccatcctcccacctcagcctc

SEQ ID NO: 58225 - DNA, 201 bp, Homo sapiens
aatcccagctactcaggaggctgaggcaggagaatggtgtgaacccgggaggcggagcttgcagtgagccgagatcgcgccactgcactccagcctgggcracagagtgagactccgtctcaaaaaaaaaaaaaaaaaaagaaaagtctggtttgagtctaggatgaaggtaccttcctccaggaaggccctggtgttcct

SEQ ID NO: 58226 - DNA, 201 bp, Homo sapiens
tgaggcaggagaatggtgtgaacccgggaggcggagcttgcagtgagccgagatcgcgccactgcactccagcctgggcgacagagtgagactccgtctcaaaaaaaaaaaaaaaaaaagaaaagtctggtttgagtctaggatgaaggtaccttcctccaggaaggccctggtgttccttctgccagactcctgagggtc

SEQ ID NO: 58227 - DNA, 201 bp, Homo sapiens
aggacaccagcagcacagggaacccaaacactggatgggaaggccagactctctggcctttgaggtcccgccaaccccgagattctaggacggaacatcargaaacttctcaagtgtcagtacaggctttggcgtgtccttagctgtatgacctcaggctgctactcactctgcctccatcattttagtgggaacatcaag

SEQ ID NO: 58228 - DNA, 201 bp, Homo sapiens
gcgtgtttggagagcatttcaggggaaagccgggaagaggaattgtaggctgaggatgggttttgtgctttgggggccgctgagtgaactcatgaaagccrtgttttgggagggactggctccccaagagggacacctgctgggtgggtatctcacactcgtcatccccgggtcccctcacccaggtttgtcatccagctg

SEQ ID NO: 58229 - DNA, 201 bp, Homo sapiens
acaaggcaggcctgtgtctcatctcttaagctctggccacagcggtccggcctgccttttctcttagccttagaccctgagctgccgagaccctctgctcytcccccaggccccagatctgagctgggattagaatccgcatcagggagggataggctggggtcagcttcgggattccaacaaggagtagggagagctggg

SEQ ID NO: 58230 - DNA, 201 bp, Homo sapiens
cttcagggcagtgtgtctcatgcaggcacaggctctgacccgctagtgggctgtgaagtcacttgaatgggctcagccatcatcgacagaaatggataggrtagaattggaatgcatccaccctataagggctgttatggtttcattaattctttcttcagctctggctattctctggttaaatatgtccagtgagtttta

SEQ ID NO: 58231 - DNA, 201 bp, Homo sapiens
tacaagttatgtagccaatccttccacacaaacaaggtccctgccctcgtggaggtttcgctctggtgggaaacagcccacaagctaaataactatgtaawgtaagccactcttctgcccagcgatgcttcctttcctggacctctgcctttctagggtattgggtccttacctcggggtttgggggcagcgttccagagc

SEQ ID NO: 58232 - DNA, 201 bp, Homo sapiens
gagatgaaggagatctacaccagcaaccacatctggacgctctttgagaacttcaccctggacatggctcgggtctgtccctgtgaggggtgtgggtgaasccccccaggaggtgtgggagtggaggggccccatgtgaggagcccccagccatccctctctcctgcctcaggtctgcagcaagcgtgagaagcgcgtggc

SEQ ID NO: 58233 - DNA, 201 bp, Homo sapiens
ctggaatttggatttgccttgtcttaggtcagattcctagaagcagagcctaagatgggtgaattcttgaggaagttctcaggagaacacagtgagggagyctcttcctctttgtatagggcaggagaagaagctgagcaagggtgtggtttcagtggaagatgcgcctcagcctgacccctcggggagctcaggattgtg

SEQ ID NO: 58234 - DNA, 201 bp, Homo sapiens
gtgcctggcactgtgggggagtggggaaggggcacagaaaagaatgagccacggaccctgcccttgagatgcatatggtctctctgggtccccgtggtggstggcactgtgtggccgggtgtgctcagggaggggtccaggcgtagtgccctggacctggctccctgtgacaggttgctggtggtctgcaggcttcggccc

SEQ ID NO: 58235 - DNA, 201 bp, Homo sapiens
gtggtgtgtgtgcaggagtctgtgtggggtaggaggagcaggcagcccgggcctcagcacactctccgcttgcagaggacagggagctggacagcacagarcgggcctgtgacactctgttgatgtgcatcgtcactgtcatgaaccatgggctacgcaacggtggtggcgtgggcgacattctccgcaagccctccaaag

SEQ ID NO: 58236 - DNA, 201 bp, Homo sapiens
gaggcaggagaatggtgtgaacccgggaggcggagcttgcagtgagccgagatcgcgccactgcactccagcctgggcgacagagtgagactccgtctcaaaaaaaaaaaaaaaaaaagaaaagtctggtttgagtctaggatgaaggtaccttcctccaggaaggccctggtgttccttctgccagactcctgagggtct

SEQ ID NO: 58237 - DNA, 201 bp, Homo sapiens
tgataaataatataatctatccatatccatatttttattttttattttttgggacgaagtcttgctctgtcacccaggctggagtgcagtggtgtgatctsagctcactgcagcctctgcccccgacccccggttcaagtgattctcctgcctcagcctcctgagtagctgggattacaggtgcgtgccaccatgcccgac

SEQ ID NO: 58238 - DNA, 201 bp, Homo sapiens
tctgaagagcaccagggacttttgggaaatgaccacctctgttgcttagtgcctggcttggggctgaacacatgatgattttcaagtgcctgtgagttttktttttttttttttttttttaagacaaggtctcactttctcactcaggctagaatgcagtgatgcaatcttggcttactgcagcctcgacctctggggttc

SEQ ID NO: 58239 - DNA, 201 bp, Homo sapiens
tgcagctcaaggtggggcccagtggcaggtgtgtgagtgctgggtgtgcatgtgatgtgcatgcatgtatgtgtgacttgtgtgtcaagtgtgcatagtgrtgtgtaatgtgggtgttagcattgtgtgatggggcatcatctggatgcacaagtgtgtggtgtgtgcagggtgtgtgtgtaatatacgcatgtttaagca

SEQ ID NO: 58240 - DNA, 201 bp, Homo sapiens
attacagatgcacaccaccatgcctggctaattttttatttttttaaattatttttattttttcccaccacttgctgcctgttgataattttttattaactttttttttttttttttgtaaagacaggatttcgtcatgttgcccaggccagtctcgaactcctggcctcaagtgatcctcctgcctcggcttcccatagt

SEQ ID NO: 58241 - DNA, 201 bp, Homo sapiens
ggaggatgggaaggtcatggcacctgaccttttgttggatgggagagctgttatggagaggaatgagggagaagttgtcaggggcatggtgtcctgagackgtggcctgcctccctctgcccctccacccaggacaatgcctccaagctgctcctggctctgatggagagccggcatgacagtgaaaatgctgagcgaatc

SEQ ID NO: 58242 - DNA, 201 bp, Homo sapiens
gggaatgggacctggcccggtgctcacaagggccttgcactgggttagatgctctgctgctgagcaagggtcctgctctttcattctgcactgggccctasaagttatgtagccaatccttccacacaaacaaggtccctgccctcgtggaggtttcgctctggtgggaaacagcccacaagctaaataactatgtaatgt

SEQ ID NO: 58243 - DNA, 201 bp, Homo sapiens
tcgacaccatagagcagtgaacaacctgtacagctgtccatggagttcccagtggctcctggagacagtggctctggggaacccaatttgggagccctggrtctagtcttaacctctccccttgttttatagagttggagcctggggcccttagatgggactggtctgtccatggtctgaccatcctgtaagtctgcagta

SEQ ID NO: 58244 - DNA, 201 bp, Homo sapiens
cccctccccggccggcgcctgctcctccctcctcccttgcctgggtagaaactctgctggttgtgtgaactattcctgcacctgttggtaactgccacccygaatagcactgggtggctcagcactgggaggccctagcctccctagcccttctctgggatcccctaaaatttggcccactctggcaacaatgggaatgac

SEQ ID NO: 58245 - DNA, 201 bp, Homo sapiens
aatttgggagccctgggtctagtcttaacctctccccttgttttatagagttggagcctggggcccttagatgggactggtctgtccatggtctgaccatcctgtaagtctgcagtagagcctagatggcccccaggtctctgactcaccctggcttcctcagacatgtggatcgtgccatgatgctggaatgtggtggtc

SEQ ID NO: 58246 - DNA, 201 bp, Homo sapiens
gggaatgactccttgtaccactagaggcccccaagaccttctccagtgacaaagtcagaacctgtattgaaccagttgttaaatattttgaatatcacctyggcccttgcgcttcctcaccctgtccgtctgaacccccatctagccttcccggaccccagggtgatgccctggggctttccctccttggggagctgggag

SEQ ID NO: 58247 - DNA, 201 bp, Homo sapiens
gggagggcattcacctatgcagagccacataatcagaaccgcaagcggtcacacagccacatgctgttgctttgtggaaagtcacatggtccatggcaagsctctcctgctgccaccttcgcctcggtctcagtaaaggactgaggaggaggaaaggacagagaccactgctctcagagagtgccagtctgatggagggga

SEQ ID NO: 58248 - DNA, 201 bp, Homo sapiens
ttggggagctgggagtccatcccacccatctctaagccttgggagggagctagttccagggtggcggtgctgccagctggggaaggggaagggtgggctcygtccttagagggaccagcctctgagaccctcttcccaccgctggctgtcaccaccccaggttcctggactacctctctgacctgtgtgtgtccaaccaca

SEQ ID NO: 58249 - DNA, 201 bp, Homo sapiens
ttgtctggattcaaatcttggctctgccactcctaatggtgtaacttgggcaagttacctaacgtcccctggcgccttggtttccccatctgtgaaatcaggcagtaatagtacttccctcttggatcgttgtaggttacttgagctaatctatgtaaagtatttagaacagcctctttcttgtgatcaccagggtgtcca

SEQ ID NO: 58250 - DNA, 201 bp, Homo sapiens
tttccctaccctgagcagcagtcacagcagatagctcaatcaccatcccttctcaggctgaaactttctttagagcagcaagggcttcctttctgggaaarctagaggagattcccaaaccgtaaggtcaaggggaaactggggcagttttattgacgatggcaatgtacaagactccacacctaggtatgtgcacgaggt

SEQ ID NO: 58251 - DNA, 201 bp, Homo sapiens
ggcagaggcatgagaatcacttgaacccaggaggcgaaggttgcagtgagccaagatcgtgccatgcactccatcctgggcaacagagtgactgtctctgaaaaaaaaaaaaaaaaaaaaaaaaagacaggatccaaacgtggtatctctgtccaaagctatggagatgccctccatgctgcccccatccaacaggggagc

SEQ ID NO: 58252 - DNA, 201 bp, Homo sapiens
ctctctgacctgtgtgtgtccaaccacatcgccatccccgtcacccaagagctcatctgcaagtgtgtgctggaccccaagaacagtgacattctcatccrgaccgagtgagccctgtgccccctgcccgcacttgggctccacgctgctgacccccagctgtcttagagcttaggccctgtctgggttcaggctggaact

SEQ ID NO: 58253 - DNA, 201 bp, Homo sapiens
aagtatattagttatctataccgtgttaacaaattatccccaaacctagcagttaaaacaacaagcattcgctatctcagtttctgtgggccagaatgacrgtgggaatggtaccatccagcaggaactcctaactccagtgggtgggcggatcccggagtggcagcacttattcaccaaagataaggcagacgtgccatc

SEQ ID NO: 58254 - DNA, 201 bp, Homo sapiens
tcatctgcaagtgtgtgctggaccccaagaacagtgacattctcatccggaccgagtgagccctgtgccccctgcccgcacttgggctccacgctgctgayccccagctgtcttagagcttaggccctgtctgggttcaggctggaactggcacccttgctctctgcagctgtgaactctgtgcctgttatgtgccccgct

SEQ ID NO: 58255 - DNA, 201 bp, Homo sapiens
gcagaggcatgagaatcacttgaacccaggaggcgaaggttgcagtgagccaagatcgtgccatgcactccatcctgggcaacagagtgactgtctctgaaaaaaaaaaaaaaaaaaaaaaaaagacaggatccaaacgtggtatctctgtccaaagctatggagatgccctccatgctgcccccatccaacaggggagca

SEQ ID NO: 58256 - DNA, 201 bp, Homo sapiens
tactgcaagctctgcctcctgggttcacgccattctcctgcctcagcctcccgagtagctgggactacaggtgcccgccaccacgcccagctaatttttgyatttttagtagagacagggtttcaccgtgttagccaggatggtctcaatctcctgacctcatgatccgcccacctcggcttcccaaagtgctgggattac

SEQ ID NO: 58257 - DNA, 201 bp, Homo sapiens
cagaggcatgagaatcacttgaacccaggaggcgaaggttgcagtgagccaagatcgtgccatgcactccatcctgggcaacagagtgactgtctctgaaaaaaaaaaaaaaaaaaaaaaaaagacaggatccaaacgtggtatctctgtccaaagctatggagatgccctccatgctgcccccatccaacaggggagcaa

SEQ ID NO: 58258 - DNA, 201 bp, Homo sapiens
gccccctgccccccataaagtaggaagggccttctgacctcagatcagtcctcaccccatcctcacctgacctttcctctcttctccagttcatcctcaaygtccgcctggattaccgcatatcctacctgctgtctgtcttcaagaaggagtttgtggaggtgtttcccatgcaggacagtggggctgatggcacagccc

SEQ ID NO: 58259 - DNA, 201 bp, Homo sapiens
gtggtgcctttgaggggtcgcaccttctcctcacagctctctccctgttcttcccagcttcagtaggagtgtcttctcagccctccccttccaggcttcawggtcctggccagctgccccttctccccgcctctcccattcaatttcctgcgccggtcatctggcgcccttgggtccttggttctagcttctctccagcac

SEQ ID NO: 58260 - DNA, 201 bp, Homo sapiens
ctgtctcatttaattgcctcagtgagggggaagggcagggatccttcccttcgttttccaaatggggaaactgaggctcacagaacagcagggacttgctygaggtgacagccagtcagaggctgagccagaccgggatctggtctcctgactcccagcctggatctctgccccctttgtactgccctgcaggggagtagg

SEQ ID NO: 58261 - DNA, 201 bp, Homo sapiens
gtctaccacacgcctcctcgagtgtccgtggctacagcagcagcacaagggctccgtggaggcctgcatccggaccctcgccatggtgggtgagtgtgccrgggcactggccagccccaaaccactcctcctgccgctcacagtggggacgcctgccctcctaataaacactttatccctaagctcgcccatctcctgctc

SEQ ID NO: 58262 - DNA, 201 bp, Homo sapiens
tagcatcggcctgtgcaggtctgcatcataattttctggggctttttcaccttcccatacctggaactccaggtgcaccacacgactgcaacctgtcccgygctctcagtctctttacctttgctcttgggttgttcccgccctttagcaagcaagtctccacctgggtaaatctgtcccaccctctaaggcttaatgcaa

SEQ ID NO: 58263 - DNA, 201 bp, Homo sapiens
ttgtactgccctgcaggggagtagggggctgtggctcctcccctacttggttccttcccagaaaggggcaggcagagcagctgctgtgcagccagtgcagrgaagagggtggtttgagtgtctccctgtgctcccctctttcccgggctgggcctacaatctgcttccatctgcccctctccccacagctgccaacatgaa

SEQ ID NO: 58264 - DNA, 201 bp, Homo sapiens
taagggagctgtgcttcctgcttccttggaagttaagagtcaaagaaggaatgatttgtaagtgctgtaagtaatcagtccagcagcttcagcgtcaccargaagtttgtcagaaatgcagaatctcagaccccgtgcccgtcctactgaatgagaatctgcattttattaagatccccaggggactggtgcattaaagtg

SEQ ID NO: 58265 - DNA, 201 bp, Homo sapiens
gtaaactcataaaataaagcacataacaagacaaagggaaccagtggcttggagcgagttatcaaaatattggagaaaacaaattagtagtgacagttatrtatgtgcctctttactaatacgttaagtagcgagctgcactggtgggtgtaattagtaccactacttcaaggcagcgacgaatataaacgatattttgtg

SEQ ID NO: 58266 - DNA, 201 bp, Homo sapiens
gtggatccaggagcggttgagactgccagccggccagcaagggaaagcaggcccacgcctgttcttggcaggagagcaaggccaatgccactgctttatcscttaccctaggtgggagcagcagaggccagggctggagtagctgattagggccaacaaaaagtggaggattgaatgtggcctcaggccagtggctaggga

SEQ ID NO: 58267 - DNA, 201 bp, Homo sapiens
gtccaaatgaattttggtcccaagtgtacaaacaagctttggttttggaagcgtggacaaggctgcccgtgtcagtgcagtggtcaggacggggcctgggygcagggctagctctggctgttcttatctggcttcagcctcctcatctggaggggcaccagtggctcctgtcccacagctgttgagggtgtggagtagggt

SEQ ID NO: 58268 - DNA, 201 bp, Homo sapiens
atcgcctctctctttgagctggaccccaccaccttgcagaaaaccgactctttcgtgccccggtgggtatgcgccatgtgcctgggagttgactggtggtrctcagggtgggccctcctgtctctgggactctctggatcccccactcctccgccctcctgcggtcctttagcctctggggtctctgtaggtcccatccct

SEQ ID NO: 58269 - DNA, 201 bp, Homo sapiens
tctgtcctgggaaacgtggctttgcctcccagacacgtgtcagatgccagctctcctcagcggagcctcctgatccctcaatttgccatctgtctgactcscgtcttcccggggcgtggggcgtgcttgtcaggcaggcgggcgggaggaaggaaggaaggagatccagggtctgtctgggtgcagaggccttcctccacc

SEQ ID NO: 58270 - DNA, 201 bp, Homo sapiens
ggagctagtactgctagctactcaggaggctgaggtgggagaactgtttgagcccaggagttcaaggttacagtgagctttaactcactggattgcaccaytgcactccagtctgggtgacagagcaagactctgtaacttaaaaaaaaaagaaaaaagctggccgggcacgatggctcaagcctgtaatcccagcacttt

SEQ ID NO: 58271 - DNA, 201 bp, Homo sapiens
ccccatcactttcagctgtgttcacttgtcctccaatcattgatacctctctctaccttttccaaaatacagattctacaacttggagggacggaggtggkcgtggccctgatgagctggagggcccggactccaaacttcatcatggtcatgatccccggggtgggctacagccttcaggcccaccccagttccctccct

SEQ ID NO: 58272 - DNA, 201 bp, Homo sapiens
cctcagttctggtaagctggaggggttatgggtgggaatatctccatccccagagaaggtcaagtgctggagggagcgggtggagaacctggcctaggggrcctgctgctgggtgcgtttctgcagggagcaagggtagaagaattgggaggtggagtagagaggaaaagttagggtcagtggcagagccaggcagatgct

SEQ ID NO: 58273 - DNA, 201 bp, Homo sapiens
aaacagaaaaatagtaaaagagagtctgcatcataataaagtgttcttttcccacctagttctggttttcctgagatacttatttccattctttctgtctktctcttcaggagcgagactcctccagtacctcccccaccaccctatctggccagttatccaggctttcctgagaatggagcccctgggcccccaatctct

SEQ ID NO: 58274 - DNA, 201 bp, Homo sapiens
aatactcatatttcccctcaggggcccatgaagaggttgactacactgaaaagctcaagttcagcgatgaggaagatgggcgagactctgatgaggagggwgctgagggccagtgagttagggccatcaggggagaagaggagggggtcttggtttgtattttggtaatatactcttagaggagtatattagttgcagctg

SEQ ID NO: 58275 - DNA, 201 bp, Homo sapiens
ttatttccattctttctgtctgtctcttcaggagcgagactcctccagtacctcccccaccaccctatctggccagttatccaggctttcctgagaatggrgcccctgggcccccaatctctcgctttcctctggaggaaccagggccccgtccactcccctggcccccaggcagtgatgaagtggccaagatacaaactc

SEQ ID NO: 58276 - DNA, 201 bp, Homo sapiens
tctcgcatgtggttatacaacatgccatatttcattttcttttttgtgtacagccgttttccccgtgtggcgggcccccgaggctcagggccaccaatgcrcttagtagagcctgtgggtcgtccctctattctcaaagaggataatctcaaagagtttgatcagttggatcaggagaatgatgatggttgggcaggtaag

SEQ ID NO: 58277 - DNA, 201 bp, Homo sapiens
tatttccattctttctgtctgtctcttcaggagcgagactcctccagtacctcccccaccaccctatctggccagttatccaggctttcctgagaatggarcccctgggcccccaatctctcgctttcctctggaggaaccagggccccgtccactcccctggcccccaggcagtgatgaagtggccaagatacaaactcc

SEQ ID NO: 58278 - DNA, 201 bp, Homo sapiens
acacgccaacacacccagctaattttttgtgtgtttttagtagagatggggtttcacatgttggccaggatggtctcgatctcttgacctcgtgatccgcycgcctcagcctcccagagtgctgggattacaggcgtgagccaccgcgcccagccagagtcttccacttttatagcatgtcctcaggaaatgtcttctgtc

SEQ ID NO: 58279 - DNA, 201 bp, Homo sapiens
tcttccgcacccagcgcgtcgacctttaccagcaggtgaaggagaaacccttgtggccccaactctaaattcgagttgccacctgatttcctgtccttccrtctcatcgctgacctctcactgtgactcactctttaacacatgcctgtcccctaggcctccccaccagatgccctgcgctggatacctaagccttgggag

SEQ ID NO: 58280 - DNA, 201 bp, Homo sapiens
gaaggcgggaaacctgatggtctggtacctgtcagagccttccactttttttttttttgagacggagtctcattctgtcacccaggctggagtgcagtggygcaatctcggctcactgcaacctctgcctcctgggttcaagcgattttcctgcctcagcctccagagtagcgggactacaggcacacgccaacacaccca

SEQ ID NO: 58281 - DNA, 201 bp, Homo sapiens
ttcatggaggcacatgagcaagtttaagtctcagtcttatatgatggagtgtagtggtgccagaactgacctccttggggaataagcagttattctgtagsggggtgagtttgaaggcgggaaacctgatggtctggtacctgtcagagccttccactttttttttttttgagacggagtctcattctgtcacccaggctg

SEQ ID NO: 58282 - DNA, 201 bp, Homo sapiens
cttcctctgtatttccctctgcattaagttctatccatgtggaggacagaacaaaatcagcctcactcacaaaacatcagaaaacgttctactggaatacraacaaagggatcaataaaaagaaaatctgaggccaggtgcggtggctcatgcctgtaataccagcactttgggaggccgaggagggcacatcacctgagg

SEQ ID NO: 58283 - DNA, 201 bp, Homo sapiens
ccttgttaaatgactaaggaatggtactaaactttagctttttgtcttggagagagagcatgaaaaaatagacaacagcctacaaaggatgacaaaattawtttgtccttatatttgtaaatggtagcaatgggcatgatttcagtcctgagtctccaccagttggagaagtcagggaggcatctcaggtgtgaataacct

SEQ ID NO: 58284 - DNA, 201 bp, Homo sapiens
taaagggggtgtgggctctgggtgaacaccagttatcctcctacaaaggcgtgtctgtggttccctgtctttggacacgtaagaattggaggaaaataaakgtggatttgggaaactttgaggccagcttgcttcttgcaggctcatgatcaaccaatctcacataaaagtattgaatgttacatatctcagccttcttga

SEQ ID NO: 58285 - DNA, 201 bp, Homo sapiens
tgctggatttttacttagatttccttgacaaaggtgtctgggggaaaggagggaacatggcatttgagctatgagggagctaagtagatcatggttgcttragaagagtgggcagtttacatagactggaggaaaagacaccagagggcctcatatctgagtccctaatgataatgcaatggagtttttaagtttctgtta

SEQ ID NO: 58286 - DNA, 201 bp, Homo sapiens
gctgatcctgctcttctcgccagcaactattctcaccttgaatgttcatgtgcatcatgaccacgggttccacactctggtgggaaatccggatgaccctygggtggctggtggctggcgggggagctggacctggcgggggagccccctcagctgaggactcgacattggtagaagacggagccacggatgaggcctgcc

SEQ ID NO: 58287 - DNA, 201 bp, Homo sapiens
ctccacattatctggcccctcaacctccccctctctagagtacctgaggctcaggggaagctctttctgctccctgaacttccattggctcctcaggaagyggctgtgaaattaaagaacaccatacttcctctcagatctctccagttctctcaagtaccctgaccccatcgcccaacaggtcccttacctgggggggat

SEQ ID NO: 58288 - DNA, 201 bp, Homo sapiens
ccacacctggctgaacctgcaccaaggactgagagacaagataacacaaagatcccaaaatcaagaatcataagactgggagtggaggaggcagctgcctygaccagacccaggagaggaaaggaatagagaagggttactcacaaaactctcccgcacatactcttctagccccgtgatcaatgtgtgggttgccatctg

SEQ ID NO: 58289 - DNA, 201 bp, Homo sapiens
gcccccaccccgctgagggagttcctcttgccccctacccccggggcttgtatatagattataaatatataagggggaaaggggtgggcggggaggggttstggggctggggcctcacttcccctcctcccccttcccctggtcccctgtccctggggctgtttgttaaaaaagagtaataaaaggatttaaaaaaaaaaa

SEQ ID NO: 58290 - DNA, 201 bp, Homo sapiens
taccacaacctccacctcctgggtttaagcgattatcctgcctcagcctcctgagtagctgggattacaggcatgcgccaccacacccggctaattttgtrtttttagtagagacagggtttctccattttggtcaagctggtcttgaactcctgacctcaggtgatccgcctgcctcggcctgccaaagtgctgggattg

SEQ ID NO: 58291 - DNA, 201 bp, Homo sapiens
atggcaagccagccactcacctgcaagaagtcagtcatgccttggagaaaggcagggacaccaggcatcgccacagtgatggtgggagaagccacaccagrccctccagcccctggccctgcaggccctagcaggttccccagaagctgagagaactgaagatcagccatggagggttgaggggtgggtggaggctgggca

SEQ ID NO: 58292 - DNA, 201 bp, Homo sapiens
gaaaaagtttcctcattaaacgaggggaggggagactgaataacaagagctcccaccatctctacatagtttgattccaggcatgacggggaaacctggayagagagagaggcttagggaagaggaaaaccaaccttgcgtctcttggcaggcataccactgaggtaggcatcactcagagggggctgcggtttcaccttc

SEQ ID NO: 58293 - DNA, 201 bp, Homo sapiens
gcacttagggaggccgaggtgggcagatcaactgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagtgagccgag

SEQ ID NO: 58294 - DNA, 201 bp, Homo sapiens
cacttagggaggccgaggtgggcagatcaactgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagtgagccgaga

SEQ ID NO: 58295 - DNA, 201 bp, Homo sapiens
agaaaaccagagctgctacaggaggtaagggatgggtttgagattgtgcttcactgcactcttactcgtgaaaattcttctgggttatgttttctctgttytctttcctgtttctttcactgtgtttttactccagaattctcagtattagtctcccatgtgtctcccttgttgtccccacaccctgtgtcaccccactct

SEQ ID NO: 58296 - DNA, 201 bp, Homo sapiens
acttagggaggccgaggtgggcagatcaactgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagtgagccgagat

SEQ ID NO: 58297 - DNA, 201 bp, Homo sapiens
tactctgtctcaaaaaaaaaaaaaaacaaacatcaaaactggcttgtacaatttagcgtgctgagtagaacacaacagtgttccaaggaagtattaatttwaaaaagttcacacaagattaagggacacactacctaatggagacaatgtagagagaaagcagccagaaaaatccgacttttatttcttaaatactgtgaa

SEQ ID NO: 58298 - DNA, 201 bp, Homo sapiens
caggtgaaggagaaacccttgtggccccaactctaaattcgagttgccacctgatttcctgtccttccgtctcatcgctgacctctcactgtgactcactstttaacacatgcctgtcccctaggcctccccaccagatgccctgcgctggatacctaagccttgggagcggacagggccgccacctcgagaagggccctc

SEQ ID NO: 58299 - DNA, 201 bp, Homo sapiens
cccaaatttcttgttacagatgcttctacccatggtagactcacagctgcctgtggtgaactttggctccctgccgccagcaccacctcctgccccacctyccctttctctgttacctgtgggccctgctctgcagccccccagcctggctgtgcggcccccacctgctcctgctactcgggtgctgccttcacctgccag

SEQ ID NO: 58300 - DNA, 201 bp, Homo sapiens
tcctaagacggcctgggcagaaacctctcggcctccagagacagagccgggacctcctgccccaaagcctcccctacccccacctcaccggggccccgccrggaactggggcccccctggggactacccagtgagtgtctccaataagggattgagagggtcagctgtgggaaattggtgtcagctgagtaattgaagcgg

SEQ ID NO: 58301 - DNA, 201 bp, Homo sapiens
ggtctcaaagaagaccaggataatgagtttgtcaccacccagagagatcaaccccaaagcctgggtcgttgcatcctgcaagtagcgacagttgatttgtygtaaaagagatgatagaaagcatagtaactgattcccctggccctgctgggtcttgccaattgacaggatcgtgggggtcctccctgcaagcccccagca

SEQ ID NO: 58302 - DNA, 201 bp, Homo sapiens
tactgttgttctaatggtttcatagaaagttaatgccaccaccataggctcatgagaggccatgaagtgctttaatgggtcttaaatgggaggggcttcartagaatagatgttgaatagaatattttagtcttaagggagctagagatgagacgtgagattcctggggtgttcatggagtgtctattgttggactagatc

SEQ ID NO: 58303 - DNA, 201 bp, Homo sapiens
cagacagtgggggctcaagctcagagccatttgaccgtcatgcacctgctatgttacgggaacggggcactccaccggtggatccaaagttggcctgggtrggagatgtcttcaccgccacacccgctgaaccccgcccacttacctcacctctgcgccaggctgcggatgaggatgacaaggggatgaggtgagtcttgg

SEQ ID NO: 58304 - DNA, 201 bp, Homo sapiens
acctcattttcttcatctttaaaatgaaaggttcagagtcaatgaattcccagggccccttcccctaacatgtcactaggggctcttacccagtggttatrtaatggcaagaaggtaccactgcctggctgggccgggggacaggaagatgaggtgaatggcaagccagccactcacctgcaagaagtcagtcatgccttg

SEQ ID NO: 58305 - DNA, 201 bp, Homo sapiens
tggctgcataagaagctgccccacaaggccgctcaccatctgggccaacgaggcattggtacccagaccggcgccctgctggatagagagcaagggagaayttcagacctgcccttccatgcaccaccacaggagtctctccctagactgttacgcactagaactccccgacccttgctcaccagtgtcccagagactggg

SEQ ID NO: 58306 - DNA, 201 bp, Homo sapiens
tcccaactttacactgggtcctttaaagggggtgtgggctctgggtgaacaccagttatcctcctacaaaggcgtgtctgtggttccctgtctttggacaygtaagaattggaggaaaataaatgtggatttgggaaactttgaggccagcttgcttcttgcaggctcatgatcaaccaatctcacataaaagtattgaat

SEQ ID NO: 58307 - DNA, 201 bp, Homo sapiens
tgactaaggaatggtactaaactttagctttttgtcttggagagagagcatgaaaaaatagacaacagcctacaaaggatgacaaaattaatttgtccttrtatttgtaaatggtagcaatgggcatgatttcagtcctgagtctccaccagttggagaagtcagggaggcatctcaggtgtgaataaccttcccattctg

SEQ ID NO: 58308 - DNA, 201 bp, Homo sapiens
gggttgatatatttctccctgtttcccgacaggtacgccaggatctgccatccccttcggatttttattctactcctctgcagcctggtggccaaagtggmtttctcccttcaggggctcctgcccagcaggtatattgtatcttcacacttccccttcatttgatttctctgtccagttgctggctttgattttccctgg

SEQ ID NO: 58309 - DNA, 201 bp, Homo sapiens; identical to SEQ ID NO: 16869

SEQ ID NO: 58310 - DNA, 201 bp, Homo sapiens
acggagcttctcaagtcagcggccaggcatggaacggcagaatcggcgccctggcccagggggcaaggctggcagcagtggcagcagcagtggaggaggcrgtgggggtcctggaggaaggaccgggccaggacgaggcgacaagaggagctggccctctcccaagaaccgaaggtgggtaggaacaaacaaatttattgt

SEQ ID NO: 58311 - DNA, 201 bp, Homo sapiens
agccagagagccaaggatttgagtaaacggagcttctcaagtcagcggccaggcatggaacggcagaatcggcgccctggcccagggggcaaggctggcarcagtggcagcagcagtggaggaggcggtgggggtcctggaggaaggaccgggccaggacgaggcgacaagaggagctggccctctcccaagaaccgaagg

SEQ ID NO: 58312 - DNA, 201 bp, Homo sapiens; identical to SEQ ID NO: 16873

SEQ ID NO: 58313 - DNA, 201 bp, Homo sapiens
atggagtggctcatgcctgtaatcccagcattttgggaggctgaggcaagaagattgcttgagcccagcagttcgagactagcctcggcaactggatgccrtctctgccaaaacaaacagaaaaatagtaaaagagagtctgcatcataataaagtgttcttttcccacctagttctggttttcctgagatacttatttcc

SEQ ID NO: 58314 - DNA, 201 bp, Homo sapiens; identical to SEQ ID NO: 16877

SEQ ID NO: 58315 - DNA, 201 bp, Homo sapiens; identical to SEQ ID NO: 16875

SEQ ID NO: 58316 - DNA, 201 bp, Homo sapiens
atgcataggaacccttagaaggactcaaaaacacctggactttaatagggaagagaataggttgtaagcagaagttgggaaacataacttgtgggaaaaartaacgatttagtggatactggagctaatgctctgttttctccagtcgtcctccagaggagcgtcccccggggcttcccctgcctcccccacctcccagca

SEQ ID NO: 58317 - DNA, 201 bp, Homo sapiens
tatgtattcattgctggttctttgctttccagtctgtgcatctgtatgcataggaacccttagaaggactcaaaaacacctggactttaatagggaagagrataggttgtaagcagaagttgggaaacataacttgtgggaaaaagtaacgatttagtggatactggagctaatgctctgttttctccagtcgtcctccag

SEQ ID NO: 58318 - DNA, 201 bp, Homo sapiens
gttttctatggcagtgctgggccttccagttctcaggtaggccccgcttcccattgcatgaccccttcagtgaataataatttttttctgcctggtatgtrtttataatcaagcctttctacgttgcagagttgtgagataccactttgtcacatcatttttctccctactttttgcttctatgggtgggatggtgatctt

SEQ ID NO: 58319 - DNA, 201 bp, Homo sapiens
ctatgggtgggatggtgatcttttttcttgaccacagatactaaagctgtttcaaccgtgctcctctcctgcagatctctgggggagccatggactctcarttacatccaaacagtggaggcttccgccctgggacaccctcactgcacccttacaggtaagactcgatgcctgtggatcacagaagtacttggagatgtg

SEQ ID NO: 58320 - DNA, 201 bp, Homo sapiens
ctagaagctagtggacttaaggcattgctaggactctggcttcctaacagcttttctccccacaatttattttcagatcacagcccctatacctacccccsggcccagcccctccctcagcactgctctctggggtagctctcaagggccagtttctggatttctccacaatgcaagctacagagctggggaagttgccgg

SEQ ID NO: 58321 - DNA, 201 bp, Homo sapiens
  misc_feature (1)...(201): n = A,T,C or G, or insertion/deletion polymorphism (see Tables 1-2)
cctttccctcccccaatgcactttactgtgtgcccaatccaggagctgccccgggagcagcctctgccccctggccccattggcacagaacgatcacagcntacagaccgaggcacagagcctggccccattcggccatcccatcgacctggtcccccagtccagtttggcactagtgacaaggtctgtgtgggctggatc

SEQ ID NO: 58322 - DNA, 201 bp, Homo sapiens
gacccccactttgaggagccggggccaatggtgagaggggtgggtgggactcctcgggactctgccggggttagtccctttccccctaaacgtcgggagcrgcctcccagaaaaccagagctgctacaggaggtaagggatgggtttgagattgtgcttcactgcactcttactcgtgaaaattcttctgggttatgtttt

SEQ ID NO: 58323 - DNA, 201 bp, Homo sapiens
actggaaagcggttggtagggtgttagagtcaagaacacccacctatgtattcattgctggttctttgctttccagtctgtgcatctgtatgcataggaayccttagaaggactcaaaaacacctggactttaatagggaagagaataggttgtaagcagaagttgggaaacataacttgtgggaaaaagtaacgatttag

SEQ ID NO: 58324 - DNA, 201 bp, Homo sapiens
gacctctcactgtgactcactctttaacacatgcctgtcccctaggcctccccaccagatgccctgcgctggatacctaagccttgggagcggacagggcygccacctcgagaagggccctcccgacgggcagaggagcctgggtcccgaggggacaaggagcctgggttgcccccaccccgctgagggagttcctcttgc

SEQ ID NO: 58325 - DNA, 201 bp, Homo sapiens
ggctaaggcaactggaaagcggttggtagggtgttagagtcaagaacacccacctatgtattcattgctggttctttgctttccagtctgtgcatctgtaygcataggaacccttagaaggactcaaaaacacctggactttaatagggaagagaataggttgtaagcagaagttgggaaacataacttgtgggaaaaagt

SEQ ID NO: 58326 - DNA, 201 bp, Homo sapiens
gcctcagttctggtaagctggaggggttatgggtgggaatatctccatccccagagaaggtcaagtgctggagggagcgggtggagaacctggcctagggrccctgctgctgggtgcgtttctgcagggagcaagggtagaagaattgggaggtggagtagagaggaaaagttagggtcagtggcagagccaggcagatgc

SEQ ID NO: 58327 - DNA, 201 bp, Homo sapiens
tggggagttacattctgatcttcactgcttaaagcagaagtatggtaggtatttaacagagtcaggcagcacaacttacctacctcttcctctgaacaggytgtcagaaagcagtgacactaattactatactttctttttctaaacctcattttcttcatctttaaaatgaaaggttcagagtcaatgaattcccagggc

SEQ ID NO: 58328 - DNA, 201 bp, Homo sapiens
gcttggtctgtctccccacctctaccagcatctgctgagctatgagccaaaccagggatttacagggtagggagggtgggataggcagcggcattagatcrgaggaatgagatggacagacctgggctgtgggctaggagggcagtcagctggcctagggtagcccgggctggtgtcagggtaaggagaggaagggaggga

SEQ ID NO: 58329 - DNA, 201 bp, Homo sapiens
ccaaagaatcctgggggacaagggcagatgttagcaatggcctttaccacctggcctgcccacccacaaccagatcatcaacctcatcccaccttggcaayacccctaaaccaaggccatctacattcctctggctgccccttcctggagcaagccaaagcatcctttttgctcaccaagggccccatcagctccaggctc

SEQ ID NO: 58330 - DNA, 201 bp, Homo sapiens
gaaaaagtaagcaggttggagaaacgctggccaagtccctatgatcccagcaagcacacaaggccatccctcagaagctaacatttccccccccaagcacrctgtcaaatagcccggggtggcactgtcaagccttcccagatgccaaaggggaaaacaaatggtagcaccaggctgaccagttcatcgctgaagggatcc

SEQ ID NO: 58331 - DNA, 201 bp, Homo sapiens
taccccccacctgctctgggttgagtctggagctgttctctcacttggctgtcccctttctgcagtttgtatgtgtgcatcagtcaggtattggggtgctytctaccctgacttaactagctccttctccactcctctcagatgagtcagtctgacagtggggtggacctgagtggggattctcaggtgtcatcaggtccc

SEQ ID NO: 58332 - DNA, 201 bp, Homo sapiens
gattctcttgtagggaatctgagtggataaccttgttatataagagcaggcaaggcccggacctactgggaacaagagatggaagagctgacttgaccgcraggggagatgctttttgggctggagggcttgtgacatgaataggattatttttctttttctttggtttcttcaggcctagttccccgagagcgttcagac

SEQ ID NO: 58333 - DNA, 201 bp, Homo sapiens; identical to SEQ ID NO: 16890

SEQ ID NO: 58334 - DNA, 201 bp, Homo sapiens
aagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcaagtcagcttagtttttatttgggtgattttttt

SEQ ID NO: 58335 - DNA, 201 bp, Homo sapiens
gatgccgcctttcgtgagtcttggtgtcttgtcttggaacgattacactggaagctggagagctaggaatcaggacttagtctttgacctatgagatagargggagggtgggaggatgattgatagcaggcttaaggagctagaagggtatatgactgtccctctgagcagctactgttggacccttttacagatgtatcc

SEQ ID NO: 58336 - DNA, 201 bp, Homo sapiens
ctggggactgtagttggggtcttcctgcagtcgtttttgtatatcagaccggagctaaagagaaaaagtaagcaggttggagaaacgctggccaagtcccyatgatcccagcaagcacacaaggccatccctcagaagctaacatttccccccccaagcacactgtcaaatagcccggggtggcactgtcaagccttccca

SEQ ID NO: 58337 - DNA, 201 bp, Homo sapiens
ctagagtgatgggtattttaacttgaacttcagggagcattggggcttggtttagtccagccacgtctgagccagagacgaagaggtccctttcttacctrttgcaggttccttgttaaatgactaaggaatggtactaaactttagctttttgtcttggagagagagcatgaaaaaatagacaacagcctacaaaggatg

SEQ ID NO: 58338 - DNA, 201 bp, Homo sapiens
tctgccatccccttcggatttttattctactcctctgcagcctggtggccaaagtggctttctcccttcaggggctcctgcccagcaggtatattgtatcktcacacttccccttcatttgatttctctgtccagttgctggctttgattttccctggttttctgacattcctccctgcccccaacatgcacacccaaatt

SEQ ID NO: 58339 - DNA, 201 bp, Homo sapiens
cagctcatgatttttttcccctcagctgcatccagtggaactaaagccgttccaggattatcaaaaactgagcagcaaccttgggggacctggatcatcayggactcccccaactggaaggtgaaacggaatagggatgtggactttccaagtgcttccttactttggaaccagggtctggatcctaggcttgccttagac

SEQ ID NO: 58340 - DNA, 201 bp, Homo sapiens
tttccaagtgcttccttactttggaaccagggtctggatcctaggcttgccttagacgcccttcttcccttaggtccttctctggcctcaattcccgtctsaaggccacgccttccacctacagtggagtcttccgcacccagcgcgtcgacctttaccagcaggtgaaggagaaacccttgtggccccaactctaaattc

SEQ ID NO: 58341 - DNA, 201 bp, Homo sapiens
gactgcccgcgtctactgccttcccacggtgttccagcagaacggcacaactaacccacagccaaacacacacacacacacacacacacacacacacacacacacacccaccaccccgcggctccgcccccgacttccccacggaccgtcacttccggtctcccccaaacctgccaccgacggccacttccgtttccccga

SEQ ID NO: 58342 - DNA, 201 bp, Homo sapiens
actgcccgcgtctactgccttcccacggtgttccagcagaacggcacaactaacccacagccaaacacacacacacacacacacacacacacacacacacacacacccaccaccccgcggctccgcccccgacttccccacggaccgtcacttccggtctcccccaaacctgccaccgacggccacttccgtttccccgat

SEQ ID NO: 58343 - DNA, 201 bp, Homo sapiens
ccccccaggtccccaagctttacttttgtggggcacgacgagaaagtccgcagccccaaacagtgagtttctgagggcgagtcgggccggggccggcctakgtgggagggagccgagcaccccgaggagccgccaccgctgtcgcccgggggaccgtactacgcctgcgtgcgtcgcactacggatgcgtggacacttaag

SEQ ID NO: 58344 - DNA, 201 bp, Homo sapiens
cttccacctacagtggagtcttccgcacccagcgcgtcgacctttaccagcaggtgaaggagaaacccttgtggccccaactctaaattcgagttgccacytgatttcctgtccttccgtctcatcgctgacctctcactgtgactcactctttaacacatgcctgtcccctaggcctccccaccagatgccctgcgctgg

SEQ ID NO: 58345 - DNA, 201 bp, Homo sapiens
cctctcccaagaaccgaaggtgggtaggaacaaacaaatttattgtggtttaaaaattggaggagggggaaaaagcctgagggaaagataagtttgggtgkagtggagattgtggcctgaggggccatgggctctagaatgtcagtaggatttccatgtctggctaaggcaactggaaagcggttggtagggtgttagagt

SEQ ID NO: 58346 - DNA, 201 bp, Homo sapiens
gggccaggacgaggcgacaagaggagctggccctctcccaagaaccgaaggtgggtaggaacaaacaaatttattgtggtttaaaaattggaggagggggraaaagcctgagggaaagataagtttgggtggagtggagattgtggcctgaggggccatgggctctagaatgtcagtaggatttccatgtctggctaaggc

SEQ ID NO: 58347 - DNA, 201 bp, Homo sapiens
gagaaacgcttgaacccaggaggtggaggttgtagtgagccgagattgtgccatcgcactccagcttaggcaacgagcgaaactccgtctcaaaaatgaatgaatgaatagcacaactccatctcaaaaatgaatgaatgaatgaaagaagcagtggtccttcatttgccaggatttatttggggtgggttgattctcttg

SEQ ID NO: 58348 - DNA, 201 bp, Homo sapiens
tacaaaaaagtagccggcgtggtggcgctcgcctgtagtcccagctactcgggagactgaggcaggagaaacgcttgaacccaggaggtggaggttgtagwgagccgagattgtgccatcgcactccagcttaggcaacgagcgaaactccgtctcaaaaatgaatgaatgaatagcacaactccatctcaaaaatgaatg

SEQ ID NO: 58349 - DNA, 201 bp, Homo sapiens
tgcaaaaatgggcttagttaagaaataagcagtggttggccaggcattgtggctcacgcctgtaatcccagcacttagggaggccgaggtgggcagatcarctgagttcaggagttcgagaccaccatggctaacgtggtgaaaccccatttctactaaaaatacaaaaaagtagccggcgtggtggcgctcgcctgtagt

SEQ ID NO: 58350 - DNA, 201 bp, Homo sapiens
gaaagtcccctcagtcttaggcattggatattagggtcttactgtgactctggtacgataggttttgcccatcatagtgatgagggaagggcatatgcttrgcactgctgagatagctctgttgcaaaaatgggcttagttaagaaataagcagtggttggccaggcattgtggctcacgcctgtaatcccagcacttagg

SEQ ID NO: 58351 - DNA, 201 bp, Homo sapiens
aactgtttgagcccaggagttcaaggttacagtgagctttaactcactggattgcaccactgcactccagtctgggtgacagagcaagactctgtaacttaaaaaaaaaagaaaaaagctggccgggcacgatggctcaagcctgtaatcccagcactttgggaggccaaggtgggtggatcacaaggtcaagagttcgag

SEQ ID NO: 58352 - DNA, 201 bp, Homo sapiens
ttgcactccagcctgggtgacagagcaagactctgtctcaaaaaaaaatcctgtctcacaagaaatacataaataaaaatgaaaactatttcctataggcyaagactgaagaaagtactgttgttctaatggtttcatagaaagttaatgccaccaccataggctcatgagaggccatgaagtgctttaatgggtcttaaa

SEQ ID NO: 58353 - DNA, 201 bp, Homo sapiens
gaggcgggcagaacatgaggtcaggagttcaagatcagcctggccaacatagtgaaacccgtctctactaaaaatacaaaaattagccaagtgtggtggcwtgtgcttgtagtcccagctgcttgggaggctgaggtagtagaatcgctttaacccgggaggcagagatttctgtgagccaagaccatgccattgcactcc

SEQ ID NO: 58354 - DNA, 201 bp, Homo sapiens
gaaaaccctccagtcagcgcttatcccttctgctctctcccctcacccagagaaatacatggagtttgaccttaatggaaatggcgatattggtgagaaaygggtgatttgcgggggcagggtggtgtgcaggcctaagaagacagaggtctctcctacatgctccattcctcatgatttgggagggggcccacctaccac

SEQ ID NO: 58355 - DNA, 201 bp, Homo sapiens
accaggataatgagtttgtcaccacccagagagatcaaccccaaagcctgggtcgttgcatcctgcaagtagcgacagttgatttgttgtaaaagagatgrtagaaagcatagtaactgattcccctggccctgctgggtcttgccaattgacaggatcgtgggggtcctccctgcaagcccccagcacctgaagatgagg

SEQ ID NO: 58356 - DNA, 201 bp, Homo sapiens
gaaaagttagggtcagtggcagagccaggcagatgctgaccctttttctctttcccagacccccactttgaggagccggggccaatggtgagaggggtggrtgggactcctcgggactctgccggggttagtccctttccccctaaacgtcgggagcggcctcccagaaaaccagagctgctacaggaggtaagggatggg

SEQ ID NO: 58357 - DNA, 201 bp, Homo sapiens
ccccctaaacgtcgggagcggcctcccagaaaaccagagctgctacaggaggtaagggatgggtttgagattgtgcttcactgcactcttactcgtgaaawttcttctgggttatgttttctctgttttctttcctgtttctttcactgtgtttttactccagaattctcagtattagtctcccatgtgtctcccttgttg

SEQ ID NO: 58358 - DNA, 201 bp, Homo sapiens
ggccaggagtgagctccgggttctgggctggggcacgctcctccacttcttctgcctccatgggctcccggggaggtgcttcactttcaactggttctgaygtttgagagctcaaggctactggctccggggtcacagccggtggctgcgggggcggctgactgtgctgcggttggggccctcctcgacactgaaggtagg

SEQ ID NO: 58359 - DNA, 201 bp, Homo sapiens
ggcacagaagtgagtgagggtgggagggtgtgtctgagctgggacttttttgagcactggtcataccccccacctgctctgggttgagtctggagctgttytctcacttggctgtcccctttctgcagtttgtatgtgtgcatcagtcaggtattggggtgctttctaccctgacttaactagctccttctccactcctct

SEQ ID NO: 58360 - DNA, 201 bp, Homo sapiens
cacagcaaccctgctggcatccaacaggctctggcccagcttagtagccgtcaagggagtgtaactgcaccagggggtcatccaaggcacaagcctgggcytccccaagcccctcagggcccctctcctaggcccccaacccgatacgagccccagagggtcaacagcggcctcagttctggtaagctggaggggttatgg

SEQ ID NO: 58361 - DNA, 201 bp, Homo sapiens
cgggatagtaaggtctgtatatccctgatcatgtgctgagccatcaccagccgtacccggggctcactctacaatgagagaaggtttatcagggtaggttrcagatgaagccatgagttctaccacctactaaatcaggtcccagccatctctcagccaggtccaccccacctcccagcctccttctcccagatccccttc

SEQ ID NO: 58362 - DNA, 201 bp, Homo sapiens
attggcacagaacgatcacagcgtacagaccgaggcacagagcctggccccattcggccatcccatcgacctggtcccccagtccagtttggcactagtgrcaaggtctgtgtgggctggatctgggtatcctgagttgggtggagagaagggaaggactaaaggtgggacatagaggacacatgtctgtcacgggacaat

SEQ ID NO: 58363 - DNA, 201 bp, Homo sapiens
atccgcccaccttggcctcccaaagtgctgggattacaggcgtgagccactgcacctggccctgttgcaatgtttttccagggagggaaagagttatctgyatttcagcctgttctgttttgggagtactggggctgaggagaaagggcagggccatcaaagggctcacattgttattgtagtccgtggtggcagcagcac

SEQ ID NO: 58364 - DNA, 201 bp, Homo sapiens
ccctgatgaggaagggccatagagcaaagagctaaggatcatcagcaaaggcccgctgggcattggggaagcgctggggactgtagttggggtcttcctgyagtcgtttttgtatatcagaccggagctaaagagaaaaagtaagcaggttggagaaacgctggccaagtccctatgatcccagcaagcacacaaggccat

SEQ ID NO: 58365 - DNA, 201 bp, Homo sapiens
agagaagggaaggactaaaggtgggacatagaggacacatgtctgtcacgggacaatgtctcctgccttcttgtgatcacaggactcagacttacgcctartggtaggagacagcttgaaagcagagaaggagctaacagcatcagtcactgaggtaagtgggagtaagagtttggtggaaaggcccaagatttctgggga

SEQ ID NO: 58366 - DNA, 201 bp, Homo sapiens
agggcaagtccttagagatccagaaacccgctggtgagagtcctgcaaagatgcttctgatggttgaaagctaggcatgcatggggcatacgttttagagytctttaaagggaagtggctgtagtagaaataccaaaagactagaggagatttcccaactttacactgggtcctttaaagggggtgtgggctctgggtgaa

SEQ ID NO: 58367 - DNA, 201 bp, Homo sapiens
tcaggggcacaaggggtacgatacgaggacagtgcttacagcaaagattatcaccttctctgtaagggaggacaaaatcacttacaggtttagagagaaaytgttttgttgcaatgtgtgtttttttgttttgttttgttttttgagacagtctcgctctgtcacccaggctagagtgcagtagtgcaatctcggctcact

SEQ ID NO: 58368 - DNA, 201 bp, Homo sapiens
tcagcaaaggcccgctgggcattggggaagcgctggggactgtagttggggtcttcctgcagtcgtttttgtatatcagaccggagctaaagagaaaaagyaagcaggttggagaaacgctggccaagtccctatgatcccagcaagcacacaaggccatccctcagaagctaacatttccccccccaagcacactgtcaa

SEQ ID NO: 58369 - DNA, 201 bp, Homo sapiens
gtgcatgaactcagggggcagggagggcagctggatgagggtggagcctggggggcgggtctgatgtaaccttgaacctggaccccttcaacccacccacwcagcccttccctttctctacccagagctcagcctgccctgatgccctcactcttacccagggtttggccatgaccagggggtcccagggggccagtggga

SEQ ID NO: 58370 - DNA, 201 bp, Homo sapiens
ggcattggggaagcgctggggactgtagttggggtcttcctgcagtcgtttttgtatatcagaccggagctaaagagaaaaagtaagcaggttggagaaasgctggccaagtccctatgatcccagcaagcacacaaggccatccctcagaagctaacatttccccccccaagcacactgtcaaatagcccggggtggcac

SEQ ID NO: 58371 - DNA, 201 bp, Homo sapiens
aatgtctcctgccttcttgtgatcacaggactcagacttacgcctagtggtaggagacagcttgaaagcagagaaggagctaacagcatcagtcactgagrtaagtgggagtaagagtttggtggaaaggcccaagatttctggggaagattgctgggagtgaccagggcgtccaggatgccagacatccctctccacgag

SEQ ID NO: 58372 - DNA, 201 bp, Homo sapiens
cagaccggcgccctgctggatagagagcaagggagaacttcagacctgcccttccatgcaccaccacaggagtctctccctagactgttacgcactagaamtccccgacccttgctcaccagtgtcccagagactgggggccctccaggatgggaaggccgagcctgtggaggagtgggccgggcaatcaccacccgggtt

SEQ ID NO: 58373 - DNA, 201 bp, Homo sapiens
cagttgagcccaggagttggaggtcacagtgagctatgatcgtgccactgaactccatcctgggcaacagagcgagacttttaaaaggaaaaaaaaaaaaragtaggggaggatggatggggaataccaagtccttgcaaagtggtgagaggagtaagaatgacaagacttcattggtggatctagacttcggagggaagg

SEQ ID NO: 58374 - DNA, 201 bp, Homo sapiens
tctggcttcctaacagcttttctccccacaatttattttcagatcacagcccctatacctaccccccggcccagcccctccctcagcactgctctctgggktagctctcaagggccagtttctggatttctccacaatgcaagctacagagctggggaagttgccggctggaggagttctctaccctccaccttccttcct

SEQ ID NO: 58375 - DNA, 201 bp, Homo sapiens
tggggaagaatgaaaactcacccacaaggactggctgcataagaagctgccccacaaggccgctcaccatctgggccaacgaggcattggtacccagaccrgcgccctgctggatagagagcaagggagaacttcagacctgcccttccatgcaccaccacaggagtctctccctagactgttacgcactagaactccccg

SEQ ID NO: 58376 - DNA, 201 bp, Homo sapiens
gaaacggaatagggatgtggactttccaagtgcttccttactttggaaccagggtctggatcctaggcttgccttagacgcccttcttcccttaggtcctyctctggcctcaattcccgtctcaaggccacgccttccacctacagtggagtcttccgcacccagcgcgtcgacctttaccagcaggtgaaggagaaaccc

SEQ ID NO: 58377 - DNA, 201 bp, Homo sapiens
cactgcactccagtctgggtgacagagcaagactctgtaacttaaaaaaaaaagaaaaaagctggccgggcacgatggctcaagcctgtaatcccagcacyttgggaggccaaggtgggtggatcacaaggtcaagagttcgagaccatcctggccaacatggtgaaacccccttctctactaaaaacataaaaaattagc

SEQ ID NO: 58378 - DNA, 201 bp, Homo sapiens
caaggccacgccttccacctacagtggagtcttccgcacccagcgcgtcgacctttaccagcaggtgaaggagaaacccttgtggccccaactctaaattygagttgccacctgatttcctgtccttccgtctcatcgctgacctctcactgtgactcactctttaacacatgcctgtcccctaggcctccccaccagatg

SEQ ID NO: 58379 - DNA, 201 bp, Homo sapiens
cctcagtagctagaattacaagcatgtgtccagctaatttacttatttatttattcatatatatctatatatatgtatatatatatgtatatatatctatrgagagagacaaaggatctcactctgttgcccaggctggagtgcagtggcaccatcttggctcactgcagcctcaaactcctcggcccaagtgatccaacc

SEQ ID NO: 58380 - DNA, 201 bp, Homo sapiens
tcagccatttttctctgcacaatatccataaggctatgatcatcctgaatatgttgtttttcatctgttttttccatctacgatacatatatgcacacatrttcatctttcacgtatttgcaggtatagtcattgattccacaagatcttgggcatttgccatgggccaggtattgggggtttttatggtaatctttcctt

SEQ ID NO: 58381 - DNA, 201 bp, Homo sapiens
tagccagctgccgtcccatagctaccaagggccaaacgagagaaaagggatgaaagcctcaggttggaggataataacaacaacagctaccatataccgcrtcctaagcgttttacgaagatcacccacccgtgcactcttcttctgtttggctcatttatcatgcccagtgccaggttaaagatgaaacctagctgggct

SEQ ID NO: 58382 - DNA, 201 bp, Homo sapiens
tgacaaagtaaactcagcccaaccgggtgtcacaggctcttcaagtccaagtcccctcaaaggttgaacacatttatcccctcccaattgaattatattayttgtatgagccagcgcatgcgtctttttttttttctttttctttctttctttttttttttgaaatgaagtcttgctctgtcacccagcctagaatgcagt

SEQ ID NO: 58383 - DNA, 201 bp, Homo sapiens; identical to SEQ ID NO: 16994

SEQ ID NO: 58384 - DNA, 201 bp, Homo sapiens
caccgggaccaggtgaactgctcgggggccgaagcttacctgtgggactgcccggggctgccaggacagcactactgcggccacaaagaggacgcgggcgyggtgtgctcaggtcagtgggcggagtcgctgaagcccggtcactaccaacactcaccataggcctactgggcgccaagcctggagttagtgccggagagg

SEQ ID NO: 58385 - DNA, 201 bp, Homo sapiens
acccagcctagaatgcagtgctgcaatctcagcacactgcaacctccccctcccggattcaagcgattctcctacctcagcctcctgagtagctgggactrcaggcatgcactaccacatccagctaatttttgtatttttagtagaggctggatttcgccatgttggccaggctgatctcgaactcccgaccttagctag

SEQ ID NO: 58386 - DNA, 201 bp, Homo sapiens
taggcctactgggcgccaagcctggagttagtgccggagaggtggtccctgcccttgagatgtcacagttcaggaggggagatgagactgagacaaacatrattcaggagagaaagtggcaaatgcccccaagaaaggcagtcaggtggagtctagaggcagcagaccatgcggagctgtaggctaaggctgaccacctcc

SEQ ID NO: 58387 - DNA, 201 bp, Homo sapiens
gggactacaggcatgcactaccacatccagctaatttttgtatttttagtagaggctggatttcgccatgttggccaggctgatctcgaactcccgacctyagctagtccacccacctcagcctctcaaagtgctgggattacagatgtgagccaccaggcccagcccgcatctttctaattttaatggaattacaggcgt

SEQ ID NO: 58388 - DNA, 201 bp, Homo sapiens
gcctggagttagtgccggagaggtggtccctgcccttgagatgtcacagttcaggaggggagatgagactgagacaaacataattcaggagagaaagtggyaaatgcccccaagaaaggcagtcaggtggagtctagaggcagcagaccatgcggagctgtaggctaaggctgaccacctcccggaagaggtgacattaaa

SEQ ID NO: 58389 - DNA, 201 bp, Homo sapiens
ttggggcctcccctttccctatcagagcagtgggaagcatcacaacatccttcccttatccccctgcactctggaccccagatgcccgagataagtagctrctcccatcagtgtgggttgggagtagaaaactaggagtccatctggctgcttcccaaacctgcaaaccaggaatcccagtccagcttcccggccactggg

SEQ ID NO: 58390 - DNA, 201 bp, Homo sapiens
acacgctttctcttcctgaggttggagtggggatccacgccatcctggaagggcaaagagtgaagcacaaagagagatccagggaccacaccccggccctyggtccatcagcccctccctcggccaaggccctctgtacccacattcacgggtctccccatggccgcaacacccagcctcactctcacatctgcttcctgc

SEQ ID NO: 58391 - DNA, 201 bp, Homo sapiens
ctgggcaaggggcaggtgagtgtttccggacagctccctgaaccagtcctgctccacttgaatacctggagtctgagccagggcctcgggaggcgggcccrccagggttcacgtagcatttgtcatcactgctcgggacaaaaggccagtcttcatacacaagatgcacggtggtctgcaggttagcagggagcacgcctc

SEQ ID NO: 58392 - DNA, 201 bp, Homo sapiens
gtcagtcattcatcctttatgatatatggatttatacctcttgcagaggaatttgagcttaatcaccttgcattatgaatgtattcaatcacctttatcgsaaagagttcaatgacataaaaaccaatacaaaactcagccaaatattataaatatcctttgcacagagagtccatatatatgaaaagagaatgtgaatac

SEQ ID NO: 58393 - DNA, 201 bp, Homo sapiens
acaccacacacttaaaagcaatgagaaaattggaaaaaggaagcaaggaggaagataacataaaaagggaagcaggtcagctttacagagaatggaaaggyaagaagaagggtgagtgcccattcctctttcttcctgaattggaattcttgtttccagaatcttctgtgacagtgaaaatagagaacaaggaatctcggg

SEQ ID NO: 58394 - DNA, 201 bp, Homo sapiens
actccagcctggacaacagagtgagaccctgtcccagaaaagaaagaaaaaaaaagggggctacttggtgctcccctgctactctgcctctcacctctgcygttcatactctaccatctctccctacgcctttccgcccaccactttgccatgccctcgactctgttctctccccagttttcatgctgcccatccaggtcc

SEQ ID NO: 58395 - DNA, 201 bp, Homo sapiens
caggcctttgacattcacctgaagatggctctctgtgtgagagcgggggagtgcggatgagagacacagttggcaggggttctcgcatgccatatccctcygtgtcccatcctgccctgtctgaccccatcagccccactcacttcctcacctccacgctcttgccagcttgtgcctcatagccagctcttttcattgcct

SEQ ID NO: 58396 - DNA, 201 bp, Homo sapiens
ttccgcccaccactttgccatgccctcgactctgttctctccccagttttcatgctgcccatccaggtccaggccccgccccctgaggactcagactctgrctcggactcagactatgagcactatgacttcagcgcccagcctcctgtggccctgaccaccttctacagtgagtgcctggccgggctcccgagggcccac

SEQ ID NO: 58397 - DNA, 201 bp, Homo sapiens
catcagccccactcacttcctcacctccacgctcttgccagcttgtgcctcatagccagctcttttcattgccttctggggataggaagaggaaagataaygctgaaggcagttccctggcaatgctgggaggttggaatagaccagagcgtcccacaccttattgtggaatcacttgggagcttgtcaaaaattcctgag

SEQ ID NO: 58398 - DNA, 201 bp, Homo sapiens
agctgcaagagaggcagggaaacgaaggctctgtcctgggcagctgtgtccagataaaagccagaatggatattggggaacagacagccgtccctgccccrcctgctaacccagggcttctgggggtgggacacggatgattccacttcttctggcctgtggaccagtgtttgggcgccacagggatgaagtgtctgtcga

SEQ ID NO: 58399 - DNA, 201 bp, Homo sapiens
ttagcaaaaagtgaaaagatcgtgaagacccagagctcatcccctctgtgaaaggggtgatgaggaggggagaggagatggcctcctagctctagcaggtwttttcttcttgactttgcagaaggactgaaaacaccgtgggcagggaataatttcctcactctgcgatttcagagcattaaacgcggcttctgtaaactc

SEQ ID NO: 58400 - DNA, 201 bp, Homo sapiens
tgagaaaattggaaaaaggaagcaaggaggaagataacataaaaagggaagcaggtcagctttacagagaatggaaaggcaagaagaagggtgagtgcccrttcctctttcttcctgaattggaattcttgtttccagaatcttctgtgacagtgaaaatagagaacaaggaatctcgggagctaatgctcctcatcccct

SEQ ID NO: 58401 - DNA, 201 bp, Homo sapiens
caaccgtgttttcctcagcacctctgacagtgccggaggacagaaagtaacctcaggtgtagctggtgttgacctgacactggtcactgggcacggccagrgcggcattctggggagtgccttgtttccccaccaggcttgctctgacactgggctggccagcgggaggctcagctttccctcgatgtctatgcctccttt

SEQ ID NO: 58402 - DNA, 201 bp, Homo sapiens
gaaaataagaagttaagggggaaaaaaggatttcagccctttctggtggctcacacctgtaattcagcacgttgggaggccgaagtccaagagttccagascagcataggcaacatagtgtgaccccccacgtttacaaaaaattaaaaagttagccggatgtgagattcatgcctgtagtcccagctactcgggaggctg

SEQ ID NO: 58403 - DNA, 201 bp, Homo sapiens
caccattttggcaaggctggtcttgaattcctgacctcaggtgatccacccgcccgcctcagcctcccaaagtgctgggattacaggtgtgagccactgtrcctggcctaggctccatattttcatattcattcagtacctgctgagtaccaggccctgtgctggcactgccataggacatgaaggtttgcccttgaacag

SEQ ID NO: 58404 - DNA, 201 bp, Homo sapiens
ccggccactgggcaaggggcaggtgagtgtttccggacagctccctgaaccagtcctgctccacttgaatacctggagtctgagccagggcctcgggaggygggcccaccagggttcacgtagcatttgtcatcactgctcgggacaaaaggccagtcttcatacacaagatgcacggtggtctgcaggttagcagggagc

SEQ ID NO: 58405 - DNA, 201 bp, Homo sapiens
ggtagggtttgggccggggacccctccccactcaagactcctgcaggaaaggtccgcccttcccccagggacttttcacctcacccaccatcagctgggcygtcatggaactttatggagcctgagctctcctccttcaggctgagtggccatgcccagccttcgtttccccggctgtaaagcagggccaacgggagctca

SEQ ID NO: 58406 - DNA, 201 bp, Homo sapiens
tgcttggagaaatgccaggctccttagggtgttaggagagacctgtggccacagctgctgctccgactgggaccgggcaggcgctcccagggacaacagasggaggcagagggaagcccaggttcccaccctccattttgtaggctcctgcagcccgaacgccttctgcctgaaaatggcggctgagagaggccaggaggc

SEQ ID NO: 58407 - DNA, 201 bp, Homo sapiens
acccagtctctactaatatatataaattaggcgggcatggtggcacatgcctgtagtcccagctattcaggaggctgaggcaggagaattgcttgaactcrggaggcggaggttgcagtgagttgagatggcaccactgcactccagcctgggtgacagagcaagatagaaaggaaagaaagaaagagcaagaaggaagga

SEQ ID NO: 58408 - DNA, 201 bp, Homo sapiens
tgttcacctctttcaggaggggtgcctgggagcaggcgggcgcggggagacagagctgaggaagccccccaggcctggaggaggcccgttccccactccayttggtgtgctctcgttttgcctccctccctccttcaaccaaactaaaggatgcacagttgccaaatggattcagctccttggagaaatatgttgctttgc

SEQ ID NO: 58409 - DNA, 201 bp, Homo sapiens
atcagcatggccaacatagtgaaaccccatctctactaaaaatataaataaaaaaattagccaggcatggtggcaggcgcctgtaaccccagctactcagkagctgcggcaggagaatcgcttgaatcaggagggtggaggtggcagtgaaccgagatcgcatcactgcactccagcctgggcaacagagggagagtgaga

SEQ ID NO: 58410 - DNA, 201 bp, Homo sapiens
ttgctttgccgggatgggattctagaagtatgacaatgtctgagctggaagaaaccccagcgagctgccagccatctcctgtttgtcagaggaggaaagcraggtgcgaagtggggaacgacatgccccagggtcttggagcagggctgagaagcccagtctttccagggcctcttcccacgctgcccagcagggcatggc

SEQ ID NO: 58411 - DNA, 201 bp, Homo sapiens
tgatacaattctattggataatcgacagaatttattcagattttgccaatggttccaataatatcttctaagacaaaagaaattttgttcagtatgctgcrtttaattctcgtctctctattctccttgaatctggaatgatttctcagattttctttctctttcatgtcattgatctttttgaagcatagagcagttatt

SEQ ID NO: 58412 - DNA, 201 bp, Homo sapiens
tgtccctgatgggagcacaaccctagttctgggtcacttgtctgtcccattcagtttctaacccaaggcctggcacacagtaggtgctcagtaacatgcaytgagtgactgggcggtgctttctgacagcttcccggagtttgcacaatctgtccactcccgaagtccctgcaagtgttcagacagtcactataggtaagt

SEQ ID NO: 58413 - DNA, 201 bp, Homo sapiens
tgggcaagttcccaaagctctctgaggtaaaatgggtgtggccatgtcactcttcagcttttgcgctctaggtagatgctaaagccttccctgaagatctstatggaacttttagtcacctgcatctgtgggggctgcctcagccctaaccatgtcaacatagtgttgaaattcagttccgagaaacacttgtgggtttgt

SEQ ID NO: 58414 - DNA, 201 bp, Homo sapiens
agttgtcctcccaccctattcagcctacccaggccccgggaaatccagcctcttctccaggctcctaaatgatgaggttgagccttcacccctccccaccrccgcctctgcttgcagattcccagcggcatcgggtcacagatgaggaggtccagcaaagcaggttccagatgccacccttggaggaaggtgagtcaggat

SEQ ID NO: 58415 - DNA, 201 bp, Homo sapiens
ggcagatcacttgagctcaggaatttgagaccagcctgggcaacatgggaaaaccccgtctctacaaaaaatatacaaaaattagccagcatcgtggcaarcgcctgtagtcctagctactcgggaaactgaggcacgagaatcgcttgaacccaggaggtggaggttgcagtgagccgagattgtgccactgcactccag

SEQ ID NO: 58416 - DNA, 201 bp, Homo sapiens
cctctgcttgcagattcccagcggcatcgggtcacagatgaggaggtccagcaaagcaggttccagatgccacccttggaggaaggtgagtcaggatgggraggggtgtgaatggcagtcccacctccagagagtagctcagctcagcttgagaccttccagcaggaacctccctcaatgagtctttcctgactttcacaa

SEQ ID NO: 58417 - DNA, 201 bp, Homo sapiens
gaggcctggatggaaagacggttccaggtaatttctgcttttgttcctgtagcacagaagtcagagaacagagaagccaggttcccttcttgggatagggratgggagaatgcttgacacaaaaataaagccctcgaggttatccgctttcaaccagctgccttggagctggcagctgctgctcactcattcattcagtca

SEQ ID NO: 58418 - DNA, 201 bp, Homo sapiens
ctgccccactccttgtccggcaggatgtactactcatgcaatggggaggagctcaccctctccaactgctcctggcggttcaacaactccaacctctgcarccagtcgctggcagccagggtcctctgctcaggtaccccatcctactccacccccccagatttgagccagaattctacctgaatccatgtcctaaaaact

SEQ ID NO: 58419 - DNA, 201 bp, Homo sapiens; identical to SEQ ID NO: 16991

SEQ ID NO: 58420 - DNA, 201 bp, Homo sapiens
ttctgcctgatgatgaagaggcccacacggtttcctggagagggctgtctgccagggtgtgcacgcgcacatgcacaagctcaggctcagggggtatgtcygtggaatctgctcaggtgaagctccaggaatgtgtagtggtcatgtccgagtcttcaggctctgtatcggtcaggccggactaggcaaggctgtagcaac

SEQ ID NO: 58421 - DNA, 201 bp, Homo sapiens
actgcaatagtcccaaaagcaagctgcctccatggaacccccaggtgttttcttcagagaggagttccttcctggagcagcccccaaacttggagctggcyggcacccagccagccttttcaggtaagctgtgcctcccccaaacccccatcccatagccagcctggctggaggaggcataaagctgggagccctgagtca

SEQ ID NO: 58422 - DNA, 201 bp, Homo sapiens
acagtcaaggagaggtcaccttgaataagcaatgtccttcacatgagggacacagcctacccgagggacctcacagggggggccagaggaataagtgtcayatcttcgctctcctcacttctgcctagctctgctaaggctccccattggctgaatctgacagaagccataaggcccaggaagacaggggttaatccaaac

SEQ ID NO: 58423 - DNA, 201 bp, Homo sapiens
cgcacccggccaccctctccttttataaacttaagtttatttgaacttagaaatctgtcactatcatgtatctcaaaccaatactacttaagtaaatagaatatatatatatataaacaaagaaaacactgaaaccaaaagtgtcattaaatagcctgccgtccaagcatgagctgtctctccattcattaagaagtgtta

SEQ ID NO: 58424 - DNA, 201 bp, Homo sapiens
ggtggggtaggggagggaggtaagtttccttagccacgtgtccctgatgggagcacaaccctagttctgggtcacttgtctgtcccattcagtttctaacycaaggcctggcacacagtaggtgctcagtaacatgcattgagtgactgggcggtgctttctgacagcttcccggagtttgcacaatctgtccactcccga

SEQ ID NO: 58425 - DNA, 201 bp, Homo sapiens
cacaccggaggacgacctcgagtcatttccagatctgagcgtttccttggatctggcctccagactccacccccacacttggttcctagtcccacccctgkgttcccaaagctaacccggtctctaaccccacttactgggcccgccgcttccctgtccccgcccgctctgggtctctcctcccctttcgccatatacata

SEQ ID NO: 58426 - DNA, 201 bp, Homo sapiens
gcacccggccaccctctccttttataaacttaagtttatttgaacttagaaatctgtcactatcatgtatctcaaaccaatactacttaagtaaatagaatatatatatatataaacaaagaaaacactgaaaccaaaagtgtcattaaatagcctgccgtccaagcatgagctgtctctccattcattaagaagtgttag

SEQ ID NO: 58427 - DNA, 201 bp, Homo sapiens
gtgtcacaggctcttcaagtccaagtcccctcaaaggttgaacacatttatcccctcccaattgaattatattatttgtatgagccagcgcatgcgtcttyttttttttctttttctttctttctttttttttttgaaatgaagtcttgctctgtcacccagcctagaatgcagtgctgcaatctcagcacactgcaacct

SEQ ID NO: 58428 - DNA, 201 bp, Homo sapiens
tacaaaggtttttcatatatgcttttattttaaaatttttttgtttttattttgttttattttattttactaaaattttatttagtaaaaatagtacagawtttagaaaatacaaaaacagaaaaatttaaaaatttatcaatagctaccttcaaagataactgttgttactagcctcttgtagaatcttccagacatttc

SEQ ID NO: 58429 - DNA, 201 bp, Homo sapiens
ttccaacccgggggagtggtgtggttacgaatgtggcctctgcaagcagacagcctgggttcaattcccagcttggccattttctagccgtgtaatcttargcaagatactaaaccgctctgtgcctcagtttccccatctcgtggtcttgctttgacaattaaatcatactgaataaatgtcagccattactgctgagct

SEQ ID NO: 58430 - DNA, 201 bp, Homo sapiens
caaacgagagaaaagggatgaaagcctcaggttggaggataataacaacaacagctaccatataccgcgtcctaagcgttttacgaagatcacccacccgtgcactcttcttctgtttggctcatttatcatgcccagtgccaggttaaagatgaaacctagctgggctcagtgactttccctaggtcacacagccagtaa

SEQ ID NO: 58431 - DNA, 201 bp, Homo sapiens
catggaaggtatcacgcaggtgaacatcatctgtcctgtgacataggggcaaaagaaaggtaaaaaggctgaatttctggccgggcgcggtggctcatgcytgtaatcccagcactttgggaggctgaggcagggggattgcttgagcttaggagtttgcgaccagcctgggcaacacggtgaaaccctgtctctagtaaa

SEQ ID NO: 58432 - DNA, 201 bp, Homo sapiens
ccacttccgcccctctcaaagaccctcttcatggttctggtgaacggacagagcggctggagcccgtgtggccacctggcgtggacctctcttggccgccrtccccggccccccgtcctcgcttcgtgaggatgggatggagtctccagagtggggaggtgcaggggagccccagggaagggatgggttgaaagaagcttc

SEQ ID NO: 58433 - DNA, 201 bp, Homo sapiens
catccactcaacgagcattcaggatgcaaccgtgttttcctcagcacctctgacagtgccggaggacagaaagtaacctcaggtgtagctggtgttgaccwgacactggtcactgggcacggccagggcggcattctggggagtgccttgtttccccaccaggcttgctctgacactgggctggccagcgggaggctcagc

SEQ ID NO: 58434 - DNA, 201 bp, Homo sapiens
cattttgattatctgctgtgtgttctcccacacttatcttcatgttcctgcaatcataccagttcacagagggggttttttggccttgcttcacaaaaaaygtatcatattatattctcttctctgcatcttgcttttcctactcaacacagcttggaaatcctgccaacccatctgggtctatttcattctttataaagg

SEQ ID NO: 58435 - DNA, 201 bp, Homo sapiens
aattagccaggcgtggtggcgcatgcctgtaatcccagctactcaggaggctgagacaggagaatcgcttgaatccgggaggtggaggttgcggtgagccragatcaagccattgcactccagcctgggcaacaagagcgaaactctgtctcaaaaaaaaaaaaagaaagaaagaaagaaagtaaatggaacaatatatgc

SEQ ID NO: 58436 - DNA, 201 bp, Homo sapiens
aaggaaagagctggagagagctgataccacctcaagcaggggtcagggtcggggcagcagggggagggtgatcttggcccagctgggtagcgggaatgccrgcacacagccctgtgttcataaccggccagacactgggcctagggctttatagccattatttcccaaccctttaatcctcttggtagccaaatgggagag

SEQ ID NO: 58437 - DNA, 201 bp, Homo sapiens
aactcccagctgtgcctcttgctagctgtgccctgttgggcaactcggaacctctctgagcctcagacacctcaattataaaatgggggtgataagcatayagtactttctcctagcattgctgtgaggctccagtgaattaatttttgtaaagcacttagaacagagcctcaaagacagtaagaactgtccgaaagtctg

SEQ ID NO: 58438 - DNA, 201 bp, Homo sapiens
gcacaaggcaggaggattgcttgaggccaggaatttacgactagccccgggaacatagcaagaccagtctctacaaaactaaaaactaaatattagccaagggtagcacgtgcctatagtcccagctcctcaggaggctgaggtgggaggatcgtgtgagcccaggagatccaggctgcagtgagctatgatcgtatcact

SEQ ID NO: 58439 - DNA, 201 bp, Homo sapiens
cactgcaacctctgcctcccgggttcaagtgattctcctgcctcagcctcccaagtagctgggattacaggcatgcaccaccattgcctggctaatttttktatttttagtagagacggggtttcgccatgttagccaggctggtctcaaactcctggcctcaggtgatctgcccgtctcagcctcccagagtgctgggat

SEQ ID NO: 58440 - DNA, 201 bp, Homo sapiens
gggtctgggctggcgggaatttctgcccaaaggattctgacctgactctgtcccctgccccttccctgcagagcaccagtcctggcgcctgacagggggcrctgaccgctgcgaggggcaggtggaggtacacttccgaggggtctggaacacagtgtgtgacagtgagtggtacccatcggaggccaaggtgctctgcca

SEQ ID NO: 58441 - DNA, 201 bp, Homo sapiens
tcatggaaaggggtatcacacaaggaagttaacatcaggaggtgaggatcaaaggaatgctcctagaatcagtctgccattctctctatgatgcttgacaygatgaatattttaatttaatctttattattttttgtaattatatgactaaaggtgctgattaattttttccataaggaagaagaaacagatgtcctcctc

SEQ ID NO: 58442 - DNA, 201 bp, Homo sapiens
tcaggagtgtaccatttctcactgtgctgcccaggctggagttccttagaaacaaatcagaaacaaatctctccctctctctctttctctctctctctctmtatatatataaatatatatatatatgagttagttccaagatggccgaataggaacagctccggtctgcagctcccagggagatcagtgcaacacaatgag

SEQ ID NO: 58443 - DNA, 201 bp, Homo sapiens
tgtattatagtttgaagtcaggtagcctgatgcctccagctttgttctttttgcttaggattgtcttggcaatgcgggctcttttttggttccatatgaaytttaaagtagttttgtccaattctgtgaagaaagtcaatggtagtttgatggggatggcattgaatctataaattaccttaggcagcatggccattttca

SEQ ID NO: 58444 - DNA, 201 bp, Homo sapiens
agaatcttcaatctgtgtttaatttttagcaatatctgttgaaataattacatgattattacttttgttttttcccctgcaaatttaatgaattatattgsttcttttgaatgttaaagcatgattctattcccataagaaattccacaaggttgtgataaattatgcatattatatgttatatttttatttatcaatatt

SEQ ID NO: 58445 - DNA, 201 bp, Homo sapiens
attaccattttgctttttaaatagttttattttgtgagataaattttattctgatgaatatgaaagcaaactttgcttagaagatgtgccatccttgtagyataggacactaagtcaaagatcaaagaatcactaacatggtgattgccccagggtattccaaagcttagaaggatgctacctggttctgcccagagaaac

SEQ ID NO: 58446 - DNA, 201 bp, Homo sapiens
gccttgctaagggtctatacattttattagtgttttcaaaaaaccaacatttgcatttgttgattcatcaaattttgctttctattttattaattatgctrttatctttattatttcctttcttctatgttcttggatttcttttgttactctttttctggcttgtttagatgaatacatagattactaattttcagcatt

SEQ ID NO: 58447 - DNA, 201 bp, Homo sapiens
tcactgttttatatatgtgaattggattgagttttgtttttgatgtttaagttaatccaaagctgtactgatttgtgtgtgtttgttttctatcaatcackgagagaagcatgttaaagtctcacttggcattttaaaacattactaattttagttctgtccatttttgcttttgtattttgatactatttcattaggtac

SEQ ID NO: 58448 - DNA, 201 bp, Homo sapiens
ttgtatactttaaaacttatttttgcagaatctaaaggaatgtgcacatctcctcctcttattaaacatggagtcattattagttcaacagtagacacctmtgaaaatggctcttcagtagaatacagatgttttgatcaccatttcctagaaggatctagggaggcctattgtttagatggaatgtggactacaccacca

SEQ ID NO: 58449 - DNA, 201 bp, Homo sapiens
acatgttccaaaagaatgacaacagggtttagcattatctgcggtttcaggcatgcactggggctcttgaaatgtatcccctgtaggcaatcagggaggggcatactgtaagtaagtttgttaatgtactacaggtatatgattgatatgccatattagcaactctggacctttttacctgtctcagaagttattccttaa

SEQ ID NO: 58450 - DNA, 201 bp, Homo sapiens
ttaagacatactttgaattatatctgcactttaaaatttgttgatatttgctttataacaagcatgtatttgctttaggtaaatgttcttttcattgaaaagttaactttgtcattgttgggttcactgttttatatatgtgaattggattgagttttgtttttgatgtttaagttaatccaaagctgtactgatttgtgt

SEQ ID NO: 58451 - DNA, 201 bp, Homo sapiens
cacaagtgttttctctctcatttctttaagtagaaagtccctaaaatattagtgtattttttctattgtggtaaaatatacataacataaaatttaccacygtagctatttttaagtgtacaattcagtggcattaagtatattaacatttttgtgaccaattagcttttgggttgtctttctcctagctgaaattccctc

SEQ ID NO: 58452 - DNA, 201 bp, Homo sapiens
agagacacaattaaagaaagaatgacccttggaattttatttaattttatttatttatttatttatttatttagagacagagtcttgctctgtcgcccagsctagagtgcaatggcatgatcttggctcactgcaatttttgcctcccgtgttcaagcaattctccttcctcagccttccaagtagctgggattacaggcg

SEQ ID NO: 58453 - DNA, 201 bp, Homo sapiens
ctattggtctcatatttttataaatgtttttgatattaagtttttgatgctttggttgatattgcattgagtggagatatagtaatctctaaggacaaagmctagattaaaatatttatggcaaagctggtaatgaaacaagctcataaggaaataacaacatttaaggaaatacatcattctatatctggaacaactgcc

SEQ ID NO: 58454 - DNA, 201 bp, Homo sapiens
ttctctgtaggaattattattccagacattaagagtctctctaacctctccatactctcttccctgctctaatcactccagtctttctggtctccttactyttccacaaacaagccaagaatgctctcacttcagggcctttgcactggttgttccctttgcttgggacactctttcataagaaaatgacatggttcactc

SEQ ID NO: 58455 - DNA, 201 bp, Homo sapiens
aaattccttataaaatataattttgaggaaataagttaaaaacttcggagtttttccttgcttaaatatttgaatctaaattatttgtgctgaacatttcrttatttataaatgaaaaccaataaatgtctaatttttagtttgtatgatttgatgtagaacttaatctcttttgtatgtcttccatctgttacaaattaa

SEQ ID NO: 58456 - DNA, 201 bp, Homo sapiens
caaacctaggctagcactactagtattttatgtctcatagtagcattaaggtatacagtgatcaaccaaggcattgaagccgtagtaatcacactggatcyaggccttcttccatccatgactgcccatgtttcttcccaccacagctcctaggattgttcgagcatttctttcttttaagtgtttttatgactttaagat

SEQ ID NO: 58457 - DNA, 201 bp, Homo sapiens
gccaagtattgctttgttttacttggttgtctgttttttcttttaatgctatttatttcaaaattttttatgagttagcatatgttaaggagaaactttayctattcctgaactgtactgtccaatacagtggccatcagccacatatagctattggagacagtacttaaaatgtcactagttcaagatcagatattctgt

SEQ ID NO: 58458 - DNA, 201 bp, Homo sapiens
ttccaataagtcaattttatgaagggaaaaaatcaagaggttttataaatgttgccagactatcagagaattgatcaccttcttgtgagcactcaacaacmaacactgtaaagcattgctctacttagggctttctggggacccattgtctcagtactcactggctatagggactattacttttaataaggaagaaaagga

SEQ ID NO: 58459 - DNA, 201 bp, Homo sapiens
cgaagttatgcaaagcttccctgaaaaagtggtctgctaaattttatcatgactgttggatgtttaaagtcatttgcagatcaattatgataaaaggactscttgagttgtcacaaaagtaccttaaaaatttaagtaagaaaaataagtactagttgaagtgtctctaaaaacttttagtttgtattgtcacctgattac

SEQ ID NO: 58460 - DNA, 201 bp, Homo sapiens
taaaggtataaaaacctttctttctattttgccgaaagtatttttaaagaatcttcaatctgtgtttaatttttagcaatatctgttgaaataattacatrattattacttttgttttttcccctgcaaatttaatgaattatattgcttcttttgaatgttaaagcatgattctattcccataagaaattccacaaggtt

SEQ ID NO: 58461 - DNA, 201 bp, Homo sapiens
tttctagtttaattcaattaagacatactttgaattatatctgcactttaaaatttgttgatatttgctttataacaagcatgtatttgctttaggtaaaygttcttttcattgaaaagttaactttgtcattgttgggttcactgttttatatatgtgaattggattgagttttgtttttgatgtttaagttaatccaaa

SEQ ID NO: 58462 - DNA, 201 bp, Homo sapiens
tacaatggggataaagtgacatatgcatgtaaaagcggctaccttctccatggatcgaatgagataacttgtaatcgtggaaaatggacacttcctcctgwgtgtgttggtatgtatgctacatttaccatcagtagctaaacttatggtgtaaaattttccattctgttactttaatctgaatattcctaggaaaagacc

SEQ ID NO: 58463 - DNA, 201 bp, Homo sapiens
ggatattggcaagctatgcaacaggatcctcagtggaatatagatgcaatgaatattacttactgaggggatcaaaaatatctcgttgcgaacaaggaaartggtcatccccacctgtttgcttgggtaagaaagagaacacatggaatgtctacgtttgtacttttatgtgattttcttacagtgttttatatcatgaaa

SEQ ID NO: 58464 - DNA, 201 bp, Homo sapiens
cactgaaagtggaagacaagaagagcaaaccacgtgtacaacagaaggctggtctccagagccaaggtgcttcagtaagtcagctggatatgtcactcaawgtttcaatactcaaagaaatttgtatataaaaataggggtccaataaaaatggaaagcggttaaaccttttagtagataagaacaaaatcactagcaatc

SEQ ID NO: 58465 - DNA, 201 bp, Homo sapiens
ccctttaccattatgtaatggccttctttgtctcttttgatctttgttggtttaaagtctgttttatcagagactaggattgtaacccctgctcagcaatrgtagacgaccctccccccataacgctgtcgtgtcacaggttgatctcagactgctgagctagcagtgagcaaggctccatgggcgtggaaactgctgagc

SEQ ID NO: 58466 - DNA, 201 bp, Homo sapiens
aatgtttagttgaggtggaagaggcattaaatttgtgggcagaagacatgaacagaaacatgttccaaaagaatgacaacagggtttagcattatctgcgrtttcaggcatgcactggggctcttgaaatgtatcccctgtaggcaatcagggaggggcatactgtaagtaagtttgttaatgtactacaggtatatgatt

SEQ ID NO: 58467 - DNA, 201 bp, Homo sapiens
aattcaattaagacatactttgaattatatctgcactttaaaatttgttgatatttgctttataacaagcatgtatttgctttaggtaaatgttcttttchttgaaaagttaactttgtcattgttgggttcactgttttatatatgtgaattggattgagttttgtttttgatgtttaagttaatccaaagctgtactga

SEQ ID NO: 58468 - DNA, 201 bp, Homo sapiens
acaggatcctcagtggaatatagatgcaatgaatattacttactgaggggatcaaaaatatctcgttgcgaacaaggaaaatggtcatccccacctgtttkcttgggtaagaaagagaacacatggaatgtctacgtttgtacttttatgtgattttcttacagtgttttatatcatgaaaatgatgattttgtacaaatc

SEQ ID NO: 58469 - DNA, 201 bp, Homo sapiens
aaaagcaattgcgatgagagccaaaactgacaaatgagatctaattaacctaaagagcttctgcacagcaaaagaaactatcatcagagtgaacaggaaacttacagaatgggagaaaatttttgcaatctgcccatgtgacaaaggtctaatatccagaatctacatggaacttaacacaaatttacaagaaaaaaacga

SEQ ID NO: 58470 - DNA, 201 bp, Homo sapiens
actagaattttaaaaacagaaaactggtagagttaggtcacaaggtgtatgaagaagagaatagaggcaaagaaaaattggggctatttttcaattttgcyaagagttgattttaccatgtattcttaagatttgtaaaaccatattttgagattttttataatctaggttattaaaaaagtttataaaataaataatttt

SEQ ID NO: 58471 - DNA, 201 bp, Homo sapiens
gtcatgctcattatgtttcaccttttcatgcatttttgcctttatttttaattatgttgatagcagtctttgataattaaagctctcaagtagaataaatwcattttagctcacagaattaaattagaataagcctaatgatatttaacaaatatataaaatgaattcataagctttttggcaaatttaatttctattcta

SEQ ID NO: 58472 - DNA, 201 bp, Homo sapiens
taaagtgctcttctttaagattaattgaaaatggttattttcatcctgtaaagcaaacctatgaagaaggagatgtcgttcagtttttctgtcatgaaaaytattatctaagtggatctgatttaattcaatgctataactttggttggtacccagaatctcctgtatgcgaaggtaaatttttaaatttaatactcgcaa

SEQ ID NO: 58473 - DNA, 201 bp, Homo sapiens
catgtattcttaagatttgtaaaaccatattttgagattttttataatctaggttattaaaaaagtttataaaataaataatttttataattttagaaacrtgtttggctcctgaattatataatggaaattattccacaacacagaaaacattcaaagtgaaggacaaagtacaatacgaatgtgctactggctactaca

SEQ ID NO: 58474 - DNA, 201 bp, Homo sapiens
aatctctattagctctgacaaaattcctgtggtcatatctattttttttcctgagtcctatttttaaaataaatattatcttttaaatcagtgctattttyagcaatctttaatatatcccacctgaataaatcttgttttgtcttagtttgtaaatgactatatcttttaaatttattattttaaaatatctattataca

SEQ ID NO: 58475 - DNA, 201 bp, Homo sapiens
ggggctatttttcaattttgctaagagttgattttaccatgtattcttaagatttgtaaaaccatattttgagattttttataatctaggttattaaaaaagtttataaaataaataatttttataattttagaaacatgtttggctcctgaattatataatggaaattattccacaacacagaaaacattcaaagtgaag

SEQ ID NO: 58476 - DNA, 201 bp, Homo sapiens
gtcacaaggtgtatgaagaagagaatagaggcaaagaaaaattggggctatttttcaattttgctaagagttgattttaccatgtattcttaagatttgtraaaccatattttgagattttttataatctaggttattaaaaaagtttataaaataaataatttttataattttagaaacatgtttggctcctgaattata

SEQ ID NO: 58477 - DNA, 201 bp, Homo sapiens
agccacaggttgaaatgttttgaggaaggggttgtgagccaaggaatacaggtgatttcaagaagctagaaaaggcaaagtagctgattctcctccaaagyctccagcaggaatgtggctctcctgatatctcgattttagtccagtgaaactgactctggacttctggcctctaggactgtaggaggataaatctgtgct

SEQ ID NO: 58478 - DNA, 201 bp, Homo sapiens
ctaaatggtcagttctctttcaactgtaccttttcagaaggacaggagaaggtagcctgtgaggaaccacccttcattgaaaatggtgcagcaaatttacrctctaagatttattacaatggggataaagtgacatatgcatgtaaaagcggctaccttctccatggatcgaatgagataacttgtaatcgtggaaaatgg

SEQ ID NO: 58479 - DNA, 201 bp, Homo sapiens
ttaataaagttattttaggactaaaagaggtaatgaatgtaaaatgcctgctgtgttagtattctattggtgcgtaacaatgtcaccacaaactcagcagsttaaaacaacacaaagaaattatttcccattgggtgtaggttgggggtctgggtgcggcttaaccgactccttgcatcgatggctatcaaagctgcaatc

SEQ ID NO: 58480 - DNA, 201 bp, Homo sapiens
cacatttttccatcccttaactttcaaccttctgggtttttacttttagtgtgcctctcttataagcaatatataccttattttaaaatatacttatgcartttataattttttcccttgtaatggaatagtctatttacatattcatgtaattactaatatatttctgtttatacctaccaaccctaccaactttctata

SEQ ID NO: 58481 - DNA, 201 bp, Homo sapiens
gacttagataataaatggtcttctaaatgttttacacacacaagcacacactccacaaaatgctatgatatgatgcagaggtatatatcttagattttttyactcaaaatatattgtaaacatggtttgtcatacttctacaatatatactttaatggctgcatagtattccataatgcagatatacatatgtaatttaac

SEQ ID NO: 58482 - DNA, 201 bp, Homo sapiens
actcacctatgagtgagaacatgcagtgtttggttttctgtccttgtaatagtttgcttacaatgatggcttccagcttcatccatgtccctgcaaagggyatgaactcatcctttttaatggctgcatagtattccatggtgtgtatgtgccacattttcttaatccagtctatcattgatagacatttgggttggttcc

SEQ ID NO: 58483 - DNA, 201 bp, Homo sapiens
aaattcttgatatttttgttaacagttgattgaattccaaatattatacgtggaaaatttcaggatgtttggatgatgtcagcttactccaaagaagactyatctcatcctctggctgatgattagtgtagaggcagttggttttaatacaattagaaataaagctttctctatgtttgttttcagacctctgtttgcctt

SEQ ID NO: 58484 - DNA, 201 bp, Homo sapiens
ctgccaaatgcccactgtaactttttatttactttctgcttggcttctcatcctatgcctctatacaagtcaaggataagcagtaccttagggaaaagctrgtgcagagcctcaaactcatatctctacacttcctatccttctaaattctttattcttcaagtcctggctgctttggtttaccgaaattctcatttttct

SEQ ID NO: 58485 - DNA, 201 bp, Homo sapiens
acttagataataaatggtcttctaaatgttttacacacacaagcacacactccacaaaatgctatgatatgatgcagaggtatatatcttagattttttcrctcaaaatatattgtaaacatggtttgtcatacttctacaatatatactttaatggctgcatagtattccataatgcagatatacatatgtaatttaacc

SEQ ID NO: 58486 - DNA, 201 bp, Homo sapiens
taccttagggaaaagctggtgcagagcctcaaactcatatctctacacttcctatccttctaaattctttattcttcaagtcctggctgctttggtttacygaaattctcatttttctatcttcaactccatgagattttcagaagttctgctggctgtatgcctaagcttaccattctctatcatctaacctctcaggtc

SEQ ID NO: 58487 - DNA, 201 bp, Homo sapiens
gttattttcatcctgtaaagcaaacctatgaagaaggagatgtcgttcagtttttctgtcatgaaaattattatctaagtggatctgatttaattcaatgytataactttggttggtacccagaatctcctgtatgcgaaggtaaatttttaaatttaatactcgcaaaatgccatgtctttatcagctttaatctctatt

SEQ ID NO: 58488 - DNA, 201 bp, Homo sapiens
aggtttttttacatgaattaattattcatagtttagccattttttcatacttataaatctatatataaattattttatccaattgagaatcatgtttattscaattatttttaatttatttttatttatagtgtttttaagtatatataagtgtatgttttaagtcttgagctctttcaaccttttgttagtagtttccac

SEQ ID NO: 58489 - DNA, 201 bp, Homo sapiens
aaataatttaacaattttcttagagaaatgttaaaaaagtataataaaatgatgtaaaccattttgtaggatcacaattttaaccctttttgaagacactrtatataaaaaatggaaattatattttttgttcaactaagaatattaaaaatataagtagtggcaaagtgcatgtggtcctgttttaaaaaatgcaaacaa

SEQ ID NO: 58490 - DNA, 201 bp, Homo sapiens
ggtttttttacatgaattaattattcatagtttagccattttttcatacttataaatctatatataaattattttatccaattgagaatcatgtttattgsaattatttttaatttatttttatttatagtgtttttaagtatatataagtgtatgttttaagtcttgagctctttcaaccttttgttagtagtttccacc

SEQ ID NO: 58491 - DNA, 201 bp, Homo sapiens
atttgatattttagaaatattaatgtttttattctgtaaaaaaaatcgaagaggtttttttgtgtattttaatacatactttaccattctctttggtttaygatacatgggaaaggacacaactatactttgtatgcttagaatttaaaacgtcttaatccagtcttgatatttcttaactagaaatttgaaagagaagta

SEQ ID NO: 58492 - DNA, 201 bp, Homo sapiens
cagaaggtaaaattaattcttaatattctttattctctaaaacatacaaatggagattctaatatttatacaactcaagttttaatatactcttctatttkcattatcaattttataacatattttataaatataactttttataatatttagaccttttcctttgagcaaaattagtaaagtgttcttacagtagcataa

SEQ ID NO: 58493 - DNA, 201 bp, Homo sapiens
aactggtggtattatttactaagtaagatcatttattcttattagtacttaataaaaacaatgactcattatatgaaaaattgaaaggctgagattgtaaktaacacctgactgcaattgatgcttatttcaaaaatctctctttttcccctcaagcactctgtcttatcaagaacccttaagaacatagaaatgaatggc

SEQ ID NO: 58494 - DNA, 201 bp, Homo sapiens
aatctcacttctactgtgttcccccaaaaagcaccgaatttgtttccaggcagtaggggagcaggattgagaacttgccccaggctactagcctcccagcygagaatgcaagccagacttttgtgcctccctacctgttaagtctgcacaccagattcacgccctttcctgagttctggacaggaaagtttgtgttcggtt

SEQ ID NO: 58495 - DNA, 201 bp, Homo sapiens
cctgggacctactacaatgttttaacatgttactctagctctctcaaccacaaatagctctggaatgaatattgtaatataaccaacttatctttctgtamgaatgtcatcagtctgtattcactcacagatagcattattgagtctattcttgtacttgatttctgtaatgagagattacttttgcagaatggcagtttt

SEQ ID NO: 58496 - DNA, 201 bp, Homo sapiens
cattcaacaacttatcgtcatggagaaatagttcatatagaatgtgaacttaattttgagatccatgggtcagcagaaatacgttgtgaagatggaaaatsgacagaacctccaaaatgcattggttagtaacaccttgaagaagctttgctaaaatgaaatctgcatgtgtagctaaatggtcagttctctttcaactgt

SEQ ID NO: 58497 - DNA, 201 bp, Homo sapiens
tttctttctttttttttaaattgttgttcccagagccatgcacattatcttttactgaaatggaaaagaataatttacttctgaaatgggattttgacaayagaccacacattttgcatggtgaatatattgagtttatttgtagaggagatacttatccagctgaattatatattactggatctatacttagaatgcaat

SEQ ID NO: 58498 - DNA, 201 bp, Homo sapiens
ttagttcaacagtagacacctatgaaaatggctcttcagtagaatacagatgttttgatcaccatttcctagaaggatctagggaggcctattgtttagakggaatgtggactacaccaccattgtgtttaggtatgtactactaaatatgcctctaacaaagtaaaactatatatttttaatttgctgtcatttttgagt

SEQ ID NO: 58499 - DNA, 201 bp, Homo sapiens
aatcattgttatcagggcaagagaaaggggctttgtatatcttggtaactattgaaactggaaaggctatcagtacaaattcacaacagtatgataaagcrtagaattttctctgtaggaattattattccagacattaagagtctctctaacctctccatactctcttccctgctctaatcactccagtctttctggtct

SEQ ID NO: 58500 - DNA, 201 bp, Homo sapiens
aagaatcttcaatctgtgtttaatttttagcaatatctgttgaaataattacatgattattacttttgttttttcccctgcaaatttaatgaattatattscttcttttgaatgttaaagcatgattctattcccataagaaattccacaaggttgtgataaattatgcatattatatgttatatttttatttatcaatat

SEQ ID NO: 58501 - DNA, 201 bp, Homo sapiens
gattgttattcaacatttcagaaatgttatgttctataccactcatactttatggcaattgcaaagaaaaaataataatattttcttcattttttttacascaaacaaacaactggaagtggtaatcaattcaacaggccttctgaattgtctgaagtgaaagcaacgtttgccatttgatatttgtgacactttggcaaa

SEQ ID NO: 58502 - DNA, 201 bp, Homo sapiens
catcattaagttaaataattttttttcccatagaaaaatgcactaagcctgacctgagtaatggttacatctctgatgtaaagttattgtataaaattcargagaacatgcattatggttgcgcttcagggtacaaaaccactggagggaaggatgaagaagtggttcaatgtctctctgatggatggtcttctcaaccaa

SEQ ID NO: 58503 - DNA, 201 bp, Homo sapiens
ttgacatttactcatttcagagaaaccctgtggttttcctcatgtggaaaatggaagaattgcccaatattactatacttttaaaagcttttactttccartgagcatagacaaaaaattgtcatttttctgcttggctggttataccactgaaagtggaagacaagaagagcaaaccacgtgtacaacagaaggctggtc

SEQ ID NO: 58504 - DNA, 201 bp, Homo sapiens
tttgatgttttaaattaagtggttttagtttatgacaataatgtatagattcatttgatagtaataaagtatatattttcttatatatatatgtgtgtgagagaagccttaattatgatttcaattataaaatattgcttttgaaacttgtcataatttttgttttaaaaaatatcacttttatatttgtcagacaagtaa

SEQ ID NO: 58505 - DNA, 201 bp, Homo sapiens
aaaatttaagtaagaaaaataagtactagttgaagtgtctctaaaaacttttagtttgtattgtcacctgattacaaatttatgtttttagatttgttttyccattttcagcttgacatttactcatttcagagaaaccctgtggttttcctcatgtggaaaatggaagaattgcccaatattactatacttttaaaagct

SEQ ID NO: 58506 - DNA, 201 bp, Homo sapiens
ttttgatgttttaaattaagtggttttagtttatgacaataatgtatagattcatttgatagtaataaagtatatattttcttatatatatatgtgtgtgagagaagccttaattatgatttcaattataaaatattgcttttgaaacttgtcataatttttgttttaaaaaatatcacttttatatttgtcagacaagta

SEQ ID NO: 58507 - DNA, 201 bp, Homo sapiens
tttttgatgttttaaattaagtggttttagtttatgacaataatgtatagattcatttgatagtaataaagtatatattttcttatatatatatgtgtgtgagagaagccttaattatgatttcaattataaaatattgcttttgaaacttgtcataatttttgttttaaaaaatatcacttttatatttgtcagacaagt

SEQ ID NO: 58508 - DNA, 201 bp, Homo sapiens
atttttgatgttttaaattaagtggttttagtttatgacaataatgtatagattcatttgatagtaataaagtatatattttcttatatatatatgtgtgtgagagaagccttaattatgatttcaattataaaatattgcttttgaaacttgtcataatttttgttttaaaaaatatcacttttatatttgtcagacaag

SEQ ID NO: 58509 - DNA, 201 bp, Homo sapiens
ttatagtcagattgcccaatgtgtaagattagtgtgcgagtggaagctaggcagtgtacatgggtatgttgttcaggaacattatcaatattatcaggccrtaggatgaagaatccagggaggacacttagcattagcaagagtgaacatacaaagaaggaagctacagcaatacagcttttctaaaataaacatttttgg

SEQ ID NO: 58510 - DNA, 201 bp, Homo sapiens
gttgaagggaatagggtaataactgaaattatcatattgcaaggcaaagagaggtaatttactttaagtaacaagaaacttattttgataattaagcatargatgccagaaaaatgcttgaaactctggcctctggaagggcaagattgctactctaatgctttatcatttgtaagactcatctctcttcatgtgccaact

SEQ ID NO: 58511 - DNA, 201 bp, Homo sapiens
taaataattttttttcccatagaaaaatgcactaagcctgacctgagtaatggttacatctctgatgtaaagttattgtataaaattcaagagaacatgcrttatggttgcgcttcagggtacaaaaccactggagggaaggatgaagaagtggttcaatgtctctctgatggatggtcttctcaaccaacctgtaggaaa

SEQ ID NO: 58512 - DNA, 201 bp, Homo sapiens
tgtaggaaagaacatggtataagaatcatttcctaaaactgaagataagtgcttatcaagcttatattgaatatattgaagcttatattgatatctattawttaatagaatttatttttcattatgtctacaatgcaggaagttgatattacattgcttttctcaagtactaggtgattccttaatccaaatgttctcaat

SEQ ID NO: 58513 - DNA, 201 bp, Homo sapiens
caatatttaagttgggtcttaagagataagtagcagtttgagaattgggaggatagggtgaggcaaagggtttgatagtcattttttattttctgtaataygggatataaggtctattgacaggcaggtgaaagacatgaaggtagaacttggaggaaagtggtgaagatttgaaacaggtgctaggggaaacaaatgagg

SEQ ID NO: 58514 - DNA, 201 bp, Homo sapiens
ataattcagcccacaacaatataattcagttgtgggctgaattatatctctcttactcctcccaaaatatagccacattctaatactgagaaccattaaaygttaccttacacggtacaagacactttgaggttaacaatcttaaggtaggaatattatctggaactatctatccagactctaaatataatcacaaatgct

SEQ ID NO: 58515 - DNA, 201 bp, Homo sapiens
gtggctgttaactgaaggcagccctctgccccttgccttgcagccgttctgctttggaagctcatgatgtagcctcttgtttcttcaaaaccagcaaggakagagagtctcttggcaagaatggcgttaaaaactgatgttacataattatgtgtgcataatcacgtactaatccatcacctttgctgtattttgtgggct

SEQ ID NO: 58516 - DNA, 201 bp, Homo sapiens
ttttaaatctagggaagttgtttccagtctctaatgggcatcaaaatcacctggatcattaacagatgagcagatagcaaattgtggtatggtctcacttrcaatggaatatcatccagccataagaaggaatgaggttccgatgcatgctaccatgtggctgaacctcgagaacactattctaagggaaaggagccaaac

SEQ ID NO: 58517 - DNA, 201 bp, Homo sapiens
tggtttctccagacgcctaatttccagcaagaaaagcagttgtctccgaatcatacccagagagcttttgcaagtcagataactcccgacttctactgtcraggttgataaattggcctagtgtgattcacccccaagaatatagcagtgagacgcacaataggctcctacaagaaaagaaccttctgactgcagattttt

SEQ ID NO: 58518 - DNA, 201 bp, Homo sapiens
aatttgtggccacgtctcactctgagctcagtgcctggacttggctgtggccaggaaatggacggaagatgtggggtgagctcatgtgacatgagctttakgaaaagggccagaaaaaagctttcaggaacagaagacaaccacagctgcgtagcaggtaacagccatctaaatggcgtttttgttttgtttgtggattgc

SEQ ID NO: 58519 - DNA, 201 bp, Homo sapiens
ggctcactgctccctggcctggccatggctcaggggctcattaaacaagtactcgtgtgtctgccacacaccagccactctcctgggtcctggagagacaytaagcaagaatgacatggcgtaagtgaggggtacgactgcagggagagagggcatcatgggaggggagcaacccccacagagcggcagggggttgtcagg

SEQ ID NO: 58520 - DNA, 201 bp, Homo sapiens
tgtggacatgcgtgaccagcagtactcaggtttgagggtttgcagaaagccagggaacccacagagtcaccaacccttcatttaacaagtaagaatgttamaaagtgaaaacaatgtaagagcctaactccatcccccgtggccattactgcataaaatagagtgcatttgaaataccgctgcctccaccctgttcataca

SEQ ID NO: 58521 - DNA, 201 bp, Homo sapiens; identical to SEQ ID NO: 17045

SEQ ID NO: 58522 - DNA, 201 bp, Homo sapiens
ctccggtgcataaatattttgtttcatgtctaactccaaaaggcgcaagtgcaagaaaacatccccattctacagacacccaatgatggtaccacatacgsacatgcttaggtaaaaagatgtatttcaaagtgggatcagtgaatcttcaactaaataaataaatgtacagccccccaagatgcagaatttcccatccct

SEQ ID NO: 58523 - DNA, 201 bp, Homo sapiens
agtcattagattgtcttctccagagaatggatcccacaatttgtggccacgtctcactctgagctcagtgcctggacttggctgtggccaggaaatggacrgaagatgtggggtgagctcatgtgacatgagctttaggaaaagggccagaaaaaagctttcaggaacagaagacaaccacagctgcgtagcaggtaacag

SEQ ID NO: 58524 - DNA, 201 bp, Homo sapiens
ggtcccctgccccctcatactgtaagaggacctcgctctcacttgggaagagaagagggaattcatgttgggcttatgcttctcaagggactaggaatatrtagaactggctgtgaactaagaatggctaagttgtttttggaaaagctcagcaagctagttatggaatgaatgataaaagttgtggccggcatggtggct

SEQ ID NO: 58525 - DNA, 201 bp, Homo sapiens
ttgttgggcataactggggaaagacctgaagattttcctgaagatggccctagaatttttggtcagcagcttgtccaagcaatgtccattccccacactgyggtcccctgccccctcatactgtaagaggacctcgctctcacttgggaagagaagagggaattcatgttgggcttatgcttctcaagggactaggaatat

SEQ ID NO: 58526 - DNA, 201 bp, Homo sapiens
tctgccaggcttctggtccccagcagggtttcactaaacaaatggtagctcctggccagccccgctccaggcaggatggagtaaaaagcccctaaaatgakatgacctccttgcatccacagcaggcctgccacggcactgaacatgaggccggtcacctgcgagtacaaatgccaccgccctggcctaccaggcgtgcta

SEQ ID NO: 58527 - DNA, 201 bp, Homo sapiens
ctcccagaggtgtcagtgagagaatgtctgccaggcttctggtccccagcagggtttcactaaacaaatggtagctcctggccagccccgctccaggcagsatggagtaaaaagcccctaaaatgatatgacctccttgcatccacagcaggcctgccacggcactgaacatgaggccggtcacctgcgagtacaaatgcc

SEQ ID NO: 58528 - DNA, 201 bp, Homo sapiens
tcatctctaaaataggagtcataattggctcccagaggtgtcagtgagagaatgtctgccaggcttctggtccccagcagggtttcactaaacaaatggtrgctcctggccagccccgctccaggcaggatggagtaaaaagcccctaaaatgatatgacctccttgcatccacagcaggcctgccacggcactgaacatg

SEQ ID NO: 58529 - DNA, 201 bp, Homo sapiens
ccctgccctggggcagctcctgatagccctcgaggcggtgtggttgagtgggaagaacacaggccttctagtcagatctgtgctttcagtctccacgcagraactgcagggtcccggcaaggaacccaagctgcctgcactcagcttcctcatctctaaaataggagtcataattggctcccagaggtgtcagtgagagaa

SEQ ID NO: 58530 - DNA, 201 bp, Homo sapiens
acccatggatactactgctgctggcatagccatttgtgctgggtcatgcctgaggctgcccagaggccctgccctggggcagctcctgatagccctcgagrcggtgtggttgagtgggaagaacacaggccttctagtcagatctgtgctttcagtctccacgcagaaactgcagggtcccggcaaggaacccaagctgcc

SEQ ID NO: 58531 - DNA, 201 bp, Homo sapiens
gtgtggtgcattttatgcccacgatgtcatcccctccttatacaactctgaagaaggtggtatgattcttttctcacatacctaggacctgaggctcaggraagttaagtaatttgcctaatgtgatctcgctaagatttacacacacacaggtctgcctgtcccccaagaagctcttagtagcagctgtgcttgaactcg

SEQ ID NO: 58532 - DNA, 201 bp, Homo sapiens
tgctgtcacatttccaatactgccattgtccatccaccccccttagttctctccaggggactttgactcccggccccttttaaattaggcacacatcttakaaaacctccatccagcgccttctcagtttcatccatgctccctggcaagtcatggtgctggagaaagatgtgggacgtgtatcacccaggaaggagcaga

SEQ ID NO: 58533 - DNA, 201 bp, Homo sapiens
cttagtaaaggtgacagtcacggcagcagtgggagtcattgcaacagcttttgcatatggaatgatgtgtgcaggtgctgtgtggtgcattttatgcccaygatgtcatcccctccttatacaactctgaagaaggtggtatgattcttttctcacatacctaggacctgaggctcagggaagttaagtaatttgcctaat

SEQ ID NO: 58534 - DNA, 201 bp, Homo sapiens
atcactctctttacagccactaataggcagatgatgcatcttcacagcctcaggtttggtcgcccctgtgtggtgtgtagtgccggctttgggcttattcrcaccatggcgtgtgctgagtctggctgtgtcagtgttgggggggggctctgaccatggccccccttgcttctgctgtggtgatgcacagagcatatgccc

SEQ ID NO: 58535 - DNA, 201 bp, Homo sapiens
taatatgggttcggcatgtttatcatctatagcatatattaacttcccatatagtgtccctgtgaggcaggcactatcattctcattttatatgaggaaaytccagcatgaggtcggatttcatattcaaagtcataaaagaagaaaatggcagaatgagatttgttcttccactgttgctatactactgctagagatata

SEQ ID NO: 58536 - DNA, 201 bp, Homo sapiens
atctggaaaaagttaagcagcgattaatagagattgctaatcacgttgacaaggtaagttctttttcagtagttaaatcattcagatcatgtaaatgtttsgaaatgaggttgggggacctcatctgacttagcaaggagatgaggttctgcctctgggccttggtttggaactgtttcctgtcctctgagtgtgtaattc

SEQ ID NO: 58537 - DNA, 201 bp, Homo sapiens
cctggcctggtggttttcttagctttctgtggtccgtctggttggcccactggctcagcgtccagttataaggcagtcactttctgtttctggagtggacrtgaggatggattgccccattagcttcagcctcagttctgttctatcgtttgagcctgtgtggtcagagctgtgtccctgtgcaccgctgggcaggcagag

SEQ ID NO: 58538 - DNA, 201 bp, Homo sapiens
gttctatcgtttgagcctgtgtggtcagagctgtgtccctgtgcaccgctgggcaggcagagtgggctgactcaggcccagttccctctcccatcacaccrtgaggaggagtcacgaggcttttgaggcggggcgcctatttcccctgcctgcagctcattagggtctcaacaggcttgcagccctcctcaggtgtgcacg

SEQ ID NO: 58539 - DNA, 201 bp, Homo sapiens
tctcccgtgctgtgtgcattaccccgtgctctgcacattgtcctgtgttgtgtgtatccctctgtgctctgcatccttctgcctgttcctctgcagcttcrcccatgtcccctctcaaccccatccctccagttattcccctcaagtccccatctctggttttcacatcccgcctctctgcttccctttggaactgtgctg

SEQ ID NO: 58540 - DNA, 201 bp, Homo sapiens
gaagagaatcacttacttcttcccagggccagggagtctttgcagggagaggatcctcaaaggtaagttcagtttcaccgtgagcatagcagaagaaggartatgtgtgatgtggacatgtatgtgcttcatgtacatgtacatgcatgtgtgttcctatatgtgttcatgtgtgtgttcatacgtgtgtgtgccctgcat

SEQ ID NO: 58541 - DNA, 201 bp, Homo sapiens
tagcttcagcctcagttctgttctatcgtttgagcctgtgtggtcagagctgtgtccctgtgcaccgctgggcaggcagagtgggctgactcaggcccagytccctctcccatcacaccgtgaggaggagtcacgaggcttttgaggcggggcgcctatttcccctgcctgcagctcattagggtctcaacaggcttgcag

SEQ ID NO: 58542 - DNA, 201 bp, Homo sapiens
ccgtctggttggcccactggctcagcgtccagttataaggcagtcactttctgtttctggagtggacgtgaggatggattgccccattagcttcagcctcrgttctgttctatcgtttgagcctgtgtggtcagagctgtgtccctgtgcaccgctgggcaggcagagtgggctgactcaggcccagttccctctcccatc

SEQ ID NO: 58543 - DNA, 201 bp, Homo sapiens
actgtcacttggttggagaagttgactggtcagtgggtaggtgacatagatgaatatagatggggtgacctttcctgtctcttgtgacacagcgcatcccygagttccttgtccccagccccaggagcattctttctttggcgtttagtgctacttaagtgctaattctgtgcaataatgaaagcatcagagacaagaggg

SEQ ID NO: 58544 - DNA, 201 bp, Homo sapiens
cttttagaagactaggaagaaccatgattattaggtagctgtcccaactcttctgggtttctgtctccagaatgagagccctgtgggtgacaggcatacayctactgcactaaagaattccaggttagtgacgttatgtaggggcatgatgacttaggtaagttgggaacagcattttgttgtaatgccagtgggctcatc

SEQ ID NO: 58545 - DNA, 201 bp, Homo sapiens
cactgaggctcaggaaggccagagggcccacaggtggtcagggtcattctggatctcagcctgcagcctcaggctcctgatccattctttggcctttcacygggtacctgtgagcctttggctcgcaggcttggggatggggagggttgagagggacagctctttcccattcttgagttccacattgccctggtggtaact

SEQ ID NO: 58546 - DNA, 201 bp, Homo sapiens
tgaggccactgtcttttgtactaaatctagcaattgcagcagcagcattttcattttttgtttattccacatcattctacaatggatttacaatagtttgyaatgatacacacaatacaataaatagaagaaaataaaaacaaaatagagcagagaaaacccagataaataggaggcagagtccactgcttttctgtacat

SEQ ID NO: 58547 - DNA, 201 bp, Homo sapiens
caatggacagatggatagacgttggctgggtgggcggatggagagagggatgatgagtacagcacaattagataagtgcagagtgaggttttctcttcctyatctgtgtaatggcaaaatctctggggagaacgctctgaggccactgtcttttgtactaaatctagcaattgcagcagcagcattttcattttttgttta

SEQ ID NO: 58548 - DNA, 201 bp, Homo sapiens
gaaatggataatggatagatagaaatggacagataatggatagatagatggtacaatggacagatggatagacgttggctgggtgggcggatggagagagsgatgatgagtacagcacaattagataagtgcagagtgaggttttctcttcctcatctgtgtaatggcaaaatctctggggagaacgctctgaggccactg

SEQ ID NO: 58549 - DNA, 201 bp, Homo sapiens
gaggaaggaaggatagataaataataggtagatgggtcagtggatgaatggataatgggtgggtggaatgatggatggatggacggacggacagacagacraaggatggatggaaagaaggaaagatgggtagatggataaatcaatgataggtaggtggataggtggatgaatggataatgggtaggtggaaatggataa

SEQ ID NO: 58550 - DNA, 201 bp, Homo sapiens
gatgcatggatgggaggaaggaaggatagataaataataggtagatgggtcagtggatgaatggataatgggtgggtggaatgatggatggatggacggayggacagacagacgaaggatggatggaaagaaggaaagatgggtagatggataaatcaatgataggtaggtggataggtggatgaatggataatgggtagg

SEQ ID NO: 58551 - DNA, 201 bp, Homo sapiens
tgaaaacatttcaactgaaatcctgccaatcctgcaatccccctcccacacacttacccccatggcttcctcctctccccaggcacagaggccacagtgtrgggtaaagggttatttctagacttctctacaacagacaatatccaaaaggactcattttcagctccacaaggtcaggaatttgtgttttgtttattgctg

SEQ ID NO: 58552 - DNA, 201 bp, Homo sapiens
ttggcctattttagacatctggtgtcagtgcagttatatagtacatgtcctcttgtgtcagctcctttcacttagcatgaggttttcaggttcatccatgtgtttgtagcatgtaccagaacttccttgctttttatggctggaacacattccattaagacattatggacatgccccattcatctgttactgaatgacatt

SEQ ID NO: 58553 - DNA, 201 bp, Homo sapiens
tgcccatcatggggcaagatgctggccttcctttagaaaggggccaaatttcaattcccaccagaaaatcaagaatacataatcagatagttctgaatcamgtgaatggttctctttcaacctcacaagattttgagagtctaatattaggatttgtgatcaaaaagttgcaaacgtgcactatgtcataattccttagat

SEQ ID NO: 58554 - DNA, 201 bp, Homo sapiens
agttgcaaacgtgcactatgtcataattccttagatccgacaataaaggattctgttgtaattctccatcttaagatgatttttttttctcttggaggaartaacgacctaaataaatgtcacgtgcttgaatttctgaaaggaaaatgttaccccatacccatttattttagaaaggtcggatttgttcccctgtcaaca

SEQ ID NO: 58555 - DNA, 201 bp, Homo sapiens
gtttctgtttcctgtgacttcttagctggcagagaactatggatttattttatgagctgttgcctggaagaagtaatgacatcaatatttaagcataataytgtacgtgttcttggtctgggtattacattccatgttcttgtgttaatttctagaatggtctatatgttttttgacatacaacttttaaaaataaatttt

SEQ ID NO: 58556 - DNA, 201 bp, Homo sapiens
ctcctgccccagcctgtcactagctaggataacaggtgtgcatcaccacgcccggctaatttttgtatttttagtagagatggggtttgcccatgttggcmaggctggtcttgaactcctcacctcaggtgatccacctgccttggcctcacaatgtggtgagattacaggcgtgagccaccctgcccggccaggatttaa

SEQ ID NO: 58557 - DNA, 201 bp, Homo sapiens
tctcctttggcaacaccctcacagacacacccaggaataatactttgcatccttcaatccaatcaagttgacactcaatatttactatcacagtacttttyccccttttttctcacttgggaggaaaaatgcaataagcaagaagacgaagaaatagaggactagagaaacaggggttcaacaactgccaggtctgtttgg

SEQ ID NO: 58558 - DNA, 201 bp, Homo sapiens
tagaatctaatattttggccaaaagtgttgtttgggtgacatcccattcatttccatggcaactactgattgtcagaaagggatagtatcttctacaaccrgcttggactaaacacgtcagggcggatgactatcaggagttaaccacagttcattacagttagaaagcatctaatcgagatgaaaagataattctggaag

SEQ ID NO: 58559 - DNA, 201 bp, Homo sapiens
gtataggagtggtgtgcctgtccatgagcttgggaatttctgtactccgcctgctgtgtattttcagcctcttcattactttcctcgggaggcccggctayagccagcttatgctatctttactgtaaaataggtgcctgtttattttcccatcatacacacgcaaagataacaatgatatattgccggttccttaatctc

SEQ ID NO: 58560 - DNA, 201 bp, Homo sapiens
tttctctctctgactctgaccctcctgcttgtctcttataaggacctttgtggttacgttgggcccacccagatcatccccttcatctccagctccttcaygtaatcacatcagcaaagtccttttggtaaatgaagtaacagattcacaggttccaggaattagaatgtgtacatctttggggaggccagtattcagccc

SEQ ID NO: 58561 - DNA, 201 bp, Homo sapiens
aagaggaggcttgaacatatcagaagcttcagctacatgggtgggaggcctggcccatgtctactgcagagcatggtttgggggcagaaggatgaatttaragtccaccccttcctcctgataatcagaacttaaaagctccaggaggaaggacaaaaatgtgcaacaaagtgtttcatttagtaggaaattgtcttatat

SEQ ID NO: 58562 - DNA, 201 bp, Homo sapiens
cctccttcaatttatgttccagcagcagagaatgctttcctgtcactggctcgttaacccagcattttatttgttgtacagcatgtgtgaaaacatttcarctgaaatcctgccaatcctgcaatccccctcccacacacttacccccatggcttcctcctctccccaggcacagaggccacagtgtggggtaaagggtta

SEQ ID NO: 58563 - DNA, 201 bp, Homo sapiens
agagccatgtccctgtgcaacctctgggaggtgggaggtagccccatttttaagccatttaattctgcaaacctccttcaatttatgttccagcagcagaraatgctttcctgtcactggctcgttaacccagcattttatttgttgtacagcatgtgtgaaaacatttcaactgaaatcctgccaatcctgcaatccccc

SEQ ID NO: 58564 - DNA, 201 bp, Homo sapiens
ccatcgaaagatcatttcttttttgataaagcacttcttcatcagccgcgttggcactgtacggaatggatgtcgggatggaactgaatgtgcctcacttracactgcatatctgagttttttgatatgcattgttcattgagaccaccagtgaacacctgggcagatgtggccagtgggtgccttcttgtgggcacaaga

SEQ ID NO: 58565 - DNA, 201 bp, Homo sapiens
ctcagtacagagccatgtccctgtgcaacctctgggaggtgggaggtagccccatttttaagccatttaattctgcaaacctccttcaatttatgttccarcagcagagaatgctttcctgtcactggctcgttaacccagcattttatttgttgtacagcatgtgtgaaaacatttcaactgaaatcctgccaatcctgc

SEQ ID NO: 58566 - DNA, 201 bp, Homo sapiens
aaagtcaagcggctttttcccagtgtgtttgacacatggaagtggccgtgaacacatctgggctttatgagagaactaaagctgcctcagtacagagccaygtccctgtgcaacctctgggaggtgggaggtagccccatttttaagccatttaattctgcaaacctccttcaatttatgttccagcagcagagaatgctt

SEQ ID NO: 58567 - DNA, 201 bp, Homo sapiens
actttagtgtttccatatgaacttcagaatcttcttgctaagttctgcaaaatactgtatggggacttgtaggctaatttaggggagaattgacatcctcrtgacatcaaggcttcccatcatgaatgtggtgatttctctatttatttgttccctttaatgctattcaataagttttcaataatattctcttcaatgttc

SEQ ID NO: 58568 - DNA, 201 bp, Homo sapiens
ctccccgttaagctgtacacaaaatagaggtcaagctcgggaggctgattctgtgtggccactgatccttgaatatccagtttaggggatattgaccctgraggactgcattcatggtgtcctgtttcatcgatgaactttttaaatttaatttaatttttttgagctgagcctcgctctgtcacctaggctggaatacag

SEQ ID NO: 58569 - DNA, 201 bp, Homo sapiens
ggatgaaaagccaaagcccaaactgggagaagatatttgtcacacattaaacagagaaaagcatagcttccagaatgtagaaataactacaaattcacaakgacaagagaaagggaggaggaagaaagcaggaaaggaaatggtcagaaaacatgagcaagtatttcacaggagaagaaaatcaaatgttccataaacata

SEQ ID NO: 58570 - DNA, 201 bp, Homo sapiens
gccagagtaatggagccagctgtaccccgacattatcacagggaaaaatgaactggcaggagggattcttgaaaacagttcaagaagggcgcatcaatatrcagcctgttcttgtttcttctccatgtaattagatattgctcactggaaaatgaaagaatttgtgtgcaattccattagaatatgaaaagctgctgccca

SEQ ID NO: 58571 - DNA, 201 bp, Homo sapiens
tttctgaacaggtgaagaaacccctgcaaaacagaggggcctccccagcgatggcgactgttgcacagttcagaggaggcctgggagcatgtgagcagagyggtcagtggcctttgtcctcactacggtggtggctccatggatgctctggatcctagggaaggaaggaaggaagaacagcagttcaggagggccaaggaa

SEQ ID NO: 58572 - DNA, 201 bp, Homo sapiens
ttcttaccctcagccctattgactcttgcagaggaggggataattctttgttgctgggggctgcactgggcattgtaggatgtttggcagcatccctgtcstctgcccacagtctgctcccctgattgtgacaaccaaaagtatctgcagatattgccagtgtcccctggggtggggcacaaaatcaccctacgctccatt

SEQ ID NO: 58573 - DNA, 201 bp, Homo sapiens
tgctggtgagctcaggccatgtggaaaggagccctgagaaaggatctgttcagtgttggtgaattcatcaagacctcatttcgcatctgaggaggacatcrctactttccttttaaaacagaggcatccctgaagaattaatgctaggatgctgttcctcagagcaaggttgaaaacccgtgaattggatgacgaccattt

SEQ ID NO: 58574 - DNA, 201 bp, Homo sapiens
gataatcagaacttaaaagctccaggaggaaggacaaaaatgtgcaacaaagtgtttcatttagtaggaaattgtcttatatttccagagtgtaaaaataycctactagaaacatgatttctaattatctgatttcattctggtatgaaatagacttatgagtaggatgttttctatttaagtatttcaaaaaacatatgt

SEQ ID NO: 58575 - DNA, 201 bp, Homo sapiens
tacagtgagccaaggtcgcaccactgcacttcagcctgggcgacagagactctgtctcaaaataaataaataaataaataaataaataaataaataaatacatacatacatacatacatacatacatacatacatacctgtgaggctcctaaaacaatacctagctcatggtatgcattcgataattgtcaagagtactga

SEQ ID NO: 58576 - DNA, 201 bp, Homo sapiens
cagtgagccaaggtcgcaccactgcacttcagcctgggcgacagagactctgtctcaaaataaataaataaataaataaataaataaataaataaatacatacatacatacatacatacatacatacatacatacctgtgaggctcctaaaacaatacctagctcatggtatgcattcgataattgtcaagagtactgaaa

SEQ ID NO: 58577 - DNA, 201 bp, Homo sapiens
atcctctggtgcctggccttcactgctctttttaagctgctaagaaaccttcatttatacactgcattgtgatggcatttggctctttcttaggttgaccrcatcgtttattccctcatttgactacgcctgtgggtcttattcagctatttgcaaatcaaagccaagcgtttttcaactgacttttgttgtttatctttc

SEQ ID NO: 58578 - DNA, 201 bp, Homo sapiens
gtgagccaaggtcgcaccactgcacttcagcctgggcgacagagactctgtctcaaaataaataaataaataaataaataaataaataaataaatacatacatacatacatacatacatacatacatacatacctgtgaggctcctaaaacaatacctagctcatggtatgcattcgataattgtcaagagtactgaaatg

SEQ ID NO: 58579 - DNA, 201 bp, Homo sapiens
tgagccaaggtcgcaccactgcacttcagcctgggcgacagagactctgtctcaaaataaataaataaataaataaataaataaataaataaatacatacatacatacatacatacatacatacatacatacctgtgaggctcctaaaacaatacctagctcatggtatgcattcgataattgtcaagagtactgaaatgt

SEQ ID NO: 58580 - DNA, 201 bp, Homo sapiens
gccaaggtcgcaccactgcacttcagcctgggcgacagagactctgtctcaaaataaataaataaataaataaataaataaataaataaatacatacatacatacatacatacatacatacatacatacctgtgaggctcctaaaacaatacctagctcatggtatgcattcgataattgtcaagagtactgaaatgtgtt

SEQ ID NO: 58581 - DNA, 201 bp, Homo sapiens
agtcatgacagggactgtatggctaacaaagcttaatgtatttattatctgttccattacagaaaatgtgcatcaaccctgctctagagcactgaatgggrtggaggaagaggaggcaggtggaggagcctgggatgctcaggaaccttggctttgtacccaactttggctttatatatgaagggcagaagaattatttga

SEQ ID NO: 58582 - DNA, 201 bp, Homo sapiens
caaggtcgcaccactgcacttcagcctgggcgacagagactctgtctcaaaataaataaataaataaataaataaataaataaataaatacatacatacatacatacatacatacatacatacatacctgtgaggctcctaaaacaatacctagctcatggtatgcattcgataattgtcaagagtactgaaatgtgtttg

SEQ ID NO: 58583 - DNA, 201 bp, Homo sapiens
aaggtcgcaccactgcacttcagcctgggcgacagagactctgtctcaaaataaataaataaataaataaataaataaataaataaatacatacatacatacatacatacatacatacatacatacctgtgaggctcctaaaacaatacctagctcatggtatgcattcgataattgtcaagagtactgaaatgtgtttgc

SEQ ID NO: 58584 - DNA, 201 bp, Homo sapiens
aggtcgcaccactgcacttcagcctgggcgacagagactctgtctcaaaataaataaataaataaataaataaataaataaataaatacatacatacatacatacatacatacatacatacatacctgtgaggctcctaaaacaatacctagctcatggtatgcattcgataattgtcaagagtactgaaatgtgtttgct

SEQ ID NO: 58585 - DNA, 201 bp, Homo sapiens
ggtcgcaccactgcacttcagcctgggcgacagagactctgtctcaaaataaataaataaataaataaataaataaataaataaatacatacatacatachtacatacatacatacatacatacctgtgaggctcctaaaacaatacctagctcatggtatgcattcgataattgtcaagagtactgaaatgtgtttgctt

SEQ ID NO: 58586 - DNA, 201 bp, Homo sapiens
agagagaaaaaaggaggaacagctacagaatgaggaactctggtaagatgaaaacactactagttagaatcaatttaattactcagccagagtaatggagycagctgtaccccgacattatcacagggaaaaatgaactggcaggagggattcttgaaaacagttcaagaagggcgcatcaatatacagcctgttcttgtt

SEQ ID NO: 58587 - DNA, 201 bp, Homo sapiens
aaaaagcgaccaataatttattgcaaacagggagcaaaggttagaagaggcagcaggcagaaaagatatcctggaatagagtccagtctaaaccgatctcrgaagaattaaatacaggctgggcagaccgctccctgaaaattcctacctcatactgtgggaaaactggatttctcttggaagagatttctgcctgaaaag

SEQ ID NO: 58588 - DNA, 201 bp, Homo sapiens
tgtcacctttatatcagcatcatctcaatcaaaggtaaaatgatacttctatggcccatgaaggaatgagcttttcctatgatgcaggatgactttttgcytcattcaatggaagagttttgtggggcaattgtaggaagcagaatggagaccctgccttgaagatgtcatgtaaaaacataaagaatcacacatgtatac

SEQ ID NO: 58589 - DNA, 201 bp, Homo sapiens
ccaggcagagcaaagccactcatttactccactagtacttactgtgtaccctctagaggccagatcctggggagcagtttcggagcaggcacagaaacacraggcaggatccttgacttcagggacctcactgcagggtacctcatcaaatctgcttacacagtccgggtatcaagcaccatctagaagtgatttcagtgt

SEQ ID NO: 58590 - DNA, 201 bp, Homo sapiens
cctgcccctgactcaggacaagcttgctacaggaaatgaggtcaacagacgagcagctggccaccaggcagagcaaagccactcatttactccactagtayttactgtgtaccctctagaggccagatcctggggagcagtttcggagcaggcacagaaacacgaggcaggatccttgacttcagggacctcactgcaggg

SEQ ID NO: 58591 - DNA, 201 bp, Homo sapiens
accatgcacagcctcggccttctctaatgacatcagagaagacagcagccctgcccctgactcaggacaagcttgctacaggaaatgaggtcaacagacgmgcagctggccaccaggcagagcaaagccactcatttactccactagtacttactgtgtaccctctagaggccagatcctggggagcagtttcggagcagg

SEQ ID NO: 58592 - DNA, 201 bp, Homo sapiens
cagacagtgagtttggcaggagactgatgtgcaactgagtggccttcgtgttttctcactctcaatgaactcatagccatagaaaatgcactgtgtgtctratttccctgatcatcagatgggcacaaatacattagcctatgggcctccagaaatggtttcccatgactaagaagatcatattgttaatattgttaatgt

SEQ ID NO: 58593 - DNA, 201 bp, Homo sapiens
gatgctgaaatcaggagtttgggcctgtctgggttttgctgggtctatactggcaaatggcttcaactgacgagtgtgtccccagctgccaactgggagtkggggcgggcagcgtgttcgtgttgtgcactgaggataatgtgggatgagaaaataagcaaatgagggttaccccctgctctcctggggtgcaaatcattc

SEQ ID NO: 58594 - DNA, 201 bp, Homo sapiens
gggcctccagaaatggtttcccatgactaagaagatcatattgttaatattgttaatgttttttaattattgataaaccaatggaagagaggaaaacctakatcaagaacactggacttgaagagatctggttgtcccaattctcacaccattttttaaaataatataggcagtttagtaaccccctggctcttacattcc

SEQ ID NO: 58595 - DNA, 201 bp, Homo sapiens
aaaggccgaaatttctaccactgtaaatataagtatagtgggataggtggatagagagggagggagggagagagggagggagagagggagggagggaaggwgggagaaggttttatatacacttaccactttctgttcaattgaccatagctaaaatatctaacttttcaaacaatatatctgtatacatacatggccaag

SEQ ID NO: 58596 - DNA, 201 bp, Homo sapiens
tggtgtttttaattttctcagatggaaagcaacttcctaagcaagtaggtgaattaatcacaaaagcccacagtgagggggaggtcgagcggctcagtcarccctcagtcatccatcacccgtggtggagttttcccggctgctccggtattatctcaaaatggtggttctcttacctcatagtgtctccgagagagtggg

SEQ ID NO: 58597 - DNA, 201 bp, Homo sapiens
cgacctgcctgtaggtgtagtcaggtatgggccataggctgaagtcaggaacacccaaagatggtgggggcaggcaggggagtgagaagtcttgctttcaktggtgtgccggatgctttgtttcacaggcgcataaaagaggaacttcatttaacagacctttccatgacactgttggtgagctaacttctggctgtgggg

SEQ ID NO: 58598 - DNA, 201 bp, Homo sapiens
gaggattgcttgaggccaggagttcaagaccagcatgggcaacatagcaagaccctgtctctatttttaaaataaaaaaataaaagtaataaattgcaggwtggaaggagtgctgtgaaggaagcaaaggaagaggacaaagagaggaaacatggggtgagggagcccactttaagtgggggtttgggggaggccaaaagg

SEQ ID NO: 58599 - DNA, 201 bp, Homo sapiens
tcctatgagacaaagccatcccttagtccctggaggagttgcttttccctgccctgacccagaacgacctgcctgtaggtgtagtcaggtatgggccatakgctgaagtcaggaacacccaaagatggtgggggcaggcaggggagtgagaagtcttgctttcagtggtgtgccggatgctttgtttcacaggcgcataaa

SEQ ID NO: 58600 - DNA, 201 bp, Homo sapiens
gctgccaggagccttggggctgtggggggctggagggaagtgatgctgggtagaaatggaggaaccagagccagcaaagcccagttggccagagcaggaaygtggattcttatctgcagagcagcgggacatcattgaagcttctcaggcaagataggaatatgatctgatttatcttttaaggtttcctcatttttaaga

SEQ ID NO: 58601 - DNA, 201 bp, Homo sapiens
ttcttatctgcagagcagcgggacatcattgaagcttctcaggcaagataggaatatgatctgatttatcttttaaggtttcctcatttttaagaagaccrtgcagcctctgagatattgtagtttgccaagttaaggggttttctgtctgtacaaaaaagaagagggaggcttcctttagaagaacaagtaataatagtg

SEQ ID NO: 58602 - DNA, 201 bp, Homo sapiens
cgcctttttaaatttttgccagatattcatgagactatggaatgagagaaacatttataacccatttgtactttggaaaacaatttaaagatccctggtaragtcaaacatgtgcaaactacaccacccagagtttccatcccagattagccagggaaactcatatctgtccagcaaggcaggggtccccaacccctgtag

SEQ ID NO: 58603 - DNA, 201 bp, Homo sapiens
gaatctcttttatttaccttctaacatccctaatttatgaaaagattggatgctgttcacttaaaatctgtatttgtatagcccctgagaagcattttgcrcaatattgctgtctgcctatggacctgtagaaaccaggttgataactttcatacttctactagatccctgtggactctcaggccatcccttacataggta

SEQ ID NO: 58604 - DNA, 201 bp, Homo sapiens
aatttctgttggacagcactggggctagcagggaaattccagcccattggatccttctgtgagaatttgggatatctgtcttagctgatgcatcgcccacrggaatgttctttcctacagggagtgaccacacctcttcagcttgcctaatgcctgcagtgtaaaaagccccatcccctgccttggagaatccggtgctac

SEQ ID NO: 58605 - DNA, 201 bp, Homo sapiens
aaagagctgcaacgtaactgtatttaccattagctcatttgttgcatgctgacagtatgtggcatatctttattcctcatcataggtagcatcatcattamaaagctgggcttcatcagggacttacagagagatttgtacacccacattcgtagcagcggcattcacaatggccaaaaggtgggaacaacccaagtgttc

SEQ ID NO: 58606 - DNA, 201 bp, Homo sapiens
aacaattaactggccttaaggaaagtttcaacctctgtatgttcagaatgagggacctgcttgcctgtaaacatttattttgcttcctatttttgtttttrctcttttccccagtagtccaatttttctaaataagaagcagatgaagagcagcccattggttcctccaatctcttgtcctcagatgaaggtttctgggtt

SEQ ID NO: 58607 - DNA, 201 bp, Homo sapiens
tgagttgttaaaatataatagcgtagtaacacttacaattggatttatggacattccttttctctataaaatgtggacattttatagctctgccaatcttaaaagaaaaagaccactgatgtctgtgttgcacatagctaaagagattaatgtaagtcctgattagcaaaggttccctgctggcccacggggagaaaaggc

SEQ ID NO: 58608 - DNA, 201 bp, Homo sapiens
tgccgtgtgaatttaggaactgagctgtgtaagcctcagtttgacgtctgttagatacagaccaccaagatcctactgttgttttaggaattaaatacaawaatccataaaaccatttactacagagtctaaggcataggaaatatcccacaaaggttagctggtgctgctgttataaattcaaccattatttttgacctc

SEQ ID NO: 58609 - DNA, 201 bp, Homo sapiens
gagttgttaaaatataatagcgtagtaacacttacaattggatttatggacattccttttctctataaaatgtggacattttatagctctgccaatcttaaaagaaaaagaccactgatgtctgtgttgcacatagctaaagagattaatgtaagtcctgattagcaaaggttccctgctggcccacggggagaaaaggca

SEQ ID NO: 58610 - DNA, 201 bp, Homo sapiens
agttgttaaaatataatagcgtagtaacacttacaattggatttatggacattccttttctctataaaatgtggacattttatagctctgccaatcttaaaagaaaaagaccactgatgtctgtgttgcacatagctaaagagattaatgtaagtcctgattagcaaaggttccctgctggcccacggggagaaaaggcat

SEQ ID NO: 58611 - DNA, 201 bp, Homo sapiens
gttgttaaaatataatagcgtagtaacacttacaattggatttatggacattccttttctctataaaatgtggacattttatagctctgccaatcttaaaagaaaaagaccactgatgtctgtgttgcacatagctaaagagattaatgtaagtcctgattagcaaaggttccctgctggcccacggggagaaaaggcatg

SEQ ID NO: 58612 - DNA, 201 bp, Homo sapiens
ttgttaaaatataatagcgtagtaacacttacaattggatttatggacattccttttctctataaaatgtggacattttatagctctgccaatcttaaaagaaaaagaccactgatgtctgtgttgcacatagctaaagagattaatgtaagtcctgattagcaaaggttccctgctggcccacggggagaaaaggcatgg

SEQ ID NO: 58613 - DNA, 201 bp, Homo sapiens
gggcataagaatacctaccttggtgagttgatgtggatttaggtgaacaacatagttagaaggaatacgtgtccatgtttacctgtgatggcccaagttaygcctgttgtcggggcacgtgtattatagtgtcccttctcactccaaatgtatctcagtgtggatgatagtcaccaccccctgcccccccacacacacact

SEQ ID NO: 58614 - DNA, 201 bp, Homo sapiens
actgtattttgcttttgttgctgataatgattaatgattataatcacaatcatgtcactgttattcatagcagctcagtgtgactgaagtacctagtaccaaaaaatccttatttacgttatacttccatgtaattaaaagcttcttgtatttccaattagaaaatagtgtaatcttttttttttttttgagagacagagt

SEQ ID NO: 58615 - DNA, 201 bp, Homo sapiens
cagtgtgactgaagtacctagtaccaaaaaatccttatttacgttatacttccatgtaattaaaagcttcttgtatttccaattagaaaatagtgtaatcttttttttttttttgagagacagagtcttgctctgttacccaggctggagtgcagtgacgtgatcttggctcactacaacctctacctcccgggttcaagc

SEQ ID NO: 58616 - DNA, 201 bp, Homo sapiens
gaagagttaatattatacataaacattttatgcagtgatattttcagactctctctaaaggcagcaatgtttaagtaaaggacgcatttgattctccttcrattttctagcaatggccttcatgttttagcaaagttgatttgagatagatacactaaggttgacatggaaaggattttcttagaaaccactctcagatac

SEQ ID NO: 58617 - DNA, 201 bp, Homo sapiens
ttcaccctgaaagtgaaaaacacatcccataagtgttttaacttgtcctgaatggcctacacacacacccataagtgttttaacttgtcctgaatgacctmcacacacacacacacacacacacacacacacatacacacacacacacagagttgctccccactggtctacacagaagataatgttagtccctgcctcctg

SEQ ID NO: 58618 - DNA, 201 bp, Homo sapiens
gtctcgttaactcattaatgtaatgtctgtaattgtgatctgtttgaaaccaagttggaccaatgcaatcagcatatattctgtgatgcactttgtatccyggtcatattctcctgctaacccaatgctcaccagatgactgtggggaccagcaagggaaaagatgagctcaccttatgtgggttagaatctagggtcaga

SEQ ID NO: 58619 - DNA, 201 bp, Homo sapiens
gttcagttatatgtacatgtggtgttacttgaattagttcagaatcaaaagctaatctttaacactggcattattgctggaagtggttctcccttactgcmtgctaaaaaacttgttgacatcatttttacttcttaattttggtttatttcagctcccaagatgcctacttagtagtcaatgtgatcaaactcatagaac

SEQ ID NO: 58620 - DNA, 201 bp, Homo sapiens
aatggaggtttatggggatgcagaagagaatcacttacttcttcccagggccagggagtctttgcagggagaggatcctcaaaggtaagttcagtttcacygtgagcatagcagaagaaggagtatgtgtgatgtggacatgtatgtgcttcatgtacatgtacatgcatgtgtgttcctatatgtgttcatgtgtgtgtt

SEQ ID NO: 58621 - DNA, 201 bp, Homo sapiens
tcacagatgcaggcacgctcctgcagcaagttcaagtccctcgaggaaggccagaaggccagtgagggcagagccaggactcacacccaggggcccgactkggagcccagcggtccgcactccctggttctcatctctcccagagcctcttcctgtcgtcctccagatgtgtcctctcttgctctggagtagccaggtttg

SEQ ID NO: 58622 - DNA, 201 bp, Homo sapiens
tgaaaaggtgttttaagagggtaaaatgaactgcaattttcagtgaaaaaaatcccccaagggctttggaagtggtaggaattgatagaaattcaatgtarcgggaaagtccacactctgtagaacttgctttcctgaaaatcagtggacaatacatatcgttagaattctccctcgaactttggggtgctgttggagatt

SEQ ID NO: 58623 - DNA, 201 bp, Homo sapiens
ttctcctcatacctttctcacttctctgttcattagtctgacagtttccttttctccagaccaccccggtcttccattgcttctaactagatttttacatkatcatttaaaaaatgattatacagttcctgttcaaaatgtattctcctccacttttcttaagtctcaaaacaggtacacttggaccataaagacaaaggg

SEQ ID NO: 58624 - DNA, 201 bp, Homo sapiens
ataaattggaatggctgatagcagatcaataatgtaaactattccaaataaaaagctaatgatgcatacacataaatgagtgtaataaaaattagaaataygaataagattgttggactgtatcagtgtcaatatcctggttgtgaaattacactagaggcttgcaaaatctttccactggaggaaattgggcaaggtgga

SEQ ID NO: 58625 - DNA, 201 bp, Homo sapiens
caaaatagagcagagaaaacccagataaataggaggcagagtccactgcttttctgtacataatccatggagacctgggtgagggaaacaatttgctttcraacagtagagtctttccagcagggccttcccctgaaagtctttgcttaatttagctaaagtgggaagagagagatcaaaaatatcaaatctaaaagcagt

SEQ ID NO: 58626 - DNA, 201 bp, Homo sapiens
aatcatctccattcatccacttccatatccactttccatgttctctcaactgtctcactcttacgaaatccctgttctccaggggcatattgcagtcttakttttttcttaactctgtttctttccgttctctttctctttgctcttttttttttctcctcatacctttctcacttctctgttcattagtctgacagtttc

SEQ ID NO: 58627 - DNA, 201 bp, Homo sapiens
ggggagggttgagagggacagctctttcccattcttgagttccacattgccctggtggtaacttcagtgtcagttgctcagtggggcaagaactgggcacrtgtagacttcagccctggtggcaggcttgtagatatctaccgtgactgctttttctatcatgtttgattagaagcctctatcctgttacaggcttgctaa

SEQ ID NO: 58628 - DNA, 201 bp, Homo sapiens
tctaccgtgactgctttttctatcatgtttgattagaagcctctatcctgttacaggcttgctaagtcagcagaaagaactagcgtattctgtgcaggtckgtctactgggctaggaagaaagggtggtaccatttcagacatgcccactgtccattattaaccactgcatctgtccatgtctacgagagtctgctcctcc

SEQ ID NO: 58629 - DNA, 201 bp, Homo sapiens
catgtggctacccatgtccatcatgactgtcacctctcacctggacgactgcatggcctccttgctgcactctcagcttccagtatcatccaatatcatcyccctagaatccgttctccttccagtagccagagcaatatattatatatatatatatatatatatatatatatatatatatttattttttttttttttttt

SEQ ID NO: 58630 - DNA, 201 bp, Homo sapiens
ctaggaagaaagggtggtaccatttcagacatgcccactgtccattattaaccactgcatctgtccatgtctacgagagtctgctcctccaacaacccccwcacaaattcagcagtcatttcttgcaatgaagctgagtagctcgtctgatacatggcctctgatgggctgaggtccttttaatatggacactgtgtcccc

SEQ ID NO: 58631 - DNA, 201 bp, Homo sapiens
caggtgtcagacgctgtatcctgtgtggatatgatcagtgtgtgctgtccccatgccagtcacggtcaaggatggtagagacaacctttcctaaccgaaaytggagctcaacttacaaatacgcagaaagtgatgttagagtcaaggcatggagcgttgcttgcttgagctaatactgattgttttcttgcctagaggaag

SEQ ID NO: 58632 - DNA, 201 bp, Homo sapiens
acgagagtctgctcctccaacaacccccacacaaattcagcagtcatttcttgcaatgaagctgagtagctcgtctgatacatggcctctgatgggctgargtccttttaatatggacactgtgtcccccgcccctgggttcttggtctttcaggacttggtgcaggaagaaatagccatcgtagctcagaagtgaaaagt

SEQ ID NO: 58633 - DNA, 201 bp, Homo sapiens
tctccctattaacattcagtttgccggattcagcctgttctcctggcagaatgtctcatttgtttacttctgcccgcctacatgtcggccaggtgtcagasgctgtatcctgtgtggatatgatcagtgtgtgctgtccccatgccagtcacggtcaaggatggtagagacaacctttcctaaccgaaactggagctcaac

SEQ ID NO: 58634 - DNA, 201 bp, Homo sapiens
tttgtcagcgcctgagatgtgctgatgtccccgggtttgacggcaccattgtctaacaagagaagagaaggcagttgcttgctgctgaagaagggcaaagwctacaacataaacagtatttaataaagccagccacaatcttgatatcatgtttggcttagtgtttaggtttaattacaacgaattcagagagacttctgc

SEQ ID NO: 58635 - DNA, 201 bp, Homo sapiens
aattcagcagtcatttcttgcaatgaagctgagtagctcgtctgatacatggcctctgatgggctgaggtccttttaatatggacactgtgtcccccgccmctgggttcttggtctttcaggacttggtgcaggaagaaatagccatcgtagctcagaagtgaaaagtccactttctggtaacgtccagaagcttcctgta

SEQ ID NO: 58636 - DNA, 201 bp, Homo sapiens
agttcaggacttttaactctaattttacattcattctttcagtccaggtattctacttgtgtaaccctcacgtcttctgtttgctagtatgtttctaagastttctatggcaggtgctcacaacctctttttcgtttcctgccccatcacaggaaggggaggaactctcccatctggtactgtggctcaccttgacatggc

SEQ ID NO: 58637 - DNA, 201 bp, Homo sapiens
catttggctggaggccctgaatttaaatgagcagaaacagataggaaattatcaacaatttcctgattttccatttctggatttcctgttcctctgttgayaagaaatcaagaaaatttatagataggatgtcgcttgtgcttatatttgactgtccgagaacatttcttctaggtttctcctaacccgttgttgtctcct

SEQ ID NO: 58638 - DNA, 201 bp, Homo sapiens
aataatgtttgattgacaagaaggttgcagttttagcagagttgctgtggtcctgctgtttcacagcacttctggctctctgaaatggtcttcttttcatygtttttctctcccagtacaagaatgcaagtcctgagggcagttttctctacgtccctctctgaaatgcacaggacggagagagaggcaagccttctggga

SEQ ID NO: 58639 - DNA, 201 bp, Homo sapiens
caaatgcttgtcctagttccctcctgggaccgtccaagcagtctgtgttttctggccaccagcccctggatctgctgataaaatgtcttcctttttgcagsagcactggaaagagtagttgcctaagggagtctgtgctgcagacagacttcccttcctgacacgtgtagtgtcacaccatgaaacctccacccctaaggg

SEQ ID NO: 58640 - DNA, 201 bp, Homo sapiens
gtgcactaaaatcctagacttcaccattacacaatttatccacgtaaccaaaggctactgtacccctgaggctattgaaatattttaaaagtaaacatttkccttttgaaatgtgtctgctaattcagatacagttatcttctaagcagttaaaacatctttttcctcattcttcttcccggcaatatatctttgagacat

SEQ ID NO: 58641 - DNA, 201 bp, Homo sapiens
aacagaggctcaatgaagtacagataggctgctcagacttaggcttcggacttgagttctcaccacacgcccaggtaaagaagagcctcctgggtctgccsaatctgtggcatctgctgtcaggagaaaaacaaaactccattttggtctgcaaaaagaaaccagtgggaagcagaatgtcagcaacatattttccaaaac

SEQ ID NO: 58642 - DNA, 201 bp, Homo sapiens
ttgtccttttataaaaagatttcctaatggcttttggagcaacttggatggaactagggccattattgtaaatgaaataactcaggaattgaaaaacaaayatggcattttctgacttctaagtgggaagtaagctatgggtacacaaaggcatccagagtaatataatggacattggagactcagaagggggaggccaag

SEQ ID NO: 58643 - DNA, 201 bp, Homo sapiens
tgctgaactgaaggaaaaccctcaaggtctctctggcccctggcacccaccttcaccccatctgactctccaaaagcacaggatgaagttgttctctgacrttcccttatctgcctaaactatagaccctccaaaaaagaaataaattaccttggtccctctctgagttttcattaactaatgtcacaggaagaaagactg

SEQ ID NO: 58644 - DNA, 201 bp, Homo sapiens
ttataactgaaatgggattctctcctcctcccctttagggtcactgttactaccatggacatgtacggggatattctgattcagcagtcagtctcagcacrtgttctggtctcaggtaagtggccatgaccatggcggctctagtcttcagccatctactgcaggcaacctctgtcttttcctgctcgtgctaaagcactg

SEQ ID NO: 58645 - DNA, 201 bp, Homo sapiens
acattttatttcataaagaacatctcagagaaggagacacaagccaccccacagagttgatgaccaaagtaatccctgaatgatctgtttggtgatatacrtggacaccagtgtgggggaaggcaacacttcatagaatgacttttagtcaatctggactttggatgacttagaaggagacatgagaacattttcatgact

SEQ ID NO: 58646 - DNA, 201 bp, Homo sapiens
gaagcagcaggaccctgacctgcagccccccttgaatccagcctgattatagctggtttctccagacgcctaatttccagcaagaaaagcagttgtctccraatcatacccagagagcttttgcaagtcagataactcccgacttctactgtcaaggttgataaattggcctagtgtgattcacccccaagaatatagcag

SEQ ID NO: 58647 - DNA, 201 bp, Homo sapiens
caaaatcacctggatcattaacagatgagcagatagcaaattgtggtatggtctcacttgcaatggaatatcatccagccataagaaggaatgaggttccratgcatgctaccatgtggctgaacctcgagaacactattctaagggaaaggagccaaacacaaaaggccacatggtgtaggattccgtgtacatgaaatg

SEQ ID NO: 58648 - DNA, 201 bp, Homo sapiens
atcatgccaccctgtggtcatgtccttaggggtaactatattaccacatgatcctttcccctgggccactatgtcaccactttcctgtccctgggccaccrtgtcaccatgtggtcaggtccttagagtcactgtaccaccacatagtcctgtccctgggccattatgtcaccacacggtcctgtccctagggccactatg

SEQ ID NO: 58649 - DNA, 201 bp, Homo sapiens
aacagatgagcagatagcaaattgtggtatggtctcacttgcaatggaatatcatccagccataagaaggaatgaggttccgatgcatgctaccatgtggmtgaacctcgagaacactattctaagggaaaggagccaaacacaaaaggccacatggtgtaggattccgtgtacatgaaatgaacagaacaggcgatctgt

SEQ ID NO: 58650 - DNA, 201 bp, Homo sapiens
ggatgtggggtttgtttgaggggtggggggaagttctgcagttagtagtgatggctacacaacattgtgaatgtgctggaaaaaaacattggattacatayttcgaagtgacttaaaggatgaattttatgttgtgtaaattcaacatcaatttagcaaatcgtctgcagagcttattaaaatacaggttgctaggcccct

SEQ ID NO: 58651 - DNA, 201 bp, Homo sapiens
tcatgctcctgctggttctgggcccctctctcaaaactgcacaaagggaagcaggcgagtgtggggttgagaggcccaagcccggggcacacaggtcccgmctgggtccccagctctgccacctgcgcaccttggacagtggggtcatggcgggagctgcagccatggtcagcagagtgatcagtgtacggagcgcagccc

SEQ ID NO: 58652 - DNA, 201 bp, Homo sapiens
catggaaattactgaagccctgtggtgcgtatgtgttaagtaatactgctgccacgactgtttatcaaacatgtatggggtgagatattacttttacccasgagttgctccaaaaaaaaaaaaagccgaaattaaatttcaagccaactgcttttccaccacatgattgacagcaccacactgagaccaaaagtctttttc

SEQ ID NO: 58653 - DNA, 201 bp, Homo sapiens
cgttctaatttgattaaagaaagtcctctcttttatttcctagtggggtttatttccaagggaccaccatcggcatggccccaatcatgagcatgtgcacrgcagaccagtctgggggaattgtcatggtaagccaagggcattgggagctggttccccttgataatgattccccaggaagtcactacttttatcagactt

SEQ ID NO: 58654 - DNA, 201 bp, Homo sapiens
tgtgttttatcacagtttaaactcttacctcctctgtcgtgctcccacaccctggtcatgagatatatttgaaatgggagccacgggcaaggggtctttgyatgtctagcctagtgtctcgcgcatagtaaaaggataaagaatatttgttttgactgtacctgagtagttcacatggaaattactgaagccctgtggtgc

SEQ ID NO: 58655 - DNA, 201 bp, Homo sapiens
ctggctcagcgtccagttataaggcagtcactttctgtttctggagtggacgtgaggatggattgccccattagcttcagcctcagttctgttctatcgtytgagcctgtgtggtcagagctgtgtccctgtgcaccgctgggcaggcagagtgggctgactcaggcccagttccctctcccatcacaccgtgaggaggag

SEQ ID NO: 58656 - DNA, 201 bp, Homo sapiens
tgcagaaataaaattttcagggaaaaaagataaaatcacatgtgaatataccctcatacagctatttttatttttgcgtattttattgcaggaatatccarcagaatttttaaatattagagaatgcccccgttctaatttgattaaagaaagtcctctcttttatttcctagtggggtttatttccaagggaccaccatc

SEQ ID NO: 58657 - DNA, 201 bp, Homo sapiens
cccactggctcagcgtccagttataaggcagtcactttctgtttctggagtggacgtgaggatggattgccccattagcttcagcctcagttctgttctaycgtttgagcctgtgtggtcagagctgtgtccctgtgcaccgctgggcaggcagagtgggctgactcaggcccagttccctctcccatcacaccgtgagga

SEQ ID NO: 58658 - DNA, 201 bp, Homo sapiens
tactgtgaataatttgttgcagaattccttcaactcctgggtgaacttctggggacattgaaaagatgacttagtttggttcacacacacacacacacacrcgcgcgcgcgcgcactcactctgatttgcttgatttctccaagaatacatctaccacagagagtgaagtccaccacagagggtgaagtccatcacaggca

SEQ ID NO: 58659 - DNA, 201 bp, Homo sapiens
ttgtgtgtttgttgctttgaaaggaatgagatggggaaggcatgtctgagcttagtgaacggagctggtctcagctctccaatccctggggtctacggacrttctctgctcctttgggaaacaggccaattcagaccactcttttccaggcttctcttaattgctgtgattctggctataaacccttcctgagacttaaca

SEQ ID NO: 58660 - DNA, 201 bp, Homo sapiens
aagaagttggcacgtaactgaggaaaaagctcaatttgtataggctaggggatgtgatcaccagaaagatgtgggtggtaacaggaaaaaaaaaaaaaaaactttcttttttctcctttctatcccgcagtgtaagagtttctgatggatatgatttaaagaagtgtgcttactccattgggcttcatagcattttcctgc

SEQ ID NO: 58661 - DNA, 201 bp, Homo sapiens
atggtgaaaccccatctctactaaaaatacaaaattagccaggcatggtggtgggcgcctgtaatcccagctacttgagaggctgaggcaggagagttacytgaatccgggaggcggaggttgcagtgagacactgcactccagcatgggcaacagagtgagactcggtctcagaaaatgaagttaagaaaaaataaatac

SEQ ID NO: 58662 - DNA, 201 bp, Homo sapiens
tcagaaagctcggattcaaaccttaattcggctggttactaagcggatgaccttccggacattcttgatctgcgttcatcttcatgtataaatttggataytaatagtacctggggttgttggaagattaaaaactccttaatacagtgcctgggacatggccatcatcccaaataattactgttatttctgatgatattg

SEQ ID NO: 58663 - DNA, 201 bp, Homo sapiens
tctctactaaaaatacaaaattagccaggcatggtggtgggcgcctgtaatcccagctacttgagaggctgaggcaggagagttacttgaatccgggaggyggaggttgcagtgagacactgcactccagcatgggcaacagagtgagactcggtctcagaaaatgaagttaagaaaaaataaatacctggtcattaaaaa

SEQ ID NO: 58664 - DNA, 201 bp, Homo sapiens
ctgaggaaaatggggcacttctgctgcttggttttaaatccttgtgaaacaggtgctagacagacagacactggggcttatcttttttttagaaaaaataraagatgcatacttttggaattatcaagcttaccttttacagtcaggtttctcgtactgtcttcgtttaacatttcaatgctttttcatgagcatagcaat

SEQ ID NO: 58665 - DNA, 201 bp, Homo sapiens
aagaaccattcccagaacaaggatacaagaagacttgtatcctcggctaggcaaagaagagagaacttggaggaactgtacagccagatgaaagtactagwactcaggaaggaagagtcctatctgcccatcctgaacaagccccgtgagctagggtggctttcttgaattttaactattgcatggaataagtgatcactt

SEQ ID NO: 58666 - DNA, 201 bp, Homo sapiens
cagtacatctaatgcttgaactatccatttaaatccctcgcaaatcaatgggcacagcccacaggcctcctgccggccacttgcttgttataaggtccatktctgactttccgagtgatggaattgtcaggccagacaacttacccgggctgctcaagggtctcatccacaaccctggcgagattgcagggaattgtggtt

SEQ ID NO: 58667 - DNA, 201 bp, Homo sapiens
tagtttccacttgtaatctcacccattaagcatataatagaccacaattggccccattatgtactttctaaaaattactttccctctatccaaaaaaaaaacagatgttaacagaaatcaagatattccagcaacccttgactcttgcaaagtgggagcattgtgttcagaaaaggttgctgtcatttgcccctctaagat

SEQ ID NO: 58668 - DNA, 201 bp, Homo sapiens
atgcttgaactatccatttaaatccctcgcaaatcaatgggcacagcccacaggcctcctgccggccacttgcttgttataaggtccatttctgactttcygagtgatggaattgtcaggccagacaacttacccgggctgctcaagggtctcatccacaaccctggcgagattgcagggaattgtggttgaaaccactgg

SEQ ID NO: 58669 - DNA, 201 bp, Homo sapiens
caaagtcctccagggatcctgatgcagtccactgcaatgagatccgcctggacacccctctacagagccccagtgtactgctgactagagtgatgtccccrgccggccagcctatgttacaactgctttacctttcatgagggcacttgtgtgctactggctttttccagggactcgtagacccagttggttcataaacag

SEQ ID NO: 58670 - DNA, 201 bp, Homo sapiens
cttcttgttttcctgcttgtcttgctaaaacactcaattaaaaattgttcaacagattccttctggcatataatctggggatcatctctcaaatttcttargctgaaattagataaaacgagtgtgttctatctaaagaacgaaccatatgcacatcccctcatggatgatctaaatttatgttgtcaagtgaaaacgaaa

SEQ ID NO: 58671 - DNA, 201 bp, Homo sapiens
tttctctctgaagcctgtttctgttgtgttctagtactttcaatctcattaaagaaagagtaagaaataaacaattatttttacaagcatacaaagaaatwtattgctcttttatatgaaagagagtttgacaatttgtgtaatgtttcaattgctacttataaaactatctgaaagatgtttatccaaaaaaaaaaaaaa

SEQ ID NO: 58672 - DNA, 201 bp, Homo sapiens
cgcaataaggtcacgttcacaggtccagagattaggacttaaacatatcttttctgggggctgggggggacactattcaaccccctgcagtgacctggggrctctcatctttattttcctcattagtaaaatgggctcatgttatctgctttacaggattgctgtaaatattaaagaaaataatatattcctggccgagca

SEQ ID NO: 58673 - DNA, 201 bp, Homo sapiens
catgctatgaatggaggtttatggggatgcagaagagaatcacttacttcttcccagggccagggagtctttgcagggagaggatcctcaaaggtaagttsagtttcaccgtgagcatagcagaagaaggagtatgtgtgatgtggacatgtatgtgcttcatgtacatgtacatgcatgtgtgttcctatatgtgttcat

SEQ ID NO: 58674 - DNA, 201 bp, Homo sapiens
aatcaaggggtcagcagggttggtttcttcagcagagtctacggaagaatccctcccacatctccctcctcgctttgggtggcttctggccatccctgctrtgccttgacttgtagatgtcactcccgtttctgcttgcatctttgcttggccttcttccctacgtctgtgtgtctcctcttcggtctcttctaaggacat

SEQ ID NO: 58675 - DNA, 201 bp, Homo sapiens
gccccactgtcactcaaaactcaggatgtctcaatctaaactcctctgggtaggtctccagactggctctccacctgacctcttgtccagaaggtccacamcacctcgagtctataagcctgaccccagggagatttctgtaacctattgtatccacccaggccctgcacgctctcccctatagcgtctccttcatccctc

SEQ ID NO: 58676 - DNA, 201 bp, Homo sapiens
cgtgcatgccacagggatccactggccaccagccacggtggttttgccaggtggcatctgctctgaaggagatccaaggtcaagtctctcagctctccccrggccccactgtcactcaaaactcaggatgtctcaatctaaactcctctgggtaggtctccagactggctctccacctgacctcttgtccagaaggtccac

SEQ ID NO: 58677 - DNA, 201 bp, Homo sapiens
acaactgctttacctttcatgagggcacttgtgtgctactggctttttccagggactcgtagacccagttggttcataaacagcagaagctttgctttccyaacagacggaaacaggcaggtgtgcagttcaggagctgggccctcttggtctttcttgctttttgcagccatttaaggtgtgatgtttgcattcagtgag

SEQ ID NO: 58678 - DNA, 201 bp, Homo sapiens
aactgctttacctttcatgagggcacttgtgtgctactggctttttccagggactcgtagacccagttggttcataaacagcagaagctttgctttcctarcagacggaaacaggcaggtgtgcagttcaggagctgggccctcttggtctttcttgctttttgcagccatttaaggtgtgatgtttgcattcagtgagtg

SEQ ID NO: 58679 - DNA, 201 bp, Homo sapiens
ccttccagctgaagcctgcaggaacagcgtgcagggactccagcaactcctgtgacctcccagagttctgcacaggggccagccctcactgcccagccaaygtgtacctgcacgatgggcactcatgtcaggatgtggacggctactgctacaatggcatctgccagactcacgagcagcagtgtgtcacgctctggggac

SEQ ID NO: 58680 - DNA, 201 bp, Homo sapiens
gcccagccaacgtgtacctgcacgatgggcactcatgtcaggatgtggacggctactgctacaatggcatctgccagactcacgagcagcagtgtgtcacrctctggggaccaggtacgtggccgccacaagctcggcatcaggagaggcactggcagacctgggctgtgggactgggggcatgtgctctgttttggttag

SEQ ID NO: 58681 - DNA, 201 bp, Homo sapiens
ggcactcatgtcaggatgtggacggctactgctacaatggcatctgccagactcacgagcagcagtgtgtcacgctctggggaccaggtacgtggccgccrcaagctcggcatcaggagaggcactggcagacctgggctgtgggactgggggcatgtgctctgttttggttagcccccactcctggcgggcgctgtccac

SEQ ID NO: 58682 - DNA, 201 bp, Homo sapiens
gtacgtggccgccacaagctcggcatcaggagaggcactggcagacctgggctgtgggactgggggcatgtgctctgttttggttagcccccactcctggygggcgctgtccacacagcatccggtgtgttcagtcgggagtgattgactcccagggagggtctgaggccgcactgggcatggggtgcacagaaatggaca

SEQ ID NO: 58683 - DNA, 201 bp, Homo sapiens
gcatgtgctctgttttggttagcccccactcctggcgggcgctgtccacacagcatccggtgtgttcagtcgggagtgattgactcccagggagggtctgrggccgcactgggcatggggtgcacagaaatggacactgcctggagcctggccttaagaagctcagtgcggtccaacaggagctgcaggagcacctactgt

SEQ ID NO: 58684 - DNA, 201 bp, Homo sapiens
ggcagccctggactccaaggccccgtcaccccagaaccatttgagattcaatgcctgtgtccagctcccaggagtccaaccgtgaaatccacaagtgcagsccccaccctgtcctgcagttctctttcccttatgataatgtggttgagtcctttgtcactccctcctcctgctggctgcagaaatgacctcagcccaggc

SEQ ID NO: 58685 - DNA, 201 bp, Homo sapiens
tgggaagctcacacaagccacgagcaggtctcatgctccttggtttacaggtaaaaagcagagaccacaaaagtgacttcctcatggcctctcagtgatartgggcaaaactagatcttaaacccaagcctggctgacccccgttcaattttttttctggtaaacctcttgcataatttggatccaatcttctttttcagt

SEQ ID NO: 58686 - DNA, 201 bp, Homo sapiens
gttgcagtaggtcatactttatttttcttcattgttatgattcctgttttcatgagaatggggcagatgttattgtcacctgagcagccaactaaggcatrgcatcctcaggggcctggagttcgtttcccaacccccagcattgctgtcatgcagtttgcaccttgaaatcgccaccctctcaaagccctttgccccatc

SEQ ID NO: 58687 - DNA, 201 bp, Homo sapiens
gcaggaagaaaaaaactctgttctagaacatagaagaaggagggaattaacaagttgtttttcatcatttgaagcttgaagcggaaagcacacggagacaraaacagcacaaagatctcagtagaaagggacatgaaagaggagatggctcttgaatggagggaatgaagtacaacatggaaaatgggtcgtaaaaaggag

SEQ ID NO: 58688 - DNA, 201 bp, Homo sapiens
cctgggataattccttgcaaagctttgcagctcctgtagagaccagggcagagatacacaaggccatggtagtaaggaccacacacacttggaaagggaartccacactttactattgtgcctctctggggcctgaaaggtggacctctttcttcaaaggtcatgtgttgaaggctggatattttcagccttcaatttggc

SEQ ID NO: 58689 - DNA, 201 bp, Homo sapiens
actcaccctccagatctggcgacccaaacactgactggacgaagcccttccttccaactaatgattcccttttgaaatgggcttttctcaatctggcgttrtatttcaataaaacaatcctgcttccaaatctttctacaaataaaacaacagaaaattcaaaacacatgcctgcaacttctaactggcaaagcaatacac

SEQ ID NO: 58690 - DNA, 201 bp, Homo sapiens
accaccagcatggttactgaaaatattccttggcaattaatcttacagataactacacatctatagtcacaaacaactggcatcagagaattcccgaaatrtgttagttttttctattttatcactcaccagaatctaatgtttggtttctgcagtgtgagctgaccagaccatttttatgggctggtgaatactcagtgt

SEQ ID NO: 58691 - DNA, 201 bp, Homo sapiens
tgtttagaagtcaggaaagtctcccttttgtcccatcaagtgagaaagaaatgatcaaatttgttcatttggacttcattttctgatgaatacaaaggtcygtctgaagaagagagatgggaaggacaatacagtctccagttgtctgtaaaaatgcctttgtctgtggatgttagtggcaggggttagggaaatcagtga

SEQ ID NO: 58692 - DNA, 201 bp, Homo sapiens
tccctcatgttttgggtgaaagctcaaatgaatgaaactcttagaaggtgaccgttattgccttcctggaggtagacagaaagttaacctttagaacctcrcatcgttcaagccactggatgaattaatggcagagtggagtcagttttactggccaaacttcactgagatttatttcttgaggaactgctccctcagagg

SEQ ID NO: 58693 - DNA, 201 bp, Homo sapiens
ccccatacatgcccagctataaaacaaggcttccccctgaaagtagtcagcaaaaagaatcgctaaccactgacctgtcactctctcagccacaccttttrgatgtcgcagagcaggtgggaaggcgctttggcgctcatcatcctgcatccacgcaggttcatcaaggctgcctgacaaaatcaggtttaaaaaaaggca

SEQ ID NO: 58694 - DNA, 201 bp, Homo sapiens
tgttctaattttcatttcgagtttttattaacgtgatcccaactccaatgccagttttgcctgttttgcccagttttacagaccactgaacattcggatcrtgttggtaggcgtggaagtgtggaatgacatggacaaatgctctgtaagtcaggacccattcaccagcctccatgaatttctggactggaggaagatgaa

SEQ ID NO: 58695 - DNA, 201 bp, Homo sapiens
ctctctcagccacaccttttggatgtcgcagagcaggtgggaaggcgctttggcgctcatcatcctgcatccacgcaggttcatcaaggctgcctgacaamatcaggtttaaaaaaaggcaggtgcatctatcacatgcttaaatattattcttcggctgtgacttcatcccattttggttattctggtaaaagagctttt

SEQ ID NO: 58696 - DNA, 201 bp, Homo sapiens
attataattctacatgagacttggtggggacacagatccaaaccacgtcacactctgacccagaaggctcagtgtgtttcagctttggattcccaagtagrgatccagtgttttcacttccagaatgcttttatacttgattacacactgtttccatgcctttgcttgacttcctatcataacgatagccctttatctggt

SEQ ID NO: 58697 - DNA, 201 bp, Homo sapiens
ctttaaaagcaacagtcccctgaaccctcctactctgtttctaccttcatagcattccctaacactgggctttagaggaacataatcatttgggtcttttytctgtgtctccttgcaattttcaagcaagcaggaggtttgtccagtttggtccctcttatactcccaatgtctggaagatagtaggtgctgaataaatac

SEQ ID NO: 58698 - DNA, 201 bp, Homo sapiens
ttggagcactgagcacactgttcacatcaaatgatggcaaggtggtgtggcacatgtgtgttgaatgagatgatcatgtctgctagtagctgatgagaagrgatcaggtgcaggctaacgaagggggatgtttttagtaagaagaacatcttctgttccctgggacgaggtatcttaaataaatccgttgtcaccttggaa

SEQ ID NO: 58699 - DNA, 201 bp, Homo sapiens
cctcagcgcctgcccaagatgccctctccagcccagctctgtctccctgtctgccaggccctgggctgccctcgcctctgctcccccagccccttggtccraccaggtcctgcgcagcccatggtacagccaccccctcctccgtgtgttccccttgacccagatccctgtgtaccccacaccctgcttcttgcttaccca

SEQ ID NO: 58700 - DNA, 201 bp, Homo sapiens
ttgctttaaaaaaaaaaattgaaatactgggagtacatgaaggattgcctagatatatgagcaactttttttaatatactttaagttttggggtacatggsagaacgtgcagttttgttacataggtatacaggtgccatggtggtttgctgcacccatcaacccgtcatctacattaggtatttctcctaatgttatccc

SEQ ID NO: 58701 - DNA, 201 bp, Homo sapiens
ttctagaatggtctatatgttttttgacatacaacttttaaaaataaattttattttgtatattgaaagtacgcaacatgcagttttgggatgcatatagrtagtaaaatggttacacataggtttagaacttgaactctcaggatttaattaattaattaattaaattttgtttgtttgtttgtttgagatggagttttg

SEQ ID NO: 58702 - DNA, 201 bp, Homo sapiens
aggcatggtgagcactggtctgcaatttggccaaaagattccttgtattatgtgttgctatgtttgtaattaaagccaggataggatggagacattgcttktgagagatatgctcacttgaatctgaatgtgatctgagaatctagtcttgctttaaaaaaaaaaattgaaatactgggagtacatgaaggattgcctaga

SEQ ID NO: 58703 - DNA, 201 bp, Homo sapiens
cccatctctctgaagcttctggcaaatgctcacctttaggtctctatggattggcctattttagacatctggtgtcagtgcagttatatagtacatgtccycttgtgtcagctcctttcacttagcatgaggttttcaggttcatccatgtgtttgtagcatgtaccagaacttccttgctttttatggctggaacacatt

SEQ ID NO: 58704 - DNA, 201 bp, Homo sapiens
gtcaaggatcatggagaaagacaaagctgagatggaggacaggaaaggcaacaggtagtcagggaggttcggaaggaggtgaggtgagccctttagatgakgtaggtagcatatcagagagaagagcatgtgcaaagctcctgaagcagaaagatgcctgggatattcccagagcagcgaggtggccagcataactagagt

SEQ ID NO: 58705 - DNA, 201 bp, Homo sapiens
tacacaaagctattcctcttcctcgttcatcccgttccagtcccactcagataaaaatgcaagctgggaattcccctcccagctttctcatcccttgtgcwtgtaaacacatagtcagagattggggtgtgtatttgtttatttttacaaacatagagtcacatcatatacatcattctacggctttcttttgtcacccaa

SEQ ID NO: 58706 - DNA, 201 bp, Homo sapiens
ttatgtgctccccaggaaaatcattttgtttgataaatttccagctgtttcagcctttttactggatttgcttatcgagtttgtgaactaaatgtttgtawcctcagagtcctgggtaactttggcccaaggcaccaaagcatgattccatgggagggaagagagagaaggccctggaaggatatacctgcttgagttaaa

SEQ ID NO: 58707 - DNA, 201 bp, Homo sapiens
gttattggccatcaggtggcccttatgtgctccccaggaaaatcattttgtttgataaatttccagctgtttcagcctttttactggatttgcttatcgartttgtgaactaaatgtttgtatcctcagagtcctgggtaactttggcccaaggcaccaaagcatgattccatgggagggaagagagagaaggccctggaa

SEQ ID NO: 58708 - DNA, 201 bp, Homo sapiens
cacaaacatactgtgggcctttgatatatgccaaggtagcatgtcacatcagtgagaaaaggaaaaatggcagcaaagcacagctggctctcatttttagkggaaagttagcattgaacctcacagtcccacaaaaattaattccagatggattaaagagctaattgtcagactataaagatagaagaaaataaagaagaa

SEQ ID NO: 58709 - DNA, 201 bp, Homo sapiens
gctgaaaatatgtgaagaactcttctaactcaacaataaaaacaccaaaatccaatttacaaataagcaaggatttgagtagacatttcttcaaagaagayataaaaatggacaataaacacatgaaaagatccccaacatcattagtgattaagaaaattaaaaccaaaaccacattgaaataccactttatatccacta

SEQ ID NO: 58710 - DNA, 201 bp, Homo sapiens
ttcttgacttgctcaatagtcttcaacagacatcactatgtccaggattcaggagtcctccagaactttggctgcaaatgctgattatatgtgctctctcygtggctggaagatgtgctaaaaatggccatttctgagctctctggctgccatgaccctctttgctgggaaccgtcatgttgtacatagggattaccaggg

SEQ ID NO: 58711 - DNA, 201 bp, Homo sapiens
ttctacactccaggtggcatgaggacttctagccaggaaattactttggaaagaaatacaatcgcatattctattggttttggatatgtggcttggttttyagcacagagttcttgggggcttgtcctcacctgaacagaatgggaaatcagatgtatttttagaaccctgtagagagaagaataggagagggaaaggagt

SEQ ID NO: 58712 - DNA, 201 bp, Homo sapiens
gtctaaataaattatatttggaagactaatgtactaatgaaggtttaagcatgaaatccaagcaggattaacaagctttgcgccatattaaaaatttgagrtcacttttatgtaacactcaagagctgggggctttctgctgagcattcttttattacttatgaaaaataataaaacctatgagaggttaatttgctcata

SEQ ID NO: 58713 - DNA, 201 bp, Homo sapiens
ccacaaccttgccagcatctgttgttttttgactttttaataacagccattctgactgacaccttttttttaaactgtagcctgaacagccagggccaggkgcatctggacattccaattccaagggctcaatttatcatcaaatttgttttccacgttcaagatgaaatgtgctttgatctcagaaccttggttctctga

SEQ ID NO: 58714 - DNA, 201 bp, Homo sapiens
tccacggatttgtaaaatcttataggagataaagggctgcatcccttgagtctggagtatattatgcacatttgaaatgaggctgagttctttcagccagmccagtatcacttaggaaatgcctaccactacaacagcttgataaattcaaggagccatctgttttcctctgctgagcctcgttgctgatggtttatgtca

SEQ ID NO: 58715 - DNA, 201 bp, Homo sapiens
tatattatgcacatttgaaatgaggctgagttctttcagccagcccagtatcacttaggaaatgcctaccactacaacagcttgataaattcaaggagccrtctgttttcctctgctgagcctcgttgctgatggtttatgtcattgatgatactacttgtcagtcactatctggaaaaagttcccatatttcaacctctc

SEQ ID NO: 58716 - DNA, 201 bp, Homo sapiens
gcctgcctcggcctcccaaagtgctggtattacaggagtgagcaaccgtgcccaacctcgccctctcctgtatcttttaatggaagaaaaaaatactgcartacatagatttctttacaagctccaaacaaaactcataagaaaatcagttataattttaggatcaactgaaagttatattaaaagccataaaatgcaaaa

SEQ ID NO: 58717 - DNA, 201 bp, Homo sapiens
attcttttattacttatgaaaaataataaaacctatgagaggttaatttgctcatattaatgttatctaaaagttgctgatattacaaaaccgaatgtaayggcaccgaaatatcactttgcatttcacttttatctggtatttcaattctgatatgctctggattgacactgggaagacccaaggtactgggggagaaga

SEQ ID NO: 58718 - DNA, 201 bp, Homo sapiens
tgagctgcccttttacagccagcccataacaagttaagtaataatacattcatttgtaaaaggttttgcaatccatagcattttttaaatagagcagttaktgtgtttgaaatattttcttctaaaggtattcatttcttttgaccttttcatgtgacttttatttaacaaagaaaatcagactgagctgtaattaccttt

SEQ ID NO: 58719 - DNA, 201 bp, Homo sapiens
tcacttttatctggtatttcaattctgatatgctctggattgacactgggaagacccaaggtactgggggagaagaaggtgctgagtgcttcttggaaggrgctgaaatatttctgctttcaatgggacacagtcttggttctggtacacatttggtaggactaggtccagattccttggctcagagttatgacgttatta

SEQ ID NO: 58720 - DNA, 201 bp, Homo sapiens
ttatttttcttgatgggcttatttccaatggaatcatattagtcttgattaaccacaccagaggttcatttgttttcctgaaacctttcctacagaaatcmtgctccaaattctttattttaaaacttgtagacacttgccaatgattcttacacagaattaccgggtgcatggggggagggggttgtaaattaccatcat

SEQ ID NO: 58721 - DNA, 201 bp, Homo sapiens
ataatatgtagaatcagcgggagccctgagcttgttttcctgtaactagacggtcccatctgggggtgatgggaagcagtgacagatcaccaggccttagrttctcgtaaggaacatgcaacctagatccctcgcatgcacagttcacattagggttcaaactcttgtgagaatctagtgcttcttctgatctgacaggag

SEQ ID NO: 58722 - DNA, 201 bp, Homo sapiens
tcttatgtcttcattggatcatagattattttctgatggctgttaagagatgatcaagtccagtcctattattttactgaagaagccaggccctgagctgkggggatggtgtgcccaaggtaatatggccggcaagctgcaagctggttgaggaccctggaccactccctttccaataccccttggccttatccacacatg

SEQ ID NO: 58723 - DNA, 201 bp, Homo sapiens
gttaataatgcatattgaagtgcaaatgaacctttaaattgaaaagggaaggcatcaatgccggtcaactcagttctcaatatttctctctagaaagcacygtgatggtttttatggaagagaaagcatcctggacttaaaatgcatgtatataatgaaaatggtgcgaaaaataatttcaaatatgtggaatccttgtga

SEQ ID NO: 58724 - DNA, 201 bp, Homo sapiens
ctacatacaaaaattaattcaagatggctaaagatgtaaatataatagctaaacccatacaactcttaaaaaaaaaaaaaaaagatatgtgtagatctttrtgaccttaggttaggtaatggtttcttagacatggtaccagaagtgtaagtagccaaagaaaaaaatagacaagacctcatcaaaattttgagcttcaaa

SEQ ID NO: 58725 - DNA, 201 bp, Homo sapiens
caactaagagttaatctagagtgagaggacactgaagccattcaaaatatatgtcacacaaaagctaaggaggtgacctggcagcgaggtttgccctcccrgatggcctggatggaagcctgatgcatcctttcctaagccacgtgcttattgaagatggcagcttctctgggggaggaacagggcactgtgagagctaca

SEQ ID NO: 58726 - DNA, 201 bp, Homo sapiens
aactctactaatgactgagagaagtgagattgtttactttaagcaacagtttatgagagctgaaatccacccccctcctccctcataagcaatacttcaastgagttgttgaactggaaattaatttgatactagtttgttctaagctcatgctctaacgagcttatatttctgtgtatttaatttgaaagtacatttaat

SEQ ID NO: 58727 - DNA, 201 bp, Homo sapiens
agactgcatctcctccactccccataatcaaatttcccaaccaaccacgtgatgcatggtgtgacaaccatgtcttgctgagttgcgaaattatctgtgtwttgacttatgttataaaaactcaatcacatttgtttaaacacttaatgagacatattgaaaaaaattaaatttcacgaaattgtcattgccttggaaaat

SEQ ID NO: 58728 - DNA, 201 bp, Homo sapiens
agacataagggtgaggaaaagaaagaggctatacagtttagcgcccttgaggcaatcagagagaggaacaggaatgcagtgttggaaggtctgcagagggytgtggccacagctggctggctggtaagggccatgcagtgatcaacaggtcagggggccctggggtgcaagcccctcttaggcatgatggctccctgctgg

SEQ ID NO: 58729 - DNA, 201 bp, Homo sapiens
tcagttcattcctgttccttgtcctcttggtcctcaacacctgagagttttaaacactctgtgaccagcttgagaatttctcagaggctgtttcagacagkgactacgggagtagtaatcctttggtaacctgaatataactgcagacttccacattgagcatgataaaatggtgtggatttaaaagtatttggggaactg

SEQ ID NO: 58730 - DNA, 201 bp, Homo sapiens
ggaaaagttgttctactggagtgggaaaatgcattaggttaagtaataagtatataaaatacatggttagaggtttttgaaaaggaaaagatgtaattttstggttatgcatgtttggggctctttttctgtgttgtgttttgttggtagaaatagaatgtcttggatcagcagaactaggcaaagacggcctggcctagt

SEQ ID NO: 58731 - DNA, 201 bp, Homo sapiens
caaaaaaacatgacagcagcaatttttacaagctcgtattctttacaagcagttgcaaagtaagtattttggtggctggtgtaactggtgtgtcaggtcastgatgtgatcggggacccaagcactttcttttatttctatctgcgatacgtagatgttgacttttgcctttatgcttacttcctcatggtctcatgatag

SEQ ID NO: 58732 - DNA, 201 bp, Homo sapiens
ttttattgaatcaggctggaaaacaaaaagaaatttgctgactcatctcctcttctgctcaagtcagcacacagggaattttcctaaatttaaagttatgyataaaataagaaccactttttgttggctatagtgtatagtgctatttttttctttaaatatctcaacaattggtataagctggttgactcagaagagtgg

SEQ ID NO: 58733 - DNA, 201 bp, Homo sapiens
agctgtgtaagccagtgtgttgttagcacttacaaggttatagaccatctggttaaatgcagctattcaagaagaaaaatttaaaccagggtttcttagcratgacactgttaacatttggactgggttattctgtgctggggagagggagggtactgtcctgtgcattgtacaatgtttagcggcacccctggactctac

SEQ ID NO: 58734 - DNA, 201 bp, Homo sapiens
ctgtattctgagcactgtaaatttttcttagttcattcctcatttctgtggagcacgttttccagtaacttcctgaggatgggtgttgggaagatacaacyttttttgataacttgtgaatatgtcagggatgctttcagctgcaaataacaaaaaaacatgacagcagcaatttttacaagctcgtattctttacaagca

SEQ ID NO: 58735 - DNA, 201 bp, Homo sapiens
ggtgaaacattcggtactgagagtgagagtagggagaatacttggtttttggtttttcccatcccttacgcaacctctattttacttccacactttctggragaactatcaacctcctttcaatatgatccaacacatcaggtagtctagccatgattttttttttcctgatgtcatctttcctagagcccctcatcctcc

SEQ ID NO: 58736 - DNA, 201 bp, Homo sapiens
atgtcttcattggatcatagattattttctgatggctgttaagagatgatcaagtccagtcctattattttactgaagaagccaggccctgagctgtgggratggtgtgcccaaggtaatatggccggcaagctgcaagctggttgaggaccctggaccactccctttccaataccccttggccttatccacacatgggag

SEQ ID NO: 58737 - DNA, 201 bp, Homo sapiens
ttctgatggctgttaagagatgatcaagtccagtcctattattttactgaagaagccaggccctgagctgtggggatggtgtgcccaaggtaatatggccrgcaagctgcaagctggttgaggaccctggaccactccctttccaataccccttggccttatccacacatgggagcggagaggcccgcatttgctgggtag

SEQ ID NO: 58738 - DNA, 201 bp, Homo sapiens
tgcaagctggttgaggaccctggaccactccctttccaataccccttggccttatccacacatgggagcggagaggcccgcatttgctgggtaggtggagmctacccagccttgctgaagggtagcttggccacagtcccaccctaacaagggcaggctcccggcagcaccttcctgtgggttttaaaacaaggcgcatga

SEQ ID NO: 58739 - DNA, 201 bp, Homo sapiens
tgggagcggagaggcccgcatttgctgggtaggtggagcctacccagccttgctgaagggtagcttggccacagtcccaccctaacaagggcaggctcccrgcagcaccttcctgtgggttttaaaacaaggcgcatgaccacaagttgcagagagaagccatgaggggcaggcatgaatctggggctagtacgtccacag

SEQ ID NO: 58740 - DNA, 201 bp, Homo sapiens
tgagtgagaacatgtggtgtgggttttctgttcttgtgttagtttgctaagaatgatggtttctagcttcatccatgtccccacaaaggacatgagctcawccttttttatggctgcatagtattccatggtgtatatgtgccacattttctttatccagtctatcattgatgggcatttgggttggttccaagtctttgc

SEQ ID NO: 58741 - DNA, 201 bp, Homo sapiens
gcctgatcttctgactgtcaacagctggcttgcttgcagaagaagtggtgtaatgccagtgaaggcaaacacaaagctgcaattttaaccaactgagaaawggaggtggaatcccacagtatgcctctcttctgcctctctccttcctctgaaggttgttctttcattcgcttgtttcatttgtctttcactgcccaagac

SEQ ID NO: 58742 - DNA, 201 bp, Homo sapiens
acaagttgcagagagaagccatgaggggcaggcatgaatctggggctagtacgtccacagcagcatctttgaggggacaggcaagacacttacatttgacrtaggctctgccacttgctgacaagttctactcaatttctgctttatagcagtctactttctaacttattaaagcctatcttgacagtcggccttcttatc

SEQ ID NO: 58743 - DNA, 201 bp, Homo sapiens
agacacttacatttgacataggctctgccacttgctgacaagttctactcaatttctgctttatagcagtctactttctaacttattaaagcctatcttgrcagtcggccttcttatctgaagcaatgagggtaggtggttgattcatcaaaacaagtcggttgaagcaggaaagcattacatgggagacatatactctac

SEQ ID NO: 58744 - DNA, 201 bp, Homo sapiens
agctagtataacattgtccatgaaatagcattgactgttgaaattatcaggctaaaagcaatatctgaactttcctccttcagacttgtacttcttcctcytctagaatgtgtgtggctgattgttaaataatgaaagtgtattagtataattgcagtaacgatggccctctctccagaagcacagtgccacggtgggaag

SEQ ID NO: 58745 - DNA, 201 bp, Homo sapiens
tttgtacgtgataaggttttgtaattgaagagggaaaaggatcgataacttccaatgcaaaagcaaattaaaacttcataaatatttatctgaggaaaatrgggcacttctgctgcttggttttaaatccttgtgaaacaggtgctagacagacagacactggggcttatcttttttttagaaaaaataaaagatgcatac

SEQ ID NO: 58746 - DNA, 201 bp, Homo sapiens
ttacatttgacataggctctgccacttgctgacaagttctactcaatttctgctttatagcagtctactttctaacttattaaagcctatcttgacagtcrgccttcttatctgaagcaatgagggtaggtggttgattcatcaaaacaagtcggttgaagcaggaaagcattacatgggagacatatactctacgcattt

SEQ ID NO: 58747 - DNA, 201 bp, Homo sapiens
gggtaggtggttgattcatcaaaacaagtcggttgaagcaggaaagcattacatgggagacatatactctacgcattttattttgccttaaaatatgaaastgtatatctggcagccatattttgatggcgggctgaggcctttaggattgatttactgaatgtcattgtgcatcgacttcctgatataaaccacccaaaa

SEQ ID NO: 58748 - DNA, 201 bp, Homo sapiens
agcattacatgggagacatatactctacgcattttattttgccttaaaatatgaaagtgtatatctggcagccatattttgatggcgggctgaggcctttmggattgatttactgaatgtcattgtgcatcgacttcctgatataaaccacccaaaaatgcatcatcaacaacttctagttcgtttctttttgtggaaggg

SEQ ID NO: 58749 - DNA, 201 bp, Homo sapiens
tgcaggaaggacacacggggacaggcttcaggaagtattagtggaaatcccatgcaccctgctaggattgcaggaaacaggattcctttgctcaggaaacrgggggcctgcctcggaccccagcctggcgtgggacccggcagtcaccagcctctctgagccttctgtctgaaggagacagggatgcgccaagcatctgtc

SEQ ID NO: 58750 - DNA, 201 bp, Homo sapiens
gccatgcacccgtcttctgagtttgttcctaaatgccacgttcccactgcttcagctcctggctggagcatgagctcctggagggaaaaggttgtctttcyctaatttttctggttctcttgccccgctctctcagctctgactcaggtatctggcaggaggagtctcatgggctcttggcattggaatgagccccaagtc

SEQ ID NO: 58751 - DNA, 201 bp, Homo sapiens
ggctctcgagctcttgaatgcagaatactcggaaaggtcttccttgctgttgctcagaccttgacctctgcagtcagaaagctcggattcaaaccttaatycggctggttactaagcggatgaccttccggacattcttgatctgcgttcatcttcatgtataaatttggatattaatagtacctggggttgttggaagat

SEQ ID NO: 58752 - DNA, 201 bp, Homo sapiens
agattaaaaactccttaatacagtgcctgggacatggccatcatcccaaataattactgttatttctgatgatattgtctgtattgtatcaatattatatrgatgggtattgtatggaccttgtagcctaaataatagttttctttgaagaatacgttgggttttttgcattggtttattgtaaaaattgggaaagacctt

SEQ ID NO: 58753 - DNA, 201 bp, Homo sapiens
ctaagatattgacacagccattttcacatcaacaatcacataaataaaacacaaaactttcccggttactgttttaaaaaattccaaaattgagttagagrctaacattttattcagaattgaggttaataaactaagttaaatgagcgcatggagattcttccctaatgaagctgaacaaagatgccagaggcttgagtg

SEQ ID NO: 58754 - DNA, 201 bp, Homo sapiens
tcattctcaggcactatcttagcatgggctgccatagcaaaataccatagactggttggcttaaaccatagaattttatttctcacagttcttgagcctgkaaagtccaagatcaatgagctgacaagattgatttttcctcctgaggccttttctcttggcttccaggcagtcattagcttgctgtgtgctcacgtgacc

SEQ ID NO: 58755 - DNA, 201 bp, Homo sapiens
tgtagtcccagctacttgggaggctgaggcagaaaactgcttgaacccgggaggcgggggttgcagtgagccgagattgtaccactgcactccaacctggygacagagtaagactacaactaaaaaaaaaaaaaaaacacgaattcaaactgacttaaagaaaaacaaaataatgtggagataggcttatgctactgaaaa

SEQ ID NO: 58756 - DNA, 201 bp, Homo sapiens
tcaaagtactttgtaaaggccgacatctgtgtggtagggtgacaaggtgtgaagtttaatgccttttaaaaatcttactggaaagacacccacctcttagkaaaggtgacagtcacggcagcagtgggagtcattgcaacagcttttgcatatggaatgatgtgtgcaggtgctgtgtggtgcattttatgcccacgatgt

SEQ ID NO: 58757 - DNA, 201 bp, Homo sapiens
gctctgtgactttaggcaaattaagtaacctctctggtcctgagttctctcatctataatctgaagttaagcctcctcagcttggagactggatcagatgrttttctggggctccatttccactctaagatgttcggcctcagtaattttctgcattcaagtatgttctcactttaaccagaggaatgcttaaactgatcc

SEQ ID NO: 58758 - DNA, 201 bp, Homo sapiens
tttatgcccacgatgtcatcccctccttatacaactctgaagaaggtggtatgattcttttctcacatacctaggacctgaggctcagggaagttaagtawtttgcctaatgtgatctcgctaagatttacacacacacaggtctgcctgtcccccaagaagctcttagtagcagctgtgcttgaactcgtggccatttct

SEQ ID NO: 58759 - DNA, 201 bp, Homo sapiens
acctcactcatccttgaggcttctctcatggagcctgtgccagctcaggccaggcaagaaccgcatctcattccctgcttatcccaggctctgccctggtycctacaagccctctgggaggaagagtgggacagtatgaggaggagagcagaagccctccccccacccaacccacaaagatctgctcaagcaaagtgagtc

SEQ ID NO: 58760 - DNA, 201 bp, Homo sapiens
atgatgcctcttttcgagggaaagaagcaaggcaggaagctgcagagtccaacagggagcgcggccagggccaggagcccgtgggatcgcaggagcatgcrtctactgcctcactgacactcatctgagccctcccatgacatggagaccgtgaccagtgctgctgcagaggaggtcacgcgtccccaaggcctcctgtga

SEQ ID NO: 58761 - DNA, 201 bp, Homo sapiens; identical to SEQ ID NO: 17048

SEQ ID NO: 58762 - DNA, 201 bp, Homo sapiens; identical to SEQ ID NO: 17049

SEQ ID NO: 58763 - DNA, 201 bp, Homo sapiens
atcagccgggcgcggtggtgggtgcctgtagtcccatctactcgggaggctgaggcatgagaatggcgtgaacccgggaggcggagcttgcagtgagtcgygatcactccactgcactccagcctgggcgagagagcaagactccatctcaaaaaaaaaaaaaaaaaaaaaaaaagaaatggtgtctcagaaaatgtacag

SEQ ID NO: 58764 - DNA, 201 bp, Homo sapiens
agccctggtgacttgggaagggcagcctgtctgggcttggttttattcaaggatctagctagagttctctgacttgtgtgttcaagatcatacctcctgtyactgaactcatggtttccaggctgaagtcctatgtctgccaggcctttgggattccatgactttggcagtgggtggatgctctggctaggaattccttaa

SEQ ID NO: 58765 - DNA, 201 bp, Homo sapiens
ggccttgttttattacatttcacagtgtgcttaaataccccctacagttcttcatctcattacaaaagacaatttacatgagggtaaaatggcgatgtcartgtgatttgttttgctgctggattttgtaaaacgttctgtatcagggctttcctgtagggtgccagagagacaagagtgaaactagggttcatttaaaaa

SEQ ID NO: 58766 - DNA, 201 bp, Homo sapiens
gctcgtttagcctccacttcagtgcaatgaggtagttgttatccctattttatagatgtgaaaacagaggctcaatgaagtacagataggctgctcagacwtaggcttcggacttgagttctcaccacacgcccaggtaaagaagagcctcctgggtctgccgaatctgtggcatctgctgtcaggagaaaaacaaaactc

SEQ ID NO: 58767 - DNA, 201 bp, Homo sapiens
agggcacacatgcagacatgaggttttcaatacgagactgaataagaatgggatcctagaggcgctgcctgtgaaatgctgagtcagcctcactaggtcarcaggctctgagggagggtctctgtgatctggggccagagggaggccccacggtgcccccatggaagcccacctagatcctgttggcgcactcagtgcccc

SEQ ID NO: 58768 - DNA, 201 bp, Homo sapiens
tctcggtccgtgtctttctttatacttggtactttttcaagtgctttgcacctatttgttaaacagttttttaaaatctaaacaaaaatcgatccttctaytccagatttggcggggtggaggcaggtgatgcttctgtttgaattttgaagtttaaataaatacaaaaataattcccctcttgtgtacatccttgatttc

SEQ ID NO: 58769 - DNA, 201 bp, Homo sapiens
tgctgcagtgtcagaatgttgacatcagcagacccctcaacggcctgaatgtccctcagccccagtcaactcagcgagtgcttcctcccctccaccgggcyccacgtgcacctagcgtccctgccagacccctgccagccaagcctgcacttaggcaggcccaggtatgctttcagtactaatatgataggatgtagttca

SEQ ID NO: 58770 - DNA, 201 bp, Homo sapiens
ctctgtaaaatggagataattcagctactcagatggttaaatgagataatccacataaagcagttagtttggtgcctggagtataataataagagtgtcayatattttaatttactagttataattttttaagtatttgaatagttagaccactcatgcaactaaacgatgacactattgagaatagcagagggactagta

SEQ ID NO: 58771 - DNA, 201 bp, Homo sapiens
acacagttttatatgctgctttgttttgccttaaaaattagtcccatttacaatggcattaaaaatcctatttaataataacactatacttgaatataaaygtttaagtacttgcaaattattgggcatgtattgatgtatcattttttgctgttagaaagttctagagaggtaaatcttgggacctctttattcccctag

SEQ ID NO: 58772 - DNA, 201 bp, Homo sapiens
agtcccatttacaatggcattaaaaatcctatttaataataacactatacttgaatataaatgtttaagtacttgcaaattattgggcatgtattgatgtrtcattttttgctgttagaaagttctagagaggtaaatcttgggacctctttattcccctaggagagattcttaaaagtaaaatattgggttgaaagattg

SEQ ID NO: 58773 - DNA, 201 bp, Homo sapiens
atctactttatctgatattattatatccactccagttttattttgattagtattagtgttgtctttttgcaatcatgaatgatatttcacaataggaaacrtcattcatgattgcagcaaacagaaatggttacttctaaaaacaggataaaaagcaaagtatgaatttttccatccttttaacatacctatggaattaca

SEQ ID NO: 58774 - DNA, 201 bp, Homo sapiens
tttccaagtggaaatggaagctggttactcatgttgagaaggttttacaaagagttggttggagttggggtaaacttctagatggaatggaggtgtggggrcctggcggggatgggggatatacattctcaacctaaagtgtttagattgagagacattgacagtcttaatgccagagaggcattaagagagattaagtgc

SEQ ID NO: 58775 - DNA, 201 bp, Homo sapiens
ggaacagggcagaaccttgcgagagcagcgaacaaggagaaccgcatttaggaaggggcaggcagggaagattgctgcagatactgtcattttggatgggrgttactaagagttggcgaggcagagaaagtgggaagaatgttccagaccaagataagaagggtggtggacttgggaaaccaaagggaggccacagagcct

SEQ ID NO: 58776 - DNA, 201 bp, Homo sapiens
aacttctaaggatcaacgtgtcttttaccagtcagtgttttgtgggattgggtggtgttggtggttttattttattttattttttttagagtagaaagaastcctcatatcctaaaatagcagcaagtcaataatgattctattatgtatgagtgcttttgccatatttttctcattctcagttattccattcattctaca

SEQ ID NO: 58777 - DNA, 201 bp, Homo sapiens
aagtcggctgaacttttttttaattctggaagttaaggaaatgccatttgaagatgtatcttgtaaagtatattttctattctaccttatgaactaaaaamcagatatattttaggtggtagaacttctaaggatcaacgtgtcttttaccagtcagtgttttgtgggattgggtggtgttggtggttttattttatttta

SEQ ID NO: 58778 - DNA, 201 bp, Homo sapiens
tggcaacaccctcacagacacacccaggaataatactttgcatccttcaatccaatcaagttgacactcaatatttactatcacagtactttttccccttytttctcacttgggaggaaaaatgcaataagcaagaagacgaagaaatagaggactagagaaacaggggttcaacaactgccaggtctgtttgggacttgg

SEQ ID NO: 58779 - DNA, 201 bp, Homo sapiens
ctggctggctggctggatggatggatgggtggctggctggctggctggatggatggacgggtggctggctggatggatggacaggtggctggctggctggmtggatggatggatggatggatggatggatggatggatgggtggctggctggctggctggatggatggatggatggatggatggacgggtggctggctgga

SEQ ID NO: 58780 - DNA, 201 bp, Homo sapiens
tgttcaagggcaggaaacattcagcacgggagaaaggtaaaggccagaaaactcagccagtctagtctttccacattcctctgcctgctttattctagccrcgctggcagctgattagatggtgcccacccagattgaggacgggtgggcctctcccagtccactgactcaaatgttaatctcctttggcaacaccctcac

SEQ ID NO: 58781 - DNA, 201 bp, Homo sapiens
tctttgagacataaaaagagataaaaacatacaaaagcaaaatgcactgtattctttaccataaaatatttcaaacagaagaaaattcctaggctaacttwccaaaagatttgccaaatgaatcaatgcaaacatatgtcacagaaacgtcctttccaatcaaaatctgagaatataagtaaattggtgtttctgttttca

SEQ ID NO: 58782 - DNA, 201 bp, Homo sapiens
ttgaaatttgggagtcataggaagttctcatgcagcagaatggcctgttcagttctgtgatttagaaagggtctctgatgacagaatggaagaaagattgrtaggaatattggtagacagaagacaggaagatttcttatgggcccattgtagttagtgaaaattttgcctacagaactgggccttggaatggtcagcaat

SEQ ID NO: 58783 - DNA, 201 bp, Homo sapiens
atatggtcatcttatatgtctggctattccatatgagatcttaaaatgttctgtttcccaggtgggagactttgaccccatactttgcattttcaaagttraattcaagggctttgtgatagccagcttccaaggtgatccttgcccttccaaggccctctcctttgtgaggcagggttggtctgggtcaccaatagaaga

SEQ ID NO: 58784 - DNA, 201 bp, Homo sapiens
gctgaactcctccttggcttagacttcacttcctcacaggcagccggttcttggtccttcccacccaaccccagtcaaggaaaggtccccctgctaaatgytctcaaaatgctatgtctctgtcagagcacttatcacattctaatcaactgtttgtcttctaggttagaatttaagctctgtggtgacagagaccacatc

SEQ ID NO: 58785 - DNA, 201 bp, Homo sapiens
tgaggagagagacttatcttttttattcaccactttttcctagagttgaccacagaagcttctgtgataaataccagtgatatatgtgtaggtggatagawgggcaggtgggaagacagacagacagatcgacggatggacagatggatagatggctggatggacagatggacagatggatggatggggctcacaccttga

SEQ ID NO: 58786 - DNA, 201 bp, Homo sapiens
aggttgggggacctcatctgacttagcaaggagatgaggttctgcctctgggccttggtttggaactgtttcctgtcctctgagtgtgtaattcctgggtyctggggcagcttcaggagatgccaaaccacagcagtctggactatggtggccttggtgacatgtcttcctccaggctctcttccggtcaggtggaatacc

SEQ ID NO: 58787 - DNA, 201 bp, Homo sapiens
cagccccgatatcttgcaggaccccctgctttgggctaggcggaagatgccaatctacatcagaagactctgagataccagctggtgtgaggaggggacaygcatacaccaggtcattttatttttaaagtgtaaagctgtgtgtccaaggagtcaaaggtatttggttcaatggttccaaataagtcggctgaacttttt

SEQ ID NO: 58788 - DNA, 201 bp, Homo sapiens
gcttccccctcaccttctgccagggttgtaagttttctgaggcctcccagccatgcttcctgtacagcctgtagaaccatgagccaattaaacctattttytttataaattatccagtctcaggcatttctttatagcagtgtgagagtggactaatagagctagttattagtagagccaagatttaaattcgagcttgct

SEQ ID NO: 58789 - DNA, 201 bp, Homo sapiens
ccttctgcctcaaagcaccaattaatacaagttcttcaccgagctgggtgggtaaaggaaacaggctgaaatgcatccagctttctgtgaaaccacttacraggtcatcagccccgatatcttgcaggaccccctgctttgggctaggcggaagatgccaatctacatcagaagactctgagataccagctggtgtgagga

SEQ ID NO: 58790 - DNA, 201 bp, Homo sapiens
cttccgccacggccaagaaaatccccttctgcctcaaagcaccaattaatacaagttcttcaccgagctgggtgggtaaaggaaacaggctgaaatgcatmcagctttctgtgaaaccacttacaaggtcatcagccccgatatcttgcaggaccccctgctttgggctaggcggaagatgccaatctacatcagaagact

SEQ ID NO: 58791 - DNA, 201 bp, Homo sapiens
gcctgtccctgaattgaggaaagacatgagtcttgaggaaaatccaccaaggaggtggataacttggaataactaaactaaacatactccaggacagcttmtgatgaaaatgcagaacaccaaggatgaactcttaaaaccacttgaggcaaaagagagatttgtacaaaataatgacaactaaaccaacaataaactttt

SEQ ID NO: 58792 - DNA, 201 bp, Homo sapiens
agcctgtccctgaattgaggaaagacatgagtcttgaggaaaatccaccaaggaggtggataacttggaataactaaactaaacatactccaggacagctkatgatgaaaatgcagaacaccaaggatgaactcttaaaaccacttgaggcaaaagagagatttgtacaaaataatgacaactaaaccaacaataaacttt

SEQ ID NO: 58793 - DNA, 201 bp, Homo sapiens
tgcagtgattcctcccttctctgcatgacaccaacacttttctttatcacttgtttgacacttggcacttgcaagctgatacctgcagccttccaggaacktggtggaatgagctgctgtagctctcccagcccaaagaaaacacatggaaatccaggataaaatataaacatttaagaatttttgctaatgcctggtcaa

SEQ ID NO: 58794 - DNA, 201 bp, Homo sapiens
atgctcacttcatttgttgctttaacaaatgtttactgtgtactctccatgatctgtcccacatgtgaatatggggattcagagagaataggacagagtcrctgccctctgggaaggaggaaggttacttgttttaaagagctgtgggtattttaaaaaggatgagcttgaggcaggctttatgcttctcccttatcactg

SEQ ID NO: 58795 - DNA, 201 bp, Homo sapiens
tcacagctgtgtataatttattctgtctatccgtgcagtgaaataaaatttttatttgcatcatctaaaagaaataccagtgtataaatacataagaaaasctcataagaaacggtcttctgactacagatattgctgaggggctgttgtgcagccaatgaaaaagctgagagatggcttgattatccatgtacatagata

SEQ ID NO: 58796 - DNA, 201 bp, Homo sapiens
ttaattatctttattaattaatctttattgatgtgttaaatcacttgctcattcacttcttcacctggttatttattcacaaatatgtgtttaataccagrcagtataattgaccctggagggagagtagtgaataagataaagttcctgtcctcttagaatttagtcaaggagcccaacactaagcagatcattacaaaa

SEQ ID NO: 58797 - DNA, 201 bp, Homo sapiens
ggagcgcttgttaaaaggggcaatgcctggcgccaccgctatttaaccagaatccccagccatagggcctgagggtctatatttttaacacattctgctasgagttatattcacactttacttagagagccactagccacatgtggctatttaaattaagtttaatttaaataaaattgaaattttagttccttgctcaaa

SEQ ID NO: 58798 - DNA, 201 bp, Homo sapiens
tttccatcatcatagaaatttctgttggacagcactggggctagcagggaaattccagcccattggatccttctgtgagaatttgggatatctgtcttagstgatgcatcgcccacaggaatgttctttcctacagggagtgaccacacctcttcagcttgcctaatgcctgcagtgtaaaaagccccatcccctgccttg

SEQ ID NO: 58799 - DNA, 201 bp, Homo sapiens
agatctttttaattgagctaaattttgtttcctgagtaagagctaaattcccttgagcttctcccctcatttcattctttgaagttgtatagacgttgaaraaggtcagaacaccatttttagagctttttgttcctcaacccgagttaacttgaaagtgcctaaactggttaagatcaacctttttaaaacaggcccctc

SEQ ID NO: 58800 - DNA, 201 bp, Homo sapiens
ctttcattgattgcttatgacaataaaactaactctctggaaagcttgaaagttttgttagaggcgtttgaaccagagcaactccatcttgaataggagcygggtaaaatgaggctgaaacctactgggctgccttcctagacagttaaggcattctaagtcacaggatgagaaggatgttggcacaaaatacaggtcata

SEQ ID NO: 58801 - DNA, 201 bp, Homo sapiens
agtatgtggcatatctttattcctcatcataggtagcatcatcattacaaagctgggcttcatcagggacttacagagagatttgtacacccacattcgtrgcagcggcattcacaatggccaaaaggtgggaacaacccaagtgttcatcgacagatgaatcagtacacaaaatgtggcatacatgaaatgaaattttat

SEQ ID NO: 58802 - DNA, 201 bp, Homo sapiens
tgccattagctagttttcttaacatgaagagacagctgcttagtggctatttctatgtgggctgagctcattcagtagagcagctttcccctctggagaasaagagaatgataagcgagcataaatcatgctaaaaggaacgactcctcatcatgagtcattaggacacatgccacattggcgagcagatgaaaaaccttt

SEQ ID NO: 58803 - DNA, 201 bp, Homo sapiens
ccacaaagatctgctcaagcaaagtgagtccaggagctgtcagaggagcagggttttctctggggggtgggtgttccccctcttagcccaagctctgccayacgagaagcagatgtcttgttctaatcttcaagtgggatgattcgtggacactgccattagctagttttcttaacatgaagagacagctgcttagtggct

SEQ ID NO: 58804 - DNA, 201 bp, Homo sapiens
ttgaaccgctccgtgggccaatttagaacacttcagaaagtgaaggtcctcttcgccgccccggatccctgctggtgtctgtctcctggccacgatggtayggaaatttgcagagcatgaccctctctgagcaagcagagaggagcaaatttgatctaacacacattctacgggtttggttcaatgtaggtcaatttttaa

SEQ ID NO: 58805 - DNA, 201 bp, Homo sapiens
catctcattccctgcttatcccaggctctgccctggtccctacaagccctctgggaggaagagtgggacagtatgaggaggagagcagaagccctcccccsacccaacccacaaagatctgctcaagcaaagtgagtccaggagctgtcagaggagcagggttttctctggggggtgggtgttccccctcttagcccaagc

SEQ ID NO: 58806 - DNA, 201 bp, Homo sapiens
atccaggcacatttcatggtagcctcagcaagaggaattgaaccgctccgtgggccaatttagaacacttcagaaagtgaaggtcctcttcgccgccccgratccctgctggtgtctgtctcctggccacgatggtatggaaatttgcagagcatgaccctctctgagcaagcagagaggagcaaatttgatctaacacac

SEQ ID NO: 58807 - DNA, 201 bp, Homo sapiens
tctgttctctgcctggaagtctctgcctccagctccagcctgcctggtagctccttctcagccttcaggtctcagcccagatactcagagcacagctgacygcctgtgtgaaataggcctgcctaaccctcagtctttcctagcattttctttctttccctttaaactgcatctcctcatttatgattctgcacttgtcgt

SEQ ID NO: 58808 - DNA, 201 bp, Homo sapiens
catttcaaaatccaggcacatttcatggtagcctcagcaagaggaattgaaccgctccgtgggccaatttagaacacttcagaaagtgaaggtcctcttcsccgccccggatccctgctggtgtctgtctcctggccacgatggtatggaaatttgcagagcatgaccctctctgagcaagcagagaggagcaaatttgat

SEQ ID NO: 58809 - DNA, 201 bp, Homo sapiens
tctgccctcgggctggtcatcacacaatggatacagcacttcactgctgagcactgcgtgcaccaatgggcagtgtagacgcaatgctacagcaagccagkagggagctgagtcgactccgggcagagcaggacagatgtgctgcctgagcttggcacggaaggatggaggaggagggcagggggcacggcagtggacacc

SEQ ID NO: 58810 - DNA, 201 bp, Homo sapiens
aatccacccccaccgccccccacctctcttttttgtaactctaagaaaatcacaatcctccagctccatttaggctaggggtccccaataccctctctgaygtgctctccccaacccttaggaactgggccacacagcaggggatgagtatctgatgagtgagtgaagcttcatgtgtatttacggctgctccccatcact

SEQ ID NO: 58811 - DNA, 201 bp, Homo sapiens
gcagagctgaaccttgaaaccaccttccaaggactatggatcctcatttgggcaaatcctttttagaaaacctagccagttagagatggcttggaaggcakccttgcctgaactgaacttggctacattaaactctgaggtgccttaaagaactttaaaagaaaactgattctgcttaacctattctgaatgtatccacaa

SEQ ID NO: 58812 - DNA, 201 bp, Homo sapiens
gattcttaacttaggcccccccaagaagcgctggtgtgtcccttagtggtaggcgttctattataaatccaaaacagcagccttggccaggtatgtgcacrgacagcccctgagggaatggctttatggcagagctgaaccttgaaaccaccttccaaggactatggatcctcatttgggcaaatcctttttagaaaacct

SEQ ID NO: 58813 - DNA, 201 bp, Homo sapiens
acctttgtagccattttattcggagcaaaatcacatgcccagattcttaacttaggcccccccaagaagcgctggtgtgtcccttagtggtaggcgttctrttataaatccaaaacagcagccttggccaggtatgtgcacagacagcccctgagggaatggctttatggcagagctgaaccttgaaaccaccttccaagg

SEQ ID NO: 58814 - DNA, 201 bp, Homo sapiens
cctttatcctggagagaaatccatcaatgaatggcccactgtcactgacatctgtcctttggttcttctctagggttctcgacagcattagatcttaatgyaaaatgctcccagttttgtattgttttgttttgttttttgaagcccagttgctgatcagatagtaaatcaactaagcacttggagaatcgttactgggaa

SEQ ID NO: 58815 - DNA, 201 bp, Homo sapiens
tatctgcaagacggtactgatgtctccctcgctcgaaattacacggtaattctggcacgttgggatcaccataatcttacaccactggatctgtgcttaamctttgtagccattttattcggagcaaaatcacatgcccagattcttaacttaggcccccccaagaagcgctggtgtgtcccttagtggtaggcgttctat

SEQ ID NO: 58816 - DNA, 201 bp, Homo sapiens
tgaagaaagggcatgaagcgggaatctgctttctgttccatgtgagtaacagaatacctgacccagagtgactcagcaatgaggagcttattgtctcacaracacagtcacccagaggtggcactgctaggtgaggctaatttagcagctgacagcacctgcatcctgggccagcctttctgcaattctctgggctttctc

SEQ ID NO: 58817 - DNA, 201 bp, Homo sapiens
tgagaatctaatgcctgatgatctgtcgctgtctcccatcacccccagatgggatcgtctagttgcagaaaaagcagctcagggttcccactgattctacrtgatggtgagttgtataattatttcattatatattacaatgtaataatagaaataaagtgcacaataaatgcaatgtgctggaatcatcctgaaagcatc

SEQ ID NO: 58818 - DNA, 201 bp, Homo sapiens
catcccctgcccccacccctggtccatggaaaaattgtcttccatgaaaccggtctcaggtgccaaaaagtttggggaccactgattgaggtgactcttckgagctaatgaataagggtgtaactgtgattcaacagcaaaacccaatctgacttccctggactctttctagagctgcttccgtatccctatcagaggaga

SEQ ID NO: 58819 - DNA, 201 bp, Homo sapiens
tctttctagagctgcttccgtatccctatcagaggagatgattgacagtgttaggatttggatttggatttgggtatcaggctgcttggagacaagccacstcagctcctccattctaaaatggagagtaagaccttcctcccaggttgttaggacaacacagtgatatggtttggatctgtgtcccatcaaatctcctgt

SEQ ID NO: 58820 - DNA, 201 bp, Homo sapiens
cagctcctccattctaaaatggagagtaagaccttcctcccaggttgttaggacaacacagtgatatggtttggatctgtgtcccatcaaatctcctgttyggttgtaatccccagtgttggaggtggagcctggtgggaggtgattggatcatggaagaggtttcttctgcgtggtttagcggcatccccctagtgctgt

SEQ ID NO: 58821 - DNA, 201 bp, Homo sapiens
ctcaggtctcatcatcttccttcctgcaagcagcttcctgtgactgcccctattcctgctttcctcacccatctttctcttcctccttcattttgatggtyagaccaggtcaatcccagtaccctgcctcgtcccaccctgcacctgctgctcttgtcacctgaaggtttagatacccccatttccattctccccagcatc

SEQ ID NO: 58822 - DNA, 201 bp, Homo sapiens
caggtcaatcccagtaccctgcctcgtcccaccctgcacctgctgctcttgtcacctgaaggtttagatacccccatttccattctccccagcatcagcartgggagggcccccaagtcacctgtgtgctgtgggtggaggtgggccaggaggtgcagtgcaattctgtaggcctgtggagcccagggaccacctgtttgg

SEQ ID NO: 58823 - DNA, 201 bp, Homo sapiens
gaagatgatacaaaaccaagcccccacaggagggttatctggggagacgatttatttagaaagagttattttcacagcccttctaaggccacttcttcagyttcaactggcctagaggattttgttggtcagtttcatggttttctttgaaaatctgacaggctccagtggagaagcctctcgtgctgtgtccacagccgg

SEQ ID NO: 58824 - DNA, 201 bp, Homo sapiens
attgattggtgtggcctttatcctggagagaaatccatcaatgaatggcccactgtcactgacatctgtcctttggttcttctctagggttctcgacagcmttagatcttaatgcaaaatgctcccagttttgtattgttttgttttgttttttgaagcccagttgctgatcagatagtaaatcaactaagcacttggaga

SEQ ID NO: 58825 - DNA, 201 bp, Homo sapiens
ttccagatgtgtaaaatacgcccccctccccgcccaccaacaaactaacatgtctgcattttactgttttcagagcagcagttctagttcatattgaataraaatgatgaagaccatttgaggaagtatgatgcatgcctgttactgctttacttaaacaaacaaaaaaacagcaaagaggatctagtgtgatatagggga

SEQ ID NO: 58826 - DNA, 201 bp, Homo sapiens
ggtcctgagttctctcatctataatctgaagttaagcctcctcagcttggagactggatcagatgattttctggggctccatttccactctaagatgttcrgcctcagtaattttctgcattcaagtatgttctcactttaaccagaggaatgcttaaactgatcctactggcagaaatcatgcttacaacactagatgag

SEQ ID NO: 58827 - DNA, 201 bp, Homo sapiens
agatttaaatgtctgagattcctcatctgggggaagtgtgtgctctagggacatccctcgccaacatgatgaagccagcatggagtaccccacctgtgggwtggaggcagggtgggaagtgcccttggcctgaggagtgggtggcatttgataaaagctagatgccttcatgatactcttatatataatggcaaccttgac

SEQ ID NO: 58828 - DNA, 201 bp, Homo sapiens
gacccagggtaatattttgtcgtgtattgcattacttaattaaataaacaaggtaattcataagaattaccctgcctagccgaagcataatgaaagcagcmtaaaatattcccaaccatcattctgactaaactatttaagcgcttatggaaaattagctgttagaattagccaaactcttttgtaacctaggaggctgga

SEQ ID NO: 58829 - DNA, 201 bp, Homo sapiens
taagtaattttacaatttgagaccatgatgcttattaaagatctctatttttcatgacccagggtaatattttgtcgtgtattgcattacttaattaaatmaacaaggtaattcataagaattaccctgcctagccgaagcataatgaaagcagcataaaatattcccaaccatcattctgactaaactatttaagcgctt

SEQ ID NO: 58830 - DNA, 201 bp, Homo sapiens
tttcacggaaacccactatctgcaagacggtactgatgtctccctcgctcgaaattacacggtaattctggcacgttgggatcaccataatcttacaccaytggatctgtgcttaacctttgtagccattttattcggagcaaaatcacatgcccagattcttaacttaggcccccccaagaagcgctggtgtgtccctta

SEQ ID NO: 58831 - DNA, 201 bp, Homo sapiens
aagccacaaggaaaaggtgctaactctagcctagtgctgtaagattgcttgttgcctaatgccagcagctttttaaaaatgcaatccaagtaagtaatacrttagaatgcctggacagcaaatgaactctaaagatttcataaatgtaatgaattactgcttcaatcaaatatgaaccaactaaccacccctgccacggtt

SEQ ID NO: 58832 - DNA, 201 bp, Homo sapiens
aaggccctaatgggagcttccttggattatctgttaaaaaaaaaaaaaggaggtcacaatcttgctaccctatagcctagacattcacaacaatgtatcartgcaattctgcactcatctttttatggtgtttttgtttttccgcagaggtctcattgccagcagtttcacggaaacccactatctgcaagacggtactga

SEQ ID NO: 58833 - DNA, 201 bp, Homo sapiens
aggagattttcccaaattggaaatctgcctgtactattcatggaagagtatatgtgtgtgacaaatgtgtgcgtttgcaagtgtgtgcacccagtgtgcgmatgaaggaatgaggtgggaggaagggagagagggagggttccacattgagtgtgtgggctattgttccgaggatgcatatctgactctgttgtctgagtc

SEQ ID NO: 58834 - DNA, 201 bp, Homo sapiens
cagttggtggagactgtgacttccaagcaggagattttcccaaattggaaatctgcctgtactattcatggaagagtatatgtgtgtgacaaatgtgtgcstttgcaagtgtgtgcacccagtgtgcgaatgaaggaatgaggtgggaggaagggagagagggagggttccacattgagtgtgtgggctattgttccgagg

SEQ ID NO: 58835 - DNA, 201 bp, Homo sapiens
ctgcttttagcatttcattgctgttctattctcttctgtgacatttcaatattttcagccagttctctcacctgccggggagccagcaggggcactgctgyggatcagaatgattttcccagcaggtggttcaaccattgattccagttggtggagactgtgacttccaagcaggagattttcccaaattggaaatctgcc

SEQ ID NO: 58836 - DNA, 201 bp, Homo sapiens
ttgtttttattatctaacaaaaggtctccctccctgtcctcctccatgaaggtacatagtgtagaggaagacggtgatagtttcttctaaatccacccccmccgccccccacctctcttttttgtaactctaagaaaatcacaatcctccagctccatttaggctaggggtccccaataccctctctgacgtgctctcccc

SEQ ID NO: 58837 - DNA, 201 bp, Homo sapiens
cagcgagactccatctcaaaaaaaaaaaaaaaatactatccatccatccttattaagagagaaaaggccttttaatctgtggggtgtttttgccgttttcrttttttacatttggacattgaagtgcttgatgccatactgcatattctgttcatctattcatgtttgttcatttgcttattcatttaacaaactgtgttc

SEQ ID NO: 58838 - DNA, 201 bp, Homo sapiens
cacagagatgaataacacacggttcctgcccttcacaaggcctaaatccaccaccgttttacacagtcgcaaaggataggcttgtctgaattgatttatarcaaatactcactatagggtatcactgaactagattgccaattaataggaaaattagataatatactgctcttcctatcccaatctttgccatgtctttac

SEQ ID NO: 58839 - DNA, 201 bp, Homo sapiens
agtgatcatcagttgggttgattgccccggtttagttctcagagagtgactttattccctcatgtgtggagaagatgtactttctctctctaacccatgcrtggatgatgaatgatagctcaaagcgtttgtagtagagaacaaaggaaatcaggacatcaaattcccacctaagtatcaaatattagaattgcattttcc

SEQ ID NO: 58840 - DNA, 201 bp, Homo sapiens
aatattttgctgtgtcagaccagatcaggtgcctgagaccttttgagtgaacaaagaaatgagtggcctttatttttgttagtaagaaagcatgtgatcgytcttttcagtaaacaaactttgcaaaaatattgaaaagagacttttttaagccacaagggctatagctcatattgtaaacgtattataactttgcagagc

SEQ ID NO: 58841 - DNA, 201 bp, Homo sapiens
gtaagaaagcatgtgatcgctcttttcagtaaacaaactttgcaaaaatattgaaaagagacttttttaagccacaagggctatagctcatattgtaaacktattataactttgcagagcttgactttcctctcaaagctccttgaagcttttttaagaagggtttttcgtctgtatcacatttgcttggatatctaagaa

SEQ ID NO: 58842 - DNA, 201 bp, Homo sapiens
ttcttacctctataaaatgaggatggttatatttccttgcccatctccacggttgatggatgcaagttatttcatgaagcgattgtagtattttatctgcratgtaaatttttatgcgattgtgtgacaggtcatatttccccattttcctttatagttgtggatagagttttatttaaagagtcaataaaatgtttttct

SEQ ID NO: 58843 - DNA, 201 bp, Homo sapiens
aaagttggtgaaaagaatagattatcacatgcttgagaagttcctctttgttctaagttgtattgagtcagatcgagttcctttgctaaactcagtgcaaytcctgcattctctcagcagcgaagaggccatctcaatacaaatggaacattttgatcgcagaacagaagaccatgtgcacgttccagggctacttaggtg

SEQ ID NO: 58844 - DNA, 201 bp, Homo sapiens
gtgtatccctctgtgctctgcatccttctgcctgttcctctgcagcttcgcccatgtcccctctcaaccccatccctccagttattcccctcaagtccccrtctctggttttcacatcccgcctctctgcttccctttggaactgtgctgtggaaaattcgttcacctcgcctgtcaccttgacctgggctcacctgctgc

SEQ ID NO: 58845 - DNA, 201 bp, Homo sapiens
agtccttacaaatgaaaccagatttttatactcagtagaattttccacactctcaatttgctgatttcatcctcttggtgctgtctagcctgttcctctgkgccctgtgttttctgtttactggtaggtaattcagtgtacaggcttgtgcagattgaggtactggttttaggcaggatgacattgcaggtggtcctcgtt

SEQ ID NO: 58846 - DNA, 201 bp, Homo sapiens
taactggccttaaggaaagtttcaacctctgtatgttcagaatgagggacctgcttgcctgtaaacatttattttgcttcctatttttgtttttactcttwtccccagtagtccaatttttctaaataagaagcagatgaagagcagcccattggttcctccaatctcttgtcctcagatgaaggtttctgggttcccata

SEQ ID NO: 58847 - DNA, 201 bp, Homo sapiens
acttatggagatggatgtcagtgatggttgtacaaaattgtgaatgtgcttaacgccactgaattatgcaattgcaaatggttaaaattataaattttatrttatgtgtattttgccccagttaaaaaacaaagctgggctcctggtttgtttttattatctaacaaaaggtctccctccctgtcctcctccatgaaggta

SEQ ID NO: 58848 - DNA, 201 bp, Homo sapiens
ggtcggcagcagttcaggtcacaggatactctggatctgaggtacccatggcaaggcagagccctggatgtgagcctgagctctgcccactgccagaggcrtgaattctggccaggtgcccggcctccaaggctcacttcccactcaccctatcccctgctcagtagaatgggatgaatcaaacttcctgcagcattcctg

SEQ ID NO: 58849 - DNA, 201 bp, Homo sapiens
ccttcctccactcagtttctccgccgtaaataatcgcccccatcaacttggtgcacagcgagaacttacttagtttaacgtacttagttttacagacttargttttcccgagttgtagccccttaaaatcgggcacctgtggctcccgtttgcacagtgaggactcacccagcaggtgcctttttaaaaatccggcaactt

SEQ ID NO: 58850 - DNA, 201 bp, Homo sapiens
ggataatcagctgtatcttgagcttttcatgggtccagacctctaaatctattgagtcgtgttctgctgtcgaacttagtgctcataggcttgggagttayggtaaaggaaaagtaaagaacttcttgttttacaaaatctttttcttggatcctctgtggtttgaaacctgcattcaatataacaatataggccttgttt

SEQ ID NO: 58851 - DNA, 201 bp, Homo sapiens
gctaataatgggaaattatttcttgtgtgtgtgggcgggggaggacttttactattttatgagttcagctttggtagagagagtgtttccttaagacagayatgacccaaaatagaaaaccagggaggcctaagcactttgaatgggttacctattgtgatatattccaggattcactgcttgtttacccttagattctca

SEQ ID NO: 58852 - DNA, 201 bp, Homo sapiens
gcaaatcattccctccccagccttcctgaacccagtaacaacctcctctgccttctccacatgccttgtgctgacatgcaggaagtcatccctgtgtcccyctttttactccgtaagccaccaacctcctaagtatattcccacctacccacttccttacatcccgaagtgtgcctttcccagtccaggccacattatagg

SEQ ID NO: 58853 - DNA, 201 bp, Homo sapiens
ttgaaaacaaaactctaaaaaatgacagaaccatgacgcaactgcagaaataaaattttcagggaaaaaagataaaatcacatgtgaatataccctcatayagctatttttatttttgcgtattttattgcaggaatatccaacagaatttttaaatattagagaatgcccccgttctaatttgattaaagaaagtcctct

SEQ ID NO: 58854 - DNA, 201 bp, Homo sapiens
taaatatttttaactatgtacattgctgcttcaaacaaaacagttctgtgagtaaaaacaaaggttggaatgtgtctctggcataccttgtataaaatatrtagataaacacacattcattcattccacccttgattgctagtttgtttaggtataaaattccaagaaagaaatcatattttctcagtattttataaggca

SEQ ID NO: 58855 - DNA, 201 bp, Homo sapiens
gccatggagaattccaaatagcatttataaaatggactaactacaaatgtactaatttataaaatatactgtcaagaccctgtaaagtattgatagcactrttaataacaccatttattaagcatctgctgcttatatttatcccatgcacatgtcatttctaatacttacagtgatgtccttgcaaacattcttgtcccc

SEQ ID NO: 58856 - DNA, 201 bp, Homo sapiens
tattttatctcagtcttccttttgcagaggctatactactgtgaagttggttggttcgtgtgtgtgtacacacacacatacccctaatcaatatctgatamtcttcatgtatttaactgttaagtaaatggtaccctactatatatgacaaccttctgcaactttttaaaaaatcaatatatattttagacttattcatat

SEQ ID NO: 58857 - DNA, 201 bp, Homo sapiens
ttgatgtgttaaaaaaaaaaaaaaagctctgttttacaaagtgtaccccactagctctttctttgccatggagaattccaaatagcatttataaaatggaytaactacaaatgtactaatttataaaatatactgtcaagaccctgtaaagtattgatagcactattaataacaccatttattaagcatctgctgcttata

SEQ ID NO: 58858 - DNA, 201 bp, Homo sapiens
ataaagcaggcagaaaaaaaaaatgtgaaaagactagactgacttagcctcccagcctacatttttctcctgtgctggatgcttctttcccttgaacatcrgactccgggctcttcagctttgggactcagacgggcttccttgctcctcagcttgcagacagcctattgtgggactttgtgatcatgtgagttaatactc

SEQ ID NO: 58859 - DNA, 201 bp, Homo sapiens
aggatctgctgccaactgaaaatcaatcacaaatgaagataaatcacccctgaacatataatatggaacaatgggaaaatattatcagaattgtaaaaatwtgatttgcatgcaatttttcagaaacatagctttgcaagcataaattgaaacaagcagagtgattcatataatggggggaaaatcagtctaagattccaa

SEQ ID NO: 58860 - DNA, 201 bp, Homo sapiens
aggcagaaaaaaaaaatgtgaaaagactagactgacttagcctcccagcctacatttttctcctgtgctggatgcttctttcccttgaacatcggactccrggctcttcagctttgggactcagacgggcttccttgctcctcagcttgcagacagcctattgtgggactttgtgatcatgtgagttaatactccttaata

SEQ ID NO: 58861 - DNA, 201 bp, Homo sapiens
tgacagagtctggggagaaaacagtcttaaaactaaagtgttaggatctgctgccaactgaaaatcaatcacaaatgaagataaatcacccctgaacatayaatatggaacaatgggaaaatattatcagaattgtaaaaatttgatttgcatgcaatttttcagaaacatagctttgcaagcataaattgaaacaagcag

SEQ ID NO: 58862 - DNA, 201 bp, Homo sapiens
gtgtgtgtgtttgtgtatgtgtagttctgtattttattcgtgtgtttttatatggttttatattaaatttgtgtatttctggccttgtggtgcttcttgartccaatcaattatttaaaaaaatgtagcaagcatctctttaattactgccttgccgtttttgcttcatcacttcctttggaacttttgttatatgtagtt

SEQ ID NO: 58863 - DNA, 201 bp, Homo sapiens
agttttctggaaatgcctaaaccccattctcacatttctcatcctgagccctcccttctctgctgctccagagtctgtctcccctttctcaccatctgtaycttctcctctcttccatgcaggctgtggttgccttcaaataccggcagtgcactgtgtggtcacggacccaagcatgaaccctcggctggttttccccga

SEQ ID NO: 58864 - DNA, 201 bp, Homo sapiens
ctgggccgagggtcccattccagaaagctgctattctagagtcaaaaatggtctgtgcatagccacctgtgattaactaggactccaagctgagtcataaygaacatcatagatactcttctcaaaaacgtttgctctcattagtggcccaatttcttcattttctaaaaatttggtgctttttcccatgaaacaaatgca

SEQ ID NO: 58865 - DNA, 201 bp, Homo sapiens
accaccccctgcccccccacacacacactcaacaactgtattttgcttttgttgctgataatgattaatgattataatcacaatcatgtcactgttattcmtagcagctcagtgtgactgaagtacctagtaccaaaaaatccttatttacgttatacttccatgtaattaaaagcttcttgtatttccaattagaaaata

SEQ ID NO: 58866 - DNA, 201 bp, Homo sapiens
tccatgtttacctgtgatggcccaagttacgcctgttgtcggggcacgtgtattatagtgtcccttctcactccaaatgtatctcagtgtggatgatagtyaccaccccctgcccccccacacacacactcaacaactgtattttgcttttgttgctgataatgattaatgattataatcacaatcatgtcactgttattc

SEQ ID NO: 58867 - DNA, 201 bp, Homo sapiens
gccccccaagatgcagaatttcccatccctagtttaacagtcacggttcactttgttttacgtgcgtttcgcagatgagtggtgctctcatcagcagacamaagacttctttggcctctgcttttttttcctttcttctaataaggagactacactctagataaacaaaacagacaggcgaatgtaatccagggttttggt

SEQ ID NO: 58868 - DNA, 201 bp, Homo sapiens
ctagactagatattccatagatatcagctcgctggatgcccccagcagccctgcaaggtggatgctgttgtgcacatgaggttgctgaagccccccccccsacccccaggtagaaagttaagcgagaagactagcatctgggccaaggcctgtcagatttgaaatccagtattctttgcatattcctctgctacctttcag

SEQ ID NO: 58869 - DNA, 201 bp, Homo sapiens
ggttgtcacattttatttaacatttttctgtgtttgtagtagaaaggctttctagctgtgtcaactcagtccactgtgttttcagaactagacatctctgrtaatgattctttgggtcttttagtcaacacatttgttggctgcctattgtaatcccagatttgtgccaggaactggggatacagtgttgagaagaacaga

SEQ ID NO: 58870 - DNA, 201 bp, Homo sapiens
taaacttttgaagtgattttagcctaaatgagtaaaaattcaattggggaatgaaatgactccttctaaaacagagctcaccttctgcaactacaaaggcaaaaaaaaacaacaacaacaacaaacttacatcaggctgatttgcaaatcacaagttttactttgttttatgctgctttcttacattgaacttggttattt

SEQ ID NO: 58871 - DNA, 201 bp, Homo sapiens
tggaagaatctcttatacgagatcataaaagtccacagccctttgtgatgtcaaaaccagacactggaaagagccagcaagagctctgtctcaccatgtgmacccagagctgggaggcagacctgtgtccacttctttctccccagatgtggacatcttgaaatcctgaggagcctgggaccctggccatggctttgtttg

SEQ ID NO: 58872 - DNA, 201 bp, Homo sapiens
gataaactcatagtaattttaaaagtacattccttaaagttgtaccctatttgttgttacaatacatttttcttttggtggtttgacttcagtcctttgtaaaaaaaaaaaaaaaaaaaacaaatcacacaatctaagctgggatcataaaacagtgaattaagttatcaaaggaataatgaaatttatgtttctgaagag

SEQ ID NO: 58873 - DNA, 201 bp, Homo sapiens
gagttcgtataagattgttattatttctctcttaaatgtctaatagaattattcagtgtagctatctgggcctggagattcaaaaaatacgtccatgtcayctgagttaacaaacatattggcataacatgtttcataatattttcttatcacttaatgcctgtattatctgtaatgacgtacccctctttaattcctaaa

SEQ ID NO: 58874 - DNA, 201 bp, Homo sapiens
attggtaaattatgatttttttctcatttttttcatcctgctaggaatttaacaattttatcaatatttgcaaacaaccaactttggtttcaaagattttyttttgttatttattttattgatttttgctacttattgttgcttttcttctagtttgtctttgatttgctctttagctgcttttggttgatccttacttag

SEQ ID NO: 58875 - DNA, 201 bp, Homo sapiens
gttttagtagatattcagttgactttcttgggtttcctaggtaactaatcatatcacttataaataacttttcttttctaacatttatttccctgaaatgttattgctttattgcagtgtctcaaacataaagaattgctataaaaatgtgtacaaacagcaataattcctcttttgttttgggttttaatggaaggctcc

SEQ ID NO: 58876 - DNA, 201 bp, Homo sapiens
tcacttataaataacttttcttttctaacatttatttccctgaaatgttattgctttattgcagtgtctcaaacataaagaattgctataaaaatgtgtayaaacagcaataattcctcttttgttttgggttttaatggaaggctcctgatatttcaccattgattttaatattgactgttgatttaagatgtgagttta

SEQ ID NO: 58877 - DNA, 201 bp, Homo sapiens
gcggcctccatgctgcctgctcagcagctgcacgcccaggaacatggtaacactggcctgcttccagcaacacgatgcagccatcacagctgctctgcacrcgctgacagggtgaatgtgtctagagggaaaaagaaaaaggatgaagtcattgctagttccatatgggtggatgggtggccaccccttgggcttgtattc

SEQ ID NO: 58878 - DNA, 201 bp, Homo sapiens
gctcctgatatttcaccattgattttaatattgactgttgatttaagatgtgagtttatgattttaagaacctatttctagttttcaaatagatttttttwaaaaaaaaagtattggatactgaattttattaactttttttagacatgtacagaggtaccatatcttgtctctctctttttaaatcttgtgacctgataa

SEQ ID NO: 58879 - DNA, 201 bp, Homo sapiens
agagtcagacataagacatctggcaagggctggctgttggcatcagcaacttggggcaggatcctcaggctaagggtcccctgcagccagggcggcctccrtgctgcctgctcagcagctgcacgcccaggaacatggtaacactggcctgcttccagcaacacgatgcagccatcacagctgctctgcacgcgctgacag

SEQ ID NO: 58880 - DNA, 201 bp, Homo sapiens
catgtacagaggtaccatatcttgtctctctctttttaaatcttgtgacctgataaaaatattaattgacttattgatataaatattcattcatggatttycccttatcaaaatattcttatatttttgggacacatcctgctctgtcaaggtgtatcatatttttaatatgctgctgaatttaattccctagtgttctaa

SEQ ID NO: 58881 - DNA, 201 bp, Homo sapiens
tcccacctgatcatgatgaatgatccttttaatgtgtttttgaatttggtgtgctaggtttttgataaggatttttgcatgtatgtttaacaaggatattggcctgtaattttctttacttttttttttttttttgagacggagtctcacggtcacccaggctggagtgcagtggcgcgatctcggctcactgcaggttcc

SEQ ID NO: 58882 - DNA, 201 bp, Homo sapiens
ctgttcacatcaaatgatggcaaggtggtgtggcacatgtgtgttgaatgagatgatcatgtctgctagtagctgatgagaagggatcaggtgcaggctarcgaagggggatgtttttagtaagaagaacatcttctgttccctgggacgaggtatcttaaataaatccgttgtcaccttggaaagcaaagcctccccagg

SEQ ID NO: 58883 - DNA, 201 bp, Homo sapiens
ggatttaattgaaaacacatgagggaaagaattccaacaaggcctagcatggtagaaggacagcttgcggggcaggagccgggagtgggagaccccatgtrtgtttgtgtagctccggtgcataaatattttgtttcatgtctaactccaaaaggcgcaagtgcaagaaaacatccccattctacagacacccaatgatgg

SEQ ID NO: 58884 - DNA, 201 bp, Homo sapiens
ccgaggcatcggagcagctgcctctcccaacccatggatactactgctgctggcatagccatttgtgctgggtcatgcctgaggctgcccagaggccctgycctggggcagctcctgatagccctcgaggcggtgtggttgagtgggaagaacacaggccttctagtcagatctgtgctttcagtctccacgcagaaactg

SEQ ID NO: 58885 - DNA, 201 bp, Homo sapiens
acctggaaggaagtgtagaaccttgggtgttccttctgtttacgtctggctccagggagtcccgaggcatcggagcagctgcctctcccaacccatggatmctactgctgctggcatagccatttgtgctgggtcatgcctgaggctgcccagaggccctgccctggggcagctcctgatagccctcgaggcggtgtggtt

SEQ ID NO: 58886 - DNA, 201 bp, Homo sapiens
tgtacatgtctcaactgaccagagctcagttggtgactttattaaaaattctgggaaattatatttgcacttaaattggtttcagggaggaggagcagagrtcaaagttcacaagttaagaccatgaattataatgtgctgcagatggctgcattctggggcccaggtgtttgctattaacaatggaaatggcctactaag

SEQ ID NO: 58887 - DNA, 201 bp, Homo sapiens
ccagctgttctgttcaccagctgtgtgaccttgaacaagccttggtttccccctctgcaaaatgggcataagaatacctaccttggtgagttgatgtggakttaggtgaacaacatagttagaaggaatacgtgtccatgtttacctgtgatggcccaagttacgcctgttgtcggggcacgtgtattatagtgtcccttc

SEQ ID NO: 58888 - DNA, 201 bp, Homo sapiens
aggcagcaggcagaaaagatatcctggaatagagtccagtctaaaccgatctcagaagaattaaatacaggctgggcagaccgctccctgaaaattcctayctcatactgtgggaaaactggatttctcttggaagagatttctgcctgaaaaggtgttttaagagggtaaaatgaactgcaattttcagtgaaaaaaatc

SEQ ID NO: 58889 - DNA, 201 bp, Homo sapiens
attgtctgacaaccctctgtacacactgccagtaagaattttttttaaccttaatctataaaatcttactgcatttaatcactggatttacatttggtttrttttatacttgcaaagaaaacagccacttttatttaaagaaaagaggaggcttgaacatatcagaagcttcagctacatgggtgggaggcctggcccatg

SEQ ID NO: 58890 - DNA, 201 bp, Homo sapiens
cctctttgggaatttatctcatgattagacgggggctgtgggttttgaagtggaagatcacagatggaagtgggactgtcatcacatcacgtcaagggtcrtaccatccacaggacttatctctgttgatgttgaccttgaccatctggctaaagcagggtttgtcaggtttctctattataaagttacttttttcagctt

SEQ ID NO: 58891 - DNA, 201 bp, Homo sapiens
tcttcattgtgtgaaagctttttagtttgatgtaattccatttgcttatttttgcttttattgcctgagcttttgggacaaatctaaaaaaaaattgcctrtagaccaacatcatgtagattttctttgtttccttctagcaatctagtttcagattttatatttaaatctttaatccagttttagttggcttttttgtat

SEQ ID NO: 58892 - DNA, 201 bp, Homo sapiens
tccctccaccggaagcccctgcccacctcctggttcctctccctccaccggaagcccctgcccgcctcctgggaaggggaggctctgagggcatctgcacrtgtgatcacttgggtaaagaaatccccaggctccctgcagaagtgtttccattagcgtggtcatctcaggtttttctcttttgttttgttcttttcctgg

SEQ ID NO: 58893 - DNA, 201 bp, Homo sapiens
atgatccttttaatgtgtttttgaatttggtgtgctaggtttttgataaggatttttgcatgtatgtttaacaaggatattggcctgtaattttctttacttttttttttttttttgagacggagtctcacggtcacccaggctggagtgcagtggcgcgatctcggctcactgcaggttccaccccccggggttcatgcc

SEQ ID NO: 58894 - DNA, 201 bp, Homo sapiens
aggtttgcgtctttgcctaaccagggccttagggtaggctttgaggttaagctgagtgctgtttgaagttttgggtgttgcagaactagctcttgctcttyaccaaaatgtgtagtcgtggggagctctctccccaggtggagccttcaagtagagcctaaggctgggcctggaagatggctgttgggattcaagccaggc

SEQ ID NO: 58895 - DNA, 201 bp, Homo sapiens
gctcccatctccctattttgcctcccctccaacataaaatgagtacagatttagaatttcattggttaaatatatctttgagtattcattaaaaaaaaaacaaactttagcagtggttactcaaaatcttgccatagtcagttctgcagtatccactaaaagacttagatttttatcaaaatttctttccccctaaagtct

SEQ ID NO: 58896 - DNA, 201 bp, Homo sapiens
tagacaccaaaccagtaaaggagcaggatttgatggagggaggatgaagtatcaatgaaaaaataagtctaagtaaagaaatgcaaatatctttttctttaaaaaaaaaaaaaaagcttgttaacattataaaaaacatttcaaatatggcatctcaagtttgaattggttaacttcctttagggatttggaattttctgt

SEQ ID NO: 58897 - DNA, 201 bp, Homo sapiens
attgacaaggcaggccaacattcaaattcaggaaatacagagaacgccacaaagatactcctcaagaagagcaaatccaagacccataattgtcagattcrccaaagttgaaatgaaggaaagaatgttaagggcagccagagagaaaggtcgggttacccacaaagggaagcccatcagactaacagctgatctctcagc

SEQ ID NO: 58898 - DNA, 201 bp, Homo sapiens
tgccctctctcaccactcctattcaacatagtgttggaagttctggccagggcaatcaggcaggagaaagaaataaagggtattcagttaggaaaagaggragtcaaattgtccctgtttgcagatgatatgattgtatatttagaaaaccccatcgtctcagccccaaatctccttaagctgataagcaacttcagcaaa

SEQ ID NO: 58899 - DNA, 201 bp, Homo sapiens
atctaattaaactaaagagcttctgcacagcaaaagaaactaccatcagagtgaacaggcaatctacataatgggagaaaatttttgcaatctactcatckgacaaagggctaatatgcagaatctacaaagaattcaaatttacaagaaaaaaacaaccccatcaaaaagtgggtgaaggatatgaacagacacttctca

SEQ ID NO: 58900 - DNA, 201 bp, Homo sapiens
ctttttgctttcacttagatttttcaaaaggatgtttatcttaattctactttttgcacctcagattgattctccattttaaagttcatgtaggtgttgayaatgatttccctttcaagccagaactccaggtgtgatatttaagtttctcttgactaatgatctcatcagagtttattttctcaatggcccactgggtgg

SEQ ID NO: 58901 - DNA, 201 bp, Homo sapiens
caggctagatggtagcacctccagcttggctgaacaggctcaatagttagcctttcagacttaggaagcatctattttacattagcttccaagccagccartggtgtttcctcttaagaatgtaatgactaaaatacctactgtggaatagatatcatcatatgacatgcacagtggctcatggttggaacactgttccca

SEQ ID NO: 58902 - DNA, 201 bp, Homo sapiens
tttataacccctagactagatattccatagatatcagctcgctggatgcccccagcagccctgcaaggtggatgctgttgtgcacatgaggttgctgaagccccccccccgacccccaggtagaaagttaagcgagaagactagcatctgggccaaggcctgtcagatttgaaatccagtattctttgcatattcctctgc

SEQ ID NO: 58903 - DNA, 201 bp, Homo sapiens; identical to SEQ ID NO: 17044

SEQ ID NO: 58904 - DNA, 201 bp, Homo sapiens; identical to SEQ ID NO: 17046

SEQ ID NO: 58905 - DNA, 201 bp, Homo sapiens
ctccttaaaggctccccacaggcctgcctcctccctgaagctttccctgaccacccagactccactgaccacacggcatccatatctcattaaccacatartcaggaccatccagccacacacagcatttcttctcttgtgtttggtttgttgaagggagacaactacctaaattaagtcacattcatccagaggcacggc

SEQ ID NO: 58906 - DNA, 201 bp, Homo sapiens
taatattaataacatgaataaagagatattttttcttactacaaatgtaaactgtttatcaaggtcttttaagagacattctgtttataatcattgatgcrtgaaagaatgtaaaacaatctggcaactaaaaaccaagacattcaatgacacaaaagaatcagaagaatattttttaagggtgaattccttgaattttgt

SEQ ID NO: 58907 - DNA, 201 bp, Homo sapiens
tcctctttgtccccatcctgtggaatttctgttctaaatatttttaatattccttatcttcctccctagtcctaccactatttgtctagttctaaccctcrtcattttcacctgggctccagtcatggctgcctaactatataatatgtcatcttcacaagtcactcgttttgctgcacatgtgccagctgagcatgtatt

SEQ ID NO: 58908 - DNA, 201 bp, Homo sapiens
ggtgggcaaagtttctgtttgggatgatgaaagacttatggagatggatgtcagtgatggttgtacaaaattgtgaatgtgcttaacgccactgaattatrcaattgcaaatggttaaaattataaattttatgttatgtgtattttgccccagttaaaaaacaaagctgggctcctggtttgtttttattatctaacaaa

SEQ ID NO: 58909 - DNA, 201 bp, Homo sapiens
aaatattatgcgattctatttacatgaggtgtactttgaataggcaaaattcgaataggcaaaatcatagaaacagaaagtagaatggtggttaccggggsctggagggttagggagtgaggcgtttggtgggcaaagtttctgtttgggatgatgaaagacttatggagatggatgtcagtgatggttgtacaaaattgt

SEQ ID NO: 58910 - DNA, 201 bp, Homo sapiens
tgttctagcacttccttcctttctggcactgcaagctgcactgggttcatctggtatatttcctgtacctgtcctaaagtcagccatttctccacgagccygattccttggagaatggtattagagactctaggtactagataggctcactgctactgggcagtcattgcttctaggccttctcagctgacagagtgtggg

SEQ ID NO: 58911 - DNA, 201 bp, Homo sapiens
gtatacctcttaaaatgtatttgtctgtcatgggggaacacattataccacttggaaaatgctattttagctattgtagacttttaacaattttcttttcttttttttttttttttttgagatagggtctcactctgtcaccaatgctggagtgcagtggcacaatcagtgcaccatcacccctggctaatttaaaaaatt

SEQ ID NO: 58912 - DNA, 201 bp, Homo sapiens
cgtcgtctcattgcagctgtacagaaaatgcaaaccgtggtcttgacgcttatacttcacttctggtcaccaaacgtgggttttttttttttttttttttcccacaccaaccaattctccaactttggacaccagttgggtgtcctacagttcagttatgatgctgactacctggagttagcaccgaccccacaggcaaag

SEQ ID NO: 58913 - DNA, 201 bp, Homo sapiens
ggcattgccaaataaaatataggatgcccggttaaatttaaatttcagaaaaccaatgaggagtctttgagtatatctcatgcagcttgtgtgcgtgcaggtgtgtgtgtgtgtgtgtgtgtgtgtgtgtgtgtgtgtgtgtgtatttgtgtgtatgtataatgaggaagacccataacccactaaaaaggtgggcgggag

SEQ ID NO: 58914 - DNA, 201 bp, Homo sapiens
gcattgccaaataaaatataggatgcccggttaaatttaaatttcagaaaaccaatgaggagtctttgagtatatctcatgcagcttgtgtgcgtgcaggtgtgtgtgtgtgtgtgtgtgtgtgtgtgtgtgtgtgtgtgtgtatttgtgtgtatgtataatgaggaagacccataacccactaaaaaggtgggcgggaga

SEQ ID NO: 58915 - DNA, 201 bp, Homo sapiens
cattgccaaataaaatataggatgcccggttaaatttaaatttcagaaaaccaatgaggagtctttgagtatatctcatgcagcttgtgtgcgtgcaggtktgtgtgtgtgtgtgtgtgtgtgtgtgtgtgtgtgtgtgtgtatttgtgtgtatgtataatgaggaagacccataacccactaaaaaggtgggcgggagat

SEQ ID NO: 58916 - DNA, 201 bp, Homo sapiens
aaatgtatgcaactcccagggttctgtcttctgtctgcttgttttttactgcattgcatctctggaccctttcagaatactccaaaatatcatctatcacttttttttttttttttgagacagagtctcactctgtcacccaggctggagtgcagtggctcagtcttgtctcagcacatcctccgcctcctgggttcaagc

SEQ ID NO: 58917 - DNA, 201 bp, Homo sapiens
aggaatggggcttgcaacaaacacataactagtctcccatgtcatgtttcctgcccaagttgcatgggcaagaaagctaaagagtacgcttctagtttgcaaagataaaactgaacttcatctgtagtcttttgtagtgtttgtgggccaaaaagacagatactccagatcctaaattaaaagcctaggatggtcaccgtc

SEQ ID NO: 58918 - DNA, 201 bp, Homo sapiens
aagaaagctaaagagtacgcttctagtttgcaaagataaaactgaacttcatctgtagtcttttgtagtgtttgtgggccaaaaagacagatactccagaycctaaattaaaagcctaggatggtcaccgtcaaggaaccatccttgaggatgagccttactaaggcttggactgagccttactagaagtgcagcccaacc

SEQ ID NO: 58919 - DNA, 201 bp, Homo sapiens
gttaaatgcagctattcaagaagaaaaatttaaaccagggtttcttagcgatgacactgttaacatttggactgggttattctgtgctggggagagggagrgtactgtcctgtgcattgtacaatgtttagcggcacccctggactctacccactggttgccagtagcatctttcaccctgttgagacaaccaaaaatgtc

SEQ ID NO: 58920 - DNA, 201 bp, Homo sapiens
gagaatcgcttgaacctgggaggcggaggttgtggtgagccgagatcgcgccactgcactccagcctgggcaacagaacagagtgagactctgtttcaaaraaaagaaaagaaaagaaaaaaatacaaaaattgtcggatgtggttgtgcatgcctggaatctcagctagttgggaggctgaggcatgagaatcgcttgaa

SEQ ID NO: 58921 - DNA, 201 bp, Homo sapiens
tggaggacccactgtggacgggccaggagacgcccacgctctgtgaagtgctgccttcgcacaatctcatggaagggaagtaaccctcagacaccacctcyctactcctgtcttgggccagaattgcttacatgttcttaattttccatcattttgccttgattttgaaagtctttggggaatttcaatggaaaatgagca

SEQ ID NO: 58922 - DNA, 201 bp, Homo sapiens
aaggaaatagcagacaaactcaaaattgttttaataaaaatgggtggccgggcgcggtggctcatgcctgtaatcccagcactttgggaggccgaggtggrcggatcacgaggtcaggagatcgagaccatcctggctaacacggtgaaaccccgtccctactaaaaatgcaaacaaaaaattagccgggcgtggtggcag

SEQ ID NO: 58923 - DNA, 201 bp, Homo sapiens
cccagactccaggcctttcaggccctgaccttgacattatctgccaggatttcccctctccttccaccctgtcctgggcctggccgactcctgctccatcrttagggcccagtagttgtcggatccctacgcaaagcctttcccttgcaggatgctccacccaaagcacatccacgcacccagaagtgttactgctggagg

SEQ ID NO: 58924 - DNA, 201 bp, Homo sapiens
gtggccgggcgcggtggctcatgcctgtaatcccagcactttgggaggccgaggtggacggatcacgaggtcaggagatcgagaccatcctggctaacacrgtgaaaccccgtccctactaaaaatgcaaacaaaaaattagccgggcgtggtggcaggtgcctgtagtcccagctactcgggaggctgaggcaggagaat

SEQ ID NO: 58925 - DNA, 201 bp, Homo sapiens
atgaaattacgctcctcagggtgtgagggggcccaagcataggtgctcaagatccccgttacagaattttctgggatttaaataccctctagaggtttccrttggttacttcgtgtgcgccctatgtaaatgaaggggatgaggtaaagttacaaagtcatttaatcgctgtacgccctatgtaaatggagaggatatttc

SEQ ID NO: 58926 - DNA, 201 bp, Homo sapiens
aaagcattgagctcctctttggattccaggatctgaggacaatctgcacagtaacccagaaaggcaatcccatttgttgctgggagatcactgttccaaawccaacgtgtttgcttatgccccagaagatcaaaagttgtaaaagccaggctagcagttgtcagctctgctgatggcagaggtcgtgttggagcctgttgg

SEQ ID NO: 58927 - DNA, 201 bp, Homo sapiens
tgcatgttatgtaagacattggaaaataatttaaaatctaagtaacccatgctttgcaatctttaatgaagttctggtagactgcatacagttttattaatagttagcataaacggggtttcctccccctttcaatttatcttagaaattcaatatttcaggatgtgcaaaatcatttttcctcacctcatacatacatcg

SEQ ID NO: 58928 - DNA, 201 bp, Homo sapiens
gcatgttatgtaagacattggaaaataatttaaaatctaagtaacccatgctttgcaatctttaatgaagttctggtagactgcatacagttttattaatagttagcataaacggggtttcctccccctttcaatttatcttagaaattcaatatttcaggatgtgcaaaatcatttttcctcacctcatacatacatcgc

SEQ ID NO: 58929 - DNA, 201 bp, Homo sapiens
tgagtggagattgtgccattgcactccagcctgggtgacagagcaagactccatctcaaaaaaaggcaggcaggaaactgtgactgacaagagaaaaaaayagagccaccaatatataaatattgaaattagctgagaaggacttgaagctaattagcattggtgtggtaaaacagcaaaaacgaaaaacaaaatctctga

SEQ ID NO: 58930 - DNA, 201 bp, Homo sapiens
catgttatgtaagacattggaaaataatttaaaatctaagtaacccatgctttgcaatctttaatgaagttctggtagactgcatacagttttattaatagttagcataaacggggtttcctccccctttcaatttatcttagaaattcaatatttcaggatgtgcaaaatcatttttcctcacctcatacatacatcgct

SEQ ID NO: 58931 - DNA, 201 bp, Homo sapiens
ttccataattttgttttattttgtttttctttattaacagcaagcaataggccaccaaaaagtccaggcatattggggacaaaagagtgtgcatggttttyatggtaaaggatagagtcccccagagttattgagaagacatttattaacttttcttattcaggtaactatgattgtcagtttggatgaacttcttatgag

SEQ ID NO: 58932 - DNA, 201 bp, Homo sapiens
atgttatgtaagacattggaaaataatttaaaatctaagtaacccatgctttgcaatctttaatgaagttctggtagactgcatacagttttattaatagttagcataaacggggtttcctccccctttcaatttatcttagaaattcaatatttcaggatgtgcaaaatcatttttcctcacctcatacatacatcgctg

SEQ ID NO: 58933 - DNA, 201 bp, Homo sapiens
atgatcatgtaacagtttttggatttccttattccattgcaactttaggtaagaccctactgtatacttagggagaatacacacaggcacacacacacatmcacacacacacacacatctacacacaattttgtttatacaaaatttcttctagttaataatgcatcagaaatcttttctgaactattttctctgaaatca

SEQ ID NO: 58934 - DNA, 201 bp, Homo sapiens
tgaatgccaaggctgcagcctgaagcatttatttagtgccggagagggatctagttattttagagttcccttgaatgcaatattttaattttgttgttctkcttgaaaaattagatccctctgagcttccagtattgatggttgagatgaatgactttggctctggctgaccatggtctttggaaggataatctcagagtt

SEQ ID NO: 58935 - DNA, 201 bp, Homo sapiens
aggatgcatatctgactctgttgtctgagtctcctctgaattctccccggagaacctaaactgggaaggccctaatgggagcttccttggattatctgttaaaaaaaaaaaaaggaggtcacaatcttgctaccctatagcctagacattcacaacaatgtatcaatgcaattctgcactcatctttttatggtgtttttg

SEQ ID NO: 58936 - DNA, 201 bp, Homo sapiens
ggtattttgtgttcattatgggtgaaatgatttaaagtcaagtttggatcagcctccaatcgcacacattaaagaagggtagcacgacatggatagcaccaaaaaaaaaaaaaaaatagggaaatcaatctaatcagccaatcaatcaatcatcactttttgcacatctgtttgtacagccagttcactgggatgccctag

SEQ ID NO: 58937 - DNA, 201 bp, Homo sapiens
ccagtcatagaagaatggacaaagtatgaggccatttttgtaaggttcaaaacagggtaaaactaaacagtgtattgcttaggaatatgtacactagaaayaaaactgtagaggaaatcaagataatgattaatagaaacttcagcataatggttaccactggttgggaataagggaaatgtaataatgaatttagcatga

SEQ ID NO: 58938 - DNA, 201 bp, Homo sapiens
aattgtacttatacattttatatactcttggatgtactttcccaattaaaataatagagcagcaattactgccaaaacatttctggcccattgattagcakttaattgatttattcagcaggtacagttctttaagcattcaataaaagacacagttccattagggtaatcaatatatcatttttaagaaaaggaatgccg

SEQ ID NO: 58939 - DNA, 201 bp, Homo sapiens
cagcttgataaattcaaggagccatctgttttcctctgctgagcctcgttgctgatggtttatgtcattgatgatactacttgtcagtcactatctggaaraagttcccatatttcaacctctcccttaaaagactcttcaaccctggattcttggagtctccatctatgtctatccaggccctgggataaggagtaatct

SEQ ID NO: 58940 - DNA, 201 bp, Homo sapiens
actcatgcaatgctgaccaggaagaatgaggtctccttgagtttgtggtgcctgttctgtgggatgacccaactctccctccactcttgtcttcttcttctttttttgtttttttgagacgaagtttcgctcttgttgcccaggctggagtgcaatggtgcaatcttggctcactacaacctcggcctcccgggttcaagc

SEQ ID NO: 58941 - DNA, 201 bp, Homo sapiens
caatgctgaccaggaagaatgaggtctccttgagtttgtggtgcctgttctgtgggatgacccaactctccctccactcttgtcttcttcttctttttttgtttttttgagacgaagtttcgctcttgttgcccaggctggagtgcaatggtgcaatcttggctcactacaacctcggcctcccgggttcaagcgattctc

SEQ ID NO: 58942 - DNA, 201 bp, Homo sapiens
aggtctccttgagtttgtggtgcctgttctgtgggatgacccaactctccctccactcttgtcttcttcttctttttttgtttttttgagacgaagtttcsctcttgttgcccaggctggagtgcaatggtgcaatcttggctcactacaacctcggcctcccgggttcaagcgattctcctgcttcagcctcctgagtag

SEQ ID NO: 58943 - DNA, 201 bp, Homo sapiens
ttagccagttatcccagcagcatttattattgaatagggagtcctttcaccattgtttatttttgtcaatttttgtcaaagattagatggttataggtgtsggggtttatttctggggtctctattctgttccattggtctatgtgtctgtttttgtaccactaccatgctgttttggttactgtagccttataatatagt

SEQ ID NO: 58944 - DNA, 201 bp, Homo sapiens
agttcaatttaaaaatgggcaaaggacataaacagacacctctcaaaaggagacatacaagtgaccatatgaaaaaatgttcaacaacactaatcatcagrgaaatgcaaatcaaaaccacagtgagataccatctcacaccagtcagaatggcgattattaaaaagtcagaaataacagatgctggcaaggctagccact

SEQ ID NO: 58945 - DNA, 201 bp, Homo sapiens
gggcactaaacattgaatacacgtagatgtaaagatgagtacaacagacactggggactattagatgggggaggatgggaggggagcaagagctgaaaaamcacctattgggtactatgctcactacctgggtgacaggaccccagaccccagcatcatgcaatatatccatgtgacaaatttgcacatgtaccccttcat

SEQ ID NO: 58946 - DNA, 201 bp, Homo sapiens
ggtgcactcacaccttcttcccttcgggtgaggggctcaaatgaccctcttactggtgaggtttcctggtgaggtccactgtccctaaaagttcaatacayaccctcttcccttgctcttttatttttttctccttaattctactctttctaactcattctgttcccttagcttgcctattatctgttggccccactgaat

SEQ ID NO: 58947 - DNA, 201 bp, Homo sapiens
acagacagcggccccatccggcaagcaggtcagtgaagcccctgcatcccggtgggaggaggctgagcacctgggggcgggtgggctcgccagctgtcagyatgggtgcaggtagagccaacaagaaacccagtggggaccccacatgggtctacacagcctagggtctcccgcagtttccagatgcccctctcatccctg

SEQ ID NO: 58948 - DNA, 201 bp, Homo sapiens
tgttcctcacccatcagcaggatggtgattttttctgaaacaagagtagaggtcgcaggccctcactgggatgagttctgtcagggatgtggagtcccagmacctgactcaacatctccctgtaaacaactcagatcatttacttgtgttggtgctttgatttgagcattttaagcaagacagacgaaagacagtcaatca

SEQ ID NO: 58949 - DNA, 201 bp, Homo sapiens
ggacttacagagagatttgtacacccacattcgtagcagcggcattcacaatggccaaaaggtgggaacaacccaagtgttcatcgacagatgaatcagtmcacaaaatgtggcatacatgaaatgaaattttattcagtcttcaaaaggaatgacattctgacacatgccatcacatgaactttgaagacattatgctaa

SEQ ID NO: 58950 - DNA, 201 bp, Homo sapiens
tgcattcaagtatgttctcactttaaccagaggaatgcttaaactgatcctactggcagaaatcatgcttacaacactagatgaggaatcatgcagggcaygtggcattcaagcatcaaaacaaattaaacaattcctacgagagccaaggtttcttatctcattgtatttcagtgaaccaggaaaccctgagcgagtggc

SEQ ID NO: 58951 - DNA, 201 bp, Homo sapiens; identical to SEQ ID NO: 17065

SEQ ID NO: 58952 - DNA, 201 bp, Homo sapiens
tgaggcaggagaatgacatgaacccgggaggcagagcttgcagtgagcggagatcgcgccgctgcactccagcctgggtgacacagcgagactccatctcaaaaaaaaaaaaaaaatactatccatccatccttattaagagagaaaaggccttttaatctgtggggtgtttttgccgttttcgttttttacatttggaca

SEQ ID NO: 58953 - DNA, 201 bp, Homo sapiens; identical to SEQ ID NO: 17066

SEQ ID NO: 58954 - DNA, 201 bp, Homo sapiens
gggtgggctactgctaagagtggatggtcaaatgctctgcaaaatatgaaaagctgcaaaaccacagaagtccctccatcatcatcatcatcatcatcatyattattattattcccatccaaaggtgcaggaacagtatttcttaggaatatatatgcaatatagtacttaaagaaccagcctttgcaatgttggtgttaa

SEQ ID NO: 58955 - DNA, 201 bp, Homo sapiens
tcatgcaatttgcactcatctatgttgtactttttttgcttctagaagttctctttggttctaattcaactatgctagcttgtcttgtacttctttaaacmtagtaagaaaactttttccaataatacccaaatctgaagtctttggatatgttactgctgaagtttctatcacttctcactcctggttccttgtttccct

SEQ ID NO: 58956 - DNA, 201 bp, Homo sapiens
aaattttagataagaccaggatgtttttgtatacgatttggacttgaaagttttattaagtggctcaagctgtcccacggtcatgatacatgctacccatrtatgttccatgaatttgaaaagattaagtaattaggccccaggctcagagtataaattatgatttaaggaggcagagtattaactacgcctggaagttag

SEQ ID NO: 58957 - DNA, 201 bp, Homo sapiens
tgagctgggccacaatttcgggatgaatcatgacacactggacaggggctgtagctgtcaaatggcggttgagaaaggaggctgcatcatgaacgcttccmccgggcaagtaccattgcttccatctgctttgacagtgtgcatggcttgaagtgtgtgttgggaaccagatgagtcaaagtgtctctggttttctggtca

SEQ ID NO: 58958 - DNA, 201 bp, Homo sapiens
tttatgaggctggaaaattgcagaagttgctgtcttgagagcacttggcttaggcaaatttcagggaatttcagggagtccccagccgggaaagttagtcrgcaggatgcaagctcattttaccgtgaactgtggagggtccccagtggtttgtaaaatcccaagacttcacatttccagaagccaggaagatgaaacgtg

SEQ ID NO: 58959 - DNA, 201 bp, Homo sapiens
tgctctgtgcatcctccccaccatgctctgtgcatcctctccccatgctctgcgcaccctccccaccgtgctctgtgcatctactccccgtgctctgcgcwtcctccccaccgtgctgtgtgcatccccactccatgctctgctcatcctcccacccgtgctctgtgcatccccacccccatgctctgcgaatcctcccca

SEQ ID NO: 58960 - DNA, 201 bp, Homo sapiens
ctcagcttccagtatcatccaatatcatctccctagaatccgttctccttccagtagccagagcaatatattatatatatatatatatatatatatatatwtatatatatttattttttttttttttttttttttttttttttgagacggagtctcactgtgttgcccaggctggagtcagtggtgccatctcggctcact

SEQ ID NO: 58961 - DNA, 201 bp, Homo sapiens
cagacagcggccccatccggcaagcaggtcagtgaagcccctgcatcccggtgggaggaggctgagcacctgggggcgggtgggctcgccagctgtcagcrtgggtgcaggtagagccaacaagaaacccagtggggaccccacatgggtctacacagcctagggtctcccgcagtttccagatgcccctctcatccctgc

SEQ ID NO: 58962 - DNA, 201 bp, Homo sapiens
cgcagtttccagatgcccctctcatccctgcccgatcttctctgaggctccttgctctctgctttgactgagtggctgagtttgccagttccttagcctgygacacttttcttaactaaggtcatttctatagtgaactgctgaatgggtatgaatgtcatcactgtatcaaagtactttgtaaaggccgacatctgtgtg

SEQ ID NO: 58963 - DNA, 201 bp, Homo sapiens
ctctgctttgactgagtggctgagtttgccagttccttagcctgcgacacttttcttaactaaggtcatttctatagtgaactgctgaatgggtatgaatktcatcactgtatcaaagtactttgtaaaggccgacatctgtgtggtagggtgacaaggtgtgaagtttaatgccttttaaaaatcttactggaaagacac

SEQ ID NO: 58964 - DNA, 201 bp, Homo sapiens
aaattatagttcaagatttttgctgttcactttttaaattaactttaattaactttgttatgagacaccagaactctagctagagccccctgtgatcactrctaagggtctgaaaagagtgacattttgcccaggaaaccagaagcaatgcttttccagtaacaccaacaagtaagtcaagactgtcatctgttggctgtc

SEQ ID NO: 58965 - DNA, 201 bp, Homo sapiens
ccagcaagaaagcaattcattttttaaaaacacgaaaagagataaagcagaacccaactacagaatgagtaaagaaaagcactttggaatggcaaatctgygctggggactggaaacatttgagcctggggatggctgtgattccagtgaggcttcagtgatggctccctgctaccttctgtggctaccatggtccactgt

SEQ ID NO: 58966 - DNA, 201 bp, Homo sapiens
aaaaagacttcataaaaaatgaagacattgaaaccccagttagtctcatgtgtggatgttgggaatagtctgggcctgtgtccaaatttttaataccagcrtaggaatggaattcccagtcaagatattgacctcaaaactggtcccacatcagtgaaactcccatgggcccagacataagccaacccaaaatagttctgt

SEQ ID NO: 58967 - DNA, 201 bp, Homo sapiens
ccctggttatatcagtaagcatacattagaaagtattagcttaaaacattctacaccaaaatgaagtacattcacatattttgtgctgcatcttacaggtyttctagtaccttctatccccttctatgattggtcgtacacatagtacgtaagagcctcttcccatatagaagaagggggaaagctaagctgctttcagct

SEQ ID NO: 58968 - DNA, 201 bp, Homo sapiens
ccctctaagggtcattgtgagaatgagatgaaacgatggctgtaaaatacgctagaaacttaacactactacagaaatgtaaggtgacactgaaagtttamagtgtctttaggaaccaaattccaatttcatgtcttgaaaaaattaaccgcggaaccagcgaagacatgtcaaaatgtgattgatcgtgagatgacctca

SEQ ID NO: 58969 - DNA, 201 bp, Homo sapiens
cctacaacctaacattggagtttggggcagcaggggcgtgttgcaaacaggaccaagttccggccgctgcgtccttagaagtttggttcatttgaaacccmttagcctttaaacatccgtgttcctcatgggagatttctcattacagcctggagactccagggtaaggcaccctggccaactggataagagtaagcactg

SEQ ID NO: 58970 - DNA, 201 bp, Homo sapiens
ggtggctgggaccggagaaatggtaggtgagacgaatggaagccagcggacttattaataataataattgcttccatttgctgagtacataatatgggttyggcatgtttatcatctatagcatatattaacttcccatatagtgtccctgtgaggcaggcactatcattctcattttatatgaggaaactccagcatgag

SEQ ID NO: 58971 - DNA, 201 bp, Homo sapiens
cctgggaggaggaaagacatgccgcaaagctcacagctgggtcagggacagccttgagtgtggctgagaagcgaggaactgcctggatgtgacatttgccracttggatagccgggccatgatgcgtaggagaatatctgcttataggaaatatgcaatgaagtatttggtgggaaagggccatggtgtatatcacttatc

SEQ ID NO: 58972 - DNA, 201 bp, Homo sapiens
ccagaccaagataagaagggtggtggacttgggaaaccaaagggaggccacagagcctaagtgggatgaattgagcaggtagagggggtgggcctggtccmcactaaggaatgtgttttttgctttttgggttttttttcgagacggagtcccactctgtggcccaggctggagtgcactggtgcgatctcggctcactac

SEQ ID NO: 58973 - DNA, 201 bp, Homo sapiens
tttttcttgatgggcttatttccaatggaatcatattagtcttgattaaccacaccagaggttcatttgttttcctgaaacctttcctacagaaatcctgstccaaattctttattttaaaacttgtagacacttgccaatgattcttacacagaattaccgggtgcatggggggagggggttgtaaattaccatcatgct

SEQ ID NO: 58974 - DNA, 201 bp, Homo sapiens
aacaagttaagtaataatacattcatttgtaaaaggttttgcaatccatagcattttttaaatagagcagttattgtgtttgaaatattttcttctaaagrtattcatttcttttgaccttttcatgtgacttttatttaacaaagaaaatcagactgagctgtaattaccttttaaattaacattctatgattttaaaaa

SEQ ID NO: 58975 - DNA, 201 bp, Homo sapiens
acaatccgttttcacaaagtgctgttgctgctccaagctcccggagcaacctcctaccacacaggtagatttcaccctggaggggtgtggccagtgtgtgsttctggaaggagttgtgctgaatcactctggcgaccactagctggcagctccctggccccaggaagtggcccagagcccaccatggtaccatcctacaac

SEQ ID NO: 58976 - DNA, 201 bp, Homo sapiens
agaagaagggatatgggagaggtgttcaacaaaacaataaccctgtgtctcctaccccacaatccgttttcacaaagtgctgttgctgctccaagctcccrgagcaacctcctaccacacaggtagatttcaccctggaggggtgtggccagtgtgtgcttctggaaggagttgtgctgaatcactctggcgaccactagc

SEQ ID NO: 58977 - DNA, 201 bp, Homo sapiens
aaaaaatggatttcccatggggaaaatgttctcgttcctagaagaagggatatgggagaggtgttcaacaaaacaataaccctgtgtctcctaccccacartccgttttcacaaagtgctgttgctgctccaagctcccggagcaacctcctaccacacaggtagatttcaccctggaggggtgtggccagtgtgtgcttc

SEQ ID NO: 58978 - DNA, 201 bp, Homo sapiens; identical to SEQ ID NO: 17054

SEQ ID NO: 58979 - DNA, 201 bp, Homo sapiens
tgtgctctgtgcatcctctccccgtgctctgtgcatcctcccctccatgctctgtgcctccccctgtgctctgtgcctcctctcccggtgccctgtgcatyctctccctgtgctctgtgctttctcccgtgctgtgtgcattaccccgtgctctgcacattgtcctgtgttgtgtgtatccctctgtgctctgcatccttc

SEQ ID NO: 58980 - DNA, 201 bp, Homo sapiens
atatgcaatgaagtatttggtgggaaagggccatggtgtatatcacttatcctcagatggtttagcaaaaacactgtgtgtgtttgtaaagattgggaggygggcagtggggggaagggggaggaggggaacaacgtataaagcaaatggaataaaatatcgtcccagctactcaggaggctgaggcaggagaatggcttg

SEQ ID NO: 58981 - DNA, 201 bp, Homo sapiens
ccatgttgatagccttggttgtgataggggaacattaggaggtcaataaaggccttccccaaggcgtgtcatgactatgtttgggctttgaaaagcacccrctggctccagcatgaagtcgtagtcagagggaacaggaggggagagggagggtcccctgctctgtcagggtcaggcaggggcctcttgtggaacagcctg

SEQ ID NO: 58982 - DNA, 201 bp, Homo sapiens
caaaatattagtgtctttggggttcacgagtgtgcaatgcagtgccacggcagaggggtgagtaggctgagctgcccttttacagccagcccataacaagytaagtaataatacattcatttgtaaaaggttttgcaatccatagcattttttaaatagagcagttattgtgtttgaaatattttcttctaaaggtattca

SEQ ID NO: 58983 - DNA, 201 bp, Homo sapiens
catgcctgagtccagtataaaatgtattgttatgctccatccgtattaactgagacaaggttgggtcttctccaagctttcttttgcttgctttttgtttraatacaggtatgtatgcatgctggaggggttggagaaatactaagagatttgctgtgttttcctcctcctacagatctgcctgaatcgtcaatgtcaaaa

SEQ ID NO: 58984 - DNA, 201 bp, Homo sapiens; identical to SEQ ID NO: 17069

SEQ ID NO: 58985 - DNA, 201 bp, Homo sapiens; identical to SEQ ID NO: 17071

SEQ ID NO: 58986 - DNA, 201 bp, Homo sapiens
ggctaccctacccagaatgagcctgatctcatctgatcttggaagctaagcaggatcaggcctggctagctcttggacaggagagtctcagctcctatatgctgtgctacactgcctccagttcacttggaacaaaacactgagtctcggttatacgtttctggctatggtgtttgttgtaatggaattagtctataaatg

SEQ ID NO: 58987 - DNA, 201 bp, Homo sapiens
ctcacattttttctgtgggacagtgctggtctagagttgacttgtgggtgggaagtgcggctttggagacaggtttcccacccccgttatgaggggcagtrgtatctgacacagaaaacccttcagactatcagaatacatctccaaccccagacctctctatcctcagaatcacttctcaaggtctctgatcattttttt

SEQ ID NO: 58988 - DNA, 201 bp, Homo sapiens
taccctacccagaatgagcctgatctcatctgatcttggaagctaagcaggatcaggcctggctagctcttggacaggagagtctcagctcctatatgctgtgctacactgcctccagttcacttggaacaaaacactgagtctcggttatacgtttctggctatggtgtttgttgtaatggaattagtctataaatggag

SEQ ID NO: 58989 - DNA, 201 bp, Homo sapiens
cctgctttgtgagctcaaaagaaccaaaggtactgtgttggccaggccctgggttcagtaatcctgtatctctgaaggagaagacacactggagtgatttyattacagctcttgggaagaatgtttggcccgtgaaagaaagagctgcttaataaatgtcagagataaaggcggtcaaagggtcaggacaattgtttaatt

SEQ ID NO: 58990 - DNA, 201 bp, Homo sapiens
accctacccagaatgagcctgatctcatctgatcttggaagctaagcaggatcaggcctggctagctcttggacaggagagtctcagctcctatatgctgtgctacactgcctccagttcacttggaacaaaacactgagtctcggttatacgtttctggctatggtgtttgttgtaatggaattagtctataaatggagt

SEQ ID NO: 58991 - DNA, 201 bp, Homo sapiens
acacttttaaacaaccagatttaatgagaactcctatcacttagaaccaaggagatggtgctaaaccattcatgaaggatctagtcacctcccacaaggcyccaccttcaactttggggattacaatttgatatgagactggggcaggaacacagattcagaccatctcaatgcccacctccacaactctcagcagaatct

SEQ ID NO: 58992 - DNA, 201 bp, Homo sapiens
gctcacagttctgtaggttgtacaggaagtatggcagcatatgcttccggggaggcctcaggaaacttacaatcatggcggaagggggagccagcacttcmcatggctggagcaggagaaagagaaaaaggggaggtgccacacacttttaaacaaccagatttaatgagaactcctatcacttagaaccaaggagatggt

SEQ ID NO: 58993 - DNA, 201 bp, Homo sapiens
caggacaggggtgcagtggtctaggccgtgcttcctgctccccctacaactgggaataccgtaaaatagacatgacaattaccaggaaggaagcagtccaygtgagcttataatcacaggcattggcacacagtgcctatcaacagccacagtggacctaagagagcaaatcaagatgtcataaaactacagtacctcaga

SEQ ID NO: 58994 - DNA, 201 bp, Homo sapiens
aatgttacagaaaattttggcaagaagattaacagaggtcagcctccacccaccttgtatggtgagaggatgatattcaggaagcagggcctgtgccaagyggcaggccctgcttctcaggggcctctgctggctcctggaaagtgaccctgcctaaccctatgtttattgcaggggacctgtaagccaaacccccctcag

SEQ ID NO: 58995 - DNA, 201 bp, Homo sapiens
ccctcagaccactgcatcaattctctgagcttatgagaaagtatctagtggaagaacttcagtgcatttcgcggagccttcagagcaacatgtggaacagygcctgcacgtggcagactgagcacaaccatcctcaccgtctcatccacccacagatgaacgagtcctgctatgtgatgttggcaaaactgaagaaacgaa

SEQ ID NO: 58996 - DNA, 201 bp, Homo sapiens
cattgtaactgcctccttctgtgagccccatgtgttttgtttcagataaccaaggtttaaccataggaattctggtgaccatcctgtgtcttcttgctgcyggatttgtggtttatctcaaaaggaagaccttgatacgactgctgtttacaaataagaagaccaccattgaaaaactaaggtaccctgggtttagcttgt

SEQ ID NO: 58997 - DNA, 201 bp, Homo sapiens
cactggcctagagggcggaaggcttaggtgcctgagctgggagcgcaggtgccactccaaggtgagcgagttggaccattgccccaacggcctcaggctakcctcagactgtccaacgagaagaaaacacgagttcttcttagacctcgggagcaaaaggaaatgataaactatattaaacccaaactggaaattgctgaa

SEQ ID NO: 58998 - DNA, 201 bp, Homo sapiens
cctacccagaatgagcctgatctcatctgatcttggaagctaagcaggatcaggcctggctagctcttggacaggagagtctcagctcctatatgctgtgctacactgcctccagttcacttggaacaaaacactgagtctcggttatacgtttctggctatggtgtttgttgtaatggaattagtctataaatggagtgg

SEQ ID NO: 58999 - DNA, 201 bp, Homo sapiens
ctacccagaatgagcctgatctcatctgatcttggaagctaagcaggatcaggcctggctagctcttggacaggagagtctcagctcctatatgctgtgctacactgcctccagttcacttggaacaaaacactgagtctcggttatacgtttctggctatggtgtttgttgtaatggaattagtctataaatggagtgga

SEQ ID NO: 59000 - DNA, 201 bp, Homo sapiens
tacccagaatgagcctgatctcatctgatcttggaagctaagcaggatcaggcctggctagctcttggacaggagagtctcagctcctatatgctgtgctacactgcctccagttcacttggaacaaaacactgagtctcggttatacgtttctggctatggtgtttgttgtaatggaattagtctataaatggagtggat

SEQ ID NO: 59001 - DNA, 201 bp, Homo sapiens
acccagaatgagcctgatctcatctgatcttggaagctaagcaggatcaggcctggctagctcttggacaggagagtctcagctcctatatgctgtgctacactgcctccagttcacttggaacaaaacactgagtctcggttatacgtttctggctatggtgtttgttgtaatggaattagtctataaatggagtggatt

SEQ ID NO: 59002 - DNA, 201 bp, Homo sapiens
tgtcattgatgatactacttgtcagtcactatctggaaaaagttcccatatttcaacctctcccttaaaagactcttcaaccctggattcttggagtctcyatctatgtctatccaggccctgggataaggagtaatctgtctcgccctcccctatatcttttttttttttttttttttttttttgagacggaatctctct

SEQ ID NO: 59003 - DNA, 201 bp, Homo sapiens
cccagaatgagcctgatctcatctgatcttggaagctaagcaggatcaggcctggctagctcttggacaggagagtctcagctcctatatgctgtgctacactgcctccagttcacttggaacaaaacactgagtctcggttatacgtttctggctatggtgtttgttgtaatggaattagtctataaatggagtggattg

SEQ ID NO: 59004 - DNA, 201 bp, Homo sapiens
agccatctgttttcctctgctgagcctcgttgctgatggtttatgtcattgatgatactacttgtcagtcactatctggaaaaagttcccatatttcaacytctcccttaaaagactcttcaaccctggattcttggagtctccatctatgtctatccaggccctgggataaggagtaatctgtctcgccctcccctatat

SEQ ID NO: 59005 - DNA, 201 bp, Homo sapiens
catcctccctgtgctctgtgcatcctctccccgtgctctgtgcatcctcccctccatgctctgtgcctccccctgtgctctgtgcctcctctcccggtgcyctgtgcattctctccctgtgctctgtgctttctcccgtgctgtgtgcattaccccgtgctctgcacattgtcctgtgttgtgtgtatccctctgtgctct

SEQ ID NO: 59006 - DNA, 201 bp, Homo sapiens
accactacaacagcttgataaattcaaggagccatctgttttcctctgctgagcctcgttgctgatggtttatgtcattgatgatactacttgtcagtcastatctggaaaaagttcccatatttcaacctctcccttaaaagactcttcaaccctggattcttggagtctccatctatgtctatccaggccctgggataa

SEQ ID NO: 59007 - DNA, 201 bp, Homo sapiens
tgggatgcggctgataactgagttgttcaggcctgtgtgtctccatcaaattgcaaatggccctataggtcttctgacccctgcccctgctaacccccccrtgtgcattttcacacaatatccaagaaaatttgcagttaggagttagagccaagtgacagggtataagcaaataaccctcccttctctctaatgggtcaa

SEQ ID NO: 59008 - DNA, 201 bp, Homo sapiens
atccctcctacataccagcagttctcaactgagggtgattttgccccacagaggacagttggctgtgtctggggacagttttggttgggagagagttaccrgcatcttgggggtggaggccagggatattgctaaacaccctccattacacaggacagccccccagcacagaatcatctgcaccgattgtcagctgagctg

SEQ ID NO: 59009 - DNA, 201 bp, Homo sapiens
atggcctttattcctagctagggaattttttctatttaatgtttcttttaatgaaaactaatgtagaaatatcacttctaagtctgtcccttgttcagggrctttttcctagcccaatgtgtccgttgttccaactcagcttatcttccacacacctgtggacacttgtgatttacaaacttctgtggtagcttcctttgc

SEQ ID NO: 59010 - DNA, 201 bp, Homo sapiens
acacacatacgtgtatacacacacccacgcacccccatatacatacagatacatgcacatatacacacacaaatatacacatgtgcccacatatacatgcrtgcatacccatacacatgtacatatacacacatgcacacccacatccacacatatacatatatgcacaccatatacacacatacatatacacacacatgc

SEQ ID NO: 59011 - DNA, 201 bp, Homo sapiens
ccctcacgtccacccgggaggaagggactatgatcatccctgctccaccagtgaggatactgtgtgtgtatgtggaactggttgaatatataaacaatccrtgctcttgggcacattatatggcctttattcctagctagggaattttttctatttaatgtttcttttaatgaaaactaatgtagaaatatcacttctaag

SEQ ID NO: 59012 - DNA, 201 bp, Homo sapiens
acatatacacacattcacacatctgcacaccatatacaaacatatacacacacgcacagcatatacacatgtatatatacacacatgcacacatatacacmtgtgcacaccatatacacacatgcacacccacatgcacacacacacatgcatacccatatacacacatacatatacacacatgcacacccacatccacac

SEQ ID NO: 59013 - DNA, 201 bp, Homo sapiens
gtaggagaatatctgcttataggaaatatgcaatgaagtatttggtgggaaagggccatggtgtatatcacttatcctcagatggtttagcaaaaacactstgtgtgtttgtaaagattgggaggtgggcagtggggggaagggggaggaggggaacaacgtataaagcaaatggaataaaatatcgtcccagctactcag

SEQ ID NO: 59014 - DNA, 201 bp, Homo sapiens
tgcgtaggagaatatctgcttataggaaatatgcaatgaagtatttggtgggaaagggccatggtgtatatcacttatcctcagatggtttagcaaaaacwctgtgtgtgtttgtaaagattgggaggtgggcagtggggggaagggggaggaggggaacaacgtataaagcaaatggaataaaatatcgtcccagctact

SEQ ID NO: 59015 - DNA, 201 bp, Homo sapiens
ggaagaagttaagagggcataaaaatgaggtttgaattcatttccttgtttaaaatgaaaatagatttaaagaaatgtttatcgtgtgtgagcaatctgcytagagtcatttctcagctcccttcagatgatgcttggtgatcacactggacttctctgggagaggttcaggtttaggttttgcaaaggcagaatgaaaag

SEQ ID NO: 59016 - DNA, 201 bp, Homo sapiens
gggcttgtgcttgcaggcacaaagtgtgcagatggaaaagtaagacccaaatgtttgcttggatcataaatgtaagtctggaacagggcccattgaaaaayagcaagaactgggttacaaggtttgttggttttcctaaatctacttcttctcagatgcacctagaagaaaaagtcaataaatcctagatcctggtctgac

SEQ ID NO: 59017 - DNA, 201 bp, Homo sapiens
gtttaccatgtgaagttgataacagctgagacttcatgatgctggtcaaggcaaagtggttatatctggatttaaaattgttttgaaacctctaaaaaatytgaaatatgtggctattgccagaacatgagcagaatatagaagaatggaacagccctatttaatagcatattaatagcatacctggatttttcttcaata

SEQ ID NO: 59018 - DNA, 201 bp, Homo sapiens
aaaagaaatgagaaaaggagaggtgcaaggctggctcattgcagagattggagcactgagcacactgttcacatcaaatgatggcaaggtggtgtggcacrtgtgtgttgaatgagatgatcatgtctgctagtagctgatgagaagggatcaggtgcaggctaacgaagggggatgtttttagtaagaagaacatcttct

SEQ ID NO: 59019 - DNA, 201 bp, Homo sapiens
tattagctatggaactccaggggaaaggtaccatctttcccaagtaccttctggaaagacttggtggtgtccaaatggcctggcttccgtcaggtgcctakccccgagccaatccaccctggccaagaacctggggttactcttggcaaacgtggttctcatgcccattcttgtgactgtgggtgggttccaacctatcta

SEQ ID NO: 59020 - DNA, 201 bp, Homo sapiens
cgttaagctgtacacaaaatagaggtcaagctcgggaggctgattctgtgtggccactgatccttgaatatccagtttaggggatattgaccctgaaggaytgcattcatggtgtcctgtttcatcgatgaactttttaaatttaatttaatttttttgagctgagcctcgctctgtcacctaggctggaatacagtggca

SEQ ID NO: 59021 - DNA, 201 bp, Homo sapiens
cactgttttccacaatggttgaactaatttacactccgccagcagtatataagtgttcctttttctccacaaccttgccagcatctgttgttttttgactttttaataacagccattctgactgacaccttttttttaaactgtagcctgaacagccagggccaggtgcatctggacattccaattccaagggctcaattt

SEQ ID NO: 59022 - DNA, 201 bp, Homo sapiens
ggaaccttggctttgtacccaactttggctttatatatgaagggcagaagaattatttgagccctgcattaataaaacagctcagggaacaatatacaggwctggctgatgaaagagtagccaggggagagctggaatgagggccatgttgcaggaatagaaggaactgtggaggtactccagagaaggaattgcaaaact

SEQ ID NO: 59023 - DNA, 201 bp, Homo sapiens
aatgtggcagtatagttagaagagcagagattggagagaagagctctacctgggccttcatggagagttttaaaggccagggcatctgaaggggccttgtrgaagatggggagtattttaggaactagaaggaagggcaaaagaagaaatgggaggccgaggtgggtgggtcacctgaggtcaggagttcaagaccagcct

SEQ ID NO: 59024 - DNA, 201 bp, Homo sapiens
atgacctcagcccaggccagagaccccagctctggcaaggcctcttgtggtcggccaggcccaggctgaaagccaagcagaatcaggcaggatctctagcrggagggaaacctgataggacctttgtcagacttttgttgtgaggctttggttttaggagtgatgagggaaataaagtggaacagaaattgatgactaaac

SEQ ID NO: 59025 - DNA, 201 bp, Homo sapiens
ggaactgtgtgtcaaaattcacagaataagttgttaggtaaaatgaaaaggcctgcagttcaaacaaacaaacaaaaaactagctaagcagatccccgatmgggaaacctggtataatagcagttcatattaaaaagagtgaggggtcattttagatgacaagtgaatgcactcctggactggatttgtagaccttgaagg

SEQ ID NO: 59026 - DNA, 201 bp, Homo sapiens
cacacattcacacatctgcacaccatatacaaacatatacacacacgcacagcatatacacatgtatatatacacacatgcacacatatacacatgtgcamaccatatacacacatgcacacccacatgcacacacacacatgcatacccatatacacacatacatatacacacatgcacacccacatccacacagacaca

SEQ ID NO: 59027 - DNA, 201 bp, Homo sapiens
caaacatatacacacacgcacagcatatacacatgtatatatacacacatgcacacatatacacatgtgcacaccatatacacacatgcacacccacatgmacacacacacatgcatacccatatacacacatacatatacacacatgcacacccacatccacacagacacacacatgcacaccatatacacacatacata

SEQ ID NO: 59028 - DNA, 201 bp, Homo sapiens
acacatgcacacccacatgcacacacacacatgcatacccatatacacacatacatatacacacatgcacacccacatccacacagacacacacatgcacwccatatacacacatacatatacacagataccatatacacacatacatatatatacacgtgcatatatacacatgcacactgatatacacatgcatatgca

SEQ ID NO: 59029 - DNA, 201 bp, Homo sapiens
acatgcatacccatatacacacatacatatacacacatgcacacccacatccacacagacacacacatgcacaccatatacacacatacatatacacagayaccatatacacacatacatatatatacacgtgcatatatacacatgcacactgatatacacatgcatatgcacacatgcacaccatatacacacgtacat

SEQ ID NO: 59030 - DNA, 201 bp, Homo sapiens
taataactgctacctatgatggctgtagaaaatacttgtaaacatgataaatgcacatgcatgagtgcatttgttatttattgctgtatgacaaattgccrcaacttagtggcttactatcacacctgtgtacaatctcacagcttttgtgggttacgaatctaggcacaacttatctgggtcctctaattcagcttcttt

SEQ ID NO: 59031 - DNA, 201 bp, Homo sapiens
atatatacacatgcacactgatatacacatgcatatgcacacatgcacaccatatacacacgtacatatacacacatgcacacatatgcacatgtgcacaccatatacacacatacatatatatacaaatgcatatatacacatgcacaccaatatacacacatgcatatatacacatgcacactgatatacacacatgca

SEQ ID NO: 59032 - DNA, 201 bp, Homo sapiens
tgcccctgaaaaaagagattgcagaggcttctctaacatggcttataaaagaaatgagaaaaggagaggtgcaaggctggctcattgcagagattggagcrctgagcacactgttcacatcaaatgatggcaaggtggtgtggcacatgtgtgttgaatgagatgatcatgtctgctagtagctgatgagaagggatcagg

SEQ ID NO: 59033 - DNA, 201 bp, Homo sapiens
tacccaaatctgaagtctttggatatgttactgctgaagtttctatcacttctcactcctggttccttgtttccctgtatgctttttttttttttttccakgagttcacttttttaaattatagttcttcaaggcctaggatgcaggtgtgttcttccataaagggctattttgcctctgccaggtgcctggaggcagtac

SEQ ID NO: 59034 - DNA, 201 bp, Homo sapiens
agtgcaggttccacactgaggctctccctccccatccttccctgctctgacagatagacgaaagagaaaaagaaggcagaatgcggacaaatcaggtcccyaataggagctgagtgtgtcggtggtgtcatcctactgtgagcaaggcagatgtggaacagatggaaggaaagggcatgtgatgtgaggagctagggacct

SEQ ID NO: 59035 - DNA, 201 bp, Homo sapiens
cccaggctcctgttgagctgtttgtgagctcacgtgtctgaaactgcccaaagtctctttagagctccctataaggaaaacaaatgtatcaactgacatayttgaattgtgtcatggtatatgtattttttaagtggtcacaattcccaagaaagaaattactttataataaaggtagcagaatctaggacatcagaatag

SEQ ID NO: 59036 - DNA, 201 bp, Homo sapiens
agtgaaacattaaagtcactacattagcctccctccagatacaagcactgtcataagtttgcttactgttttcaatatttttgtataaatatgtatccatkaatatagtgtttcgtgttttaaactttacgtaagtggtatcaaactgtacttaccttcatgcaatttgcactcatctatgttgtactttttttgcttcta

SEQ ID NO: 59037 - DNA, 201 bp, Homo sapiens
atttaagtttcagatatatatcctttttcaaaagaagtgaaacattaaagtcactacattagcctccctccagatacaagcactgtcataagtttgcttamtgttttcaatatttttgtataaatatgtatccatgaatatagtgtttcgtgttttaaactttacgtaagtggtatcaaactgtacttaccttcatgcaat

SEQ ID NO: 59038 - DNA, 201 bp, Homo sapiens
catatgttcattcagtgctgaggtttgtcctcatgccttgaacggcacaagttctcagcatccatgagccaccgtccccttctgctcatggtagatgggtrtccaagttaatcccaaagcttgacagagggggtggcagagaattgggagaggaaggcagtttctattcgtttttctcctaccttaaatctcatgtttcca

SEQ ID NO: 59039 - DNA, 201 bp, Homo sapiens
catagaatttggctttaggtctttggctgtgtaggcttactactgttttacttccaaatttgagagtcaccaatcatactggataatattaacaatgtagyatcttgcccaacagggtcatatcccttaacatatggcaaagggcagaccagaatgagtgtgctgtagacacatccaggatgacagggagatcccagaaga

SEQ ID NO: 59040 - DNA, 201 bp, Homo sapiens
atgagaaatagtcctatctcataataataaaatgagtctactagcctggtcataattctactcagtatcattttccttcaatctgaaacacttgctttagrattttttcaaaatatataccatagaaatttgtagaattaaaaagagagaaaaccatatcacagtggagatttttgtaaaaataaactttgaagtaaaaca

SEQ ID NO: 59041 - DNA, 201 bp, Homo sapiens
gaagtgtgtgttgggaaccagatgagtcaaagtgtctctggttttctggtcagagcacccagggaagcttccaaaaagtaattccttcccaagaagcaagrgtggcctgtgctactctggagagccatgggcagccagatggcaatgctacatggtgtgtacaaggaagagggctgaccttttccttgaggaatggtgggc

SEQ ID NO: 59042 - DNA, 201 bp, Homo sapiens
ctcagctagttgggaggctgaggcatgagaatcgcttgaaccccagaggcagaggttgcaatgagtggagattgtgccattgcactccagcctgggtgacrgagcaagactccatctcaaaaaaaggcaggcaggaaactgtgactgacaagagaaaaaaacagagccaccaatatataaatattgaaattagctgagaag

SEQ ID NO: 59043 - DNA, 201 bp, Homo sapiens
ctcattttatatgaggaaactccagcatgaggtcggatttcatattcaaagtcataaaagaagaaaatggcagaatgagatttgttcttccactgttgctrtactactgctagagatatattttgaaggtagtttggtcttcttgtccacattttattactgagaaatgtatcagcccaaacattctgcagatactgactg

SEQ ID NO: 59044 - DNA, 201 bp, Homo sapiens
tagcacagtgagttaattagataatcagcattgtaaataccaggaatggctttgacaggtgaaagcgtctgttttcagaggtgtccactcactatgtacargtcctggagctggcagcagcatctgattggtaaggtggctctgtttctgcatttttgttgcttagctgtttcatgtccttttactgcagtgtcttcattg

SEQ ID NO: 59045 - DNA, 201 bp, Homo sapiens
agcttctgttgctacacacaaagcacaggctaataactggtaaaggtgctggtgagtgtccttctgtgccctttccctgcattccagatctcaccctcccmtaagacctctccacagtcctccctccaggacctctgatcacctgctgccgtagcctggagttaccagtatgccagctctgccctacttctgaaggcatag

SEQ ID NO: 59046 - DNA, 201 bp, Homo sapiens
tacttcaatattctaaataggccagtatcacttgacataaatactataaagataaattgaaggaaaacaaaacaatgttattaaaatgcagccagacaatrgtgtctgttggtgtccctgagcccaagacctgttctctttgtgaaaaagggcagagagccagtggctgggaggttttaggcatggaataccaaatggact

SEQ ID NO: 59047 - DNA, 201 bp, Homo sapiens
gggaggcatggcttttttcaagtgttgagctggagtaaggtcaggtatggtcaaaacacttctgtgtttctggactgctctttctctagtcttttggctcragatagcaggcttttccagttgtgggcctatccagagcccaggccaagatatataaaagaacacacacacacaaacacaccactgggtagttccttgagt

SEQ ID NO: 59048 - DNA, 201 bp, Homo sapiens
gccattttttaaagcaaatctgtaggtgacaaattctcttcattttcctttatctgagaatgtatttattcctagaggatagttttgctggatatagaatyctgcgttgactgttttctccattcagtactttaaaaatgttgttccccttccttctggactccatggtgatgagaaatccactaaaagttctacccatag

SEQ ID NO: 59049 - DNA, 201 bp, Homo sapiens
tatacaaatgcatatatacacatgcacaccaatatacacacatgcatatatacacatgcacactgatatacacacatgcatatatacacatgcacacccaygcaccccatatacatacccatgcacatgcacacacacaaatatacgcacgtgcccacatacacacacatacacacctatagacacacatacacccataca

SEQ ID NO: 59050 - DNA, 201 bp, Homo sapiens
ttgatggatattccatgaatggttgaaaggaatgtaaaatctgctgttgttggatagggtaatgtcccgtaaatagcatagttagttgatggtgttatcaratctcatattaagcttactaatattttttgtttgttatttctatcaattattgggagaggagtaacacctttaactgaagttgccaatttatctatttgt

SEQ ID NO: 59051 - DNA, 201 bp, Homo sapiens
tatatacacatgcacactgatatacacacatgcatatatacacatgcacacccatgcaccccatatacatacccatgcacatgcacacacacaaatatacrcacgtgcccacatacacacacatacacacctatagacacacatacacccatacacatgtacgctcacccacctttggacccctcctatttatgggctttt

SEQ ID NO: 59052 - DNA, 201 bp, Homo sapiens
tttgagagtcaccaatcatactggataatattaacaatgtagtatcttgcccaacagggtcatatcccttaacatatggcaaagggcagaccagaatgagygtgctgtagacacatccaggatgacagggagatcccagaagaaatgagacacaaaattaagttcctcctttcaaactcttatatacatcactattcttta

SEQ ID NO: 59053 - DNA, 201 bp, Homo sapiens
ccttttcatttttaattctgcttttttcatgctcctgctggttctgggcccctctctcaaaactgcacaaagggaagcaggcgagtgtggggttgagaggmccaagcccggggcacacaggtcccgactgggtccccagctctgccacctgcgcaccttggacagtggggtcatggcgggagctgcagccatggtcagcag

SEQ ID NO: 59054 - DNA, 201 bp, Homo sapiens
agtggcatgatctcggctcactgcaagctctgcctcccaggttcacgccattctcctgcctcagcctcctgagtagttgggaccacaggcacccaccaccrtgcccggctaatttttttgtatttttagtagagacggggtttcaccgtattagccagaatggtctcgatctcctgacctcgtgatctgcccgccttggcc

SEQ ID NO: 59055 - DNA, 201 bp, Homo sapiens
tgagcactacccttttgtgagccataatttggaatgaacagcataccattcatttattacaaagcactttttaggtgttatttttctagttatttttcttyccttgtcattataaatgggatccaattttcaattttattttagtaatgatatatcttgtattagtttatatacacacattctgggactagcctgtttatt

SEQ ID NO: 59056 - DNA, 201 bp, Homo sapiens
tcctctctctctcccccttcctctctttgtttttatccttctgtactccccagtccaacctcgtccaactctcctcccaggctcctgttgagctgtttgtragctcacgtgtctgaaactgcccaaagtctctttagagctccctataaggaaaacaaatgtatcaactgacatatttgaattgtgtcatggtatatgtat

SEQ ID NO: 59057 - DNA, 201 bp, Homo sapiens
ctcctgatatttcaccattgattttaatattgactgttgatttaagatgtgagtttatgattttaagaacctatttctagttttcaaatagatttttttawaaaaaaaagtattggatactgaattttattaactttttttagacatgtacagaggtaccatatcttgtctctctctttttaaatcttgtgacctgataaa

SEQ ID NO: 59058 - DNA, 201 bp, Homo sapiens
ggttggtctctttctcgtcctctctctctcccccttcctctctttgtttttatccttctgtactccccagtccaacctcgtccaactctcctcccaggctsctgttgagctgtttgtgagctcacgtgtctgaaactgcccaaagtctctttagagctccctataaggaaaacaaatgtatcaactgacatatttgaattg

SEQ ID NO: 59059 - DNA, 201 bp, Homo sapiens
catcattcaggtcccgtgtttataatttatcaataagatcactccataaaatatattctgatacctcacagctgtgtataatttattctgtctatccgtgyagtgaaataaaatttttatttgcatcatctaaaagaaataccagtgtataaatacataagaaaagctcataagaaacggtcttctgactacagatattgc

SEQ ID NO: 59060 - DNA, 201 bp, Homo sapiens
cagcctcttcaatccctgttgaggttggtctctttctcgtcctctctctctcccccttcctctctttgtttttatccttctgtactccccagtccaacctygtccaactctcctcccaggctcctgttgagctgtttgtgagctcacgtgtctgaaactgcccaaagtctctttagagctccctataaggaaaacaaatgt

SEQ ID NO: 59061 - DNA, 201 bp, Homo sapiens
atatttgattgatagtattaaacagaaggaaaagttgttctactggagtgggaaaatgcattaggttaagtaataagtatataaaatacatggttagaggtttttgaaaaggaaaagatgtaattttgtggttatgcatgtttggggctctttttctgtgttgtgttttgttggtagaaatagaatgtcttggatcagcag

SEQ ID NO: 59062 - DNA, 201 bp, Homo sapiens
acccttccagagatgctaaatgtggaaaaatccagtgtcaaggaggtgccagccggccagtcattggtaccaatgccgtttccatagaaacaaacatcccyctgcagcaaggaggccggattctgtgccgggggacccacgtgtacttgggcgatgacatgccggacccagggcttgtgcttgcaggcacaaagtgtgcag

SEQ ID NO: 59063 - DNA, 201 bp, Homo sapiens
agcctccacccaccttgtatggtgagaggatgatattcaggaagcagggcctgtgccaagcggcaggccctgcttctcaggggcctctgctggctcctggwaagtgaccctgcctaaccctatgtttattgcaggggacctgtaagccaaacccccctcagaagcctctgcctgcagatcctctggccagaacaactcggc

SEQ ID NO: 59064 - DNA, 201 bp, Homo sapiens
gagtgtttataactacgatccatggataagtcttaaatgttacagaaaattttggcaagaagattaacagaggtcagcctccacccaccttgtatggtgasaggatgatattcaggaagcagggcctgtgccaagcggcaggccctgcttctcaggggcctctgctggctcctggaaagtgaccctgcctaaccctatgtt

SEQ ID NO: 59065 - DNA, 201 bp, Homo sapiens
ctgtttccatgcctttgcttgacttcctatcataacgatagccctttatctggtattcacgtatcaagcttcccctttgctttgccagtacatttgcagcstcttcaatccctgttgaggttggtctctttctcgtcctctctctctcccccttcctctctttgtttttatccttctgtactccccagtccaacctcgtcc

SEQ ID NO: 59066 - DNA, 201 bp, Homo sapiens
taaaatccctaccagggaagcccggcctgggaaggtactaggatccccctgatgccccagagcattatgatccaattatataaccccctcatagtcagagaattatcatgcttcccctacatacccaactaagagttaatctagagtgagaggacactgaagccattcaaaatatatgtcacacaaaagctaaggaggtga

SEQ ID NO: 59067 - DNA, 201 bp, Homo sapiens
agggggcaatctaaaaaggctgaagactgataggcattaggtatttttcttagaccccatacatgcccagctataaaacaaggcttccccctgaaagtagycagcaaaaagaatcgctaaccactgacctgtcactctctcagccacaccttttggatgtcgcagagcaggtgggaaggcgctttggcgctcatcatcctg

SEQ ID NO: 59068 - DNA, 201 bp, Homo sapiens
agttgcccttaatgtgtaaggccctggagaccatgaagtgtgagggagatggatgtaaagcccctactgacgtgatcatgaatcgttacaggtgtggtaastgatgcgagcaggggctggtacaaggaactctcttctccccacacacacccccagccctaaagtccagaagccacaccttccccacagtccaaggtggtc

SEQ ID NO: 59069 - DNA, 201 bp, Homo sapiens
ggatattctgattcagcagtcagtctcagcacgtgttctggtctcaggtaagtggccatgaccatggcggctctagtcttcagccatctactgcaggcaayctctgtcttttcctgctcgtgctaaagcactgagagtgagtgatgggggctcccagctcagctacacctccacctaggcaagagaacacggaggccctct

SEQ ID NO: 59070 - DNA, 201 bp, Homo sapiens
gatgggtctttttataagggtcttttccccgttttgctcggcacttcttcttgctgctgccatgtaaagaaggatttgtttgcttcgccttctgctatgaycataagtttcctgaggcctcccctgccatgctgaactgtgagtcaattcaacctctttgctttataagttacccagtcttgggtatgtctttattagcag

SEQ ID NO: 59071 - DNA, 201 bp, Homo sapiens
ggagactttttattatgcattcaatctctgcttagcttttgtttgtctaggaaagtttttatttgtcccttatttctgaaatacagccttgctgggtaagrtattcctggtagacaggagtttttttttccccctccctcagcactttgaatatatcatcccactctctcctggcctgcaagttttctgctgagtaatgca

SEQ ID NO: 59072 - DNA, 201 bp, Homo sapiens
ctgctgagtaatgcactgatagtcatattgagacttctttgtatataaagtattttttatcttttgctgctctcacaattttttgtctttaagttttgacrgtttgattaatatgtgttatggtggactcctccttgggttgaatttgattggaaacttctatgctttcaggacctggatgttggcatctttccccaggtt

SEQ ID NO: 59073 - DNA, 201 bp, Homo sapiens
ttttgctgctctcacaattttttgtctttaagttttgacagtttgattaatatgtgttatggtggactcctccttgggttgaatttgattggaaacttctrtgctttcaggacctggatgttggcatctttccccaggttagggaagttttcagccattatttctttaaatgtattatgtggcccctttttctctttcttc

SEQ ID NO: 59074 - DNA, 201 bp, Homo sapiens
ttccttcatttttctgtttgttcctctgattggataattttaaattatctgcttcaattcttttgcatcttgctcaagcctgctgttgaagctttctattrcatttttaaagtttagccattgtattctttatctctagtgtttctatttgttttttgattgtttctgtttcttcatcaaacttttattcatgtattgttt

SEQ ID NO: 59075 - DNA, 201 bp, Homo sapiens
aaaatccctaccagggaagcccggcctgggaaggtactaggatccccctgatgccccagagcattatgatccaattatataaccccctcatagtcagagaattatcatgcttcccctacatacccaactaagagttaatctagagtgagaggacactgaagccattcaaaatatatgtcacacaaaagctaaggaggtgac

SEQ ID NO: 59076 - DNA, 201 bp, Homo sapiens
atctgcttcaattcttttgcatcttgctcaagcctgctgttgaagctttctattgcatttttaaagtttagccattgtattctttatctctagtgtttctrtttgttttttgattgtttctgtttcttcatcaaacttttattcatgtattgttttccaaattttatttgatttttaatctgtagtatcatatagtttaca

SEQ ID NO: 59077 - DNA, 201 bp, Homo sapiens
tgagaagcccagattcagccggtgttaagattcgccgcgtttgctgtttctgtggttctcccctttctgaggtcacctcaaacagacttcatgccattgcycctcttaacacttcaatttgtgtttttattattattatactttaagttctggggtacatgtgcagaacgtgcaggttcgttacataggtatacacgtgcc

SEQ ID NO: 59078 - DNA, 201 bp, Homo sapiens
tcctggatccaaacccatcaaccagggggtgttttcatgcaggtcactggagggcttctggacctcccccttctctatcacatctattcagcatgttgatktagcatgtgggaggtccaaggtgcagtgctgggggatccgaggagaggaagcggcagtctctgtcgcaaggagtcagctcccctccagtgtggccaggta

SEQ ID NO: 59079 - DNA, 201 bp, Homo sapiens
tggatccaaacccatcaaccagggggtgttttcatgcaggtcactggagggcttctggacctcccccttctctatcacatctattcagcatgttgatgtakcatgtgggaggtccaaggtgcagtgctgggggatccgaggagaggaagcggcagtctctgtcgcaaggagtcagctcccctccagtgtggccaggtagta

SEQ ID NO: 59080 - DNA, 201 bp, Homo sapiens
tagtgcaagcatgcaggatggtgaccaccagtgaggccaagaactggcctatccagtgggaaccctcttgatttggatagggctggcagaggacagagctsccagaagccagtcacaaccaggacacatctggtgaggtccggacagctgcaggaaagccgagactaaagggggaagttgggacagaagggaagggcaggg

SEQ ID NO: 59081 - DNA, 201 bp, Homo sapiens
cccagaaccagctgggatttgggggccgtggggaaccacactcattgaaaggagtaaggggatgggtgcagggaagttgaaatccttgtgctggatgatarttctgatttatatgcaaaggatgtgcaaaaactattagggtttcagatgagattctcttctttccttctcatttcctgaggcatctggttagcccacagt

SEQ ID NO: 59082 - DNA, 201 bp, Homo sapiens
tgaaaatctctgaaatggggagaatgtagaccttacagggtggctataaggatcaaagatgataccgcgtgctgtatccagcaccatactttaattacaartggcctgctgatgatctaaaatgtatcgttcatttaaagtgtgtgtgtttgttaagagcaaggagagtaatgacaggaaaatgatctttgttctagggtt

SEQ ID NO: 59083 - DNA, 201 bp, Homo sapiens
gccgtgacccaggtcagttcagcacctgagacatgagcatgaggcagctgtcgtcctcacctgtcaggagattttttggaaaaagatttggtgaagaagawgttgactccatgagcagctggattacaggagaatatgttggtggttccgaagaggaaaggatggcagggacaggagtctatagtcaagtagggggtttcc

SEQ ID NO: 59084 - DNA, 201 bp, Homo sapiens
gaacttttgtcttagacttagaagaccttcctatttttctttcctgccgagatagactttcagctctcaattgggtaattcagtgaggtcccctccttccttcttcacccccacttcctctcatctgctttcccgttttcataagccacagatttaggccttgttttattacatttcacagtgtgcttaaataccccctac

SEQ ID NO: 59085 - DNA, 201 bp, Homo sapiens
ccctgccccttagtgtgtttacaaagcttgacttgcccctcagaccactgcatcaattctctgagcttatgagaaagtatctagtggaagaacttcagtgyatttcgcggagccttcagagcaacatgtggaacagcgcctgcacgtggcagactgagcacaaccatcctcaccgtctcatccacccacagatgaacgagt

SEQ ID NO: 59086 - DNA, 201 bp, Homo sapiens
acttttgtcttagacttagaagaccttcctatttttctttcctgccgagatagactttcagctctcaattgggtaattcagtgaggtcccctccttccttcttcacccccacttcctctcatctgctttcccgttttcataagccacagatttaggccttgttttattacatttcacagtgtgcttaaataccccctacag

SEQ ID NO: 59087 - DNA, 201 bp, Homo sapiens
tggccatgaccatggcggctctagtcttcagccatctactgcaggcaacctctgtcttttcctgctcgtgctaaagcactgagagtgagtgatgggggctcccagctcagctacacctccacctaggcaagagaacacggaggccctctctccactgcttacaagagcatggccacccaggatcttagcctcatgttcatg

SEQ ID NO: 59088 - DNA, 201 bp, Homo sapiens
ggccgtgacccaggtcagttcagcacctgagacatgagcatgaggcagctgtcgtcctcacctgtcaggagattttttggaaaaagatttggtgaagaagwagttgactccatgagcagctggattacaggagaatatgttggtggttccgaagaggaaaggatggcagggacaggagtctatagtcaagtagggggtttc

SEQ ID NO: 59089 - DNA, 201 bp, Homo sapiens
tacatggctgatgaaatcatagcctgcctctcctgcaaatgccccttttctttgccatgtggcagtgagccctatcattgctgtgcctcagggacatcacktcctggccatatttcagtggtaaagtatgatatggcatccctcactccctcatgttttgggtgaaagctcaaatgaatgaaactcttagaaggtgaccgt

SEQ ID NO: 59090 - DNA, 201 bp, Homo sapiens
tatgaatatacacccactgggctaatagagaaagtgctcactttctctattaaaaagtgttggaagagtgggtacttgaacctagaaacaagatttccagygataacataacagaagaaaaaatgtcagcatcttgagaaagccggaagtgcagggaatgtgccatggaaagcaagaagactgagaccaggccaggtacgg

SEQ ID NO: 59091 - DNA, 201 bp, Homo sapiens
ctctctttacagccactaataggcagatgatgcatcttcacagcctcaggtttggtcgcccctgtgtggtgtgtagtgccggctttgggcttattcgcacyatggcgtgtgctgagtctggctgtgtcagtgttgggggggggctctgaccatggccccccttgcttctgctgtggtgatgcacagagcatatgccctaac

SEQ ID NO: 59092 - DNA, 201 bp, Homo sapiens
ggtgggggaggcaagctgatgaacccaaataatcttcatcactctctttacagccactaataggcagatgatgcatcttcacagcctcaggtttggtcgcmcctgtgtggtgtgtagtgccggctttgggcttattcgcaccatggcgtgtgctgagtctggctgtgtcagtgttgggggggggctctgaccatggccccc

SEQ ID NO: 59093 - DNA, 201 bp, Homo sapiens
gatctgcccaccttggcctcccacttgctgggattacaggcatgagccaccgtgcctggacttgacaacctaattttcatagaaaaaaatatattaaatayatatcatcttcatggtcatcttccattggatcatgtactttcagttagttacatctggcataatagcgagtccaaccagcatggacaggcttgggagtgg

SEQ ID NO: 59094 - DNA, 201 bp, Homo sapiens
ccagcccttgacatgaacagtaatctttagggcacactggaaaagttaggaattacaatgtgtgccagtgtgtggatgctgctttgttttagttgtttcarttttttccagtttcttcttggggacagggagagcattgaaatatttataagaatatcattggccggccagtgacaagtaccctcaactctctcttagatg

SEQ ID NO: 59095 - DNA, 201 bp, Homo sapiens
ttgatcattctacttggatcccaatttatggttcgctctcataaacagtgactgtcaaagaacattcctcagtgatgaaggctctgtgagtttgcaagtcyacgtggcacagagacagaggaaatctcagttcagtcatcctgcagaataaaaagagtgttctgttagaacaaagtggacgtagatcacatctactgcact

SEQ ID NO: 59096 - DNA, 201 bp, Homo sapiens
atgctggggcttagcttcccctcagctaatgaagcaggcatggatccttaaacagagaaggaaatatcaggctactatgatggcaattgctattatggtcmcttagttctctgttctcctcttaatttggcttctcaaggaagctttcctgctgggtagataatgaacaaaatgttttagatgaggactctggttgacttg

SEQ ID NO: 59097 - DNA, 201 bp, Homo sapiens
cagtgagctgagattgcaccactgcactccagccttggcaacagagtgagactccacctcaaaaaaaaaaaaaaacaggccacgaggtaggacatagctgrgcactattaaggggtcaggaggctggtcagtatggtggcagtagagagaggaagatggtgctatcaggacatgaggttccagaacttaggaaaaaagtct

SEQ ID NO: 59098 - DNA, 201 bp, Homo sapiens
aacggggctgggcactgtggctcatgcctgtaatcccagcactttgggaagccaaggtgggtggatcacgaggtcaagagatcaagaccatgctggccaaygtggtgaaaccccatctctactaaaaatacaaaaattcactaggtgtggtggtatgcacctgtagtcccagctactccggaggctgaagcaggagaatcg

SEQ ID NO: 59099 - DNA, 201 bp, Homo sapiens
ctaggtgtggtggtatgcacctgtagtcccagctactccggaggctgaagcaggagaatcgcttgaacctggaagtcagaggttgcagtgagctgagatcrggccactgcactccagcctgggtgagagagcaagactctgtctcaaaaaaaaaaaaaaaaaaaaaaaaagccctagaatggcttcccacttcactcaaat

SEQ ID NO: 59100 - DNA, 201 bp, Homo sapiens
aaattattcctaggtgtacattttaacaattagtttcattttccccttacatcatttcttgcaaggtaagcattgaagaattctgaccctctgcaaaagcrttacaaagtgaatgtatgtatttgacatgcaaagggcttgggttttgccattaattccaccatttatattattaggcaactttgagaaaaacctatacaa

SEQ ID NO: 59101 - DNA, 201 bp, Homo sapiens
ggcagaggagagccctgaaggacacgggagccctggaccctgatccagctggctcaggcatcgagttccaaggaagacactgactcccctggcttcggtcrtgtgcccagcattgacccgatcatataacctgtgggatggacctctctgattcaatcttatgtgcatacctctgccattagataggaaagttagctccaa

SEQ ID NO: 59102 - DNA, 201 bp, Homo sapiens
agccttttgatatgtactgaactgctccagaatgacatgattattcttgtaaaattcagattaaattttaaaaattattcttagtagacttcatttttagracgattttagagtgacagaaaaattgcaaagctagaacagatggtttccagacactccacatcccatttcccctattcttaacatcttaccttagtattg

SEQ ID NO: 59103 - DNA, 201 bp, Homo sapiens
cagattaaattttaaaaattattcttagtagacttcatttttagaacgattttagagtgacagaaaaattgcaaagctagaacagatggtttccagacacyccacatcccatttcccctattcttaacatcttaccttagtattgtacatttgttacagttagtaaaccaatatttgcatagtattttaaattaggtttat

SEQ ID NO: 59104 - DNA, 201 bp, Homo sapiens
ttgggaggctgaggcagaaaactgcttgaacccgggaggcgggggttgcagtgagccgagattgtaccactgcactccaacctggcgacagagtaagactmcaactaaaaaaaaaaaaaaaacacgaattcaaactgacttaaagaaaaacaaaataatgtggagataggcttatgctactgaaaaatctaggcatggctg

SEQ ID NO: 59105 - DNA, 201 bp, Homo sapiens
ggctgaggcagaaaactgcttgaacccgggaggcgggggttgcagtgagccgagattgtaccactgcactccaacctggcgacagagtaagactacaactaaaaaaaaaaaaaaaacacgaattcaaactgacttaaagaaaaacaaaataatgtggagataggcttatgctactgaaaaatctaggcatggctggataca

SEQ ID NO: 59106 - DNA, 201 bp, Homo sapiens
agaaccacagttgacttcctccgggaagggcattggagacatgatgtgctttccccaaatggcttttcactcattcgttcttggaacacatctgctatgcrctggcccgaggcagcatccctgcccacaggtaggagccctggggcctctcaggaggcaaaagcaagtgtggtaaatacaagaggaagacaaccttgggag

SEQ ID NO: 59107 - DNA, 201 bp, Homo sapiens
ggaaatccagagtcatagaaaagataaaccagcagacagcgttcatttacccaggctgctgtgtttgcagaaccacagttgacttcctccgggaagggcaytggagacatgatgtgctttccccaaatggcttttcactcattcgttcttggaacacatctgctatgcgctggcccgaggcagcatccctgcccacaggta

SEQ ID NO: 59108 - DNA, 201 bp, Homo sapiens
ttacctttccaggaagtaaaacgtctgtctttttatgaccttacataagatcccacagtaatacttcatttgatgtcaatgaataagtggaaatccagagwcatagaaaagataaaccagcagacagcgttcatttacccaggctgctgtgtttgcagaaccacagttgacttcctccgggaagggcattggagacatgat

SEQ ID NO: 59109 - DNA, 201 bp, Homo sapiens
gctaacgcacaaaagccacgggaagcactctgttggcccctcctccgctatcctgaccgggatcagcaggttctggacaggcagggcgcgcagagagttgyctgcgggctccgtgcctttgagcctctttcctttaatgatgttttctttcagtgctggagctgcatctgctcccaaggtcagcactcagccccctttggt

SEQ ID NO: 59110 - DNA, 201 bp, Homo sapiens
cggttcactttgttttacgtgcgtttcgcagatgagtggtgctctcatcagcagacacaagacttctttggcctctgcttttttttcctttcttctaatamggagactacactctagataaacaaaacagacaggcgaatgtaatccagggttttggtggtttttctgagtctagaaggactaaaaattagccttgatagg

SEQ ID NO: 59111 - DNA, 201 bp, Homo sapiens
aggattcttctcttgatttcttttttgaagagtctctttttagtatatagaaatgctactgatttttttgtttattttgtatcctgcaattttactgaatktgtttattctaaattctagcagtttttttagagaatctttagaattttttaacatgaagaaacacgtcatcaacaaacagcaacaattttacttcttcct

SEQ ID NO: 59112 - DNA, 201 bp, Homo sapiens
tgttctagactcccatggaaacctgaaatgctgttgactctcagcctgtaccattggtaccccatttctgagcagcagcagagaattcgtcactggatgtstgactcccagcctccactctcagggcaggattcagggtgacccagaagtttgttttagaaataaacctgtttaatattcttaacacataaagtttcaaat

SEQ ID NO: 59113 - DNA, 201 bp, Homo sapiens
tgacatttcaatagaaaccgccagaagaaaatggaaagatatcttggaaggtcaagatgtaagaaaaactgccaatgcagaattcaaactgggagaaaatwctcttaaaaatggaggaaaaataaagatatttaaaaaccaaaagcaggtgataaaattcgtctctaacagaatcaaactgtaagagctatgaaaggatgt

SEQ ID NO: 59114 - DNA, 201 bp, Homo sapiens
caatcttgacatgcccagggattggacttttaaaatctttgagtgtagagtgctattcccttttacttcttctcttgcagaagaagcctagactgtttacyccctccccacccaccatcttttttttttaagaagttaaacttttattttcactgcccaaccatcagtcaatatactgggcaaaccagcagaagcccttgc

SEQ ID NO: 59115 - DNA, 201 bp, Homo sapiens
tgaagttggacttgtacttcaagctacatacaaaaattaattcaagatggctaaagatgtaaatataatagctaaacccatacaactcttaaaaaaaaaaraaaaagatatgtgtagatctttatgaccttaggttaggtaatggtttcttagacatggtaccagaagtgtaagtagccaaagaaaaaaatagacaagacc

SEQ ID NO: 59116 - DNA, 201 bp, Homo sapiens
caaatgatcaatatggagttgtgatttttgcaccaatagtgtggtttggttaaacagacactgcctcaaagtctagaaacttggattctgatatctaagayggatttcatgcattaagcttttcgaaagcgctttactgtgttgacttatttgagctcccttaacctcatgagaatcttagaggagagaatgcagttttca

SEQ ID NO: 59117 - DNA, 201 bp, Homo sapiens
tccaaagactacgccaatgcccgtggtaactctcggcgtggtgtggtttttcagcaggtgaagggaaagttcagatggatctccagttttcaccccataaytgctagtattttaaagctgccttaatccaattccaataacatgacagctgtcttataagttcagttaattgcactctgtagtcggcctctgcaggagctg

SEQ ID NO: 59118 - DNA, 201 bp, Homo sapiens
agctgggccacaatttcgggatgaatcatgacacactggacaggggctgtagctgtcaaatggcggttgagaaaggaggctgcatcatgaacgcttccacsgggcaagtaccattgcttccatctgctttgacagtgtgcatggcttgaagtgtgtgttgggaaccagatgagtcaaagtgtctctggttttctggtcaga

SEQ ID NO: 59119 - DNA, 201 bp, Homo sapiens
cgttgaaaccggccgatgcgtccctcacacatcatgtgatttccctcgggctcaccacgctctgcctcattttacggaaaaggaaagtcttgcgctccctytactgctgtcgatcctcgtggctatatgtgcagctggaggcttctcatcatcagctctcagcttataagctcaccatccccaacaaaaaaggggggcttt

SEQ ID NO: 59120 - DNA, 201 bp, Homo sapiens
taattaaaatccatcactttctacatcattataaaatatagtatggtgtcaaaattccctctgaaaggctaaattttatcttttgataatggcaaaatacmtaagtgttccattattaaggactcaaaggctctacattgatgtaatatggtagtgataagaaaaccattgtcattctttctaagagatgtgaaatcgctt

SEQ ID NO: 59121 - DNA, 201 bp, Homo sapiens
tcatcgtttttctctcccagtacaagaatgcaagtcctgagggcagttttctctacgtccctctctgaaatgcacaggacggagagagaggcaagccttctgggatgaagctgtgttcaagagatgagggtctcagcagtatagacggagggagctggctcactttggggctgctggcttgaagaagaaagaatgggcttt

SEQ ID NO: 59122 - DNA, 201 bp, Homo sapiens
tcttcctgactagagtgaaatatagggctgttttccttttgattcaggggtgagcttatggaaccaaggaagagctgatgaagttgtcagtgcctctgttsggagtggggacctctggatcccagtgaagagcttcgactccaaggtgagttcctctccttttctcagctttgagactgccgaagcttttaaatcacatta

SEQ ID NO: 59123 - DNA, 201 bp, Homo sapiens
cttccaaactacaattacaaatataagttatagcactctgaagataaaactggtaattaaaatccatcactttctacatcattataaaatatagtatggtrtcaaaattccctctgaaaggctaaattttatcttttgataatggcaaaatacctaagtgttccattattaaggactcaaaggctctacattgatgtaata

SEQ ID NO: 59124 - DNA, 201 bp, Homo sapiens
tggggaagtacatttgcatcgtggagtcattttaagtaagattagattgagtaaattgtgggcttaattcaagatgccatcatttctctttcaaaaaaaayataatgacattgggaacttccaaactacaattacaaatataagttatagcactctgaagataaaactggtaattaaaatccatcactttctacatcatta

SEQ ID NO: 59125 - DNA, 201 bp, Homo sapiens
agggaaatcagtgacacagggaaggaggagctgatttgactgaactggggaagtacatttgcatcgtggagtcattttaagtaagattagattgagtaaaytgtgggcttaattcaagatgccatcatttctctttcaaaaaaaacataatgacattgggaacttccaaactacaattacaaatataagttatagcactct

SEQ ID NO: 59126 - DNA, 201 bp, Homo sapiens
tgacacatgtgggaagcactttgtaatctgtcaagtgcctggcaactgggagacatccgacacaagactgccactgacaacagacacagctgctcacacaygcaggtcactgcggaaaatgctccaagagatggacagagtcaggctctggagcaggaacttcctagaatgatggagttgacagggccaggtgagtctagt

SEQ ID NO: 59127 - DNA, 201 bp, Homo sapiens; identical to SEQ ID NO: 17060

SEQ ID NO: 59128 - DNA, 201 bp, Homo sapiens
aaaaaaggagcctgactcagggaatcttttcatacatcatagctgctattattattattgatgtgctggtaatgctggtaataacacttttcttttttttyttttttttttttttttgagacggggtctcactcactgtgtcacccaggctgaagtgcagtggtgcgatcttggctcactgcaacctccgcctcccaggtt

SEQ ID NO: 59129 - DNA, 201 bp, Homo sapiens
tcttttcatacatcatagctgctattattattattgatgtgctggtaatgctggtaataacacttttctttttttttttttttttttttttttgagacggkgtctcactcactgtgtcacccaggctgaagtgcagtggtgcgatcttggctcactgcaacctccgcctcccaggttcaagtgattctcctacctcagcct

SEQ ID NO: 59130 - DNA, 201 bp, Homo sapiens
caacctccgcctcccaggttcaagtgattctcctacctcagcctcccgagtagatgggattacaggcacgcactatcacacatgctaatttttgtattttyagtaggaatggggtttcacaatgttgcccaggctggactggaactcctgacctcaagtgatctgccagtctcagcctcccaaaatgccaggattacaggc

SEQ ID NO: 59131 - DNA, 201 bp, Homo sapiens
cacaatgttgcccaggctggactggaactcctgacctcaagtgatctgccagtctcagcctcccaaaatgccaggattacaggcatgagccaccatgcccrgcccttggtaataactattcttaatgtgttttatcacagtttaaactcttacctcctctgtcgtgctcccacaccctggtcatgagatatatttgaaatg

SEQ ID NO: 59132 - DNA, 201 bp, Homo sapiens
tcgccatgttgtccggctggtcttgaactcctgaccacaggtgatccacccacctcggcctcccaaagtgctggaattacaggcgtgagccaccgcaccckgcctccctttgcctatttttttaagttcgcatccttaataaaatcaactttaataaacaaaaatcctctcctacctattccaaagttagaagtctacatt

SEQ ID NO: 59133 - DNA, 201 bp, Homo sapiens
gtgttaagaaaaaaacaacaaagtattctaggggccagcagggaagatggattttgatagtttggccaggaaagccctttctaagaaggaaagatagtttwttcaataagttctaaagagccagccatgagaagagccagagtgtaagaggctggaggagcagggaggaggcaggtgtgtctagagcatggaaaataagac

SEQ ID NO: 59134 - DNA, 201 bp, Homo sapiens
ttgccaaggtcagagatggcttcctaatttccaaagccagcacacacctttcactctttatcttacttatcttgatacccattccctctcctcctctgaamtcctctcttctttgggctcctgagaccccgttctcatgtttcttctcatatgtttttgtttttgcttttcattagctttcctggctctgtccctcattct

SEQ ID NO: 59135 - DNA, 201 bp, Homo sapiens
tttcactctttatcttacttatcttgatacccattccctctcctcctctgaaatcctctcttctttgggctcctgagaccccgttctcatgtttcttctcrtatgtttttgtttttgcttttcattagctttcctggctctgtccctcattcttggtgtcctctgagtttctttgtggccccacttctgatgaagggtccc

SEQ ID NO: 59136 - DNA, 201 bp, Homo sapiens
ctggactctagagcccccacccctacatcttagccatgaagcttgtcagggcagccagttgcctaaataggccacgttctttacaccatgcttgcactatrttctgtccccatgtcccctgactccctcagtcctactcattcttgaagcaccacttaagcactcattcttaaatggcaccttctcttgtgaaacccatcc

SEQ ID NO: 59137 - DNA, 201 bp, Homo sapiens
acgcaacttaagtgacataggtgatcacatccccttgggtccccaaggagcatgtgggcatctgctgttttcttagttccttctgcctctcatgaggcaascttcttacttcctaagagcagttctagttctttctgttggatatcatgaaatagcgcaacccctaaaataagccaactcgactatgctcaacccaataag

SEQ ID NO: 59138 - DNA, 201 bp, Homo sapiens
ttatattaaaacaacgcttgactacagcaccgttgtagaatgtaacatatgcctgcatagagagccgctgtgggaagaatttccttttggatatatttaasacactcctcatgctcttgtgtcttgcacgtgtccctgagaatgtgaggaagacatgcattgttggtggtgcacactagtgttttaccagcattttttgtt

SEQ ID NO: 59139 - DNA, 201 bp, Homo sapiens
gcgaggtagctgcatccattatttggaattctcatgcatgtgagatttgtctgtgctccctatttatgtttttaatcatttaacgacattaatgtggtctyatggttattgatatggtttggcagtgtccccacccaaatcttattttgaattgtaattcccacaatcccccacatgttgtgggagggacctggtgggagg

SEQ ID NO: 59140 - DNA, 201 bp, Homo sapiens
agctactttgcaacttgctcaaacagaactcttagaaatgttaactcctcctgcactacaaacataaggaagagttaagagcccatcaggggtaaaaaatkctatcatatctcctttgaaatccagctccttcttttgtagttcaaaacaagaccacgggggcatataatctctggtcgtgcctattcagctaataggaat

SEQ ID NO: 59141 - DNA, 201 bp, Homo sapiens
ctgagtagtcaagtgacattttgggggtgtaattttagacaaggtttgaaaatagagtattgaaaattttatatagacaatgggctctcagacaaatcttyttttcctgaaaatgtccatgtcgtatctcttgattgatttgagtgtgtctcatttatgagtggagggtgctcccaaaatttgtcccaaattcaaagcaga

SEQ ID NO: 59142 - DNA, 201 bp, Homo sapiens
ttaatcttacagataactacacatctatagtcacaaacaactggcatcagagaattcccgaaatgtgttagttttttctattttatcactcaccagaatcyaatgtttggtttctgcagtgtgagctgaccagaccatttttatgggctggtgaatactcagtgtttatttgcaaatctggtttacatgagcttggtttat

SEQ ID NO: 59143 - DNA, 201 bp, Homo sapiens
attaatcttacagataactacacatctatagtcacaaacaactggcatcagagaattcccgaaatgtgttagttttttctattttatcactcaccagaatstaatgtttggtttctgcagtgtgagctgaccagaccatttttatgggctggtgaatactcagtgtttatttgcaaatctggtttacatgagcttggttta

SEQ ID NO: 59144 - DNA, 201 bp, Homo sapiens
gcaccccagtgaccttgcccgagttgctgagttgcccagaattctccagttacattcaggatgtccattactcaccctccagatctggcgacccaaacacygactggacgaagcccttccttccaactaatgattcccttttgaaatgggcttttctcaatctggcgttatatttcaataaaacaatcctgcttccaaatc

SEQ ID NO: 59145 - DNA, 201 bp, Homo sapiens
gtcctgctgtgtgtaagatgctgactcaagagccccgactctgccagagtgacacacttcccacagtccctgtgcactcctgcctggatctggaggggagkgcggatgtgaatccttcacaatatcctcccgggaggcatggatcccggacaaatgcagtcctgggagcggaggtgacttcctcagccaggcccctggcca

SEQ ID NO: 59146 - DNA, 201 bp, Homo sapiens
ccattaataatagttgtaatccagcagcagctaacactcatgggttatattgcatgccaggccctgtgctaggagcctcaatatctcatttaaccctcacrtccacccgggaggaagggactatgatcatccctgctccaccagtgaggatactgtgtgtgtatgtggaactggttgaatatataaacaatccgtgctctt

SEQ ID NO: 59147 - DNA, 201 bp, Homo sapiens
gtggaggaaagcagccaactaggaggctttgaagacaaggttgccgtggaatagtggtttgccaggggtggaagaggatggatatttccagtatacagaayagcaacagctcagggcacaaagggacagtggggccaaccagggcaagtgcaggtagttctgtgtgtgtagagcttgggctgtgccttgaagagcagagat

SEQ ID NO: 59148 - DNA, 201 bp, Homo sapiens
agacttctgcctatttatgttctcctcctccttaaaggctccccacaggcctgcctcctccctgaagctttccctgaccacccagactccactgaccacayggcatccatatctcattaaccacatagtcaggaccatccagccacacacagcatttcttctcttgtgtttggtttgttgaagggagacaactacctaaat

SEQ ID NO: 59149 - DNA, 201 bp, Homo sapiens
tggacgactgcatggcctccttgctgcactctcagcttccagtatcatccaatatcatctccctagaatccgttctccttccagtagccagagcaatatawtatatatatatatatatatatatatatatatatatatatttattttttttttttttttttttttttttttttgagacggagtctcactgtgttgcccagg

SEQ ID NO: 59150 - DNA, 201 bp, Homo sapiens
gcaggtgtgtgtgtgtgtgtgtgtgtgtgtgtgtgtgtgtgtgtgtgtatttgtgtgtatgtataatgaggaagacccataacccactaaaaaggtgggcrggagatttagtattagctcagctcagaggaggcatcctagagattttccctgcaacgacccttaatgaagactggcattccctaaaggcagggacttctt

SEQ ID NO: 59151 - DNA, 201 bp, Homo sapiens
gttcaagcgattctcctgccccagcctgtcactagctaggataacaggtgtgcatcaccacgcccggctaatttttgtatttttagtagagatggggtttscccatgttggccaggctggtcttgaactcctcacctcaggtgatccacctgccttggcctcacaatgtggtgagattacaggcgtgagccaccctgcccg

SEQ ID NO: 59152 - DNA, 201 bp, Homo sapiens
ggcagggacttctttcctgctccttagggtccaccatatccccttgcacaataaatgcttaacaaaaatgtatcatccctctcatagtgcacaatttcatrttttggtcccattctcaccaaacagctatgagactatgttaataatttccctgtacctgtgctactctgcattacaaccttcttttatttactgagaaag

SEQ ID NO: 59153 - DNA, 201 bp, Homo sapiens
gagcaataggaagtcacctgcttgggctctcatcatccccatgatggagggggaggctggaggtctgagcacccaggtagccacgtcctcttcctaaggarggggcttccctgggagctcctggcttagctctactctctcccacccactctctccctggtaaccaggaggcctttgctggggtggtggtgggtggtgtcg

SEQ ID NO: 59154 - DNA, 201 bp, Homo sapiens
aaatatcatctatcacttttttttttttttttgagacagagtctcactctgtcacccaggctggagtgcagtggctcagtcttgtctcagcacatcctccrcctcctgggttcaagcgattctcctgcctcagcgtcctgagcagctgggattacaggcgcatgccactatgcctgggtaatttttgtatttttagtagag

SEQ ID NO: 59155 - DNA, 201 bp, Homo sapiens
tcgaacagctggccccgtttccagagtgaggtcagagggaactcgacagtgctgtctgagccacccccattgtgtgactcagctggctgtgtgcctctgaytcatggtgaccaaagctggtatttattatctcatcagtctagtccttctgtagctgcctgaccagagagagaaccagacaggcagacagactgacaacct

SEQ ID NO: 59156 - DNA, 201 bp, Homo sapiens
tttagctcggcctctgaggagttgttctgatgctcctcagcactcagggatgcgcgtgggcaggtgggatggggaggcctgcagttcccgggcccttagtrcttcatccttggaccctgagcagccctcagtcctggcatcatcgcctgctgggccttggggcaccctgggcaaagcagggggcaggagcagtgggggaca

SEQ ID NO: 59157 - DNA, 201 bp, Homo sapiens
cttggaactggtgttctagtggtgaaaagagttgaaaaatggaaaatttaaaacttgcagtttgggccaggtgtggtggttcacacctgtaatctcagcaytttgggaggccaaggcaggaggattgcttgaggccaggagttcaagaccagcatgggcaacatagcaagaccctgtctctatttttaaaataaaaaaata

SEQ ID NO: 59158 - DNA, 201 bp, Homo sapiens
cttttttttttttgtttttgttttttgagatgtagtctctccctgtcacccaggctggagtgtgcagtgacacagtctcggcttactgcaacctctgtctyccaggttcaagcaatcctcccacctcagcctcccgagtagctgggattacaggcacacaccaccatgcccagctaattttttttttttttggtatattta

SEQ ID NO: 59159 - DNA, 201 bp, Homo sapiens
ttctgtgtggccactgatccttgaatatccagtttaggggatattgaccctgaaggactgcattcatggtgtcctgtttcatcgatgaactttttaaattwaatttaatttttttgagctgagcctcgctctgtcacctaggctggaatacagtggcacgatcttggctcactgcaacctccacctccccagttcaagcaa

SEQ ID NO: 59160 - DNA, 201 bp, Homo sapiens
taaaatgtttttggttgctaaaattgaacttataaccttctaaagcacaagttttataatttacataggacacaattcccttagatttaatgcatgtcctwgcttaacgtaaaggtaaagggaaaaaactctaagggataagactgcaatagttaatagttaatctgtaagttaaaaatgtttgtttttattaaaatatcc

SEQ ID NO: 59161 - DNA, 201 bp, Homo sapiens
gcagggttaatctgtctcaaagctgctctgtggctaggccaggattcaaacatattgcttatttccctgtcctgtgaccttctaaagcctgtgcaaaaatkattttcctttaccacattccctggttttgctcaaagcatatctcacttcaaaaatgcccaagagccaggaatagggtgattttcttaattgccctgaatg

SEQ ID NO: 59162 - DNA, 201 bp, Homo sapiens
acatgctacccatatatgttccatgaatttgaaaagattaagtaattaggccccaggctcagagtataaattatgatttaaggaggcagagtattaactaygcctggaagttagggaggatgtaagagtatgtataaagggcaatgtctgcaatctggatgggaagagagtagaccaatgtgtttttgtcttctgagtatt

SEQ ID NO: 59163 - DNA, 201 bp, Homo sapiens
tttattgcttgggattaaatataacctttgatgatcatcctcaaagcttcttaccagctggtcacatcctacaagtcttgacctcctataaatacaacctscttctccaaaaatccactgattcagctatgtcagccaccccaccccttaccccatgttcctcatttagcctagaaatgtggaggttcttctttccttatt

SEQ ID NO: 59164 - DNA, 201 bp, Homo sapiens
tccagtttttagaatttccatgtggctctagttctctgctgacttttctgtttttcaatttcttgaacatatgaagtgtggcattttaaattttaaattcygcttctgagttcctttaactgcatctcctataggtcagtttctattgcctgtggtttttttcttgtatttcagtcttatcttctcggtgttcacttatgc

SEQ ID NO: 59165 - DNA, 201 bp, Homo sapiens
cttctgtaaggctgctgcaatttgctgggggtctgctccagaccccagtagcctcagtttttcttgtaccacttcccatggtgagggttcccttggctccrtgtcactcccaggtgggccattgcctcaccctgcttttttttttttgttctccatgtgtctatttgtttcctgaatcaatcccatttagtgtataatcaa

SEQ ID NO: 59166 - DNA, 201 bp, Homo sapiens
tgctttcagctatcaacccaggactggacccagtgcctggctcataaataggccctcagttaataaatgtataatattcctttttgaaaaatttttgaagygtcatttattatgcccattttgatctaactataaaaagcatgaaaagggtgcaatttgggaaattagcaatcgataataagtgaaacggtatcttgtcac

SEQ ID NO: 59167 - DNA, 201 bp, Homo sapiens
ggcctttgccaaggtcagagatggcttcctaatttccaaagccagcacacacctttcactctttatcttacttatcttgatacccattccctctcctcctytgaaatcctctcttctttgggctcctgagaccccgttctcatgtttcttctcatatgtttttgtttttgcttttcattagctttcctggctctgtccctc

SEQ ID NO: 59168 - DNA, 201 bp, Homo sapiens
catcctgtacatagcattttaacaggttgttggctaaagttaattatccatcggaaaaattgtcagtaactcaagaataaacattatcattatttatgtartaacaaacaggccccaatccagggacaccccattataatgctgccgtgccttaattcctgactgtgttatactgcagttaattcaattttgtcctctcta

SEQ ID NO: 59169 - DNA, 201 bp, Homo sapiens
ggatagcaccaaaaaaaaaaaaaaaatagggaaatcaatctaatcagccaatcaatcaatcatcactttttgcacatctgtttgtacagccagttcactgkgatgccctagccaagtgcattgtgggaaacctctgagagaacacaggcacctgggggccctagaggtgggcagctgggtcctggccgcacccgtctttgc

SEQ ID NO: 59170 - DNA, 201 bp, Homo sapiens
gggaaacctctgagagaacacaggcacctgggggccctagaggtgggcagctgggtcctggccgcacccgtctttgcagatttgcctgggcttgccatctyaaggggagtctgccaaaaaagcctttctgtgaggaaggcacttgcctcctgtgagcacatgtgcactgaggatagagtgtctgatgagttttgcccaacg

SEQ ID NO: 59171 - DNA, 201 bp, Homo sapiens
attaccccgtgctctgcacattgtcctgtgttgtgtgtatccctctgtgctctgcatccttctgcctgttcctctgcagcttcgcccatgtcccctctcarccccatccctccagttattcccctcaagtccccatctctggttttcacatcccgcctctctgcttccctttggaactgtgctgtggaaaattcgttcacc

SEQ ID NO: 59172 - DNA, 201 bp, Homo sapiens
caagacaaatgcacactgctgacttaagcagagaggaaatgtttaggaaggaactggaggaaagcacaacgaaccaggtctcagaaaggtcgaggaccagrccacttggggatcttggaaaaagaaccgatggacacgctcagcagggtctgccaaggactgtccttgtgtcatctggtcatgttcctaccccttggccag

SEQ ID NO: 59173 - DNA, 201 bp, Homo sapiens
atgattccatttctataaaataacagaacgggcaaatccatagagatagaaagcaggttaatggttgccagagatggaggagcagggaatggaaagtgacygctaatgaatatgagatttctttctgaggtgacagaaatgttttagaatcaattagtggtgatgagtatataatattgtgaatatacaacaaaacccact

SEQ ID NO: 59174 - DNA, 201 bp, Homo sapiens
aaaagtagaaacaactcatgtgctcaacacttggataagcaaaatatgttttcatccacaaggcagaaggtgattcagctgtagaaaaggaatgacattcyaatgcatgcctcagtatgaatgaacttgagaacaccatgcttaagtgaaagaagccagtcacaaaaggcacttattgtatgattccatttctataaaata

SEQ ID NO: 59175 - DNA, 201 bp, Homo sapiens
attctgctgtcaccctgtttttcttcttaatttttttttactttgaaataatgtttgattgacaagaaggttgcagttttagcagagttgctgtggtcctkctgtttcacagcacttctggctctctgaaatggtcttcttttcatcgtttttctctcccagtacaagaatgcaagtcctgagggcagttttctctacgtc

SEQ ID NO: 59176 - DNA, 201 bp, Homo sapiens
atgtgcacaggagcaggagctcacatttttcctctcctccttttccatgtggttactgtgtgaaagggtgaatgtctgctccattcccctcgtcttccccyggtcctccccatggaactgtctctttacagggaagagggtgggaggagacaggccctgaaaatccctggtccctgctaactggggagtggctgcagcccc

SEQ ID NO: 59177 - DNA, 201 bp, Homo sapiens
gccagccagccagccagccagccagccagccagccacctcctttctgccctggatcagatctcattccacagccaggcctcatttcctgagaggccacacrtgccacaagcccagagagcagacctaaggaagagtaagcattggaacatgtgctctgccagaggccgagtcaagagaggatgcgagctgctgacacccta

SEQ ID NO: 59178 - DNA, 201 bp, Homo sapiens
ctgcaaatgctgattatatgtgctctctccgtggctggaagatgtgctaaaaatggccatttctgagctctctggctgccatgaccctctttgctgggaaycgtcatgttgtacatagggattaccagggtttatgactccatggcctctgagagaaatctctgccttgcaaataaaatagaaggtattaaaagaaggtag

SEQ ID NO: 59179 - DNA, 201 bp, Homo sapiens
aagaaagcaggggcaactcttgattgtattatttaactttatcttgaattcactgcattggattcatttttttgttgttgttcatttgccgatttgtatcygcattcttccctgggctttcttcccacattcttaaaccaaaatgttgtttacttttgtcttttaaataaccaaaaccaagcaaaacaaaatctattccta

SEQ ID NO: 59180 - DNA, 201 bp, Homo sapiens
tttcctggctctgtccctcattcttggtgtcctctgagtttctttgtggccccacttctgatgaagggtcccgctggtgatgtccctctcaactgtgaccycatggtctacttgcacctaggggctcacataagtgaaaatagcagtgagagctaccacacgtggagttcccactgtgtgaaccgctgtatcaggtgttac

SEQ ID NO: 59181 - DNA, 201 bp, Homo sapiens
ttctgtaattatcagtgtttcacatctcactggcatcaaatctcctgtttctcatctcattgctttttttttttccatttacaatctaatgttatcttctrttttcctcctggtaaagtaattgtccatttttcttagtcttttcttgacaacctggcctctcctttcataaaaggctctaataagcatttcctatagcac

SEQ ID NO: 59182 - DNA, 201 bp, Homo sapiens
cagtgtttcacatctcactggcatcaaatctcctgtttctcatctcattgctttttttttttccatttacaatctaatgttatcttctattttcctcctgrtaaagtaattgtccatttttcttagtcttttcttgacaacctggcctctcctttcataaaaggctctaataagcatttcctatagcacacctgcagccat

SEQ ID NO: 59183 - DNA, 201 bp, Homo sapiens
atagtattttttaaaatgaaacttttaggagggattactgaggctgatcattataaattacatcttttagtcattaaattgggcctccctcctcctcaacrtattagctatttttttccccagacacatggaaagctttcagcttctaatgaagaactcctttctggagcatgtttctagaatatgagtttagcagcacac

SEQ ID NO: 59184 - DNA, 201 bp, Homo sapiens
tagttctgacacattctatccagattgggttgcgtttctatgataatgattcagtttctcattcgtttatttacgaagcacttcttctatgctaggcattrtgctaggtttagaggtgttgtttctgctttttagctcaacccagtgtgggaggaagacaagtaaacaagaaataaggccgaatagggaaagtcttgttac

SEQ ID NO: 59185 - DNA, 201 bp, Homo sapiens
gagggagatagactgtaaacaagtaaaagaaaaacaacaaatcatcacaaatgaggaactttgctaggaagagacagaacagggtgtgtgagaaccaacarcccccttaggaggccgggacttctctgaggtggtgatgtccaggccagtgcctggaggttaagccacacaaagggcccagggaagatgttttggcagaga

SEQ ID NO: 59186 - DNA, 201 bp, Homo sapiens
tgaagaagagagatgggaaggacaatacagtctccagttgtctgtaaaaatgcctttgtctgtggatgttagtggcaggggttagggaaatcagtgacacagggaaggaggagctgatttgactgaactggggaagtacatttgcatcgtggagtcattttaagtaagattagattgagtaaattgtgggcttaattcaag

SEQ ID NO: 59187 - DNA, 201 bp, Homo sapiens
aatttacttttaccaatgttttttgtgagaaccaccagcatggttactgaaaatattccttggcaattaatcttacagataactacacatctatagtcacraacaactggcatcagagaattcccgaaatgtgttagttttttctattttatcactcaccagaatctaatgtttggtttctgcagtgtgagctgaccagac

SEQ ID NO: 59188 - DNA, 201 bp, Homo sapiens
aaattcaaaacacatgcctgcaacttctaactggcaaagcaatacactttgagaatgcctttgggttttttgttcatttatttgttgttctaattgttttkgttgttgataacgtacgttctcgttggctgagagtataatttttttctcactgatttttgtcccacaaatctggtatctcaagacttcctatgttgattt

SEQ ID NO: 59189 - DNA, 201 bp, Homo sapiens
ttgcatttttgttgcttgttgaaggactgaattatatatcttgtctatgataataccccagcacatgttacaggtcttgaaggaacaaattaattaacttytgttttctttaagttacaaaattttcatggttagattgacagagaattcagcagttttaacacttttcatgacttaatgggttctagtgtttccctgggc

SEQ ID NO: 59190 - DNA, 201 bp, Homo sapiens
cagttgtgtcctggcctggtgctctgtatggacgctcacaccagcctccttgctaaccttcctggagcctgtatttttctctttcccctccaagtctcatytgtgtggctgtcagaaccacctgtggctctgaagcttgtgtctgctcaggtcccttccgtgtttggcggctctgcatggcacaggataaagtcagcagca

SEQ ID NO: 59191 - DNA, 201 bp, Homo sapiens
gcatggcacaggataaagtcagcagcattgggcagcatgtaggttctgtccccagcctgcctgtctcagcagcagcgggtctccctgcctcaggccctgcrccctgaccacctggcatccgtgtcatttcccctcccctctgcgcgttgcccgctagcatgctgtttctgcacccccatgcctttgaggatgcagtcccct

SEQ ID NO: 59192 - DNA, 201 bp, Homo sapiens
gctgtttctgcacccccatgcctttgaggatgcagtcccctctcgctggaatgctctcctccccatttcccattcctctcctcaccttttccccaccagcscagctcattcttccccatctttcccagctcccttgggcaccccctccccaggctgacttctgggttggaagcctttcctggggctccagcagtgctttgg

SEQ ID NO: 59193 - DNA, 201 bp, Homo sapiens
aggatgcagtcccctctcgctggaatgctctcctccccatttcccattcctctcctcaccttttccccaccagcccagctcattcttccccatctttcccrgctcccttgggcaccccctccccaggctgacttctgggttggaagcctttcctggggctccagcagtgctttgggcgtgtccctgtcatggagccctgac

SEQ ID NO: 59194 - DNA, 201 bp, Homo sapiens
aatgaacattatttgccaattgaaatgtgcacattgaatattacactttctcacaggctgccatttcaatcttcatactttctccagcccatttttcaccstgtttcttttgtgctttgttgaatgcccaatataccttgcctccagttgatagatgggatggaaaagccgagtaattcagcatcatattgatatttttta

SEQ ID NO: 59195 - DNA, 201 bp, Homo sapiens
ggtcggtatgccctggcttgcagctttctgtggtagtcccggatgggttggagtcttgctttggtggaaggggaatctagccatgcaccagatttttgctkactccttttctttcccctttctttttcttctagccagtgtttatcagtggcctacttattgtgtatgagtccctgtgctaagtagtgaggatactaagac

SEQ ID NO: 59196 - DNA, 201 bp, Homo sapiens
tcatcccacaacaaacggcaaatagcaaaatcaactcctggcacagttaaaatgcattttacttcctggtattgagagaagcagagtgccttgttagatcrcctaatctaataagcagagaaaaagaatgttctcatgaaattatgcattcaccttctgttttcatttgctgacgtaagatagtccatctaattggatttt

SEQ ID NO: 59197 - DNA, 201 bp, Homo sapiens
cctgtttcttttgtgctttgttgaatgcccaatataccttgcctccagttgatagatgggatggaaaagccgagtaattcagcatcatattgatatttttyatcctttaagcttttatgtcattccaaggctacattaagagctcagcttcttggcaactatttaaaaaattggacagcttcattggataacgttttctgt

SEQ ID NO: 59198 - DNA, 201 bp, Homo sapiens
tcggctggttttccccgattgtctgatctctcagagttctgtatgagccagatgaaggcagaggctggccattcgcttcctttgaatacaactcatgttgkattcatactttgcccatagttgtacatcagaaacttgatgagttgtttagatatcttagatttcattgccaagtattcaagaccatcaaacccacagttt

SEQ ID NO: 59199 - DNA, 201 bp, Homo sapiens
ctattcactcagcaaacatttatttagcacctcctgtttgcagacactgttaggctatggggagataggctgactaaaatatattcctcagcatataaatyctgcttaagaggcacagagcattttaaagacatttaaaaaacatgttttaatgtaattactataataggagatgtgtacaaaataccactgtggtatttt

SEQ ID NO: 59200 - DNA, 201 bp, Homo sapiens
accttaagcagccaaaatcctaacagcagctgccaacctttcactctctgcattgtcttccgctttgatgcctgccgtgtgcccagggctaaaatccctascagggaagcccggcctgggaaggtactaggatccccctgatgccccagagcattatgatccaattatataaccccctcatagtcagagaattatcatgct

SEQ ID NO: 59201 - DNA, 201 bp, Homo sapiens
atttctgctgcaaagaaactgtaagcaaagtagcaacgtgtgatgttgtctcttcatctgaaccaacatggctaatttatgcaagtaagtaataatgtatyactgaaaagtaaaagaagaaactgcaaaatctgaagacttgaccataactacctgttagctttggcgatgtggctcacatatgttcacgtgcatatgtgg

SEQ ID NO: 59202 - DNA, 201 bp, Homo sapiens
tgcgaatatcttttaaacttagttatctttctcacattatcatcccctttgaagtcagagccatttggcatggctgcatttccatttgagctgctgcttayattactgggtgatttgagagaggggggaagatatttcttaaagaattttaggacccagatttaggatggctgatttaacatggaatttcaagaaaacttg

SEQ ID NO: 59203 - DNA, 201 bp, Homo sapiens
cactcattcttccagctaacaggattgggaaagcagccttatctccttgtttaaagtcaataggatgccagtagcttgcgaatatcttttaaacttagttrtctttctcacattatcatcccctttgaagtcagagccatttggcatggctgcatttccatttgagctgctgcttatattactgggtgatttgagagaggg

SEQ ID NO: 59204 - DNA, 201 bp, Homo sapiens
cattgctccacattgctgttctccggcaatagactctcactttttcttccttattggctaaatggtcctctcaaaggtcacagttgctaagtatattgatygatagggtttttctgccccgcggggattacaacatggtaagcctagtgactgaacactgcacactgtccagttagaaggtagcagtcaaggaagacacag

SEQ ID NO: 59205 - DNA, 201 bp, Homo sapiens
tggtcattggctgacacaaggagtaactaaagatatattttatgaacaaatctgtgtttattactcccattgaacataagcctttggaaggtaaagctgaygtccctgtgtccctttgcactcaggacaggggtgcctccagcagacagggtgctcaatgtatgtttgttgttagtaataactataacttattgggtgatg

SEQ ID NO: 59206 - DNA, 201 bp, Homo sapiens
gtgaggtgagccctttagatgaggtaggtagcatatcagagagaagagcatgtgcaaagctcctgaagcagaaagatgcctgggatattcccagagcagcraggtggccagcataactagagtggacagggacagggaggcagtagagagaaatgaggtcagaagggaagtggaaaggtaggatcaccaggggtcacgaag

SEQ ID NO: 59207 - DNA, 201 bp, Homo sapiens
ccataatatttctgccttttgtcagttgatttgtagtgaactttcagagggcaaaggaggacattttcccttagcccctacaggtatgtatgtgaattatyctaggaagagtctgaggaggttcatgtctcacaaaaggttagtagtcactgtattagaagggtccatttccagtcagatgaattttacatgaaaattttg

SEQ ID NO: 59208 - DNA, 201 bp, Homo sapiens
aacactgtatcctaatcccaaggaacagagcttgaaaattacccccccaacctctacccctacaagctcaagagacttttcaacttgtgcttctccccgcwacctgtcttagtggtggatttaaagatcagcctctggggtcccacggcaggtttattttactcttcaaatgcttttgcctttgattccaaaccttggaga

SEQ ID NO: 59209 - DNA, 201 bp, Homo sapiens
ttgctttgagtaccttgttgaatgcacgttgcccacgttacaagatttataatttgatggcttaaatgacactcaaatatgtttgtcgtttcatatagaartacacacttggtctgtacttgccagccatattttaattcttttagcttacagctttctagaagcatgattgtaatttccagtcattttgacttgtggaga

SEQ ID NO: 59210 - DNA, 201 bp, Homo sapiens
actggaggaagatgaagcttctacctcgcaaatcccatgacaatgcgcagcttgtcaggtagggagttacgtcttgtctgcttaaaaaaaaaaggagtgcyctcggcgaagcccttcgtttcacctgcacagccccaggagctgccacctttctgcagagcacactgccttgtgcaagggggcttctcagctcacaccagg

SEQ ID NO: 59211 - DNA, 201 bp, Homo sapiens
tttcaccatgttggccaagatggtctcaatctcctgacctcatgatccgcccacctcggcctcccaaagtgctgggattacaggcatgagccaccgcgccmggccgaggagcctgtttttaaagattcatcattattagtggaaaatgtatgtttatacaatatctaaggacagtactttgggtgaatactgtcagattcc

SEQ ID NO: 59212 - DNA, 201 bp, Homo sapiens
tttggatggttttctgatggttctgtctccaagcccaatggcccaaagtctgaggtttttagctttttaccactgcaaatgctttacatgccttctggccrgtatacagtttgtctttaaaataaccttattcttggaagtcagaaacccaggtttattgctttacaaggaccattttgtcatatataagctatatatgtt

SEQ ID NO: 59213 - DNA, 201 bp, Homo sapiens
tgaaagtcattcctttttatctaactggcctaaaacagccttgctttggaaataatattaataacatgaataaagagatattttttcttactacaaatgtraactgtttatcaaggtcttttaagagacattctgtttataatcattgatgcatgaaagaatgtaaaacaatctggcaactaaaaaccaagacattcaatg

SEQ ID NO: 59214 - DNA, 201 bp, Homo sapiens
agcaaaaggttaatgaacccccagccgcaagagtcagagaatcgggacacctcccatttccaaagtctgcctggcaacacaaagagccagcaagaataagwtatagctggtttataatcttaaatgaaatgaatggctcttcaaacagatgactcaatgtggtcagatttattatgaagtattgtgaattttccaactgtc

SEQ ID NO: 59215 - DNA, 201 bp, Homo sapiens
gttgttggaagattaaaaactccttaatacagtgcctgggacatggccatcatcccaaataattactgttatttctgatgatattgtctgtattgtatcartattatatggatgggtattgtatggaccttgtagcctaaataatagttttctttgaagaatacgttgggttttttgcattggtttattgtaaaaattggg

SEQ ID NO: 59216 - DNA, 201 bp, Homo sapiens
gtgaaaatcaacaaaataacaaatttggtgttcattaacttcctttctaagaagcttctttgtacgtgataaggttttgtaattgaagagggaaaaggatygataacttccaatgcaaaagcaaattaaaacttcataaatatttatctgaggaaaatggggcacttctgctgcttggttttaaatccttgtgaaacaggt

SEQ ID NO: 59217 - DNA, 201 bp, Homo sapiens
ttttcctcacctcatacatacatcgctgcttttagcatttcattgctgttctattctcttctgtgacatttcaatattttcagccagttctctcacctgcsggggagccagcaggggcactgctgcggatcagaatgattttcccagcaggtggttcaaccattgattccagttggtggagactgtgacttccaagcagga

SEQ ID NO: 59218 - DNA, 201 bp, Homo sapiens
gatgtgcaaaatcatttttcctcacctcatacatacatcgctgcttttagcatttcattgctgttctattctcttctgtgacatttcaatattttcagccrgttctctcacctgccggggagccagcaggggcactgctgcggatcagaatgattttcccagcaggtggttcaaccattgattccagttggtggagactgt

SEQ ID NO: 59219 - DNA, 201 bp, Homo sapiens
atagttagcataaacggggtttcctccccctttcaatttatcttagaaattcaatatttcaggatgtgcaaaatcatttttcctcacctcatacatacatygctgcttttagcatttcattgctgttctattctcttctgtgacatttcaatattttcagccagttctctcacctgccggggagccagcaggggcactgct

SEQ ID NO: 59220 - DNA, 201 bp, Homo sapiens
tcggatttcatattcaaagtcataaaagaagaaaatggcagaatgagatttgttcttccactgttgctatactactgctagagatatattttgaaggtagwttggtcttcttgtccacattttattactgagaaatgtatcagcccaaacattctgcagatactgactgaaagtctttcggatccaggaactggcctcaga

SEQ ID NO: 59221 - DNA, 201 bp, Homo sapiens
tcatattcaaagtcataaaagaagaaaatggcagaatgagatttgttcttccactgttgctatactactgctagagatatattttgaaggtagtttggtcytcttgtccacattttattactgagaaatgtatcagcccaaacattctgcagatactgactgaaagtctttcggatccaggaactggcctcagaagtgagt

SEQ ID NO: 59222 - DNA, 201 bp, Homo sapiens
atttgttcttccactgttgctatactactgctagagatatattttgaaggtagtttggtcttcttgtccacattttattactgagaaatgtatcagcccaracattctgcagatactgactgaaagtctttcggatccaggaactggcctcagaagtgagtaagaaagaccccatcagttagcccagctgaaaaggcacct

SEQ ID NO: 59223 - DNA, 201 bp, Homo sapiens
gtattaactgtagttaccatattgcacagtagatcttgaacttattcctcctaaccgaaattttgtgtcctttgacccacatctctccacccccaagcccyccacccctggtaagctctgcttttaagagttaactttttaagattctacatataaaggagaacaatatttaaggcagatacgtaattagtgcagattttt

SEQ ID NO: 59224 - DNA, 201 bp, Homo sapiens
tcattagaccagaaaaaggtacagaccttcctgatagcgtgacctcccctctgccatggcagggttgagattcagtctttgaaatgtgtctactgatgccrgagagcatgggcgtctgcaacggtgactgacccctctcctgtcctgcatctgcacctcccacagggggctttccagggagggccgtggactcaagggagg

SEQ ID NO: 59225 - DNA, 201 bp, Homo sapiens
aggtattacagctcaatctctggaggaggtctgatcaagaaagactgtgaaatttatagtatggttctataatgtattcatagtctactgtcaaataataktataccacagtgggagaatttaaaaatatcttcagtctaggatctttgcccttctgtgaaccagccaatttggtgtataatatgatggtgttctcacaat

SEQ ID NO: 59226 - DNA, 201 bp, Homo sapiens
gaacaattggttaatcacattttctctaaagtagagttggactcctacttggtactggacacaaaaatcaagtctggatgggacttaaatgtgaaaggcaraattatgaaacatttagaagataacacagtctgctttttgatcttggagtagggaaggatttctcaaataaggcacaaagactttaaaccatgaaggatt

SEQ ID NO: 59227 - DNA, 201 bp, Homo sapiens
tccaaagccagcacacacctttcactctttatcttacttatcttgatacccattccctctcctcctctgaaatcctctcttctttgggctcctgagacccygttctcatgtttcttctcatatgtttttgtttttgcttttcattagctttcctggctctgtccctcattcttggtgtcctctgagtttctttgtggcccc

SEQ ID NO: 59228 - DNA, 201 bp, Homo sapiens
agtgaaaatcaacaaaataacaaatttggtgttcattaacttcctttctaagaagcttctttgtacgtgataaggttttgtaattgaagagggaaaaggaycgataacttccaatgcaaaagcaaattaaaacttcataaatatttatctgaggaaaatggggcacttctgctgcttggttttaaatccttgtgaaacagg

SEQ ID NO: 59229 - DNA, 201 bp, Homo sapiens
ctctactaaaaatacaaaaattagctgagcatggtggtatgtgcctgtagtcctagctactcaggaggctgaggcaagagaattgcttgaacccaggaggyggaggttgcagtgagccaagatcatgccactgcactccagcctgggcaacagagggagactgtgtctcaaaaaaaaaaaaaaaaatccctatgtagcaca

SEQ ID NO: 59230 - DNA, 201 bp, Homo sapiens
tccttagtgactgcctgccatcgaggctgcactcagcacaaccatttggaagagtgagctcaggatcccattcacaatgctgggtcttcagtgaccatctyctgaaaagagacaaacgtctacaggattaagaactgagtgatgatgtgcacctgagatacagagtgaaatgagctgctgcacacacggcctagggagtcc

SEQ ID NO: 59231 - DNA, 201 bp, Homo sapiens
gaacccagaagtggaggttgcagtgagctgagatcatgccactgcactccaggctgggtaacagagtgagactccgtctaaaaaaaaaagaaaaaaaaaaagagtgaattgggcagatgtagaagcaggcacgctacacgctagtcccctctgccccaacctgagaaggctggatagacagatgggatgtctcaacaggtg

SEQ ID NO: 59232 - DNA, 201 bp, Homo sapiens
ggactctgtttctactctgtgatcgctcccttcacactggattctgtgtcacccatcaccctaccagttcgtggtgtcatcaagatgggggctgttcctayttgtctttgtatcccagcagctagcacctggcagcggtagttacacaggaaatacttcctgtggttgtgttgaacaggataaaatagtgcatgttatgta

SEQ ID NO: 59233 - DNA, 201 bp, Homo sapiens
cctgcctccagaccttactctcctgcctcagaaggactctgtttctactctgtgatcgctcccttcacactggattctgtgtcacccatcaccctaccagytcgtggtgtcatcaagatgggggctgttcctacttgtctttgtatcccagcagctagcacctggcagcggtagttacacaggaaatacttcctgtggttg

SEQ ID NO: 59234 - DNA, 201 bp, Homo sapiens
gaatcgacctttgttccctgcctccagaccttactctcctgcctcagaaggactctgtttctactctgtgatcgctcccttcacactggattctgtgtcamccatcaccctaccagttcgtggtgtcatcaagatgggggctgttcctacttgtctttgtatcccagcagctagcacctggcagcggtagttacacaggaa

SEQ ID NO: 59235 - DNA, 201 bp, Homo sapiens
acctatttttaaataaagtcaccatcacaggtgccgggaagtaggagttaaacgtatctttttggaaggacggttcaacccacggcacacatcatgttatsctttctcaaatgatccctttttctcactccgttgttcaataaccatttggcctgtggaagaaattctgactactttagcctgatgctcatactcttttcc

SEQ ID NO: 59236 - DNA, 201 bp, Homo sapiens
tcaactgaaatcctgccaatcctgcaatccccctcccacacacttacccccatggcttcctcctctccccaggcacagaggccacagtgtggggtaaaggrttatttctagacttctctacaacagacaatatccaaaaggactcattttcagctccacaaggtcaggaatttgtgttttgtttattgctgaatccccagc

SEQ ID NO: 59237 - DNA, 201 bp, Homo sapiens
gagctgtaattaccttttaaattaacattctatgattttaaaaaagacttttgttgttcaaagtaatttgaaaagcaaccttccttcatgaagagtttcaraataacatttcaaactgtgctgttcctcttactaccaacattcagaaccagtgtctgaactgaaatatttccaaaaggaattaaaacaaggacaacagat

SEQ ID NO: 59238 - DNA, 201 bp, Homo sapiens
tgcctttgccagtgagtgtgagggcccgtctgtgttttatgttttccgcaccctctctcaaacactcgctgttaagtagactgcagcggagacctgccatyggggtctaactgatttaagccaggcatatcctcaacatattgcaatccatgtaaaacaaggagctgactctcagttctgaacttggctgggagcaggtct

SEQ ID NO: 59239 - DNA, 201 bp, Homo sapiens
acatgtgcactgctgaggagagtgaggggcagcacttgggaggcccacgtgcctttgccagtgagtgtgagggcccgtctgtgttttatgttttccgcacmctctctcaaacactcgctgttaagtagactgcagcggagacctgccattggggtctaactgatttaagccaggcatatcctcaacatattgcaatccatg

SEQ ID NO: 59240 - DNA, 201 bp, Homo sapiens
gtcccctctcaaccccatccctccagttattcccctcaagtccccatctctggttttcacatcccgcctctctgcttccctttggaactgtgctgtggaamattcgttcacctcgcctgtcaccttgacctgggctcacctgctgcatctccattgtcaaggtcaccagactcctccaccctcctggagctctctgcctgt

SEQ ID NO: 59241 - DNA, 201 bp, Homo sapiens
agaatctgagctcctagtctaaggctaccctacccagaatgagcctgatctcatctgatcttggaagctaagcaggatcaggcctggctagctcttggacrggagagtctcagctcctatatgctgtgctacactgcctccagttcacttggaacaaaacactgagtctcggttatacgtttctggctatggtgtttgttg

SEQ ID NO: 59242 - DNA, 201 bp, Homo sapiens
atagtctgactctagaatctgagctcctagtctaaggctaccctacccagaatgagcctgatctcatctgatcttggaagctaagcaggatcaggcctggstagctcttggacaggagagtctcagctcctatatgctgtgctacactgcctccagttcacttggaacaaaacactgagtctcggttatacgtttctggct

SEQ ID NO: 59243 - DNA, 201 bp, Homo sapiens
ctgagacattgaggggctaaataactcggccacacccacagttaataaggattcaaacccagatagtctgactctagaatctgagctcctagtctaaggcyaccctacccagaatgagcctgatctcatctgatcttggaagctaagcaggatcaggcctggctagctcttggacaggagagtctcagctcctatatgctg

SEQ ID NO: 59244 - DNA, 201 bp, Homo sapiens
cacatgcctatgtttattcagtcattcattcatgcactaattcaacaaatgtttactgatagtgtccaatgtggtagctaacattgagtaaatatcaacarcaggcaagacactgtgcacagaacttttcatatattctgttgtttgatcttcaccaaaaatcagttcttgctatctttatacccagatgagaatactgag

SEQ ID NO: 59245 - DNA, 201 bp, Homo sapiens
aatgtggtcatcagagaagacctacacgtggtctgaaataaatgacttttgactggctcctgttctagagagtgctttggttttgtttgtttatgtgctcsttttgtttaataatcttgatttgctgctccaataatccatgattcagcagaaagcttaaactcctttttaagggttttccaagtggaaatggaagctggt

SEQ ID NO: 59246 - DNA, 201 bp, Homo sapiens
agctcaggccctcccttcctcacagctggaagatgttttagccacctgtctttttctcccaactaccagtataacctagctttaatccagaccccgcacckgcctgaatgatccttctaaaacatctttctatttgtatcacaagattgcatttacattttgatcctcccaaatcatcagcagcttcccccaatgcctcct

SEQ ID NO: 59247 - DNA, 201 bp, Homo sapiens
caacattgttaagacctgaattgctaaaatattaataaaggatgtgatagaagtacaagtacatagtaaataatatacgtaataattaatataacttaatmtacattaaattcttcctttcctttctctgtaatatttaagctggtcaagtgtgctccttttttttttttttttttttttttttttttgatggagtctcgc

SEQ ID NO: 59248 - DNA, 201 bp, Homo sapiens
ccttgttcattcaaataagatttcaacattgttaagacctgaattgctaaaatattaataaaggatgtgatagaagtacaagtacatagtaaataatataygtaataattaatataacttaatatacattaaattcttcctttcctttctctgtaatatttaagctggtcaagtgtgctcctttttttttttttttttttt

SEQ ID NO: 59249 - DNA, 201 bp, Homo sapiens
ctctctgaaatggtcttcttttcatcgtttttctctcccagtacaagaatgcaagtcctgagggcagttttctctacgtccctctctgaaatgcacaggayggagagagaggcaagccttctgggatgaagctgtgttcaagagatgagggtctcagcagtatagacggagggagctggctcactttggggctgctggctt

SEQ ID NO: 59250 - DNA, 201 bp, Homo sapiens
tgaatgagacctgcatactcaagcccctgaggcaatgtggctgctaaaaaggtgactgccacctgagcgtgtgggggtatatgtggtgggtcctaggcagsggaggtcattcttctgctacacagggtggggcacagccaaaaccctgcatccttcgccgttgcaagcctgacatcagagagccacctgccacttcattct

SEQ ID NO: 59251 - DNA, 201 bp, Homo sapiens
ctcatttccaccattggatgcttctttcctttcctcttccgccaaccatgacatccttacggtcaggggtaggacagcgtggctcatcataggcatcgatragcactcctcaaatgagtggatgatggagtctggacaacctggaccaagccagaagtgagttcccaggaggtcgaaggtcacttgggtggggtgagaaac

SEQ ID NO: 59252 - DNA, 201 bp, Homo sapiens
tggtccctcttatactcccaatgtctggaagatagtaggtgctgaataaatacatgtgtctgattgaagcctgcaacatgatggctggctggctggctggmtggatggatgggtggctggctggctggctggatggatggacgggtggctggctggatggatggacaggtggctggctggctggctggatggatggatgga

SEQ ID NO: 59253 - DNA, 201 bp, Homo sapiens
ccaatgtctggaagatagtaggtgctgaataaatacatgtgtctgattgaagcctgcaacatgatggctggctggctggctggatggatggatgggtggcyggctggctggctggatggatggacgggtggctggctggatggatggacaggtggctggctggctggctggatggatggatggatggatggatggatggat

SEQ ID NO: 59254 - DNA, 201 bp, Homo sapiens
acccagtagtgggttggctgggtcaaatggtaatttctgttttaggcctttgaggaacgactgcactgttttccacaatggttgaactaatttacactccrccagcagtatataagtgttcctttttctccacaaccttgccagcatctgttgttttttgactttttaataacagccattctgactgacacctttttttta

SEQ ID NO: 59255 - DNA, 201 bp, Homo sapiens
tacgactgctgtttacaaataagaagaccaccattgaaaaactaaggtaccctgggtttagcttgtcatctgttctagaaatggtggctcagaggctgggygcggtggctcaagcctgtaatcccagcactttgggaggctgaggcgggcggatcacgaggtcaggagatcgagaccacggtgaaaccccgtctctactaa

SEQ ID NO: 59256 - DNA, 201 bp, Homo sapiens
actaaggtaccctgggtttagcttgtcatctgttctagaaatggtggctcagaggctgggtgcggtggctcaagcctgtaatcccagcactttgggaggcygaggcgggcggatcacgaggtcaggagatcgagaccacggtgaaaccccgtctctactaaaaatacaaaatatcagccgggcgcggtggtgggtgcctgt

SEQ ID NO: 59257 - DNA, 201 bp, Homo sapiens
aggggacaggaggagaaacgttccaggctgatgctgagttttacttggggtggcgggggagaggaaggaagtgtttaggagctgatgaaagtcatagcgtrtaggacctgaggaccatgttgatagccttggttgtgataggggaacattaggaggtcaataaaggccttccccaaggcgtgtcatgactatgtttgggct

SEQ ID NO: 59258 - DNA, 201 bp, Homo sapiens
agaggctgggtgcggtggctcaagcctgtaatcccagcactttgggaggctgaggcgggcggatcacgaggtcaggagatcgagaccacggtgaaaccccrtctctactaaaaatacaaaatatcagccgggcgcggtggtgggtgcctgtagtcccatctactcgggaggctgaggcatgagaatggcgtgaacccggga

SEQ ID NO: 59259 - DNA, 201 bp, Homo sapiens
ggaggctgaggaggcatgaaccaggggacaggaggagaaacgttccaggctgatgctgagttttacttggggtggcgggggagaggaaggaagtgtttagragctgatgaaagtcatagcgtataggacctgaggaccatgttgatagccttggttgtgataggggaacattaggaggtcaataaaggccttccccaaggc

SEQ ID NO: 59260 - DNA, 201 bp, Homo sapiens
atatcagccgggcgcggtggtgggtgcctgtagtcccatctactcgggaggctgaggcatgagaatggcgtgaacccgggaggcggagcttgcagtgagtygcgatcactccactgcactccagcctgggcgagagagcaagactccatctcaaaaaaaaaaaaaaaaaaaaaaaaagaaatggtgtctcagaaaatgtac

SEQ ID NO: 59261 - DNA, 201 bp, Homo sapiens
aaaggaacatttgaaccaacagctggaggctgaggaggcatgaaccaggggacaggaggagaaacgttccaggctgatgctgagttttacttggggtggcrggggagaggaaggaagtgtttaggagctgatgaaagtcatagcgtataggacctgaggaccatgttgatagccttggttgtgataggggaacattaggag

SEQ ID NO: 59262 - DNA, 201 bp, Homo sapiens
cgggaggcggagcttgcagtgagtcgcgatcactccactgcactccagcctgggcgagagagcaagactccatctcaaaaaaaaaaaaaaaaaaaaaaaargaaatggtgtctcagaaaatgtacagcaaactgcttctcacttcatttttttagcaaaggtcagattttctggatcataaacctgggacttggttctttt

SEQ ID NO: 59263 - DNA, 201 bp, Homo sapiens
tgcctcagcctcctgcgtagcctgggattacaggcatgtgccaccatgctaggctaatttttggtatttttagtagagacggagtttcaccatgttggccwggctggtctcaaactcctgacctcaggtgatccgcccgcctcggcctcccaaagtgctggagttacaggcatgagctaccacgccccgccgtttttcttc

SEQ ID NO: 59264 - DNA, 201 bp, Homo sapiens
ccagaaaactcagccagtctagtctttccacattcctctgcctgctttattctagccacgctggcagctgattagatggtgcccacccagattgaggacgrgtgggcctctcccagtccactgactcaaatgttaatctcctttggcaacaccctcacagacacacccaggaataatactttgcatccttcaatccaatca

SEQ ID NO: 59265 - DNA, 201 bp, Homo sapiens
ccaggacaggggtgcagtggtctaggccgtgcttcctgctccccctacaactgggaataccgtaaaatagacatgacaattaccaggaaggaagcagtccmcgtgagcttataatcacaggcattggcacacagtgcctatcaacagccacagtggacctaagagagcaaatcaagatgtcataaaactacagtacctcag

SEQ ID NO: 59266 - DNA, 201 bp, Homo sapiens
gtccaagaaagagaacagctctcagcactgagcatggctggattaggacattcttgcgttgctatgaagaaatacctgagacttggtaatttataaagaaraaaggtttcattggctcacggttctgcaggctttacaggaagcatagcatcggcatctgctcagcttctggggaagcctcagaaagcttgcagtcatggt

SEQ ID NO: 59267 - DNA, 201 bp, Homo sapiens
gcacagtcaccctgaagagggaggtgttgctctaaagctccaccaaagctccaaaatgaagcagaagctcagatgcaaaagggaagaatccatcccctgcrtgtctctcctccatgccccaccttctggggtcagagatccaaggcctcattgggcagccctggactccaaggccccgtcaccccagaaccatttgagatt

SEQ ID NO: 59268 - DNA, 201 bp, Homo sapiens
aggaagaactttacctacatggtaatattttcatgcaaattctaaatactcgttttcagccagtatgtccaaagattttgaaatcagaaaatacagtactyggccaaaaaggatgggagtctacttgtcctctctaaatgagggtggacaccatgtgtctccaaaccgtaggagtcacctgctcccatgacgtgtccaaga

SEQ ID NO: 59269 - DNA, 201 bp, Homo sapiens
attactgtcatactcaaagcacttaggataatgtgtgggaacagaggagacatccaaaaaacatttatatgaattaagaattttattttagaagtgcggaygacatgttgacttatcagctatgccttcaaaaagcctgcacttcaccacttgccccagatggctgtttcacctgttctgcttttccaggaaggtgtgtaa

SEQ ID NO: 59270 - DNA, 201 bp, Homo sapiens
tatgttatcttaatgaaatccatctcattcaaactgtgtaactaaattatataagggtaaagttaaagttggataatttcaatattgatctgaaagcaatwtggaggtcattcatgttttgagtcaatactcaaatcatttcagaaatgcaggacattttatcaggaagaactttacctacatggtaatattttcatgcaa

SEQ ID NO: 59271 - DNA, 201 bp, Homo sapiens
agtgtaacatatgttatcttaatgaaatccatctcattcaaactgtgtaactaaattatataagggtaaagttaaagttggataatttcaatattgatctkaaagcaatttggaggtcattcatgttttgagtcaatactcaaatcatttcagaaatgcaggacattttatcaggaagaactttacctacatggtaatatt

SEQ ID NO: 59272 - DNA, 201 bp, Homo sapiens
taaacaaatgtattacctcccagttaccatttttgtggtgagcgcacgtaacattcaccgcctgcattttgcaagactctgttgtatgctgagcatgaatytttgctggctttcctcctgttcctgtcttccccttccccttcccctctcttgtcttcaaaatatcttgagaagatacaatgtacacaagtggtatgactg

SEQ ID NO: 59273 - DNA, 201 bp, Homo sapiens
caggcagaaaaccaaaggaggactgcgatgggggctaatagtggtgatggggctgctttagataagagatcaggaaaggaccctctggggagacaacactraaaccaagagcagaaggatgaaaaggtgctggctacatgaaaagccatgtaaagaatgttccagacatgggcacagcaggtgcaatggccctcagaggga

SEQ ID NO: 59274 - DNA, 201 bp, Homo sapiens
aaccatcagatcttgtgagacttattcactatcaggagaacagaaagggaaagatctgcccccatgattcaattacctcccactggctcccccccccccckacaacacatgggaattcagggagctacaactcaagatgacatttgggtggggacacagccaaaccgtatcactttccttcctccctgcctgcagagaact

SEQ ID NO: 59275 - DNA, 201 bp, Homo sapiens
gatcccaatgcatgatcatttcttagtgatgaaatcaaaagtgtggcaactctaccaatatgttgggagccattgcattctgccaatgaggcacagtaaamccctttcccttttctgtgtcctgtctccccattccattgtttcccccaagctttctcatctgtgatctcaagatgttcatctgaggtgacttctagttta

SEQ ID NO: 59276 - DNA, 201 bp, Homo sapiens
aaataggaataccaggcagaaaaccaaaggaggactgcgatgggggctaatagtggtgatggggctgctttagataagagatcaggaaaggaccctctggrgagacaacactgaaaccaagagcagaaggatgaaaaggtgctggctacatgaaaagccatgtaaagaatgttccagacatgggcacagcaggtgcaatgg

SEQ ID NO: 59277 - DNA, 201 bp, Homo sapiens
gagccctcctgtggctcacattcttgaaggtagagataaataagtaaggagacgcataaacaaaataggaataccaggcagaaaaccaaaggaggactgcratgggggctaatagtggtgatggggctgctttagataagagatcaggaaaggaccctctggggagacaacactgaaaccaagagcagaaggatgaaaagg

SEQ ID NO: 59278 - DNA, 201 bp, Homo sapiens
aactgcatctcctcatttatgattctgcacttgtcgtgtgtttactcgttttatgtaggtctcctccactatgcttaatgccattgacagggactgattcygctcctgttgctttgtctccaaggcccagctgaagcacagattagcacaggtgcaacttctgtcacgctcttaggggctgatgccccccagagcatcgcc

SEQ ID NO: 59279 - DNA, 201 bp, Homo sapiens
gtgactaaggactaccccttcttcacactcttctcttcagggccctgtcaccttcccactgccttgcctgctctccttcccctcttcctctcctttgctcrtgactgcgtgacagggccagggtgccctgtgaatgagcctgcccaggcagcccctctggcagctcagaggaggtgagcttagaagacaggggtttcagag

SEQ ID NO: 59280 - DNA, 201 bp, Homo sapiens
cttctcttcagggccctgtcaccttcccactgccttgcctgctctccttcccctcttcctctcctttgctcgtgactgcgtgacagggccagggtgccctrtgaatgagcctgcccaggcagcccctctggcagctcagaggaggtgagcttagaagacaggggtttcagagctcaacgctgccaaggagggcaactttct

SEQ ID NO: 59281 - DNA, 201 bp, Homo sapiens
ttctaagtaattgatgccaatctcttacttttctttccctgtttccctcatttaagcagtttgaaattgataacatgttgtcagcattgaactggatgacyggagaacattcagaattcttgaaataatgaaggaatgaatgagattgtccccaccccataccccctgtatgatcagtgtaagcaatttgaagcatatttc

SEQ ID NO: 59282 - DNA, 201 bp, Homo sapiens
ttatttcattttatttcatgagacagagtctcactcggttgcccaggctggagtgcaatgacatgagctcactacaacttctgcctcccgaattcaagagrttctcctgcctcagcctaccgagtagctgggactacaggcgcacgccaccacatgcagctaatttttgtatttttagtagaggtgggattttgccatgtt

SEQ ID NO: 59283 - DNA, 201 bp, Homo sapiens
tgcccccagcacgacacttacgtggcacccacatcacatcacgtccctctctcgccactcgaatgaaacgactaggttatgcttcagaactccttgtaccrttcctcgattgtttttgatgagagaaaaaaatgtagggcatgtataggcagtttccaaagcaagtcatgtacacagaaaaaggaaaatcgacttgatgct

SEQ ID NO: 59284 - DNA, 201 bp, Homo sapiens
ctctgcaaaatgggcataagaatacctaccttggtgagttgatgtggatttaggtgaacaacatagttagaaggaatacgtgtccatgtttacctgtgatrgcccaagttacgcctgttgtcggggcacgtgtattatagtgtcccttctcactccaaatgtatctcagtgtggatgatagtcaccaccccctgccccccc

SEQ ID NO: 59285 - DNA, 201 bp, Homo sapiens
tgaggaaactccagcatgaggtcggatttcatattcaaagtcataaaagaagaaaatggcagaatgagatttgttcttccactgttgctatactactgctrgagatatattttgaaggtagtttggtcttcttgtccacattttattactgagaaatgtatcagcccaaacattctgcagatactgactgaaagtctttcg

SEQ ID NO: 59286 - DNA, 201 bp, Homo sapiens
tctgaaagcagtcgaaacagtgggctcagaggatcccgccctcttcgggggtgccccctttctaaagagttgcttctcactcccaaacctgactcagaggyggcaggagcagtatctgtgactgacaacaaaagccgttcacgtagaggaggagggtggcgggactggcttggctctgatgcttccctgatgtccactttt

SEQ ID NO: 59287 - DNA, 201 bp, Homo sapiens
gtacctggaccagggtgtgtttagcagctattaatgcttacagccaggaggaggtgcaggctctctgcagggctggaagtgagggaatacagcgatgacawaggagccctcctgtggctcacattcttgaaggtagagataaataagtaaggagacgcataaacaaaataggaataccaggcagaaaaccaaaggaggact

SEQ ID NO: 59288 - DNA, 201 bp, Homo sapiens
tctttacttctctgggcgtgtttcctcaccggcaaaatgggaacacttaacgaggaaactttgcagagagcattcagctttcaaactctgactccccaagygtgtgacatattttttaataactcctttctcattatttcccttttacctccttgctttgaatcttgagacacaacagaaaacatatacatggtgctttag

SEQ ID NO: 59289 - DNA, 201 bp, Homo sapiens
cgctctgggctcttacatcctgtcgtaacatcgttgtaagggttgcgttgtgactgcaggaattcccagttgcagttccaggaaggtcagagaggagcaaygttcccagccacagttctgtgagctatggttcagactgaagtcttttgcttattttggtgataaaagctgaacatggtttgtgctgaagttccagctggt

SEQ ID NO: 59290 - DNA, 201 bp, Homo sapiens
acacagaaaaggaaccttccctgggcttggtaagacaggaaaggagagtaccacaagaaggcttcctggaggaagttgcagctcagccaaaatggaaggakcagtaagaattagccacatataaagggcaggtaggaattggccaagccaaggatgtggactgacaccttaagggccaaacactgctggagaagcacaact

SEQ ID NO: 59291 - DNA, 201 bp, Homo sapiens
agtacctggaccagggtgtgtttagcagctattaatgcttacagccaggaggaggtgcaggctctctgcagggctggaagtgagggaatacagcgatgacmtaggagccctcctgtggctcacattcttgaaggtagagataaataagtaaggagacgcataaacaaaataggaataccaggcagaaaaccaaaggaggac

SEQ ID NO: 59292 - DNA, 201 bp, Homo sapiens
catctgctcaacatgtaatgtattcagcacttagcacagcacctgcagcagacactccgtcaatattgcttgaccatcctgtaaggtctggtagcgccacrcagtggttaagagcacaaattctaaagcaaaaccacccggacactgtcatggatggcatgaccttgggcaggtcatttgaccctgctgtgtcttggtttc

SEQ ID NO: 59293 - DNA, 201 bp, Homo sapiens
aggatcacaagccagagtccagctacccaggttcgaatcccagctcgagcacttaaccagctgtgggatgtgacgatgaaacagacaccgagcctggcackcagtcggggctttggggaagtgagccagccatggccactgctgtgccagtgatcatttcacagcagttcttccccacgctgtaccatatgttccttctga

SEQ ID NO: 59294 - DNA, 201 bp, Homo sapiens
ctccccaggctgacttctgggttggaagcctttcctggggctccagcagtgctttgggcgtgtccctgtcatggagccctgaccactctgggtctgtgtcmttcagcagtggggcctcctggagcatcttattcccattgtgcagcatgctagatattgtttaaatgagagaatatttaggtgtcacgtgtcatcccacaa

SEQ ID NO: 59295 - DNA, 201 bp, Homo sapiens
acttttcttccataaaattgtcaggaaagggcaggctgtaagatagaccttctgtctggagacaggatacgtcaaggttaggatcacaagccagagtccarctacccaggttcgaatcccagctcgagcacttaaccagctgtgggatgtgacgatgaaacagacaccgagcctggcactcagtcggggctttggggaagt

SEQ ID NO: 59296 - DNA, 201 bp, Homo sapiens
atgactcaggtctgaaaattatgagtcctgcttgaagaaatgggaataacatgtgagggaatctggtcccatccttcaccttgagggatatactgtggtcraaccaaatagcaggagcatgacctcataggagagcaagtccagagaaattagcgtatttgttgagaaagtgatacaccctccagaagagaaaaatgttat

SEQ ID NO: 59297 - DNA, 201 bp, Homo sapiens
tcacagcacttctggctctctgaaatggtcttcttttcatcgtttttctctcccagtacaagaatgcaagtcctgagggcagttttctctacgtccctctstgaaatgcacaggacggagagagaggcaagccttctgggatgaagctgtgttcaagagatgagggtctcagcagtatagacggagggagctggctcactt

SEQ ID NO: 59298 - DNA, 201 bp, Homo sapiens
tgtttggtcttagcagatacagataaacatcccgtaatagaaaacgatgtactttttgagtgagatgtgttgtgtttgtcagtgttggatatgaatacacrcattctagaggcagcagactgggggtttctctttgctcatgggatattatgattaacttaattccctgcttgagtgccgaggagtcacctcttttacttt

SEQ ID NO: 59299 - DNA, 201 bp, Homo sapiens
aaaatgctgatagtgatatggacaatgaaatccagactgaggtggtttcagatggagatgaggaactttttaggaactagagtaaaggtgaattttgttaygttttagcaaagacactggtagcattttgcttctgccctagagatttgtggaactttgaacttgagagagatgatttagggtatctggaggaagaaattt

SEQ ID NO: 59300 - DNA, 201 bp, Homo sapiens
taacattcgttatcttttgtctttttgataatggccattctgacaggtgtgagataatatctcattgtggttttattggcatttccctaatgattatttaygttggactttttttcatatatctgttggtcatttggagtatgtcttattttgagaaatgtctagtctggtcccttgcccattttaaaatcaggctaatag

SEQ ID NO: 59301 - DNA, 201 bp, Homo sapiens
aaagaatctatgctttctttcccaaacctaaagactggctcaaaaggttctttcttagttattgtcattcccagaaatgtatttatatttttaatgctatrttttatatcacagagccatgagtgaccagtattcctatgagcagatgggttaacaaaatacagaactttcctgaagttgtcagtctttcagttaacctgt

SEQ ID NO: 59302 - DNA, 201 bp, Homo sapiens
aattacagatttttttctttttaaagactgaatagtattccatttgtatatatactacattttctttattcatctgttgacagatgcttgggttaattctrtaacttgactatcgtgaatattgctgcaatgcacatgggagttcagacatctctttgacatactgatttcaaatcttttgggtaaataccgagaagtggg

SEQ ID NO: 59303 - DNA, 201 bp, Homo sapiens
tgctgcagtaaacatacgtgtgcatgtgtctttatagtagaatgatttataatcctttgggtatatacccagtaatgggattgctgggtcaaatggcattkctggttctagatccttgaggaatcgccacacttttcttctacaatggttgaactaatttacactcccaccaacagtgtaaaagcattcctatttctccac

SEQ ID NO: 59304 - DNA, 201 bp, Homo sapiens
catgacccagggtaatattttgtcgtgtattgcattacttaattaaataaacaaggtaattcataagaattaccctgcctagccgaagcataatgaaagcmgcataaaatattcccaaccatcattctgactaaactatttaagcgcttatggaaaattagctgttagaattagccaaactcttttgtaacctaggaggct

SEQ ID NO: 59305 - DNA, 201 bp, Homo sapiens
cattacttaattaaataaacaaggtaattcataagaattaccctgcctagccgaagcataatgaaagcagcataaaatattcccaaccatcattctgactraactatttaagcgcttatggaaaattagctgttagaattagccaaactcttttgtaacctaggaggctggaattgaataagaaattaaggcactggggaa

SEQ ID NO: 59306 - DNA, 201 bp, Homo sapiens
ttaagcgcttatggaaaattagctgttagaattagccaaactcttttgtaacctaggaggctggaattgaataagaaattaaggcactggggaaaatgtcmatttacccttggagagtccatatggaggaagcaaatagttcaaaggcccagctgtaagaatattgattggtgtggcctttatcctggagagaaatccatc

SEQ ID NO: 59307 - DNA, 201 bp, Homo sapiens
gattctgggcccccctgaatttcccatccagttgtgtcctggcctggtgctctgtatggacgctcacaccagcctccttgctaaccttcctggagcctgtwtttttctctttcccctccaagtctcatctgtgtggctgtcagaaccacctgtggctctgaagcttgtgtctgctcaggtcccttccgtgtttggcggctc

SEQ ID NO: 59308 - DNA, 201 bp, Homo sapiens
tctaaactacatccatggctaagactgaactcatgtctcttctctcctttatgagtgacccatctctgttgacatcacgcaagagtcctcagtctgttacrcagttcctgattctgggcccccctgaatttcccatccagttgtgtcctggcctggtgctctgtatggacgctcacaccagcctccttgctaaccttcctg

SEQ ID NO: 59309 - DNA, 201 bp, Homo sapiens
tgtacctcgtatgatgaaagcgggagaaagtgagaggaaggggtgggaggaggaggtgccacatgcttttaattgaccagatcttgcaaaaactcattctyacgaagacagcaccaagccatcaaggatccgcccccacaatccaaacacctcctaccagaccccacctccagctttggggattacaattcaatgtgagat

SEQ ID NO: 59310 - DNA, 201 bp, Homo sapiens
tagttttcattatccatctggatctgtccacaggaagcagagatgactattggcaggtccagcatcacatggttcaggaggcagagatgactatttgcggrttcagcatcacatggtccaggaggcagagataactattggcaggtccaggatcacatggttcaggaagcagagaaggctattagtgggttcagactcaca

SEQ ID NO: 59311 - DNA, 201 bp, Homo sapiens
aattgtgaaccaaatgtgagtcttgtagagctcttggaaggcttcgaagggtgggggtgcacttactaaagatccctcccacaattctatgaatgtagtaraaaccaccaaattatgtgcattcaaaggctgtgttttatggtatgtgaagcatatctcaataatgctgttatttagaaaaaaaaagttactctgactgca

SEQ ID NO: 59312 - DNA, 201 bp, Homo sapiens
acttaaatactgctgggatggagtgaggattgggacccttagcaggaacaactaagacatgtctacagagggcacatcagtgtgtgatttagggagtttcrctatcttctctgtaatctctcagactgttttaaaagaagcaagctgtgagcaaaagctttttaacaccaaatggcaaagcaaaccctcgaaaggggaaaa

SEQ ID NO: 59313 - DNA, 201 bp, Homo sapiens
ctgttggtaatctgtaagtaaatcagatattcccgacatagaccctggctgggtcatgttgggctttgcattaaatattaagactgtagaacaatattttmtgcaatggaaaattctatagttaaaaacaagaggcagttgatttattataagtgggcaaaaatgtgttataactgaaatgggattctctcctcctcccct

SEQ ID NO: 59314 - DNA, 201 bp, Homo sapiens
tttttcttattatattattgtctagttttggtatcagggttatactggcctcataagttaaggttttctcactttctgtattttgtgaaagagttcgtatragattgttattatttctctcttaaatgtctaatagaattattcagtgtagctatctgggcctggagattcaaaaaatacgtccatgtcatctgagttaac

SEQ ID NO: 59315 - DNA, 201 bp, Homo sapiens
tacaattttatattttacaatccttccttgtcccagacacggtgcttttctaacagctctgttgcaggcagtggtgtctgcatggggctggcacaacccayggctttttttggatcctcctgactcagcctaggggattggagcaggcaaactcagtgggccttcgcagaaaagagggtgtgctttaactgattatgcctc

SEQ ID NO: 59316 - DNA, 201 bp, Homo sapiens
ggctggctggctggcttccgccacggccaagaaaatccccttctgcctcaaagcaccaattaatacaagttcttcaccgagctgggtgggtaaaggaaacrggctgaaatgcatccagctttctgtgaaaccacttacaaggtcatcagccccgatatcttgcaggaccccctgctttgggctaggcggaagatgccaatc

SEQ ID NO: 59317 - DNA, 201 bp, Homo sapiens
caccaattaatacaagttcttcaccgagctgggtgggtaaaggaaacaggctgaaatgcatccagctttctgtgaaaccacttacaaggtcatcagccccratatcttgcaggaccccctgctttgggctaggcggaagatgccaatctacatcagaagactctgagataccagctggtgtgaggaggggacacgcataca

SEQ ID NO: 59318 - DNA, 201 bp, Homo sapiens
ccagggcaagaagggcaattagaaaatgaattcgaggttcactttgcttctagtctatagactatttgcgggtggtatgtggcactaatgaatataaatgrgtttgatcgttcactcgcattattgaatatttcatgcacctttacgcatggaatagtatgaactgatacacataaaatgactaaggtgattattctccac

SEQ ID NO: 59319 - DNA, 201 bp, Homo sapiens
aattttgaagtttaagagaaatgactgttttacctgtgttggtagaaacgtttgaagaatgcaacgtaagctgacctactaaatctacccttgcgattcaktctgagagaagtgggcgtggggctttactgtcagtggaagtaatcgtttatcaggtttacaacttttcccctgtatctgaggccctatttttttgttctt

SEQ ID NO: 59320 - DNA, 201 bp, Homo sapiens
tgttcttatagagacctccactgagtctgcagcagtccaaaaggctgtctgtgaactcttcgctcatgaacagataggctcatctgaacagtcccaaaagrcaatcataacagcatgtctcagtgtgtcacatgattggacccaaaattctgtgtatttgtgacttatagtgaagcagtatattaagaagttattttgcag

SEQ ID NO: 59321 - DNA, 201 bp, Homo sapiens
tgtctcttccaacatggaggaaaaaatatttcagaaaaatacggaatttggtttgttgctgcttatttttcagaccgtcagaaccatatgctgatgctgcytcctgggaaggcagtgtccaccagtggttaggaacaggtggtctttggagctaaatagagtcaagtttagtctccagggctcagctgtgtggctttggac

SEQ ID NO: 59322 - DNA, 201 bp, Homo sapiens
aaattaaccaggcgtaatggtgtgtgcctgtaatcccagctactcaggaggctgaggcaggagaattgcctgagcttgggaggtagatgtcgcagtgagcygggatcgcaccactgcactccagcctgggtgacagagagagactcagtctcaaaaaaaaaagtgaatgccccaaggcctgacaccctgtgagcaaacaat

SEQ ID NO: 59323 - DNA, 201 bp, Homo sapiens
atttcttttatttttaattgatccaactagttctgacacattctatccagattgggttgcgtttctatgataatgattcagtttctcattcgtttatttaygaagcacttcttctatgctaggcattgtgctaggtttagaggtgttgtttctgctttttagctcaacccagtgtgggaggaagacaagtaaacaagaaat

SEQ ID NO: 59324 - DNA, 201 bp, Homo sapiens
gacaagtcacttaacctctctgagtgcttcctcttccttatcaagcaggcaattacagtccttaccctgcagagtctctttcaagataaagtaaggaagtrcgtatcaaaagcgaatgcccccggctgggcaccgtggctcacgcctgtaatcccagcactttgggaggctgagataggtgtcaggagttcaagaccagtc

SEQ ID NO: 59325 - DNA, 201 bp, Homo sapiens
cttttttcaagtgttgagctggagtaaggtcaggtatggtcaaaacacttctgtgtttctggactgctctttctctagtcttttggctcaagatagcaggsttttccagttgtgggcctatccagagcccaggccaagatatataaaagaacacacacacacaaacacaccactgggtagttccttgagttctgagatccc

SEQ ID NO: 59326 - DNA, 201 bp, Homo sapiens
ggaggaagggagagagggagggttccacattgagtgtgtgggctattgttccgaggatgcatatctgactctgttgtctgagtctcctctgaattctcccyggagaacctaaactgggaaggccctaatgggagcttccttggattatctgttaaaaaaaaaaaaaggaggtcacaatcttgctaccctatagcctagaca

SEQ ID NO: 59327 - DNA, 201 bp, Homo sapiens
ttgtcatgaaatcttttcgcatgcctatgtcctcgatggtgttgcctagattttctcctaaggtttttatagttttgggttttatatgtaagtctttaatygatcctgagtttatttttgtatatggtgtaaggaaggggtccagcttcaattttctgcatatggctatccagttcttccagactatttattaaataggga

SEQ ID NO: 59328 - DNA, 201 bp, Homo sapiens
ctgctgtttcacagcacttctggctctctgaaatggtcttcttttcatcgtttttctctcccagtacaagaatgcaagtcctgagggcagttttctctacrtccctctctgaaatgcacaggacggagagagaggcaagccttctgggatgaagctgtgttcaagagatgagggtctcagcagtatagacggagggagctg

SEQ ID NO: 59329 - DNA, 201 bp, Homo sapiens
cagaccgtcagaaccatatgctgatgctgcttcctgggaaggcagtgtccaccagtggttaggaacaggtggtctttggagctaaatagagtcaagtttastctccagggctcagctgtgtggctttggacaagtcacttaacctctctgagtgcttcctcttccttatcaagcaggcaattacagtccttaccctgcaga

SEQ ID NO: 59330 - DNA, 201 bp, Homo sapiens
tgtgtatttgtgacttatagtgaagcagtatattaagaagttattttgcaggaaactttgttgtcccctacagcttccaaaatgctgtatcagcagttttmtttaatatagtttgtgaaactaaatgagaaagagctgggcaaaggaagctttttttattccaggggaaaacaaaagttgttttgatcattttgaatcttt

SEQ ID NO: 59331 - DNA, 201 bp, Homo sapiens
tccttgtcctcttggtcctcaacacctgagagttttaaacactctgtgaccagcttgagaatttctcagaggctgtttcagacagtgactacgggagtagkaatcctttggtaacctgaatataactgcagacttccacattgagcatgataaaatggtgtggatttaaaagtatttggggaactgtaaaatgtctaggat

SEQ ID NO: 59332 - DNA, 201 bp, Homo sapiens
agacaagcaaagcaggcacacacttcccatgggaaagcacaactgatgatcacagcagataactgtcagagatgaacgatctaatatgtgtttttccactytgaggctgaagcaaactggccattttatcaaaactgcaagcagtgtatcaggttacgcagtggcaaaaaagcttcctgcccagtataatctatccacatt

SEQ ID NO: 59333 - DNA, 201 bp, Homo sapiens
ttttacaaataacagtgttcaacctccagttgttgagagttaatttaaatggtttgaggcaggtccatgcagatttcttaaaaaaaaaaaaaatactcccyggtgattttagtgagcacccaaggcttagatccacttggggaaattgatgctgcatccaatgccagattgctggtcaagtcgattcggctgatttaggta

SEQ ID NO: 59334 - DNA, 201 bp, Homo sapiens
ttctcaccctagctgcattttagaatcacccagaaacttttacaaataacagtgttcaacctccagttgttgagagttaatttaaatggtttgaggcaggyccatgcagatttcttaaaaaaaaaaaaaatactccctggtgattttagtgagcacccaaggcttagatccacttggggaaattgatgctgcatccaatgc

SEQ ID NO: 59335 - DNA, 201 bp, Homo sapiens
catgaaaacgcatgaggtttcagatctagaaactattacccacattagaagtcaaagtgcatttttctcatagagaaaatgaaatgttctaaatggtgatrtgaaagtcaactctatgagttaaaaggcatttaagagttaaccttcaaaaactaaccgagtctataaaaaatacatttcaaattcaaatcatcaccctgt

SEQ ID NO: 59336 - DNA, 201 bp, Homo sapiens
catccatgctccctggcaagtcatggtgctggagaaagatgtgggacgtgtatcacccaggaaggagcagaaagcccgaagcaaaaggggcagtgcctgcygcatgctcctcaaattcacttattctttcacgtattcatctgctcaacatgtaatgtattcagcacttagcacagcacctgcagcagacactccgtcaat

SEQ ID NO: 59337 - DNA, 201 bp, Homo sapiens
gggcagtgcctgccgcatgctcctcaaattcacttattctttcacgtattcatctgctcaacatgtaatgtattcagcacttagcacagcacctgcagcaracactccgtcaatattgcttgaccatcctgtaaggtctggtagcgccacgcagtggttaagagcacaaattctaaagcaaaaccacccggacactgtcat

SEQ ID NO: 59338 - DNA, 201 bp, Homo sapiens
atcaggaaaggaccctctggggagacaacactgaaaccaagagcagaaggatgaaaaggtgctggctacatgaaaagccatgtaaagaatgttccagacaygggcacagcaggtgcaatggccctcagagggagaggatctggaatgttctagaaccaaccagaggccagtgttggctagagtagcatgagctagaggaaa

SEQ ID NO: 59339 - DNA, 201 bp, Homo sapiens
catgggcacagcaggtgcaatggccctcagagggagaggatctggaatgttctagaaccaaccagaggccagtgttggctagagtagcatgagctagaggraaaagtgagcacagtgtggtggcagggtgggcagcatgaggttgcaagcacctcggaggccatcgggaggcgttgggatttcaccccagggccaacaaga

SEQ ID NO: 59340 - DNA, 201 bp, Homo sapiens
gaggaagtcagagcagggagcaggggcacacaaagccctgcatggtgggttcattcccaagggtgtggagcgcatgacacctggagtcttggctgcagaarcacagattcctggaagggagagctgggaaggagttccgatatcaggtcatattgcttctctccatctctcattcaaacccctgaaagaaaaccaaggaag

SEQ ID NO: 59341 - DNA, 201 bp, Homo sapiens
gcacaccatgttgttttgaaggagatagttgaatctagctaataaacaaatgtattacctcccagttaccatttttgtggtgagcgcacgtaacattcacygcctgcattttgcaagactctgttgtatgctgagcatgaatttttgctggctttcctcctgttcctgtcttccccttccccttcccctctcttgtcttca

SEQ ID NO: 59342 - DNA, 201 bp, Homo sapiens
aattaattttactgctgtttaaccctaaaattactctgtcctccagtttgctgacagttgtctatcaaaagctcgttttctctaatccccagctttcctgrtggacttttctctccctcatacgtaaaatgacttttctccttggccatctgtccaaaccagctttcagttaagcctggtcagaagccttcgaatgatgta

SEQ ID NO: 59343 - DNA, 201 bp, Homo sapiens
agaaaacagcccaaagccttaagactgagtctcatgccagctggagagctgcaaaggtggaaacccatcagtttccacctgctcatacatttcagccagtkgacaagtcagccctcctgttcttatagagacctccactgagtctgcagcagtccaaaaggctgtctgtgaactcttcgctcatgaacagataggctcatc

SEQ ID NO: 59344 - DNA, 201 bp, Homo sapiens
cagtttctcgaagaacttaaaacagaactcccatttgacccagcaaccccactactgtgtatatatccaaaagaaaataactcattctaccaaaaagacaygtgccctcatactttcattatagcgctattcacaatagcgaagacatggaatcaacctaggtgcccttcaacagtggattggataaagaaaacgtggtat

SEQ ID NO: 59345 - DNA, 201 bp, Homo sapiens
tggtcacacaaggcctcacagctagaagggcccatggttggtttaatgctctgctatcaccgtctttaaattcttaacaatttatgaacaaaggtgccacrttttcatttgcggtctcttgagttactcatagactaaacgttgagggatgagagggatttcccagaggaaaatgccctgaagaaagggcatgaagcggga

SEQ ID NO: 59346 - DNA, 201 bp, Homo sapiens
ccatcgctgtctccataattcattcttccttccttactccttcgctgatgacaactagttgggcacctgaactttcacaaaagatgtccagttaaaaggarccagtatggaactttgtacacaatttcccctgtattctactatctgcaacaatgtgaaactttttaattttaatttttaatttcaatgtgaaataaaaag

SEQ ID NO: 59347 - DNA, 201 bp, Homo sapiens
tgcagaatttggcacagaaacagacttggtgaagcaaaatgaacagtttggacggacaaaaccctgggggtggggttggtggggtttgaggaacaaagagrgaaagccaaacgattatttgatttaagcatcagaattggatgaccctgagaatccctctggagaacacactaaagattgtttctccagagaatgtcgaaa

SEQ ID NO: 59348 - DNA, 201 bp, Homo sapiens
tcagtggaagtaatcgtttatcaggtttacaacttttcccctgtatctgaggccctatttttttgttcttaaaattgtgctactgaaacttgatagatctyatactaggaaggcaatcatgacacattaaaaacagcctgaggccgggcatgatggctcatgcctttgggaggtcgaggcgggcggatcacaaggtcaaga

SEQ ID NO: 59349 - DNA, 201 bp, Homo sapiens
tctactatctgcaacaatgtgaaactttttaattttaatttttaatttcaatgtgaaataaaaagtcttgaaaggagacatttttttctttcggtggtttraagatcgagtctcactttgaccttcggaaaaatgttagagcatttcagagacacgtacgtctgcgaacctgcagtgatttggggactttatacaacttga

SEQ ID NO: 59350 - DNA, 201 bp, Homo sapiens
cacactaaagattgtttctccagagaatgtcgaaattttagataagaccaggatgtttttgtatacgatttggacttgaaagttttattaagtggctcaakctgtcccacggtcatgatacatgctacccatatatgttccatgaatttgaaaagattaagtaattaggccccaggctcagagtataaattatgatttaag

SEQ ID NO: 59351 - DNA, 201 bp, Homo sapiens
atttcttaacacttctgagcctcaattcctatatctataaaatggccatataccaactcatagtgtcattataaagatttaaagactcaccagttgtcacrtgtcctcccacatcatagaccatgtggatgcttaatgagcagtggctaataaataccacttgcagtccagggcaagaagggcaattagaaaatgaattcg

SEQ ID NO: 59352 - DNA, 201 bp, Homo sapiens
attttcagacttcgtaatgtcattggatagtcattaaatttatacaaaattacagttcagtgaacttaaggataggctgaaaaaggtaaaagtggtaatartcaaaaaggctgaaatctggaatcaattaactgaaaacaaattaaccaacaattatggtatgccctgtttatttttctaaagatcttgaaataaagcaaa

SEQ ID NO: 59353 - DNA, 201 bp, Homo sapiens
agttaatcagttaggtaaatacattccttaaaataatcaaccaagaattttctgggacaggaagggagaaaggtatgctttcctatccaacatgcatgtgrccaagggctgggtgtaagatatgttagcatgtgacaacccaagcccattgccgctgtaagagtgtgtggccttgaacacatttcttaacacttctgagcc

SEQ ID NO: 59354 - DNA, 201 bp, Homo sapiens
gttaccggggcctggagggttagggagtgaggcgtttggtgggcaaagtttctgtttgggatgatgaaagacttatggagatggatgtcagtgatggttgyacaaaattgtgaatgtgcttaacgccactgaattatgcaattgcaaatggttaaaattataaattttatgttatgtgtattttgccccagttaaaaaaca

SEQ ID NO: 59355 - DNA, 201 bp, Homo sapiens
tgccatcacatgaactttgaagacattatgctaagtgaaatgactcagacactaaaggacaaatattatgcgattctatttacatgaggtgtactttgaayaggcaaaattcgaataggcaaaatcatagaaacagaaagtagaatggtggttaccggggcctggagggttagggagtgaggcgtttggtgggcaaagttt

SEQ ID NO: 59356 - DNA, 201 bp, Homo sapiens
cggcattcacaatggccaaaaggtgggaacaacccaagtgttcatcgacagatgaatcagtacacaaaatgtggcatacatgaaatgaaattttattcagycttcaaaaggaatgacattctgacacatgccatcacatgaactttgaagacattatgctaagtgaaatgactcagacactaaaggacaaatattatgcga

SEQ ID NO: 59357 - DNA, 201 bp, Homo sapiens
cagttttgaaatatttgttagactgcttttggctttcagtccgtgccaaacatgtgctttggtgacagatggagtcatgtgggcccctgaatgaaacactkcattgtgtatagactttgtcttccagcagttgggttgcagaagctgggagataaagaggatccaattgctatgaggtgtgttctccagtgagcataggat

SEQ ID NO: 59358 - DNA, 201 bp, Homo sapiens
gtggggtctgggcctccgggctgagggcactgcccgtggacacctctgccacagcctagcttcgcttgaaatcctggccatggcctgctttccacaccctrcttcatttcactatgtgaccgatatgggtacactgtggtgggggaacatggcccagactgatggaagaccagcatgagcaaaggtgccatgcaggagagc

SEQ ID NO: 59359 - DNA, 201 bp, Homo sapiens
tctttgtgcactggcgtgaggtgacagatgcaggaaacactttgtaaactgtcaagcgcctggcaactgaaagacatccgacacaagacagccattaagtrattacatgcatagcaacgctgaccagctgtggtccaagcagttcatatagtaccaagtttcctaacttggtgtcatttgagaacttactttcatgacttt

SEQ ID NO: 59360 - DNA, 201 bp, Homo sapiens
tcagacttcgtaatgtcattggatagtcattaaatttatacaaaattacagttcagtgaacttaaggataggctgaaaaaggtaaaagtggtaatagtcaraaaggctgaaatctggaatcaattaactgaaaacaaattaaccaacaattatggtatgccctgtttatttttctaaagatcttgaaataaagcaaaagtt

SEQ ID NO: 59361 - DNA, 201 bp, Homo sapiens
tggagaccctgccttgaagatgtcatgtaaaaacataaagaatcacacatgtatacgtgcggcatacagacattcctcagccgaaaggaccccaaactggsttaatgaaatgtcaaattatatctttttaagtttaaactaaatgatagcgttttaccttggtcccttataaggaattacattaagtcaaatgttaatgaa

SEQ ID NO: 59362 - DNA, 201 bp, Homo sapiens
agtcaaaaaggctgaaatctggaatcaattaactgaaaacaaattaaccaacaattatggtatgccctgtttatttttctaaagatcttgaaataaagcaraagttttccacaggtactaatagctagaaacccatgggaataagtttcggagtagaacttccccacatggggtggatctccagccacagtggaagaagaa

SEQ ID NO: 59363 - DNA, 201 bp, Homo sapiens
tgctgtacatcctgtgcgttgcagccccagagcctttccactggacgagctctgaccttgcaaaaagaaggcccgcccattctttccctggacgttctttmtgtgaacgacaacgttgctgaactagcctgctgcctctctctggggcaggcctctctgctcgaggtagaaggtcttgctcagagccaacacctctctgtt

SEQ ID NO: 59364 - DNA, 201 bp, Homo sapiens
gcgttgcagccccagagcctttccactggacgagctctgaccttgcaaaaagaaggcccgcccattctttccctggacgttctttatgtgaacgacaacgytgctgaactagcctgctgcctctctctggggcaggcctctctgctcgaggtagaaggtcttgctcagagccaacacctctctgtttttgtttctgcctgg

SEQ ID NO: 59365 - DNA, 201 bp, Homo sapiens
gctcttgccataaatagctaacgttcctggagagttcactgggcaccgtaactgagctctttgcacacattatcttattggcaccccacggcagctccacrgtgtgggaaccattatatcgtggtgttgtcgattaagatgctgaggctgagggaggcaaatcccttgcccaagatctcaccaagtagtgggagatggaga

SEQ ID NO: 59366 - DNA, 201 bp, Homo sapiens
tagagagacagggataggatgacttattttaaaagaatgcatccttattctttcattatcagggaatattactgacatgtacagaaactttatatgtattycatttgtaattctaaatgtttatttttctctgatttagtaaaataactcactgaagtctaaaaatgaaaacctggttttgtttagatgtgtaagacggtc

SEQ ID NO: 59367 - DNA, 201 bp, Homo sapiens
atctatagcatatattaacttcccatatagtgtccctgtgaggcaggcactatcattctcattttatatgaggaaactccagcatgaggtcggatttcatrttcaaagtcataaaagaagaaaatggcagaatgagatttgttcttccactgttgctatactactgctagagatatattttgaaggtagtttggtcttctt

SEQ ID NO: 59368 - DNA, 201 bp, Homo sapiens
gtaatttcacattgaagccccagtcccttccctctcccattcctgcagttcacggaggtgatgtcaccccatgcgtggtggagacttaggccttccacgtrccacccgctgtctggggctttcaggcctgtgaagcattttcttgcttcttctccactcataacctccctcccttcccaaagatgtccctaccagcatcac

SEQ ID NO: 59369 - DNA, 201 bp, Homo sapiens
aaaaatccattacaatgcccctttggcaaaggctggcgactctctcccattggagtaagctgaatgtttctgcctcttgcagaattacatggtagaaaccygcagctctagaccagtcaaggccatttgaggaggaccagatagtcacatgctgaaatgggtctttggcatatctttcaaaatttcactggcctccatgct

SEQ ID NO: 59370 - DNA, 201 bp, Homo sapiens
ctctcccattggagtaagctgaatgtttctgcctcttgcagaattacatggtagaaacccgcagctctagaccagtcaaggccatttgaggaggaccagakagtcacatgctgaaatgggtctttggcatatctttcaaaatttcactggcctccatgctttaatttgatcttttcaagtattctttaaccacttcagaag

SEQ ID NO: 59371 - DNA, 201 bp, Homo sapiens
gtcattttggatgggggttactaagagttggcgaggcagagaaagtgggaagaatgttccagaccaagataagaagggtggtggacttgggaaaccaaagsgaggccacagagcctaagtgggatgaattgagcaggtagagggggtgggcctggtccacactaaggaatgtgttttttgctttttgggttttttttcgag

SEQ ID NO: 59372 - DNA, 201 bp, Homo sapiens
tttgtggttgattcccatgtcacatttctcttggaatcctgttattcttctttctgtgtaataatgtggtcattggctgacacaaggagtaactaaagatrtattttatgaacaaatctgtgtttattactcccattgaacataagcctttggaaggtaaagctgatgtccctgtgtccctttgcactcaggacaggggtg

SEQ ID NO: 59373 - DNA, 201 bp, Homo sapiens
cccagaaaagatacgtaagaatttcatatatctggaaattcaccaatttaactctcaagtttaaataactatttaaagtaatatcatccatcagtgaaaaytgagaaagaacctccttgaagctcataaggaaaaaacccttgagtttgtacctaattttacctcctgaaggccctgatatttaaaataatctaattctca

SEQ ID NO: 59374 - DNA, 201 bp, Homo sapiens
actttagcagtggttactcaaaatcttgccatagtcagttctgcagtatccactaaaagacttagatttttatcaaaatttctttccccctaaagtctatktggtggagctttcttttagaatcatcaaccagtttgttcttggcattaaacattatcttttctcattaaagctctaatttttttaaaaaaagctaatgat

SEQ ID NO: 59375 - DNA, 201 bp, Homo sapiens
cctcagcctcctgagtagttgggaccacaggcacccaccaccatgcccggctaatttttttgtatttttagtagagacggggtttcaccgtattagccagratggtctcgatctcctgacctcgtgatctgcccgccttggcctcccaaagtgctgggattacaggcgtgagccactgtgcccagccgtgtgctctttttt

SEQ ID NO: 59376 - DNA, 201 bp, Homo sapiens
attgtcctcatttttaaaatgaaaaaagcagtcacagagaagttaagcaactttcccaaaggcacatagctagtgatatggtttggatctgtgtccccacscaaatcttatgtcaaattgtaatccccaacttggaggtggagactagtgggaggtgattggatggggccgggggcagactttccccttggtgctgttctt

SEQ ID NO: 59377 - DNA, 201 bp, Homo sapiens
tagctagtgatatggtttggatctgtgtccccacccaaatcttatgtcaaattgtaatccccaacttggaggtggagactagtgggaggtgattggatggrgccgggggcagactttccccttggtgctgttcttgtgatagtgaataagtgctcaccagatcaggtttaaaagtgtgtagccctccccattctctctctt

SEQ ID NO: 59378 - DNA, 201 bp, Homo sapiens
gcaaatcaacagccaaaattctagtatatccacttattccatgtaatgatgactttgactttgtagcaaaaatcaagattgactctcagggtggacagccygtacttagcacagtgtcaggttctgccctgtcagcatctgatgaagggatgagcgcattttatgaggcattaatacagttgatccaaaaacacattgatt

SEQ ID NO: 59379 - DNA, 201 bp, Homo sapiens
  misc_feature (1)...(201): n = A,T,C or G, or insertion/deletion polymorphism (see Tables 1-2)
ggggcatttgcaatgcatgtgctgggctcaagagagcagtcagagctggagatttggcgtcgagcatcttctacatagaggaccaagtttttcataagtangtctgggcttcatgactggctgatttttctaatgtttcaacgggaaaaaaaaaaagctgaaccccaattttcattagcaaagtgtacagattgaggatgt

SEQ ID NO: 59380 - DNA, 201 bp, Homo sapiens
cagcaccttccagctttgctctcagccaccatagcatcacttcaaagaggtctgttcctcaccaccttctcattttcagtctcccattagtgtgtttgtcrctttcatagacaaaacagcacaggctgtaatgtacactcttcacgttttgtctgcttcccaccagactttgaacctcccaaagggcagaagcatacacat

SEQ ID NO: 59381 - DNA, 201 bp, Homo sapiens
gctggcggttgagggcggttcccagcttctggagacaccaggttccttggctcatggctcccttctggcaccttcagagtaagcacagtgggtcaagcccycttgtcacatctttctgaccccagtcatgaaagattctctgccttcaggaacgcttgtgattacattgggcccatctgaataatccagggtgaggtccct

SEQ ID NO: 59382 - DNA, 201 bp, Homo sapiens
catctctactaagaatacaaaagttagccaggtgtggtggtgcaagagtagttgagtaatcccaactactcaggagccagaggcgggagaattgcttgaasccagaagtggaggttgcagtgagctgagatcatgccactgcactccaggctgggtaacagagtgagactccgtctaaaaaaaaaagaaaaaaaaaaagag

SEQ ID NO: 59383 - DNA, 201 bp, Homo sapiens
gcccatctgaataatccagggtgaggtccctgtccttaaccttaattgcatcttcacagtcccttttgccaagtaaggtaacatatgcacacattccaagsgttagcacatctttggggactgtcatttctatgaccacaatgataggaaaagcgttttgttatcccattttccttgtaagaaaactgaggtccagcagag

SEQ ID NO: 59384 - DNA, 201 bp, Homo sapiens
ctctactaagaatacaaaagttagccaggtgtggtggtgcaagagtagttgagtaatcccaactactcaggagccagaggcgggagaattgcttgaacccrgaagtggaggttgcagtgagctgagatcatgccactgcactccaggctgggtaacagagtgagactccgtctaaaaaaaaaagaaaaaaaaaaagagtga

SEQ ID NO: 59385 - DNA, 201 bp, Homo sapiens
ttccaagggttagcacatctttggggactgtcatttctatgaccacaatgataggaaaagcgttttgttatcccattttccttgtaagaaaactgaggtcyagcagagttaaaagattggccctcagtccatggcccacagctgccgtctgaccgtagccttctagcctgaggcccctcctactgtagcctcttaaatgga

SEQ ID NO: 59386 - DNA, 201 bp, Homo sapiens
gtggtggtgcaagagtagttgagtaatcccaactactcaggagccagaggcgggagaattgcttgaacccagaagtggaggttgcagtgagctgagatcaygccactgcactccaggctgggtaacagagtgagactccgtctaaaaaaaaaagaaaaaaaaaaagagtgaattgggcagatgtagaagcaggcacgctac

SEQ ID NO: 59387 - DNA, 201 bp, Homo sapiens
actgtagcctcttaaatggaaaaatgctacatttccaaaatgaaatagttctttgttgcttaaaattattgttcctttgcagtcaaaagaggaggaattgytgcatctccataaactttcaacctaggatgctcctagaaattgatcagggtgttccaagacctggggtggtccgaggatgctgaaatgaactgggtcttg

SEQ ID NO: 59388 - DNA, 201 bp, Homo sapiens
taatcccaactactcaggagccagaggcgggagaattgcttgaacccagaagtggaggttgcagtgagctgagatcatgccactgcactccaggctgggtracagagtgagactccgtctaaaaaaaaaagaaaaaaaaaaagagtgaattgggcagatgtagaagcaggcacgctacacgctagtcccctctgccccaac

SEQ ID NO: 59389 - DNA, 201 bp, Homo sapiens
tgcacagccaaagaaattaccaacagacagcctacagaatgggagaaaatattcacaaactatgcatctgacaaaggtctaatatccagaatctacaaggwacttaaatcaacaagtaaaaaacaaatagttcaatttaaaaatgggcaaaggacataaacagacacctctcaaaaggagacatacaagtgaccatatgaa

SEQ ID NO: 59390 - DNA, 201 bp, Homo sapiens
gtaacaatcaaaagaaaatggaatgaatacatgcttttaagaagtctaaggcaattagtggtcttcaattaaagtagctgtctgttctccctctctattgrtttctcctttactagtcatacctcaactaatgtacataaagatcttccctgaaggaaaatatgttcttctgcaagatgttgacattggactctcctaaca

SEQ ID NO: 59391 - DNA, 201 bp, Homo sapiens
tgcagggtccagcacctgtgaggatggagcacaggagggaacagcccagaagcctggcttcacccttagatgatcctgccttcgttacctatgtgaatctragaaatatatttaacctctgatgtgctaattttcttgtccataaaatggaataatgagacctaccttgtaggattaaatggtaggattcagctcatgatg

SEQ ID NO: 59392 - DNA, 201 bp, Homo sapiens
ttaaataaatccgttgtcaccttggaaagcaaagcctccccagggtggagagcagagaagggcaggagtcagagtgaggctctggagtgtcggcatcctgrccatcagaagcgatgtgagataaagtgccaaacaggacaccaatcagggagagaaaagggaccacgccgcagggcatggtttgttctaaagaatgtggca

SEQ ID NO: 59393 - DNA, 201 bp, Homo sapiens
gagtccctgtgatggactcgaaagcaaatacctgtaagggcataagaacactttgacacactacactacaaagaaatggtgcatgtttcttggcatgtagratccaatagattaattttcaaagtcgagtaacactcagaaatgcacacagttcttataaacaccagacagtatcaaaatatataaatttggtatgttttt

SEQ ID NO: 59394 - DNA, 201 bp, Homo sapiens
gccattatgtcaccacacggtcctgtccctagggccactatgtcaccacacggtcctgtccctggatcaccacgtcaccgcatgatcctgtccttagggcyaccatgtcaccacatggtcctgtccttggggccactatgtcaccacactgttctgttcctgaggccaccacatcaccacacagtcctatccccaggccat

SEQ ID NO: 59395 - DNA, 201 bp, Homo sapiens
ggatcaccacgtcaccgcatgatcctgtccttagggccaccatgtcaccacatggtcctgtccttggggccactatgtcaccacactgttctgttcctgargccaccacatcaccacacagtcctatccccaggccatcatgtcaccacacccacctccactctttaccttgtattttgcattgattcagattttatcaaa

SEQ ID NO: 59396 - DNA, 201 bp, Homo sapiens
atcccattcacaatgctgggtcttcagtgaccatcttctgaaaagagacaaacgtctacaggattaagaactgagtgatgatgtgcacctgagatacagartgaaatgagctgctgcacacacggcctagggagtccgagggttggggattaccgcaatgccgtcttcaggaaggttctgcaggaggctcagccttgcaga

SEQ ID NO: 59397 - DNA, 201 bp, Homo sapiens
acgaaaggggtgaaatcttcccatctatctgtgttcttctttctttcttctcgtcatcatttctgtttttgccgaaacacattgatcccattcaaagtatmgtataataaaagaccaattactttctaaaaaatgctgactttccattttagtccaaatgccttgagatcacacacaaaaggaacacagattagaagcaca

SEQ ID NO: 59398 - DNA, 201 bp, Homo sapiens
tgatttccttggctttaagaagaagctagaaggaaggttgaaatcatttactgaaatgcccccagcagcaaaaagccgcttggtattttatttgcaacatkaaatttgttttttttttatttcatttccttcacagttggggagaacttaaaaaacagaggtaataagaacaataaaaatcatgcagagacgatcagagtg

SEQ ID NO: 59399 - DNA, 201 bp, Homo sapiens
aagacagtgaaagacacaggggaagaccatgcaatttggaatccaaagttggagattgatctagttagtgactgtgtgtcctcaggaaagcatatttgctbatgatgactcagattccccatctataaaacaaagatggtagtgcctgcttcccagagctgcttgagagatcaaagaaaaataatatggatgaaagtgttg

SEQ ID NO: 59400 - DNA, 201 bp, Homo sapiens
agctaggcattccctgaaagatcaaaagcatctaaggctgctggtggtgatgcattttctcgatggggttgttgtggtgggcagctggatttaggagtgtyctttattgcacctgctcccattgttaggctgttggaagaaacgtggtgcacagcatgaggggaggctaatcctgaatgttttatggagcattacgactgc

SEQ ID NO: 59401 - DNA, 201 bp, Homo sapiens
gatgactcagattccccatctataaaacaaagatggtagtgcctgcttcccagagctgcttgagagatcaaagaaaaataatatggatgaaagtgttgttygctgtccatcctgcagaaatgtcaatttcacaagaaacttaaaagtcatcttctgtccatccgcgatgcattctgcttcttccagccccggccacctctg

SEQ ID NO: 59402 - DNA, 201 bp, Homo sapiens
ggttacatacctattccaaattaactatacctttgacgcaatgaatactaaaaacaaaaaaaatcaagtagagtgaaatgcttgtgcactactagcatgtratgctgttagacaccaaaggcaatcaatcatttagtatataatagaattttaaatttgcatagccattggcccaatagagtcaagtccgagagtttttac

SEQ ID NO: 59403 - DNA, 201 bp, Homo sapiens
aagaaacttaaaagtcatcttctgtccatccgcgatgcattctgcttcttccagccccggccacctctgtcattggtcttctctgctcttgatgacctgcytcttgccccctccctaaggctccagccccttcctgttgtctgctggtccagacactgtgcgattcctgcccccctctatggcccactgcccccacactca

SEQ ID NO: 59404 - DNA, 201 bp, Homo sapiens
aacaccttcagccccagagtcagccctgtgcttaaagatgttttacctaaaagtacatcaataggagactgattcaataatcagctatgaaacaggatacsatacaacaatttaaaatgatgagacttttattataaaaaattcatggtataatcaatgtaactagcatgttagaaaatagttgtttcctgctagtgtttg

SEQ ID NO: 59405 - DNA, 201 bp, Homo sapiens
cctgggactcagatgctgctcccttgtttgaggagttggagtgatagctccaagggaggccaaagctcttctattcagattactgcccagccaggcagacscagacagaaattttccttcaaccaagcaccacattgctccacattgctgttctccggcaatagactctcactttttcttccttattggctaaatggtcct

SEQ ID NO: 59406 - DNA, 201 bp, Homo sapiens
agagcaaaaaatatctactcattgaatattgggtctttaaatatccagaagtttactgtaattgaaaaacctgcttagaaaccacaacctaaattaaagcrgtcccagtctcttaagtctatagctaatgctgagagtcatctaattaatcctactcaaaatgcttctgtggtgaaccgattcttcatggcacagggctga

SEQ ID NO: 59407 - DNA, 201 bp, Homo sapiens
aaattcgttcacctcgcctgtcaccttgacctgggctcacctgctgcatctccattgtcaaggtcaccagactcctccaccctcctggagctctctgcctrtgactaaggactaccccttcttcacactcttctcttcagggccctgtcaccttcccactgccttgcctgctctccttcccctcttcctctcctttgctcg

SEQ ID NO: 59408 - DNA, 201 bp, Homo sapiens
gacaatctgcacagtaacccagaaaggcaatcccatttgttgctgggagatcactgttccaaatccaacgtgtttgcttatgccccagaagatcaaaagtygtaaaagccaggctagcagttgtcagctctgctgatggcagaggtcgtgttggagcctgttggcccaatccaccatctttgagcatatgaggaagaatgg

SEQ ID NO: 59409 - DNA, 201 bp, Homo sapiens
ggtgtgcggtcaccacatccaggaagccgtccttagctctcactcccgtctctattctgcctgcctagtgacagccgactacttcctctttcaaccttgcrtgccatgcatgaactgctaccccagcatcaataactatttatttatactttcttacctcttgatcacccacacgagaccagaaggaccatggagtatgtg

SEQ ID NO: 59410 - DNA, 201 bp, Homo sapiens
cacaaaaaggtattggattttctttctttccataccaattgattttatattgtctgacaaccctctgtacacactgccagtaagaattttttttaaccttratctataaaatcttactgcatttaatcactggatttacatttggtttattttatacttgcaaagaaaacagccacttttatttaaagaaaagaggaggct

SEQ ID NO: 59411 - DNA, 201 bp, Homo sapiens
ggtaaacaggggaaccacaaaaaggtattggattttctttctttccataccaattgattttatattgtctgacaaccctctgtacacactgccagtaagawttttttttaaccttaatctataaaatcttactgcatttaatcactggatttacatttggtttattttatacttgcaaagaaaacagccacttttatttaa

SEQ ID NO: 59412 - DNA, 201 bp, Homo sapiens
taaagagtagaaaaacataaaatagcaagataaaaatgagtcaacatattaatctcattatatgtaaatagatggaatctctttgtaaaaatgaaaacatratctgcttagaatttaaaataaaatccagctacatcatttttacaggattcacacccaaaatataaaatggttgtgagaactaagaaaaggaatgggaaa

SEQ ID NO: 59413 - DNA, 201 bp, Homo sapiens
atccagctacatcatttttacaggattcacacccaaaatataaaatggttgtgagaactaagaaaaggaatgggaaaagatattgtagacaaatcttaatwaaaaaaaaagcaaaacaaaacaaaaaaaaagctgctgtagtggtaacatcagagaagctagaccttaaggcaaaaatgacattaataggcataaagggag

SEQ ID NO: 59414 - DNA, 201 bp, Homo sapiens
agaaagaaacagaaaagagagatcttagaaataccacaacaataggctccggtcttccaaatgtccacgatctatgatggtgaacagtgcttgtctaatayagacatctctagaatgtgtaaaatatgcattcaaagttatttgaatagttttgtgcattctgttacaatctcccttactagttttctttttcttaggcat

SEQ ID NO: 59415 - DNA, 201 bp, Homo sapiens
cagtaaagacagggagtgaacaatgttgttcactaattaaaacccacagcccagaacagctggtccttccagcaggagccccttaaggagagtccgaggcyttgcattgtttttcgtggtgaggacccagatgcagcttttagggttttgtttttattgaatcaggctggaaaacaaaaagaaatttgctgactcatctcc

SEQ ID NO: 59416 - DNA, 201 bp, Homo sapiens
gtgggaaaactatttgggtctcgttatgaatgtaggagggaggtagctttgataggcttgccagcagggggcttgtgctccacttcatcagataattaaargagaggttttcaccctatgctgtccctgctctgaaaatttagtgtctcctctgcaccagacctcagacagggagtatcctcagagaccattcttccatct

SEQ ID NO: 59417 - DNA, 201 bp, Homo sapiens
ggacagagactttcctttgacaaacccaatgtagctattgaacatttgtggaaagttaaaaaaccagtcctaccccattgtcacttcagaaaatgcctacrtctgaactgaggctgttggcattctttgataatttacttcggccattttcacagggttcccccctgcccctacccttggatatttgtggttgcctcacat

SEQ ID NO: 59418 - DNA, 201 bp, Homo sapiens
aggtgcccttcaacagtggattggataaagaaaacgtggtatggaatactacacagccatcaaaagaacgaaattatgtcctttgcagcaacatggatggrgccggaggccattatcctaagcaaattagtgcaagaatagcaagtcaaataccacgtgttctcacttataagtgggcactaaacattgaatacacgtaga

SEQ ID NO: 59419 - DNA, 201 bp, Homo sapiens
cctacacattctgaagtttaaatcctggacttaaactgttctccttcatcctatttggatgggaaacccccaaaaaacccaatgtttgtgtgtttgttgctttgaaaggaatgagatggggaaggcatgtctgagcttagtgaacggagctggtctcagctctccaatccctggggtctacggacgttctctgctcctttg

SEQ ID NO: 59420 - DNA, 201 bp, Homo sapiens
gaagaagagagatgggaaggacaatacagtctccagttgtctgtaaaaatgcctttgtctgtggatgttagtggcaggggttagggaaatcagtgacacagggaaggaggagctgatttgactgaactggggaagtacatttgcatcgtggagtcattttaagtaagattagattgagtaaattgtgggcttaattcaaga

SEQ ID NO: 59421 - DNA, 201 bp, Homo sapiens
aattcactcaacacaattataaaaattttttacctttcaacatttttttcctgtggggaattgctatttgacaattgacataagaactcttgtgggtcagrttttctgtgaactatgaattccaagatcaatgcaagttttaatataaatatgtgaaaagctcccatctccctattttgcctcccctccaacataaaatga

SEQ ID NO: 59422 - DNA, 201 bp, Homo sapiens
tggcattaaacattatcttttctcattaaagctctaatttttttaaaaaaagctaatgatgaaaattttagttataatttaaatgaaatttgcatgtacarttgtcagtaaggactatgaaacataaacaattacataatttttgagatgcagcagatcctagaaactcactcagtcctgtggttgccaacctttctccat

SEQ ID NO: 59423 - DNA, 201 bp, Homo sapiens
agcccctgcccgcctcctgggaaggggaggctctgagggcatctgcacgtgtgatcacttgggtaaagaaatccccaggctccctgcagaagtgtttccaytagcgtggtcatctcaggtttttctcttttgttttgttcttttcctggtaaacaggggaaccacaaaaaggtattggattttctttctttccataccaat

SEQ ID NO: 59424 - DNA, 201 bp, Homo sapiens
tttctgtcagctgggggtctggtgatagctgggcacaggaagattgtgagtcatgtgcacgggagggatatgtgtcctggaccatgaaaaaggcagacttrtagcttatctgcttcttcattttgctttcccccaatcctgctagcctgactcctcctccctaactaggactccacaagccaggctcatcatcatattctt

SEQ ID NO: 59425 - DNA, 201 bp, Homo sapiens
ctgactcctcctccctaactaggactccacaagccaggctcatcatcatattcttcttaaaacatcattgagaatggattgaatttccctgctgttgctgyactccacacatacctaactcaccggctctccctgcctgcctctccctcacaggctgctttgctgtcccactggccgaggcactcaacaccagtgccttct

SEQ ID NO: 59426 - DNA, 201 bp, Homo sapiens
cctccacagcacattccacaccctttcctgtccaccatcacatggctgcaccagctcaggccctcccttcctcacagctggaagatgttttagccacctgwctttttctcccaactaccagtataacctagctttaatccagaccccgcacctgcctgaatgatccttctaaaacatctttctatttgtatcacaagattg

SEQ ID NO: 59427 - DNA, 201 bp, Homo sapiens
taaatgagaggctgaggcaggagaatagcttgaacccgggaggcagaggttgcagtgagccgagatcacaccattgcactcgagcccgggcaacaagagcraaactctctctcaaaaaaaataaaaagactgagaccaaaggaaacgtcatctcagtaaaattgttccacggtgtgggagaggttttttttttaagacaat

SEQ ID NO: 59428 - DNA, 201 bp, Homo sapiens
ttagccacctgtctttttctcccaactaccagtataacctagctttaatccagaccccgcacctgcctgaatgatccttctaaaacatctttctatttgtrtcacaagattgcatttacattttgatcctcccaaatcatcagcagcttcccccaatgcctcctcagtcaaattcaaatttcttagaccagtatcaccctc

SEQ ID NO: 59429 - DNA, 201 bp, Homo sapiens
ttgcagtgagccgagatcacaccattgcactcgagcccgggcaacaagagcgaaactctctctcaaaaaaaataaaaagactgagaccaaaggaaacgtcrtctcagtaaaattgttccacggtgtgggagaggttttttttttaagacaatctaaattaaaatgtgattcttttaactgtttctcattaagttaattgac

SEQ ID NO: 59430 - DNA, 201 bp, Homo sapiens
agtttggtccctcttatactcccaatgtctggaagatagtaggtgctgaataaatacatgtgtctgattgaagcctgcaacatgatggctggctggctggmtggatggatggatgggtggctggctggctggctggatggatggacgggtggctggctggatggatggacaggtggctggctggctggctggatggatgga

SEQ ID NO: 59431 - DNA, 201 bp, Homo sapiens
gccacctggcagacatcacaaggcatgttggaggagggactggcacatctactgctggccaagcttaccacctggtgcttgtgggtcacaagcatcatctyttagaagactaggaagaaccatgattattaggtagctgtcccaactcttctgggtttctgtctccagaatgagagccctgtgggtgacaggcatacacct

SEQ ID NO: 59432 - DNA, 201 bp, Homo sapiens
catgtgtctttatgatagaatgatttatatttctttgggtattacccagtagtgggttggctgggtcaaatggtaatttctgttttaggcctttgaggaaygactgcactgttttccacaatggttgaactaatttacactccgccagcagtatataagtgttcctttttctccacaaccttgccagcatctgttgttttt

SEQ ID NO: 59433 - DNA, 201 bp, Homo sapiens
ctggtttataatcttaaatgaaatgaatggctcttcaaacagatgactcaatgtggtcagatttattatgaagtattgtgaattttccaactgtcctcccygaccaagcacacaggaagaggcaggctcaatgacaacctctcagggctcatttagaatgtcattaagcgtgcttgcacctgtcacctttatatcagcatc

SEQ ID NO: 59434 - DNA, 201 bp, Homo sapiens
gcactgttttccacaatggttgaactaatttacactccgccagcagtatataagtgttcctttttctccacaaccttgccagcatctgttgttttttgactttttaataacagccattctgactgacaccttttttttaaactgtagcctgaacagccagggccaggtgcatctggacattccaattccaagggctcaatt

SEQ ID NO: 59435 - DNA, 201 bp, Homo sapiens
gagattaaaaactaattttcagaaggacaaaaacttatcttgaggaaatataggtctcttgagtgtccactttgaaagctaaaataatcaactaataaaaytttaatagattcctctttgtttcctgtcaaggaaaaacaacaggattttacatgttaaaggaaggccgctggttttcaaagcagcggctccattttctct

SEQ ID NO: 59436 - DNA, 201 bp, Homo sapiens
atgacgtgtccaagaaagagaacagctctcagcactgagcatggctggattaggacattcttgcgttgctatgaagaaatacctgagacttggtaatttayaaagaaaaaaggtttcattggctcacggttctgcaggctttacaggaagcatagcatcggcatctgctcagcttctggggaagcctcagaaagcttgcag

SEQ ID NO: 59437 - DNA, 201 bp, Homo sapiens
cctgctcgtccccaaaggtggaaccataagcgagaacggctttgtgtggtagccaaaagcacatcttcattttcgtaaaaaagaaaaatgcagctctattaaaaaaaaaaaaaaaaaagcacagccttatttttgagagccccaaactagaaacaatccaaatatccatcaaccagtaaaaggataaacaatggtatattt

SEQ ID NO: 59438 - DNA, 201 bp, Homo sapiens
ctgctcgtccccaaaggtggaaccataagcgagaacggctttgtgtggtagccaaaagcacatcttcattttcgtaaaaaagaaaaatgcagctctattaaaaaaaaaaaaaaaaaagcacagccttatttttgagagccccaaactagaaacaatccaaatatccatcaaccagtaaaaggataaacaatggtatatttg

SEQ ID NO: 59439 - DNA, 201 bp, Homo sapiens
tgctcgtccccaaaggtggaaccataagcgagaacggctttgtgtggtagccaaaagcacatcttcattttcgtaaaaaagaaaaatgcagctctattaaaaaaaaaaaaaaaaaagcacagccttatttttgagagccccaaactagaaacaatccaaatatccatcaaccagtaaaaggataaacaatggtatatttgc

SEQ ID NO: 59440 - DNA, 201 bp, Homo sapiens
tcagcttctggggaagcctcagaaagcttgcagtcatggtggaaggtgcagtggaaacatgtacctcgtatgatgaaagcgggagaaagtgagaggaaggrgtgggaggaggaggtgccacatgcttttaattgaccagatcttgcaaaaactcattctcacgaagacagcaccaagccatcaaggatccgcccccacaat

SEQ ID NO: 59441 - DNA, 201 bp, Homo sapiens
tggaaaattcgttcacctcgcctgtcaccttgacctgggctcacctgctgcatctccattgtcaaggtcaccagactcctccaccctcctggagctctctrcctgtgactaaggactaccccttcttcacactcttctcttcagggccctgtcaccttcccactgccttgcctgctctccttcccctcttcctctcctttg

SEQ ID NO: 59442 - DNA, 201 bp, Homo sapiens
ctaagcaggatcaggcctggctagctcttggacaggagagtctcagctcctatatgctgtgctacactgcctccagttcacttggaacaaaacactgagtstcggttatacgtttctggctatggtgtttgttgtaatggaattagtctataaatggagtggattggggaagcgggtagcattcatttacaatgggagaca

SEQ ID NO: 59443 - DNA, 201 bp, Homo sapiens
aagcaggatcaggcctggctagctcttggacaggagagtctcagctcctatatgctgtgctacactgcctccagttcacttggaacaaaacactgagtctyggttatacgtttctggctatggtgtttgttgtaatggaattagtctataaatggagtggattggggaagcgggtagcattcatttacaatgggagacacc

SEQ ID NO: 59444 - DNA, 201 bp, Homo sapiens
tgaactcagaccagtaaacatcccatactctgtggcaagtctgcagaagggaggatgcagcccctgtcctcagggaacatacattctaacaacatatgacrtaatgtgcccataacagagatgctttgggagccaaacaatgcaaggggcaaacccacgttcccagaggaactcactgttttggtgacttttcttccataa

SEQ ID NO: 59445 - DNA, 201 bp, Homo sapiens
cttaacttctcggtgcctctgtaaaatggagataattcagctactcagatggttaaatgagataatccacataaagcagttagtttggtgcctggagtataataataagagtgtcatatattttaatttactagttataattttttaagtatttgaatagttagaccactcatgcaactaaacgatgacactattgagaat

SEQ ID NO: 59446 - DNA, 201 bp, Homo sapiens
ctttgggagccaaacaatgcaaggggcaaacccacgttcccagaggaactcactgttttggtgacttttcttccataaaattgtcaggaaagggcaggctrtaagatagaccttctgtctggagacaggatacgtcaaggttaggatcacaagccagagtccagctacccaggttcgaatcccagctcgagcacttaacca

SEQ ID NO: 59447 - DNA, 201 bp, Homo sapiens
ctatgcattttctgcagaggtggagatcttcagttcagtgatgctgtcaaaacacaacatttctcctaatcaacaacttttatctgtctgtattatatgcaacatataatattttataacacaagactcaccagtctggcacagtctcatctaagaaaaggctactttgtttaagttgccatgggaagacggtggcagcta

SEQ ID NO: 59448 - DNA, 201 bp, Homo sapiens
gctgggatgcggctgataactgagttgttcaggcctgtgtgtctccatcaaattgcaaatggccctataggtcttctgacccctgcccctgctaacccccycgtgtgcattttcacacaatatccaagaaaatttgcagttaggagttagagccaagtgacagggtataagcaaataaccctcccttctctctaatgggtc

SEQ ID NO: 59449 - DNA, 201 bp, Homo sapiens
ctgaatgggagttcatgatttggctgttggcttgcctgttggtgtataggaatgctagcaatttttgcacattgattttatatactgagactttgttgaarttgctcaagaagcttttgggctaagacaatggggttttcaagatataggatcacgtcatctgcaaacaaagttagtttgacttcctctcttcctatttga

SEQ ID NO: 59450 - DNA, 201 bp, Homo sapiens
taatccaaatttggatttgaggtgagaattaactttaaaaaattatctaatggaaaaataaagaattttatcactctattaaggaactttataactcaacrctattttttcatagttctgatgttttattttttcagtgcctggttgttcaaagatttaatttaagcatccctgtactgttcaaataacagagtttcataa

SEQ ID NO: 59451 - DNA, 201 bp, Homo sapiens
ggcctcacagaatgagttagagaggagtctcttctttccaatttttttggaatagtttcagtagaaatggtaccagctctattttctacctcttgtagagytcagctgtgaatctgcctggtcctgggttttgtttggttggtaggctatttactactgcctcaatttcaggactcattattggcctattcagggattcaa

SEQ ID NO: 59452 - DNA, 201 bp, Homo sapiens
ctccagaccccagtagcctcagtttttcttgtaccacttcccatggtgagggttcccttggctccgtgtcactcccaggtgggccattgcctcaccctgcttttttttttttgttctccatgtgtctatttgtttcctgaatcaatcccatttagtgtataatcaaattttatttttttctagatgaccacctagtaatcc

SEQ ID NO: 59453 - DNA, 201 bp, Homo sapiens
aaaaaatgtagggcatgtataggcagtttccaaagcaagtcatgtacacagaaaaaggaaaatcgacttgatgctgtgttttttggcactcaccactgactgttttagaaacatatgtttaaaataaaacctgtagaagtctcgtcttggtgttccaatggttttgcctgttttgagttttattttccgagcaattgttat

SEQ ID NO: 59454 - DNA, 201 bp, Homo sapiens
aaaaatgtagggcatgtataggcagtttccaaagcaagtcatgtacacagaaaaaggaaaatcgacttgatgctgtgttttttggcactcaccactgactgttttagaaacatatgtttaaaataaaacctgtagaagtctcgtcttggtgttccaatggttttgcctgttttgagttttattttccgagcaattgttatt

SEQ ID NO: 59455 - DNA, 201 bp, Homo sapiens
tagttaattatccaaagtttgttggtagggttatggtgctttttggtggtaaattcactccattaataatagttgtaatccagcagcagctaacactcatgggttatattgcatgccaggccctgtgctaggagcctcaatatctcatttaaccctcacgtccacccgggaggaagggactatgatcatccctgctccacc

SEQ ID NO: 59456 - DNA, 201 bp, Homo sapiens
ctcatttaaccctcacgtccacccgggaggaagggactatgatcatccctgctccaccagtgaggatactgtgtgtgtatgtggaactggttgaatatatmaacaatccgtgctcttgggcacattatatggcctttattcctagctagggaattttttctatttaatgtttcttttaatgaaaactaatgtagaaatatc

SEQ ID NO: 59457 - DNA, 201 bp, Homo sapiens
gtgatttacaaacttctgtggtagcttcctttgctttacaaagatatgttaaatggtgattatattgttgcattctttcagctgagccccaactgctaaakaaatgtaattttcatatgataggcactgtgagagaaattcaactcaagtgtttgaaatcattgttgagtgttgctagatatatactgggtcctatgatgg

SEQ ID NO: 59458 - DNA, 201 bp, Homo sapiens
cagttgctaagtatattgatcgatagggtttttctgccccgcggggattacaacatggtaagcctagtgactgaacactgcacactgtccagttagaaggyagcagtcaaggaagacacagagatgggttttctgaagcatccccaccggctcctgctaacgggcacccttgccacaacccttggggacacaggacaggca

SEQ ID NO: 59459 - DNA, 201 bp, Homo sapiens
caagcgttgcctgccagcagaattttgggggccacatgaggtctgattatcccgttgagacaaagttttgaagatgttcctagcattctgtgttacatacrtatgtcaacagacattatacaagggtacgattacaggcaaatacagaaacattcactgcagacccagaaccagggttgcaactttctaccctgaagctct

SEQ ID NO: 59460 - DNA, 201 bp, Homo sapiens
aacacttactgacttctggacacagctccaatgaacccctctctcatgggtatccacaggaggggccccacgaaaaaaaggggcatgtgttcttacattttttttttttttttttttttttgagacagagtctcactctgtcacctaggctggagtgcagtggcacgatctcagctcactgcaacctctgcctcccgggtt

SEQ ID NO: 59461 - DNA, 201 bp, Homo sapiens
acacttactgacttctggacacagctccaatgaacccctctctcatgggtatccacaggaggggccccacgaaaaaaaggggcatgtgttcttacattttttttttttttttttttttttgagacagagtctcactctgtcacctaggctggagtgcagtggcacgatctcagctcactgcaacctctgcctcccgggttc

SEQ ID NO: 59462 - DNA, 201 bp, Homo sapiens
catgcacacacacaaatatacgcacgtgcccacatacacacacatacacacctatagacacacatacacccatacacatgtacgctcacccacctttggayccctcctatttatgggcttttctctgagtttggaaatgacttcaccttcttatgatgccatgagtgacactgtaatgaggctctgcggtacccaggaaaa

SEQ ID NO: 59463 - DNA, 201 bp, Homo sapiens
atgctgagataggtctttttccccacattttccagagaaagaggtcaagtgacttgcacaagtcccaaagcatcatttttggctaaaacctagcgtggaayaaccccaccttccctggccagctccctcacactggcttctggtcaacacagccctgccccttagtgtgtttacaaagcttgacttgcccctcagaccact

SEQ ID NO: 59464 - DNA, 201 bp, Homo sapiens
cttttctctgagtttggaaatgacttcaccttcttatgatgccatgagtgacactgtaatgaggctctgcggtacccaggaaaagcattccgcccatgtatggattttaggtgatagctttttgttgggaacaggccccccgccaaatctggccataaactggccccaaaactggccataaacaaaatctctgcagcactg

SEQ ID NO: 59465 - DNA, 201 bp, Homo sapiens
gcacacagtgcctatcaacagccacagtggacctaagagagcaaatcaagatgtcataaaactacagtacctcagaaagccaggcctgtaagacacaaagaaaaagaggagctaccaagtagcatgacagtatgaagactggacacctgtgttagtctgttctcacattgctataaagaaatatcgaagactgggtaattc

SEQ ID NO: 59466 - DNA, 201 bp, Homo sapiens
gcccacccagggcggaaaactgcttaaaggtgttcttaaaccacaaacaatagcatgcatgatctgtgccttaaggacatgctcctgctgcagataagtarcccaacccatccctttatttcaacccatccattcatttcccataaggaatacttttagttaatctacaatctatagaaacaatgcttatcactggcttgc

SEQ ID NO: 59467 - DNA, 201 bp, Homo sapiens; identical to SEQ ID NO: 17067

SEQ ID NO: 59468 - DNA, 201 bp, Homo sapiens; identical to SEQ ID NO: 17068

SEQ ID NO: 59469 - DNA, 201 bp, Homo sapiens
gacttgaccataactacctgttagctttggcgatgtggctcacatatgttcacgtgcatatgtggctgcgatgagagggcatcgttcctggtttgtcagcrcctgagatgtgctgatgtccccgggtttgacggcaccattgtctaacaagagaagagaaggcagttgcttgctgctgaagaagggcaaagtctacaacat

SEQ ID NO: 59470 - DNA, 201 bp, Homo sapiens
tagtgcctcagcagcagtgggacatggtcagggctgtaagcacaagcccctgttccactctccttagacaagagaagacataacacagtgcttaagaactytccagagctccaagcatgactgtggttgtatttctgcttagctccaatgacacttggatgatgatgaggagcagtgggtagttttagggctttgtattgc

SEQ ID NO: 59471 - DNA, 201 bp, Homo sapiens
atttaccacattttcttacccagtatatcactgatgggcacttaggttgattccatgtctttgctattgtgaatagtgctgcagtgaacatatgcatgcgygtataatagaatgatttctattcctttgggtatatacccaataatgggattcctgggtcaaatggcatctctgctgctaggtctttgaggaatcatcaca

SEQ ID NO: 59472 - DNA, 201 bp, Homo sapiens
atgatctcattcctttttatggctgcatagtattccatggtgtatatttaccacattttcttacccagtatatcactgatgggcacttaggttgattccaygtctttgctattgtgaatagtgctgcagtgaacatatgcatgcgtgtataatagaatgatttctattcctttgggtatatacccaataatgggattcctg

SEQ ID NO: 59473 - DNA, 201 bp, Homo sapiens
ctcctcttttcaggatgtttatggaggcttcatcactttggcattatcgatttttaactccagctccagctcctctcccctccccagaggatgggggtggrctggaagttcccagcttctaatcatggctcagtctttctggtgaccagcccccatccaggagcccaccaagagtcaccttattagaacaaaagacgttcc

SEQ ID NO: 59474 - DNA, 201 bp, Homo sapiens
atgaaaagtctcagctctaccccccacccacctctctgctaggagagattatggaaattttcaaacactcaaaattggagagaagagtacagtgaaaccckatctacccatcactcaacttcagcaaccgtcaacttgctgtcactcatcttacatccttgttttgaattcaaatggcaacacattatgtactttcttcta

SEQ ID NO: 59475 - DNA, 201 bp, Homo sapiens
accgtattagccagaatggtctcgatctcctgacctcgtgatctgcccgccttggcctcccaaagtgctgggattacaggcgtgagccactgtgcccagcygtgtgctcttttttaagactattgaggccactatgggttctggctcagtagagaataggctgtgtgcatccttagctgcatcttccatgctctgtgcatc

SEQ ID NO: 59476 - DNA, 201 bp, Homo sapiens
tctttaagggtatcagttatccacggaagcatgatctctccctgaagggaacttctcagaacatgttttcaagggaagttgttcacgtgattacagggttsaaaggggtatttgtttcccacttatttgttactataaacatgaaaattacataaaaagcagatgcctgatattttagcctttacatttgctaataggtaa

SEQ ID NO: 59477 - DNA, 201 bp, Homo sapiens
aatgtctttaagggtatcagttatccacggaagcatgatctctccctgaagggaacttctcagaacatgttttcaagggaagttgttcacgtgattacagkgttcaaaggggtatttgtttcccacttatttgttactataaacatgaaaattacataaaaagcagatgcctgatattttagcctttacatttgctaatag

SEQ ID NO: 59478 - DNA, 201 bp, Homo sapiens
tttggaactgtgctgtggaaaattcgttcacctcgcctgtcaccttgacctgggctcacctgctgcatctccattgtcaaggtcaccagactcctccaccmtcctggagctctctgcctgtgactaaggactaccccttcttcacactcttctcttcagggccctgtcaccttcccactgccttgcctgctctccttcccc

SEQ ID NO: 59479 - DNA, 201 bp, Homo sapiens
catatactaattattcatcagacacaaacatcaaatgtctttaagggtatcagttatccacggaagcatgatctctccctgaagggaacttctcagaacaygttttcaagggaagttgttcacgtgattacagggttcaaaggggtatttgtttcccacttatttgttactataaacatgaaaattacataaaaagcagat

SEQ ID NO: 59480 - DNA, 201 bp, Homo sapiens
caggttaaaaacaaagtgtccacaggacttccttcttggtggaggctctgggggagaacccatttcctgctccttgacgcactggcggaattcagttctaygtggtggtaggaacatggttcctattttcttgctggcggttgagggcggttcccagcttctggagacaccaggttccttggctcatggctcccttctggc

SEQ ID NO: 59481 - DNA, 201 bp, Homo sapiens
cccttctactattaactgatctttatcagaatctttattaatatcttattaataattatctttactaaacattaataattaataaagctaattaagacaaygtgcttgctcatgcctcccaagatcaaaagttataaaagtcatgtcaacaattgtcagctcttctgatgtcagaggtcatgttggaaaacattggcctaa

SEQ ID NO: 59482 - DNA, 201 bp, Homo sapiens
gctgcaaagaatgtgtttccaccaccctctcagacatgggcaagaagggtaagggggatacctgattttgtgtttctggaaagctaggagctcaagctacrgataccccacactaggacatctggagaaatgttgccatctagatgatgcggcatctgggggatggaagtgcccagtttatctggaggtggtcacaaccat

SEQ ID NO: 59483 - DNA, 201 bp, Homo sapiens
tctaaaagagagagaaactcatgtttctgagagaaatgcatgtttctgacagccaggtatggagggaagtgtctggcctagagttgagaggcctggatttyagttcctgccctaccgttaaccagctctgtgacctttgatggttatttaggtcttggtttccccatctattcagggaaggggctggctaaaagaaaaagg

SEQ ID NO: 59484 - DNA, 201 bp, Homo sapiens
aaccacgtgatgcatggtgtgacaaccatgtcttgctgagttgcgaaattatctgtgtattgacttatgttataaaaactcaatcacatttgtttaaacayttaatgagacatattgaaaaaaattaaatttcacgaaattgtcattgccttggaaaatctagaatttggagttctcataattatggtcagtaatctaaga

SEQ ID NO: 59485 - DNA, 201 bp, Homo sapiens
acaaatctacacaatacctatacataagcttaacaaaaattttccaacagccacgtggaaaaaaaaatctaaaactagactaaaggacataaaaatgaccktattaaaagaagaggcctgccatgtacatgaataggcaagcggtttattatgaaaatataagttcttcccaaactgacctgtacttcagtgtaatacaaa

SEQ ID NO: 59486 - DNA, 201 bp, Homo sapiens
tttccaacagccacgtggaaaaaaaaatctaaaactagactaaaggacataaaaatgaccgtattaaaagaagaggcctgccatgtacatgaataggcaarcggtttattatgaaaatataagttcttcccaaactgacctgtacttcagtgtaatacaaactgagatctcaatgggttattgtgtagcttaaaattggat

SEQ ID NO: 59487 - DNA, 201 bp, Homo sapiens
tccaacagccacgtggaaaaaaaaatctaaaactagactaaaggacataaaaatgaccgtattaaaagaagaggcctgccatgtacatgaataggcaagcrgtttattatgaaaatataagttcttcccaaactgacctgtacttcagtgtaatacaaactgagatctcaatgggttattgtgtagcttaaaattggattc

SEQ ID NO: 59488 - DNA, 201 bp, Homo sapiens
ctattcttaatgtgttttatcacagtttaaactcttacctcctctgtcgtgctcccacaccctggtcatgagatatatttgaaatgggagccacgggcaargggtctttgcatgtctagcctagtgtctcgcgcatagtaaaaggataaagaatatttgttttgactgtacctgagtagttcacatggaaattactgaagc

SEQ ID NO: 59489 - DNA, 201 bp, Homo sapiens
cctgccatgtacatgaataggcaagcggtttattatgaaaatataagttcttcccaaactgacctgtacttcagtgtaatacaaactgagatctcaatggrttattgtgtagcttaaaattggattctgtaattcatctgaagagaaaatagggaatgataacctagaaacctttgagaaaagaatggtaccaaaagaaaa

SEQ ID NO: 59490 - DNA, 201 bp, Homo sapiens
gcaaccttacttttagacccacgtgtctactcatagtgcatatccaagagaactggaaacacatccttacaaaaatgtgtacacatgtgttcatagtaacrttactcataatagtcaaaaagtagaaacaactcatgtgctcaacacttggataagcaaaatatgttttcatccacaaggcagaaggtgattcagctgtag

SEQ ID NO: 59491 - DNA, 201 bp, Homo sapiens
tatatatgcttttaaaaggtgagttttatggcaagtgaatttaatcttaattttaaaggacaacttaactctacctgatatcaaaatagagtatagagcamtagtcattggaacagtgtggaattggcacagaaacagacaaatggatgtctgtctcagtgggctagcacagagagtacaaaagtggcaccacaaacatac

SEQ ID NO: 59492 - DNA, 201 bp, Homo sapiens
ttatataattatataatatataattatctattatatattgttacatattatataatttctgatatataacatattgcatattatataatatgcaatatatwatatattgcatattatataatatgcaatatattatatattgcatataatatataattgcatatgtaatatataatatatgttacatgtaagataatatat

SEQ ID NO: 59493 - DNA, 201 bp, Homo sapiens
gttaaaagacatttcccatgtaataacaggcagagtattaatatcctgagtatataaagaacttctaaaattaatatgaaaaagctcaacagaataataawtgtccctgcaaccccttaaccctatcaccctcctttcatcgccttttagatgatctgagaattttgtcatctacgttgagaccaagagatcatcttagcc

SEQ ID NO: 59494 - DNA, 201 bp, Homo sapiens
atattatataatatatagtatgtatatactatatagtatatatactatagtatataatatatatagtatatagtatatatatagtatatagtgtatatagtatatatagtatatatagtatatatagtatatatagtatatagtatatatactatatatatactatatataatatagtatattatacatctaatatataat

SEQ ID NO: 59495 - DNA, 201 bp, Homo sapiens
tattatataatatatagtatgtatatactatatagtatatatactatagtatataatatatatagtatatagtatatatatagtatatagtgtatatagtatatatagtatatatagtatatatagtatatatagtatatagtatatatactatatatatactatatataatatagtatattatacatctaatatataata

SEQ ID NO: 59496 - DNA, 201 bp, Homo sapiens
ttcttcactttaagtagaatacagaaactatcaccttttaggtcgcttttcctcttccttttataatacagatgtcttaaatactacctttatgtgtactragagtcactgcagatgttgtaattttgctttcagccaaacataatctttaaaacttaactttgcttattattttctgtctgaaaaactttctttagccat

SEQ ID NO: 59497 - DNA, 201 bp, Homo sapiens
atgttaccctttaaacatcagtcactgaaaaatccacatttctcactccaggctggtgtctgtctggaacttttctaagacatatgatatagattaagtgkgtgatttctctcccatcacacatagggaacggaaattaattccatgcaggtgtggagaatatttggaggtgactcttgtttggcagcacaaattgaatcc

SEQ ID NO: 59498 - DNA, 201 bp, Homo sapiens; identical to SEQ ID NO: 17072

SEQ ID NO: 59499 - DNA, 201 bp, Homo sapiens
caggcaggccattgtggaggtgagttgcaactcctggcacctggctgtgtggcccagtggcctccacgcacactggtcttccggtgctgtgtgtttctctyggcagcgttcttcgcttatttgtaaatacaccacctcctcgtgtgtgctgtgctgttcagcttggctgcaggtccttgtgaagccattgtttctggctct

SEQ ID NO: 59500 - DNA, 201 bp, Homo sapiens
agcattttgacatattgtactgaatactctgttatgtggggttttcctatgcattgtagaatgtttagcagcatccatggcctctatcaactagatggaartaacatgtgtaattatgtttccaaacattgccaaaatgtcctctgaaaggcataacctcccttgattgaaaaccactgctctaaagattacagtatgtat

SEQ ID NO: 59501 - DNA, 201 bp, Homo sapiens
gtattagtgttgtctttttgcaatcatgaatgatatttcacaataggaaacatcattcatgattgcagcaaacagaaatggttacttctaaaaacaggatraaaagcaaagtatgaatttttccatccttttaacatacctatggaattacatttgaaaagcgtttcttgtagacagcatatagattttttcatccattta

SEQ ID NO: 59502 - DNA, 201 bp, Homo sapiens
tatccgcattcttccctgggctttcttcccacattcttaaaccaaaatgttgtttacttttgtcttttaaataaccaaaaccaagcaaaacaaaatctatycctatcatcgtcacaaatcttcagtaggaaaccttgaaactgattctggagtcagactgatttaggtcccagtctggtatctctaatttattagctgtgt

SEQ ID NO: 59503 - DNA, 201 bp, Homo sapiens
tttatagaaccttaggggatacaaaattatgcatacaaaggatcataaaataccaagtgcaatgtaaacacagttgccacttacttcatctgttatcataratcaaagactgcttctacagtaagagaagcgcatttccaattcaggtgggactcaccttaaaatatgcgagtggagggagtccccttattagaaacattt

SEQ ID NO: 59504 - DNA, 201 bp, Homo sapiens
gtgcatgactgttgtcgtgtgtgaaggagctgtgtgctaaggagggtgcagtggagacagactaacacctgagctgctcaaaagaggagcttctcagaggraaccctgagaagatgcatgtacctttctctgcagagacctgcacccagctggcgtccagaggatctgagtgaggagtactgagtatactcagccacttct

SEQ ID NO: 59505 - DNA, 201 bp, Homo sapiens
actaattatttcttagaaatgtaaaattattaacactggatcaaggtgaaagaggaaaatttaaatataactatataaagatattaaatttgtaatagtayttttaatatttactgacaaaaataagctcagactcaaatgatttagctggtgagttttaactaacatataagaaacaaatagttcctgagaaaaaaagaa

SEQ ID NO: 59506 - DNA, 201 bp, Homo sapiens
ccagctggcgtccagaggatctgagtgaggagtactgagtatactcagccacttcttgccagtctgccacttaattggggctgcagcataacctttgctcratgataaaattaaccttgattccggactgatatctgtcttcactaaggaagtgtctgtgctgtggtttctttttgtaagctgtgacattatcaaagaata

SEQ ID NO: 59507 - DNA, 201 bp, Homo sapiens
agcatggccacccaggatcttagcctcatgttcatgccccctcttacagtgccatcctcaggcctggtggggtaaaagcgactgaactggttgagtttctrcatccaagcattttgtgaattattttccatttatgtggctctgatgctttataattcccagtgctaaaagatagaacattacataccaatgttgaagctg

SEQ ID NO: 59508 - DNA, 201 bp, Homo sapiens
tccaagcattttgtgaattattttccatttatgtggctctgatgctttataattcccagtgctaaaagatagaacattacataccaatgttgaagctgctrgcttaatgtaaatcttaaagggcctcctctcattaggaaacaaagtaaggaaactaatttagcaacaaccaaggtgagttgaatagaggcatggattggt

SEQ ID NO: 59509 - DNA, 201 bp, Homo sapiens
acagccatgcacccgtcttctgagtttgttcctaaatgccacgttcccactgcttcagctcctggctggagcatgagctcctggagggaaaaggttgtctytctctaatttttctggttctcttgccccgctctctcagctctgactcaggtatctggcaggaggagtctcatgggctcttggcattggaatgagccccaa

SEQ ID NO: 59510 - DNA, 201 bp, Homo sapiens
aagctgctggcttaatgtaaatcttaaagggcctcctctcattaggaaacaaagtaaggaaactaatttagcaacaaccaaggtgagttgaatagaggcayggattggtagggggtttgctactatgctacgggcatgatgcaggaaacaattaccttcccatgctagacaagtcaaccccaggtgttactcacagcccgc

SEQ ID NO: 59511 - DNA, 201 bp, Homo sapiens
aacaaccacacacctaccagtttattctttgctgccctcacttctactccagccagcagagaatgagagttctatttgctcacatgttccccattgctcamtacatctgatttatctctaagtatttaccagcgttggtcctttcatgtaactaaaaataagtacacaaagctattcctcttcctcgttcatcccgttcca

SEQ ID NO: 59512 - DNA, 201 bp, Homo sapiens
aacaaatgcagtgacctctaggaaagccaagccctgtgcccacctctagtgagcatcatgagacagtctttgttctttgattctgggactggactagttgdggggggggggtgttcatgcagcactcctgggataattccttgcaaagctttgcagctcctgtagagaccagggcagagatacacaaggccatggtagtaa

SEQ ID NO: 59513 - DNA, 201 bp, Homo sapiens
ctctttcttcaaaggtcatgtgttgaaggctggatattttcagccttcaatttggcattaaggtcattgtgtgtaaagaagagaaaagctgcccgggggcrcggtggctcacgcctgtaatcctagcactttgggaggccgaggcgggtggatcacaaggtcaagagatcgagaccattctggccaacatggtgaaaaccc

SEQ ID NO: 59514 - DNA, 201 bp, Homo sapiens
tctttctttatacttggtactttttcaagtgctttgcacctatttgttaaacagttttttaaaatctaaacaaaaatcgatccttctattccagatttggyggggtggaggcaggtgatgcttctgtttgaattttgaagtttaaataaatacaaaaataattcccctcttgtgtacatccttgatttctttcctttaccc

SEQ ID NO: 59515 - DNA, 201 bp, Homo sapiens
aggagagtgaggggcagcacttgggaggcccacgtgcctttgccagtgagtgtgagggcccgtctgtgttttatgttttccgcaccctctctcaaacactmgctgttaagtagactgcagcggagacctgccattggggtctaactgatttaagccaggcatatcctcaacatattgcaatccatgtaaaacaaggagctg

SEQ ID NO: 59516 - DNA, 201 bp, Homo sapiens
gagtgaggggcagcacttgggaggcccacgtgcctttgccagtgagtgtgagggcccgtctgtgttttatgttttccgcaccctctctcaaacactcgctrttaagtagactgcagcggagacctgccattggggtctaactgatttaagccaggcatatcctcaacatattgcaatccatgtaaaacaaggagctgactc

SEQ ID NO: 59517 - DNA, 201 bp, Homo sapiens
ctggctttaggtgagctgctttagcccactgttactcttaaaatatttttcaaaagttacatggagctctcagaattgaccattttgctccagccctgagmtgaggaagccctgtccaccctgtggtttcagagaactggatccttaacccagagtacctcacggctccctgctgtctcttaaccctcttgctaccctggt

SEQ ID NO: 59518 - DNA, 201 bp, Homo sapiens
agcccgagctggctcctgacaccagcccccaatgccagccccaccatggtttccaaatgccaccacctggctttaggtgagctgctttagcccactgttamtcttaaaatatttttcaaaagttacatggagctctcagaattgaccattttgctccagccctgagctgaggaagccctgtccaccctgtggtttcagaga

SEQ ID NO: 59519 - DNA, 201 bp, Homo sapiens
ccttttgtcagttgatttgtagtgaactttcagagggcaaaggaggacattttcccttagcccctacaggtatgtatgtgaattatcctaggaagagtctraggaggttcatgtctcacaaaaggttagtagtcactgtattagaagggtccatttccagtcagatgaattttacatgaaaattttgtgtctttctaaagt

SEQ ID NO: 59520 - DNA, 201 bp, Homo sapiens
ctggtactgtggctcaccttgacatggctgcttggtggcagaacactgtatcctaatcccaaggaacagagcttgaaaattacccccccaacctctacccytacaagctcaagagacttttcaacttgtgcttctccccgctacctgtcttagtggtggatttaaagatcagcctctggggtcccacggcaggtttatttt

SEQ ID NO: 59521 - DNA, 201 bp, Homo sapiens
ctgagatgggcagaggttattcatttgcaggacgagggatgagtgctagtcttgccaactcccagcagcaggggctcttggctttgactctactccccctrctgtgagtcccgggacctcatgatgaccaagcagaggctgagggcgagtgggagaccacatgaccgccagtttcgttggagtggaggggcaggtagacga

SEQ ID NO: 59522 - DNA, 201 bp, Homo sapiens
agtcatttcttcccctcttgaaaaatgttctcctcttttctcaccacagctgggagtttctaatatgaataaagtgccaggaatttggcagtaacagtatwttcataaatacacatgaaatttggtggggtttaaagaaaaataaaatggaaagagcatattgtcaggtttaagcacagacctaccttgagatgaaaactg

SEQ ID NO: 59523 - DNA, 201 bp, Homo sapiens
tcccaaagtgctgggattacaggcatgagccaccgcgccaggccgaggagcctgtttttaaagattcatcattattagtggaaaatgtatgtttatacaakatctaaggacagtactttgggtgaatactgtcagattcctggagggaaaaaagactttattcctcctcctgttgtggctgtgactctttggttttctaga

SEQ ID NO: 59524 - DNA, 201 bp, Homo sapiens
tcccgtgtgactgtgcttcattagaggaccacaaatctaagaggaaggaatcaatgtagcaaggaagcagagatcctcataaaattgaaaacaggattgtrgtaccatttctgtattttccaatatagagcaaatcattaattttagtgactgaaagtcattcctttttatctaactggcctaaaacagccttgctttgga

SEQ ID NO: 59525 - DNA, 201 bp, Homo sapiens
ctcacgtgacctctctttgtgcgtgtacagagggaggaagctctggtgtcccttataagggcacgaatcccatcatggggcttccctcatgatctcatctragcctgatcagctcccaaaggccccatctcccgataccatcacatgggggccatggctctaacatatgaatttgcagggtatataaacactcagtccata

SEQ ID NO: 59526 - DNA, 201 bp, Homo sapiens
cggctcagtcaaccctcagtcatccatcacccgtggtggagttttcccggctgctccggtattatctcaaaatggtggttctcttacctcatagtgtctcygagagagtgggagaatggactcaatgagatcacatgtctgtaaattgtaaatcattccacaaaggtagtatattattacttagcttacagggattttgga

SEQ ID NO: 59527 - DNA, 201 bp, Homo sapiens
taatttggatccaatcttctttttcagtcccaccatccccttcctgaggaaaccaccctattcccgccatgctgtttttttggctgtttccagagcatgcygccacatgcgtggtgctgcccctctgcctgggacacactactccctgccctcccttttgactttggaagatccactcttccctcaaggcccaagtcaaac

SEQ ID NO: 59528 - DNA, 201 bp, Homo sapiens
ctttttcagtaatttgcttctcatgattagaatgtggtgacatgttttacagttaagtgttcagcttatttagatccgatgtaaaatagaaaatgttgcartacaaaatgaaatgttactgccattttctttttagggcagaattgatggtattcatttccactttccccttgcctgtttttgttttttttgtttttgaga

SEQ ID NO: 59529 - DNA, 201 bp, Homo sapiens
tgcccctttgtactcataagaggaccccaaccaagtgaggggcccagggctccatggggaaggccctgatcagacttgaagcatgagtgtgtctgtaatcrgaaggcctgagagcagcagtgagtggctctcaaatgggaaagtggggtggttgcgtcaaacaagagaccatcagttcaccatttcaccagttcaggctgg

SEQ ID NO: 59530 - DNA, 201 bp, Homo sapiens
ccaaccttaacagcttgcacctgttccacctcattatgtggcccaggtcagaccctgcatggaaataccaattcatagaatattctaattaatagaacagygaatattaaagagcatctcgtaggtggtaattgtctggtaactagtgtgtaagtcactgtccttccttctgttgatggactatatacatagatcatggtg

SEQ ID NO: 59531 - DNA, 201 bp, Homo sapiens
tctgagccttaatttcttcaaccacaaaaagctgagccattggtcagatggcttctaacatcctttacctctcccttgttcttctcctgttcttcccatawagcagtaaagagagagttccagttctatgatttgacgactgactaaaattgctatcgtgattgtgaccttaaagttatttttattaacttgcccacacat

SEQ ID NO: 59532 - DNA, 201 bp, Homo sapiens
aaatttatagataggatgtcgcttgtgcttatatttgactgtccgagaacatttcttctaggtttctcctaacccgttgttgtctcctaacttgaatttcrgtagaccactgcttagcactcaatatttaatgaatattattcttggttcattctaaatcatttttctagttggaaacagtaggggttatcccaaatgata

SEQ ID NO: 59533 - DNA, 201 bp, Homo sapiens
ccagccggccagcctatgttacaactgctttacctttcatgagggcacttgtgtgctactggctttttccagggactcgtagacccagttggttcataaamagcagaagctttgctttcctaacagacggaaacaggcaggtgtgcagttcaggagctgggccctcttggtctttcttgctttttgcagccatttaaggtg

SEQ ID NO: 59534 - DNA, 201 bp, Homo sapiens
catcccaaaggcaaatgcaaattatttttgaattgccttttctttagggattatctgtgccattgttcccctccgttagtatggataattatgagtcaaayagaaaagttgctgccttctctgaaaagaaatgtttgcttgggtactgtgtacatataggacagcgagttggggaggtgctgttttgcttcctcgaaggtg

SEQ ID NO: 59535 - DNA, 201 bp, Homo sapiens
acactcgctgttaagtagactgcagcggagacctgccattggggtctaactgatttaagccaggcatatcctcaacatattgcaatccatgtaaaacaagragctgactctcagttctgaacttggctgggagcaggtctaagaactctgactgtgtaaggaagtgcttctcatctctgacatttgcatattcccgctgct

SEQ ID NO: 59536 - DNA, 201 bp, Homo sapiens
aatctagggtcagatgttcaactttgagcagtttcttctactttagttcaccatgttggaatggtgcctaactagcaaatgcagaacttctataagttttrttattggccagatgcttccagcaactgagaataggacctgctttcatctggtgcttggctttggctgctatcactagccacccttttctccgtggctacc

SEQ ID NO: 59537 - DNA, 201 bp, Homo sapiens
ataattagagttttacataggatatagtttcagtatctgggtttgccataaatcttctggattattgacaaaattttattaattgcatttataaaactcakgataaatccattcaagaaagatggttttcaggagtaaagtattatattattaaactagtatgtgattagcttcaccccagccaatggtatataaattttt

SEQ ID NO: 59538 - DNA, 201 bp, Homo sapiens
atcactataaaaattataaaagtcactttttaatctctgaataatctcaagaaggaaagagagaagacagcatgagacctcctagtaaaacaggtgccccytcgaagtctggaggaggttgtgtttagaataaatcaaagcaagcagttgtacagcaggcagcctccatgtgggactccctccccgagagtttatgcaagc

SEQ ID NO: 59539 - DNA, 201 bp, Homo sapiens
gcattcatttttaaccaggagcttcctctgcagttgaaattctgccttgctgctgcagacgcctctgtatgcatgactcgaggcttctgcctctcgagctkgtagctttcagaagcaataagtgaaggcagggaacgtttttatctagcacagggcttaaccctgttttccagccaatatcaggaaatgtccttgttttaa

SEQ ID NO: 59540 - DNA, 201 bp, Homo sapiens
ggtccatctccctctccctgccttttgtccctgcctgagggtgacagctttgttctctctgactagctttctcctgaagtaagggaccaggatggaggtgstggccacattctcagagccttgagaacagagaagaaagacgtcatccccagacatcccagctcaacatgctgtagggaagatttgtgatgggcttagctt

SEQ ID NO: 59541 - DNA, 201 bp, Homo sapiens
attcccctcgtcttcccccggtcctccccatggaactgtctctttacagggaagagggtgggaggagacaggccctgaaaatccctggtccctgctaactrgggagtggctgcagcccctgtgttgggcagcccttgaggtcagtagtgggtgagacttgcccctccctccctccatggagtcctctaggcagcagtgttc

SEQ ID NO: 59542 - DNA, 201 bp, Homo sapiens
gaggactagagaaacaggggttcaacaactgccaggtctgtttgggacttggattgcaaaagctgaagtctacatatccaggcatcttagtaaacagcccrgatggaagggctccagggcgttgatagtgtttgtctccatgtggtgcgggactctgtgcttttctgggttctctgattcacatgtgcacaggagcaggag

SEQ ID NO: 59543 - DNA, 201 bp, Homo sapiens
aaactgcaaaatctgaagacttgaccataactacctgttagctttggcgatgtggctcacatatgttcacgtgcatatgtggctgcgatgagagggcatcrttcctggtttgtcagcgcctgagatgtgctgatgtccccgggtttgacggcaccattgtctaacaagagaagagaaggcagttgcttgctgctgaagaag

SEQ ID NO: 59544 - DNA, 201 bp, Homo sapiens
cttatctcttaagatttgaagtaattttcatttattaaattttttgtattggggggcagtcattgggtttgctgtaagttttccatacttagttctgtgtyttgatcaaatgagactatcttagagcagcaaaagggagatgaggagcagacctttgcctgcttaaaaagcagtttgctttaaaaaaataaaaaggtgggg

SEQ ID NO: 59545 - DNA, 201 bp, Homo sapiens
ctagatggaactgagagtgaagtataagtacaaatagcaagagctatttcatgaaaaattctataataaactgggacatcagcccaggtcccataatacasttacacacaaaagcaagtgttcatgcacatgcctgcatgcatacaggtaaatagggatatcaataaatgtcagtgccttatggcctaagaggcagtgtag

SEQ ID NO: 59546 - DNA, 201 bp, Homo sapiens
gggatggaactgaatgtgcctcacttgacactgcatatctgagttttttgatatgcattgttcattgagaccaccagtgaacacctgggcagatgtggccrgtgggtgccttcttgtgggcacaagaagggcagacaaagccattccatgccctgtgacttactgttctgggctctcctttctcaggtacccatttcccat

SEQ ID NO: 59547 - DNA, 201 bp, Homo sapiens
aatgtcagtgccttatggcctaagaggcagtgtagtagataaaaatatatcgattcacttgaactttcaaacttaaaaagatattttcttatgactttggrggaaacaggaagctgttgaactttgccatgactttttttgtcacctttgttgaggagagcttgcctccaaattataatgcttctcttgcagcagaaccct

SEQ ID NO: 59548 - DNA, 201 bp, Homo sapiens
gcagcagtgagtggctctcaaatgggaaagtggggtggttgcgtcaaacaagagaccatcagttcaccatttcaccagttcaggctgggcacttggcacastttgtctcttctgaccctccaacaagcccctgaagtggggactatgaagctttacagaagatgatgctcaaactctgagaccaaatgtcagtttccccag

SEQ ID NO: 59549 - DNA, 201 bp, Homo sapiens
aaaaaagatcacaaaagcagctgcagagaagagatgggtcacctgcccaaggaggctgaggactgacttctcagcaacaagaatggaaaccaagtcatccrtgatcgctcgagcctgtagtcccagctacttgagaggctgaggcaggaggattgcttgaggataggagtttgagaccagcctgggtaacatattgagacc

SEQ ID NO: 59550 - DNA, 201 bp, Homo sapiens
aagcctgtaatcccagcactttgggaggctgaggcgggcggatcacgaggtcaggagatcgagaccacggtgaaaccccgtctctactaaaaatacaaaawatcagccgggcgcggtggtgggtgcctgtagtcccatctactcgggaggctgaggcatgagaatggcgtgaacccgggaggcggagcttgcagtgagtcg

SEQ ID NO: 59551 - DNA, 201 bp, Homo sapiens
gctggctggctggcttccgccacggccaagaaaatccccttctgcctcaaagcaccaattaatacaagttcttcaccgagctgggtgggtaaaggaaacaggctgaaatgcatccagctttctgtgaaaccacttacaaggtcatcagccccgatatcttgcaggaccccctgctttgggctaggcggaagatgccaatct

SEQ ID NO: 59552 - DNA, 201 bp, Homo sapiens
tagaatgcaatgactcattttattaggttgagccaataacaaatatattatgtttagaaaaatatgttagttcaacctatactattgatgacttttcaaarattctactgcagtacaaacatggcttatgccctaaaaataatctataggttttgatttagaagtagaattccttccaacatttaaatgttgggtattaaa

SEQ ID NO: 59553 - DNA, 201 bp, Homo sapiens
ataagaaattaaggcactggggaaaatgtccatttacccttggagagtccatatggaggaagcaaatagttcaaaggcccagctgtaagaatattgattgrtgtggcctttatcctggagagaaatccatcaatgaatggcccactgtcactgacatctgtcctttggttcttctctagggttctcgacagcattagatct

SEQ ID NO: 59554 - DNA, 201 bp, Homo sapiens
tgataaagcacttcttcatcagccgcgttggcactgtacggaatggatgtcgggatggaactgaatgtgcctcacttgacactgcatatctgagttttttkatatgcattgttcattgagaccaccagtgaacacctgggcagatgtggccagtgggtgccttcttgtgggcacaagaagggcagacaaagccattccatg

SEQ ID NO: 59555 - DNA, 201 bp, Homo sapiens
tccttattcattaggaagttagtgtcagctgcaaattcagggacctgcttctgaaaggactcatcgtctatgtatttaatttcttttctttctttctttctttttttttttttttttagacagagtcttgctctatccccaaggctggagtgcaatggcgccatcttggctcactgcagcctccacctcccaggttcaagc

SEQ ID NO: 59556 - DNA, 201 bp, Homo sapiens
catttaaatgttgggtattaaaaatactatcctgggaggctgaggcaggagaatgacatgaacccgggaggcagagcttgcagtgagcggagatcgcgccrctgcactccagcctgggtgacacagcgagactccatctcaaaaaaaaaaaaaaaatactatccatccatccttattaagagagaaaaggccttttaatct

SEQ ID NO: 59557 - DNA, 201 bp, Homo sapiens
tggggtttatttccaagggaccaccatcggcatggccccaatcatgagcatgtgcacggcagaccagtctgggggaattgtcatggtaagccaagggcatygggagctggttccccttgataatgattccccaggaagtcactacttttatcagactttgtgaagatagatcctttcctttaatgctttttagatttaact

SEQ ID NO: 59558 - DNA, 201 bp, Homo sapiens
ttgtggggcaattgtaggaagcagaatggagaccctgccttgaagatgtcatgtaaaaacataaagaatcacacatgtatacgtgcggcatacagacattmctcagccgaaaggaccccaaactggcttaatgaaatgtcaaattatatctttttaagtttaaactaaatgatagcgttttaccttggtcccttataagga

SEQ ID NO: 59559 - DNA, 201 bp, Homo sapiens
cagctgcaaattcagggacctgcttctgaaaggactcatcgtctatgtatttaatttcttttctttctttctttctttttttttttttttttagacagagycttgctctatccccaaggctggagtgcaatggcgccatcttggctcactgcagcctccacctcccaggttcaagcgattctcctgcctcagcttcccgag

SEQ ID NO: 59560 - DNA, 201 bp, Homo sapiens
gtgtctccgagagagtgggagaatggactcaatgagatcacatgtctgtaaattgtaaatcattccacaaaggtagtatattattacttagcttacagggrttttggaactatcaaaaagttaaaggctttttcagaattcctactcatcattgctggaaagactcccagtgcccttagcagtcactcagcagcatgtcca

SEQ ID NO: 59561 - DNA, 201 bp, Homo sapiens
ttgttttgttttttgtttgtttgtttgtttttgagacagagtctctctctgtcaccaggctggagtgcagtggcatgatctcagctcactgcaacctccarctccctggtttaagtgattctcctgcctcaacctcccgagtagctgagattacaggcacacgccaccacgcccagctaatttttgtattttttttttttt

SEQ ID NO: 59562 - DNA, 201 bp, Homo sapiens
aagtagtgcaggaatagatgtgccctcccaaaggtcaggcagttcataaaccttaattttggccaatccactttttaaaaactatttaaagtgcagtagawcatatgaaggaggaaattggcatggaatggcggtaaagccactttgaccttcacctttgcacttgtggtgctcgctccatcagcacctgtctgactagcc

SEQ ID NO: 59563 - DNA, 201 bp, Homo sapiens
cactgcaacctccagctccctggtttaagtgattctcctgcctcaacctcccgagtagctgagattacaggcacacgccaccacgcccagctaatttttgkattttttttttttttttttagtagagacagggtttcaccatgttggccaagatggtctcaatctcctgacctcatgatccgcccacctcggcctcccaaa

SEQ ID NO: 59564 - DNA, 201 bp, Homo sapiens
tttttggtatatttaatagagatggggtttcatcatgttggacaggctggtcttgaactcctgacctcaagtgatccgcctgcctcagcctcccgtagtgytaggaatgcaggtgtaagtgaccatgcacagcctcggccttctctaatgacatcagagaagacagcagccctgcccctgactcaggacaagcttgctaca

SEQ ID NO: 59565 - DNA, 201 bp, Homo sapiens
acactcatagcaaagaatatttagcgtaatagtaaatgtcacttcctagagtaggaaaaaaggcaatattaacattcaaaaaatgactcttacagattcctttttttttttttttttgcagaaagtttctgttaaatgagagttggaggaatagggccatctcctcgggtggggtaggtgaatctgcaagtcatattcacc

SEQ ID NO: 59566 - DNA, 201 bp, Homo sapiens
cggcttactgcaacctctgtctcccaggttcaagcaatcctcccacctcagcctcccgagtagctgggattacaggcacacaccaccatgcccagctaattttttttttttttggtatatttaatagagatggggtttcatcatgttggacaggctggtcttgaactcctgacctcaagtgatccgcctgcctcagcctcc

SEQ ID NO: 59567 - DNA, 201 bp, Homo sapiens
cagaggggaatctgaataagcagcattcatttttaaccaggagcttcctctgcagttgaaattctgccttgctgctgcagacgcctctgtatgcatgactygaggcttctgcctctcgagctggtagctttcagaagcaataagtgaaggcagggaacgtttttatctagcacagggcttaaccctgttttccagccaata

SEQ ID NO: 59568 - DNA, 201 bp, Homo sapiens
ccatgcccagctaattttttttttttttggtatatttaatagagatggggtttcatcatgttggacaggctggtcttgaactcctgacctcaagtgatccrcctgcctcagcctcccgtagtgctaggaatgcaggtgtaagtgaccatgcacagcctcggccttctctaatgacatcagagaagacagcagccctgcccc

SEQ ID NO: 59569 - DNA, 201 bp, Homo sapiens
tctgcccatcctgaacaagccccgtgagctagggtggctttcttgaattttaactattgcatggaataagtgatcacttcatttaaaaagataaataatcytatcgaagggtacagcattctcagcaagatgaggccaaaaacaataaaaaaaagtgtttagctttgagtttgacagagaagaaagccctggaattctagc

SEQ ID NO: 59570 - DNA, 201 bp, Homo sapiens
aattcctacctcatactgtgggaaaactggatttctcttggaagagatttctgcctgaaaaggtgttttaagagggtaaaatgaactgcaattttcagtgaaaaaaatcccccaagggctttggaagtggtaggaattgatagaaattcaatgtagcgggaaagtccacactctgtagaacttgctttcctgaaaatcagt

SEQ ID NO: 59571 - DNA, 201 bp, Homo sapiens
tatcatccagccataagaaggaatgaggttccgatgcatgctaccatgtggctgaacctcgagaacactattctaagggaaaggagccaaacacaaaaggmcacatggtgtaggattccgtgtacatgaaatgaacagaacaggcgatctgtagagacagaaagcagattcgtggttggcaggggctgggtggggaatgga

SEQ ID NO: 59572 - DNA, 201 bp, Homo sapiens
atcctggattatatcctgaagtatgttttccatctttgtgggcttatctacctttgatcttcgaggttgctgacacctttggatgagatttttgtgggtcrttttctgtttaacagtctggccactcttccgtaaggctgctgcaatttgctgggggggctctgttctgcccgcctcttttgggtaccccaatcacttgta

SEQ ID NO: 59573 - DNA, 201 bp, Homo sapiens
cacttgcagtccagggcaagaagggcaattagaaaatgaattcgaggttcactttgcttctagtctatagactatttgcgggtggtatgtggcactaatgwatataaatgggtttgatcgttcactcgcattattgaatatttcatgcacctttacgcatggaatagtatgaactgatacacataaaatgactaaggtgat

SEQ ID NO: 59574 - DNA, 201 bp, Homo sapiens
ctgctgttagtctgataggctttcctttgtaggggacctggtttttctctctggctgcccttagcattttttctttcattttgaccttggaaaatctgatrattatgtgtcttggggttgatcttctcatggagtatcttaccttctctggatttcctgaatttgaatgttggcctgtcttgccaggtaggggaagttatc

SEQ ID NO: 59575 - DNA, 201 bp, Homo sapiens
cccaactacagaatgagtaaagaaaagcactttggaatggcaaatctgtgctggggactggaaacatttgagcctggggatggctgtgattccagtgaggyttcagtgatggctccctgctaccttctgtggctaccatggtccactgtgccgttgtcacgcctcagggaacctgcgtggtccagaccatcaccccaccta

SEQ ID NO: 59576 - DNA, 201 bp, Homo sapiens
cttccttccccatgcggtcgagggttgcagctcagccctctcccattggctgtatttcggactttcagttcattcctgttccttgtcctcttggtcctcarcacctgagagttttaaacactctgtgaccagcttgagaatttctcagaggctgtttcagacagtgactacgggagtagtaatcctttggtaacctgaata

SEQ ID NO: 59577 - DNA, 201 bp, Homo sapiens
ccatagctactgtaagaaaccaacctgatggtttgatttttttccttcctttccctacccttgaggaggctcttaactgtattaaacaaaatggcagcagrtcatagaaaagaagatgttttcatagagaaaatagcttcctcccaggaaaagggtttcccccacaaaggctgtgtttttaagtccccaacataacaaagc

SEQ ID NO: 59578 - DNA, 201 bp, Homo sapiens
ataggccttgttagtgggggatggggtccagaaaccaagaaggtgtgaaagacattctttccctggagtaggagctgctgctgcagtgatccacagccagmtgagggtccaggtgggaggcagggccgaggagagcccaggtaactgcatcacggcgatcaccagcagccggaaaggactgttgcacacttacctgatgtg

SEQ ID NO: 59579 - DNA, 201 bp, Homo sapiens
tagaacagtgaatattaaagagcatctcgtaggtggtaattgtctggtaactagtgtgtaagtcactgtccttccttctgttgatggactatatacatagrtcatggtgcgtgtggaagaccccattgagtgcctgtattttgtgccagtgggcttttgtttttgttagtcaatcatttgaccaaaaagcattgctttgat

SEQ ID NO: 59580 - DNA, 201 bp, Homo sapiens
tgattttcattgctctcttgctggtctcaattttgacagcagaataatgagtaatagaaaagtttcattaattctgaaaagagatgtcttgtcatttgacrattctcagagaacattcttacgataagaagttggcacgtaactgaggaaaaagctcaatttgtataggctaggggatgtgatcaccagaaagatgtgggt

SEQ ID NO: 59581 - DNA, 201 bp, Homo sapiens
gattgtagtaccatttctgtattttccaatatagagcaaatcattaattttagtgactgaaagtcattcctttttatctaactggcctaaaacagccttgstttggaaataatattaataacatgaataaagagatattttttcttactacaaatgtaaactgtttatcaaggtcttttaagagacattctgtttataatc

SEQ ID NO: 59582 - DNA, 201 bp, Homo sapiens
ttttttgtttatttgggtcatctctgatttctttcagcagtgttttgtagttctcttatagagaactttcctctccttggctagatagattcctaggtatytcctttttctgtgtgactattgcaaatgggattgtgttcttgattttgttctcagctagaacattattggtgtagagaaatgctactggtttttgtacat

SEQ ID NO: 59583 - DNA, 201 bp, Homo sapiens
acatctgtttgcatatataaataaaataacaagggtgggagctgtgtaagccagtgtgttgttagcacttacaaggttatagaccatctggttaaatgcarctattcaagaagaaaaatttaaaccagggtttcttagcgatgacactgttaacatttggactgggttattctgtgctggggagagggagggtactgtcct

SEQ ID NO: 59584 - DNA, 201 bp, Homo sapiens
gagtttgagaccagcttggccaacatggtaaaaccccgtctctactaaaaatacaaaaagtagccagtcgtggtggtgtgtggctgcaattccagctgctygagaggctgagtcaggagaatcgcttgaacccaggaggcaaaggttgcagtgagccgagaccatgccattgcaccacagcctgggcaacaagagcgaaac

SEQ ID NO: 59585 - DNA, 201 bp, Homo sapiens
ggaagaagtggctttttgctaagctttgaaaagtagaggcattggcgcaggcggagatgaggaaggaaaaaggcctgtgaggctgggctgcgaaaacatgmagcacttctgcgtctgtcacagattctcctcctctctgatccatcaacaattgaggcatcaaattttcaaatggacagaaagacccggttcatcatccat

SEQ ID NO: 59586 - DNA, 201 bp, Homo sapiens
gagagaaagcaaggtggatgctggagtcctatatgccaggctggcaacaaggggagagatgaagaatgacaggttagagcctgcctattctggctcacgaragccagcatgagtatcccttcccaactccaaattcagagacatcatgttggtagcctgaaactggccacagtcagagtatttacaccactgaaaatggta

SEQ ID NO: 59587 - DNA, 201 bp, Homo sapiens
tgtgtttatatacgtatgtatatgagtctgtatgtttatgtatatgtatgtgcatgtgtatgtatatttgtatgtgggtgtctatgtatgtgcgtggttawatgtgtgtaggtttgtgtgtgtgtgcacatacacatgcatgtttgtgtagatgtatttgtgtgtgtgcacatgcacatgttgtgtatatgtatttgtgta

SEQ ID NO: 59588 - DNA, 201 bp, Homo sapiens
tccagcatggtgcctgggacatgagatggcactaaggttagagggatgggccgaagacaagatgggcatgggtttaattaccagctttcccacctattagytaagctgtaaatctgaggctacactctgtagtcctttctgtaacataggaatgagatgataatgcataaataaggatgatatggtacccacctcctagga

SEQ ID NO: 59589 - DNA, 201 bp, Homo sapiens
gagtttgggcttgatcctgaaggcaatgagaggcatggaaggttttcagcagaggagtaatatccattaggctggcattttagaaaaaccacagcaaaaawtgtcctgaaaatacaatcttccctctccagacagagtatagctaccccccttccaaagttcacctcattggccacagcctgggagcccacgtggctggag

SEQ ID NO: 59590 - DNA, 201 bp, Homo sapiens
ttaggctggcattttagaaaaaccacagcaaaaaatgtcctgaaaatacaatcttccctctccagacagagtatagctaccccccttccaaagttcacctsattggccacagcctgggagcccacgtggctggagaggcaggaagcaagactccaggcctgagcaggattacaggtaaggccccagaggcagggccccagt

SEQ ID NO: 59591 - DNA, 201 bp, Homo sapiens
taacaaccatatcaaatagatgccattatcaccccattttgtaaaatgaagaacctgaagcacaaaaaggtagagtgacatgctcaaggtcatgcatcttkccccaaaagcagctgagtaggaatttggagccaggcaacctagacccagaacctgtgttcttaactatgataccacattgcttcacccctttctttctac

SEQ ID NO: 59592 - DNA, 201 bp, Homo sapiens
aagaagaaagatacacaagtaaatgggagactctggtgtggaaaaaatccttgcttaaacaaaatctaaatttctttgctcatttgtcctcctccatccaygccactgggaacccttttgcaatgagccacattcagactctatgtcctcatatttagcacccaaggccatggcactgcatcactctggtgcatggtaccc

SEQ ID NO: 59593 - DNA, 201 bp, Homo sapiens
ctccagccctagtgccccctcgtgcctcctgaatcactcatcaactgtgacctgggcttaaccccttaagaaaaaccaaaccaaaccaaaccaaaccaaamcaaaacaaaacacctggcttttgctaaggtgacccaaactcttacaaagcttccttttctccccaggtacaacttctgtagcgaagacacagtgcgggaa

SEQ ID NO: 59594 - DNA, 201 bp, Homo sapiens
tttgtgggtacattttaattatcttagaaatggacacatttaccgaaactattgcagttacaagtaaactgaggatttagacagagtgtgcatttcttccrttctatttctgcggcatgaaatgagagcaagcaactagtataattaatgggatgaggccagtttgcacatccttgtgaccagctaccctgaatttttacc

SEQ ID NO: 59595 - DNA, 201 bp, Homo sapiens
tgcagctccagccctagtgccccctcgtgcctcctgaatcactcatcaactgtgacctgggcttaaccccttaagaaaaaccaaaccaaaccaaaccaaamcaaaacaaaacaaaacacctggcttttgctaaggtgacccaaactcttacaaagcttccttttctccccaggtacaacttctgtagcgaagacacagtgc

SEQ ID NO: 59596 - DNA, 201 bp, Homo sapiens
cttccgttctatttctgcggcatgaaatgagagcaagcaactagtataattaatgggatgaggccagtttgcacatccttgtgaccagctaccctgaattyttaccactccacagttcattgtttctttcctttttaaggccgcatcagacacacctgttctcttcattcagcaaagacgtaattggtaccagctctttgc

SEQ ID NO: 59597 - DNA, 201 bp, Homo sapiens
ggtcgggagccctgtgcaagctggaggtgcaaccaaatcctttcctccctgaccccatcagaggatactcagcctctaaattcagctccccaaggccccawtagcaagcatcccatggcctggatcctgggactgtgtggttaaaaacatgtcaggtggtggcatcattggaatcttaaaaattagaggtgttcccaggag

SEQ ID NO: 59598 - DNA, 201 bp, Homo sapiens
ctggctggataaggtttcccctgctcccattatctccccaaccccactatctccccaacaccagaaactgttcgaggtggaggaggtgaactgcatctgcrtggactggaagaagggctcccaagccacctacacacaggctgccaacaacgtgcgagtggtgggcgcccaggtggcccagatgctcgacatcctcttggt

SEQ ID NO: 59599 - DNA, 201 bp, Homo sapiens
ctgggctatgtcccttaagaagcccaactccattctctgctttcccctctgtctgtgcatccctgatgcccaggggctgcctcgctggtggagtgcaggcrggaatcagggggaaggatgatttctctccaaaacctgctgaatggactaagacacagggtagagactgggcatgtttgggccactttgtaccaacctgcc

SEQ ID NO: 59600 - DNA, 201 bp, Homo sapiens
ttctgcagtgctgatcatctcttttagggttggatcctgtagaagcaagtttcgagagtactcctgaagaggtgcgacttgatccctctgatgctgacttygttgatgtgattcacacggatgcagctcccctgatcccattcttgggtgagacctatgatgctccagctgtgagcatgcacaactgtgttttaaccatga

SEQ ID NO: 59601 - DNA, 201 bp, Homo sapiens
ttgggccactttgtaccaacctgccccatgacagttccataggaggtgacccagtaaagacagaggttacatattcatataaatgtataacacatcttacrtagtttttaaagtcagatttattgaggtataatttatatttggcaaaatgcacgctgtttagcatacacttgtatgagtttggacaaatgaatagttgtg

SEQ ID NO: 59602 - DNA, 201 bp, Homo sapiens
gacttgatccctctgatgctgactttgttgatgtgattcacacggatgcagctcccctgatcccattcttgggtgagacctatgatgctccagctgtgagyatgcacaactgtgttttaaccatgaaagtcctgcatgacaaaaagctcattgtttttctaagcatttcaggttttggaacgaaccaacagatgggtcatc

SEQ ID NO: 59603 - DNA, 201 bp, Homo sapiens
aaagttacccgaaggctgtaggcatgcagagctttggggtccctgctaggtagcaatgcttgttaaggttggctccaagccccccaatccacaccctgcayacaactccaaggtgcacgaagccaaaacacaatcaagacatgccacttgttctccatcctggctgcaaaccagagtcacctgggagttaaaaaaaaaaaa

SEQ ID NO: 59604 - DNA, 201 bp, Homo sapiens
gcagtgacaccccagagcacaccttgagagcaaatccttgagcagattcaacctttctctgtaggaaaagaagtttgctatgaggacctcgggtgcttttytgacactgagccctggggcgggacagcaatcaggcccctgaaaattctcccctggagccctgagaagatcggcacccgcttcctgctgtacaccaatgaa

SEQ ID NO: 59605 - DNA, 201 bp, Homo sapiens
tgatctcagctccactgcaacctccacctcctgggttcaagagattcttgtgcctcagcctcccaagtagctgggattacaggcatgcaccaccacgcccrgctaatttttgtatttttagtagagacagggtctcaccatgttggccaggctggtctcaaactcccggcctcaagtgatccacctgcctcgacctcccaa

SEQ ID NO: 59606 - DNA, 201 bp, Homo sapiens
aatgcagttctagagggggatactgctaaatacatacttctccataaggccttgtttgatttgtagattaacaaatagaatttcttatactttggctgggygtggtggctcacgcctgtattcccatcactttgggaggcggacacgggcggatcacttgaggtcaggagttggagaccagcttgaccaacatggcgaaac

SEQ ID NO: 59607 - DNA, 201 bp, Homo sapiens
cagagtatagctaccccccttccaaagttcacctcattggccacagcctgggagcccacgtggctggagaggcaggaagcaagactccaggcctgagcagrattacaggtaaggccccagaggcagggccccagttttgtccccagaaaccccagaatgaggtctcaagaatgcagcccagttcagagctcccctgaagga

SEQ ID NO: 59608 - DNA, 201 bp, Homo sapiens
cctccaaatcaagatacagaacacttctatcaccatatatatcactctgtaatttttttttttttttttgagacggagtctcgctctgtcgcccaggctgsagtgcagtggcgcaatcttggctcactacaacctccccctcccgggttcacgccattctcctgcctcagcctcccgagtagctgggactacaggcgcccg

SEQ ID NO: 59609 - DNA, 201 bp, Homo sapiens
atagttgtgtaaacacctccaaatcaagatacagaacacttctatcaccatatatatcactctgtaatttttttttttttttttgagacggagtctcgctstgtcgcccaggctggagtgcagtggcgcaatcttggctcactacaacctccccctcccgggttcacgccattctcctgcctcagcctcccgagtagctgg

SEQ ID NO: 59610 - DNA, 201 bp, Homo sapiens
tccccttccgagagtgactggaagacagcatccctctgtaagccaggctgctgggcctatggaggccgccaggcgcctgtggggacaaggaggtgagagtmcctgccttcggaggccaccgtcctgtgtgacactccagaaccatagcagaccttgtcctagagcctccaggcagcaagcgctgtaggcgctggttgcagc

SEQ ID NO: 59611 - DNA, 201 bp, Homo sapiens
atgatctcagctccactgcaacctccacctcctgggttcaagagattcttgtgcctcagcctcccaagtagctgggattacaggcatgcaccaccacgccyggctaatttttgtatttttagtagagacagggtctcaccatgttggccaggctggtctcaaactcccggcctcaagtgatccacctgcctcgacctccca

SEQ ID NO: 59612 - DNA, 201 bp, Homo sapiens
attgttttttgttaattgtaagactttttacatttaccatcatgggatgttacgttcttatcatggaattctcaacagtcgtgggagaatgactgagatggaatctcgctctgttgcccaggctagagtacagtggcatgatctcagctccactgcaacctccacctcctgggttcaagagattcttgtgcctcagcctcc

SEQ ID NO: 59613 - DNA, 201 bp, Homo sapiens
gttagggcttcttggcagaaaaaatgaaacacagaagagaaggtgggaaggggccaaggaacaccagtgaggaaatggggcaaagcttccgagctcacagstggtgaggcctgagagaagtccgtggttcttgaacaaccacaaaaataactgcttacatctgcattgttttttgttaattgtaagactttttacatttac

SEQ ID NO: 59614 - DNA, 201 bp, Homo sapiens
tgcatgaggggcgacagggcccaagtgcagggaatatgatcggaggcctccgatgccaagttagggcttcttggcagaaaaaatgaaacacagaagagaargtgggaaggggccaaggaacaccagtgaggaaatggggcaaagcttccgagctcacaggtggtgaggcctgagagaagtccgtggttcttgaacaaccac

SEQ ID NO: 59615 - DNA, 201 bp, Homo sapiens
agtatccaaagagaaaggcagccctccccctctttatttctccgtccccctctctttattaagtacctttggtaaatgtacccttgcaaatgactttattmagtacctattgtatggcctggcaaacagtaagggatgcaaacactgagcctacactcaaggagcttacagttcagctgttgagaaaaatcagacttatgg

SEQ ID NO: 59616 - DNA, 201 bp, Homo sapiens
tacagtaacatgtagtacaggtttgtaacctaggagcaataggctgtaccatacagcctaggtatgtagtaggctgtgccatctacgtttgtgtgagtacrtgctatgatgtccacacaatgattaaattacctaaggacacatttctcagaacatatctccattgttaagcaacgcaggactatataactttatgtactg

SEQ ID NO: 59617 - DNA, 201 bp, Homo sapiens
taaaaaccatagtttgaggtgctagcatatagctggcttttccatttctccatcctttatttggaaattaattcggaaaaataatcctgttaatctagaakagaaaacagcagcctggcattgtatggtaattagaactcatttccgtgaacagggatgtttatgtttctctatttcaagggggattctcaaaccaggctc

SEQ ID NO: 59618 - DNA, 201 bp, Homo sapiens
cagatgggtcatcttgacttcttccccaatggaggagagagcatgccgggatgcaagaagaatgccctgtctcagatcgtggatctagatggcatctgggygggtaaagtcatggtggggtgaggggagcagggcgggtactttcctggagtgaccaatacctttctgcagcaaatcttaagaataaaaatgaaactgtct

SEQ ID NO: 59619 - DNA, 201 bp, Homo sapiens
aacagggatgtttatgtttctctatttcaagggggattctcaaaccaggctcaacccattcctatgagtttgatgcaaagctggatgttggaacaattgasaaagtcaagtttctttggaataacaatgtgataaatccaaccctccccaaagtgggtgccaccaagatcactgtgcaaaagggagaagagaagacagtgt

SEQ ID NO: 59620 - DNA, 201 bp, Homo sapiens
tacaagtattacttggaaagcatcctcaatcccgatgggtttgctgcatatccctgcacttcctacaagtcctttgagtctgtaagctattgtcctgcctygagcaacaagcatcacccctctgagggactgctgtcctgctgcgtttgggatttgcaatgccttctcactacacgttttgcattgaccctcagagttcat

SEQ ID NO: 59621 - DNA, 201 bp, Homo sapiens
agtttctgaaaatacggtcctactttggaaccatcccatttggagagagaggcagagaagctgttacaggcccccaaccacctgttcaggtctccttattygttttcccaggaacccgggactttgtggcttgcaatcacctaagaagctacaagtattacttggaaagcatcctcaatcccgatgggtttgctgcatatc

SEQ ID NO: 59622 - DNA, 201 bp, Homo sapiens
  misc_feature (1)...(201): n = A,T,C or G, or insertion/deletion polymorphism (see Tables 1-2)
aaacacctggcttttgctaaggtgacccaaactcttacaaagcttccttttctccccaggtacaacttctgtagcgaagacacagtgcgggaagacacgcngctcaccctcacgccctgctaagctcccggggcgacgaggctgctgcgttcacactaataaaatccactggtgcatctgtatgctctgggtctatctcct

SEQ ID NO: 59623 - DNA, 201 bp, Homo sapiens
cttggcatatatggatgccatcaaagcaaatattaagaatgaggacaggccagctgtggtggctcacgcctataatcccagcactttgggaggccgaggcsggcaaatcacttgaggtcaggagtttgagaccagcttggccaacatggtaaaaccccgtctctactaaaaatacaaaaagtagccagtcgtggtggtgtg

SEQ ID NO: 59624 - DNA, 201 bp, Homo sapiens
gatccgcctgcctcggcctcccaaagtgccgggattacaggcgtgagccaccgcacccggcccactctgtgtattttttttgtaagaagacattgattaawcaatccttccactgatgttgtgatgcatgaaatacttgccaatatttcaacaacaaattaaacactcaaaaaccaggtattcattcctcaatcaacattt

SEQ ID NO: 59625 - DNA, 201 bp, Homo sapiens
cacgcacatgcatatgtttgtgtatatgtatttgtatttgtgtgcgtgtgcatgcaggccctgggacagcatttcaggtagaagcctaagtgacagctgcycgtgcacctgctctgtgctagagactgcccagggccctggggagcagagaggaaacacagtccccgccctcgaggtgcttgccaggctgcactcccgagc

SEQ ID NO: 59626 - DNA, 201 bp, Homo sapiens
ccattctggggcagagctggctaacagaactttctgcaatgaggggcatattctgtgtagccattagcctcatgtggcaacttaacatttgcaacacagckaatgagtttgagaaactaaatttttaattgtatttaatttggatttaaatgtaagcagccacatgtggctggtgacctcctccctgggcaatgcagttct

SEQ ID NO: 59627 - DNA, 201 bp, Homo sapiens
gctggagatatggggtttccatcacactgtctggaagaacagccactggtcagatcaaagttgctttgtttggaaataagggaaacactcaccagtacagyatcttcaggtaatttcctattttaacactacgtctcatttgatgatatacacagccttcaaaccacacacttaatttgaacacttatcatctctttatat

SEQ ID NO: 59628 - DNA, 201 bp, Homo sapiens
gcatatagctggcttttccatttctccatcctttatttggaaattaattcggaaaaataatcctgttaatctagaatagaaaacagcagcctggcattgtrtggtaattagaactcatttccgtgaacagggatgtttatgtttctctatttcaagggggattctcaaaccaggctcaacccattcctatgagtttgatgc

SEQ ID NO: 59629 - DNA, 201 bp, Homo sapiens
ttttagtaacctcattggggtttcaattcctactaaggaatctgccgactaggattccctccaatgacacagtatccaaagagaaaggcagccctcccccyctttatttctccgtccccctctctttattaagtacctttggtaaatgtacccttgcaaatgactttattcagtacctattgtatggcctggcaaacagta

SEQ ID NO: 59630 - DNA, 201 bp, Homo sapiens
agtaaaaacactgaattagttgaattactcaaacattttcctgttatgaaaatggccagtaacatttaataataataataataataataataatgaagaagctaaagaaaatcaagattttggtccaagctcttctcagaatcccctcatattttttagtaacctcattggggtttcaattcctactaaggaatctgccga

SEQ ID NO: 59631 - DNA, 201 bp, Homo sapiens
aagtaaaaacactgaattagttgaattactcaaacattttcctgttatgaaaatggccagtaacatttaataataataataataataataataatgaagaagctaaagaaaatcaagattttggtccaagctcttctcagaatcccctcatattttttagtaacctcattggggtttcaattcctactaaggaatctgccg

SEQ ID NO: 59632 - DNA, 201 bp, Homo sapiens
gaagtaaaaacactgaattagttgaattactcaaacattttcctgttatgaaaatggccagtaacatttaataataataataataataataataatgaagaagctaaagaaaatcaagattttggtccaagctcttctcagaatcccctcatattttttagtaacctcattggggtttcaattcctactaaggaatctgcc

SEQ ID NO: 59633 - DNA, 201 bp, Homo sapiens
tagtttgggaagtaaaaacactgaattagttgaattactcaaacattttcctgttatgaaaatggccagtaacatttaataataataataataataataataatgaagaagctaaagaaaatcaagattttggtccaagctcttctcagaatcccctcatattttttagtaacctcattggggtttcaattcctactaagg

SEQ ID NO: 59634 - DNA, 201 bp, Homo sapiens
caaggagaacaaagaggttggccctgccaggtggtgggtggaaccaggaggcctcataagctagagcatagtacagaggaggctgggccgggctggtcggsagccctgtgcaagctggaggtgcaaccaaatcctttcctccctgaccccatcagaggatactcagcctctaaattcagctccccaaggccccattagcaa

SEQ ID NO: 59635 - DNA, 201 bp, Homo sapiens
cttcaggtaatttcctattttaacactacgtctcatttgatgatatacacagccttcaaaccacacacttaatttgaacacttatcatctctttatatgtcactggtttttaattatagtcatgcaacatgtaacaacattttagttgatggaccacatacacaacagttgctttataagcttgtaataccatatttttac

SEQ ID NO: 59636 - DNA, 201 bp, Homo sapiens
cttgatccctctgatgctgactttgttgatgtgattcacacggatgcagctcccctgatcccattcttgggtgagacctatgatgctccagctgtgagcaygcacaactgtgttttaaccatgaaagtcctgcatgacaaaaagctcattgtttttctaagcatttcaggttttggaacgaaccaacagatgggtcatctt

SEQ ID NO: 59637 - DNA, 201 bp, Homo sapiens
tacatctgtgcacatgtgtgggtgtatgaatgcatgtgtgagtgtgtttgtgtatgtacctttgtgtgtatgcatgtgtttatatacgtatgtatatgagyctgtatgtttatgtatatgtatgtgcatgtgtatgtatatttgtatgtgggtgtctatgtatgtgcgtggttatatgtgtgtaggtttgtgtgtgtgtgc

SEQ ID NO: 59638 - DNA, 201 bp, Homo sapiens
gggtttcaccatgttagccaggatggtctcgatctcctgaccttgtgatccgcctgcctcggcctcccaaagtgccgggattacaggcgtgagccaccgcrcccggcccactctgtgtattttttttgtaagaagacattgattaatcaatccttccactgatgttgtgatgcatgaaatacttgccaatatttcaacaac

SEQ ID NO: 59639 - DNA, 201 bp, Homo sapiens
ttggacaaatgaatagttgtgtaaacacctccaaatcaagatacagaacacttctatcaccatatatatcactctgtaatttttttttttttttttgagayggagtctcgctctgtcgcccaggctggagtgcagtggcgcaatcttggctcactacaacctccccctcccgggttcacgccattctcctgcctcagcctc

SEQ ID NO: 59640 - DNA, 201 bp, Homo sapiens
caagaatgcactaggattgcaatacttgtgagatcctgacctgtggtctccctggctttgggcctgaataagcacagggccgtgggtaggaaaaagggacrgctggaggaaagttggagtggtgacctgagagggcagagcgactgtctctcaaacctcagaccccaagtctggctagtagaacatgtggctttgtgggaa

SEQ ID NO: 59641 - DNA, 201 bp, Homo sapiens
gtcatatttccagacttgtgggaagacttgacagctattattaatcttgttttgtgtatttgggcagattaaagtattaagtgcgcacagcatgggctatmatcacctgctgttttcttgaagtagtgtccaaatgataaggctggaatatatatttttagaaagggctggacactcgatccggtgggagggaacatctgg

SEQ ID NO: 59642 - DNA, 201 bp, Homo sapiens
gctggaatatatatttttagaaagggctggacactcgatccggtgggagggaacatctggaacattagacagggtaagccacctttgcaactcctttcccyctgctgtgacgtacaggtgaggtaaacagtactgaagtccagggcgtcggtgctcactgctctggcaatgcccggtgagactgaattatgtttaaattta

SEQ ID NO: 59643 - DNA, 201 bp, Homo sapiens
gccctagtgccccctcgtgcctcctgaatcactcatcaactgtgacctgggcttaaccccttaagaaaaaccaaaccaaaccaaaccaaaccaaaacaaamcaaaacacctggcttttgctaaggtgacccaaactcttacaaagcttccttttctccccaggtacaacttctgtagcgaagacacagtgcgggaagacac

SEQ ID NO: 59644 - DNA, 201 bp, Homo sapiens
ggggaaggatgatttctctccaaaacctgctgaatggactaagacacagggtagagactgggcatgtttgggccactttgtaccaacctgccccatgacasttccataggaggtgacccagtaaagacagaggttacatattcatataaatgtataacacatcttacatagtttttaaagtcagatttattgaggtataat

SEQ ID NO: 59645 - DNA, 201 bp, Homo sapiens
cactgcttctactagtagaagaaacccagtcgccattatggccaaaagcattcttttaacccaatcaaagcatttgaattataacagcaacagcaagatayatctacataatatgatggtgataataataataataatgctattataattattatgataagcatagattaagtgcctgcttatcccaaatactgcacaaaa

SEQ ID NO: 59646 - DNA, 201 bp, Homo sapiens
gtgaggagggaagcagtgcctgctggtctctgtttggtagagatgcagctgagagttatggattaaagaaggacaaagaattgatatccagaccttacttytaaaactctgaaatttgccttcataatgacacgccagtggaagcaaaaataagaatcgctaacacttagaaagtggttttttaaaaatcatcttcaattt

SEQ ID NO: 59647 - DNA, 201 bp, Homo sapiens
gtgtggtcgcaggcgcctgtagtcctagctactcaggaggctgaggcaggagaattgcttaaattcggaggcagaggttgcagtgagctgagatcgcgccwctgcactccagcctgggcgacagaatgaggctgtctcaaaaaaaaaaaaaaaaaagaaagaaaaaaagaaaagaaaagaaaagtcctgaggagaaaactc

SEQ ID NO: 59648 - DNA, 201 bp, Homo sapiens
agatcgcgccactgcactccagcctgggcgacagaatgaggctgtctcaaaaaaaaaaaaaaaaaagaaagaaaaaaagaaaagaaaagaaaagtcctgargagaaaactcccactatctctgtgcatgtgatcacacatattagtatactatatgtggaatgattccaagtgcattttaaatttatagtaccattttaaa

SEQ ID NO: 59649 - DNA, 201 bp, Homo sapiens
tggcaagtgcttgggggatagacaacaacaagaagagaagaacaaaccaggcccagaggtgagaggctatgatgtattcgagggtctgaaagttcaacaargggtttggctgaagagtctagaaaaatagatgatgagttaggaaagctcggaggccttcagaatgagtttgggcttgatcctgaaggcaatgagaggcat

SEQ ID NO: 59650 - DNA, 201 bp, Homo sapiens
gtttcctcaggattgcttgaaaatgaaagtcctggccaggtgcgcagtggctcatgcctgtaatcccagcactttgagaggccgaggcgggtggatcaccygaggtcaggagttcaagaccagcgtagccaacatggtgaaaccctgtctctactaaaagtacaaaaattagccaggtgtggtcgcaggcgcctgtagtcc

SEQ ID NO: 59651 - DNA, 201 bp, Homo sapiens
agagactgcagcggcggcggcgggagcgggcggacgcgcaggcaagaccaggactcgggctggaggggcgctgggctcggacctgccaaggccacgggggwgcaagggacagaggcgggggtcctagctgacggcttttactgcctaggatgacgctgcggcttctggtggccgcgctctgcgccgggatcctggcagagg

SEQ ID NO: 59652 - DNA, 201 bp, Homo sapiens
gccttgggggttcccagtcttgagggggcagagggtaggagggttcccaagtcactctctgcctctcttgccccatttttctggtagggtctggcaggccycccagggagagaaggaatcccaggacccctggggccacctggaccaccggggtcagtggtgagtagaggtgccctaaagccccacgtatttgatttcctg

SEQ ID NO: 59653 - DNA, 201 bp, Homo sapiens
ggggtcaggagcacataggatggaatcagcactgccaagtggggattggggtccggggtctaggtcagggtacaccgtgtgggcaggaactcacgaggtcyggtcacaggcacgccaccagcagtcgtgcacactctccgggaaacgaggggcagtagtgtcctcaagatgctgaagtcattgacgaagaagaagaagtca

SEQ ID NO: 59654 - DNA, 201 bp, Homo sapiens
cttgagagtacagtggacagcggccagtggccctgtgactggctacaaggtccagtacactcctctgacggggctgggacagccactgccgagtgagcggyaggaggtaggatgtcaggagtgataggtggtggctggggacttggctgggcaagataaagtgacctcttgccctgggcaggtgaacgtcccagctggtga

SEQ ID NO: 59655 - DNA, 201 bp, Homo sapiens
ggtgggagcctggggtggtggtgcagtgcccacgttgacattcgcctgagcccaagcaccaccctctgctctgtttcgtcctcagggagagcgaggacctygaggcccaaagggggagccggtaggtgaagggggaagggaggcggccgggatgtcccagggaggagcaggactgccccacaccagaccctgtgcagggcc

SEQ ID NO: 59656 - DNA, 201 bp, Homo sapiens
agtgtgggcacgctcagaatgagggggccacgggtggacgggggccaagttcatgtctttttttctccagggggagcctggtgtgccgggccagtcggggrcccctggcaaggagggcctgatcggtcccaaggtacagggtctgtggacagtggacatgacagggagtcaggatggggcagggaagctcatggtcgggtc

SEQ ID NO: 59657 - DNA, 201 bp, Homo sapiens
accgaggctttgacgggcagccaggccccaagggtgaccagggcgagaaaggggagcgggtgagttgaagccatggtcatggtgaattgaggggagcgtgsactttgggagagggtccatctctggggcctctgattactgactctgtcctatatctccccagggaaccccaggaattgggggcttcccaggccccagtgg

SEQ ID NO: 59658 - DNA, 201 bp, Homo sapiens
agataaggagataagagttccctccaggtcagaggtcgtggttttggagggggtggttggagtttgggaccccttgtctggggtttgacgttcaagccccsccaccaaccctctctctctctgtctttctctcaccctctctcttcagggtgaccggggctttccagggcccctgggtgaggctggagagaaggtaagtgc

SEQ ID NO: 59659 - DNA, 201 bp, Homo sapiens
cccccatccatggggtctgtgcctgagggatctcaatgggacctctcagtcctgggggtctctaccctggagggagatctttttggggtcctcttagtccwtggggtgtgccccaagggatatctcagaggccctataaatcttaacaaagactttttccaggggcttccaggcctccgtggagaacagggcctccctggc

SEQ ID NO: 59660 - DNA, 201 bp, Homo sapiens
agaccctgggcggcctggccccccaggacctgttggcccccgaggacgagatgtaagaggctggagtcgggggagtcatggcgggtaagggagtagggctrttgccagcatcatgggggttcttggaaccagggctgactctcatgtttcacagggtgaagttggagagaaaggtgacgagggtcctccggtgagactcct

SEQ ID NO: 59661 - DNA, 201 bp, Homo sapiens
tggccttactggcagagcaggacccccagtgagtacccgttaccctgggcaacctcaaggcttctggggtcccctccccttgagaactgcttgcttcgagygtcctgcatcacctccctcttgcctcctccacagggtgactcagggcctcctggagagaagggagaccctgggcggcctggccccccaggacctgttggc

SEQ ID NO: 59662 - DNA, 201 bp, Homo sapiens
tctccaggctctgtgcacccccatccctgctctgtcatcctcctcaggctctgtgtttccttccaccccaggttggcctgctgtcttacagtcatcggccytccccactgttcccactgaatggctcccatgaccttggcattatcttgcaaaggatccgtgacatgccctacatggacccaagtgggaacaacctgggtg

SEQ ID NO: 59663 - DNA, 201 bp, Homo sapiens
aggaacagtcccgggtcctggggcccgagctcagcagctatcacctggacgggctggagccagcgacacagtaccgcgtgaggctgagtgtcctagggccrgctggagaagggccctctgcagaggtgactgcgcgcactggtaagcctgcctcaccttggcgtgctcctcccctgctgatgacccaccctgacttcctgc

SEQ ID NO: 59664 - DNA, 201 bp, Homo sapiens
ccctgacgctccaccctatccccacaggccccattgagcagctcccagactacaaccggatccgtagcggcatgttctggctgcgcttctaggcgggaagyctatgtaagcaagagggcagggccggggtttgtggtcccccccccaccacaaacacagcacttcggctcctctaacctgtgccacaggtgaccaccaata

SEQ ID NO: 59665 - DNA, 201 bp, Homo sapiens
ccagtaggctggtgctccaccagttcatccatccactccctgcctcctgtccagctgctgctcagacccttctctgtcccctctccctgagtgagttagakcctgactgccctgtgcagtatgacttttctctctatcaccagggtgacccgggtttgcctggaaaagcaggcgagcgtggccttcgggtgagtcttggca

SEQ ID NO: 59666 - DNA, 201 bp, Homo sapiens
ccaggtaccccaccctgacgctccaccctatccccacaggccccattgagcagctcccagactacaaccggatccgtagcggcatgttctggctgcgcttytaggcgggaagcctatgtaagcaagagggcagggccggggtttgtggtcccccccccaccacaaacacagcacttcggctcctctaacctgtgccacagg

SEQ ID NO: 59667 - DNA, 201 bp, Homo sapiens
cctgtgggtgaaaagggagaccagggagatcctggagaggatggacgaaatgtgagtcccagcctatgactcctcaccccaaccttaaccctccaaccagscaattcccaatacctgatcctaccccccaaccctgtaatgctaaaccctcccaatcttcacttcctttgacccctgcacacacgcatctgaaggctacca

SEQ ID NO: 59668 - DNA, 201 bp, Homo sapiens
ctgcatcacctccctcttgcctcctccacagggtgactcagggcctcctggagagaagggagaccctgggcggcctggccccccaggacctgttggccccygaggacgagatgtaagaggctggagtcgggggagtcatggcgggtaagggagtagggctgttgccagcatcatgggggttcttggaaccagggctgactc

SEQ ID NO: 59669 - DNA, 201 bp, Homo sapiens
cacctccctcttgcctcctccacagggtgactcagggcctcctggagagaagggagaccctgggcggcctggccccccaggacctgttggcccccgaggaygagatgtaagaggctggagtcgggggagtcatggcgggtaagggagtagggctgttgccagcatcatgggggttcttggaaccagggctgactctcatgt

SEQ ID NO: 59670 - DNA, 201 bp, Homo sapiens
aacttgggggcagagttgagcctggggcaaaccagagccatggcctgggacctgagggctcctattgactataatcatttcctttcccagggtcccccagracccccgggacggctggtaagggctgcgctgggtctggtcctctgtcattgttctcacttgcccctttggctccacatcatgtcccctcattccttccac

SEQ ID NO: 59671 - DNA, 201 bp, Homo sapiens
aaggtgagagggtgtgggggtttctcaggacatgagcctgggttatcagatccacctcagccttggtggcctcttaccactctattttccacagggtgacyggggtccccctgggctggatggccggagcggactggatgggaaaccaggagccgctgggccctctgggccgaatgtgagtcttggtagtcctgcctggtt

SEQ ID NO: 59672 - DNA, 201 bp, Homo sapiens
tgtgggggtttctcaggacatgagcctgggttatcagatccacctcagccttggtggcctcttaccactctattttccacagggtgaccggggtccccctrggctggatggccggagcggactggatgggaaaccaggagccgctgggccctctgggccgaatgtgagtcttggtagtcctgcctggttgtccccttcccc

SEQ ID NO: 59673 - DNA, 201 bp, Homo sapiens
gccccaggctgcctctatgctgtgctctccaacaggaccagagctgcctgtgagccctgtaacagacctgcaagccaccgagctgcccgggcagcgggtgygagtgtcctggagcccagtccctggtgccacccagtaccgcatcattgtgcgcagcacccagggtgaggtggacgcagccagcacccccaccacacacac

SEQ ID NO: 59674 - DNA, 201 bp, Homo sapiens
agccttggtggcctcttaccactctattttccacagggtgaccggggtccccctgggctggatggccggagcggactggatgggaaaccaggagccgctgrgccctctgggccgaatgtgagtcttggtagtcctgcctggttgtccccttcccctaccccttcacatgaggaccctagaccccagcctcattggttggtc

SEQ ID NO: 59675 - DNA, 201 bp, Homo sapiens
gggagatctttttggggtcctcttagtccatggggtgtgccccaagggatatctcagaggccctataaatcttaacaaagactttttccaggggcttccasgcctccgtggagaacagggcctccctggcccctctggtccccctggattaccggtgagaccagactttcatgttacccccttttcccccttactaccctc

SEQ ID NO: 59676 - DNA, 201 bp, Homo sapiens
gtacagccaccagcattctctcttccactcctgcagggccccatcggctttcctggagaacgcgggctgaagggcgaccgtggagaccctggccctcaggrgccacctggtctggcccttggggagaggggcccccccgggccttccggccttgccggggagcctggaaagcctggtattcccgggctcccaggcagggct

SEQ ID NO: 59677 - DNA, 201 bp, Homo sapiens
ctgcagggccccatcggctttcctggagaacgcgggctgaagggcgaccgtggagaccctggccctcaggggccacctggtctggcccttggggagagggscccccccgggccttccggccttgccggggagcctggaaagcctggtattcccgggctcccaggcagggctgggggtgtgggagaggcaggaaggccagga

SEQ ID NO: 59678 - DNA, 201 bp, Homo sapiens
ccccatcggctttcctggagaacgcgggctgaagggcgaccgtggagaccctggccctcaggggccacctggtctggcccttggggagaggggcccccccrggccttccggccttgccggggagcctggaaagcctggtattcccgggctcccaggcagggctgggggtgtgggagaggcaggaaggccaggagagagggt

SEQ ID NO: 59679 - DNA, 201 bp, Homo sapiens
ggtgactctgtgacttctgggcggggactgagctgtatgacttccaattccatgtgacctccattccaatgaagactttgatcatacaaccccaaggcagsgccaagctgtatctgtcctgtttgttttcagggacctgctgttgctggacccaaaggagaaaaggtaagcctggtatggggcaaggggaggtttctacag

SEQ ID NO: 59680 - DNA, 201 bp, Homo sapiens
acgccaccagcagtcgtgcacactctccgggaaacgaggggcagtagtgtcctcaagatgctgaagtcattgacgaagaagaagaagtcactggtgggctytgaggcaactcgcttcagctcctcagggtcagcattcttgatccctgaagtgacgacccatcaggactcagtcacccacatgctctctgactgcccccac

SEQ ID NO: 59681 - DNA, 201 bp, Homo sapiens
gtgactctgtgacttctgggcggggactgagctgtatgacttccaattccatgtgacctccattccaatgaagactttgatcatacaaccccaaggcaggkccaagctgtatctgtcctgtttgttttcagggacctgctgttgctggacccaaaggagaaaaggtaagcctggtatggggcaaggggaggtttctacagg

SEQ ID NO: 59682 - DNA, 201 bp, Homo sapiens
tcctcttagtccatggggtgtgccccaagggatatctcagaggccctataaatcttaacaaagactttttccaggggcttccaggcctccgtggagaacarggcctccctggcccctctggtccccctggattaccggtgagaccagactttcatgttacccccttttcccccttactaccctcacccgatccccgacatc

SEQ ID NO: 59683 - DNA, 201 bp, Homo sapiens
ggcacaaacacactggtgtgtagccacatttggggcacttagagacatgttgatacccagacacttccacccagactcatgtgctaagacatggacccaakaccgcatgtggacctgtgttgagacatggtgagacacacatggatggctctgacctgtgacatgtgctaggacatgctggcccatgactttatatggtca

SEQ ID NO: 59684 - DNA, 201 bp, Homo sapiens
acatgtgctaggacatgctggcccatgactttatatggtcacccacacgcttatggtcatacacattgagctacacacaagagttgcagacagatgccaakacacatggctctcaaggcatgtataagcccatgctctttggagacatgtataagcccatgcccatatgcagacatgggccaagatgtgcaaacagaccag

SEQ ID NO: 59685 - DNA, 201 bp, Homo sapiens
agacaccagtgaatgtttgggctgatgtgagtcctctgcccacagggagaacctggggaccctggagaagacgggaggaaggtaaagtcccccacctgggktctctctggtctctgcttggagccatgcctgaagcatccttgtcttccttagggagagaaaggagattcaggcgcctctgggagagaagtgagtattgga

SEQ ID NO: 59686 - DNA, 201 bp, Homo sapiens
gacaccagtgaatgtttgggctgatgtgagtcctctgcccacagggagaacctggggaccctggagaagacgggaggaaggtaaagtcccccacctggggyctctctggtctctgcttggagccatgcctgaagcatccttgtcttccttagggagagaaaggagattcaggcgcctctgggagagaagtgagtattggag

SEQ ID NO: 59687 - DNA, 201 bp, Homo sapiens
ctcagaagggatggagggtcccctggcgctgctgccagtgtgccttcacacaaggggtctggaggtccaggtgggaagcatggatggccacccatgcctgytgggggctggcattggggtgcttcggggaacttgggggcagagttgagcctggggcaaaccagagccatggcctgggacctgagggctcctattgactat

SEQ ID NO: 59688 - DNA, 201 bp, Homo sapiens
cccagactacaaccggatccgtagcggcatgttctggctgcgcttctaggcgggaagcctatgtaagcaagagggcagggccggggtttgtggtccccccyccaccacaaacacagcacttcggctcctctaacctgtgccacaggtgaccaccaataaaatcctctgctgagaagtgtgtcatccctcttttggcattgg

SEQ ID NO: 59689 - DNA, 201 bp, Homo sapiens
ttaccctcacctcttatctgaccctgttccctccagggggacccaggtgtccgaggcccagcaggagaaaaggtgagagggtgtgggggtttctcaggacrtgagcctgggttatcagatccacctcagccttggtggcctcttaccactctattttccacagggtgaccggggtccccctgggctggatggccggagcgg

SEQ ID NO: 59690 - DNA, 201 bp, Homo sapiens
cagactacaaccggatccgtagcggcatgttctggctgcgcttctaggcgggaagcctatgtaagcaagagggcagggccggggtttgtggtccccccccmaccacaaacacagcacttcggctcctctaacctgtgccacaggtgaccaccaataaaatcctctgctgagaagtgtgtcatccctcttttggcattggca

SEQ ID NO: 59691 - DNA, 201 bp, Homo sapiens
ctggccccaggctccggaccctccgctaggtgctgctgctgctgtgtgtgtgcatgtctgtgtgtgtgtgtttgtgtgtacctgtgtctgtgtgcctctckgtgtgtgcctgcttgtgtgtgcctgtgtctgtgtgtgcctgtgtgtgcctgtgtctgtgtgtggttgtatgtggatgtgtgtgtgcaggcccgtgtgtgc

SEQ ID NO: 59692 - DNA, 201 bp, Homo sapiens
tcagggtgctgcaggcaaagctggggacccagggagagacgtaagtgaggggagatgctgggacagagggggctcggggctgcgtaagctccaaccagatyatcatagtcacagcatccgagagagttggtggggggtcggttcagccttgcctttgggagggtctcagtccctggcacacaggttttagtagaatccccc

SEQ ID NO: 59693 - DNA, 201 bp, Homo sapiens
tccccacagggggagccgggcagcaatggtgaccaaggtcccaaaggagacagggtgaggcctctctccacccttccatagagtccccctcctttctgggsgcacactagaggtggtgtgcatatgcacctgggcacgtggcagggactgggggctcagggcacgacactctgccttcagggtgtgccaggcatcaaagga

SEQ ID NO: 59694 - DNA, 201 bp, Homo sapiens
aaaggacctcggggagacaatggggaccctggtgacaaggtacagggaagagggtggtgtactctctgtggggtcctgtggctgtggtggttccacagcawctgtgagggcaggaggggaggacaggaggaggctttctggggttcagggggaaggggttctgtggctgactatggagtggccgagaggaggggctctagg

SEQ ID NO: 59695 - DNA, 201 bp, Homo sapiens
agaacgcgggctgaagggcgaccgtggagaccctggccctcaggggccacctggtctggcccttggggagaggggcccccccgggccttccggccttgccdgggagcctggaaagcctggtattcccgggctcccaggcagggctgggggtgtgggagaggcaggaaggccaggagagagggtgaggctgggggctggcca

SEQ ID NO: 59696 - DNA, 201 bp, Homo sapiens
cttttgaccttatagtgacccagtgctctcatggtgtcctcatgtcacccagggtcccccacctccacagtagccgcctatgatggtgtcccctgcctatsgtgacccttgtccccatggcaagccccagtggctctggcctccagaggtgactcccaccccatggtgttccctacccactatccagggcgattctctttg

SEQ ID NO: 59697 - DNA, 201 bp, Homo sapiens
cgaccgtggagaccctggccctcaggggccacctggtctggcccttggggagaggggcccccccgggccttccggccttgccggggagcctggaaagcctrgtattcccgggctcccaggcagggctgggggtgtgggagaggcaggaaggccaggagagagggtgaggctgggggctggccaggagagtgagggaagagg

SEQ ID NO: 59698 - DNA, 201 bp, Homo sapiens
ggggagaggggcccccccgggccttccggccttgccggggagcctggaaagcctggtattcccgggctcccaggcagggctgggggtgtgggagaggcagraaggccaggagagagggtgaggctgggggctggccaggagagtgagggaagaggggttgggaggggtgggaccccccatgggcttggccctcacccgcta

SEQ ID NO: 59699 - DNA, 201 bp, Homo sapiens
ttctctccagcgcctgaggctccgccagccctggggacgcttcacgtggtgcagcgcggggagcactcgctgaggctgcgctgggagccggtgcccagagmgcagggcttccttctgcactggcaacctgagggtgagaggtgtccccaggaggaagttagggaccattgggggcagggctgtggcagactccgcaaggta

SEQ ID NO: 59700 - DNA, 201 bp, Homo sapiens
tggagaacaggtgggctgcgatgggcttcgtggggcaggctgtctggaggctgtgctggggctgccaccccattttcttgtttcctgcagggcagagatgrccctcctggactccctggaacccctgggccccccggaccccctggccccaaggtgatcaccccatccctgccttagtcctgtgactagtgaccaggaagc

SEQ ID NO: 59701 - DNA, 201 bp, Homo sapiens
aggtgggctgcgatgggcttcgtggggcaggctgtctggaggctgtgctggggctgccaccccattttcttgtttcctgcagggcagagatggccctcctrgactccctggaacccctgggccccccggaccccctggccccaaggtgatcaccccatccctgccttagtcctgtgactagtgaccaggaagccaccctta

SEQ ID NO: 59702 - DNA, 201 bp, Homo sapiens
ggtgggctgcgatgggcttcgtggggcaggctgtctggaggctgtgctggggctgccaccccattttcttgtttcctgcagggcagagatggccctcctgractccctggaacccctgggccccccggaccccctggccccaaggtgatcaccccatccctgccttagtcctgtgactagtgaccaggaagccacccttag

SEQ ID NO: 59703 - DNA, 201 bp, Homo sapiens
agtccccctcctttctgggggcacactagaggtggtgtgcatatgcacctgggcacgtggcagggactgggggctcagggcacgacactctgccttcaggrtgtgccaggcatcaaaggagaccggggagagcctggaccgaggggtcaggacggcaacccggtaagtccttgcccaacagccacacatgtgcaagaaggt

SEQ ID NO: 59704 - DNA, 201 bp, Homo sapiens
aggaggaagagggagttctgatgagagtcctgggaggggtcctgcattgaccattccctccctttgctgtttttatttcagggagatctgggcctccctgrcctgcccggtgctcctggtgttgttgggttcccgggtcagacaggccctcgaggagagatgggtcagccaggccctagtggagagcgggtgaggggctgg

SEQ ID NO: 59705 - DNA, 201 bp, Homo sapiens
gcccaccttgccccggggccagcagccactgctcccagcacaccctgccctacctgcagagcgggtaccccctgaggatgatgagtactctgaatactcckagtattctgtggaggagtaccaggaccctgaagctccttgggatagtgatggtgagaatggggggctgcgcccagcggggtctggggaggggcaggcagg

SEQ ID NO: 59706 - DNA, 201 bp, Homo sapiens
acctggggtctctctggtctctgcttggagccatgcctgaagcatccttgtcttccttagggagagaaaggagattcaggcgcctctgggagagaagtgastattggagttttctgcaacctctgacccctgaccctgaccctgggggaatatgactccactcttttctgaggtctcagggtgctgatgctggctgcatcc

SEQ ID NO: 59707 - DNA, 201 bp, Homo sapiens
ccccagctggcgggctcgttgtattctaagcccccagcctgatctggtcctgactgaatccctctcctggtcactcccacagggcagcaagggagagcctsgtgacaagggctcagccgggttgccaggactgcgtggactcctgggaccccaggcaagttctgccccaggcccaggcccaggcccaggtccagagccagc

SEQ ID NO: 59708 - DNA, 201 bp, Homo sapiens
tctctctggtctctgcttggagccatgcctgaagcatccttgtcttccttagggagagaaaggagattcaggcgcctctgggagagaagtgagtattggasttttctgcaacctctgacccctgaccctgaccctgggggaatatgactccactcttttctgaggtctcagggtgctgatgctggctgcatccttcacagg

SEQ ID NO: 59709 - DNA, 201 bp, Homo sapiens
gacctcacatggaccctctccctgctagggatccccaggaaaggatggagtgcctggtatccgaggagaaaaaggagatgttggcttcatgggtccccggkgcctcaaggtaggaaagaaacaagattggtttttttctggtcaggaaggcctaatgttgaagggcgagggacctggggtcagatattagggcactgggtc

SEQ ID NO: 59710 - DNA, 201 bp, Homo sapiens
caaaggacctcggggagacaatggggaccctggtgacaaggtacagggaagagggtggtgtactctctgtggggtcctgtggctgtggtggttccacagcwtctgtgagggcaggaggggaggacaggaggaggctttctggggttcagggggaaggggttctgtggctgactatggagtggccgagaggaggggctctag

SEQ ID NO: 59711 - DNA, 201 bp, Homo sapiens
ggtgcttgggttacagaaggtttgggcattaggccagggagctcatgggagttcagggaggttccagagctgagggaggtcagggcagaaggtctctcatscttcttctgttcccagggtgaccgaggctttgacgggcagccaggccccaagggtgaccagggcgagaaaggggagcgggtgagttgaagccatggtcat

SEQ ID NO: 59712 - DNA, 201 bp, Homo sapiens
gtgcttgggttacagaaggtttgggcattaggccagggagctcatgggagttcagggaggttccagagctgagggaggtcagggcagaaggtctctcatgmttcttctgttcccagggtgaccgaggctttgacgggcagccaggccccaagggtgaccagggcgagaaaggggagcgggtgagttgaagccatggtcatg

SEQ ID NO: 59713 - DNA, 201 bp, Homo sapiens
tcccatctgttgcacataggggcggccagggcctgccggtcctcgaggcgagaagggagaagctgcactgacggtgagtgtgggcctggatgggcctgggwgggcctgggtgggcctgggtgggctggggccctacctccctcacccagcaccctgacccctgggccctggctccatgcagtctcaccatagtccctgtat

SEQ ID NO: 59714 - DNA, 201 bp, Homo sapiens; identical to SEQ ID NO: 17161

SEQ ID NO: 59715 - DNA, 201 bp, Homo sapiens
taccccttcacatgaggaccctagaccccagcctcattggttggtcttggccttgacgagctctggggcgagacctgttgtctgtgtcttctcccagagcyctgcctgggtggggcatgttcttgccatgcaggccttaggctcacagggactagagcccctgaccccatgaccatgatgaactgactttgagtctctcct

SEQ ID NO: 59716 - DNA, 201 bp, Homo sapiens
cttgccctgggcaggtgaacgtcccagctggtgagaccagtgtgcggctgcggggtctccggccactgaccgagtaccaagtgactgtgattgccctctamgccaacagcatcggggaggctgtgagcgggacagctcggaccagtgagcaattctgccagcctctgaccccattcacctaacccccgaccccagtacccc

SEQ ID NO: 59717 - DNA, 201 bp, Homo sapiens
cctgggtcattctgggacttcagagcattagaagccatgatgtttcaatgggcaaccctcctgggaagccatgggcctttgtgacccctttgtgttctgcygtatctcagggttttcctggtgtcccaggaggcacgggccccaaggtgagtgcggatgttgggtagggggcgtggtgagggggctgaccaggctgggggc

SEQ ID NO: 59718 - DNA, 201 bp, Homo sapiens
ggttggccctggggcctgactactgagcagagaaggctcagtccagacacccctcacctgccattctgtgcagggtgaagctggccgtgcaggggagcccrgagaccctggggaagatgtgagtccggggcctaggcaagggcgagcctggcctgaggagtgtgatggcgggcataaggggccactcttgggccggggcac

SEQ ID NO: 59719 - DNA, 201 bp, Homo sapiens
cggagagtgtgcacgactgctggtggcgtgcctgtgacccgacctcgtgagttcctgcccacacggtgtaccctgacctagaccccggaccccaatccccmcttggcagtgctgattccatcctatgtgctcctgaccccgaccccaactctgcatcatacatgcccaccccaatcctcctgcctgatcccctgatcccgc

SEQ ID NO: 59720 - DNA, 201 bp, Homo sapiens
tgtggatcggttgctggaaactgctggcatcaaggtgggttgtttaggggctgggggtagggacaagtgggggcccttggggctagtggtgcccacaggcrtaggggctgcggcgacgcaccccgctcctctgacctcttgctgtccctcaggcatctgccctgcgggagatcgtggagacctgggatgagagctctggta

SEQ ID NO: 59721 - DNA, 201 bp, Homo sapiens
ctctctaagtgtcttcccagggttcttccacagggtgggagcctggggtggtggtgcagtgcccacgttgacattcgcctgagcccaagcaccaccctctsctctgtttcgtcctcagggagagcgaggacctcgaggcccaaagggggagccggtaggtgaagggggaagggaggcggccgggatgtcccagggaggagc

SEQ ID NO: 59722 - DNA, 201 bp, Homo sapiens
aggtgaaggacctgggcttcctgggcggaaaggggaccctggaccatcggtaagtgcagggtatgtggaggcaagtgatgtgtagtggggggaccaacacsaggggggcgagagtgaggtctgtggggttgcaccttatactttgtctcctccatcagggcccccctggacctcgtggaccactgggggacccaggacccc

SEQ ID NO: 59723 - DNA, 201 bp, Homo sapiens
ctggacctcgtggaccactgggggacccaggaccccgtggccccccagggcttcctggaacagccatgaaggtgacagcctcatgagtgccatgtgatgcrgagacctggtgaccccatttgaacccacataacccctgccagttactctggcccttgtgaccctttgattacccccatcctcaccatgacgcctcagttc

SEQ ID NO: 59724 - DNA, 201 bp, Homo sapiens
gggcattaggccagggagctcatgggagttcagggaggttccagagctgagggaggtcagggcagaaggtctctcatgcttcttctgttcccagggtgacygaggctttgacgggcagccaggccccaagggtgaccagggcgagaaaggggagcgggtgagttgaagccatggtcatggtgaattgaggggagcgtgcac

SEQ ID NO: 59725 - DNA, 201 bp, Homo sapiens
ggaattgggggcttcccaggccccagtggaaatgatggctctgctggtcccccagggccacctggcagtgttggtcccagaggccccgaaggacttcaggsccagaaggtaaggggccccagctctgactcctgatccctgaaccttccctacccttccaacctcataaccatcttccagcctgcctgccccaacctctga

SEQ ID NO: 59726 - DNA, 201 bp, Homo sapiens
ctctgaagctgtggcccccaacctgcctgactctgatccccactgcctctgaccctgctcacttggtccctgtgtctgacagggtgagcgaggtccccccrgagagagagtggtgggggctcctggggtccctggagctcctggcgagagaggggagcaggtgagtagggattccaaggcttgggtcagagatcggggtga

SEQ ID NO: 59727 - DNA, 201 bp, Homo sapiens
aagggaacttgggcagtggggacacaccagaaaggggctcccaggagtctccagccatgcctcaaccaagtgctaaagggtgctctgggcaagaggcctarggaaaagggtgtgaaggtgctttcctgaggccgtgcggggcagaaggcaggagcttctctgtcatgggcagcccttcacccagactttgtccccagaatg

SEQ ID NO: 59728 - DNA, 201 bp, Homo sapiens
tgaggctctgctgggggccctgctcaggggtgtgggtctctcctggggcagtggttgggtgctgggcttcatagttcttggctcatatttttactcacttmttcctagggtcttcccggaagccctggaccccaaggccccgttggcccccctggaaagaaaggagaaaaagtaggaaggctgacttgatgatgtcccagt

SEQ ID NO: 59729 - DNA, 201 bp, Homo sapiens
gccactggaccccaccttagggcttaatgtggtgatgttgggaatggctggagcggacccagagcagctgcgtcgcttggcgccgggtatggactctgtcyagaccttcttcgccgtggatgatgggccaagcctggaccaggcagtcagtggtctggccacagccctgtgtcaggcatccttcactactcaggtttggaa

SEQ ID NO: 59730 - DNA, 201 bp, Homo sapiens
gggaggatggcgctctgagcacagcacagcccttgagcagtgaccctcctatagaacactatctgggctgtgattccacagtgctgggcccgtgagcaggytgggagctctgcggctctccttctgctagaacctgcccccagactcttggctatgatcctgtgaccccaagaccgccatgcaggtcatgagctctttgtg

SEQ ID NO: 59731 - DNA, 201 bp, Homo sapiens
cacacacacatatcctgggggtcctcttaagtgctgggggttctggctcccttgctgccggccccatgtgtgttcacccgggatctgtgtgtggcctgggmcctggccgctgagcatctgagtggccacacatgcagcggatgggccagtgttggggacagtcccactgaagggctcccccatctgtgtttctcacagggt

SEQ ID NO: 59732 - DNA, 201 bp, Homo sapiens
cttaggggttgagcggaccctggtgcttcctgggagtcagacagcattcgacttggatgacgttcaggctgggcttagctacactgtgcgggtgtctgctygagtgggtccccgtgagggcagtgccagtgtcctcactgtccgccggggtgagtactgcaggaggcttgtggaggacagctgcctgcctcactctggtcc

SEQ ID NO: 59733 - DNA, 201 bp, Homo sapiens
agtaatggggaacctggggcagtgtagcgggtcataggggcacctgcaaaatattgggagggtctgtctcaggccagctgctcttcttagggggcacctgsagttcgggggcctgtgggtgaaaagggagaccagggagatcctggagaggatggacgaaatgtgagtcccagcctatgactcctcaccccaaccttaacc

SEQ ID NO: 59734 - DNA, 201 bp, Homo sapiens
gggtgtagctgtacagccaccagcattctctcttccactcctgcagggccccatcggctttcctggagaacgcgggctgaagggcgaccgtggagaccctrgccctcaggggccacctggtctggcccttggggagaggggcccccccgggccttccggccttgccggggagcctggaaagcctggtattcccgggctccc

SEQ ID NO: 59735 - DNA, 201 bp, Homo sapiens
tctgacctcacatggaccctctccctgctagggatccccaggaaaggatggagtgcctggtatccgaggagaaaaaggagatgttggcttcatgggtcccyggggcctcaaggtaggaaagaaacaagattggtttttttctggtcaggaaggcctaatgttgaagggcgagggacctggggtcagatattagggcactgg

SEQ ID NO: 59736 - DNA, 201 bp, Homo sapiens
gaccccttaccttgcctctgtccccagcccctgagcctgtgggtcgtgtgtcgaggctgcagatcctcaatgcttccagcgacgttctacggatcacctgrgtaggggtcactggagccacagcttacagactggcctggggccggagtgaaggtatggctccctgacgccacccctgtccttcctggctgggactgctca

SEQ ID NO: 59737 - DNA, 201 bp, Homo sapiens
aaactgctggcatcaaggtgggttgtttaggggctgggggtagggacaagtgggggcccttggggctagtggtgcccacaggcataggggctgcggcgacrcaccccgctcctctgacctcttgctgtccctcaggcatctgccctgcgggagatcgtggagacctgggatgagagctctggtagcttcctgcctgtgccc

SEQ ID NO: 59738 - DNA, 201 bp, Homo sapiens
ttttgaccttatagtgacccagtgctctcatggtgtcctcatgtcacccagggtcccccacctccacagtagccgcctatgatggtgtcccctgcctatgstgacccttgtccccatggcaagccccagtggctctggcctccagaggtgactcccaccccatggtgttccctacccactatccagggcgattctctttgg

SEQ ID NO: 59739 - DNA, 201 bp, Homo sapiens
tgaccgaggctttgacgggcagccaggccccaagggtgaccagggcgagaaaggggagcgggtgagttgaagccatggtcatggtgaattgaggggagcgwgcactttgggagagggtccatctctggggcctctgattactgactctgtcctatatctccccagggaaccccaggaattgggggcttcccaggccccagt

SEQ ID NO: 59740 - DNA, 201 bp, Homo sapiens
cagagatggccctcctggactccctggaacccctgggccccccggaccccctggccccaaggtgatcaccccatccctgccttagtcctgtgactagtgascaggaagccacccttagcttggtccccagaaatatggtagtgtgtgccataaccctggaatttctgaccctataaccctctgtgatcctgagatctgtga

SEQ ID NO: 59741 - DNA, 201 bp, Homo sapiens
ttttggggtcctcttagtccatggggtgtgccccaagggatatctcagaggccctataaatcttaacaaagactttttccaggggcttccaggcctccgtrgagaacagggcctccctggcccctctggtccccctggattaccggtgagaccagactttcatgttacccccttttcccccttactaccctcacccgatcc

SEQ ID NO: 59742 - DNA, 201 bp, Homo sapiens
atgggtaggtattatctgtgactggaaagggtgaggtatggaaattgacccccaaggaaaaagcccccagaggttgggaacaggcccaagtgaggcccagwttgaggctcatcagtgccctctctatgtagggtctgcagggtccaagaggcccccctggcccagtggtgagtacccaagaaccttcacctgtcttgcccc

SEQ ID NO: 59743 - DNA, 201 bp, Homo sapiens
ggtgtagctgtacagccaccagcattctctcttccactcctgcagggccccatcggctttcctggagaacgcgggctgaagggcgaccgtggagaccctgrccctcaggggccacctggtctggcccttggggagaggggcccccccgggccttccggccttgccggggagcctggaaagcctggtattcccgggctccca

SEQ ID NO: 59744 - DNA, 201 bp, Homo sapiens
ctgtgaccccaagaccgccatgcaggtcatgagctctttgtgtcagtccattttgtataaccccttccctgctgtcagcggtgactctgtgacttctgggmggggactgagctgtatgacttccaattccatgtgacctccattccaatgaagactttgatcatacaaccccaaggcagggccaagctgtatctgtcctgt

SEQ ID NO: 59745 - DNA, 201 bp, Homo sapiens
cccatcggctttcctggagaacgcgggctgaagggcgaccgtggagaccctggccctcaggggccacctggtctggcccttggggagaggggcccccccgsgccttccggccttgccggggagcctggaaagcctggtattcccgggctcccaggcagggctgggggtgtgggagaggcaggaaggccaggagagagggtg

SEQ ID NO: 59746 - DNA, 201 bp, Homo sapiens
tgcaggcccgtgtgtgctatctatgagaggcagtccatgggtaggtattatctgtgactggaaagggtgaggtatggaaattgacccccaaggaaaaagcycccagaggttgggaacaggcccaagtgaggcccagattgaggctcatcagtgccctctctatgtagggtctgcagggtccaagaggcccccctggcccag

SEQ ID NO: 59747 - DNA, 201 bp, Homo sapiens
ctttcctggagaacgcgggctgaagggcgaccgtggagaccctggccctcaggggccacctggtctggcccttggggagaggggcccccccgggccttccrgccttgccggggagcctggaaagcctggtattcccgggctcccaggcagggctgggggtgtgggagaggcaggaaggccaggagagagggtgaggctggg

SEQ ID NO: 59748 - DNA, 201 bp, Homo sapiens
gggtcatagggagatgggtggggttggcactgccctgaactttctcttcctccagggcctgactggacctactggagctgtgggacttcctggacccccckgcccttcaggccttgtggtgagtgagtccctgtggcccctgtagggacaccgtgttttcactccttggggcccatgttctctcatgtcgtcctgtgtcca

SEQ ID NO: 59749 - DNA, 201 bp, Homo sapiens
tgccacagacatcacagggctgcagcctggaaccacctaccaggtggctgtgtcggtactgcgaggcagagaggagggccctgctgcagtcatcgtggctygaacgggtcaggccctgcccccgtcccttggctctctgcctccattgctctttcagacccccatgccttcccttgcagacccttgcttctccccagaact

SEQ ID NO: 59750 - DNA, 201 bp, Homo sapiens
aaggtaagcctggtatggggcaaggggaggtttctacagggttgaggtctaggtcatagggcctatctatgggacttggggggtcacaggacttgctgggycagggggttaactggagcctgggactagcactgatggtctttgtcacctccagggagatgtggggcccgctgggcccagaggagctaccggagtccaagg

SEQ ID NO: 59751 - DNA, 201 bp, Homo sapiens
gtatcccctcgccaactcctcttccccttgttgagccattcttctcactggtcattccccccacaggtagacacaggacctggagccagagagaaggtatyagggtctgtgggtggagggtaagaaagaccccagtgcccctcccagcaggttctaccttgggcatggcttggcttcaaggctgttcctcagcaagcttat

SEQ ID NO: 59752 - DNA, 201 bp, Homo sapiens
ggagccagagagaaggtattagggtctgtgggtggagggtaagaaagaccccagtgcccctcccagcaggttctaccttgggcatggcttggcttcaaggmtgttcctcagcaagcttatctctgccacagggagagcctggggaccgcggacaagagggtcctcgagggcccaagggtgatcctggcctccctggagccc

SEQ ID NO: 59753 - DNA, 201 bp, Homo sapiens
gctagagcctggcgtctcttacatcttctccctgacgcctgtcctggatggtgtgcggggtcctgaggcatctgtcacacagacgccaggtatagtgggcrtagtgggaagggcagaaaggtgtgtctgggtgggctgcccgcttcagtaacttgttccccttcctacagtgtgcccccgtggcctggcggatgtggtgtt

SEQ ID NO: 59754 - DNA, 201 bp, Homo sapiens
tgtttccttccaccccaggttggcctgctgtcttacagtcatcggccctccccactgttcccactgaatggctcccatgaccttggcattatcttgcaaargatccgtgacatgccctacatggacccaagtgggaacaacctgggtgaggactgcagcaggcatggactcctggggctatccactgggagcttggtgccc

SEQ ID NO: 59755 - DNA, 201 bp, Homo sapiens
cgcatcattgtgcgcagcacccagggtgaggtggacgcagccagcacccccaccacacacactgaagttccagcctgaggggtctgagtgtacctccagcsctctccttccacacctgggtccctatagtctcctccctgtctcgttatccatctgcttcccaagatggcactgagccctgaactgtcaacagggtgtgtc

SEQ ID NO: 59756 - DNA, 201 bp, Homo sapiens
tgactcctgtcatcctacatgctaagatcccacagactcctgtcctccagtgtccctgaccatcactggcccctttcatcctatgtccttgtcttgcactsacttttttcagccatatcccagctctctggtccccaccaccccacatccccacccccatggcccttctcactctgcgtccctgtccatcactgccatcgt

SEQ ID NO: 59757 - DNA, 201 bp, Homo sapiens
gtccctgaccatcactggcccctttcatcctatgtccttgtcttgcactcacttttttcagccatatcccagctctctggtccccaccaccccacatcccmacccccatggcccttctcactctgcgtccctgtccatcactgccatcgtcccacatccctgtctctttctgacccctgcccacctaccctgacttctctc

SEQ ID NO: 59758 - DNA, 201 bp, Homo sapiens
cacaggatacagggtttcctggcactcagcccacggtggggactggggtttgggagggggcaggtcagggtggaatgggggctgggggtttattgggggtycaggtggggctctggggcacagagtttgctagccctggagctgcctccatccctgttcccaggcccagagaaatcccagttggtttctggggaggccacg

SEQ ID NO: 59759 - DNA, 201 bp, Homo sapiens
ctctaagtgtcttcccagggttcttccacagggtgggagcctggggtggtggtgcagtgcccacgttgacattcgcctgagcccaagcaccaccctctgcyctgtttcgtcctcagggagagcgaggacctcgaggcccaaagggggagccggtaggtgaagggggaagggaggcggccgggatgtcccagggaggagcag

SEQ ID NO: 59760 - DNA, 201 bp, Homo sapiens
ggtgagtgagtccctgtggcccctgtagggacaccgtgttttcactccttggggcccatgttctctcatgtcgtcctgtgtccattgtcaccctgacatcygacttgttctccgtcagggtccacaggggtctccaggtttgcctggacaagtggtgagttctgggggtcaagggttgggctccaggggtcaagggtcgac

SEQ ID NO: 59761 - DNA, 201 bp, Homo sapiens
cgtggagtggggtgtagctgtacagccaccagcattctctcttccactcctgcagggccccatcggctttcctggagaacgcgggctgaagggcgaccgtrgagaccctggccctcaggggccacctggtctggcccttggggagaggggcccccccgggccttccggccttgccggggagcctggaaagcctggtattcc

SEQ ID NO: 59762 - DNA, 201 bp, Homo sapiens
cctcaggggccacctggtctggcccttggggagaggggcccccccgggccttccggccttgccggggagcctggaaagcctggtattcccgggctcccagkcagggctgggggtgtgggagaggcaggaaggccaggagagagggtgaggctgggggctggccaggagagtgagggaagaggggttgggaggggtgggacc

SEQ ID NO: 59763 - DNA, 201 bp, Homo sapiens
ttacccccatcctcaccatgacgcctcagttctcccaaaatccttgaaatccaattggaccccatgaccctcatcactcctggtatctttgggagtgaggygtggcccagggtcatggggtcgtcatctgttttctagggtgacaaaggcgatcgtggggagcgggtaagtgagggacaggttgtgctaggggtggcttgg

SEQ ID NO: 59764 - DNA, 201 bp, Homo sapiens
agaccctggccctcaggggccacctggtctggcccttggggagaggggcccccccgggccttccggccttgccggggagcctggaaagcctggtattcccdggctcccaggcagggctgggggtgtgggagaggcaggaaggccaggagagagggtgaggctgggggctggccaggagagtgagggaagaggggttgggag

SEQ ID NO: 59765 - DNA, 201 bp, Homo sapiens
agggtcatagggagatgggtggggttggcactgccctgaactttctcttcctccagggcctgactggacctactggagctgtgggacttcctggacccccmggcccttcaggccttgtggtgagtgagtccctgtggcccctgtagggacaccgtgttttcactccttggggcccatgttctctcatgtcgtcctgtgtcc

SEQ ID NO: 59766 - DNA, 201 bp, Homo sapiens
ggaggatggcgctctgagcacagcacagcccttgagcagtgaccctcctatagaacactatctgggctgtgattccacagtgctgggcccgtgagcaggcygggagctctgcggctctccttctgctagaacctgcccccagactcttggctatgatcctgtgaccccaagaccgccatgcaggtcatgagctctttgtgt

SEQ ID NO: 59767 - DNA, 201 bp, Homo sapiens
cgggctccctggagcaaagggagagaaggtgagtgtgtgtggggctgccagtgagggggggtcaactggtgggggccaaggaatcccactgacctctcccscttaccagggagcccctggaggccttgctggagacctggtgggtgagccggtaagtagggaacttctgacagcagatgttctgggggtcctgtctctcca

SEQ ID NO: 59768 - DNA, 201 bp, Homo sapiens
gaccgtggagaccctggccctcaggggccacctggtctggcccttggggagaggggcccccccgggccttccggccttgccggggagcctggaaagcctgdtattcccgggctcccaggcagggctgggggtgtgggagaggcaggaaggccaggagagagggtgaggctgggggctggccaggagagtgagggaagaggg

SEQ ID NO: 59769 - DNA, 201 bp, Homo sapiens
caagggacagaggcgggggtcctagctgacggcttttactgcctaggatgacgctgcggcttctggtggccgcgctctgcgccgggatcctggcagaggcsccccgagtgcgagcccagcacagggagagaggtgggcaccgcaagggaggacccggcccggggcactgcaccgtgccaccctccgctccactcggccttc

SEQ ID NO: 59770 - DNA, 201 bp, Homo sapiens
cctggcagcaggggagagcgtggggagaaggtaggaacgtggggaaggtcctggcatgagtgggggggtgagtggatcttgtatgatattagaattcaggygcggggcctccccagtttgggcgggactcacactcttttgcccaatagggtgatgttgggagtgcaggactaaagggtgacaaggtgagtgtgggcatgg

SEQ ID NO: 59771 - DNA, 201 bp, Homo sapiens
gggagagcctggggaccgcggacaagagggtcctcgagggcccaagggtgatcctggcctccctggagcccctggggaaagggtgagtgtgattggtcctygggggtgcaggcatgggagggcctgctctgatttcttcctcccctatcctcagggcattgaagggtttcggggacccccaggcccacaggtgagtgatgc

SEQ ID NO: 59772 - DNA, 201 bp, Homo sapiens
ccccatccatggggtctgtgcctgagggatctcaatgggacctctcagtcctgggggtctctaccctggagggagatctttttggggtcctcttagtccawggggtgtgccccaagggatatctcagaggccctataaatcttaacaaagactttttccaggggcttccaggcctccgtggagaacagggcctccctggcc

SEQ ID NO: 59773 - DNA, 201 bp, Homo sapiens
ccaggcctccgtggagaacagggcctccctggcccctctggtccccctggattaccggtgagaccagactttcatgttacccccttttcccccttactacsctcacccgatccccgacatccaaccagtgatctgttcccacagggaaagccaggcgaggatggcaaacctggcctgaatggaaaaaacgtgagtgtgtcc

SEQ ID NO: 59774 - DNA, 201 bp, Homo sapiens
cagactttcatgttacccccttttcccccttactaccctcacccgatccccgacatccaaccagtgatctgttcccacagggaaagccaggcgaggatggsaaacctggcctgaatggaaaaaacgtgagtgtgtccagggcagctgcggcgaaacctgccaagaaacgccagcacacctacacagccaagatctgtagca

SEQ ID NO: 59775 - DNA, 201 bp, Homo sapiens
ccccgtggagtggggtgtagctgtacagccaccagcattctctcttccactcctgcagggccccatcggctttcctggagaacgcgggctgaagggcgacbgtggagaccctggccctcaggggccacctggtctggcccttggggagaggggcccccccgggccttccggccttgccggggagcctggaaagcctggtat

SEQ ID NO: 59776 - DNA, 201 bp, Homo sapiens
tcctgcctgatcccctgatcccgcattcccagcggatgactcgacctctgctccacgagacctggtgctgtctgagccaagcagccaatccttgagagtayagtggacagcggccagtggccctgtgactggctacaaggtccagtacactcctctgacggggctgggacagccactgccgagtgagcggcaggaggtagg

SEQ ID NO: 59777 - DNA, 201 bp, Homo sapiens
ggaccccttaccttgcctctgtccccagcccctgagcctgtgggtcgtgtgtcgaggctgcagatcctcaatgcttccagcgacgttctacggatcacctrggtaggggtcactggagccacagcttacagactggcctggggccggagtgaaggtatggctccctgacgccacccctgtccttcctggctgggactgctc

SEQ ID NO: 59778 - DNA, 201 bp, Homo sapiens
tccctgaccatcactggcccctttcatcctatgtccttgtcttgcactcacttttttcagccatatcccagctctctggtccccaccaccccacatccccmcccccatggcccttctcactctgcgtccctgtccatcactgccatcgtcccacatccctgtctctttctgacccctgcccacctaccctgacttctctct

SEQ ID NO: 59779 - DNA, 201 bp, Homo sapiens
ctgaagggcgaccgtggagaccctggccctcaggggccacctggtctggcccttggggagaggggcccccccgggccttccggccttgccggggagcctgraaagcctggtattcccgggctcccaggcagggctgggggtgtgggagaggcaggaaggccaggagagagggtgaggctgggggctggccaggagagtgag

SEQ ID NO: 59780 - DNA, 201 bp, Homo sapiens
ggaagagggtggtgtactctctgtggggtcctgtggctgtggtggttccacagcatctgtgagggcaggaggggaggacaggaggaggctttctggggttyagggggaaggggttctgtggctgactatggagtggccgagaggaggggctctagggagggctcaaggccttggtgtgaggttaggagagctctgtggact

SEQ ID NO: 59781 - DNA, 201 bp, Homo sapiens
cgggggaggaggaggaaactcactagcattccccacaggctgtggtcgggctccctggagcaaagggagagaaggtgagtgtgtgtggggctgccagtgakggggggtcaactggtgggggccaaggaatcccactgacctctcccccttaccagggagcccctggaggccttgctggagacctggtgggtgagccggtaa

SEQ ID NO: 59782 - DNA, 201 bp, Homo sapiens
cttttcctcaaagggtgacccaggagtcggggtcccgggctcccctgggcctcctggccctccaggtgtgaaggtaagtcaatgccccatcaccagttgtrggggcagcaggccgggcccccacaggaggaagagggagttctgatgagagtcctgggaggggtcctgcattgaccattccctccctttgctgtttttatt

SEQ ID NO: 59783 - DNA, 201 bp, Homo sapiens; identical to SEQ ID NO: 17179

SEQ ID NO: 59784 - DNA, 201 bp, Homo sapiens
tctggatcacagggagccacacactgtcggcttccacactctgagctctgggggccctgtcttggcttctgtgtgcccatccttggtctgtttctcaccayatctgggcacacgtgtgctctggtctgatctcccagatcccaggacacacctgagttcttgtgaacctctccttggtcctgtgtttacaatcctcctttc

SEQ ID NO: 59785 - DNA, 201 bp, Homo sapiens
agagggagttctgatgagagtcctgggaggggtcctgcattgaccattccctccctttgctgtttttatttcagggagatctgggcctccctggcctgccmggtgctcctggtgttgttgggttcccgggtcagacaggccctcgaggagagatgggtcagccaggccctagtggagagcgggtgaggggctgggaacagc

SEQ ID NO: 59786 - DNA, 201 bp, Homo sapiens
gagccctgttccctgcccttgacccttttctctagggtcttgctggccctgcaggaccccaaggaccttctggcctgaaggtgagtctaggtgtgtggatrggaggaggaggctccttcaagctgtgtccatgcctggggtagtgtgcgccaacctcctgggctgtcatctcctgcaatgaggatgagctccaggagccct

SEQ ID NO: 59787 - DNA, 201 bp, Homo sapiens; identical to SEQ ID NO: 17266

SEQ ID NO: 59788 - DNA, 201 bp, Homo sapiens
attctctgcagggtctaccaggagagcgtggtatggctgggcctgaagggaagccggtgagtggtggctgaagcacctggccccaggctccggaccctccrctaggtgctgctgctgctgtgtgtgtgcatgtctgtgtgtgtgtgtttgtgtgtacctgtgtctgtgtgcctctctgtgtgtgcctgcttgtgtgtgcct

SEQ ID NO: 59789 - DNA, 201 bp, Homo sapiens
gctcccaggagtctccagccatgcctcaaccaagtgctaaagggtgctctgggcaagaggcctagggaaaagggtgtgaaggtgctttcctgaggccgtgyggggcagaaggcaggagcttctctgtcatgggcagcccttcacccagactttgtccccagaatgtggatcggttgctggaaactgctggcatcaaggtgg

SEQ ID NO: 59790 - DNA, 201 bp, Homo sapiens
cagggcctcctggagagaagggagaccctgggcggcctggccccccaggacctgttggcccccgaggacgagatgtaagaggctggagtcgggggagtcayggcgggtaagggagtagggctgttgccagcatcatgggggttcttggaaccagggctgactctcatgtttcacagggtgaagttggagagaaaggtgacg

SEQ ID NO: 59791 - DNA, 201 bp, Homo sapiens
tctggcccttgtgaccctttgattacccccatcctcaccatgacgcctcagttctcccaaaatccttgaaatccaattggaccccatgaccctcatcactyctggtatctttgggagtgaggtgtggcccagggtcatggggtcgtcatctgttttctagggtgacaaaggcgatcgtggggagcgggtaagtgagggaca

SEQ ID NO: 59792 - DNA, 201 bp, Homo sapiens; identical to SEQ ID NO: 17162

SEQ ID NO: 59793 - DNA, 201 bp, Homo sapiens
cctggtgcagcagggatccctggtgacccggtaagatgcccctgctcccacaggggccccctgtccccagagggcccccgtcaccatggtggtcccaccastgtggtagcttttgaccttatagtgacccagtgctctcatggtgtcctcatgtcacccagggtcccccacctccacagtagccgcctatgatggtgtccc

SEQ ID NO: 59794 - DNA, 201 bp, Homo sapiens
accatcactggcccctttcatcctatgtccttgtcttgcactcacttttttcagccatatcccagctctctggtccccaccaccccacatccccacccccmtggcccttctcactctgcgtccctgtccatcactgccatcgtcccacatccctgtctctttctgacccctgcccacctaccctgacttctctcttagggg

SEQ ID NO: 59795 - DNA, 201 bp, Homo sapiens
cctgggccccacatccatcctcctttcctggaacttggtgcctgaggcccgtggctaccggttggaatggcggcgtgagactggtcagtgcgggggaaggratggacaggcaagggtcagggcatggcctctgctggtctgaccctgttatcttgcaggcttggagccaccgcagaaggtggtactgccctctgatgtgac

SEQ ID NO: 59796 - DNA, 201 bp, Homo sapiens
ggcccttctcactctgcgtccctgtccatcactgccatcgtcccacatccctgtctctttctgacccctgcccacctaccctgacttctctcttaggggtkgagcggaccctggtgcttcctgggagtcagacagcattcgacttggatgacgttcaggctgggcttagctacactgtgcgggtgtctgctcgagtgggtc

SEQ ID NO: 59797 - DNA, 201 bp, Homo sapiens
ggcagtggggacacaccagaaaggggctcccaggagtctccagccatgcctcaaccaagtgctaaagggtgctctgggcaagaggcctagggaaaagggtstgaaggtgctttcctgaggccgtgcggggcagaaggcaggagcttctctgtcatgggcagcccttcacccagactttgtccccagaatgtggatcggttg

SEQ ID NO: 59798 - DNA, 201 bp, Homo sapiens
cctcctcagggcttccctggagcagatgggcgtccaggcagccctggccgcgccgggaatcctgggacccctggagcccctggcctaaaggtgagcaagcyttgtcctgcaggtcagggtgggcgctgcctgagtgggtggggtggctccgactgttctgcctctggcctccatttgcagggctctccagggttgcctggc

SEQ ID NO: 59799 - DNA, 201 bp, Homo sapiens
cagtggggacacaccagaaaggggctcccaggagtctccagccatgcctcaaccaagtgctaaagggtgctctgggcaagaggcctagggaaaagggtgtsaaggtgctttcctgaggccgtgcggggcagaaggcaggagcttctctgtcatgggcagcccttcacccagactttgtccccagaatgtggatcggttgct

SEQ ID NO: 59800 - DNA, 201 bp, Homo sapiens
agtgtcagtggggcaggagaggttggcagcacaggtctcactgattacccttcctagggcctgagaggacaagttgggcctcctggcgaccctggcctccyggtgagtgtcccccacatctgtccctgcaccctgactggcttatccccacctaactgctatcttctttcagggcaggaccggtgctcccggcccccaggg

SEQ ID NO: 59801 - DNA, 201 bp, Homo sapiens
cgacccatagtttacccaccctcatgaccctcagctttcatagtagaccgcatatttaagctctggccccatgcctccctccggagtctcatctttctgtkactgatgcctgtgttgcctcctgacctctgtcaacagggagccaaaggtgaccgaggactgccagggccgcgaggcgagaaggtgaggtgggttggccct

SEQ ID NO: 59802 - DNA, 201 bp, Homo sapiens
cctctgacctcttgctgtccctcaggcatctgccctgcgggagatcgtggagacctgggatgagagctctggtagcttcctgcctgtgcccgaacggcgtygaggccccaagggggactcaggcgaacagggccccccaggcaaggaggtgagcagaagtggctcagtgggttgtgccccgtggagtggggtgtagctgta

SEQ ID NO: 59803 - DNA, 201 bp, Homo sapiens
cttggtgcctgaggcccgtggctaccggttggaatggcggcgtgagactggtcagtgcgggggaagggatggacaggcaagggtcagggcatggcctctgytggtctgaccctgttatcttgcaggcttggagccaccgcagaaggtggtactgccctctgatgtgacccgctaccagttggatgggctgcagccgggcac

SEQ ID NO: 59804 - DNA, 201 bp, Homo sapiens
ggtgaccccatttgaacccacataacccctgccagttactctggcccttgtgaccctttgattacccccatcctcaccatgacgcctcagttctcccaaartccttgaaatccaattggaccccatgaccctcatcactcctggtatctttgggagtgaggtgtggcccagggtcatggggtcgtcatctgttttctaggg

SEQ ID NO: 59805 - DNA, 201 bp, Homo sapiens
tggccaggaacagtcccgggtcctggggcccgagctcagcagctatcacctggacgggctggagccagcgacacagtaccgcgtgaggctgagtgtcctarggccggctggagaagggccctctgcagaggtgactgcgcgcactggtaagcctgcctcaccttggcgtgctcctcccctgctgatgacccaccctgactt

SEQ ID NO: 59806 - DNA, 201 bp, Homo sapiens
cgctgaggctgcgctgggagccggtgcccagagcgcagggcttccttctgcactggcaacctgagggtgagaggtgtccccaggaggaagttagggaccaktgggggcagggctgtggcagactccgcaaggtaggcgaggacagtgatggtgggcggggtctgtcactgggggtctgcgggatccgtgacagtaggtaag

SEQ ID NO: 59807 - DNA, 201 bp, Homo sapiens
tccgccggggtgagtactgcaggaggcttgtggaggacagctgcctgcctcactctggtcctggttctgacttctgacttctgtctgtaactcctagagcyggaaactccacttgctgttccagggctgcgggttgtggtgtcagatgcaacgcgagtgagggtggcctggggacccgtccctggagccagtggatttcgg

SEQ ID NO: 59808 - DNA, 201 bp, Homo sapiens
aggtccggagtccagccagacactgcccccagactctactgccacagacatcacagggctgcagcctggaaccacctaccaggtggctgtgtcggtactgygaggcagagaggagggccctgctgcagtcatcgtggctcgaacgggtcaggccctgcccccgtcccttggctctctgcctccattgctctttcagacccc

SEQ ID NO: 59809 - DNA, 201 bp, Homo sapiens
agttcctgcccacacggtgtaccctgacctagaccccggaccccaatccccacttggcagtgctgattccatcctatgtgctcctgaccccgaccccaacyctgcatcatacatgcccaccccaatcctcctgcctgatcccctgatcccgcattcccagcggatgactcgacctctgctccacgagacctggtgctgtct

SEQ ID NO: 59810 - DNA, 201 bp, Homo sapiens
ccatcactggcccctttcatcctatgtccttgtcttgcactcacttttttcagccatatcccagctctctggtccccaccaccccacatccccacccccawggcccttctcactctgcgtccctgtccatcactgccatcgtcccacatccctgtctctttctgacccctgcccacctaccctgacttctctcttaggggt

SEQ ID NO: 59811 - DNA, 201 bp, Homo sapiens
tgggctgcccagagccactgcagccccacccgccaccctggctcgcgcattgtcctatcgctggatgtccccatcggcctcttgcagatcttactggagcwagcccgggccagggctgccagggagcaggccaccaccaacgcccgcatcctggcccgtgtcggccactgctgagcctgagagagggggtcacagtgatag

SEQ ID NO: 59812 - DNA, 201 bp, Homo sapiens
caggcgaacagggccccccaggcaaggaggtgagcagaagtggctcagtgggttgtgccccgtggagtggggtgtagctgtacagccaccagcattctctyttccactcctgcagggccccatcggctttcctggagaacgcgggctgaagggcgaccgtggagaccctggccctcaggggccacctggtctggcccttgg

SEQ ID NO: 59813 - DNA, 201 bp, Homo sapiens
caggtcagaggtcgtggttttggagggggtggttggagtttgggaccccttgtctggggtttgacgttcaagccccgccaccaaccctctctctctctgtmtttctctcaccctctctcttcagggtgaccggggctttccagggcccctgggtgaggctggagagaaggtaagtgcaacctggggggtgccaagggccct

SEQ ID NO: 59814 - DNA, 201 bp, Homo sapiens
ttgggggattcaggtgtgaggggtgctactctgggctccccatggtgttaggggaggctggaagataaggagataagagttccctccaggtcagaggtcgyggttttggagggggtggttggagtttgggaccccttgtctggggtttgacgttcaagccccgccaccaaccctctctctctctgtctttctctcaccctc

SEQ ID NO: 59815 - DNA, 201 bp, Homo sapiens
tactctgggctccccatggtgttaggggaggctggaagataaggagataagagttccctccaggtcagaggtcgtggttttggagggggtggttggagttwgggaccccttgtctggggtttgacgttcaagccccgccaccaaccctctctctctctgtctttctctcaccctctctcttcagggtgaccggggctttcc

SEQ ID NO: 59816 - DNA, 201 bp, Homo sapiens
gtggccctggccagtttggttgcaggatggacagaggctcgttaggaggcagctccctgaccgacctggggccggggagcagcaggcggggtaggcacggsacagcgtggggagggtggagggttagggaaagacctggatgaagtcagggtggtgctggaggggtgcgagagtgttggggggtctctcctggtttagggg

SEQ ID NO: 59817 - DNA, 201 bp, Homo sapiens
catcctggcccgtgtcggccactgctgagcctgagagagggggtcacagtgatagggccaccctggatgggaagacctggagggcagccacacagctggayggatgctgccacatctgggcatacagtgtctggacgctgccacatctgggcatacagtgtctggacactgccacatggagccactgtcatgcaggtcata

SEQ ID NO: 59818 - DNA, 201 bp, Homo sapiens
tgtttcctgcagggcagagatggccctcctggactccctggaacccctgggccccccggaccccctggccccaaggtgatcaccccatccctgccttagtyctgtgactagtgaccaggaagccacccttagcttggtccccagaaatatggtagtgtgtgccataaccctggaatttctgaccctataaccctctgtgat

SEQ ID NO: 59819 - DNA, 201 bp, Homo sapiens
tcacagcctggtcccatctgttgcacataggggcggccagggcctgccggtcctcgaggcgagaagggagaagctgcactgacggtgagtgtgggcctggrtgggcctgggagggcctgggtgggcctgggtgggctggggccctacctccctcacccagcaccctgacccctgggccctggctccatgcagtctcaccat

SEQ ID NO: 59820 - DNA, 201 bp, Homo sapiens
agctactcagtgcgagtgactgcacttgtcggggaccgcgagggcacacctgtctccattgttgtcactacgcgtaggcagagcatgcgctggagagcttyggatgggtggtgtggatggtttggggatccgggcttgtgctctggattggagaaaggaccaggattggtagtgagcctttgggggcagggtctgagagga

SEQ ID NO: 59821 - DNA, 201 bp, Homo sapiens
accccttccctgctgtcagcggtgactctgtgacttctgggcggggactgagctgtatgacttccaattccatgtgacctccattccaatgaagactttgrtcatacaaccccaaggcagggccaagctgtatctgtcctgtttgttttcagggacctgctgttgctggacccaaaggagaaaaggtaagcctggtatggg

SEQ ID NO: 59822 - DNA, 201 bp, Homo sapiens
gactacttcagccagctgagcaacaatgccaaggaggccgtggaacatctccagaaatctgaactcacccagcaactcaagtaagagggactacagtgtgyggtggtgacggggaattcttaaaggccatgcaatgtactggcaagggttgagcttagagacaggagccctgagcttaggatacccactgccctgccacta

SEQ ID NO: 59823 - DNA, 201 bp, Homo sapiens
ggtagattctgagacaaactatgtgggagatcctgagatagaaattcagcatcgtaacttagtctgtgacacccatcctctccaatctgcaccaccatagrgagggtgaactcggtacctctgagcactcacctgtcctagcacgtgtgcataaggcgagtggtatacaagcagacaaagtcttgccgtgtaaatgccaaa

SEQ ID NO: 59824 - DNA, 201 bp, Homo sapiens; identical to SEQ ID NO: 17275

SEQ ID NO: 59825 - DNA, 201 bp, Homo sapiens
ggcactgagtactgacctttgctcccgctgcaagctggactgtgcctgattcaggagcagggttgggaccgatgggttccagggaggtgagccttgcaggrgtaagacgtggctaacatttagtgatcacttttactatgtgccagacattgttgcaagcactataagatcatctcagtgaatcctcacagcctaggaggc

SEQ ID NO: 59826 - DNA, 201 bp, Homo sapiens
ggcgggtgagacagaagcgcctctggacctctcacatgctagtggcacctgctgctaggactgtaagtcctggaggtcaaactgcggctgaggtgtcattygtgactcagtctcctcctcccctctggcctggggaagggacaggggcactgagtactgacctttgctcccgctgcaagctggactgtgcctgattcagga

SEQ ID NO: 59827 - DNA, 201 bp, Homo sapiens
gacaaagtcttgccgtgtaaatgccaaatgtaacgtggcctccttgtgcccttccccacagtgccctcttccaggacaaacttggagaagtgaacacttaygcaggtgacctgcagaagaagctggtgccctttgccaccgagctgcatgaacgcctggccaaggactcggagaaactgaaggaggagattgggaaggagc

SEQ ID NO: 59828 - DNA, 201 bp, Homo sapiens
aagtcttgccgtgtaaatgccaaatgtaacgtggcctccttgtgcccttccccacagtgccctcttccaggacaaacttggagaagtgaacacttacgcargtgacctgcagaagaagctggtgccctttgccaccgagctgcatgaacgcctggccaaggactcggagaaactgaaggaggagattgggaaggagctgga

SEQ ID NO: 59829 - DNA, 201 bp, Homo sapiens
gtcttgccgtgtaaatgccaaatgtaacgtggcctccttgtgcccttccccacagtgccctcttccaggacaaacttggagaagtgaacacttacgcaggygacctgcagaagaagctggtgccctttgccaccgagctgcatgaacgcctggccaaggactcggagaaactgaaggaggagattgggaaggagctggagg

SEQ ID NO: 59830 - DNA, 201 bp, Homo sapiens
aataatccctgccatgtccttttgctttgacgttctagagtttgacaaatggccacatcctatcattcaggctcatggaagagagggagggaggaaaatgycacgtgagctgatttctaatacgtttcagaaagacaggccccagtggaatcaaggggagggaggtgggaatatttgggaggcccctgggcacaggcaagg

SEQ ID NO: 59831 - DNA, 201 bp, Homo sapiens; identical to SEQ ID NO: 17284

SEQ ID NO: 59832 - DNA, 201 bp, Homo sapiens
gcacaggcaaggaaagcagcaccttgtgccactggaagaccccagcagaggtcaagaagacaacattgtgttacacaatgtgatcctatggcccagaacaytccctctgggaaggacctcaaagtcccaccctctgcagacaaggaggggaaagcaaactgctggaggtgacatggtgggtagattctgagacaaactatg

SEQ ID NO: 59833 - DNA, 201 bp, Homo sapiens
agaaggcatttgggaggtgatcaggtcatgaagggggagccctcatgaatgagattagtgtccttataaaagaggccccacagaaatcccttgccccttcyacgtgcgaggacacagcgagaaggtgccatttatgaaccaggaagtgggccctcaccagacacgggatatgctggtgccttgctcttagacttcccagcc

SEQ ID NO: 59834 - DNA, 201 bp, Homo sapiens; identical to SEQ ID NO: 17285

SEQ ID NO: 59835 - DNA, 201 bp, Homo sapiens; identical to SEQ ID NO: 17286

SEQ ID NO: 59836 - DNA, 201 bp, Homo sapiens
tcggacatgctcaaatggtgcaggcgctcccagcatgggtgcacccaggcgggcgggtgagacagaagcgcctctggacctctcacatgctagtggcacckgctgctaggactgtaagtcctggaggtcaaactgcggctgaggtgtcattcgtgactcagtctcctcctcccctctggcctggggaagggacaggggcac

SEQ ID NO: 59837 - DNA, 201 bp, Homo sapiens; identical to SEQ ID NO: 17287

SEQ ID NO: 59838 - DNA, 201 bp, Homo sapiens; identical to SEQ ID NO: 17288

SEQ ID NO: 59839 - DNA, 201 bp, Homo sapiens; identical to SEQ ID NO: 17289

SEQ ID NO: 59840 - DNA, 201 bp, Homo sapiens
catctcaaaaaaaaaaaaaattgcacctgtactaaacatatacagacttttttggtgattacctcctaaacaatacagtataacaaccattcacacagcayttccgtcgtattaggtattataagtaatctagagatttaaagtatgtgggaggctgtgcttaggttatatgtaaatactatgccattttatatcaaggac

SEQ ID NO: 59841 - DNA, 201 bp, Homo sapiens; identical to SEQ ID NO: 17273

SEQ ID NO: 59842 - DNA, 201 bp, Homo sapiens; identical to SEQ ID NO: 17274

SEQ ID NO: 59843 - DNA, 201 bp, Homo sapiens
gtgattatgcatgcagcctcatttagagatccaatagacatctaagtagaagacctcctgggcaccaccaccattgccctccatcccccaatgggaggtcycctgagagcctcaggtcccaagattctgctcaagccagctgctcctgcccagggagtgtggctggggggcaagaagggcaggagtcaggcctcaggctgg

SEQ ID NO: 59844 - DNA, 201 bp, Homo sapiens
gcagagcaggtgctggagcctgcggggccctggtctgctctgtccaggggcctcctgccaggtggcctgccagtttggggctgagtttgcagccactgggrttaggggcagagagtcagggggcctgagcagtctcatcagcacagccagctgtgggcagctgcagccttggagtggtctttcaccccacccttagagact

SEQ ID NO: 59845 - DNA, 201 bp, Homo sapiens
atagaaattcagcatcgtaacttagtctgtgacacccatcctctccaatctgcaccaccatagggagggtgaactcggtacctctgagcactcacctgtcytagcacgtgtgcataaggcgagtggtatacaagcagacaaagtcttgccgtgtaaatgccaaatgtaacgtggcctccttgtgcccttccccacagtgcc

SEQ ID NO: 59846 - DNA, 201 bp, Homo sapiens
ccgggtgtgctagaatgggctggcggggtcccgtggccccagaccctccaagcctttccatctctgcagagggtctggaggagcctggcctctctctcccrcatggcaacggacccagggaggtcaggacatgtgggtagagagacctggcagggtgctgagctagatgtagcacacctccaggaagcctggtaccttgtc

SEQ ID NO: 59847 - DNA, 201 bp, Homo sapiens
aatccctgccatgtccttttgctttgacgttctagagtttgacaaatggccacatcctatcattcaggctcatggaagagagggagggaggaaaatgtcaygtgagctgatttctaatacgtttcagaaagacaggccccagtggaatcaaggggagggaggtgggaatatttgggaggcccctgggcacaggcaaggaaa

SEQ ID NO: 59848 - DNA, 201 bp, Homo sapiens
cctgccactaactggccgggcctctgaacctaggatccacatatgtaaaccggaagtttggaccgaataatccctgccatgtccttttgctttgacgttcyagagtttgacaaatggccacatcctatcattcaggctcatggaagagagggagggaggaaaatgtcacgtgagctgatttctaatacgtttcagaaagac

SEQ ID NO: 59849 - DNA, 201 bp, Homo sapiens; identical to SEQ ID NO: 17276

SEQ ID NO: 59850 - DNA, 201 bp, Homo sapiens
gcaagggttgagcttagagacaggagccctgagcttaggatacccactgccctgccactaactggccgggcctctgaacctaggatccacatatgtaaacyggaagtttggaccgaataatccctgccatgtccttttgctttgacgttctagagtttgacaaatggccacatcctatcattcaggctcatggaagagagg

SEQ ID NO: 59851 - DNA, 201 bp, Homo sapiens
agctggagcagaggggccacacaggagacggggcctcatgaattgctctctgttaccacccaggagccagggctgaggtcagtgctgaccaggtggccacrgtgatgtgggactacttcagccagctgagcaacaatgccaaggaggccgtggaacatctccagaaatctgaactcacccagcaactcaagtaagagggac

SEQ ID NO: 59852 - DNA, 201 bp, Homo sapiens
tggacatgaggtctgcctggctgccaagtggctcacaggagagctggcccagtcccagtggtgggcccattggcattggtgctataccagtttcacatatycctgtggcttccaaaaagctaagctcagacagggaaaatggcaggttgaggcacccccaccatcatccagtctgcagctcagagctggagcagaggggcc

SEQ ID NO: 59853 - DNA, 201 bp, Homo sapiens; identical to SEQ ID NO: 17280

SEQ ID NO: 59854 - DNA, 201 bp, Homo sapiens
cactgaggaaggaggaggggagggcagccaggggggtggcgatagggagagagtttaaatgtctggctggctctgagcttcagtcagttcccactgcagcrcaggtgagctctcctgaggacctctctgtcagctcccctgattgtagggaggatccagtgtggcaagaaactcctccagcccagcaagcagctcaggatg

SEQ ID NO: 59855 - DNA, 201 bp, Homo sapiens; identical to SEQ ID NO: 17283

SEQ ID NO: 59856 - DNA, 201 bp, Homo sapiens
gctttgacgttctagagtttgacaaatggccacatcctatcattcaggctcatggaagagagggagggaggaaaatgtcacgtgagctgatttctaatacrtttcagaaagacaggccccagtggaatcaaggggagggaggtgggaatatttgggaggcccctgggcacaggcaaggaaagcagcaccttgtgccactgg

SEQ ID NO: 59857 - DNA, 201 bp, Homo sapiens
aacactccctctgggaaggacctcaaagtcccaccctctgcagacaaggaggggaaagcaaactgctggaggtgacatggtgggtagattctgagacaaastatgtgggagatcctgagatagaaattcagcatcgtaacttagtctgtgacacccatcctctccaatctgcaccaccatagggagggtgaactcggtacc

SEQ ID NO: 59858 - DNA, 201 bp, Homo sapiens; identical to SEQ ID NO: 17290

SEQ ID NO: 59859 - DNA, 201 bp, Homo sapiens
actacttcagccagctgagcaacaatgccaaggaggccgtggaacatctccagaaatctgaactcacccagcaactcaagtaagagggactacagtgtgcrgtggtgacggggaattcttaaaggccatgcaatgtactggcaagggttgagcttagagacaggagccctgagcttaggatacccactgccctgccactaa

SEQ ID NO: 59860 - DNA, 201 bp, Homo sapiens; identical to SEQ ID NO: 17291

SEQ ID NO: 59861 - DNA, 201 bp, Homo sapiens
ttcaagttgtcatctttttgctgctgggggttcttgccatgatgttgatagctgctgactgagcggagtggtggttgttgaaggctggggttgtgttgaakgctgtggcaattttgtgattggccaccaatggagtttgctgcatcaatggactcatcctttcatgaaatttttattggtagcatgcaatgttatttgata

SEQ ID NO: 59862 - DNA, 201 bp, Homo sapiens
cagtccctcaggccacacagcgcatgtccattgccttcatgccgcaggagactgaggggtcatgcatgagggccacttctctgggttgtccccacaacackggcggtgtccctgggacacgtggaaggggaggggcagctcactgctgacatctccttctgcaggcctggaggaggcagaggccaggagggagaggtccca

SEQ ID NO: 59863 - DNA, 201 bp, Homo sapiens
ggggcagcccctgacaaggaggaccaccgcggcctccctgcagtttctcttgcacctgactctgcccacagctcacccagtgcccccggggccctgcccaycctcctctttctccttgtctgctgcctcctgatggcaagacacccaggcccagtccatggacctcctctctgctgtatccactctgcagagaccccctca

SEQ ID NO: 59864 - DNA, 201 bp, Homo sapiens
atgatatagtgaagtggggatgaaaaggatccaaccatgggcagaacctggggtctggtgccagtggagacagccccagtgtctagcatgagacacggggratgttccgttggagggtgggtatgatgactctcctgaaagcttccctccctccagtccagatggcccctccatccctcaacgtgaccaaggatggagaca

SEQ ID NO: 59865 - DNA, 201 bp, Homo sapiens; identical to SEQ ID NO: 17315

SEQ ID NO: 59866 - DNA, 201 bp, Homo sapiens; identical to SEQ ID NO: 17318

SEQ ID NO: 59867 - DNA, 201 bp, Homo sapiens
gcgtcacactgcagaggcctcatggggtagctggggctgcagactcccgggaactcggcgcctgagccggcagctgaccaccaactcggcagggagaaggkggtggcatggttgatagaatgatggaagggttgcccagtgcacaggctgggcatgagcctggtgctgaaggaggatggactttaaggtcaaaagggagag

SEQ ID NO: 59868 - DNA, 201 bp, Homo sapiens
gccgtctccccgattagatggtggccaaagagaaagggaaggcctttgcagagagcacctcccacctggtcatcagacccgcaagttgaaagaggcaaagrgtaaagcaggcagaaactgggcgtggagtcagaagttctccacccactcttcatgagacagcacagctgggcagaggatgccacatctctgggtgggcac

SEQ ID NO: 59869 - DNA, 201 bp, Homo sapiens
tttttaagaaatctccaaactgctttccacaatggctgaactaatttacattcctatcaatagcatataagcatttgcttttctctgctgcctcaccagcrtctattgttttatgactttttaataatagtcattccaactgatgtgagatagcatctcattgtggttttgatttgcatctctctgatgattagtgatatt

SEQ ID NO: 59870 - DNA, 201 bp, Homo sapiens; identical to SEQ ID NO: 17321

SEQ ID NO: 59871 - DNA, 201 bp, Homo sapiens
tgtgtacatgtgttcatgtccaggggatgacactgtggcatccaacagccgtggaccagcagcccacggggagcttagtaggagtcaaatcctaggccccygtctcagctgctctgctgtctagcgcattgtgcagtggtaggtgtcagtgatccaagtggggacccagtccctcaggccacacagcgcatgtccattgcc

SEQ ID NO: 59872 - DNA, 201 bp, Homo sapiens
gcaccggctacaacgggatctggagtgagtggagtgaggcgcgctcctgggacaccgagtcgggtaggtgaaggctggagtccagagcttctggccaggaycagctcatagtttctcactgccagaaaatccccaatgcagcagccgtagcaggcctgcaacaacttgtaggtgagccgtctccccgattagatggtggcc

SEQ ID NO: 59873 - DNA, 201 bp, Homo sapiens
ggggtaaagggcagggcccctgggagatcagaacaggcttcccagagggaagagctttgcaactcagatctgaagggtagacaggaggggagggcagtaagagcctctctggcagggtaacagctgtgcagaggctgggggatcagaagggcatgggcagctggggaacctgctcaccattgtgtccagggagcatcagct

SEQ ID NO: 59874 - DNA, 201 bp, Homo sapiens
gccacagactgggtccttggattggaaggttttgctgtgattccttcatcttcccacctccctgcacttgctgcgtgcactgacccctcacctttcaccayagtgaccaccaggcgactcccgcagaacaagacaagtccaaggggtggtttcagagagagtaaggatacaggagatattgggagcaacccaagtccccag

SEQ ID NO: 59875 - DNA, 201 bp, Homo sapiens
tgaggccctggaggtgaggtgccagccctggccacggggtagacagtggcagagcaagctgtgtggacgtgtctgggagggggctccgcgctctcccaggscccccctccgtatgtgggctgccacctctcccacccaagctctcctgggcacgtgccacaagggaaggggaccagaatcgctctggggtgttggccaggg

SEQ ID NO: 59876 - DNA, 201 bp, Homo sapiens
tccctccctcaatgcctttaacattctgcccccaggtcacctccttagagaagcctgcttgtcccatatttcaaattgcctccctggcccagcccttcctscctcctcacctgcttcttgctttatttttccacatgaagttctctccactgcacacgctacacactttgttccatgcgggtccccttctcccaggatggc

SEQ ID NO: 59877 - DNA, 201 bp, Homo sapiens
cctccctggcccagcccttcctccctcctcacctgcttcttgctttatttttccacatgaagttctctccactgcacacgctacacactttgttccatgcrggtccccttctcccaggatggcagctccgtgggcaggatttttgtgtgttttatcactgctggcccctgattctgaacagagccaggcatgtggtgagca

SEQ ID NO: 59878 - DNA, 201 bp, Homo sapiens
agtgcccctattacatcctaggcttctatacatacttcgttattttctttattgttttctcttccatttggctgtcactacattccttattatttttctarcgaatggagcaagtctctcatctctggtttgttataatttagaatcagtttgccaaggccaggcacagtggctcatgcctataatcccagcactttggga

SEQ ID NO: 59879 - DNA, 201 bp, Homo sapiens
cggtccagcccttaggtgcccttcacttcctcccctccagtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggta

SEQ ID NO: 59880 - DNA, 201 bp, Homo sapiens
cagaagggctgggagctgagaaggctcaaaatagggtgggacaggtggcttcagggttctgggcctcagtgttgtcaatgtcaggggctgcactgacaggyggagtccccggtgccatccgaagtgctgtccgtgggtgggccctcagggaggatccacggtggtgagagagaagccgcagcaggcctggggtatggcagg

SEQ ID NO: 59881 - DNA, 201 bp, Homo sapiens
agcgcattgtgcagtggtaggtgtcagtgatccaagtggggacccagtccctcaggccacacagcgcatgtccattgccttcatgccgcaggagactgagrggtcatgcatgagggccacttctctgggttgtccccacaacacgggcggtgtccctgggacacgtggaaggggaggggcagctcactgctgacatctcct

SEQ ID NO: 59882 - DNA, 201 bp, Homo sapiens; identical to SEQ ID NO: 17310

SEQ ID NO: 59883 - DNA, 201 bp, Homo sapiens
gggacctgtcaggtcagcctcggggtgggagtggacagaggacagaggaggagggaggccctgcaagagctcctgctccgccaggcacctgcgaggccggstgctgccgtctgacctggggtttctgcggagtgcctcctacactgatgttggtgacaatggtggtggtggcaatggtgaaaatcttctcttgtttcatca

SEQ ID NO: 59884 - DNA, 201 bp, Homo sapiens
tgggaaacaatgaaaatgcgatacgaacacatagaccacacatttgagatccagtacaggaaagacacggccacgtggaaggtgagggcctttgcccaggsacgggagaaacactggggagggcgggagaagggaaagcaaccagaggcattccacctgcaaggcgtcgggcccttggcaggtgaccagtgagaggtagcc

SEQ ID NO: 59885 - DNA, 201 bp, Homo sapiens
acaccagccacatcacctgcaggtgggcagacacccaggatgcccagcggctcgtcaacgtgaccctcattcgccgggtgaatgagtgagtgatgctgggkgcaggggccacgggcaggggctacgacgtcccctgtgcctggcatggggcgacagtgtagagagggacctgtcaggtcagcctcggggtgggagtggaca

SEQ ID NO: 59886 - DNA, 201 bp, Homo sapiens
aggcattccacctgcaaggcgtcgggcccttggcaggtgaccagtgagaggtagccactgggacgtggtgatcactaggctgtgtggtcagcaggtcactstcctgtctcttggtgaagtaactgaggtttggaaaagtggcgtggcttggccaacgtgaacagctgaccctgagtccccaggcaacagaagaccctctgg

SEQ ID NO: 59887 - DNA, 201 bp, Homo sapiens
cccaggccagggctcggtcccctgcctccacagagcccagaacagaaaccacagaaccaaccccacaccttcagtctagaaatggggcaactgaggctagragggaggtgggccagtggtggagccaggagcgggccctggggtcctgaacccccattctcagggtccagagtccagtcggcctgcactgcgttcctgaaa

SEQ ID NO: 59888 - DNA, 201 bp, Homo sapiens
taggagggaggtgggccagtggtggagccaggagcgggccctggggtcctgaacccccattctcagggtccagagtccagtcggcctgcactgcgttcctraaaaggccacaatatgggtgcaagctgccccagaagggctgggagctgagaaggctcaaaatagggtgggacaggtggcttcagggttctgggcctcagt

SEQ ID NO: 59889 - DNA, 201 bp, Homo sapiens
gggcgtcctgtgggtagctgtgccctggggacttggaggagttagggcttggcctcttaggatgacctgagcccagactcctagggcggccagtggatggrgaggcagccaggggtgccaagctgcttgggtgttgtaggagagctctggggaggactcagcctcgctagcgggatctggttggtcctggtgggaaggacg

SEQ ID NO: 59890 - DNA, 201 bp, Homo sapiens
acgggtcttgctcaaggtccctcagctgctgggggcaggggtggcctggaaccccctgtgtccacacaaaaggccatgcaggccctgactgccccccagcrgtccagcccttaggtgcccttcacttcctcccctccagtccagcctcctgagcccagggacctgcagatcagcaccgaccaggaccacttcctgctgacc

SEQ ID NO: 59891 - DNA, 201 bp, Homo sapiens
gtaacagctgtgcagaggctgggggatcagaagggcatgggcagctggggaacctgctcaccattgtgtccagggagcatcagcttcaagggctggacagyggtgggaagaagcaggagacacaggtaaggacctgtccctggagaggcttctgtctcctgcagtctcaggtagaggggaccctctaggcatggagagcac

SEQ ID NO: 59892 - DNA, 201 bp, Homo sapiens
gtgttgtaggagagctctggggaggactcagcctcgctagcgggatctggttggtcctggtgggaaggacgcctagtggggtgaagagagctcaggcctgrgagtcaggcacctatagtctgtcttcgctttgtcactaagatgctggtggtagtgagagcaccccctgtccaccctgggcttctgtctcctcatctgtgg

SEQ ID NO: 59893 - DNA, 201 bp, Homo sapiens
tcatagtttctcactgccagaaaatccccaatgcagcagccgtagcaggcctgcaacaacttgtaggtgagccgtctccccgattagatggtggccaaagrgaaagggaaggcctttgcagagagcacctcccacctggtcatcagacccgcaagttgaaagaggcaaagggtaaagcaggcagaaactgggcgtggagtc

SEQ ID NO: 59894 - DNA, 201 bp, Homo sapiens
tggctaggagatggggacatgagggcatgcaaatcatagttcagatatacacacaattcattcattcaaccttctttccttgagcgcctacataagccaaygaagcagtcaacaaaccagccagcaaccctgcccttggagcttacagcctggaaacaaggaaggtttctaaggcgatggagacaacttagatatagggag

SEQ ID NO: 59895 - DNA, 201 bp, Homo sapiens
caccctgggcttctgtctcctcatctgtggaatggggagcatggatagtccctgacatcttggtttagaaagagagagaacgcatgctcgtgtgtttgccygtgtgtgcatttgtgtgtgtgcctgtgtgtgtatgtgcatgtgcggatgtctggggatgcaggagtgcagagagactaagaggcagagggtgaaacctgg

SEQ ID NO: 59896 - DNA, 201 bp, Homo sapiens
catttgagatccagtacaggaaagacacggccacgtggaaggtgagggcctttgcccagggacgggagaaacactggggagggcgggagaagggaaagcarccagaggcattccacctgcaaggcgtcgggcccttggcaggtgaccagtgagaggtagccactgggacgtggtgatcactaggctgtgtggtcagcaggt

SEQ ID NO: 59897 - DNA, 201 bp, Homo sapiens
aaaacatgatatagtgaagtggggatgaaaaggatccaaccatgggcagaacctggggtctggtgccagtggagacagccccagtgtctagcatgagacayggggaatgttccgttggagggtgggtatgatgactctcctgaaagcttccctccctccagtccagatggcccctccatccctcaacgtgaccaaggatgg

SEQ ID NO: 59898 - DNA, 201 bp, Homo sapiens
acgcccacagcatggccctgccagccctggagccctccaccaggtactgggccagggtgagggtcaggacctcccgcaccggctacaacgggatctggagygagtggagtgaggcgcgctcctgggacaccgagtcgggtaggtgaaggctggagtccagagcttctggccaggaccagctcatagtttctcactgccaga

SEQ ID NO: 59899 - DNA, 201 bp, Homo sapiens
tacaacgggatctggagtgagtggagtgaggcgcgctcctgggacaccgagtcgggtaggtgaaggctggagtccagagcttctggccaggaccagctcayagtttctcactgccagaaaatccccaatgcagcagccgtagcaggcctgcaacaacttgtaggtgagccgtctccccgattagatggtggccaaagagaa

SEQ ID NO: 59900 - DNA, 201 bp, Homo sapiens
tattctcccaggttatgacttatctttttctttaccatgtttaagatgtcttatgtcatataaaaatgttttcattgttaagtcaaacctgtcattacttyttactttatggtttctgattttggtgtcttgtaaacctctaagatcacaggtgtcttgtaaacctctttttactttatggtttctggttttgtgtcttga

SEQ ID NO: 59901 - DNA, 201 bp, Homo sapiens
cttcaggactcttgggaggtaggaaccacggccagctctgccccagcccgaagggatgggcagcacccctcctccagcacccactgtctcctgacaggacrcagccatcctcctctccaacacctcccaggccaccctggggccagagcacctcatgcccagcagcacctacgtggcccgagtacggacccgcctggcccc

SEQ ID NO: 59902 - DNA, 201 bp, Homo sapiens
ggaaacaatgaaaatgcgatacgaacacatagaccacacatttgagatccagtacaggaaagacacggccacgtggaaggtgagggcctttgcccagggasgggagaaacactggggagggcgggagaagggaaagcaaccagaggcattccacctgcaaggcgtcgggcccttggcaggtgaccagtgagaggtagccac

SEQ ID NO: 59903 - DNA, 201 bp, Homo sapiens; identical to SEQ ID NO: 17311

SEQ ID NO: 59904 - DNA, 201 bp, Homo sapiens
cacacggtgggcacccactgagagctatgggagggatgaatgacggagtacatgaggacctgtctccaacccaggggatgaggcccagccccagaacctgsagtgcttctttgacggggccgccgtgctcagctgctcctgggaggtgaggaaggaggtggccagctcggtctcctttggcctattctacaagcccagccc

SEQ ID NO: 59905 - DNA, 201 bp, Homo sapiens
acctcatgcccagcagcacctacgtggcccgagtacggacccgcctggccccaggttctcggctctcaggacgtcccagcaagtggagcccagaggtttgytgggactcccagccaggtaatgttgccagagcccaggaaatgccccgtggtgggagggcaggctcatcaggagctcctggcacagcagggttcctgggct

SEQ ID NO: 59906 - DNA, 201 bp, Homo sapiens
taccaggatggatggggtgtcaggaggcagaagggctccccaaggacaagatacctgggctgagctttgagggtcccagtggtgccaggtggcaaaagttkctctggctcagggcatcttgagggtggagacagaaacccttcaggaagggagctgaaggggtgggacaggaggctgggggccatgttgggaggctgagat

SEQ ID NO: 59907 - DNA, 201 bp, Homo sapiens
gaggcccagagctgggtgcggtgtggcttgagaagctcactttgaacttgagaaagagcccagcactttgcccagagacataccaggcactatccagcaatctctctctctctctctctctctctcagtctctctctctgtctgtctgtctttttagttatgacactctgccctgctgatttgggttgctgatttgggttg

SEQ ID NO: 59908 - DNA, 201 bp, Homo sapiens; identical to SEQ ID NO: 17319

SEQ ID NO: 59909 - DNA, 201 bp, Homo sapiens
aggcccagagctgggtgcggtgtggcttgagaagctcactttgaacttgagaaagagcccagcactttgcccagagacataccaggcactatccagcaatctctctctctctctctctctctctcagtctctctctctgtctgtctgtctttttagttatgacactctgccctgctgatttgggttgctgatttgggttgg

SEQ ID NO: 59910 - DNA, 201 bp, Homo sapiens
actgggaccttgtcagacaggtgctagcgacaagctgcatatgtgcaatttttagtcttcaaaaaccctgctgttatatttttgtacagcccaattctaatttttttctatcatctttcctgctttgtaatcattttataatgagtaaacatttcctattagcttttggtcactctttttttcatccagcagttttattta

SEQ ID NO: 59911 - DNA, 201 bp, Homo sapiens
tcattacttcttactttatggtttctgattttggtgtcttgtaaacctctaagatcacaggtgtcttgtaaacctctttttactttatggtttctggtttkgtgtcttgaaacctctaagattacagaaagagttttaataattttactattttggttttgactttgagatttttagcccacctagaatttagagaagtga

SEQ ID NO: 59912 - DNA, 201 bp, Homo sapiens
ttgtgtgtatacatgtgggtatgtgtgtgcatgttttgtgtgtacgtgtatatatgtatgtatctgtgtgtgtctgtgtgttgtgcgtgtgtgtgcctgcrtgtgtccgtgtgcttgtgtgtgtgtgtgtgtttgcatgggcatcttgagtgaagcttccaacaatctaacagaagaaaaggagccacacttgtctgttct

SEQ ID NO: 59913 - DNA, 201 bp, Homo sapiens
atcccagcactttgggaggctgaggcaggcagatcccttgaagttggacgttcaagaccagcctggccaacacggtgaaaccccatgtctactaaaaataygaaaaattagccgggtttggtggtgtgcacctgtaatcccagctacttgggatgctgaagtgggagaactgcttgaacccaggaggcaaagtttgcagtg

SEQ ID NO: 59914 - DNA, 201 bp, Homo sapiens
ttttgttttgttttgttttgtttttgtgacagagttttactcttgtcgcccaggctggaatgcagtggtgcaatcttggctcactgcaacctctgcctccygggttcaggtgattctcctgcctcagcctcctgagtagccgggattacaggcatgagccaccacacgtggctaatttttgtatttttagtagagacaggg

SEQ ID NO: 59915 - DNA, 201 bp, Homo sapiens
tgagccgagatcatgccattgcactccagcctgggtgatggggtgagattctgtctcaaaaaaaaaaaatagtattttttttaaagaaaccatatttgctrccagcatttgggtttatttagcacatatatgatcttccaaaacaagaggagatctttagcaagttttcagttctcttccattctccaccccagcctcaca

SEQ ID NO: 59916 - DNA, 201 bp, Homo sapiens
gctgtcacctccgtggtgtcttccaggctgcgcagaaagtgggaggagaagatccccaaccccagcaagagccacctgttccaggtaggaactggctgcgwggggcggagtgggggcttctctgttcctgcctctcttgtctctgtccccacctcctccttcccttcctgtgggctttgggtggtagggatgtaggtggac

SEQ ID NO: 59917 - DNA, 201 bp, Homo sapiens
ggaatgcagtggtgcaatcttggctcactgcaacctctgcctcccgggttcaggtgattctcctgcctcagcctcctgagtagccgggattacaggcatgmgccaccacacgtggctaatttttgtatttttagtagagacagggtttcaccatattggccaggctggtctcgaactcctgacctcagatgatccgcctgt

SEQ ID NO: 59918 - DNA, 201 bp, Homo sapiens
ttctcttccattctccaccccagcctcacagcaaactcccacattaaaatcatctgagttttagttcaatattcttctttaacttatctgtaagtgttacwggtttatttacctcagtatttcagctttcttggatttttttttcctgaaatataacctagagtaatttctttcagaaaagatctgaaaaactttctttgt

SEQ ID NO: 59919 - DNA, 201 bp, Homo sapiens
cggggagcttagtaggagtcaaatcctaggcccccgtctcagctgctctgctgtctagcgcattgtgcagtggtaggtgtcagtgatccaagtggggaccyagtccctcaggccacacagcgcatgtccattgccttcatgccgcaggagactgaggggtcatgcatgagggccacttctctgggttgtccccacaacacg

SEQ ID NO: 59920 - DNA, 201 bp, Homo sapiens
tccattctccaccccagcctcacagcaaactcccacattaaaatcatctgagttttagttcaatattcttctttaacttatctgtaagtgttacaggtttmtttacctcagtatttcagctttcttggatttttttttcctgaaatataacctagagtaatttctttcagaaaagatctgaaaaactttctttgtccttac

SEQ ID NO: 59921 - DNA, 201 bp, Homo sapiens
cctcagtatttcagctttcttggatttttttttcctgaaatataacctagagtaatttctttcagaaaagatctgaaaaactttctttgtccttacatacycaaaattttttgtgtcctttaaatgtcaaagaaaacttggcattttgtgattctaggtttaagcataattttcccttggtattttcaagacatctattta

SEQ ID NO: 59922 - DNA, 201 bp, Homo sapiens
gtcaaagaaaacttggcattttgtgattctaggtttaagcataattttcccttggtattttcaagacatctatttaaagttcagagtctcttatgtgaaayctttagccaatctgacccttgttgcattcaaagtatcctatttgttttcttctggaagcatttctgggatcatcctcatattcttgcaagacgaaaagtt

SEQ ID NO: 59923 - DNA, 201 bp, Homo sapiens
gtgagtcccgtggctcccacccacttccctgtccctgtcctcactgctgcaccctgggggagggccgcagcgtatcctcaggatcctgcccgccagccctyctcctgctcccctccctctgtctctccccctggccttccctgggcctcccccgcttccctcctcctgcacattcctgctcatcctgtcttggaaagtcca

SEQ ID NO: 59924 - DNA, 201 bp, Homo sapiens
atgtgaaatctttagccaatctgacccttgttgcattcaaagtatcctatttgttttcttctggaagcatttctgggatcatcctcatattcttgcaagasgaaaagtttaccagtgagaactaggcatggctttattaaaaggaatcttgggagttaaccctgatctctgtcccctactacaaaacctcatcgtagtagc

SEQ ID NO: 59925 - DNA, 201 bp, Homo sapiens
caggcctggaggaggcagaggccaggagggagaggtcccaagagcctgtgaaatgggtctggcctggctcccagctgggcaggaacacaggacttcaggayactaaggaccctgtcatgcccatggccagcacccaccagtgctggtgcctgcctgtccagagctgaccagggagatggtgctggcccaggggctgctctc

SEQ ID NO: 59926 - DNA, 201 bp, Homo sapiens
tgggctaagccgtgtcctctcccaacagggacctcctggagccagtgtcctgtgacctcagtgatgacatgccctggtcagcctgcccccatccccgctgygtgcccaggagatgtgtcattccctgccagagttttgtcgtcactgacgttgactacttctcattccaaccagacaggcctctgggcacccggctcaccg

SEQ ID NO: 59927 - DNA, 201 bp, Homo sapiens
cttgttgcattcaaagtatcctatttgttttcttctggaagcatttctgggatcatcctcatattcttgcaagacgaaaagtttaccagtgagaactaggyatggctttattaaaaggaatcttgggagttaaccctgatctctgtcccctactacaaaacctcatcgtagtagcctccccccttgaatacagattcctta

SEQ ID NO: 59928 - DNA, 201 bp, Homo sapiens
tggggcatctcccaaaggtgacctcaagcccacaattcccctaagctccagccctccaggcgtactggcctctccacctgtcacttagacaacaggtgtcyccgactccaaacgtcctcaaccaaagtcccgctctcacccgagctgcgctgctgcctctgtcttccccatctccctttctaaatgggagctcctagtggc

SEQ ID NO: 59929 - DNA, 201 bp, Homo sapiens
ctttattgagtggcctcttgtctccttgaaagccctgtgaagctttccccatttgctgttgtatctgtttggctgcacatggaaaatccctaagcaacagwggcttaacaacatagaagtttctttttcccagcatataaaagatgcccagaggtagcagtttcaggctagtatggttgctccagagtgagagtgggaatc

SEQ ID NO: 59930 - DNA, 201 bp, Homo sapiens
agctaaacctgaaaagggacacgttttatgaaagttttcgttgacgtggcaaaaacccatgctggtggcaggctggtaggaggtactgcaggctgtcattgggagtctcagaaccacggcaggcttggtgctgttattggtgcctttggctgctgctgaaacggagacagagggaggtgactagtccaaggcctctctact

SEQ ID NO: 59931 - DNA, 201 bp, Homo sapiens
gggggacatcagggcttccagagaaccatctccaccccaccaagacccttgtgcctgacccggatcatctgcccagggtggtcccaactcttctgcccatkttcttcccacagggtgttccctgtaggattcggggacagcgaggtgtcacctctcaccatagaggaccccaagcatgtctgtgatccaccatctgggcct

SEQ ID NO: 59932 - DNA, 201 bp, Homo sapiens
gcgcatgtccattgccttcatgccgcaggagactgaggggtcatgcatgagggccacttctctgggttgtccccacaacacgggcggtgtccctgggacaygtggaaggggaggggcagctcactgctgacatctccttctgcaggcctggaggaggcagaggccaggagggagaggtcccaagagcctgtgaaatgggtc

SEQ ID NO: 59933 - DNA, 201 bp, Homo sapiens
agcacaagagacaaagtccccagcaatttcttttccctagttccatagcttattcttttcaccacatgtattcttccagaacattttctaagcatgatacragcatatagtttttcttttcctgtttgttttttgttttgttttgttttgtttttgtgacagagttttactcttgtcgcccaggctggaatgcagtggtgc

SEQ ID NO: 59934 - DNA, 201 bp, Homo sapiens; identical to SEQ ID NO: 17312

SEQ ID NO: 59935 - DNA, 201 bp, Homo sapiens
ccacttccctgtccctgtcctcactgctgcaccctgggggagggccgcagcgtatcctcaggatcctgcccgccagccctcctcctgctcccctccctctrtctctccccctggccttccctgggcctcccccgcttccctcctcctgcacattcctgctcatcctgtcttggaaagtccagctgagcgtgtctggcttcc

SEQ ID NO: 59936 - DNA, 201 bp, Homo sapiens
gggctgagaataattttattgagtgatgaagatggctttccgtggaaaggggattcaggggtgggaggtggggtgtagggggaggttttgccacgtggctyggtctggggccctttatggattcaaaatgaggagtgtatgctgattggtttgtgagtatgcaaaaaaggttaaagtgacaacaccactcaaagctgtgca

SEQ ID NO: 59937 - DNA, 201 bp, Homo sapiens
gctgtgcagaggttgtgcgttagaaattataataggtattgtcaaatcagcctcaaagtagctgagctaagctgacgtccccaaggtagtgcataaagggkccaatttacctttagagaaattatcaatcttctaattttgtccaatattatgtatggaaattctcaatgtcgcgtgatttttttctttccctgattatgg

SEQ ID NO: 59938 - DNA, 201 bp, Homo sapiens; identical to SEQ ID NO: 17313

SEQ ID NO: 59939 - DNA, 201 bp, Homo sapiens
ctgacgtccccaaggtagtgcataaagggtccaatttacctttagagaaattatcaatcttctaattttgtccaatattatgtatggaaattctcaatgtygcgtgatttttttctttccctgattatgggtgaagttgtacattttctatatgtggattggccttttggatttcatttatgatgaatgtggagaaatttt

SEQ ID NO: 59940 - DNA, 201 bp, Homo sapiens; identical to SEQ ID NO: 17316

SEQ ID NO: 59941 - DNA, 201 bp, Homo sapiens
ccagagccactggttgtccccaggggatctggagtttgaggtggtctacaagcggcttcaggactcttgggaggtaggaaccacggccagctctgccccascccgaagggatgggcagcacccctcctccagcacccactgtctcctgacaggacgcagccatcctcctctccaacacctcccaggccaccctggggccag

SEQ ID NO: 59942 - DNA, 201 bp, Homo sapiens; identical to SEQ ID NO: 17320

SEQ ID NO: 59943 - DNA, 201 bp, Homo sapiens
ttcagaccaatgcccttcccagcatggatctggcctctctcccctaatcccccaaggcagtaagttccagagccctgggcctgcacagagcggggtcttarggaatactgcaccaaccccactccctgccctgaggtcgatttcccgcccagatgctgacattcctctttctccccggctgctggaagtgctgcctatgtg

SEQ ID NO: 59944 - DNA, 201 bp, Homo sapiens
tccctgcacttgctgcgtgcactgacccctcacctttcaccatagtgaccaccaggcgactcccgcagaacaagacaagtccaaggggtggtttcagagasagtaaggatacaggagatattgggagcaacccaagtccccagccaggcttggtagcggcaggggcccagggagagggccacaaccaggtagaaaggaggc

SEQ ID NO: 59945 - DNA, 201 bp, Homo sapiens
gttttaaccttttaaagtaaaagacactaacctgtcctccataattctggttggtatggtctatatgttgaagtgcacccaagtttatgttgcaacctaakccccaatgtgagaatatctggaggtagtgcctgtggcaccctataaaataccccagcgagctcccttgcttattccatgtgagattatagggagaagact

SEQ ID NO: 59946 - DNA, 201 bp, Homo sapiens; identical to SEQ ID NO: 17322

SEQ ID NO: 59947 - DNA, 201 bp, Homo sapiens
gttgcaacctaagccccaatgtgagaatatctggaggtagtgcctgtggcaccctataaaataccccagcgagctcccttgcttattccatgtgagattayagggagaagactgcaaggaacaggccctcaccagatagtgaatctgcccgcaccttgatcttgaacttcccagcctccagaactatgagaaataaacttt

SEQ ID NO: 59948 - DNA, 201 bp, Homo sapiens; identical to SEQ ID NO: 17323

SEQ ID NO: 59949 - DNA, 201 bp, Homo sapiens
tgtgtgtacgtgtatatatgtatgtatctgtgtgtgtctgtgtgttgtgcgtgtgtgtgcctgcgtgtgtccgtgtgcttgtgtgtgtgtgtgtgtttgcrtgggcatcttgagtgaagcttccaacaatctaacagaagaaaaggagccacacttgtctgttctgctctcttgggtacttcccagaccagtgaaatgaaa

SEQ ID NO: 59950 - DNA, 201 bp, Homo sapiens
ccgccagccctcctcctgctcccctccctctgtctctccccctggccttccctgggcctcccccgcttccctcctcctgcacattcctgctcatcctgtcytggaaagtccagctgagcgtgtctggcttccttgcccacatttctcagggcggcactcccggcccctaggctccaggatggctgctctggccgtttccct

SEQ ID NO: 59951 - DNA, 201 bp, Homo sapiens
ctgggggagggccgcagcgtatcctcaggatcctgcccgccagccctcctcctgctcccctccctctgtctctccccctggccttccctgggcctcccccrcttccctcctcctgcacattcctgctcatcctgtcttggaaagtccagctgagcgtgtctggcttccttgcccacatttctcagggcggcactcccggcc

SEQ ID NO: 59952 - DNA, 201 bp, Homo sapiens
ctgcagggccttggctggggttctctccctgcttcagccgctagcaccctccttgtgcctgaagcccgcactgggatgctcctgggctcttgaggtgaaayggcccctcccaagggctcccagagacctggcttctgtgataatgctgggaccacagtccccttaacaaataccaggctcctgaggacggggactagagag

SEQ ID NO: 59953 - DNA, 201 bp, Homo sapiens
ccacgctgcatcccagggctgagtgtgtgccccctcccaggctgcacagtcggtccaggggccaggcctgtgcttgatgcatgtccctgtcctggggtggrgggaggggaccgtgcccaggaacagcacactgcggaggcccagaaaccatgctgagaaccaacagaatgtcttgcttctgccaggagaggagggtccgca

SEQ ID NO: 59954 - DNA, 201 bp, Homo sapiens
cttgatgcatgtccctgtcctggggtggggggaggggaccgtgcccaggaacagcacactgcggaggcccagaaaccatgctgagaaccaacagaatgtcktgcttctgccaggagaggagggtccgcaaccaggagcccaccccggcagacatgaacacatgtacatgtgcctggccacctggtgcctctgcagggacct

SEQ ID NO: 59955 - DNA, 201 bp, Homo sapiens
gggggtaaagggcagggcccctgggagatcagaacaggcttcccagagggaagagctttgcaactcagatctgaagggtagacaggaggggagggcagtaagagcctctctggcagggtaacagctgtgcagaggctgggggatcagaagggcatgggcagctggggaacctgctcaccattgtgtccagggagcatcagc

SEQ ID NO: 59956 - DNA, 201 bp, Homo sapiens; identical to SEQ ID NO: 17372

SEQ ID NO: 59957 - DNA, 201 bp, Homo sapiens
attacctccacctggtctctcccttgacatgtagggattatagggattataattcaagatgagatttgggtggggacacaaagtctaaccatatcaccaayttagtatgccattgtactatattaatcaattttttaaaatcttttggattttgtttacctagttgatttcattgtggctatttttatttcatcataaagc

SEQ ID NO: 59958 - DNA, 201 bp, Homo sapiens
ccttaaattatatggggcctttgggccattgcaaggttttaggagtttattctgagagagaaataaaaccacagaggcttctgagggaggtgtcacctgayctgacttccattttaacactctccttctggctgctctatggggaatactctaaatggggcaaagggcacaagcagggagaccatggaagaagtcattata

SEQ ID NO: 59959 - DNA, 201 bp, Homo sapiens
acactggaaggacttagattatcactcaacaattaatattgttttaggagagatggagccagggccactctgctcaaggtaggtgacacagtgagtccttytttttccctccttcacaaagtctcgttttctagtgccttcatacagagttgtactgggtgctttgaaggtactcccaatattagagtctgctttatacaa

SEQ ID NO: 59960 - DNA, 201 bp, Homo sapiens
ccagtagtgtttctatagggatgaattatgtaacaggaagttccgatttaatccattattattaatatacacaagaatgtgtattaaagtgaatttattcrattcataatagcaccaacaaaaatcctggacccaaagccaaaaccaacaacaacaacaaaagggattgtcacattttatgggaacagttcagattcacac

SEQ ID NO: 59961 - DNA, 201 bp, Homo sapiens
aaccttcaattttctaaccatgccacctgtatggcagcccgcagcaccagaccttcagttagacctgtaaaacagatctgagattcctggaactagaaagytccaacctggcatagcgtaaagagacttggaaaaatggaataaagccacttttgctcaagattgagtggcagattaactcaccttaatgcttttggtaat

SEQ ID NO: 59962 - DNA, 201 bp, Homo sapiens
accatatcataccactctcagctgactagatggcaaggtagtcaacccttctagataattgttttaagtaggatcttccttgtatatgtagatttcttggygaaagcaattctgtctcttgaatgtcagcaaagtaagcatcagaaggtgactgaggagaggtgaaaagggattattccaaatgttgtggtctattccccc

SEQ ID NO: 59963 - DNA, 201 bp, Homo sapiens
taatttaaaatggttaataatcatagctaaagacttcttttaaaatcttctgggagtcagattgttttgaggttactttttgcaaagaatgaggaactcamttgtgcctggagaaatgacaacttcgtggaacgttttcctccctttctttggacagagcttaaccttggctttggacaccagttgttgagtaggcattgc

SEQ ID NO: 59964 - DNA, 201 bp, Homo sapiens
gtaactaacctgcacattgtgcacatgtaccctaaaacttaaagtataataataataataaataaataaataaaatagatctattttattagaaaaaaaaataaaataggtctattttattagaaaaaaaaaagaatctttgacctaatacattattaaaagaaaaacctttatcaagaaatgcaattgaaaatgaagttt

SEQ ID NO: 59965 - DNA, 201 bp, Homo sapiens
atattaatcaattttttaaaatcttttggattttgtttacctagttgatttcattgtggctatttttatttcatcataaagctgctatttatttcaagtargccacaaaatttccttattttacagttttcaaagtgctttctcaaatgtgcattattcagatccctgtaagccaggtattatttttaccatttttagatg

SEQ ID NO: 59966 - DNA, 201 bp, Homo sapiens
ctaatttaaaatggttaataatcatagctaaagacttcttttaaaatcttctgggagtcagattgttttgaggttactttttgcaaagaatgaggaactcmcttgtgcctggagaaatgacaacttcgtggaacgttttcctccctttctttggacagagcttaaccttggctttggacaccagttgttgagtaggcattg

SEQ ID NO: 59967 - DNA, 201 bp, Homo sapiens
aaaacatgtggaaaaatgctcaccatcactggccatcagagaaatgcaaatcaaaaccacaatgagataccatctcacaccagttagaatggcaatcattraaaagtcaggaaacaacaagtgctggagaggatgtggagaaataggaacacttttacactgttggtgggactgtaaactagttcaaccattgtggaagtc

SEQ ID NO: 59968 - DNA, 201 bp, Homo sapiens
tctaatttaaaatggttaataatcatagctaaagacttcttttaaaatcttctgggagtcagattgttttgaggttactttttgcaaagaatgaggaactyacttgtgcctggagaaatgacaacttcgtggaacgttttcctccctttctttggacagagcttaaccttggctttggacaccagttgttgagtaggcatt

SEQ ID NO: 59969 - DNA, 201 bp, Homo sapiens
ttttgcaacctactcatctgacaaagggctaatatccagaatctacaatgaactcaaacaaatttacaagaaaaaaacaaacaaccccatcaaaaagtggrcaaaggacaggaacagacacttctgaaaagaagacatttatgcagccaaaaaacatgtggaaaaatgctcaccatcactggccatcagagaaatgcaaat

SEQ ID NO: 59970 - DNA, 201 bp, Homo sapiens
cctgagaaaaacaagaaatggggaagggattccctatttaataaatggtgctgggaaaactggctagccatatgtagaaagctgaaactggatcccttccytacaccttatacaaaaattaattcaagatggattaaagacttaaacattagacctaaaaccataaaaaccctagaagaaaacctaggcattaccattcag

SEQ ID NO: 59971 - DNA, 201 bp, Homo sapiens; identical to SEQ ID NO: 17370

SEQ ID NO: 59972 - DNA, 201 bp, Homo sapiens
caaaccactgctcaaggaaataaaagaggatacaaagaaatggaagaacattccatgctcatgggtaggaagaatcaatatcatgaaaatggccatactgsccaaggtaatttatagattcaatgccatccccatcaagctaccaatgactttcttcacagaattggaaaaaactactttcaagttcatatggaaccaaaa

SEQ ID NO: 59973 - DNA, 201 bp, Homo sapiens; identical to SEQ ID NO: 17371

SEQ ID NO: 59974 - DNA, 201 bp, Homo sapiens
taccagtctgtgtcttttaattggagcatttagtccatttacatttaaagttaatattgttatgtgtgaatttgatcctgtcatgatgatgttagctggtyattttgctcattagttgatgcagtttcttcctagtctcgatggtctttacattttggcatgattttgcagcagctggtaccggttgttcctttctatgtt

SEQ ID NO: 59975 - DNA, 201 bp, Homo sapiens
cagtcatttttactttaatgtatttacatttttcctatgctaatttttgaattgaattaattaatacgtgtatttgatgtatcaaacagtattactggtcrtggagtactggctgatggcaccaccagatttacatgcaagggcaaaccagtccaccacttcatgaacaccagtacatttaccgagtacacagtggtggat

SEQ ID NO: 59976 - DNA, 201 bp, Homo sapiens; identical to SEQ ID NO: 17374

SEQ ID NO: 59977 - DNA, 201 bp, Homo sapiens; identical to SEQ ID NO: 17375

SEQ ID NO: 59978 - DNA, 201 bp, Homo sapiens
acttaattcaatttagtttggttcaaatggctttctaaggcttatctgaagtggtgatattggtatgaaaatatcacaagaatttcccttgtattttagtscatggtacactaaaaatgccacaaacactgaccacattgattgctgtttctgccttaaagggcaaatgtgtatagaaatttaattaaggactaaagttgc

SEQ ID NO: 59979 - DNA, 201 bp, Homo sapiens
caagtatgaattcatgcaaattttatctacaacatctacctcatggaggtctcaaacagcaatcaaaaagcctgtctacaagatgaaatgactttcactcrttgggcctataaataattattgagcttccactatgtgccaaggacgtggatttcattagtaaaaggaactgtatattgagatccaaatttttactaattt

SEQ ID NO: 59980 - DNA, 201 bp, Homo sapiens
atttccttattttacagttttcaaagtgctttctcaaatgtgcattattcagatccctgtaagccaggtattatttttaccatttttagatgaagaccaakgttgtgaaagcaaataaataactggtcaaacctcctggggtagtgccaggatataaactaattgcaaaacttgtgctcttttgaccatataacaaacttc

SEQ ID NO: 59981 - DNA, 201 bp, Homo sapiens
ttttcatactactataaaaaaaaaaaactgcccgagactgggtcatttataaagcaaacagattcaattgactcacagttcagcatggctgggggcttcargaaacttataatcatggtggaaggcaaagaggaagcaaggcaccttcttcacaggctgcaggaaggagaagtgtcgagcaaagcgggaagagccccttac

SEQ ID NO: 59982 - DNA, 201 bp, Homo sapiens
tgagggaggtgtcacctgatctgacttccattttaacactctccttctggctgctctatggggaatactctaaatggggcaaagggcacaagcagggagascatggaagaagtcattataatgctggaaggaaaggatgctggcttggagtgatggggctggtgagaagtagtcagctcttggatacattttgaagataga

SEQ ID NO: 59983 - DNA, 201 bp, Homo sapiens
tggaaaacttaaaatattatatatgctcttctgttcatatttatactagtcagggagtctgtaagttaaaggcataattcagacccattataatacttgcytatttcttaggttattaaatgcaaagcagctgtgctttgggagcagaagcaacccttctccattgaggaaatagaagttgccccaccaaagactaaagaa

SEQ ID NO: 59984 - DNA, 201 bp, Homo sapiens
atcctgtgaccacttttggatggggttcttcattttttttcttgtatatttgtttaagttccttgtaaattctgcatattagacctttgtcagatgagtasatcacaaaaatctcctcccattctgtaggttgcctgttcactctgacgatagtttcttttgctgtgcagaagctctttagtttaattagatcccatttgt

SEQ ID NO: 59985 - DNA, 201 bp, Homo sapiens
tgaattaattaatacgtgtatttgatgtatcaaacagtattactggtcgtggagtactggctgatggcaccaccagatttacatgcaagggcaaaccagtmcaccacttcatgaacaccagtacatttaccgagtacacagtggtggatgaatcttctgttgctaagattgatgatgcagctcctcctgagaaagtctgtt

SEQ ID NO: 59986 - DNA, 201 bp, Homo sapiens
tgtcgcacagatgaccatgtgataaaaggaacaatggtgtccaagtttccagtgattgtgggacatgaggcaactgggattgtagagagcattggagaagsagtgactacagtgaaaccaggtatatgcaggtgtcaaaccacaagtttgaaataattaggctttgattagcctatcaaaggaaatagcacacactaggaa

SEQ ID NO: 59987 - DNA, 201 bp, Homo sapiens
attagagggatccttaacacaattcagggaattaaaaggatacaagaatggattttactgagtaatgtttaatttggcaaaacctcaacctttagaaggcraaccttacggtgtttataaaccttagaatatatttttaaaagttttacctatagtatgggctcaattcacatttgttaatttcatattttaacattaatg

SEQ ID NO: 59988 - DNA, 201 bp, Homo sapiens
ttgttcagtttccatgtagttgagcggttttgagtgagtttcttaatcctgagttctagtttgattgcactgtggtctgagagacagtttgttataatttstgttcttttacatttgctgaggagagctttacttccaactatgtggtcaattttggaataggtgtggtgtggtgctgaaaaaatgtatattctgttgatt

SEQ ID NO: 59989 - DNA, 201 bp, Homo sapiens
gtcattcaggagcaggttgttcagtttccatgtagttgagcggttttgagtgagtttcttaatcctgagttctagtttgattgcactgtggtctgagagayagtttgttataatttctgttcttttacatttgctgaggagagctttacttccaactatgtggtcaattttggaataggtgtggtgtggtgctgaaaaaat

SEQ ID NO: 59990 - DNA, 201 bp, Homo sapiens
aatttctctctacacactgctttgaatgtgtcccagagattctcgaatgctgtgtatttgttttcattggtttcaaagaacatctttatttctgccttcawttcgttatgtacccagtagtcattcaggagcaggttgttcagtttccatgtagttgagcggttttgagtgagtttcttaatcctgagttctagtttgatt

SEQ ID NO: 59991 - DNA, 201 bp, Homo sapiens
tatgtgtcaaggaatttatccatttcttctagattttctagtttatttgcgtagaggtgtttgtagtattctctgatggtagtttgtatttctgtgggatyggtggtgatatcccctttatcattttttattgcatctatttgattctcctctctttttttctttattagtcttgctagcggtctatcaattttgttgatc

SEQ ID NO: 59992 - DNA, 201 bp, Homo sapiens
aagtaaattggagttcaaggaattaagaatctttgacctcttattattttgagatacgtcccatcaatacctagtttattgagagtttttagcatgaagcrttgttgaattttgtcaaaggccttttctgcatctattgagataatcatgtggtttttgtctttggttctgtttatatgcagattacatttattgatttgc

SEQ ID NO: 59993 - DNA, 201 bp, Homo sapiens
gttcttttctttgtgtccataggtactcaatatttagcttccacttataagtgagaacatgtagtatttagttttctgtttctgcattcgtttgctcaggrtaatggcctccagctccttccatgtccctgcaaagaatatgatcttatttttttatggctgcatagtattctgtggcaaatatgtaccacattttcttta

SEQ ID NO: 59994 - DNA, 201 bp, Homo sapiens
aggatgggtaacgggcagtgccagaggactggggtggaggtggaggtgaatgctattttataaagttcaaggaaggcctccttgataaggtaacattggarcaaaaacataaataagatattcagaaatcttgggaaagaatattccaggaaggagacgtagtaaatacaacagggtgttggcaagaaccataagaacggg

SEQ ID NO: 59995 - DNA, 201 bp, Homo sapiens
aatgaatgcagaatataccataaggttacaagtgcaaaggataataataaaggatgggtaacgggcagtgccagaggactggggtggaggtggaggtgaawgctattttataaagttcaaggaaggcctccttgataaggtaacattggagcaaaaacataaataagatattcagaaatcttgggaaagaatattccagga

SEQ ID NO: 59996 - DNA, 201 bp, Homo sapiens
gtatggcagcccgcagcaccagaccttcagttagacctgtaaaacagatctgagattcctggaactagaaagctccaacctggcatagcgtaaagagactwggaaaaatggaataaagccacttttgctcaagattgagtggcagattaactcaccttaatgcttttggtaatttaagaataaatagtccttaatttatca

SEQ ID NO: 59997 - DNA, 201 bp, Homo sapiens
ggcttgcagaccattgcaaagttgtgacggctgtgagtcatattgctgaaggtggaactctgaagccagactatctatgtgaaggcacaagctgctgttayatacaacagagtgaactgagcatcagtcagaaaaagtctatgtttgcagaaatacagatccaagacaaagacaggatgggcactgctggaaaagtaagtg

SEQ ID NO: 59998 - DNA, 201 bp, Homo sapiens
catactgaaattatactgatgctttcagaattagctcagatacccttatcagagttgcgtaacaaagaaaactaattgttaaggactttgagcccagaggwtttccaataacagaatttacttgaagtttctatgacagatagaaaggacaattgtttaaactatcctttcttgaaagatatgaaaacaagtcattaaaaa

SEQ ID NO: 59999 - DNA, 201 bp, Homo sapiens
aactatcctttcttgaaagatatgaaaacaagtcattaaaaactctcattttacatttcagcattcgaacggtcctgacgttttgagatccaaagtggcargaggtctgtgttgtcatggtgaactggagtttctcttgtgagagttccctcatctgaaatcatgtatctgtctcacaaatacaagcataagtagaagatt

SEQ ID NO: 60000 - DNA, 201 bp, Homo sapiens
tatctccacacctagtgtccactactataagatgacaagctttaacctgcctatcaagccctaccaggtgcaagaactgggctaggtgcaaatgggatgcwgagatgcagacacaaattcaatcatccaggaactcacagtcataatctgtatgcttcatgatgttcatggttctcttcatccttaccatgctaatagtct

SEQ ID NO: 60001 - DNA, 201 bp, Homo sapiens
tgggttttccactggatatggcgctgctgttaaaactggcaaggtaagaaacagggtaggctagtttatttgttcttctttccttttcttaaatgatttgyttggaatcttgaagagttttggaaaaaaaaaaaacatttaaaagaatgtattgcatattcaggctgccaagcaacacaatgccaaatcaactaaaagaaa

SEQ ID NO: 60002 - DNA, 201 bp, Homo sapiens
cattaaggtaagcgtgagccctagagaacttaagccaaaagcgttatcaaacttatattgaatatagcactgttgtgaggctggattcttaaataaggagrtgcttcccatgtttggagtattaattcctttactggctcttatatattgttaaggatctggttgtactcgatgtgaaattaatgagttcattatcctttt

SEQ ID NO: 60003 - DNA, 201 bp, Homo sapiens
tgacatctgctatatagagaggtttttctaaaattaatatttcttcgaggtagcctttaaaaatggaattacatgggtaaacatgccacaacatccttaawtatcttgatgtaccatgcaaattactttctaaagggttgacataggtaagatggcccattttaccatttatctgacaatactgtgtattctcattaagtt

SEQ ID NO: 60004 - DNA, 201 bp, Homo sapiens
ggagatattccttgaggaatgaaatgcttggtgagcaggcatacagtgagggaaacactggatatggtgtttcagagaatgtcagtggaagcaggggtaarttggaaatagtatatccaatgtcagcaagacattggtggaaaatagagaaattgatttatattggcattattcataatttgatttccggatagctgggca

SEQ ID NO: 60005 - DNA, 201 bp, Homo sapiens
tgtgtgcttatttgcaggtttgaaaagcagagatgatgtcccaaaactagtgactgagttcctggcaaagaaatttgacctggaccagttgataactcatrttttaccatttaaaaaaatcagtgaaggatttgagctgctcaattcaggacaaaggtaactgtttcttatgatgatcttgtctcttctccacaggctact

SEQ ID NO: 60006 - DNA, 201 bp, Homo sapiens
aaagggcaaatgtgtatagaaatttaattaaggactaaagttgcactgaaatttttttaaagcaagtaaaaaacaaggtggcttaatttaatttcatgacyttgtcatagtacataggtcatttcagagcttatgtcacactgtaagagacacaggaagcaaacgatctcctccgttttaaactcagattgatgccctggc

SEQ ID NO: 60007 - DNA, 201 bp, Homo sapiens
catgggagaacaaagtttttcctctttctgcaacattacttggggcataaaaaagcaagaggctagttggtatggatgaggttttatagagaaggcttttyagggaaaatgaaacttgaagaacaaaacaataagagatataagaagttgaacctccttgctttgactatttgtgggaagtgggaagattatagattattc

SEQ ID NO: 60008 - DNA, 201 bp, Homo sapiens
agggcaaatgtgtatagaaatttaattaaggactaaagttgcactgaaatttttttaaagcaagtaaaaaacaaggtggcttaatttaatttcatgacttkgtcatagtacataggtcatttcagagcttatgtcacactgtaagagacacaggaagcaaacgatctcctccgttttaaactcagattgatgccctggcat

SEQ ID NO: 60009 - DNA, 201 bp, Homo sapiens
agaaaaagtctatgtttgcagaaatacagatccaagacaaagacaggatgggcactgctggaaaagtaagtggaacatttctgtcccctcctcatcatgayctaatgatgtgaggctgatacttagaactttgaatccattaaagtaattaaacacttggagatattccttgaggaatgaaatgcttggtgagcaggcata

SEQ ID NO: 60010 - DNA, 201 bp, Homo sapiens; identical to SEQ ID NO: 17366

SEQ ID NO: 60011 - DNA, 201 bp, Homo sapiens
tgtttcctttatgactttttttaacttttattttaggttcaggggtacatgtgcaggtttgctacataggcaaattgtgtatcatggggtttggtgtacarattattttgtcacccagataataagcatggtacctaattggtggttttttcatccttaccctccctccaccttccaccctcaaatgggccctggtgtcca

SEQ ID NO: 60012 - DNA, 201 bp, Homo sapiens
gtagtcccagctaactggggaggctgagatgggaagaccacttgagcccaggaactagagtacaatctgggcaacagagtgtgatattgtcttaaaaaaawttttttttttaattcattacagacttgataggcacagaattgtatctcatttttatttttttaaaaggcgtttttatgagtgagaacaaacatgtcacaa

SEQ ID NO: 60013 - DNA, 201 bp, Homo sapiens
attattcataatttgatttccggatagctgggcaattgctccaggaagccaaatgtttccacaaggacacttcaatcgtctcagtagcatgtgctgcactygctgcagtagttcaatgggaaaccagggtctcatgcccagatgttggaagaaacgttcctgccattaagaatggaaaatgctaattctgggatgcaaaat

SEQ ID NO: 60014 - DNA, 201 bp, Homo sapiens
acaggcaacaacgtgggatacacctttgaagttattgggcatcttgaaaccatggtaagacccaaaatttgagaagccacaaaatacccaagttattagayatgcacaaggtaaatttaattgtctataactttattaatagtcaataatggaaatatctctgcgatagtcagttttactcaggcaaaaactgataatcac

SEQ ID NO: 60015 - DNA, 201 bp, Homo sapiens
cctctccacaggtcaaacctggttccacttgcgtcgtctttggcctgggaggagttggcctgtcagtcatcatgggctgtaagtcagctggtgcatctagratcattgggattgacctcaacaaagacaaatttgagaaggccatggctgtaggtgccactgagtgtatcagtcccaaggactctaccaaacccatcagtg

SEQ ID NO: 60016 - DNA, 201 bp, Homo sapiens
ctgtgcttttttttttttttttttgagataatgagtaggaaaaagaaaaaaacttgggtttatttttttcacaatccttgacctccttgaaatgaaattcycatcagccagcacaccgatttcatgagctaagtgaaatggagagtttatgggaagcagatgtgaagccctcatcttgtgaaaaatctgctttggattctt

SEQ ID NO: 60017 - DNA, 201 bp, Homo sapiens; identical to SEQ ID NO: 17365

SEQ ID NO: 60018 - DNA, 201 bp, Homo sapiens
ttgtctataactttattaatagtcaataatggaaatatctctgcgatagtcagttttactcaggcaaaaactgataatcacatagcaattttgcctaaaawgtcaaacacttaagagcaggttcactggaccaaagttaaataccatatcataccactctcagctgactagatggcaaggtagtcaacccttctagataat

SEQ ID NO: 60019 - DNA, 201 bp, Homo sapiens
cacaatgtagagaatgcaatgcttgtcgcaacccagatggcaacctttgcattaggagcgagtaggtttcagtcatttttactttaatgtatttacatttktcctatgctaatttttgaattgaattaattaatacgtgtatttgatgtatcaaacagtattactggtcgtggagtactggctgatggcaccaccagattt

SEQ ID NO: 60020 - DNA, 201 bp, Homo sapiens
ctaaatttatttacaaatgactcagagttatgattttttatttcttctattaaaaaatgggatatatgtgcagagcgtgcaggtttgttacacaggtataygtgcgccatggtggtttgctgcatctgttgactcgtcctccaggttccctcccctcaccccccacctcctaacaggccctgatgtgtgttgttcccctct

SEQ ID NO: 60021 - DNA, 201 bp, Homo sapiens
tttctgcatctattgagataatcatgtggtttttgtctttggttctgtttatatgcagattacatttattgatttgcatatattgaaccagccttgcatcrcaggtatgaaagcccatttgatcatggtggataagctttttgatgtgctgttggattcggtttgccagtattttattgaggatttttgcatcaatgttca

SEQ ID NO: 60022 - DNA, 201 bp, Homo sapiens
attgttgaattttgtcaaaggccttttctgcatctattgagataatcatgtggtttttgtctttggttctgtttatatgcagattacatttattgatttgyatatattgaaccagccttgcatcgcaggtatgaaagcccatttgatcatggtggataagctttttgatgtgctgttggattcggtttgccagtattttat

SEQ ID NO: 60023 - DNA, 201 bp, Homo sapiens
caagtaaattggagttcaaggaattaagaatctttgacctcttattattttgagatacgtcccatcaatacctagtttattgagagtttttagcatgaagsattgttgaattttgtcaaaggccttttctgcatctattgagataatcatgtggtttttgtctttggttctgtttatatgcagattacatttattgatttg

SEQ ID NO: 60024 - DNA, 201 bp, Homo sapiens
actggcaaggtaagaaacagggtaggctagtttatttgttcttctttccttttcttaaatgatttgcttggaatcttgaagagttttggaaaaaaaaaaaacatttaaaagaatgtattgcatattcaggctgccaagcaacacaatgccaaatcaactaaaagaaaaataaaaaattcagattagaaattttatttcttc

SEQ ID NO: 60025 - DNA, 201 bp, Homo sapiens
tggctgggggcttcaggaaacttataatcatggtggaaggcaaagaggaagcaaggcaccttcttcacaggctgcaggaaggagaagtgtcgagcaaagcrggaagagccccttacaaaaccatcagatcttgtgaaaactcactcactatcatgagaacagcatgagggaaactgccccatgattcaattacctccacct

SEQ ID NO: 60026 - DNA, 201 bp, Homo sapiens
caccttatacaaaaattaattcaagatggattaaagacttaaacattagacctaaaaccataaaaaccctagaagaaaacctaggcattaccattcaggayataggcatgggcaaggacttcatgtctaaaacaccaaaagcaatggcaacaaaagccaaaattgacaaatgggatctaattaaactaaagagcttctgca

SEQ ID NO: 60027 - DNA, 201 bp, Homo sapiens
aagtgtttttctttttttttcttttttttttttttttttttttttttgagacagagtcttgcttgtcccccaggctggagtgcagtggcatgatctcggcycactgcaacctccgcctcccggtttcacgccattctcctgccccagcctcccaagtagctgggactacaggctccggccaccgcatccggctaatttttt

SEQ ID NO: 60028 - DNA, 201 bp, Homo sapiens
gactgacacatggtaggtgctccgttaatgttaccttttaaaaagattgctggggagagaccaggaccaaaagtgtttttctttttttttctttttttttyttttttttttttttttgagacagagtcttgcttgtcccccaggctggagtgcagtggcatgatctcggctcactgcaacctccgcctcccggtttcacgc

SEQ ID NO: 60029 - DNA, 201 bp, Homo sapiens
tagcataatgactgacacatggtaggtgctccgttaatgttaccttttaaaaagattgctggggagagaccaggaccaaaagtgtttttctttttttttcytttttttttttttttttttttttttgagacagagtcttgcttgtcccccaggctggagtgcagtggcatgatctcggctcactgcaacctccgcctcccg

SEQ ID NO: 60030 - DNA, 201 bp, Homo sapiens
gcataactgtgggagcgtgagcttagccctctgtgtttgtagaagcagaaacaaacctggaagattttggattattaacattatactttcttgcttcaatstcagagtcaggaggtcaggtgttgaccttccccctgccctccaagaggtgtgtgacactggggaagtcacttcccctctctgagcctcagggtttttcac

SEQ ID NO: 60031 - DNA, 201 bp, Homo sapiens
gggtctcagtatatgaatttggagggcacacaactcagtctatagcactgatgcctccatcaaaaataccccatgtgacagctggttgaggaggattaacmtcgaaccaccttattctcaatgccatttaggctgtagcacactttcttccaatcttatgctttttgtttccaagtagaaaagaaacgctttactgaagag

SEQ ID NO: 60032 - DNA, 201 bp, Homo sapiens
agacaccagtcctgtaggattagggccctacccttacgactctctttaaattaatgacttccttaaaggctcaatctccaaatatagttactggggtttarggtctcagtatatgaatttggagggcacacaactcagtctatagcactgatgcctccatcaaaaataccccatgtgacagctggttgaggaggattaaca

SEQ ID NO: 60033 - DNA, 201 bp, Homo sapiens
caactgatgtattttctcacagttctggaggcaaaaagtccaaggtgaaggtgccagcagggttgatgtctggggagggctctgctcctggcttacagagkctgcctcagggctgtgtcctcacatggccttcccagtgtggggggtgtatgtgtgtgtgtgtgtgtgtgtgtgtgtgagtgtgagagagagagagagaga

SEQ ID NO: 60034 - DNA, 201 bp, Homo sapiens
ttccctggtgaatcactcttctcaggatgccttagtaaaacgccacaggctgggtggctccaacaactgatgtattttctcacagttctggaggcaaaaaktccaaggtgaaggtgccagcagggttgatgtctggggagggctctgctcctggcttacagaggctgcctcagggctgtgtcctcacatggccttcccagt

SEQ ID NO: 60035 - DNA, 201 bp, Homo sapiens
tgtgactttcactttcccttttgggttccagggtatatctcagagactggagaacgtgtctggttattatgcagatgcacggctggaggtgggatccacayagctcagaacagctggatcttgctcacactctttcaagagaagcttccttggtaagttaggggtggtctgaccttccccatctccccatcctcacagcag

SEQ ID NO: 60036 - DNA, 201 bp, Homo sapiens
tcaggaggtcaggtgttgaccttccccctgccctccaagaggtgtgtgacactggggaagtcacttcccctctctgagcctcagggtttttcacctgccakagggggttaggatgccctaccctgctgacccccagcaggctgctgaccccatctggggtgaggtgggaggcggggcagtgcgagtcaggggaaagttgac

SEQ ID NO: 60037 - DNA, 201 bp, Homo sapiens
tctctccaatgctaatagtagttcaatcagatgggcatgtggttaaagcctgagaatgaacagcaggtcaaaggtggggaaccaagtagcatgatgccatscaaagacccagagagacgtttcaggggcagagccaggggtcaggatggggcaggggtgggcctgggttggaggagcagcaggaaggctcgggcaccaagg

SEQ ID NO: 60038 - DNA, 201 bp, Homo sapiens
gtcgctgaacatctgtttcagttttcttatctgaaaatggaaatacaaatggtacccacttaataggctcttggaagaggactgtgagttattatttatamcatcttagagcaattagtggtgcaaagtcgagtccacaaatgttcacccctatttctcattgactgttattatacctataagtgccttgactaacactgt

SEQ ID NO: 60039 - DNA, 201 bp, Homo sapiens
ggctgctggcaccatggactcaggtaggcttgcttcttcctcttccctggctggttcctactcgcacctagaatggagggtggcgtttccacaactcagtsagccccagaggaacccggatggtcaagcaggccgatgagtcttccctgagccccaaaagaggccacatggagtcccccgacccaagggtctgtgggggca

SEQ ID NO: 60040 - DNA, 201 bp, Homo sapiens
agacacttgggcatagagtgcaagacacagatttggaatgaggagtcatttacagtaagcatgtatgcatgagtcaatatttttatatatttaagggagtrgagcccagtcatggaagacatgggatttgaatcagaagtcctggctctacccctattgtgaaaacatggcaaggttgcttaacatttgaggtttcttctg

SEQ ID NO: 60041 - DNA, 201 bp, Homo sapiens
ggtataaaccaaaagtaagattctaagcctccccctcatttaaaggacttcctcctcagccagggctcttaaaatttaacctgaaagactggttcaggccrtgaagggaaatgggggtcagacatgcttcattatgcctctctggcattaatatcaacacaggctttcagtctaataagaaacattttacagcctgtttct

SEQ ID NO: 60042 - DNA, 201 bp, Homo sapiens
cagtctaataagaaacattttacagcctgtttctctgtgaagcctgctagctgaaagcttcatctgcaggataaaactttggtctccacaacctcttatcrcaactcaaacattccttcctattgatctccggtctttagacaaactcaaccaattgtcaaccagaaaacgtttcaatttacctgtagcctggaaacgccc

SEQ ID NO: 60043 - DNA, 201 bp, Homo sapiens
gccaacccctacctttgaggggcctgacagggccacctcacagctgcctgggcttgttgttgcctcctcactacagaaaccatggaagtctctagagtcartgtttccaggctggggctgccagatcactcctgtaggtggttgaaccagttgagttcattcttctcagtgagggggacacaggtggaggtccatcggcac

SEQ ID NO: 60044 - DNA, 201 bp, Homo sapiens
cccagttaaggggttgaacttgaccctggcaggtcattaaagattcctcaggagacctaggtattgtggctcagggctgtaattcccgtgctaatgcacgraggctaatgcaggaggatccctcgaacccaggagttcaggacaagcctgggcagcatagcacgaccccatctctgcaaaaatgaaaataaaaagattgac

SEQ ID NO: 60045 - DNA, 201 bp, Homo sapiens
ctctgtgtcgtggcctcgaagggtctttgattctgtgcagcttcttttcctcctcatttctttaagggaggcatcgcattcattagtcttttttttctgayggagtcttgctctgtcgcccaggctggagtgcaagtagcaccatcggctcactgcaccctccgcctcctgggttcaagtgattctccagctcaccctcct

SEQ ID NO: 60046 - DNA, 201 bp, Homo sapiens
ccctccaagaggtgtgtgacactggggaagtcacttcccctctctgagcctcagggtttttcacctgccagagggggttaggatgccctaccctgctgacycccagcaggctgctgaccccatctggggtgaggtgggaggcggggcagtgcgagtcaggggaaagttgacattgcagcccagatgcctgcaggggctgca

SEQ ID NO: 60047 - DNA, 201 bp, Homo sapiens
gtcaggaggtcaggtgttgaccttccccctgccctccaagaggtgtgtgacactggggaagtcacttcccctctctgagcctcagggtttttcacctgccwgagggggttaggatgccctaccctgctgacccccagcaggctgctgaccccatctggggtgaggtgggaggcggggcagtgcgagtcaggggaaagttga

SEQ ID NO: 60048 - DNA, 201 bp, Homo sapiens
tccacaaagcaccatggcacttccctggtgaatcactcttctcaggatgccttagtaaaacgccacaggctgggtggctccaacaactgatgtattttctyacagttctggaggcaaaaagtccaaggtgaaggtgccagcagggttgatgtctggggagggctctgctcctggcttacagaggctgcctcagggctgtgt

SEQ ID NO: 60049 - DNA, 201 bp, Homo sapiens; identical to SEQ ID NO: 17391

SEQ ID NO: 60050 - DNA, 201 bp, Homo sapiens
gatcactggaatatttcccgtacatggggagaaagcatggtggaaagctcactttctggtgattctcagctgaaatagatcggttcctccacaaagcaccrtggcacttccctggtgaatcactcttctcaggatgccttagtaaaacgccacaggctgggtggctccaacaactgatgtattttctcacagttctggagg

SEQ ID NO: 60051 - DNA, 201 bp, Homo sapiens
ggcacatggcagaaggaagcgatcactggaatatttcccgtacatggggagaaagcatggtggaaagctcactttctggtgattctcagctgaaatagatyggttcctccacaaagcaccatggcacttccctggtgaatcactcttctcaggatgccttagtaaaacgccacaggctgggtggctccaacaactgatgta

SEQ ID NO: 60052 - DNA, 201 bp, Homo sapiens
tcgaaactcagattttgaagacactggtgtaaagcgtttgacaataggcacatggcagaaggaagcgatcactggaatatttcccgtacatggggagaaarcatggtggaaagctcactttctggtgattctcagctgaaatagatcggttcctccacaaagcaccatggcacttccctggtgaatcactcttctcaggat

SEQ ID NO: 60053 - DNA, 201 bp, Homo sapiens
tgctcttgacaaaatgaactattttcataacccactgatgggtcgaaactcagattttgaagacactggtgtaaagcgtttgacaataggcacatggcagraggaagcgatcactggaatatttcccgtacatggggagaaagcatggtggaaagctcactttctggtgattctcagctgaaatagatcggttcctccaca

SEQ ID NO: 60054 - DNA, 201 bp, Homo sapiens
agaaacgctttactgaagaggccaccaaatacttccgggagagagtcagcccagtgcatctgcaaatcctgctgactaacaatgaagcctggaagagattygtgactgcggctgaattgcccaggtaacctccgtggggttacctccatggggcgccccggctatgccatcctgatctcccctgggctagttttctctggc

SEQ ID NO: 60055 - DNA, 201 bp, Homo sapiens
cctaaacacatctagatcccaggaatttacataagggtatatatatatacacccttatgtatatatatattatatatatttcaaatatcttacaaaagaawactcactcttgctgtgttcaatacactctgatattttcaatgctcttttctttttaaaatgctgctcttgacaaaatgaactattttcataacccactga

SEQ ID NO: 60056 - DNA, 201 bp, Homo sapiens; identical to SEQ ID NO: 17395

SEQ ID NO: 60057 - DNA, 201 bp, Homo sapiens
tttgtagcgttgaccagtgtgggagtggtcagtgatacagcatatgcaccctgtgtcatattgacacagattgaaaatgctgccatcctaaacacatctakatcccaggaatttacataagggtatatatatatacacccttatgtatatatatattatatatatttcaaatatcttacaaaagaatactcactcttgctg

SEQ ID NO: 60058 - DNA, 201 bp, Homo sapiens
ttgtggctcagggctgtaattcccgtgctaatgcacggaggctaatgcaggaggatccctcgaacccaggagttcaggacaagcctgggcagcatagcacraccccatctctgcaaaaatgaaaataaaaagattgactgacatagtgatgcacttgtagttcccactactcagaaggatgaggcaggaggatcgattgat

SEQ ID NO: 60059 - DNA, 201 bp, Homo sapiens
atgtcccagtgcatacataaatccatactgcttcccagtcccttctctgcagttccataattcccaaatccctgcaaaccacacatttttggggcaactcmtctgggcagtaatcctgctgtgtactaagatgctttgtactgataatattatgtatcccatttaaggtgaatattcattggtttctctgttgaaacattt

SEQ ID NO: 60060 - DNA, 201 bp, Homo sapiens
gcaccacagccttggggaagtggaaacagcagggtcggggagtagggggagagcagggtccaggaggtgcggagggctgagagaggaggttgaccagcagycccgacctctgacctcccgctctgctcccagctgaccctggggtgtttccagcacaggccagtcccctccctccagctcttgccctgcaccagcccctct

SEQ ID NO: 60061 - DNA, 201 bp, Homo sapiens
gggagccacggttgcacccatctcctggcctgtgtgtgatcatcgaatgaggcacatatgaggagccctgcagatcacagacacccagtacacactggctrttatcaattagttatcacacatgttgccaggcccaggtcattgtcagaacgttccttcccatctctatttcggtgtatagactctgtagtttctgtgatt

SEQ ID NO: 60062 - DNA, 201 bp, Homo sapiens
tcaccatgttagccaggatgttctcgatctcctgaccttgtgatccacccacctccgccacccaaagtgctgggattacaggcatgagccaccgtgccagrcgcattccttagtcttaatgggcatagtgttagggacccgcctactccctatggcaggagatttagtgatttctccctttttggtgatagaaacaacgct

SEQ ID NO: 60063 - DNA, 201 bp, Homo sapiens; identical to SEQ ID NO: 17392

SEQ ID NO: 60064 - DNA, 201 bp, Homo sapiens; identical to SEQ ID NO: 17393

SEQ ID NO: 60065 - DNA, 201 bp, Homo sapiens
gagaacatgccaggcaaggtgatctcttccagtctgaggttttatttgatagcttaaggactcagagttagtcaaaatgcaatgtctgaaggcacccttcyttctgacaccagttgcagatttgaaggtgtttcttaagcccccactcaggtttgataattcactacaaagacttacgtaactcactgataactgttattg

SEQ ID NO: 60066 - DNA, 201 bp, Homo sapiens
gataacaggcatgcaccaccatgcccggctaattttttcatttttttagtagagacagagttgctccatgttggtcaggctgctctcgaactcccaacctsaggtgatccacccacctcagcttcctaaagtgctgggattacagatgtgaaccagtgtgcctagccagcttttctttagggagtaaatcattttctttac

SEQ ID NO: 60067 - DNA, 201 bp, Homo sapiens
catgggatttgaatcagaagtcctggctctacccctattgtgaaaacatggcaaggttgcttaacatttgaggtttcttctgtttcaaaatgggagccacrgttgcacccatctcctggcctgtgtgtgatcatcgaatgaggcacatatgaggagccctgcagatcacagacacccagtacacactggctgttatcaatt

SEQ ID NO: 60068 - DNA, 201 bp, Homo sapiens
attatactgactggtaacaagtagatttagttctcatatgtaaatgttctgttttgttctaaaagttaaaagttaaccaagtgtttacattttggtgacgytttaaatcttgcttactgttgagctgagttgtacaatatggttgcacatgttttgctgcacggctttagtttttcctgatgtttctaattgcctttgttt

SEQ ID NO: 60069 - DNA, 201 bp, Homo sapiens
agtgtatacggttcagacaaatcatttaataaagagggctccactcactcccttcccaattaaaagcagctaattttgatgttcagattttcctttttttwttttctgagacagaatttcactcttgttgcccaggctggagtgcaatgtagctatcttggctcaccacaaactccacctcctgggttcaagcgattctcc

SEQ ID NO: 60070 - DNA, 201 bp, Homo sapiens
ggtgcaattacatttgacatgctggcaaccaaataaaaggcaaaccttgcatatgccacacacacactcacaaattcacacacacacacacacacacacacgcacactcacacctgctattcagatttcacttcatggagccctgtgtttctcacctctgtgtcgtggcctcgaagggtctttgattctgtgcagcttctt

SEQ ID NO: 60071 - DNA, 201 bp, Homo sapiens
aggtgcaattacatttgacatgctggcaaccaaataaaaggcaaaccttgcatatgccacacacacactcacaaattcacacacacacacacacacacacacgcacactcacacctgctattcagatttcacttcatggagccctgtgtttctcacctctgtgtcgtggcctcgaagggtctttgattctgtgcagcttct

SEQ ID NO: 60072 - DNA, 201 bp, Homo sapiens
agaggttgtttcacccaccctgactctgagcacctacttgagccaggccctgtgggtaaactgaggccatgggagatgagtgactcgctgagggtcccatrtcaggaagttgagcaggtagatcacaggactccatgtccctgacactcacctggttccttttcaggcctctgggtgatagagaagaaagaagctgtgctg

SEQ ID NO: 60073 - DNA, 201 bp, Homo sapiens; identical to SEQ ID NO: 17398

SEQ ID NO: 60074 - DNA, 201 bp, Homo sapiens; identical to SEQ ID NO: 17400

SEQ ID NO: 60075 - DNA, 201 bp, Homo sapiens
aagatgaggagagggcagggaagattagaagccgggacctaccagccaaccccggaatccttcagaagggcttggctgggaggctcaaggaagaaactctstctccgaaacaagatgatctgtggtttaataacgcggccagctgggttcagaggtgatagtggggagccatgtcccctgagaccagcctgcagaggacag

SEQ ID NO: 60076 - DNA, 201 bp, Homo sapiens
gtttttctttttttttcttttttttttttttttttttttttttgagacagagtcttgcttgtcccccaggctggagtgcagtggcatgatctcggctcacygcaacctccgcctcccggtttcacgccattctcctgccccagcctcccaagtagctgggactacaggctccggccaccgcatccggctaattttttttgt

SEQ ID NO: 60077 - DNA, 201 bp, Homo sapiens
acaggtggctcacattcagtcccacaatttgctttctcctcctcaagggttaagaaaaaaaacgaacccttccagtcaggtcagtgactggagagctccawggaaagtctctcagtgacctggctgctggcaccatggactcaggtaggcttgcttcttcctcttccctggctggttcctactcgcacctagaatggaggg

SEQ ID NO: 60078 - DNA, 201 bp, Homo sapiens
gggggacaaagggtgtccagcacagcaccagtgaattcaccaagacagacacttgggcatagagtgcaagacacagatttggaatgaggagtcatttacartaagcatgtatgcatgagtcaatatttttatatatttaagggagtggagcccagtcatggaagacatgggatttgaatcagaagtcctggctctacccct

SEQ ID NO: 60079 - DNA, 201 bp, Homo sapiens
ggacaaaacacatggggtgttgccaaccagagaagctcacccagttaaggaaaaattcctgtgaatcacattagatcaggaagcctttattcaggattgttgttacaggggagggagactgagcccagctcccaatatagtaaagacagagggggagtcacagccaacaccagggtgaggagtgggagatggaccagttct

SEQ ID NO: 60080 - DNA, 201 bp, Homo sapiens
cttggctctgtccctgcacagctctggggctgttgttttatgtcttggagactgggacctgccatctctccaatgctaatagtagttcaatcagatgggcrtgtggttaaagcctgagaatgaacagcaggtcaaaggtggggaaccaagtagcatgatgccatccaaagacccagagagacgtttcaggggcagagccag

SEQ ID NO: 60081 - DNA, 201 bp, Homo sapiens
ggtatgcacacaggtgaagctgtcacctgctaaggcattagtttggctggcgacatgtgacagtgagaccctgaagcttggaggtgccaggtcaggaggcmgtcaagtggcttgagagttcatgtgcagccaggactaatagccaggcctttcacttttcagtcaaagggggcagtggctggacccagtggccttcagtca

SEQ ID NO: 60082 - DNA, 201 bp, Homo sapiens
tcaaagtctcatgagtccataagaggttccatgaaattgcacatggcattggtatgcacacaggtgaagctgtcacctgctaaggcattagtttggctggygacatgtgacagtgagaccctgaagcttggaggtgccaggtcaggaggcagtcaagtggcttgagagttcatgtgcagccaggactaatagccaggcctt

SEQ ID NO: 60083 - DNA, 201 bp, Homo sapiens
tgtccaaatgcaggtcttttcagcattagtgatttatagagatgattttcaaagtctcatgagtccataagaggttccatgaaattgcacatggcattggyatgcacacaggtgaagctgtcacctgctaaggcattagtttggctggcgacatgtgacagtgagaccctgaagcttggaggtgccaggtcaggaggcagt

SEQ ID NO: 60084 - DNA, 201 bp, Homo sapiens
gagagggatatttcttccctccctgatttgatcccatcactgatgggcatagtgggccatgggtgactgtttccctgacagcatgcctgggaactggggcrttctgaactgccatttgggaccctcttctgttctacatagagtagaggaagtgtttcttcgggccagcttggagagttggaacaagtgtctgccaactgg

SEQ ID NO: 60085 - DNA, 201 bp, Homo sapiens
ggatggggcaggggtgggcctgggttggaggagcagcaggaaggctcgggcaccaaggctgggagtagggtgagaagagggaggcactgagggcatgaaakgtaacgtggccatggacttgcagaggaccagtgagtgggagagggatatttcttccctccctgatttgatcccatcactgatgggcatagtgggccatgg

SEQ ID NO: 60086 - DNA, 201 bp, Homo sapiens
gttttatgtcttggagactgggacctgccatctctccaatgctaatagtagttcaatcagatgggcatgtggttaaagcctgagaatgaacagcaggtcaraggtggggaaccaagtagcatgatgccatccaaagacccagagagacgtttcaggggcagagccaggggtcaggatggggcaggggtgggcctgggttgg

SEQ ID NO: 60087 - DNA, 201 bp, Homo sapiens
atcttgacctgatcaatgtgtgttcctggagatgctgtccggggcccttttcttccacctctgaggaactgcacaaacacagcaggatcctcctgctgacmcagaacacagagaggctggaatggagttggacagagctgggggtggatcttggctctgtccctgcacagctctggggctgttgttttatgtcttggagac

SEQ ID NO: 60088 - DNA, 201 bp, Homo sapiens
gaaaaaaaattgcaaaacgatcttcagaagctgtgctgctgcctatggcagtgtggcagggagggggcctcgggtggggtgagtgcccaaaagggtgggcraggacgatttggggagttctccaaaggttatgacccactatgggcctacccttcgttcccggctgtaaacctctaaacttagcatttatccaagctatcc

SEQ ID NO: 60089 - DNA, 201 bp, Homo sapiens; identical to SEQ ID NO: 17396

SEQ ID NO: 60090 - DNA, 201 bp, Homo sapiens
ttggctcagagctgaggcaggagggagggctccctgtctgggcctcctccaggaactaaagtccctttccgggaattgaccaaactgcaggcttgcccagrgaggacatgctgtgtcctagttcagctcgaggggcagtatccagcttcaaccctcagcggatgccccagacaagattccgagccaggccaacaacgccta

SEQ ID NO: 60091 - DNA, 201 bp, Homo sapiens
ggcctgggccattgccgtgggggaggggaggcttggaaaccatggctatgattcagaggttagctggctcgcgtgtttttagaaatttcttttttctttcycctcgtacaaaagtaataagactggggaggacacgggagaaaataaatggaaactcagaaacctgatagagccaccaaaagtacatgaaatcagagtcat

SEQ ID NO: 60092 - DNA, 201 bp, Homo sapiens
agcaataaatacacagatctagtgctggaggttccctccatccaaccctggtttccttcatcctttcagtgaaggaggaaaaaataaaagcaaaatacccstcacccaagtcagcactgtgttcatttccctaaggcctgttttctcccctcactgagttgccttggcaaccaagtcacatctgctcaggagccgccctgg

SEQ ID NO: 60093 - DNA, 201 bp, Homo sapiens
ctggccgaagttaagttttgtttgtgcctaacgtaagcacccatctgaaacgactccagttaagttccccatagttggcagtttaaggggggttacagccwttctgaaggcctgtttgcttttgtttgcccaggtgttcattttaagtttgctttaacaccctggtactcccaccccagcaataaatacacagatctagtg

SEQ ID NO: 60094 - DNA, 201 bp, Homo sapiens
cctccctccagctcttgccctgcaccagcccctctgctctgagtggccctgtgaaaagagtgactcagcgtcccactgaactgagccccattctggccttygccacgtcttctctgtgtcacctggagcttcttacctcccctcacctggaatgcgagtataatatttccccatgtggtcatgaggatcaaatagtacatg

SEQ ID NO: 60095 - DNA, 201 bp, Homo sapiens
cccccgacccaagggtctgtgggggcatctatgtcctgacctctcctcaggggagcatggcccaggtgcccacttcctccctgccctggcacctagcaaaygactcaagtggggcaccacagccttggggaagtggaaacagcagggtcggggagtagggggagagcagggtccaggaggtgcggagggctgagagaggag

SEQ ID NO: 60096 - DNA, 201 bp, Homo sapiens
gggtttcatcgtgttagccaggatggtcttgatctcctgacctcgtgatcctcccgcctcggcctcccaaggtgctgggattacaggcatgagccgctgcrcccgaccaagtgtttttcttagagttggatgcccagcaggactttctttgaaaaaagccagaaaaatcttgacctgatcaatgtgtgttcctggagatgc

SEQ ID NO: 60097 - DNA, 201 bp, Homo sapiens
ctcggctcactgcaacctccgcctcccggtttcacgccattctcctgccccagcctcccaagtagctgggactacaggctccggccaccgcatccggctawttttttttgtatttttagtacagacggggtttcatcgtgttagccaggatggtcttgatctcctgacctcgtgatcctcccgcctcggcctcccaaggtg

SEQ ID NO: 60098 - DNA, 201 bp, Homo sapiens
tgtttttctttttttttcttttttttttttttttttttttttttgagacagagtcttgcttgtcccccaggctggagtgcagtggcatgatctcggctcaytgcaacctccgcctcccggtttcacgccattctcctgccccagcctcccaagtagctgggactacaggctccggccaccgcatccggctaattttttttg

SEQ ID NO: 60099 - DNA, 201 bp, Homo sapiens
aggatgcttgagtcaccagcttgccatcctgtgtcattcaacacctcctccagactcttcgcaggaaggtgacccagaaaccccttgaaggacatgatacygtccctgtgctctgatgtgccccctggtgtttgagtggagtgatttttagatagcggtttgcctgttaaaaccttccctttgttccctatattattgctt

SEQ ID NO: 60100 - DNA, 201 bp, Homo sapiens
cagtaaaagagttcactcatctgttgcttaaaatataggatgcttgagtcaccagcttgccatcctgtgtcattcaacacctcctccagactcttcgcagraaggtgacccagaaaccccttgaaggacatgataccgtccctgtgctctgatgtgccccctggtgtttgagtggagtgatttttagatagcggtttgcct

SEQ ID NO: 60101 - DNA, 201 bp, Homo sapiens
gctccttcttaggttctgggggctggtttgactggatgatgcctactcttctcttatggctggtaaatggtgtgattgtcctgagcgtctttgtgaagctkctggttcatggggagccagtgatccggccacactcgcgctcctcggtcaccttctggaggcaccggaaacaggcagatctggatctcgccagagtgagtt

SEQ ID NO: 60102 - DNA, 201 bp, Homo sapiens; identical to SEQ ID NO: 17443

SEQ ID NO: 60103 - DNA, 201 bp, Homo sapiens; identical to SEQ ID NO: 17442

SEQ ID NO: 60104 - DNA, 201 bp, Homo sapiens; identical to SEQ ID NO: 17431

SEQ ID NO: 60105 - DNA, 201 bp, Homo sapiens
agcaactcaaatgtccatccacaggaaaataagcacattgtgatatattcatacaatgaaattatgcctagcaattaaaaaacagaactgctgacaggcayggtggctcacgcctgtaatctcagcactttgggaggccaagaggggtggatcacctgaggtcaggagtttgagaccagcctggccaacacggtgaaaccc

SEQ ID NO: 60106 - DNA, 201 bp, Homo sapiens; identical to SEQ ID NO: 17433

SEQ ID NO: 60107 - DNA, 201 bp, Homo sapiens
gagttcgagacccacctatcaatatggtgaaaccctgtctctactaaaattacaaaaattagccgggcatggtgccgtgcacctgtagtcccagctactcrggaggctgaggcgggagaatcgcttgaacccaggaggcagaggttgaagtaagacaagttcgcgccactgcactccatccagcgtgggcgatagaggaag

SEQ ID NO: 60108 - DNA, 201 bp, Homo sapiens
ccttgtgatccacccgcctcggcctcccaaagtgctgggattacagacgtgagccactgcccttggctttcatagttttctgttctccatattttctgctrtggatcctgaacatatattgggttggggggagggggggcatgtattattaatcttttttttaattttttttttttggagacagttttgctcttgttgccc

SEQ ID NO: 60109 - DNA, 201 bp, Homo sapiens
atggtagaattttagcagaaggtccctatctgcaaatttgccccgctgttatcttgtctgttcctcagtgtgcccttgggacagaataagcccatactcasgtctctgatcaggctgtgtcctccttgctgccaaattctggagaattccagctgagaagctttacgtcactcattccttccatactcactggcattccct

SEQ ID NO: 60110 - DNA, 201 bp, Homo sapiens
gaggccgaggtaggagaatgtcgtgaacctgggaggtggagcttgcagtgagccaagattgcgccactgcactccagcccgggcgacagagcaaatctccrtctcaaaaaaaaaaaaaaagaaatagtgtgtcaagccaaaggagttcatgctaatgagtccatttatatgaagtttaaaaagaggcaaaatgaagctatg

SEQ ID NO: 60111 - DNA, 201 bp, Homo sapiens
cgaggtaggagaatgtcgtgaacctgggaggtggagcttgcagtgagccaagattgcgccactgcactccagcccgggcgacagagcaaatctccgtctcaaaaaaaaaaaaaaagaaatagtgtgtcaagccaaaggagttcatgctaatgagtccatttatatgaagtttaaaaagaggcaaaatgaagctatggtgct

SEQ ID NO: 60112 - DNA, 201 bp, Homo sapiens
tttcttttcttcctagtgaattctccagtgctctggagtacttgaaattacttcattcttttgtggactctgtgggggttatgagccccccactctccagsagctccgtgctcaagtccgccctgggtaagcacctgcgggtggcccacagtctcagggtgctcagttcaggtcttcacagtgcttttgccccaggggtcc

SEQ ID NO: 60113 - DNA, 201 bp, Homo sapiens
gaggtaggagaatgtcgtgaacctgggaggtggagcttgcagtgagccaagattgcgccactgcactccagcccgggcgacagagcaaatctccgtctcaaaaaaaaaaaaaaagaaatagtgtgtcaagccaaaggagttcatgctaatgagtccatttatatgaagtttaaaaagaggcaaaatgaagctatggtgctg

SEQ ID NO: 60114 - DNA, 201 bp, Homo sapiens
gaaggcactgagacagagaaattagatgatttgccaatgcttcctatgctgatgacggggaatgaacttggattttctgatgtgggattccatattcttcrctgtcctatgaaaatgaggtgggagatgccttgattcaggaagcctgtctgtctaggagccccttctctggtcaaaagttgtttttaaaaaatccttgct

SEQ ID NO: 60115 - DNA, 201 bp, Homo sapiens
agttttctctggtgccaactcgtggttcaccgtgtacaactttagaagtggttaacagtttgacagcaaagcagaaatcatatgacttgtttctggcataygtagatcaaaacttaaaacatatttagccatgttaatcctcttgtggtgtagtttatcagcagtgattcttgaagggaggtagtaaccaaggttccgtgg

SEQ ID NO: 60116 - DNA, 201 bp, Homo sapiens
gatgtgtcctataaacagtggcacattgtagataagttggcagtgtttttctttagtgatacttaaattaatggtgagacttaaaattgctgacatcttakagtcaatgaaatatgatcatctgtttcattcagtaagctcctgctataataggcagagaggtcaacaaatgaatgacagttcagcgtgagtatgttagac

SEQ ID NO: 60117 - DNA, 201 bp, Homo sapiens
ccagtggctcacgcctgtattcccagcattttgggaggctgaggtgggcagatcacctgaggtcagtagtttgagatcagcctggccaacatgatgaaatyccatctctactaaaaatacaaaaatgagccaggtgtggtggtgggtgcctgtattcccagctactcaggaggctgaggcaggagaatcacttgaaccagg

SEQ ID NO: 60118 - DNA, 201 bp, Homo sapiens
cgagccaggtcatgtgggcccatctcagccccaccacgggctggccgtgagaggctggacaagttcacttcttttccgtggattgggtggggcagcagacyccacctcccaggatggatgtgagcgttcagtgaatgagtccaggtaacgccaaggaactgcaccaacttcatggtagattctcggttgtgacacacatct

SEQ ID NO: 60119 - DNA, 201 bp, Homo sapiens
agcagcaggtgcagacagtacaggcccagcgggtgctgacacaaacggccaatggcacgctgcagacccttgccccggctacggtgcagacagttgctgcrccacaggtgcagcaggtcccggtaagtggctggaaaggattcagggaggcactggttggggctgttaactggtccttggttgaagatgtggtctacatac

SEQ ID NO: 60120 - DNA, 201 bp, Homo sapiens
gctgggattataggcacccacctccacacccagctaattttttgtatttttagtagagacggggtttcaccatcttggccaggctggtcttgaactcctgwccttgtgatccacccgactcggtctcccaaagtgctgggattacagacgtgagccaccgcgcccggcccacatgcttagtttctatgttcctgtaactaa

SEQ ID NO: 60121 - DNA, 201 bp, Homo sapiens
cacccgcacccaccagctgctggaacacagcctgcggcggcgcaccacgcagagcaccaagcacggtgagtccacccctccccagctcacaggctgggccrggccctgcgccctaggaagagaggagaagaggggccagcccagctcccacatctggcattggtgcccagcacacctctcgcctctctgagaatgaaagaa

SEQ ID NO: 60122 - DNA, 201 bp, Homo sapiens
gagaaccctcccccatccctagcctccccttccactcccagtctcctctacagaaagaagctaactaagtatctccagagagtttaataccacatctctgsgggggtggtcccttaaagaacgggtacaacaccttattgtggccactttataggtaaggaaactgaggcacacgttggaatgactatcttgggtggcttc

SEQ ID NO: 60123 - DNA, 201 bp, Homo sapiens
tcatgtgcatttctaaaaatcatgccatgcgaaatcatgcagtaaaaaacacggagtgggcatgttggctcatgcttgtaatcaggaggctaaggtgggaggatcgcatgaggcagggagttcaagaccagcctgggcaacaaagcaagacccagtctctcttacaaataaaaaataaaaattatctggacatggtggtgt

SEQ ID NO: 60124 - DNA, 201 bp, Homo sapiens
ctgttccctcacgtcctgcggagttcaccagactctggggctctccacttcctcccagagctgctgagtgttggtctggggagaggcctggtaggtgctargatccttgcctcagggatgggccagtcacctgtctcccctctctcgtggctgaccccacaggtggtccagctgctcacctgtgacctgctactgtcgcta

SEQ ID NO: 60125 - DNA, 201 bp, Homo sapiens
tgcccctgccacctgcctgtgctgtattccctatacaagctgctgtccctgtcagagccttgctttctcacctgcagaatggggagggcttgtctcccacytcctggggccatggaaggaactggttctcccctgagctgttccctcacgtcctgcggagttcaccagactctggggctctccacttcctcccagagctgc

SEQ ID NO: 60126 - DNA, 201 bp, Homo sapiens
cagcacttctttaagcacttgtaatttttattcctttggataaattcctagaagtttacaacacgaccagctgcaagatggggcagtgaggtgcttgaagsagtgggtgggctgcacttcagaatcccggtggaactttttcaaaaaactcgtgcccggggcccccctctcaggaggccgtcggtgggcctgggcactggc

SEQ ID NO: 60127 - DNA, 201 bp, Homo sapiens
ttgtgctgaaattggggtgcctgggggtcatccattaggaaatgagatgtagatacttaggagaaggtaaaactgggatggagattgaagagagtcactgytgagtcaagaggagagaactgggagattagaggttaggaaagtgttagcttttcaaggagtagtctgtagatggtggagacaatgccacagagaacaaca

SEQ ID NO: 60128 - DNA, 201 bp, Homo sapiens
tccctttgggtttctcctccctcctctgtctatttggcctcgcccttgacaaacattccccacattcacacccaggcctttggcctaatgttcttgaatgytgcttgcctctcattgaataggcttttatgtagctctcatattcagttcatattttggcattttaaaaaatatatatttttgcttctttctcaactagat

SEQ ID NO: 60129 - DNA, 201 bp, Homo sapiens
ttcactcctcaaatttgtaattaaaaaaaggaaattctcaagcagttttattcaattagaactttgcaaatatcaaattgtccgtatccttctggattctygtctgaacattgcttatctgcgtacatatcacagtgttttcacatagggattgctgtatgttgaagtagttgaggtgtaatagccatataatctaatgtg

SEQ ID NO: 60130 - DNA, 201 bp, Homo sapiens
ggaaagaggttagagcaagtttgggtctgcagtgctaggattagaggtggcctcacaagccaaaaccgctatactcacagccttaggacagtgactccctrctcgctgcctcagtgtttccagctgtaaaaaaggacccttggtaccttcgacagaacagcacccatctagtacaaaggtagttccttttatgatcaaaac

SEQ ID NO: 60131 - DNA, 201 bp, Homo sapiens
tttgcagttttttcttaacataagcactgttctgaatacttgtgaacaagtcacttgggagtttgttcatgggcgtgtatcttccaaagaggagtcttcamgttcagctgggtaacacactatcagctgtagccctttcattttaaaaacatttccagtgctgcaaattactatggtgattgggaattacaacttggaaat

SEQ ID NO: 60132 - DNA, 201 bp, Homo sapiens
tgggagatgggaagaaaacgaatacttttcagtctttgccctgtgcggagttccacacaaggcacataggatcctccagctcccagcccagagtacatagygtatgcaaatttgagtggatgtttgtatttgtagcgtgatttgataacctgctttgcaagtattctttttctctttagttttagggagatttgggggcat

SEQ ID NO: 60133 - DNA, 201 bp, Homo sapiens
tcgtgtcaaagaaagtcctatgatagatgcttgtggtgagaggaaaaagggaccctgctgctgaatagtcacagggcagtggagtgggcgcctctgcatarataattaattccagggacatgagatgatctatgtctccggtatgacaggaataatgaagttgagttctgagggaggggttctagggcttgagcggggctg

SEQ ID NO: 60134 - DNA, 201 bp, Homo sapiens
ccacagcctctttcacatcaggcaattagcagatgagttacagggggaggctcctaggccccagttggggaagattctggtgtctataaaatttaggaaamcttaaaaaaaaatttttttttttttggcttgggattacaagccaagccaccagcgtggccaagatggtgaaaccctgtctctactaaaaatataaaaatt

SEQ ID NO: 60135 - DNA, 201 bp, Homo sapiens
tcattggttttgttcttaaatatcaatagtgcaaccactggcttttattcaaaggtttaattggaatctaacctggggattttcccctttttaaatttatrtttaaaaaaaaaaactatggaaagtcggcatggtctgggctgcttgggagcctgaggcaggaggatcacttgagtccaggaatttgagactctcctgggc

SEQ ID NO: 60136 - DNA, 201 bp, Homo sapiens
agggggagtagaagtctatatcaaaacaaaaagccggagcaaggccagtgaccattaacaccttttgatactttgtagggagattttgcagctgctgccgscaacctacaaacctgcctggcagttttgggccgggcactgcccacctcccgcctggacctggcctgcagcctctcctggaacgtgatccgctacagcctg

SEQ ID NO: 60137 - DNA, 201 bp, Homo sapiens
tttagtagagacggggtttcaccgtgttagccaggatggtctcgatctcctgacctcatgatccgcccgcctcggcctcccaaagtgctgggattacaggygtgagccaccgcgccaggccgacatggtgattcttaattgctatgtcattctttttttctgaacatattaaaagagaaataacaaagtgggggaagtact

SEQ ID NO: 60138 - DNA, 201 bp, Homo sapiens
tccagctgagaagctttacgtcactcattccttccatactcactggcattccctgtgtgaggcactgaggggacagaggtaactacagtatggttgccacrctgccctctcacctcccttcctgtgtctcctgcaggaggaacacctgaggccagtacagaatggagtgtggaggctgagatctccctaggctgataaaaa

SEQ ID NO: 60139 - DNA, 201 bp, Homo sapiens
ttccaagtagctgcaattacaggcgtgtgccaccacgtccagctaattttttctatttttagtagagatggggtttcactgtgtttgccaggctggtctcraactcctgatcttaagtgatccgccggccttggcctcccaaagtgctgggattacaggtgtgagccactggcacccagccacattgtgaaggttttttaa

SEQ ID NO: 60140 - DNA, 201 bp, Homo sapiens
tttggaaacacacagtgtggctgtgctgctgacattgttatgttgcactgtgcgcctctgagtcctatacaacaacctgcaattgtgacagctctgggtgygacagaaatgggtgccatgttcccagctaccctgtgaggtagacaggaacacacagccagtatatcacagagcctggcatcccatcctgtgatcaggcct

SEQ ID NO: 60141 - DNA, 201 bp, Homo sapiens
gagaggagaagaggggccagcccagctcccacatctggcattggtgcccagcacacctctcgcctctctgagaatgaaagaagcccgaggccgcccttggygggttgcaggggttggggtggtcatgggtcatgctgtgatcagggaaggagggttggggtggcgtcccagcacaggtgcaggcatagaagcagaagctcg

SEQ ID NO: 60142 - DNA, 201 bp, Homo sapiens
ccctgagcacttacctagccaggagttaagatgcagaagcagttatgaacccccttccccatcaggtgctgcccacctggaggggtaggcaggcattcatkcagtcgctcatttcaccaggactcccagcaaccgataaaacagaccaaaattcctccccttgtggccttaataccataagccttgtaggcaggacatttt

SEQ ID NO: 60143 - DNA, 201 bp, Homo sapiens
tctgaacatattaaaagagaaataacaaagtgggggaagtacttgcagacatttaagaagaataagtatctataatatctggaagttttttaaatcagtgaaaaaaaaaaaaagacaaaatagcctgatagcaaaaatggacgaaggtcaagagcaggcggtttacaaaggaagaaatgcaaatgctcaataaaattggga

SEQ ID NO: 60144 - DNA, 201 bp, Homo sapiens
caggagacctaggggccaggtttgggaaaagtggttccatgtcttcagttgatcaacaagtattcaagtgctggctgtggtttctgagctgtaaggaatcrtgaaagatagcatagaattttatggcttcatggagcttgagatgagaaactctagtgccagtatggaacagcttaaaattgcacagcacaacaagtaaaa

SEQ ID NO: 60145 - DNA, 201 bp, Homo sapiens
ctatgccttaagataactgtccaggctaggcactgtggcttacgcctgtaatcccagcactttgggaggctgaggcgggtggatcacgaggccaggagttmaagaccagcctggccaacatggtgaaaccccgtctctactaaaaatacaaaaaattagccgggcgtgctggcaggtgcctgtaatcccagctacttggaa

SEQ ID NO: 60146 - DNA, 201 bp, Homo sapiens
caaaaagagttgggcatgctgaaggtcagtggtctgaagataaaattatcccttgattctcacccctgtgttcccattactgaatgttagctccttgaggyagagaccttcgtttcattcccactaaattctttgaacctagaacagtgcctggcacagtgagagtgcccattaaatatttgtggaatgcctgagtgatcc

SEQ ID NO: 60147 - DNA, 201 bp, Homo sapiens
tggtccagcctcagatcatcaagacagattcccttgttttgaccacactgaagacagatggcagccctgttatggctgcggtccagaacccggccctcacygccctcaccacccctatccagacggctgcccttcaagtaccagtaagagctgccttctcccccaccctcctccctccccctttattcctggaggtgttag

SEQ ID NO: 60148 - DNA, 201 bp, Homo sapiens; identical to SEQ ID NO: 17438

SEQ ID NO: 60149 - DNA, 201 bp, Homo sapiens; identical to SEQ ID NO: 17439

SEQ ID NO: 60150 - DNA, 201 bp, Homo sapiens
actgtttccgtagtcacctctactttttgatcgttcaccaggttttgaaatcactgtgtaggcagcacccactatgcagttcaaaactttatgtaggcctsttttgtactgggctccaggttcagtgctggcaaataaacaagttccttgttctcacagaatgtgtatggccttgggtgccaggcaccgttccatgcctta

SEQ ID NO: 60151 - DNA, 201 bp, Homo sapiens
tgtaagcaggcttctaagttgcaaataccaggtggtgtggtgtgctttgaagctatttattcaacatgtgtttatcaagaagtgtctgtccaggcgcagtrgctcatacctgtaatcctagcactttgggaggccaagatgagaggatcccttgagcccaggagtttgagactagcctgggcaacatacctggacaacata

SEQ ID NO: 60152 - DNA, 201 bp, Homo sapiens
gggaaaggcccccagtagagggaagagtgtcagtgacagcccagagacacggaggaaggatgcctgaggaatacaaagggtacacatagacagcgcttgcrtgtgcctgggatgacaggaaagggacagaaatggccattgggtcttagagctggagagctgaacagctaggccatgaggtgggccttgtgtatatgtttt

SEQ ID NO: 60153 - DNA, 201 bp, Homo sapiens
tgctgcccacctggaggggtaggcaggcattcattcagtcgctcatttcaccaggactcccagcaaccgataaaacagaccaaaattcctccccttgtggccttaataccataagccttgtaggcaggacattttggtcccctgaggtaatatgaggtaatatgaagattggttcagcaatagcagagctactgtacttgg

SEQ ID NO: 60154 - DNA, 201 bp, Homo sapiens; identical to SEQ ID NO: 17430

SEQ ID NO: 60155 - DNA, 201 bp, Homo sapiens; identical to SEQ ID NO: 17445

SEQ ID NO: 60156 - DNA, 201 bp, Homo sapiens
agtgagggtaggctgtgggggatgctagggaaaggcccccagtagagggaagagtgtcagtgacagcccagagacacggaggaaggatgcctgaggaatayaaagggtacacatagacagcgcttgcgtgtgcctgggatgacaggaaagggacagaaatggccattgggtcttagagctggagagctgaacagctaggcc

SEQ ID NO: 60157 - DNA, 201 bp, Homo sapiens
agatcatctgaggtggaaaagagtccctggtaaaagtaattttaaatagttttgaagtagaattgtgaaattcagagtttggagaaaggaagagggtggtsacaagtagaaaagagaagacatggcacttacattcaaagaaagattgccctaccccacccctcaaaggcatgtgcagaagagggagtgagtacttttcca

SEQ ID NO: 60158 - DNA, 201 bp, Homo sapiens
atttcaaagaatcttatagttcttcaatggagttcaagaattgggacaggtgggggaatgtaaaggcaaaaagctgagacagtcctcccaaagtgcacttkccgtccagaaaggatggaagaaaatgaagccccagggagttgttgattctcaacatctgttaactcccttgctgggtgcagtcatttgctgattagcttc

SEQ ID NO: 60159 - DNA, 201 bp, Homo sapiens
tcttgtcaccagttgggaaaagcaggccttttgcctctctctcctctcatcctgctcctgctgttcagccaggtttcctgcctggctcagggtcagagtaygggacaacagaggttgcttttcaggggtgagcaaggcagggtggtgtgggaagggatgtcatgaggtggcaggcgagatggctcagggagagctaccctg

SEQ ID NO: 60160 - DNA, 201 bp, Homo sapiens
caccccggcacctccccaggtgttcctgcatgaagccaccgtgcgcctgatggcaggagccagccccacccgcacccaccagctgctggaacacagcctgmggcggcgcaccacgcagagcaccaagcacggtgagtccacccctccccagctcacaggctgggccaggccctgcgccctaggaagagaggagaagagggg

SEQ ID NO: 60161 - DNA, 201 bp, Homo sapiens
ggagcagcctcaacgtcagtggggccacctctgaccctgccctcaaccacgtgagtgggagctgagttggcccctgggggaggtgctctgcactggtttasgagaacactcccactcacctcatgctgaccctgcgggtggggccatccgaaagacagagaaaccaggacagcagccccctttcaaaaaagttacggctta

SEQ ID NO: 60162 - DNA, 201 bp, Homo sapiens
ggagccttaatcggtagtaaatagaaagtcaaacaaggtgatggttccatagagcatcagataacttttaggcaggcagcttagacagtgctgtagtatamctttttttttttttttttgagtcaggggtcttgctctgttgttccaggcttgagtacagtggtacagtcgtggctcactgcagccttgaactctggcctc

SEQ ID NO: 60163 - DNA, 201 bp, Homo sapiens
ctggctccagggagacgatgcagctgtgcgctctcattttaccaaagtggaacgcatccccaaggccctggaagtgacagagtgcgtaaccctccttggcmactcacttgcttctctccaggggaatcttgtttgagttagcaggagcaaactggactgggtgggcgtgttggggtgaagggtcaggactgcatgacaggt

SEQ ID NO: 60164 - DNA, 201 bp, Homo sapiens
ccaaaattcctccccttgtggccttaataccataagccttgtaggcaggacattttggtcccctgaggtaatatgaggtaatatgaagattggttcagcartagcagagctactgtacttgggggttaatatgcaacttttctgttcttcaagtggtcataaaaattcttagaatcccctggttatgtctcatggttcttt

SEQ ID NO: 60165 - DNA, 201 bp, Homo sapiens
acttttctgttcttcaagtggtcataaaaattcttagaatcccctggttatgtctcatggttctttcatttactcagaaggtatttattgggcatcttgtrttgatcacagcactgtgaatccagaaataaaagccagtgcctttgccaagctacagagttaaagaaaagaaaaatgaaatgaataaaagtaaaagaaaac

SEQ ID NO: 60166 - DNA, 201 bp, Homo sapiens
gttaaagaaaagaaaaatgaaatgaataaaagtaaaagaaaacctgtgcctgtctacaaggagctcaggtcagacgagggcagggattgtggctatcaagyacctcccatatgcctagctaggagccaggcttgggaactctcaaatgggtaattcccggtccttgttatcagctagctcacaacatgctgacctcaggct

SEQ ID NO: 60167 - DNA, 201 bp, Homo sapiens
ggtttcaccatgttagccaggatggtctcgacctcgtgatccgcctgcctcagcctcccaaagtgctgggattacaggcgtgagccaccatgcccaggcctttttttttttttttttttttgagatggagtttcgctcttgttgcccaggctggagtgcaatggaccagtctcagctcactgcaacctctgcctcccgggt

SEQ ID NO: 60168 - DNA, 201 bp, Homo sapiens
catacgtagatcaaaacttaaaacatatttagccatgttaatcctcttgtggtgtagtttatcagcagtgattcttgaagggaggtagtaaccaaggttcygtggctcctgagacttcttggggcctgatttgattaacccaggaagagtctcagacctcatgaagtactgccaggtctggcagcacttggccaaagcggg

SEQ ID NO: 60169 - DNA, 201 bp, Homo sapiens
gactagattattgcagatgaactttttagttgttttctggctttggttattatgaagggtgctgctgtgaacctccttgtacacacatctttcaggaaacrtgactgcatttttaggaatggcatcgctgggtcagaggttgtgcgtatttccaaattgttggccattctccactccatcagcagtgaacaagacttctag

SEQ ID NO: 60170 - DNA, 201 bp, Homo sapiens
ggtgtcactgtttcttaccaatacatgaacctgtcaagcactgcacacctcaagctttggaatcagactagcaaccatcactctctctcttttccacattrattttcacacagtactatgacagatatcacatctccaaaggaagctagtgtggtctcaatgctgaggctgcatgctctccccatctagtcacttacagtg

SEQ ID NO: 60171 - DNA, 201 bp, Homo sapiens
tttctgttctccatattttctgctgtggatcctgaacatatattgggttggggggagggggggcatgtattattaatcttttttttaattttttttttttggagacagttttgctcttgttgcccaggttggagtgcagtggcgtgatcttggctccctgcaacccccgcctaccaggttcaagcgattctcctgcctcag

SEQ ID NO: 60172 - DNA, 201 bp, Homo sapiens
gagccagttgttgggggcaagtggagggctggcctctgtgaaaatggtttagactagaggttcccaaacttgctcaactcatgactcaagattcccaaacwttctctactcactatgtctcagtaaatttttcatggcatcccttagccaaaagaaatacctaacggttctggttttcgttttttgaaacagtgtcttgct

SEQ ID NO: 60173 - DNA, 201 bp, Homo sapiens
caaagaggaaggacggactattggtgcccctggtcccagtgattagaaatgtaagtgaaacaccccacctcatctcataagctgctttgagattatgagtrtgtgtctatagaacaggttgttttctctcagactcaggcagtgtctccaggttccccctggagagagatagtcttctctgtctgtgtcctcgagtggcac

SEQ ID NO: 60174 - DNA, 201 bp, Homo sapiens
gttcttgtacttgttgggcagctctaatatgaaagataaaatgaacgaaaagtacaaatgaagaaagtttaggtgactattcctctgatcttgaggatgarggtttttcttaagcgttacacagaagccatgtaatttcactatacaatgtaaaaatggtgtatagtcagttctgctatagttcatcatgtgcatttctaa

SEQ ID NO: 60175 - DNA, 201 bp, Homo sapiens
gagtccgtttgtttgtttgtttgtttgtttgtttgaaccaaagctcagggaggttgagtaacttgcttaaggtcacaagcctgatcagaaattgtcagtgrctaagctgggtgtgcagctctgctctctctaacattcagagcccatggtccttacatcacacagcaataaattgtgattaagctccaagggtactcttag

SEQ ID NO: 60176 - DNA, 201 bp, Homo sapiens
agaaaagtcgggggtgagggcaccatggagaactcaagttgggccagcaggtcctctgtgcaagtgtcctgctctgcacaacacgacagttgtcccagcarctgtcagcactgtgtccgggtcctcctccctgcagccttcatggcgccacaggctgaaaagaagagacgagagcagtgtggcccccagcatcttcagaag

SEQ ID NO: 60177 - DNA, 201 bp, Homo sapiens
tagtcttttcctttacagttagacattttaagtcctgttcaataaatctttgtcctacctcaaagtcatgaagatattctcctatgttgtctgctagacgytttattttttactctttacacatatgtacctaatccacctggaattaatttttataagagttggaggtaggagtgcaagatctgtttttctccataagga

SEQ ID NO: 60178 - DNA, 201 bp, Homo sapiens
gcactgggattacaggcatgagccaccacaaccggtctcagcagctttctgtttgtcagatatacaaatataccccaggctccaggcccccacatcccccaaaaaacacacacacacacacacacacagcatcagagacctgagaaggacatcttggtggaggtttgggggaatggagatggttccttttatttttttata

SEQ ID NO: 60179 - DNA, 201 bp, Homo sapiens
cgcttgagcctgggaggtggaggctgcagtgagctgaaattgcaacactgcactccaacctgggtgacagagcaataccctatctcaaaaaaaagagagasagagtctcgctgtgttgcccaggctgttctcaaactcctgacctcaagtgaccctcccaccttggcctcacaatgcactgggattacaggcatgagccac

SEQ ID NO: 60180 - DNA, 201 bp, Homo sapiens
tagaaaacagcatcttgtcaaggcatatggtctcatttgaagaataatttaataatttggataggaaggtatacttgtaaaatacagccagtcaaaaataycttttccccattccccttgatgcgtccattacatacatgttcaccctgagattgatcttccatcagcattgaaatgaacattgaaagtaataagatgggc

SEQ ID NO: 60181 - DNA, 201 bp, Homo sapiens
gttgggttcaggatctagtttggaacagtgatgaaatttcgagctgctgaaccagatatggaactgctttgctaacctggtgtctgcccagcttaagcccyctccatcccacagctgtgaaaggaaatcatgcttcttcccaagtgctaacattcctgtgaggccttacactttacccaagtcctcctgatacatttgtct

SEQ ID NO: 60182 - DNA, 201 bp, Homo sapiens
cctgtgctgatctttcccagtctcccccaaagcccacctccaccatggtgctttctgcaccccacagtggctgcagccagcattctgccaccttggtgttrcccctggtccttgtccttccacagagctacttcctcagccgagcccagagcctgtgtggccccgagcacagtgctgttcctgactccctgcgctggctct

SEQ ID NO: 60183 - DNA, 201 bp, Homo sapiens
aagaaagagtccagttgactaggctagtaatcttattaactggatagttgcactcttatgtttaggccccaaaatgctttgtattatttcacttcttcctmaacaatcctgtgagatactcttattacctctattttaatacggtaattaaagaagccgaggccaggagatgttgacttatctaaggccactcaccttaga

SEQ ID NO: 60184 - DNA, 201 bp, Homo sapiens
ctgtaatcccagcactttggaaggctgaggcgggtggatcacgaggtcaggggttcgagaccagcctgaccaacatggtgaaaccccgtctctactgggcktggtggcgggcgcctgtaatcccagctactcaggaggctgaggcaggagaagtgcttgaacccaggaggtggaggttgcagtgagccgagatcccgccac

SEQ ID NO: 60185 - DNA, 201 bp, Homo sapiens
ctaagttgcaaataccaggtggtgtggtgtgctttgaagctatttattcaacatgtgtttatcaagaagtgtctgtccaggcgcagtagctcatacctgtratcctagcactttgggaggccaagatgagaggatcccttgagcccaggagtttgagactagcctgggcaacatacctggacaacatagtgagaccccatt

SEQ ID NO: 60186 - DNA, 201 bp, Homo sapiens
taagttgcaaataccaggtggtgtggtgtgctttgaagctatttattcaacatgtgtttatcaagaagtgtctgtccaggcgcagtagctcatacctgtartcctagcactttgggaggccaagatgagaggatcccttgagcccaggagtttgagactagcctgggcaacatacctggacaacatagtgagaccccattt

SEQ ID NO: 60187 - DNA, 201 bp, Homo sapiens
agtagctcatacctgtaatcctagcactttgggaggccaagatgagaggatcccttgagcccaggagtttgagactagcctgggcaacatacctggacaayatagtgagaccccatttctgtaaaaaaaaaaaaaatacaaaaattagccaggcttggtggcaccagcctgtagtcccaactacttgggaggctgaggtgg

SEQ ID NO: 60188 - DNA, 201 bp, Homo sapiens
cccatttctgtaaaaaaaaaaaaaatacaaaaattagccaggcttggtggcaccagcctgtagtcccaactacttgggaggctgaggtgggaggatcactygagcctaagaggctgaagatacagtgagtcaagatcacaccactgcacttcagcctcgtcaacagagcgagaccctgtctcaaaaaaaaaaaaatacata

SEQ ID NO: 60189 - DNA, 201 bp, Homo sapiens
tcccaacactttggaaggccgaggcaggtagatcacttgaggtcaggagttcgagaccagcctgaccaacatggtgaaaccctgtctctactaaaaatacaaaaaaaaaaaaaaaaaaagtgctactctgagggaactctgaccagcatttgctcatagaacaaacgcacgcagtacaatctcaatcgagtaaaaagtctg

SEQ ID NO: 60190 - DNA, 201 bp, Homo sapiens
aagatcacaccactgcacttcagcctcgtcaacagagcgagaccctgtctcaaaaaaaaaaaaatacatacacacacacacacacacacacacacacacaygtatatgtatatatattttttaaattaagaaaaaatgtctgctctatgctggacacttaaagtgacttcccctgggtcctagggtactttctgagcctta

SEQ ID NO: 60191 - DNA, 201 bp, Homo sapiens
agcatcagataacttttaggcaggcagcttagacagtgctgtagtataactttttttttttttttttgagtcaggggtcttgctctgttgttccaggcttkagtacagtggtacagtcgtggctcactgcagccttgaactctggcctcaagtgatcctcccacctcagcctcccaagtagctgggactacaggcatgtgc

SEQ ID NO: 60192 - DNA, 201 bp, Homo sapiens
ctttgcctctgtttaaactatattaatataaggagagtcttgcagtatacactgttttgtgtctgacttattttgctcaatatcatgtgtaagaatcattwtgttgttatgtagaattatagattgttcgttctcatatttatagtgttccattgtatgactagattattgcagatgaactttttagttgttttctggctt

SEQ ID NO: 60193 - DNA, 201 bp, Homo sapiens
tactttttaaaaatcattactactaatttgctcagtttttcttcttgattgttgttctcaaagtctgtttcttttatttattttcattattattattattwtttttttttttgagacggagtctcgctctgtcgcccaggctggagtgcagtggcgcaaactcggctcagtgcaagctccgcctcccgggttcatggcatt

SEQ ID NO: 60194 - DNA, 201 bp, Homo sapiens
gctttgcctctgtttaaactatattaatataaggagagtcttgcagtatacactgttttgtgtctgacttattttgctcaatatcatgtgtaagaatcatkatgttgttatgtagaattatagattgttcgttctcatatttatagtgttccattgtatgactagattattgcagatgaactttttagttgttttctggct

SEQ ID NO: 60195 - DNA, 201 bp, Homo sapiens
gcccacgactctgaccagcacccacactcaggctctggccgcagtgtcctgtcattcgagtcaggtaggtggaggccccttgccccacctgggcatggctrgaccactatggcaggagaaggaccctgtgtacaaacttcttggcttggctaccaggtcccaaagggcttttatagtgggcccccacctgcttgcttctga

SEQ ID NO: 60196 - DNA, 201 bp, Homo sapiens
ggataggtgaaaaggagaccctcagggccattcagaagaacaccctcatctaaagaacagataggccatcgcggtggctcacacctgtaatcccagcactytgggaggccaaggcaggtggatcacctgaggtcaggagttcgagacctgcctggccaacatggcaaaaccctgtctctactaaaaatacaaaaattagcc

SEQ ID NO: 60197 - DNA, 201 bp, Homo sapiens
ttttggggtagatggagttttgctctttttgctctttttgcctaggctggagtgcagtggcacagtctcagctcactgcaccctccacctcctgggttcargtgattcttctgcctcagcctcccaagtagctgcaggcatgtgccaccatgcccagctaatttttttatttttagtagagacggggtttcaccatgttgg

SEQ ID NO: 60198 - DNA, 201 bp, Homo sapiens
cagtgcagagaggccactgttgcccccaaaactcatgtgcactggagcatcttgcccctgtgtgctagcattttatccactttccttccagccacctccasccccaccatcaaccctggcaactttgtcctgtaactaaaatagcctttagcacatggcataaccggagagcttttgacattcctctttggagattcatgt

SEQ ID NO: 60199 - DNA, 201 bp, Homo sapiens
ttgtctaacacaaggtgcataataaatacaaaatataagaataaatgacctttgtaaactaggtttcccagcccctaatagggctgggtaacaaatacctrttaaaggattattgactgaatctgtaatttggagaaactgtaaccctatttggaggcttcacattctttattcttgaccagaattaatttaaccagattt

SEQ ID NO: 60200 - DNA, 201 bp, Homo sapiens
taccttgtgggtatctcagcctcctagccagccatggtgggactcccatggggtggaagaacctgcgccttcaacccacaagggttttatttctgcccctrccacctgcctgtgctgtattccctatacaagctgctgtccctgtcagagccttgctttctcacctgcagaatggggagggcttgtctcccacctcctggg

SEQ ID NO: 60201 - DNA, 201 bp, Homo sapiens
accagcccatatctttcccacaaaagggtttcaagagtacttgacaaaatgagatcagtgcacccacatgcctgtgtagtgggtgctctggaagtaccgcyaacattgacctgcataagggtctacccttcaccaagcacttcggataaattatcttattaatcctcagggcaaagaggccaagtgtgtattttcaaagca

SEQ ID NO: 60202 - DNA, 201 bp, Homo sapiens
tgtgcacattttgtgcattcctgcatggctcatttcagccgaatatggttttctgcacttcctagtgtttttctcatgcataagcaaatgcaaaatttatrttatgctcagattgtttctggatgtatctgatgcatttgaacaaattcacattttcaaagtaagagttaaagcaaaagtgtcaaaaaaaaaaaacccact

SEQ ID NO: 60203 - DNA, 201 bp, Homo sapiens
gctcatttcaccaggactcccagcaaccgataaaacagaccaaaattcctccccttgtggccttaataccataagccttgtaggcaggacattttggtccmctgaggtaatatgaggtaatatgaagattggttcagcaatagcagagctactgtacttgggggttaatatgcaacttttctgttcttcaagtggtcataa

SEQ ID NO: 60204 - DNA, 201 bp, Homo sapiens
tcagaccccatcagcggcctcctccaggaatccttttttttaatttttttatcttttgaagcagagtctcgctctgttgtccaggctggagtgcaatggcrcaatcttggctcactgcaacctccacctccccggttcaagtgattctccagcctcagcttccctagtagctgggattataaggtgcctgccaccacacct

SEQ ID NO: 60205 - DNA, 201 bp, Homo sapiens
acctgaggagagggggagggggcagttctgcctgggagataagaaaacttttgggaggagatgacactggacttggggcttaaggagaggagtgagggtaggctgtgggggatgctagggaaaggcccccagtagagggaagagtgtcagtgacagcccagagacacggaggaaggatgcctgaggaatacaaagggtaca

SEQ ID NO: 60206 - DNA, 201 bp, Homo sapiens
taaaatccaagaactggaagcaactcaaatgtccatccacaggaaaataagcacattgtgatatattcatacaatgaaattatgcctagcaattaaaaaamagaactgctgacaggcacggtggctcacgcctgtaatctcagcactttgggaggccaagaggggtggatcacctgaggtcaggagtttgagaccagcctg

SEQ ID NO: 60207 - DNA, 201 bp, Homo sapiens; identical to SEQ ID NO: 17435

SEQ ID NO: 60208 - DNA, 201 bp, Homo sapiens
tgaggcaggagaattgcttgaacctgagaggtggaagctgcagtgagccgagatcgcaccactgcactccagcctggatgacagaacgagactgactctcaaaaaaaaaaaaaaaagctactgatgcatgaaacaacatggggctgtccctcagaaatagtgtgtcaagccaccgggcgcagtggctcacacctgtaatcc

SEQ ID NO: 60209 - DNA, 201 bp, Homo sapiens
cactgggattacaggcatgagccaccacaaccggtctcagcagctttctgtttgtcagatatacaaatataccccaggctccaggcccccacatcccccaaaaaacacacacacacacacacacacagcatcagagacctgagaaggacatcttggtggaggtttgggggaatggagatggttccttttatttttttatag

SEQ ID NO: 60210 - DNA, 201 bp, Homo sapiens
ggattacaggcatgagccaccacaaccggtctcagcagctttctgtttgtcagatatacaaatataccccaggctccaggcccccacatcccccaaaaaacacacacacacacacacacacagcatcagagacctgagaaggacatcttggtggaggtttgggggaatggagatggttccttttatttttttatagtggtg

SEQ ID NO: 60211 - DNA, 201 bp, Homo sapiens
attacaggcatgagccaccacaaccggtctcagcagctttctgtttgtcagatatacaaatataccccaggctccaggcccccacatcccccaaaaaacacacacacacacacacacacagcatcagagacctgagaaggacatcttggtggaggtttgggggaatggagatggttccttttatttttttatagtggtggt

SEQ ID NO: 60212 - DNA, 201 bp, Homo sapiens
aaggatagatctaaattgtttctgaaatgtttaaatttcaaaccccgcatagtcaaggataataaaacagactcatctttttttgccctcttgttaaattmtaagcttcacaggcatttgaatacatctaaaaaatttggtttgtgagccttagaatttaaccacttacaaaactcttgagctccctccacttctgaggac

SEQ ID NO: 60213 - DNA, 201 bp, Homo sapiens
atatacctgggaaatagctggttaagcttcaccacaaaggatagatctaaattgtttctgaaatgtttaaatttcaaaccccgcatagtcaaggataataraacagactcatctttttttgccctcttgttaaattctaagcttcacaggcatttgaatacatctaaaaaatttggtttgtgagccttagaatttaaccac

SEQ ID NO: 60214 - DNA, 201 bp, Homo sapiens
aaattaaagttgatgaaagaaataacagattccccggctctatatacctgggaaatagctggttaagcttcaccacaaaggatagatctaaattgtttctraaatgtttaaatttcaaaccccgcatagtcaaggataataaaacagactcatctttttttgccctcttgttaaattctaagcttcacaggcatttgaata

SEQ ID NO: 60215 - DNA, 201 bp, Homo sapiens
tccatttttacactgcactcttattctctagaaaactgtattctctcttccttagcagccttttgtgacaaaaagatgagcaaaaatgtcacactaggtamaatttcttccaggcatattcatacctttcatcttactccatacagttgttttaggtggtttctctagtatagaaatgcccagtttctctatggcttgtaa

SEQ ID NO: 60216 - DNA, 201 bp, Homo sapiens
atccatgatgttagcttttcctctataaatcaacttaactctcttttataatggtgacacttacaaagctaaaaccccaggaaaattaaagttgatgaaakaaataacagattccccggctctatatacctgggaaatagctggttaagcttcaccacaaaggatagatctaaattgtttctgaaatgtttaaatttcaaa

SEQ ID NO: 60217 - DNA, 201 bp, Homo sapiens
tggcacagttttcacttttttcctgatccataaaaccagcaaagtggatacattcagtgttctataactacatttaagatccatgatgttagcttttcctytataaatcaacttaactctcttttataatggtgacacttacaaagctaaaaccccaggaaaattaaagttgatgaaagaaataacagattccccggctct

SEQ ID NO: 60218 - DNA, 201 bp, Homo sapiens
gcatcaaactacagtttgcttctacttggaccttaactttctcaaataatgcaagagcttttgttttatactatgaccctttgatatccttgtcttttctrgctttttctagtttttctcaggtgctcccccaacctgttccacacaggatttgtaacttcaggtcatttgcatggttatcagaatgccccttcgctaatg

SEQ ID NO: 60219 - DNA, 201 bp, Homo sapiens
gatcgtttcaatttcttcaaggattagagttcccgtttgaatagcagaatgcccattatctaatccaagttctactgaaatcactttctctccagaagttrtgctattgctcacatttgattcacagacctcatcaccatctttccgtgagatgccttcacttagatcctgggttgacttagcctttgttgcctgatcatt

SEQ ID NO: 60220 - DNA, 201 bp, Homo sapiens
cccgccgccgggtgcgccccctccccaccgcgcggggacagacagcaggcagcgccaatgcgagcggagcggagcgggcgggcaggggcggggcgaccgcsggaggcgcggggcggcgcgggcgccgggacccacctgcagcagcagcctgcctgcctgccgcggggaagcccatcgtgctccgcccgggcgccaatctcc

SEQ ID NO: 60221 - DNA, 201 bp, Homo sapiens
tgtggcttgacatctattttaagagttcctgagctactgtgatgataagtcccccaaacatttgatgagagttgggaagccagtatcccctgagcaccagwggatccctgaggaggagtgacatctctagctcagccaggataccgtgttatgttattaacatttatagctaacatcgaatagcagtttccattacaacat

SEQ ID NO: 60222 - DNA, 201 bp, Homo sapiens
aaattatctaatctgaagtagagaaataagttattgtatatgaaagttctctgtaaacttcagtgctctatgtaagtttcagagtttattactccaggttkctttcatatgtaaagggaagaggtatgtttgggtcttctgatctgcagcttccttaatgtcctgtcctgtcatgtctgtgtctaagctttataccctctg

SEQ ID NO: 60223 - DNA, 201 bp, Homo sapiens
gttttcttttttctcctcctctgtcttattttgtcttttctgttttccaaagattcattcttagcttttttccctcttatttcattctactttttagtctrctttattattttcatacttggttacttcagccttgtcgtttcagaggcctcttctccctctctggctctgctctctctagagccctgtcctgcttcttgt

SEQ ID NO: 60224 - DNA, 201 bp, Homo sapiens
gtgctgggattataggcatttatttaccgttctgctttccctttgctagcaggaattttctttctctctctctctctcttttttttttttttttttttttygctttattgggagaaaaagtgcttagagtgttcagttattttttatatttttctaattcatttcttctctggttacaaatcagtcatgcatggatgtttt

SEQ ID NO: 60225 - DNA, 201 bp, Homo sapiens
agtgctgggattataggcatttatttaccgttctgctttccctttgctagcaggaattttctttctctctctctctctctttttttttttttttttttttktgctttattgggagaaaaagtgcttagagtgttcagttattttttatatttttctaattcatttcttctctggttacaaatcagtcatgcatggatgttt

SEQ ID NO: 60226 - DNA, 201 bp, Homo sapiens
caacaagcaggcggcctggcagccgcccgtcaccgggtcctcgcagcgcgtccgccgcgctccggctccccgcacggatcggcgcccctccggccccgcastccgccaggcccgcggcccgtcgccctccggcctgggccaaagttgcgcaaatagccccacaactggcaaatacttaccggccgcaacaggaaccagagc

SEQ ID NO: 60227 - DNA, 201 bp, Homo sapiens
tgcaggcttttttttttttttttttttttttttttgagacagtcgtgctgtgtcgccaggctggagtgcagtggtgcaatctcagctcactgcaacctccrcctctcgaattcaagtgattctcctgcctcagcctcctgagcatgtgccaccatgcccagctaatttttgtatttttagtagagacagggtttcaccatg

SEQ ID NO: 60228 - DNA, 201 bp, Homo sapiens
tgtacatggttggttggataagacagcaagtgcctcagggcagagtttggataaatggtaagagtttgctagcagctgattggccgtgatagacaacactsatttaaagcagaaatatatctgttcgttgagagttaagaaaatagtggttaactgtatttctattcttatagttccttttaatattagaaattcaaagca

SEQ ID NO: 60229 - DNA, 201 bp, Homo sapiens
gtttctgaagtttcaagtgggcttgcttgctggggttgaacatcttgtttttccttgatcgtttcaatttcttcaaggattagagttcccgtttgaatagsagaatgcccattatctaatccaagttctactgaaatcactttctctccagaagttatgctattgctcacatttgattcacagacctcatcaccatctttc

SEQ ID NO: 60230 - DNA, 201 bp, Homo sapiens
gggtggaggtagagttgtacatggttggttggataagacagcaagtgcctcagggcagagtttggataaatggtaagagtttgctagcagctgattggccrtgatagacaacactcatttaaagcagaaatatatctgttcgttgagagttaagaaaatagtggttaactgtatttctattcttatagttccttttaatat

SEQ ID NO: 60231 - DNA, 201 bp, Homo sapiens
gtgccaggcccactcattattctttgacacaggaaatccttgtatatagctaaagggtggaggtagagttgtacatggttggttggataagacagcaagtrcctcagggcagagtttggataaatggtaagagtttgctagcagctgattggccgtgatagacaacactcatttaaagcagaaatatatctgttcgttgag

SEQ ID NO: 60232 - DNA, 201 bp, Homo sapiens
gcactttggttgaagggtgatttaagactagcagacgctgagtaagacaaaaagtggcagcctcctgtttgccagaatggataaaagttgcaagtagaaaygggttctaaagtccatatgtccctgctctttcaggtctcctgctggttttcaaggactgggcttccagccttgggtgctatgcattggagcctggagagg

SEQ ID NO: 60233 - DNA, 201 bp, Homo sapiens
gctgggattataggcatgcgcaaccaagcccggctaattctgtatttttagtagagacggagtttctccatgttggtcaggctggtcttgaactcccaacytcaggtgatctgccagccttggcctcccaaagtgctgggattacaggtgtgagccactgcacccagccaggaacactttcttttaatatcaagcctcaga

SEQ ID NO: 60234 - DNA, 201 bp, Homo sapiens
gcctatgggtaaataaagaaccagggactgtgccacctaatccaaactcagtatttcagaggagagaaggctgccacccagagaagtgaagcaacgggtayttggcagggctgggaggacccagagattgtgactccaagtcctgctttgcaaagagttgaaaggacaaactaaccaaacatctacctgcttcgtgtagac

SEQ ID NO: 60235 - DNA, 201 bp, Homo sapiens
gggtaacccataattttatgaactgtagaaggaactggaaccctgaaaatcagtttatgatctaagtaaatattatcttaggttgggtgtttcatactgtrtgcctctaacagaaagataaagtcattctagaacaatgacggaactaaaatatgaacatttgacagtgtttctcctcacaatgtttcagtgagcactaga

SEQ ID NO: 60236 - DNA, 201 bp, Homo sapiens
gtttcaccacattggccaggctggtctcgaactcctgaccttagctgatccacccgccttggcctcccaaagtgctgggattataggcgtgagccactgcscctggccaaatagcgcttataagagacttaagactaggaaaccactcacgtttaatatcaatatgcatattctgcacactatctgctgaaattgggaaaa

SEQ ID NO: 60237 - DNA, 201 bp, Homo sapiens
  misc_feature (1)...(201): n = A,T,C or G, or insertion/deletion polymorphism (see Tables 1-2)
gtccatgaatcaccacaggccatccccaggcagagtgaggcacacacagctgtgatcaaatgttgccttctctcgttttaaacaaggaattaactgtacanggtgattatctctggggagtgggagtcaaaatgactttcatttttgtattttatgtacttcaatacaggctgaatttttcaaagagcatggattttataa

SEQ ID NO: 60238 - DNA, 201 bp, Homo sapiens
ctggccaacatggcaaaaccccatctatactgaaaatacaaaaaattagccaggcatggtggtgcgaacctgtaatcccagctactcgggaggctgaggtsggagaatcgcttgaacccgggaggcagaggttgcagtgagctgagatcacgtcactacactgcagcctgggcaaaagagcacgactcttgtcccaacccc

SEQ ID NO: 60239 - DNA, 201 bp, Homo sapiens
gaaagtccccgggtcacgcggttgtttgtggggagcctgtgacgctcaggcttgtccctatgcttccgcctacagagtcacaactgcgaactgtggcggcrgcactcagagcgcgggccgacccccgcccggccactgaggcgggcgggcgggagggcgcgcacgtacgcacgcacgcacgcacgcacaccccggccctgg

SEQ ID NO: 60240 - DNA, 201 bp, Homo sapiens
cctttcttgccttttgttcattttttgtacatccacaatctatgaggtatgttacctactgaaatttactttcttttccaactgtggttcaacaactgacyttcttctctcatactttccaacccattccattctgaataagttaagagttttcttaccttcagctcttctcaccttccaatactaagtgaatacagcctg

SEQ ID NO: 60241 - DNA, 201 bp, Homo sapiens
gcctataatcccaggctgaggtggagaggatcacttgaggccaggagttctaaaccaccctgggcaacatagtgagacccccatctctacaggaaataaamaattagctggatatgatggcatgtgcctgtagttccagctacttgggatgctaaggcaggaggattgcttgaggctaggaggttgaggccacagtgagcc

SEQ ID NO: 60242 - DNA, 201 bp, Homo sapiens
ggtggggagtccaggcattgtgctcatctaggatgtaaaaaagcattacaaataaactaatgctgggcacagtggctcacgcctataatcccaggctgagrtggagaggatcacttgaggccaggagttctaaaccaccctgggcaacatagtgagacccccatctctacaggaaataaaaaattagctggatatgatggc

SEQ ID NO: 60243 - DNA, 201 bp, Homo sapiens
tcctttcttgccttttgttcattttttgtacatccacaatctatgaggtatgttacctactgaaatttactttcttttccaactgtggttcaacaactgaytttcttctctcatactttccaacccattccattctgaataagttaagagttttcttaccttcagctcttctcaccttccaatactaagtgaatacagcct

SEQ ID NO: 60244 - DNA, 201 bp, Homo sapiens
ctgtgtgtacatcttcagtgcacagaaacagcctctgaagtgagatcagagaatgtacaatttgtttatcagtaatattactaataaggggaaggaaggcwttagcagcccagagaagagaaagggcacgggaaagccactaatctggagggactcttagcaccaaggtaaaggcactagaccttctctgccagcacatgc

SEQ ID NO: 60245 - DNA, 201 bp, Homo sapiens
agcttatcatgttaatatcactagatacagtgtgccagtaaaatagcttacatatttatctgagcaatactctactgatcttaccatttatcccatcttgrtctctacccattgcctgggcctatagctaccaaaaatgacttataactccttgttaatagctcttacatttcagaggccttctgggaataagccctccaa

SEQ ID NO: 60246 - DNA, 201 bp, Homo sapiens
tgaataatttcatttaaatttagatctccttgttactctgtaggtttgtgtgaactgtagacaattttgtattaataaaaaataatgcgtatatacatacwcacctatctacatttatcttgtcctttttttcagaaccacaatggacactgccagccatagccttgttcttctccagcagctgaacatgcagcgagaatt

SEQ ID NO: 60247 - DNA, 201 bp, Homo sapiens
tgccacctaatccaaactcagtatttcagaggagagaaggctgccacccagagaagtgaagcaacgggtacttggcagggctgggaggacccagagattgygactccaagtcctgctttgcaaagagttgaaaggacaaactaaccaaacatctacctgcttcgtgtagacttcagctttgtgttgagcttcgggaagtaa

SEQ ID NO: 60248 - DNA, 201 bp, Homo sapiens
ttagagtcagagctcacacaagaaaatgtggatactatcctagttgagtagcagcttctctttcagaatttttataccaattctgaaaaagaaaatttgcrtggcatttttaattcataaattattttcctcctcaagtttcattgactttttttcttcacagcttatccatggttttaaggttgtatatattagatcttc

SEQ ID NO: 60249 - DNA, 201 bp, Homo sapiens
tttgcagacagcaaatcacccaccttgaggtcataaaggagctggaagctgctgggtgcttgtgctgctctctggacggcctgagccagggctaaggcacmcttgcccccttctgcccagtgagtgcacttcacggcatcaaaagccccatgttctctggaaaggcggctgatgaggtccagctcagactctgtatccgtc

SEQ ID NO: 60250 - DNA, 201 bp, Homo sapiens
cagtggctcacgcctgtaattccagcactttgggaggccaaggcaggtggatcacgaggtcaggagttcgagaccagcctggccaagatggtgaaaccccrtctctactaaaaaaataagaaaaattagctgggcacggtggcagacgcctgtaatcccagctacttgggaagctgaggcaggagaatcacttgaacccag

SEQ ID NO: 60251 - DNA, 201 bp, Homo sapiens
gccctataattcataaataagctacatgaggaaaaaagccaaattattacccagtaacaacttacctgtttagaataatccattcacctgttctgtttcarggtccaaatcaatatcataaaaacagggccgggtggggagtccaggcattgtgctcatctaggatgtaaaaaagcattacaaataaactaatgctgggca

SEQ ID NO: 60252 - DNA, 201 bp, Homo sapiens
taaattgtttctgaaatgtttaaatttcaaaccccgcatagtcaaggataataaaacagactcatctttttttgccctcttgttaaattctaagcttcacrggcatttgaatacatctaaaaaatttggtttgtgagccttagaatttaaccacttacaaaactcttgagctccctccacttctgaggacgtttcctgaca

SEQ ID NO: 60253 - DNA, 201 bp, Homo sapiens
ctactattagtttcagatcttctgggcaggggctgacttctcttggcttacttatacttcctaactcccagtgggcctgaatagacactggccagactttyaaagtagcttcttgaagatggatggtgatctggaaggaaaaacaagaaataaatgttttctctaagcactgaaatgtttcctgttccttccatactgcac

SEQ ID NO: 60254 - DNA, 201 bp, Homo sapiens
gcaaacacgtctatcgaaatggtctgcgtatctctctatgggttgctagcgctgcttgttgccagttttgaactttaagccaaaagaaatccattatgctyataagcaattgagaactattccttattgagatccaaggtttctcaaaactagcagacctgggagtttgcaagagtttcaggcaaaaaataagatgagctt

SEQ ID NO: 60255 - DNA, 201 bp, Homo sapiens
tagaattctaagtttttccagttatagaatcagtaaaatcaaattgaatataaagtaaatgaaatctgttttaaagcatattctaaactatcacttctgcytacatttcacatgaattcactcctaccaggattatttttaaatattttcttccatataggaaattaatagttactttaatgcataactgtatgttataca

SEQ ID NO: 60256 - DNA, 201 bp, Homo sapiens
ccaccttcaccttacaagaatgagtgctggggagtagaggagttgctcactcgcctcctcagctcacgctttgcaagaccaaaaggaggtacagggcttgyctgcttttaaattttgtttcgttcagtcttgctagctgagctgcccatgtgatttttgcttcagcaacacgatggtaggagttagtatcctttaacttgg

SEQ ID NO: 60257 - DNA, 201 bp, Homo sapiens
taaacagacatgcatgatttatgttaatttatacatgatgagaattaaggctgaaaatgacttctggggaaactcctactattagtttcagatcttctggrcaggggctgacttctcttggcttacttatacttcctaactcccagtgggcctgaatagacactggccagactttcaaagtagcttcttgaagatggatgg

SEQ ID NO: 60258 - DNA, 201 bp, Homo sapiens
cttttgtgtgtgtgtgtgtgtttttgagacagagtctcactgttgcccaggctggagtgcagtggtgtgatcacagctcactgcagccttgacctcccagkcttaagtgatcctcctgcctcagcccctcaagtagttgggagtacaggtgcatgccaccatacctagctaattgttttattttttgtggagatgacgttt

SEQ ID NO: 60259 - DNA, 201 bp, Homo sapiens
caaacttgtttccttttattctgtggaacgtcactaaagtaaacagacatgcatgatttatgttaatttatacatgatgagaattaaggctgaaaatgacktctggggaaactcctactattagtttcagatcttctgggcaggggctgacttctcttggcttacttatacttcctaactcccagtgggcctgaatagaca

SEQ ID NO: 60260 - DNA, 201 bp, Homo sapiens
gtctcatttccctatggttcagtagttcaatataatgggaagaactggtgaaaatgtttatgatccgagggtttggttttgttttttttttttgagacaayttatcaggctagtttaagatgcttcaatatgaaccatttcattgattctaagacacgtttttcacatgctgaaattgtcaatacagatttttagtttgtt

SEQ ID NO: 60261 - DNA, 201 bp, Homo sapiens
agactttgttatatcagaggtcattaaaaagcttatggcataccataagtgctcaataaatacaccttcctcccccaaagcactccaatctccatatgccrttttagcaactccctgtatgttatgtcattttacactgcaatctgtgctgacttcctccaatccagaagtgactgcatttcagtggtagagttttataaa

SEQ ID NO: 60262 - DNA, 201 bp, Homo sapiens
cacttgggcccagaaggtcaaggctgctgtgagccactactgcaccactgcacgccagcctgggcaacaaagtgagaccctgcctcaaaaaaaaaaaaaaattcagtcagccttgttcactcagcaaacacgtctatcgaaatggtctgcgtatctctctatgggttgctagcgctgcttgttgccagttttgaactttaa

SEQ ID NO: 60263 - DNA, 201 bp, Homo sapiens
gagtaagttaactgatcatgctgttcttactcaaacatcttacatagttcacttcaaacacgacactactttttagtcttatattctgtatgctttttgarctgaccacatttcattatttctgttactttttttttctatgccaagctgaatccttctgttatctaactattcatattcttcccagtaattttattcatt

SEQ ID NO: 60264 - DNA, 201 bp, Homo sapiens
atcttggctccctgcaacctccacctctcgggttcaagcaattctcctgcctcagcctcccaagtagctgggattacaggcgtgcaccaccacgcccagcyaatttttgtattttcagtagagatggggtttcaccacattggccaggctggtctcgaactcctgaccttagctgatccacccgccttggcctcccaaagt

SEQ ID NO: 60265 - DNA, 201 bp, Homo sapiens
cctcccacagagtaagttaactgatcatgctgttcttactcaaacatcttacatagttcacttcaaacacgacactactttttagtcttatattctgtatsctttttgaactgaccacatttcattatttctgttactttttttttctatgccaagctgaatccttctgttatctaactattcatattcttcccagtaatt

SEQ ID NO: 60266 - DNA, 201 bp, Homo sapiens
tcccccttattggcaattcttctgcctcagcctcccaagtagctgggattacagacgtctgccaccacgcccaactaatttttgtatttttagtagagacrgtttcaccatattggccaggctggtcttgaactctgacctcaggtgatccaccctcctcggcctcctaaagtgctgggattataggcatttatttaccgt

SEQ ID NO: 60267 - DNA, 201 bp, Homo sapiens
actggagtgcagtggtgcaatcttggctccctgcaacctccacctctcgggttcaagcaattctcctgcctcagcctcccaagtagctgggattacaggcrtgcaccaccacgcccagctaatttttgtattttcagtagagatggggtttcaccacattggccaggctggtctcgaactcctgaccttagctgatccacc

SEQ ID NO: 60268 - DNA, 201 bp, Homo sapiens
ggtttcgccatgttggccaggcgggtcttgaactcctgacctcaagtgatccgcccaccttggcctcccaaagtgctgggattataggtgtgagccactgygcctggtccatgttttctttatccatttgactatccatggacatttgagtttttcccccttattggcaattcttctgcctcagcctcccaagtagctggg

SEQ ID NO: 60269 - DNA, 201 bp, Homo sapiens
catggccactgtgtgggtttgatggtatttctaggtgaggtaggccgcctatggtgtatttttggaactaaaagcctacaccccccagccacccctgaaartttcattgctgttctctattatttgcagcattggttgcttccttatgttaaggcatcaaagtcttctttaacaatctggatatattttagttaagggtaa

SEQ ID NO: 60270 - DNA, 201 bp, Homo sapiens
gggtgatcttctttacgcagtctactgattcagattttgtctccctccagaacaccctcacggacacacccagaataatgtttgactaactattggggcascccatggcccagtcatttggacacataaaattaaacattacacagggctatccccccccatagagacatttgacgatgtggagatgtttttggttgtcac

SEQ ID NO: 60271 - DNA, 201 bp, Homo sapiens
tgcacaccctggggaaagtccccgggtcacgcggttgtttgtggggagcctgtgacgctcaggcttgtccctatgcttccgcctacagagtcacaactgckaactgtggcggcggcactcagagcgcgggccgacccccgcccggccactgaggcgggcgggcgggagggcgcgcacgtacgcacgcacgcacgcacgcac

SEQ ID NO: 60272 - DNA, 201 bp, Homo sapiens
tgcactctccaccatgccaggaccgcagtgccagtttaccccactcacctgtagagaatgtatccggcggaggtcattatatatacttggcttgattcagkttatggagaagtcaggcatggccactgtgtgggtttgatggtatttctaggtgaggtaggccgcctatggtgtatttttggaactaaaagcctacacccc

SEQ ID NO: 60273 - DNA, 201 bp, Homo sapiens
cgagattgcgccattgcactccagcctgggcgacagagtgagactccgtctcaaaaaaaaaaaggcagggtgtggtggctcacacctgtaatcccagcacyttgggaggccaaggcgggcggattatgaagttaggagatcgagaccatcctggacaacatggtgaaaccctgtctctagtaaaacacaaaaaattagctg

SEQ ID NO: 60274 - DNA, 201 bp, Homo sapiens
agaatgcccattatctaatccaagttctactgaaatcactttctctccagaagttatgctattgctcacatttgattcacagacctcatcaccatctttcygtgagatgccttcacttagatcctgggttgacttagcctttgttgcctgatcattcaatggggtctgtgtttgtatatccaaaatttcagcttcttcctg

SEQ ID NO: 60275 - DNA, 201 bp, Homo sapiens
ctcatgcctgtaatcccagcactttgggaggccaaggcccaggagtccgagaccagcctgggcaatatagtgagacctcatctctgccaaaaattttggcyaggggcagtggctcacgcctgtaatcccagcactttgggaggtcgaggtgggcggatcaccagaggtcaggagttcaagatcagcctggctaacatggcg

SEQ ID NO: 60276 - DNA, 201 bp, Homo sapiens
catatagatttgtggcacttaaattattaatttttgatttcttaagagtgaagtctgtaaatgatttctctctgctgtacttctgtgtttgtatggttggwcattttgaaaactggtgagattgcacagtcccaaacctggatgtcttaaatacaaggaattacaaactgtgatttttgtcttgaagacctggaagaattc

SEQ ID NO: 60277 - DNA, 201 bp, Homo sapiens
cgcaccaccacacccagctaatttttgtatttttagtagagatggggtttcatcatgttggcaaggctggtttcgaactcctgaccttgtgatctgcctayctcagcctcccaaagtgctgggattacaggtatgggccactgggcccagcctatttttatttctttgatgtaggtgatctaaatagtagatgaggacagg

SEQ ID NO: 60278 - DNA, 201 bp, Homo sapiens
cattattgggaataaaactttgtcaatttcagctttattgaaagttctcccaaatatattgtttttgtttacacaaaggaaaaggaacaaaaacaataaakaaatacctttgtttttttttcttttttgagacggagtctcgctctgttgcccaggctggagtgcagtggtgcgatctcggctcactgcaacctccgcctc

SEQ ID NO: 60279 - DNA, 201 bp, Homo sapiens
tactgtaatttaatcatcactgtttctttttagccttcagtaaggaggatactagttctttggcattattgggaataaaactttgtcaatttcagctttaytgaaagttctcccaaatatattgtttttgtttacacaaaggaaaaggaacaaaaacaataaataaatacctttgtttttttttcttttttgagacggagt

SEQ ID NO: 60280 - DNA, 201 bp, Homo sapiens
ttttcttagaaagatcagcatcctcagcatttattgcaggttgcatttcaccctccaatggcttttgctgctttgaagactctgaccttttcctgcgtgtkacaagacgtttgagtgaggcccaggccccccgtgtgggctctggctgatcagaagctcctgcttcttgtggacacttccttgccacatcagcagcttcag

SEQ ID NO: 60281 - DNA, 201 bp, Homo sapiens
tgggaattttatgcagggaatcttaagtctagattttgcctttttcttagaaagatcagcatcctcagcatttattgcaggttgcatttcaccctccaatrgcttttgctgctttgaagactctgaccttttcctgcgtgttacaagacgtttgagtgaggcccaggccccccgtgtgggctctggctgatcagaagctcc

SEQ ID NO: 60282 - DNA, 201 bp, Homo sapiens
ttccttgatcgtttcaatttcttcaaggattagagttcccgtttgaatagcagaatgcccattatctaatccaagttctactgaaatcactttctctccaraagttatgctattgctcacatttgattcacagacctcatcaccatctttccgtgagatgccttcacttagatcctgggttgacttagcctttgttgcctg

SEQ ID NO: 60283 - DNA, 201 bp, Homo sapiens
cagatctcaacaacccaaaaaacagttgtcaaacaaggactggaggtcaaagaagctccttccagtaacagtggaaacagagctgctgtccagggtgaccwcccccagttgcagttgtctcttgctattggtctggatgatggcactgcagaccagcagagggcctgtcctgccacccaggccctggaggagcaccagaag

SEQ ID NO: 60284 - DNA, 201 bp, Homo sapiens
aggccctggaggagcaccagaagcccccagtttccatcaagcaggagagatgtgacccagaatctgtgatctcccagagccacccctcaccctcatcagargtgacaggccccacttttactgaaaacagtgtcaaaatacacttatgccattactgtggggaacgttttgattcccgtagtaacctaaggcaacatctcc

SEQ ID NO: 60285 - DNA, 201 bp, Homo sapiens
ggcaggtgaatcacaaggtcaggtgtttgacaccagtctggccaacatggtgaaaccccgtctttcctaaaaagagaaaaaaattagccgggcatagtggygggcgcctgtaatctcagcggcaggctgaggcaagagaatagcttgaacctgggatgtggaggttgcagtgagccgagatcactccactgcactccggcc

SEQ ID NO: 60286 - DNA, 201 bp, Homo sapiens
agagatgcagtgaatagtggtgtgggactgacccccagtttttgttattgttgttttcatttattctgcaggcttttttttttttttttttttttttttttgagacagtcgtgctgtgtcgccaggctggagtgcagtggtgcaatctcagctcactgcaacctccgcctctcgaattcaagtgattctcctgcctcagcc

SEQ ID NO: 60287 - DNA, 201 bp, Homo sapiens
atttcagtgtctgtaataataatagcaattggctccattcttttgctttcttctgatttggatttctcttcagtgatcccattttctttaaaatctgattyttggctcaattcagtatcttttggcttagtttcttcagctacaatctctgtactttcatagtcttttccatttggtgcactttctagggtactgttactg

SEQ ID NO: 60288 - DNA, 201 bp, Homo sapiens
cagagatgcagtgaatagtggtgtgggactgacccccagtttttgttattgttgttttcatttattctgcaggcttttttttttttttttttttttttttttgagacagtcgtgctgtgtcgccaggctggagtgcagtggtgcaatctcagctcactgcaacctccgcctctcgaattcaagtgattctcctgcctcagc

SEQ ID NO: 60289 - DNA, 201 bp, Homo sapiens
ccagagatgcagtgaatagtggtgtgggactgacccccagtttttgttattgttgttttcatttattctgcaggcttttttttttttttttttttttttttttgagacagtcgtgctgtgtcgccaggctggagtgcagtggtgcaatctcagctcactgcaacctccgcctctcgaattcaagtgattctcctgcctcag

SEQ ID NO: 60290 - DNA, 201 bp, Homo sapiens
aagcgattctcctgccttagcctcccaagtagcttgggattacaggcatgcaccaccatacccagctaattttgtgtttttagcagagacagggtttcacyatcttggtcaggctggtctggaactcctgacctcaggtcatgcaccagcctcggcctcccatagtgctgggattacaggtgtgagccaccgtgccaggcc

SEQ ID NO: 60291 - DNA, 201 bp, Homo sapiens
ttttaaatcagcccaatgcaaaacactcccctttcctctacctggcaattcttaccaacctgagtaatgtgaacagagaacatgagtccatgaatcaccayaggccatccccaggcagagtgaggcacacacagctgtgatcaaatgttgccttctctcgttttaaacaaggaattaactgtacatggtgattatctctgg

SEQ ID NO: 60292 - DNA, 201 bp, Homo sapiens
ggaggcggaggttgcagtaagccgagatggagccgttgcactccagcctggtcaacaagagcaaaactccgtctcaaataataataataataataataatwtaacttggggattattccacatcagtacattaaatatgtagttttaatagagtctgccttttttttttttttttttttttgagatagggtcttgctctgt

SEQ ID NO: 60293 - DNA, 201 bp, Homo sapiens
cttggtgaagtgcatccccttaatgaaaacagcgaggcccttgaatgccgcaggctcagctccttcattgttaaggagaatgaacagcagccagaccacascaaccggggtaccacagagcctttgcagatcagtcaagtatctttgatctccaaagacacagagccagtagaattaaactgtaatttttctttttcaagg

SEQ ID NO: 60294 - DNA, 201 bp, Homo sapiens
atcactaaacatttctacttagatacctggtagacacttggagctcagagtgtctgaagtgaaacccctattcttcttcttcttttttttttttttgaggkggggtctcagaacctcttatcaagacggtttctgtacttcttctctaatgttctgggactctgcctttatatcaacacctagcacatggcagttactctg

SEQ ID NO: 60295 - DNA, 201 bp, Homo sapiens
ctctaatactttttttttgagatggagtctcgctctgtagcccaggctggaatgcagtggtgtgatctcggctcactgcaacctcttcctcccaggtcccrgttcaaacagttctcctgcctcagcctcccgagtagctgggattacaggcacacgccactgtgcccagcttttttttttgtatttttagtagagacgggg

SEQ ID NO: 60296 - DNA, 201 bp, Homo sapiens
tctgcctcctgggttcaagcgattctcccgcctcagcctcccgagtagccgggattataggtatgtgccaccacacctggctaattttgtatttttagtaragacggggtttcttcatgttggtcaggctggtctcgaactcccgacctcaggtaatccacctgcctcggcctcccaaagtgctgggagcgagccaccatg

SEQ ID NO: 60297 - DNA, 201 bp, Homo sapiens
attcttctgcctcagcctcccaagtagctgggattacagacgtctgccaccacgcccaactaatttttgtatttttagtagagacggtttcaccatattggccaggctggtcttgaactctgacctcaggtgatccaccctcctcggcctcctaaagtgctgggattataggcatttatttaccgttctgctttccctttg

SEQ ID NO: 60298 - DNA, 201 bp, Homo sapiens
gaaatggatatatacagatctgttgaggcagaaagaaaagcgggggaaaaacccactctccctgtttctacacttttgcacttagtaacaatttgcctgaytgaaggatttgtgaatggttctctttttttttttttttttttttgagaaggagtctcgctctgttgcccagactggagtgcagtggtgcaatcttggctc

SEQ ID NO: 60299 - DNA, 201 bp, Homo sapiens
tttaacagtgaatgcataaaaatacaaccaactgacatccaacctgacatattcagctatttgttgcacattatgtacacggggaaagggccaaaacagaytgtggatcatagtcgtttggaggaagggattcgatttcttcacgccgactacctttctcacattgcaactgaaatgaatcaagtgttctcaccagagact

SEQ ID NO: 60300 - DNA, 201 bp, Homo sapiens
cctcatcagaggtgacaggccccacttttactgaaaacagtgtcaaaatacacttatgccattactgtggggaacgttttgattcccgtagtaacctaagrcaacatctccatacacatgtgtctggatccctgccattcggtgtccctgcttccattctggaaagtaatgaccttggtgaagtgcatccccttaatgaaa

SEQ ID NO: 60301 - DNA, 201 bp, Homo sapiens
gtttgtgagccttagaatttaaccacttacaaaactcttgagctccctccacttctgaggacgtttcctgacacattcaacagcatcagcgtccaatcagsagggagctcaaagagtaatccagctaattctaaggacacaaaggttttctctaggtaaacagtttaggtaaattacaaagtggtaagtttttcttgagga

SEQ ID NO: 60302 - DNA, 201 bp, Homo sapiens
ttaaattctaagcttcacaggcatttgaatacatctaaaaaatttggtttgtgagccttagaatttaaccacttacaaaactcttgagctccctccacttstgaggacgtttcctgacacattcaacagcatcagcgtccaatcaggagggagctcaaagagtaatccagctaattctaaggacacaaaggttttctctag

SEQ ID NO: 60303 - DNA, 201 bp, Homo sapiens
gctcacacaagaaaatgtggatactatcctagttgagtagcagcttctctttcagaatttttataccaattctgaaaaagaaaatttgcgtggcatttttwattcataaattattttcctcctcaagtttcattgactttttttcttcacagcttatccatggttttaaggttgtatatattagatcttctcataagacat

SEQ ID NO: 60304 - DNA, 201 bp, Homo sapiens
actgagtatcctatgatttaactcaattctgacactaactgtctggagcagatcctacaggtaaagggctcagtcctaaaagactgccccacttcagacaygaatcgcaagtccaggttgtcacctgtgcttctgaccaactggttataaactggagggtccccacaaccccctgctcaggttcatttgctagaatggctc

SEQ ID NO: 60305 - DNA, 201 bp, Homo sapiens
agtaattagttaatgtatatatgaatgattcattatctttttttttttttacatggtagctgctgccttgagatctatttttttttttgagatgaagtctkgctgtgtccaatcttggctcactgcaacctctgcctcctgcatacaagcaattctctcatatcagcctcctgagtacctgggattacaggtgcccgccat

SEQ ID NO: 60306 - DNA, 201 bp, Homo sapiens
gatgatcatttataattcttcctggcacataataagtattcgatatatgttgtattaataatcagtaattagttaatgtatatatgaatgattcattatctttttttttttttacatggtagctgctgccttgagatctatttttttttttgagatgaagtcttgctgtgtccaatcttggctcactgcaacctctgcctc

SEQ ID NO: 60307 - DNA, 201 bp, Homo sapiens
gctcatagcttttcccactataccatagtcttatcatacgctaagtgaaatctaatacatttttcctttctcttcaatctcgtgcttctctctaacagccrtctctctgccctggtcctagagttacttgaaacgtaatttggctcctgagtcctgagaatattctgcattccacttgacctctgcctgttctacccttgc

SEQ ID NO: 60308 - DNA, 201 bp, Homo sapiens
ggctggagagcaatgatgcgatctcgactccctgcaacctccgcctcccaggttcaagcaattctcctgcctcagcctcccgagtagctgggattacaggygcccaccgcctcacctggctaatttttatatttttaatagagacgcggtttcaccacgttggccaggctggtcttgaactcctgacctgaggtgatttac

SEQ ID NO: 60309 - DNA, 201 bp, Homo sapiens
ggtcacacacggacggtaacaatttgtccctttccaaggaaattagttcagaggcactagatcttgctgcttctctcctcctccatcctctctcatacgaytgatactgccaggtgttgttctgccttctcccttttaaaatggaagtgagtaggtgtgtggcattgagcactcctgacagcttttgcaataaatcccatg

SEQ ID NO: 60310 - DNA, 201 bp, Homo sapiens
ctccttctttgctagtaaaatcttcccttccctcactaggcatatttgtggcatcccaggttataatcctcgttgctcattcctgaataaactcaacctayttggagataattttttgtaatgtctttctttaggctgacagtaggaaataacccccagctttcagtttttccttctgaatttaagatggtttgcatttcc

SEQ ID NO: 60311 - DNA, 201 bp, Homo sapiens
aattggttttggacagtcagagcagagtggttataaagcacacttgcaaggcgcggtggctcacacctgtaatcccagcactttgggaggccaaggtgggyagatcacaaggtcaggagatcgagaccatcctggctaacatggtgaaaccccgtctctactaaaaatacaaaaaattagccgggcatggtggcgggcgcc

SEQ ID NO: 60312 - DNA, 201 bp, Homo sapiens
gtgctgggattacaggctcagccacaggctgagcttcacgcctagctgaagctctccttctttgctagtaaaatcttcccttccctcactaggcatatttrtggcatcccaggttataatcctcgttgctcattcctgaataaactcaacctacttggagataattttttgtaatgtctttctttaggctgacagtaggaa

SEQ ID NO: 60313 - DNA, 201 bp, Homo sapiens
taggatgccaaagccccatgaaccccattgaacagttttgaaagtattgaaccatctgaattagtgttggtgtcttgggtgctgaggatgcaggtagcaargcagtggggctcctctcattttaaagcccctttcttttctttaaggctctctttaatcgtttggtgccatcagtaaatggagtgagaaggttctctgaca

SEQ ID NO: 60314 - DNA, 201 bp, Homo sapiens
attggttttggacagtcagagcagagtggttataaagcacacttgcaaggcgcggtggctcacacctgtaatcccagcactttgggaggccaaggtgggcrgatcacaaggtcaggagatcgagaccatcctggctaacatggtgaaaccccgtctctactaaaaatacaaaaaattagccgggcatggtggcgggcgcct

SEQ ID NO: 60315 - DNA, 201 bp, Homo sapiens
agatatttgacctgggtttttttctaggctgagaggataaatctagccttttaatcatgtccaaaactgtactcggcatcctcatccccaagttacccctwactcccgtcttttggttagtatcaccattcttccttcccgcaagtctgaagccttttagtttccctcccaagcattccctatattggaccagtctctaaa

SEQ ID NO: 60316 - DNA, 201 bp, Homo sapiens
atgccaaagccccatgaaccccattgaacagttttgaaagtattgaaccatctgaattagtgttggtgtcttgggtgctgaggatgcaggtagcaaagcartggggctcctctcattttaaagcccctttcttttctttaaggctctctttaatcgtttggtgccatcagtaaatggagtgagaaggttctctgacatcca

SEQ ID NO: 60317 - DNA, 201 bp, Homo sapiens
cattagcgaaggggcattctgataaccatgcaaatgacctgaagttacaaatcctgtgtggaacaggttgggggagcacctgagaaaaactagaaaaagcyagaaaagacaaggatatcaaagggtcatagtataaaacaaaagctcttgcattatttgagaaagttaaggtccaagtagaagcaaactgtagtttgatgc

SEQ ID NO: 60318 - DNA, 201 bp, Homo sapiens
caagctcatcagagaagttttcaagtattgagaagctgtcaagctcacaggggtggataaaaaattttaattttcacccaaaaactcacattttatcattrgcaacaaatacaattaattgtttcccttgaaataccagtttcactttattcatttttgagaaaatatttgtcaaatactcaagcctgaataatcattgct

SEQ ID NO: 60319 - DNA, 201 bp, Homo sapiens
ttttttcttccacattttttatattgtatggaatctggaatctgatcattgattaggacataaaagtcttcttggagtagcctattttagatgaagttacrtcagtaatcatagtcttaaagtcatgatatacatagcaaagatggatggtagaggttatttctcatttatctatagattagaagtggctagtgtggaata

SEQ ID NO: 60320 - DNA, 201 bp, Homo sapiens
cagctcacggtgtcctggtttccacagggcactccagtgtttgtccatgctggcccgtttgccaacatcgcacatggcaattcctccatcattgcagaccrgatcgcactcaagcttgttggcccagaagggtttgtaggttagtgttttttgcaaaaccagtgaatagactgtatgtttcttttaacatcaggggaattg

SEQ ID NO: 60321 - DNA, 201 bp, Homo sapiens
tgtttttgtgcacttattctaatttctccacgtggcatgcgaaggagggcagcttctatcctccaactctgatgcaggctggcttttctttcaggggtgcygattgccggaaggcatgctgtggtggttgggcgcagtaaaatagttggggccccgatgcatgacttgcttctgtggaacaatgccacagtgaccacctgc

SEQ ID NO: 60322 - DNA, 201 bp, Homo sapiens
cctctgcccccacgtggtggtgcttgttgccactgtcagggctctcaagatgcacgggggcggccccacggtgagtggtgggttgaagtatctgattatcrgcagtgtgctgacggccaaaaggaagttggatgacttctgcctgtttcttcattgagttgctcttatcctcgtgattaacaggcagcaaaagcaagggac

SEQ ID NO: 60323 - DNA, 201 bp, Homo sapiens
tcttccacattttttatattgtatggaatctggaatctgatcattgattaggacataaaagtcttcttggagtagcctattttagatgaagttacatcagyaatcatagtcttaaagtcatgatatacatagcaaagatggatggtagaggttatttctcatttatctatagattagaagtggctagtgtggaataaatag

SEQ ID NO: 60324 - DNA, 201 bp, Homo sapiens
tgcaatggaagagggcagagcttcttaatcactatccactgcccatggtggggcccatgaaatggacaccttcacccatttgctcatttctgtggatgcarcagggctgagccacggcatagatcaagactgggggctggggggcggggcggggaggcaccagacacctccatcctttagatatactctacaaaagagaaa

SEQ ID NO: 60325 - DNA, 201 bp, Homo sapiens
tgagtaggtatatatttgttcatggttttgtcatttaaactcagatttcaattgagagactagtattagaaaacacttgatcaaaactgtccaaatgattstaaaaaataaataaataaatgtgcttagtagttacaataatgcatttgcatttatttgatttctaagtcattggagaagcatgcttaactgagcttccac

SEQ ID NO: 60326 - DNA, 201 bp, Homo sapiens
tcgagtgatcctcctgcatcaaccttctgagtagctgggactacaggcatgtgccaccatgcctggctaatttttaagctttttgtagcgacaggggtctyactgtgttgcccaggctggactcaaactcctggactcaagcgatcctcctggttcaccttcctaaagtgctgagattacaggcgtgacccaacatgcctg

SEQ ID NO: 60327 - DNA, 201 bp, Homo sapiens
tttggcatgtgtagaaatgagcacggcatgtgaagggctgtcagaaacagtgtgtggcttacatttgaggccttaacccaatatcttatgaaatagcttaygacacttaagaatttaatacaaagctcagggatatccttttcatttctgggtttttttttggtgtgtatttcattatttcatttctgatgtccaaatccc

SEQ ID NO: 60328 - DNA, 201 bp, Homo sapiens
ggagattggcgcccgggcggagcacgatgggcttccccgcggcaggcaggcaggctgctgctgcaggtgggtcccggcgcccgcgccgccccgcgcctccsgcggtcgccccgcccctgcccgcccgctccgctccgctcgcattggcgctgcctgctgtctgtccccgcgcggtggggagggggcgcacccggcggcggg

SEQ ID NO: 60329 - DNA, 201 bp, Homo sapiens
ctgtgcttctgaccaactggttataaactggagggtccccacaaccccctgctcaggttcatttgctagaatggctcacagaactcagagaagcatttcayttgtgtttatggtttattataaaggatacagctcagaaacaaccagatggaagagaagcgtagggggcatcactctcccagcacctggatgtgttcacca

SEQ ID NO: 60330 - DNA, 201 bp, Homo sapiens
ttcagatgtagacgctgagctgccaggaacattagtcactgtcaagccttcaccgtttttaacctccctcccactctccctaccgtgcttttaagacagtrgctcataattgatcactcattttcttgtagtgtaattatctaacaggcgataaagaaattgctctcctacaactcctcactttgaatacttgcgatatga

SEQ ID NO: 60331 - DNA, 201 bp, Homo sapiens
tcaatctcgtgcttctctctaacagccatctctctgccctggtcctagagttacttgaaacgtaatttggctcctgagtcctgagaatattctgcattccwcttgacctctgcctgttctacccttgcgggacatctgaatgcttaattagtgggtatcgttgccagctttactcccaggaagtaacactggctgcttttt

SEQ ID NO: 60332 - DNA, 201 bp, Homo sapiens
tgagccaccacacccagccctaattttttttttttttttttgaggtggagtttcactattgttgcccaggctggagtgcaatggcacaatctcaactcacygctggagtgcagtggcactatctcagcgcactgcaacctccacctcccaggttcaagcaattctcctgcctcagcctcccgagtagctaggattacaggc

SEQ ID NO: 60333 - DNA, 201 bp, Homo sapiens
agcatagttgttctataagtgggcctttcaaaggggggcttactacatttatatgatttgtttggtttttccttcccttagtttgctataattaagcctgytctctccattggtggcatttttcttgattaagtctcctttctaaagagactggttgtgaagaggcagatggtttgagtaggtgctgcgagtgtttgctgg

SEQ ID NO: 60334 - DNA, 201 bp, Homo sapiens
tatttacggcagccatataacgaatacctcttctgtgccagccactatgttgttaggctctgtcttctgatggaagggtctgtgctgtgcagagtagagtyaatttgtattatcataaccctatgaatacataaaatctataaacacaattggtaaatataatttgggtaagggtaactaattcctttcaaacagcaaata

SEQ ID NO: 60335 - DNA, 201 bp, Homo sapiens
ttttttttttttgaggtggagtttcactattgttgcccaggctggagtgcaatggcacaatctcaactcaccgctggagtgcagtggcactatctcagcgsactgcaacctccacctcccaggttcaagcaattctcctgcctcagcctcccgagtagctaggattacaggcatgtgccaccacacctggctaattttgta

SEQ ID NO: 60336 - DNA, 201 bp, Homo sapiens
ctctccattggtggcatttttcttgattaagtctcctttctaaagagactggttgtgaagaggcagatggtttgagtaggtgctgcgagtgtttgctggcsaagtgcagggcaagttgggtatatttgtaagctcgctgtggatggtagctccagagcctaagcacggtgctgcctcctctgtgcatcactgggtcatgca

SEQ ID NO: 60337 - DNA, 201 bp, Homo sapiens
ccagagcagtatacaagccccgtttgttttggctatattgcacaccctacaccctccagaagagttgttaaaatgtgaggctcagaagcttccatgttggyattttaccagctaaggcatgaccaagatggtgacattatttctttttcttgccacctctctcagtatctctccttattagctatcatcaaatctctttgt

SEQ ID NO: 60338 - DNA, 201 bp, Homo sapiens
tcctgtagattaaatacatgtaggcccttttgtgcttaaaaagatttgtctgggcagggcgtggtggctcatgcctgtaatcctaggactttgggaggccsaggcaggaggatcacctgagatcaggagttggagaccagcctgactaacatggtgaaaccccatctctactaaaaatacaaaattagctgggcatggtgg

SEQ ID NO: 60339 - DNA, 201 bp, Homo sapiens
ctacttactttgctggctaagctttttttttttctttgcccctcaccacaagcctggacgggagacgtactgcttggtatctggtgcttgagaggtcccaggagataagggagcatttctgtgaaaggttttgccagagcctgtcaggaacttaatcttgactgcaatgaatgacttaacattataagtgatctttgggtt

SEQ ID NO: 60340 - DNA, 201 bp, Homo sapiens
gtgtgtctgattgctatataagacactgcttttggtatgaaattatgacagtctttatggaaaataatttggcatattatcaagtgccttaaaaatgcttctcctccttgactcatttagagtatgaactgggtttttttgttcattttgtgtgtgtgtgtgtttttactttgaaattattttaattttgaaatagaaaac

SEQ ID NO: 60341 - DNA, 201 bp, Homo sapiens
tgtgtctgattgctatataagacactgcttttggtatgaaattatgacagtctttatggaaaataatttggcatattatcaagtgccttaaaaatgcttctcctccttgactcatttagagtatgaactgggtttttttgttcattttgtgtgtgtgtgtgtttttactttgaaattattttaattttgaaatagaaaaca

SEQ ID NO: 60342 - DNA, 201 bp, Homo sapiens
ttgtactttagcaccagagtcaacagctttctgtgatacaaggtttatataatatgttgtaatcacatctccctgcctcagacctctagtctttttcgctstggtgctggcaccaccatcttcccacattccctgagctagaagcctgaggccgtctccttaggagctctcttcctcactccctgcatccagttaggggct

SEQ ID NO: 60343 - DNA, 201 bp, Homo sapiens
gtgtctgattgctatataagacactgcttttggtatgaaattatgacagtctttatggaaaataatttggcatattatcaagtgccttaaaaatgcttctcctccttgactcatttagagtatgaactgggtttttttgttcattttgtgtgtgtgtgtgtttttactttgaaattattttaattttgaaatagaaaacat

SEQ ID NO: 60344 - DNA, 201 bp, Homo sapiens
ccagtgacttctaaatctagatttcttctgagctccaggctcttggtctgggacaccactggtttccttcccaccttcaagtctcctttgcttgttgttgytcatcaccctaatacctaaaccatttgaatgccttgggctcacccttgagatctcttccccatcttattctttccctaagtaacctcacccagtcccata

SEQ ID NO: 60345 - DNA, 201 bp, Homo sapiens
cgaggcgggcggatcacttgaggtcaggagttcgagatcagcccggccaaaccccatctctactaaaaaaatacaaaaactagctgggcatggtggcacgygcctgtaatcccagctacttgggaggctgaggcgcgaaaattgcctgaacccaggaggtggatgttgcattgagccaagattgtgccactgcactccagc

SEQ ID NO: 60346 - DNA, 201 bp, Homo sapiens
actgcactccagcctgggcaacagaccgagactctgtctccaaaaaaaaaaaaaaaaaaaaaaaatgacaactcagggtcttggaataattaattaatatatttttttgctattagaggattattttcattaagtattttgggtagtattctgttattctatccttttaagctatttgtttaagcctcagatgtaaaagag

SEQ ID NO: 60347 - DNA, 201 bp, Homo sapiens
ttgggaggctgaggcgggtggatcacaaggtcaggagattgagaccatcctggctaacacaatgaaaccctgtctctactaaaaatacaaaaaaattagcygggcatagtggcgggtgcctgtagtcccagctactcgggaggctgaggcaggagaatggcgtgaacctgggaggtggagcttgcagtgagccgagattgc

SEQ ID NO: 60348 - DNA, 201 bp, Homo sapiens
caaagaaagagaacccgggcacaacctgcgtttgcaagtggactgcctagtggctgtagccgctggctcctgtgcttcggggaaaagtcctgtgccgactrtgctcccaaacgcgcagctgctggtgactttctgccgggagagtgggtagttgcggcttcctggagcccccctagtcagaactcagaaatccaatctact

SEQ ID NO: 60349 - DNA, 201 bp, Homo sapiens
gttatttctcatcacgtgtcctagaaagcaccacaccttgaatcagcatttctccacctggcccatgtggaaatgaatgggttattgctgtgacccagggygcagggtgccaaaaggcctgcagtgtgctgaggagttatattaaatgagtagatagggaagatgcacctcacaaaatagaattgtcccacatagggtgtc

SEQ ID NO: 60350 - DNA, 201 bp, Homo sapiens
cggttagttaagggactcgggtccttccgaactgcgcatgcgccaccgcgtctgcagggggagaagcgggcaggggcgcaggcgcagtagtgtgatccccyggccagtccctaagcacgtgggttgggttgtcctgcttggctgcggagggagtggaacctcgatattggtggtgtccatcgtgggcagcggactaataaa

SEQ ID NO: 60351 - DNA, 201 bp, Homo sapiens
catgtgtagaaatgagcacggcatgtgaagggctgtcagaaacagtgtgtggcttacatttgaggccttaacccaatatcttatgaaatagcttatgacasttaagaatttaatacaaagctcagggatatccttttcatttctgggtttttttttggtgtgtatttcattatttcatttctgatgtccaaatcccctacc

SEQ ID NO: 60352 - DNA, 201 bp, Homo sapiens
tggttttgcacctttagtacatcttggacaggttccatgttaacacagatgggtctcactttcataacatctgcatgataaatatttattgagtgtatatrtcataattcattggcccagtcccccttggaggaggtttatgtttataattttccaatgctacaagcagggctgcagtaaacatacttaaagatacatttc

SEQ ID NO: 60353 - DNA, 201 bp, Homo sapiens
ctcactaggcatatttgtggcatcccaggttataatcctcgttgctcattcctgaataaactcaacctacttggagataattttttgtaatgtctttcttyaggctgacagtaggaaataacccccagctttcagtttttccttctgaatttaagatggtttgcatttcctagaggggatcccatttagaggtaggggtca

SEQ ID NO: 60354 - DNA, 201 bp, Homo sapiens
ggttttttttacagacagggtctcactctgtcacctaggctggactgcagaggcgtgatcatagctgcagcctctaactcttgggcttaagcagtctcccygcttcaacctcccaactagctggaagaacaggaacacgccaccacaccaggctaattttttaattttttgtagagacggggtctccctatgttgcccagg

SEQ ID NO: 60355 - DNA, 201 bp, Homo sapiens
cctctccaggctccaatgcatagcacccaaggctggaagcccagtccttgaaaaccagcaggagacctgaaagagcagggacatatggactttagaacccrtttctacttgcaacttttatccattctggcaaacaggaggctgccactttttgtcttactcagcgtctgctagtcttaaatcacccttcaaccaaagtgc

SEQ ID NO: 60356 - DNA, 201 bp, Homo sapiens
tctgaggcttgatattaaaagaaagtgttcctggctgggtgcagtggctcacacctgtaatcccagcactttgggaggccaaggctggcagatcacctgargttgggagttcaagaccagcctgaccaacatggagaaactccgtctctactaaaaatacagaattagccgggcttggttgcgcatgcctataatcccagc

SEQ ID NO: 60357 - DNA, 201 bp, Homo sapiens
gtctacacgaagcaggtagatgtttggttagtttgtcctttcaactctttgcaaagcaggacttggagtcacaatctctgggtcctcccagccctgccaartacccgttgcttcacttctctgggtggcagccttctctcctctgaaatactgagtttggattaggtggcacagtccctggttctttatttacccataggc

SEQ ID NO: 60358 - DNA, 201 bp, Homo sapiens
ttgtggcatcccaggttataatcctcgttgctcattcctgaataaactcaacctacttggagataattttttgtaatgtctttctttaggctgacagtagraaataacccccagctttcagtttttccttctgaatttaagatggtttgcatttcctagaggggatcccatttagaggtaggggtcaaaatttttgtctta

SEQ ID NO: 60359 - DNA, 201 bp, Homo sapiens
gctgcccaaagcagtcgattttgttctgtgctgtgtgattggtcacataccctaagtccttagggcaggaaataatcttatactactgtacagcctgcaarcattgcagcgtcttgcctttaacacatgaaaagcaccattttaagctaggagatttaaataggaaatgcctctgactctgtttcttttccttccaggtca

SEQ ID NO: 60360 - DNA, 201 bp, Homo sapiens
ggttgaggcagaatggcgtgaacctgggaggcagagcttgcagtgagccgagatcacgccactgcactccagactgggcgacagagcgagactccgtgtcaaaaaaaaaaaaaaaaaattaagcacacttaacctgggtagtcaagaccttctccacttgctcatctctttcttctcattcttcctcacacctgtgactgg

SEQ ID NO: 60361 - DNA, 201 bp, Homo sapiens
ggggtcatgcaagaacttgtgtgggttgtttaggtattgcattggtggtcagggttttgttataatggcctcaccgtagtagaatgggaagcaaaaaatcttttttttttttttgggggacgaagtctgtctctgttgcccaggctggagtgcagtggcacgatctccactcgctgcaagctctgcctcccgggttcatgc

SEQ ID NO: 60362 - DNA, 201 bp, Homo sapiens
agtgacctggagcttgaaactgaggtgaggattaaaataaccacctcttctaagtttcatttatttcattttgcttagagcacagtagagagtgccaagcrtttcctggagaaatttaagccaggaaagtggatgattcagtataacaaccttaacctcaagacacctgttccaaggtaaaaataaagttttactgattta

SEQ ID NO: 60363 - DNA, 201 bp, Homo sapiens
atttagccaagacctccaggtatttttttttttttttttttttgagacacagttttgctcatgtcacccaggctggagagcaatgatgcgatctcgactcyctgcaacctccgcctcccaggttcaagcaattctcctgcctcagcctcccgagtagctgggattacaggcgcccaccgcctcacctggctaatttttata

SEQ ID NO: 60364 - DNA, 201 bp, Homo sapiens
cctttctaacatgcaccagctgacaggggccaggcgagcagccccaaagcatgttaggtgcctcttgactcttagctaggattgaagcatggtaataagtrggtctgaagcagttcattttgtgattgaactggagtgacctggagcttgaaactgaggtgaggattaaaataaccacctcttctaagtttcatttatttc

SEQ ID NO: 60365 - DNA, 201 bp, Homo sapiens
ggctcactgtggcctcaacctcctagcctcaagcaatcctcctgccttagcatcccaagtagctggaactacaggcacatgccatcatatccagctaattktttatttcctgtagagatgggggtctcactatgttgcccagggtggtttagaactcctggcctcaagtgatcctctccacctcagcctgggattataggc

SEQ ID NO: 60366 - DNA, 201 bp, Homo sapiens
aacggagcaactactgtgtatccagcacaatgccaggccttgggctacacaactgaataaggttcaacttcaccttcaccttcagctgcttcctccccatstcctctctgtcatgtctgttattccttccaaaccttgtttgatttccccttatcaagggatgatctttccttctctccctccctcctctcccatagaaca

SEQ ID NO: 60367 - DNA, 201 bp, Homo sapiens
gccatcatatccagctaattttttatttcctgtagagatgggggtctcactatgttgcccagggtggtttagaactcctggcctcaagtgatcctctccayctcagcctgggattataggcgtgagccactgtgcccagcattagtttatttgtaatgcttttttacatcctagatgagcacaatgcctggactccccacc

SEQ ID NO: 60368 - DNA, 201 bp, Homo sapiens
aaaattaataatgtatatttcttcatcaagggtggtcctagtgaaactggcatttagttttactgggagtgtgtggtagtgaaggataccttgactactartccaaagccattgtcttgatttgtgctggttcactagtagtcttacacaccattgcttttgcaccatcggtacagacgttaacacaatgaaaaaggcaaa

SEQ ID NO: 60369 - DNA, 201 bp, Homo sapiens
tattgaggatggtatctaggtcatcaaaagaagcctgagagagaagcttgtctcattttatgcttgtagtactaaggtttaggagactgactagcccaagrgtgcacagagttagtagatagaagagttgccacttgcaggcaggtctgcctggtgccagagcctttgattttcatcatgtgctgtacagcttccaagatg

SEQ ID NO: 60370 - DNA, 201 bp, Homo sapiens
taacatcaccaacaagctcatcagagaagttttcaagtattgagaagctgtcaagctcacaggggtggataaaaaattttaattttcacccaaaaactcayattttatcattagcaacaaatacaattaattgtttcccttgaaataccagtttcactttattcatttttgagaaaatatttgtcaaatactcaagcctga

SEQ ID NO: 60371 - DNA, 201 bp, Homo sapiens
ttgccaggctggaatgtagtagtgcaatcatagctcactgtagcgttgaactcctggcttcaagcagtcctcctgcctctgcctgccaaagcatgggtatyacaggcgtgagccactgtacctggccccgtttacactcttaaagatgtaagacctcaagaagctattgtttatacagatttatccattaatgtttactat

SEQ ID NO: 60372 - DNA, 201 bp, Homo sapiens
aggactggtgccgagcatcctgcagtgcacaggatagtccccataacaaaggatgatctggtccaaatgtcagtggtgctgagatcgaaaaaccctgatcragaagcttaatgtgagttattgtgtcattgtgtgtgtggattaatgatggactttaccctcactaagaattataggattcattaaaattttacactattc

SEQ ID NO: 60373 - DNA, 201 bp, Homo sapiens
ttacttcccgaagctcaacacaaagctgaagtctacacgaagcaggtagatgtttggttagtttgtcctttcaactctttgcaaagcaggacttggagtcrcaatctctgggtcctcccagccctgccaagtacccgttgcttcacttctctgggtggcagccttctctcctctgaaatactgagtttggattaggtggca

SEQ ID NO: 60374 - DNA, 201 bp, Homo sapiens
acgatctccactcgctgcaagctctgcctcccgggttcatgccattctcctgcctcagcctccctagtagctgggactacaggtgcctgccaccatgcccrgctaattttttgtatttttagtagagacggggtttcaccgtgttagccaggatggtctcgatctcctgacctcgtgattctcccacctcggcctcccaaa

SEQ ID NO: 60375 - DNA, 201 bp, Homo sapiens
gacggatacagagtctgagctggacctcatcagccgcctttccagagaacatggggcttttgatgccgtgaagtgcactcactgggcagaagggggcaagkgtgccttagccctggctcaggccgtccagagagcagcacaagcacccagcagcttccagctcctttatgacctcaaggtgggtgatttgctgtctgcaaa

SEQ ID NO: 60376 - DNA, 201 bp, Homo sapiens
ctgggttcaagtgattctcctgcctcagcttcccaagtagctgggattacaggcgtctgccaccgtgcccagctaatttttcttatttttttagtagagayggggtttcaccatcttggccaggctggtctcgaactcctgacctcgtgatccacctgccttggcctcccaaagtgctggaattacaggcgtgagccactg

SEQ ID NO: 60377 - DNA, 201 bp, Homo sapiens
agcaccaacacacagcgatttcagaattcatttatgtaactgcagaaattggaacattacatagacatagagtcggtgctgctcccgtgcactcctcctcrctgttttgaggtgtgtcctcagtaacccagtgtggctgttgatcccagtggtgtggtatttgtggtctctggacatctcattttggaaaaactgcaagtt

SEQ ID NO: 60378 - DNA, 201 bp, Homo sapiens
tgcccagcattagtttatttgtaatgcttttttacatcctagatgagcacaatgcctggactccccacccggccctgtttttatgatattgatttggaccytgaaacagaacaggtgaatggattattctaaacaggtaagttgttactgggtaataatttggcttttttcctcatgtagcttatttatgaattatagggc

SEQ ID NO: 60379 - DNA, 201 bp, Homo sapiens
gtgcagtatggaaggaacaggaaacatttcagtgcttagagaaaacatttatttcttgtttttccttccagatcaccatccatcttcaagaagctactttraaagtctggccagtgtctattcaggcccactgggagttaggaagtataagtaagccaagagaagtcagcccctgcccagaagatctgaaactaatagtag

SEQ ID NO: 60380 - DNA, 201 bp, Homo sapiens; identical to SEQ ID NO: 17465

SEQ ID NO: 60381 - DNA, 201 bp, Homo sapiens
ccaagttaaaggatactaactcctaccatcgtgttgctgaagcaaaaatcacatgggcagctcagctagcaagactgaacgaaacaaaatttaaaagcagrcaagccctgtacctccttttggtcttgcaaagcgtgagctgaggaggcgagtgagcaactcctctactccccagcactcattcttgtaaggtgaaggtgg

SEQ ID NO: 60382 - DNA, 201 bp, Homo sapiens
aacctatgatacttatggggtcttcaactcatttcaacaccaggaatgtcattctcacaaacctctgtagtcatgcttttgatgaaggctgtcattggatytccccagctcctgctgtcactgttggccactgcacagggattctctgggatgggtgatatgtagctggaggtgcttttatttgaccctcatagtccactg

SEQ ID NO: 60383 - DNA, 201 bp, Homo sapiens; identical to SEQ ID NO: 17467

SEQ ID NO: 60384 - DNA, 201 bp, Homo sapiens
gaggcaggaggattgattgaacccaggaggcagaggttgcagtgagctgagatcgcaccactgcactccagtctgggcaacagagcaagactccatctcaaaacaaacaaacaaacaaacaaacaaaaaaagcttaaaaattaaattctggtgtaaaagacaggtagcaaacaaaaatataaagaaataaagtcattttag

SEQ ID NO: 60385 - DNA, 201 bp, Homo sapiens
aggcaggaggattgattgaacccaggaggcagaggttgcagtgagctgagatcgcaccactgcactccagtctgggcaacagagcaagactccatctcaaaacaaacaaacaaacaaacaaacaaaaaaagcttaaaaattaaattctggtgtaaaagacaggtagcaaacaaaaatataaagaaataaagtcattttaga

SEQ ID NO: 60386 - DNA, 201 bp, Homo sapiens
ggcaggaggattgattgaacccaggaggcagaggttgcagtgagctgagatcgcaccactgcactccagtctgggcaacagagcaagactccatctcaaaacaaacaaacaaacaaacaaacaaaaaaagcttaaaaattaaattctggtgtaaaagacaggtagcaaacaaaaatataaagaaataaagtcattttagat

SEQ ID NO: 60387 - DNA, 201 bp, Homo sapiens
caaacatctgtcattccatagcttttaagttaagtaggcactggagcctgatgggactaacacaccctacaattctgctgagtttttgtcgtaactgatcwccaggactgtgattctgagacttagttttgatttctcccccacttgaccagatgataaaaaaccaaatgggagaaaagttgtgggtgatgtggcatacga

SEQ ID NO: 60388 - DNA, 201 bp, Homo sapiens
gtagagttaatttgtattatcataaccctatgaatacataaaatctataaacacaattggtaaatataatttgggtaagggtaactaattcctttcaaacrgcaaataagctataatgatgtggcataatgacaggaaacataccagctctttttttcttgaaggctgggaaacaagcagagctctactctagtgtcatag

SEQ ID NO: 60389 - DNA, 201 bp, Homo sapiens
attgtgaataaaagtttctataagagttctgaaaagctgatcgagttttggctgcttttctccccaagtagaaatgtcaaaaacctactcagaagtaaagrtgtgaatttattgagaaaaagggaagggaagaatagagaaataagatcaggcacattaatagaggaaagtagggatggcataattccagtctgttttgga

SEQ ID NO: 60390 - DNA, 201 bp, Homo sapiens
ggagctgattgtacagcactgcttttagctttattttgtttttcagttactgctattggttatagcctgtggttttagcctgcactgtgacaggcattgcrtacgtcactgcgggctcaccacctcacccactgagggtcccaaagtcagattcagctcctatgggcccttttcctttccactgggggaagtaacacacaa

SEQ ID NO: 60391 - DNA, 201 bp, Homo sapiens
gaaatgcctctgactctgtttcttttccttccaggtcactgctggactgcctcttcccaaggcttacatacaggaggtaacctgagttatttctcatcacrtgtcctagaaagcaccacaccttgaatcagcatttctccacctggcccatgtggaaatgaatgggttattgctgtgacccagggtgcagggtgccaaaag

SEQ ID NO: 60392 - DNA, 201 bp, Homo sapiens
tgctgtgtgattggtcacataccctaagtccttagggcaggaaataatcttatactactgtacagcctgcaagcattgcagcgtcttgcctttaacacatraaaagcaccattttaagctaggagatttaaataggaaatgcctctgactctgtttcttttccttccaggtcactgctggactgcctcttcccaaggctta

SEQ ID NO: 60393 - DNA, 201 bp, Homo sapiens
accagatcgcactcaagcttgttggcccagaagggtttgtaggttagtgttttttgcaaaaccagtgaatagactgtatgtttcttttaacatcaggggarttgggatggcatttttactgttgctttcctctttacagtgacggaagcaggatttggagcagacattggaatggaaaagttttttaacatcaaatgccgg

SEQ ID NO: 60394 - DNA, 201 bp, Homo sapiens
agggggtgagtggtgcactgacagtgcttatgaaggacgcaatcaagcccaatctcatgcagacactggaggtgagcagagtgactcctgccttcttgaaytggttttggacagtcagagcagagtggttataaagcacacttgcaaggcgcggtggctcacacctgtaatcccagcactttgggaggccaaggtgggcag

SEQ ID NO: 60395 - DNA, 201 bp, Homo sapiens
cacaagcctggacgggagacgtactgcttggtatctggtgcttgagaggtcccaggagataagggagcatttctgtgaaaggttttgccagagcctgtcargaacttaatcttgactgcaatgaatgacttaacattataagtgatctttgggtttaggtgcccaaataccagtccctccttagtaagcagccttttagac

SEQ ID NO: 60396 - DNA, 201 bp, Homo sapiens
tgcttatgaaggacgcaatcaagcccaatctcatgcagacactggaggtgagcagagtgactcctgccttcttgaattggttttggacagtcagagcagastggttataaagcacacttgcaaggcgcggtggctcacacctgtaatcccagcactttgggaggccaaggtgggcagatcacaaggtcaggagatcgagac

SEQ ID NO: 60397 - DNA, 201 bp, Homo sapiens
agccagactccgtctcaaaaaataaataatttaataattggcaacttcatagcatatccagaaaaaaaccatgaatggtccaattcaggtgaaagtatcarttggtccaagatggctaacatgggtaagcctagaatgtcaaatattggtttcagaaggttgggtttttttgctggtgggagttgatgctgcacacatttg

SEQ ID NO: 60398 - DNA, 201 bp, Homo sapiens
ctcctgagtacctgggattacaggtgcccgccatcacgcctagctaatttttttttttgagatggagtttcactcgtcgcccagactggagtacaatggcrtgatctcggctcactgcaacctctgcctcctgggttcaagcgattctcctgcctcagcctcccaagtagctgggattacaggcgtccgccaccatgtcca

SEQ ID NO: 60399 - DNA, 201 bp, Homo sapiens
tttgccagagcctgtcaggaacttaatcttgactgcaatgaatgacttaacattataagtgatctttgggtttaggtgcccaaataccagtccctccttartaagcagccttttagacctaaccttttctacctaaggttttgttcagtctttttgaaaagcaggaaggccaggtccttgtgaggcttttctcattacaag

SEQ ID NO: 60400 - DNA, 201 bp, Homo sapiens
acccatttgttcttcccctttgttttcctaattccttagcaatgcattcaagaacattcatgatctggcccaagtatatatttaaaagttgagttttcatytttttttaataaagtggatgagtaacttcccaaataactgaatatttataggaaattaagacttgacttttcattataagagatactaatgggctaggca

SEQ ID NO: 60401 - DNA, 201 bp, Homo sapiens
atacagcataaatgtttctaaagagtaaagacatctaattgcctttatttccttcttatttccatcacttttttaagattgactagcatcaatgctgggaracttgctagaggtgacctcaatgactgtttcattccttgtacgcctaagggatgcttggaactcatcaaagagacaggtaaaaacaacaaaccaaacaac

SEQ ID NO: 60402 - DNA, 201 bp, Homo sapiens
gacaggtctatacctttctccgaagatgatttcgagttctccaaatttaaagaggaaagggtgggttattgaaaagtacacgttttcatgtaagaggtggrtagggaaaaatagtcattcatgaccttctctggctcagtgaatctgcattttttacataagatgacagatggccggacgcggtggctcacgccagtaatc

SEQ ID NO: 60403 - DNA, 201 bp, Homo sapiens
ttatcttcatgtagagatcaccctttattttagcaaagttgatggatggatttaaaatacagtataattattgcaaagtgctatgagagtccagaagaggractcattctgccaagaggagggctttacaaagaagatatttgacctgggtttttttctaggctgagaggataaatctagccttttaatcatgtccaaaac

SEQ ID NO: 60404 - DNA, 201 bp, Homo sapiens
atgcaggcaatctgcattttacataagataacatagacagaattgggcaggggaaaaatcagatatacatttgtgtctggtgggctggggggatttacatygccatggtgaaattttaacagaaacatcataaagatgttgcagctcactacgaatttctttgtgggcaaaatatgggggaggcatgtagcttttcatctt

SEQ ID NO: 60405 - DNA, 201 bp, Homo sapiens
ctaacttttttttttgagacggagtttcgctcttgttgcccaggctggagtggaatgctcactgcagcctccgcctcccgggttcaagtgagtctcctgcytcagcctctgagcagctgggattacaggtgcccgctaccaagcccagctgattttttaatatttttagtagagacggggtttcaccatgctggccaggct

SEQ ID NO: 60406 - DNA, 201 bp, Homo sapiens
tgctctcctgcctagatagctcctcaagggcagtggtcactgtggcgccacatccagcttcctgccatctgaccactggcactcatatctattgaattgtygaagggagttatagctggaagtcttttttctcccttcccatctcaagtttcagatgtagacgctgagctgccaggaacattagtcactgtcaagccttca

SEQ ID NO: 60407 - DNA, 201 bp, Homo sapiens
ctcccgcctccgcctcccgagtagctgggactacaggcgcccgccaccacgcccggctaattttttttgtatttttagtagagatggggtttcaccatgtyagccaggatggtctcgatctcctgacctcgtgatccgcccacctttgcctcccaaagtgctgggattacaggcgtgagccaccgcacccagcaagctcag

SEQ ID NO: 60408 - DNA, 201 bp, Homo sapiens
tcttagagttagctttctctgcttggtgagggtatcacattttgcttgttctagcaattactacaaatgttgacaccgggaacaccttcacccttccacctttttttttttttttggagacacagtctcgctctgttgcctgggctggagtacagtggcacgatcttggctcactgcaacctccgcctcctggtttcaagc

SEQ ID NO: 60409 - DNA, 201 bp, Homo sapiens
gcaggaggattgattgaacccaggaggcagaggttgcagtgagctgagatcgcaccactgcactccagtctgggcaacagagcaagactccatctcaaaacaaacaaacaaacaaacaaacaaaaaaagcttaaaaattaaattctggtgtaaaagacaggtagcaaacaaaaatataaagaaataaagtcattttagatg

SEQ ID NO: 60410 - DNA, 201 bp, Homo sapiens
tctgtatatacatagggatgagatccaattctaaagcaaaatttatttgtgtttcattatataccttatacttgtagactgaaggtaattttatatatatrtgtgtgtgtgtatatatatatataataataattattattattattattttttttgagactgagttttgctcttgtcacccaggctggagtgcaatggcac

SEQ ID NO: 60411 - DNA, 201 bp, Homo sapiens
ttgtgtttcattatataccttatacttgtagactgaaggtaattttatatatatgtgtgtgtgtgtatatatatatataataataattattattattattwttttttttgagactgagttttgctcttgtcacccaggctggagtgcaatggcacgatctcggcgcactgcaacctccacctcctgggttcaagtgattct

SEQ ID NO: 60412 - DNA, 201 bp, Homo sapiens
caaaggactcttctggctcttgcaattcaaattagcaccacaaaactgagaactgtctgtataagggacaactgaagctaagattcaggccatgtcctgakatctgaggagagcgtccagtaatagcaccaatatgacaagctcagaaaatcctgtgttacaaaagccggcttctttctctgccatggtcctgttaaaagg

SEQ ID NO: 60413 - DNA, 201 bp, Homo sapiens
tataggcatgagccaccatgcccagctaattttattttatttttgaggcagagttttactcttgtcgcccaggctagagtgcagtggtgcaatattggctyactgcaacctccacctcccaggttcaagcgattctcatgcctcagcctcctgagtagctgtgactacaggcatgcgccaccacgcccagctaatttttgt

SEQ ID NO: 60414 - DNA, 201 bp, Homo sapiens
cctccacctcccaggttcaagcgattctcatgcctcagcctcctgagtagctgtgactacaggcatgcgccaccacgcccagctaatttttgtatttttarttgcccatattgcccaggctggtctcaaactactgacctcaagtgatctgcccactcaagcctcccaaagtgctgggattacaggcgtgagccaccgcac

SEQ ID NO: 60415 - DNA, 201 bp, Homo sapiens
cgcacctgtccccgctttttttttttttttttttgagacagagtcttgctctgttgcccaggctggatgcagtggcatgatctcagctcactgcagcctcygcttcctgggttcaagcgattctcatgcctcagcctcctgagaggctgagattacaggcatgcgccactatgcccggcttattttttatatttttgtaga

SEQ ID NO: 60416 - DNA, 201 bp, Homo sapiens
tgtggaaatgaatgggttattgctgtgacccagggtgcagggtgccaaaaggcctgcagtgtgctgaggagttatattaaatgagtagatagggaagatgyacctcacaaaatagaattgtcccacatagggtgtcaataagccactgccctagaccagtggttgattctcaacagctgattttgaccccggggacatttg

SEQ ID NO: 60417 - DNA, 201 bp, Homo sapiens
ggcaaagagagaagcctgtactcagccaagggtgcagagatgttatatatgattgctcttcagggaaccgggcctccagctcacaccccagctgctcaacyacctcctctctgaattgactgtcccttctttggaactctaggcctgaccccactccctggccctcccagcccacgattcccctgacccgactccctttcc

SEQ ID NO: 60418 - DNA, 201 bp, Homo sapiens
aggatcatcttctcgaaccccgagtgacaagcctgtagcccatgttgtaggtaagagctctgaggatgtgtcttggaacttggagggctaggatttggggrttgaagcccggctgatggtaggcagaacttggagacaatgtgagaaggactcgctgagctcaagggaagggtggaggaacagcacaggccttagtgggat

SEQ ID NO: 60419 - DNA, 201 bp, Homo sapiens
ccaatcacctctgctcacctccctctttctctctctctctctctctccctccccctctctcccctgcaacacacacacacacacacacacacacacgcacrcatgcacgcaccacacactctgacgacctttaaaggcttcctgtggctggatgaaatctagaggctttacccttcttgcatggccctgcatgacctggcc

SEQ ID NO: 60420 - DNA, 201 bp, Homo sapiens
ggctctgaggaatgggttacaggagacctctggggagatgtgaccacagcaatgggtaggagaatgtccagggctatggaagtcgagtatggggacccccmcttaacgaagacagggccatgtagagggccccagggagtgaaagagcctccaggacctccaggtatggaatacaggggacgtttaagaagatatggccac

SEQ ID NO: 60421 - DNA, 201 bp, Homo sapiens
caagaagacaggggggccccagggctccaggcggtgcttgttcctcagcctcttctccttcctgatcgtggcaggcgccaccacgctcttctgcctgctgmactttggagtgatcggcccccagagggaagaggtgagtgcctggccagccttcatccactctcccacccaaggggaaatggagacgcaagagagggagag

SEQ ID NO: 60422 - DNA, 201 bp, Homo sapiens
agccaaaccttgagccctagagcccccctcaactctgttctcccctaggggctccctggtgttggcctcacaccttcagctgcccagactgcccgtcagcmccccaagatgcatcttgcccacagcaccctcaaacctgctgctcacctcattggtaaacatccacctgacctcccagacatgtccccaccagctctcctc

SEQ ID NO: 60423 - DNA, 201 bp, Homo sapiens
cctgggccttggtgggtttggttttggtttccttctctgtctctgactctccatctgtcagtctcattgtctctgtcacacattctctgtttctgccatgrttcctctctgttcccttcctgtctctctctgtctccctctgctcaccttggggtttctctgactgcatcttgtccccttctctgtcgatctctctctcgg

SEQ ID NO: 60424 - DNA, 201 bp, Homo sapiens
gggacctgagcgtccgggcccaggggctccgcacagcaggtgaggctctcctgccccatctccttgggctgcccgtgcttcgtgctttggactaccgcccmgcagtgtcctgccctctgcctgggcctcggtccctcctgcacctgctgcctggatccccggcctgcctgggcctgggccttggtgggtttggttttggtt

SEQ ID NO: 60425 - DNA, 201 bp, Homo sapiens
gcaaagagagaagcctgtactcagccaagggtgcagagatgttatatatgattgctcttcagggaaccgggcctccagctcacaccccagctgctcaaccrcctcctctctgaattgactgtcccttctttggaactctaggcctgaccccactccctggccctcccagcccacgattcccctgacccgactccctttccc

SEQ ID NO: 60426 - DNA, 201 bp, Homo sapiens
ctggaaaggacaccatgagcactgaaagcatgatccgggacgtggagctggccgaggaggcgctccccaagaagacaggggggccccagggctccaggcgktgcttgttcctcagcctcttctccttcctgatcgtggcaggcgccaccacgctcttctgcctgctgcactttggagtgatcggcccccagagggaagagg

SEQ ID NO: 60427 - DNA, 201 bp, Homo sapiens
  misc_feature (1)...(201): n = A,T,C or G, or insertion/deletion polymorphism (see Tables 1-2)
cgccgcgtgccccgccccgctcactgtctctctctctctctctctttctctgcaggttctccccatgacaccacctgaacgtctcttcctcccaagggtgngtggcaccaccctacacctcctccttctggggctgctgctggttctgctgcctggggcccaggtgaggcagcaggagaatgggggctgctggggtggctc

SEQ ID NO: 60428 - DNA, 201 bp, Homo sapiens
ctcaactctgttctcccctaggggctccctggtgttggcctcacaccttcagctgcccagactgcccgtcagcaccccaagatgcatcttgcccacagcamcctcaaacctgctgctcacctcattggtaaacatccacctgacctcccagacatgtccccaccagctctcctcctacccctgcctcaggaacccaagcat

SEQ ID NO: 60429 - DNA, 201 bp, Homo sapiens; identical to SEQ ID NO: 17482

SEQ ID NO: 60430 - DNA, 201 bp, Homo sapiens
cccgggccccagccccgacctagaacccgcccgctgcctgccacgctgccactgccgcttcctctataaagggacctgagcgtccgggcccaggggctccrcacagcaggtgaggctctcctgccccatctccttgggctgcccgtgcttcgtgctttggactaccgcccagcagtgtcctgccctctgcctgggcctcgg

SEQ ID NO: 60431 - DNA, 201 bp, Homo sapiens
tgagttcggaaattaggctttacctccagccctggggtgccaggcaggagaaaaccatgtggtaggctgagggggtagggtgacccattggggtgacctakatagggccttgggtcaccctctgcctcctccagcctgtggctgaaagtcagccatgaagtaatgggggacactgttactcatcccagaagcacccacact

SEQ ID NO: 60432 - DNA, 201 bp, Homo sapiens
atcacctctgctcacctccctctttctctctctctctctctctccctccccctctctcccctgcaacacacacacacacacacacacacacacgcacgcaygcacgcaccacacactctgacgacctttaaaggcttcctgtggctggatgaaatctagaggctttacccttcttgcatggccctgcatgacctggcccct

SEQ ID NO: 60433 - DNA, 201 bp, Homo sapiens
attttctaggaagtttaagggtctcagctttttcttttctctctcctcttcaggatcatcttctcgaaccccgagtgacaagcctgtagcccatgttgtargtaagagctctgaggatgtgtcttggaacttggagggctaggatttggggattgaagcccggctgatggtaggcagaacttggagacaatgtgagaagga

SEQ ID NO: 60434 - DNA, 201 bp, Homo sapiens
aaaccttgagccctagagcccccctcaactctgttctcccctaggggctccctggtgttggcctcacaccttcagctgcccagactgcccgtcagcacccyaagatgcatcttgcccacagcaccctcaaacctgctgctcacctcattggtaaacatccacctgacctcccagacatgtccccaccagctctcctcctac

SEQ ID NO: 60435 - DNA, 201 bp, Homo sapiens
gctcgagggccaggatgtggagagtgaaccgacatggccacactgactctcctctccctctctccctccctccagcaaaccctcaagctgaggggcagctycagtggctgaaccgccgggccaatgccctcctggccaatggcgtggagctgagagataaccagctggtggtgccatcagagggcctgtacctcatctact

SEQ ID NO: 60436 - DNA, 201 bp, Homo sapiens
ttcctgtctctctctgtctccctctgctcaccttggggtttctctgactgcatcttgtccccttctctgtcgatctctctctcgggggtcggggggtgctstctcccagggcgggaggtctgtcttccgccgcgtgccccgccccgctcactgtctctctctctctctctctttctctgcaggttctccccatgacaccac

SEQ ID NO: 60437 - DNA, 201 bp, Homo sapiens
gaagcaactacagaccccccctgaaaacaaccctcagacgccacatcccctgacaagctgccaggcaggttctcttcctctcacatactgacccacggctycaccctctctcccctggaaaggacaccatgagcactgaaagcatgatccgggacgtggagctggccgaggaggcgctccccaagaagacaggggggcccc

SEQ ID NO: 60438 - DNA, 201 bp, Homo sapiens; identical to SEQ ID NO: 17500

SEQ ID NO: 60439 - DNA, 201 bp, Homo sapiens
ggtggtattgtagccagcttatatttgcatctacagccatgtttctagtccagcttggtgtgcaatactagatgagttaataactggtccttgtttctgayctggttcccattgtgtaactgtgttgattgggaaggtagtttgtgagccatgaaatgcttggttcattggttgcttattgacctcattaacctaggactt

SEQ ID NO: 60440 - DNA, 201 bp, Homo sapiens; identical to SEQ ID NO: 20383

SEQ ID NO: 60441 - DNA, 201 bp, Homo sapiens
ctatgacatattccaaaagctcaacagcaacacccaggtgagggcagtcttgcttgaatagctaatgattcttgaaaaatagtaagtgccaggggaaccawatactggattcttgagcctttttatgcatctgcttcagttttaggtgtggctagggaagggagcaggcctcaggaaggaaccagcactctaagactggcc

SEQ ID NO: 60442 - DNA, 201 bp, Homo sapiens
gccgggcacagtggtaactgacatatgagcacctgcctctctctgctcagatacagaaggtggtcatggcactaggagactacatgggcgcctcctgtcaygcctgtatcgggggcaccaacgtgcgtgctgaggtgcagaaactgcagatggaagctccccacatcatcgtgggtacccctggccgtgtgtttgatatgc

SEQ ID NO: 60443 - DNA, 201 bp, Homo sapiens
tgctctttaccacattcaactcctaatttatttgtttaggttatgatgtgattgctcaagcccaatctgggactgggaaaacggccacatttgccatatcrattctgcagcagattgaattagatctaaaagccacccaggccttggtcctagcacccactcgagaattggctcagcaggtaagagtggcttctattccct

SEQ ID NO: 60444 - DNA, 201 bp, Homo sapiens; identical to SEQ ID NO: 17493

SEQ ID NO: 60445 - DNA, 201 bp, Homo sapiens
cccctagagtaactggaatgagattgttgacagctttgatgacatgaacctctcggagtcccttctccgtggcatctacgcctatggttttgagaagcccyctgccatccagcagcgagccattctaccttgtatcaagggtgagacctctcagtcccagaagacattgtggactgtccctgacctgggtagagtggcatc

SEQ ID NO: 60446 - DNA, 201 bp, Homo sapiens
ggtattttttgggagctggtgggagttggatctgggacagcaggttgatggcatcatgcaggccactcctgacagagcccggctgtcaggatttctgagtrcttcggtcgggcaggggacaaaacttatgctttaaaccaacagatccagagacaatggccccgatgggatggagcccgaaggcgtcatcgaggtgagact

SEQ ID NO: 60447 - DNA, 201 bp, Homo sapiens
agctttaatttctttgcatcccctagagtaactggaatgagattgttgacagctttgatgacatgaacctctcggagtcccttctccgtggcatctacgcstatggttttgagaagccctctgccatccagcagcgagccattctaccttgtatcaagggtgagacctctcagtcccagaagacattgtggactgtccctg

SEQ ID NO: 60448 - DNA, 201 bp, Homo sapiens
aagtgtcttccctccgggatagagtgtcctccgtgcacatgctgaagagttgtctttcttgacgtaggccagaggcattgatgtgcagcaggtttctttastcatcaactatgaccttcccaccaacagggaaaactatatccacaggtaagcgtagatctggaacactcccctaccccttcacacctggccctccctggg

SEQ ID NO: 60449 - DNA, 201 bp, Homo sapiens
cctgagccgctgcctgcatggggcaaatgcctcagttttatagaaactcctcctttgggtattttttgggagctggtgggagttggatctgggacagcagrttgatggcatcatgcaggccactcctgacagagcccggctgtcaggatttctgagtgcttcggtcgggcaggggacaaaacttatgctttaaaccaacag

SEQ ID NO: 60450 - DNA, 201 bp, Homo sapiens
ctgcggatgggcaggtccaccttccttcgggggtgagcggcctgaggtatgggagggcgacgctacttcgcgacgggggcgggcgggatgtggattgttccatggaggggtgggagacgccgccgggtggtcgagggagcgagcacatggtggcctgaggcgttcccctcccccagtctgcttcgcttctaagtgttgtgc

SEQ ID NO: 60451 - DNA, 201 bp, Homo sapiens
agaagcagctggtttccctaaagggaggagggttgtaagctctgaggcttttgttagtaggcaccagattctgtttgctcggagactacagctcagctccmccttttccatgactcaagctttaatttctttgcatcccctagagtaactggaatgagattgttgacagctttgatgacatgaacctctcggagtcccttc

SEQ ID NO: 60452 - DNA, 201 bp, Homo sapiens
cccggcggcaagcaccacctctgggcaccgtgagcgcggcggcacgcctgccggcctgtcttcagaaagggtcacccccttatgtcgggggtggcctggcytgagccgctgcctgcatggggcaaatgcctcagttttatagaaactcctcctttgggtattttttgggagctggtgggagttggatctgggacagcaggt

SEQ ID NO: 60453 - DNA, 201 bp, Homo sapiens
tgtctgcctggcgggaaggtcctgggcaaaggatcagtctttgtactctgagagcagactacttggctcctctctgttttttatcagcgaagttggatatmtctctcccacatttccctaatcatatgctatatattggctttttttttcttctctagcccccaaatacatcaagatgtttgtactggatgaagctgacga

SEQ ID NO: 60454 - DNA, 201 bp, Homo sapiens
ttcccagggctgttgtctgcctggcgggaaggtcctgggcaaaggatcagtctttgtactctgagagcagactacttggctcctctctgttttttatcagygaagttggatatatctctcccacatttccctaatcatatgctatatattggctttttttttcttctctagcccccaaatacatcaagatgtttgtactgg

SEQ ID NO: 60455 - DNA, 201 bp, Homo sapiens
atctgagcctctggcttccctgccagtgcagccctggcagtgtcctacttcccagggctgttgtctgcctggcgggaaggtcctgggcaaaggatcagtcyttgtactctgagagcagactacttggctcctctctgttttttatcagcgaagttggatatatctctcccacatttccctaatcatatgctatatattggc

SEQ ID NO: 60456 - DNA, 201 bp, Homo sapiens
tcagctgaatgtgagtttaataatagtgcatgccccaaagttgttggttaggaatcaatacatgaaaaacatttaagaatggtgccgggcacagtggtaaytgacatatgagcacctgcctctctctgctcagatacagaaggtggtcatggcactaggagactacatgggcgcctcctgtcacgcctgtatcgggggcac

SEQ ID NO: 60457 - DNA, 201 bp, Homo sapiens
tcgggggcaccaacgtgcgtgctgaggtgcagaaactgcagatggaagctccccacatcatcgtgggtacccctggccgtgtgtttgatatgcttaaccgsagatacctgtgtgagtaattcggttctccaatcccctgggtcactttgctcttgtgcacgctttccagtctttcagcgtaagccagagtcattcccaagg

SEQ ID NO: 60458 - DNA, 201 bp, Homo sapiens
aggcaagtggatcacttgaggtcaagagtttgagactagcctggccaacatggtgagaacttgtctctactaaaaatacaaaaattaactgggcatggtgrtgtgcacctgtaattccagctacttgggaggctgaggcaggagaatcacttgaacctgggaggtggaggttgcagtgagctgagattgcaccactgcact

SEQ ID NO: 60459 - DNA, 201 bp, Homo sapiens
taatatgctacagttgtatttgtcatgctggtgaaaagatgtggtctttcacctggatgctttctcattaagcattatttttctgtttagcttcctgtgtragcaaacattttctcagcttgatactcagtgcatcagcggcttgcagaagagactgcctaggcctgctctgtccagtacggtagccacaagtcacttgtg

SEQ ID NO: 60460 - DNA, 201 bp, Homo sapiens; identical to SEQ ID NO: 17526

SEQ ID NO: 60461 - DNA, 201 bp, Homo sapiens; identical to SEQ ID NO: 17529

SEQ ID NO: 60462 - DNA, 201 bp, Homo sapiens
tttttcccatttttctttcatacttcagaaagacgagaatccaggacttgaatcgtatcttcccactttctgaggactactctggatcaggcttcggctcyggctccggctctggatcaggatctgggagtggcttcctaacggaaatggaacaggattaccaactagtagacgaaagtgatgctttccatgacaacctta

SEQ ID NO: 60463 - DNA, 201 bp, Homo sapiens
gtgggtgctgctgttatatgaatgggcacaaaatctgtctacattttgccttttaccaaatttagaatctatttagttaaaaccttcttagggcgggtggrgtgcagttgctcattcctgtaatctcagcacactgggaggccaaggcaggaggattgcttgagcccaggtgtttgagaccagcctgggcacatagtgaga

SEQ ID NO: 60464 - DNA, 201 bp, Homo sapiens
aaaaaaaataaaaataaaaacttcttaggacagagtgattagaagctgtgtagtagatacttagtaacaatgtgggttcctcgggcaggttatcctacgcrgagagccaggtaccaatgggtgcgctgcaatccagacagtaattctgcaaactgccttgaagaaaaaggaccaatgttcgaactacttccaggtgaatcc

SEQ ID NO: 60465 - DNA, 201 bp, Homo sapiens
ttctcaccaccaggcctttgtctttgctaaactgaggaaggaagattttatttcattagctaacaaagaacctcctatataggccgggcatggtggctcamgcctgtaatcctcacattttcagaggccaaggtgggtggattgcctgagctcaggagtttgagaccagcttgggcaacatggcaaaaccccatctctact

SEQ ID NO: 60466 - DNA, 201 bp, Homo sapiens
caggatggagtgcagtggtgtgatcatagctcactgcagcctcgaactcctcaagtgatcttcctgcctcagcctcccaagtagcgggaccacaggcacamagcaccatgcccatctaattaaaaaaatttttttttgtagagacaggggtctctgtacatttcccaggctggtcatgtactcctaagctcaagcagtcct

SEQ ID NO: 60467 - DNA, 201 bp, Homo sapiens
tttttttttttacagagtctcactcttgttgcccaggctggagtgcagtggtgcgatctcagctcactgccacctctgcctcccgggttcaagtgattctyctgcctcagcctccagggtgtgccactatgcccagctaatttttgtatttttggtagagacggggttttgccatgttgaccaggctggtcttgaacttct

SEQ ID NO: 60468 - DNA, 201 bp, Homo sapiens
cctgtttcttcctacttctctggttgtgctttttcctctgctcagtatttaacatgttggtgtgaccctggctctggcctgggcccccttctctatctacrtgctttctctcgacgacctccatcggttgcatgggtttaactaccaaatctgtgattctagctccgacaccccaggctaaagtagccacctggtcactcc

SEQ ID NO: 60469 - DNA, 201 bp, Homo sapiens
cacgccactgcactccagcctgcacaacagaaggaggccctttctgtaaaaaaaaaaatggttgaccactccttccttgaaatgcttttttcttgaggctyccatgccctgccttatcctgtttcttcctacttctctggttgtgctttttcctctgctcagtatttaacatgttggtgtgaccctggctctggcctgggc

SEQ ID NO: 60470 - DNA, 201 bp, Homo sapiens
aaaatacaaaaattagccaagcatggagaaacctcgtctctatagaaagacacaaaaactagccatgcatgcctgtggtccagctactcgaaaggctgagrtgggaggattgcttgatcctgagaggtcaaggctgaagtgagccatggtgtggcactgcactccagccagggtgacagactaaaaccttgtctcaaaata

SEQ ID NO: 60471 - DNA, 201 bp, Homo sapiens
tgctgatcccaaacccttttgccctcagatcctcctgtccttccctggccctgctctgtattggctgtggggtgggggtggcggtggaactgacccctggsgtctgcatttctcaggctcccagggctgtggctgactttggccaatgggaggcaaggacgggagactgagagcttgggaggaagggagagaggtatgttt

SEQ ID NO: 60472 - DNA, 201 bp, Homo sapiens
ggctgtggctgactttggccaatgggaggcaaggacgggagactgagagcttgggaggaagggagagaggtatgtttcttctccttactccctgcctgggrtggcaccttgggcaggactctgttttgcccatggcctcagctcccaccagatgcctctagtccctgggctcaggaaatagacaacctccttccactatcg

SEQ ID NO: 60473 - DNA, 201 bp, Homo sapiens; identical to SEQ ID NO: 17523

SEQ ID NO: 60474 - DNA, 201 bp, Homo sapiens; identical to SEQ ID NO: 17524

SEQ ID NO: 60475 - DNA, 201 bp, Homo sapiens; identical to SEQ ID NO: 17525

SEQ ID NO: 60476 - DNA, 201 bp, Homo sapiens
aaacctagaaaatcactctcctcaaagccagggttaatcatcatgctccaaaccaggtacatttcacatcactttgggatcctggcaactttctcttttgttttttttttttttttgagacagggtctcctctgtcacccaggatggagtgcagtggtgtgatcatagctcactgcagcctcgaactcctcaagtgatctt

SEQ ID NO: 60477 - DNA, 201 bp, Homo sapiens
ccccaagttttagtgcgctgtgacggtgtcattgttattttaacactgggagacgttatattccaattggggtgaatctgactgtgtgtattttcttttcttttttttttttttaaagataaacttggttcttactgaaaactcaattatggttagacatagttcatgtaaaacctctcagattttaaagagaaggccaaa

SEQ ID NO: 60478 - DNA, 201 bp, Homo sapiens
ttttgcccatggcctcagctcccaccagatgcctctagtccctgggctcaggaaatagacaacctccttccactatcgctgtagcccaaggagggaagtattttttttctttctttctttctttttttttttttttttacagagtctcactcttgttgcccaggctggagtgcagtggtgcgatctcagctcactgccacc

SEQ ID NO: 60479 - DNA, 201 bp, Homo sapiens
ccagatgcctctagtccctgggctcaggaaatagacaacctccttccactatcgctgtagcccaaggagggaagtattttttttctttctttctttctttytttttttttttttacagagtctcactcttgttgcccaggctggagtgcagtggtgcgatctcagctcactgccacctctgcctcccgggttcaagtgatt

SEQ ID NO: 60480 - DNA, 201 bp, Homo sapiens
acttaaaacctgtaatgactaagacaatgaaaatgataggcttgtaagaaaaatacaatttgttattctttggcaaataaggaatcatgtctaaataagayggaggtcatggcttgatagagagatggctgaacctatagtagaaaaacactaggttccgccaaatggtaagggaaatgttgagtcacaatgacacacatg

SEQ ID NO: 60481 - DNA, 201 bp, Homo sapiens
aacctatagtagaaaaacactaggttccgccaaatggtaagggaaatgttgagtcacaatgacacacatgtcctagatttgtttcgtcaaagcgacttttrgttgtcatgatcttacttccggtggagatgaaatcttacagatgatcgcagagacattcattttatgttggaaatttataaaatcattttcttctagtta

SEQ ID NO: 60482 - DNA, 201 bp, Homo sapiens
cagatgcctctagtccctgggctcaggaaatagacaacctccttccactatcgctgtagcccaaggagggaagtattttttttctttctttctttcttttyttttttttttttacagagtctcactcttgttgcccaggctggagtgcagtggtgcgatctcagctcactgccacctctgcctcccgggttcaagtgattc

SEQ ID NO: 60483 - DNA, 201 bp, Homo sapiens
tggtgcaagcttgtagttctagctactcaggaggctgagctgggaggattccctgagcccaggaagtcgaggctgcagtgagctataactgggctgctgcrctccaatatgggcaaaggagagagatcccatctctaaagaataaaataaataaataaaaattgaaaatacaaaaataaaacacaaaatggcaacaatcag

SEQ ID NO: 60484 - DNA, 201 bp, Homo sapiens
aaattatacctttagctgtttttctctagagaacgtaatttgtaagttattgaagcctaccatggctaaatgggcttctctttatgtatttaagtatattmtgtcctcacatctggtaccaacagagcatctatactcctagctccctggcactccattccttcaagaaccgtattcttcatatgaggatttaggaaggac

SEQ ID NO: 60485 - DNA, 201 bp, Homo sapiens; identical to SEQ ID NO: 17536

SEQ ID NO: 60486 - DNA, 201 bp, Homo sapiens
ctttatgtttatttgctggtgtcctttagcctgtcttcctcactggtctataacctgcttgagagcgtgaaccgtgacttctttttcccagccgcagcccrtgtgcctgcaacagtgtctggcacatggcagatctcaatacgtgtttaattgaatgaatcaataaacaaatgaagaaatggatgaatggctgcaattgtc

SEQ ID NO: 60487 - DNA, 201 bp, Homo sapiens
gctggtgtcctttagcctgtcttcctcactggtctataacctgcttgagagcgtgaaccgtgacttctttttcccagccgcagcccgtgtgcctgcaacastgtctggcacatggcagatctcaatacgtgtttaattgaatgaatcaataaacaaatgaagaaatggatgaatggctgcaattgtctaatgttttcctca

SEQ ID NO: 60488 - DNA, 201 bp, Homo sapiens
ggcaggtggatcaccaggtcaggagttcaagaccagcctggccaagacagtgaaaccccctctctactaaaaaatacaaaaattagccaggcgtggtggcrggtgcctgtaatcccagctacttgggagcctgaggcagagaattgtttgaacccaggagacggaggttgcagtgagccgagatcatgccactgctctcca

SEQ ID NO: 60489 - DNA, 201 bp, Homo sapiens
tttacatagtttttcatatatgccaaagttaagttcttacaaagtaaaaattcatgcagtttgaactaattaaaatttactaaacaactttttttttttttaaaataggaccaaatagaaggagaaaaagtaccaaatactttgttccaaagtggtacaaaagttcgctttctgctgaggcagggagaggggttttgctct

SEQ ID NO: 60490 - DNA, 201 bp, Homo sapiens
tggtatctttttatgggacacttgtatttctcctgtgttttacttatttattcctaggagactcaaactctttaagggcaagattagtcttttttttttttctagtctcatagtactcagcagatggtcttgcacttaccatatacttactaagtgaacaaataagaccagaaatatggtttttgactggtagcagaagag

SEQ ID NO: 60491 - DNA, 201 bp, Homo sapiens
gtttcactctgttgcccagtctggagtgcagtggcacgatctcagctcgctgcaaccgctgcctcccatgttcaagccattctcctgcctcagcctcccgwggagctgggattacaggtgccaaccaccacttccagcttattttttgtatttttagtagacatagggtttcaccatgttggccaggctggtcttgaattc

SEQ ID NO: 60492 - DNA, 201 bp, Homo sapiens
tactagagacagggttacaccatgttgccaaggctggtctcgaactcctggactcaagcaatctgcctgcctcggcctcccaaagtgctgggattacaggygtgagccaccacacctggattattattattattattattattattattattactttgagacaagatctcgctccgttgtccaggctggagtgcagtgaca

SEQ ID NO: 60493 - DNA, 201 bp, Homo sapiens
catatggaatattactgtgggaaatcttctcacttggtaagttgggcagctgctggcctcccttggctcctggctttgcatcctctgctctctcggtgccsccccacccctccccccaacactgatgggtcttacttgtattgcagcccatgactttatgtttatttgctggtgtcctttagcctgtcttcctcactggtc

SEQ ID NO: 60494 - DNA, 201 bp, Homo sapiens
ttcttactgtctgtgtatctgccttcaaatctcctctttttttttttttttttttttgagacagagtttcactctgttgcccagtctggagtgcagtggcrcgatctcagctcgctgcaaccgctgcctcccatgttcaagccattctcctgcctcagcctcccgaggagctgggattacaggtgccaaccaccacttcca

SEQ ID NO: 60495 - DNA, 201 bp, Homo sapiens
tcgagatatcatgagtgattccaactatgttgtcaggggcaatgtgaggctgctatttcctacttatttttatacggctattttgtgttgtgtcgttatcrtggtaaacaactgcactcactgtggtgcatttttgatttatggtaacatcaaaaaaccctcacagcagtctgcttacttatgcttaaaaggtttttctgc

SEQ ID NO: 60496 - DNA, 201 bp, Homo sapiens
ccaaaaaaaagatttgaaaagatgtgcttatatatgttttcttgtttattttaacttgtatcccttaaagtctgccttttctcccctgttcactgttggartcacctagcgtgttaccttggctcttggctaattgtagtagcataaaggcctgggatcccttgtgaggtcacggctagcacagccctcccaggctgcaca

SEQ ID NO: 60497 - DNA, 201 bp, Homo sapiens
gacagggtctcaccatcttggccaggctggtctcgaactcctgaccttgtgatccgcccaccttggcctcccaaagtgctgggatttcaggagtgagccaycgcccctggctgagggccattctttatatcttttttcttgaattgtgtattcaattctttttcccagttttctactgtgttttggttctgtgtccctcaa

SEQ ID NO: 60498 - DNA, 201 bp, Homo sapiens
tgtgtacagtgctttttgtctttagccttaagggatccaaagtattattttctgaagttacttaggttagttcctttctttcccatcccttcactatggtkttattatttatttgtgatacaattgaattaatttggttcgtattccgtcttgatatttcttccagccccctcatttcacatattctagttggtttattta

SEQ ID NO: 60499 - DNA, 201 bp, Homo sapiens
tcctttcaacatctcctcatctttttccaagcccttccttaatttttgacacactaccagatagttcaggttcatcttgtatttttcttttcttgccttamccctggaattcagcacttctccaaagagcactggcttctctggggggtagtatttaggaaccaagatctgagagttgggtgtgcccattgctgctgggat

SEQ ID NO: 60500 - DNA, 201 bp, Homo sapiens
gctcctggaccgccttgcgttttcgctccacacactcaacacagtccatccccactacacccgtgatgtcctcccatacaccaagggccctcatgcttgcrtctcctttcggagcttcaggttcatatgttaaatgtttggatgtctcaaaggtccctttaacacagtgtatgcaaggtgaattcccctaaccctggccct

SEQ ID NO: 60501 - DNA, 201 bp, Homo sapiens
tttggtagagatgagatctcactgtattgctcaggctaatcttgaactcctgggctcaagtgatcctcccaaagtgctaggattacaggtgtgagctaccrtgcctgacagaatacctatttcttgctaggcacaagcagtacaaagattaaagagatggaggtaggggaacttgtgtataaataaccaattttatttttt

SEQ ID NO: 60502 - DNA, 201 bp, Homo sapiens
aaccatcatcgtgtgctcttttatgtccaccttcttttactcaacattataataataagattcaaccttgttctctgtagcagtgtttttttttttaattkctggtaccattccgtggtatgaatagatcttataatttattttatccattatgttcacgaagcacatggaagttgttccaattttgtgtaattatgcata

SEQ ID NO: 60503 - DNA, 201 bp, Homo sapiens
catcccttggctcctggtcagcctggctcaagctattcccggactgccagcggtggagcccactccctctgtactgtgcatttatcatgctattctctctyctctgaagcccgcagatttgtctatccagattgtggattgtacccagctttaatttttaaaaactttttacaggggctgggcacggtggctcacgcctgt

SEQ ID NO: 60504 - DNA, 201 bp, Homo sapiens
ttaatagccttaaattctttgaattagaacatgggatcccaatttcccttatattgtaaacactacttttttttttttttttttttttgagacggagtctygctctgtcacccaggctggagtgtagtggcgcgatctcagctcactgcaacctccgcctcccaggttcaagcgattctcctgcctcagcctcctgagtag

SEQ ID NO: 60505 - DNA, 201 bp, Homo sapiens
aatgcattgtatatgagaaaattgctatgaaaggccacgtgcagtggctcacgcctataatcccagcactttgggaggccgaggcggacagatcacttgargtcaggagttccagaccagcctggccaacatgggggaccctcacttctactaaaaatacaaaaaattagccgggtgtggtggtgcatgcctgtaatcaca

SEQ ID NO: 60506 - DNA, 201 bp, Homo sapiens
cttaatatttgttaattgcatggatggatgaataaataaatgtcaaaatgctcatattttaaaaatgcattgtatatgagaaaattgctatgaaaggccaygtgcagtggctcacgcctataatcccagcactttgggaggccgaggcggacagatcacttgaagtcaggagttccagaccagcctggccaacatggggga

SEQ ID NO: 60507 - DNA, 201 bp, Homo sapiens
acccttcataggcagcataaacaggtcatctctaatgctgccgggaagataatgcgatagcttcatgtcttagcacctcacctaactctggcttgaataaycttcccatagagatttaataaggcaacttcttagagttttggcaaaagtgaagactggctctattttacagatgaaattgaatatgaaaaccaaaaaagg

SEQ ID NO: 60508 - DNA, 201 bp, Homo sapiens
tggccctcctctgttcctatgggaactcgggtgacttttgaaactttagcttccccctcccttactgcgtcccaaaaggatgcttaccttgctaaacttcmtgaaagcccaatcatgctttttctcttctctctttcttctctttttttcctttatcttctttctcatttttttccctttctttccctgtctttaaacaac

SEQ ID NO: 60509 - DNA, 201 bp, Homo sapiens
taggtacttaatatttgttaattgcatggatggatgaataaataaatgtcaaaatgctcatattttaaaaatgcattgtatatgagaaaattgctatgaarggccacgtgcagtggctcacgcctataatcccagcactttgggaggccgaggcggacagatcacttgaagtcaggagttccagaccagcctggccaacat

SEQ ID NO: 60510 - DNA, 201 bp, Homo sapiens
gcagcccaatgttatttatcttttctttagagaattataattaataggaccttcagtcggcaacgtgttctcagtgggttccagcttgtgtgggtgttgcrtgcagtgtgtcagcatgcatatgtttgataaagttttgatgtgaagaaggggaggccttagacctgcagttttcatgaattcactttgttctatctgcaa

SEQ ID NO: 60511 - DNA, 201 bp, Homo sapiens
gctacttggaagcgtcccttccaaggttggaggatcccttgagcatgggaggtggaggttgcagtgagctgagatcgcaccactggactccatcctaggtracacagtgagatcatgtctcaaaaaaaaaaattcctcctggagtgagcagcagaaaaaacaaaaaataaaagactaggcacagtggctcatgcctgtaat

SEQ ID NO: 60512 - DNA, 201 bp, Homo sapiens
tctatcaaaaatacaacaacaacaaaaaaattaaccagccatggtggtgtgcgcctgtggtcccagctacttgtgaggctgaggccggaggatcatctgarccagggaggtggaggttgcagtgagccaagattgtgccactgccctccagcctgccttggcctcccaaagtgttgggattacaggcatgagccactgcta

SEQ ID NO: 60513 - DNA, 201 bp, Homo sapiens
gggggacatacgccatgacagtccgtacaacattttagaaatgcagcccaatgttatttatcttttctttagagaattataattaataggaccttcagtcrgcaacgtgttctcagtgggttccagcttgtgtgggtgttgcgtgcagtgtgtcagcatgcatatgtttgataaagttttgatgtgaagaaggggaggcct

SEQ ID NO: 60514 - DNA, 201 bp, Homo sapiens
gccactcgggaggctgagacaggagaatcacttgagcctgggaggcggagcttgcagtgagccaagaacgcgccactgcactccagcctgggcgacagagygagactccatctcaaaaaaaaaaaaaaaaaaaaaaggtagaaatctatatacaacaaaaagtgcacacacacacacacacaaatcatgtatacaaataat

SEQ ID NO: 60515 - DNA, 201 bp, Homo sapiens
atatttaacagaagacaaaaacatccagcaccaggtaaaattcacaatgtctgacacccagttataaatttactagacaaacaaggaacaagaaatatttracttaaggagaaaaatcagtcacccaaaagggacccagaaatgacatcaaatgtggaattagtgggcaagaaaattaaaacggttattataacaatattc

SEQ ID NO: 60516 - DNA, 201 bp, Homo sapiens
gccaggtggtgaagaacgtggcctggccttcaagaacatcccttggctcctggtcagcctggctcaagctattcccggactgccagcggtggagcccactscctctgtactgtgcatttatcatgctattctctcttctctgaagcccgcagatttgtctatccagattgtggattgtacccagctttaatttttaaaaac

SEQ ID NO: 60517 - DNA, 201 bp, Homo sapiens
atcgcttgaacctgggaggcggaggttgtggtgagccaaagtggtgccactgtactccagcctgggtgacagagtgagactgcatctcaaaaaaaaaaaaraaagaaaagaaaaacccattttctggggagaaattctagctgctgcagaaatttgcataagttgcaaggagcctaatgttaatccccaagaccatgggga

SEQ ID NO: 60518 - DNA, 201 bp, Homo sapiens
ccagcaccaggtaaaattcacaatgtctgacacccagttataaatttactagacaaacaaggaacaagaaatatttaacttaaggagaaaaatcagtcacycaaaagggacccagaaatgacatcaaatgtggaattagtgggcaagaaaattaaaacggttattataacaatattccaaatctttctgaatgaggaaaga

SEQ ID NO: 60519 - DNA, 201 bp, Homo sapiens
aggcggggggatcacgaggtcgggagttcaagaccagcctagcaaacacagtaaaaccctgtctctactaaaaatacaaaaattatctgggcatgatggcrtgcacctttagtcccagctacttgggaggctgaggcaggagaatcgcttgaacctgggaggcggaggttgtggtgagccaaagtggtgccactgtactcc

SEQ ID NO: 60520 - DNA, 201 bp, Homo sapiens
ggagtgatatgccatatttatgtattagaaaactcaatattgttataatgtcagttttgcccaaattgatctagtgattcagtgaaattccttttaaaatycctgtagatctttttgcagaaattgacaagctgattctaaaattcatatggaaatgcaagagaactagaatatccaaaacaactctaaagaacaaagtta

SEQ ID NO: 60521 - DNA, 201 bp, Homo sapiens
aggaacaagaaatatttaacttaaggagaaaaatcagtcacccaaaagggacccagaaatgacatcaaatgtggaattagtgggcaagaaaattaaaacgrttattataacaatattccaaatctttctgaatgaggaaagattgtacatgttaagaagagacatagcaaatataacaaattactcaaattgaactactaa

SEQ ID NO: 60522 - DNA, 201 bp, Homo sapiens
ggcaggcagatcacctgacgtcaggaattcgagaccaacctgggcaacatggcgaaaccctgtctttactaaaaatataaaaattagccgggcatgatggygggcacctgtaatcccagctactcagaagctaagggacaaaaattgcttgaacccgggagatggaggttgcagtgagccaagatcgcaccattgtactcc

SEQ ID NO: 60523 - DNA, 201 bp, Homo sapiens
aatgtggaattagtgggcaagaaaattaaaacggttattataacaatattccaaatctttctgaatgaggaaagattgtacatgttaagaagagacatagyaaatataacaaattactcaaattgaactactaaggatgaaaactcaattacactggagagaattagtaccagattaaacattgtaggagaaaagattagt

SEQ ID NO: 60524 - DNA, 201 bp, Homo sapiens
aactttcagaagagggacttggaactctggtctccaactctttgcctcacagaagagagcttgaaaatgaagtgtcttgacatcctctggtttgtttcatratgtgtaaaataaagccacaactctttaaagttttagattaatgtcaacttttgttttacttacccccacccccatcccagtactgtcccttcaaagtgt

SEQ ID NO: 60525 - DNA, 201 bp, Homo sapiens
gcactgtactagatgctggagatacagagtcagttatgatatgactcctgggctcgaagatcttatgaatgataggggagacagagacaagcagacatgcragtcgaagatgacactgaggccgggggtgggtggctcaggcctgtagtcccagcactttgggaggttgagacggtggattgcttgaggccaagagttcaa

SEQ ID NO: 60526 - DNA, 201 bp, Homo sapiens
ctgccaccacgcctggctaatttttgtatttttagtagagacgaggtttcaccatattggccaggccagtcttgaacttctgacctcaagtgatccacccrcctcggcctcccaaagtgctgggattacaggcatgacccaccatgcctggcttctctcataattttgaatttaaataaataatgcagattgactctgagc

SEQ ID NO: 60527 - DNA, 201 bp, Homo sapiens
catcatggctttgtagcacctttctctgaatggattcccaggcattctgatggaggcattcgttgagccttggagcattctttttttttttttttttttttcagacagagtttcgctctgttgcctaggctggagtggtgcaatggtgtgatctcggctcactgcaacctccacatcccaggttcaagcgattctcttgcc

SEQ ID NO: 60528 - DNA, 201 bp, Homo sapiens
acctcaaatgatccacccgctttggcctcccaaagcgctgggattgcaggcatgagccacagcgcccagccaatcagtttcctttaagacagtaattgagytttaaatagaaggtagtgtgttaggtcttggccattggaagctcgcttttctccccataaccagcctgtttcattgctttatctcctcatgtttcactta

SEQ ID NO: 60529 - DNA, 201 bp, Homo sapiens
gatcttgcctacgattattatggtggtgtttgcctaatggtgcttttctttttcctacattccctctatgttaattggaatgctttgtaaggaagcactgyccctttcccctcattttatttatgtatttattcaattttttatttatatcagtagaggcccatgaatatttattttatcctctggattgtaacccaatac

SEQ ID NO: 60530 - DNA, 201 bp, Homo sapiens
tagcaaatataacaaattactcaaattgaactactaaggatgaaaactcaattacactggagagaattagtaccagattaaacattgtaggagaaaagatkagtggacttggcggcatagcaacagaaactatccaaaatgaacagagcaaaaaagaccaaataacgtaaacagagaattagggaggtacagaacttcagg

SEQ ID NO: 60531 - DNA, 201 bp, Homo sapiens
gtagtcaaatgcacctcttttttcttttctttttttttttttttttttttttttgagatggagtctggctctgttgcccaggctggagtgcagtggcacartcttggctcactacaacctctgcctccccggctcaagtagttctcctgcctcagcctcccgagtagctggaactataggcgtgcgccaccaggcccagct

SEQ ID NO: 60532 - DNA, 201 bp, Homo sapiens
agagaattagggaggtacagaacttcaggtcgtcagatatacatgtaattagagtccctaaaggagagaatggaggaaaggaagatgacagtaaagatatstcaaaaataagggaggaaaattgtcaaaatcggataaaaatgataaacctatgggttcaagaagcccagtgaaactcaaacacatgactaatgacaacta

SEQ ID NO: 60533 - DNA, 201 bp, Homo sapiens
catcacatttatggaacattccacctaacaatagtcacagtagtcaaatgcacctcttttttcttttctttttttttttttttttttttttttgagatggwgtctggctctgttgcccaggctggagtgcagtggcacaatcttggctcactacaacctctgcctccccggctcaagtagttctcctgcctcagcctcccg

SEQ ID NO: 60534 - DNA, 201 bp, Homo sapiens
agtacagtttgctgagctatctggaattttccctagagagagaatgcattggccaaccaatatgttctagcctgcttggcagttttatttctcaatgtcarttaatgggtctcttgagcacctgatagtgggaattagtcctctttgaccttctcccattggacttgctggcaaatctaatgttctagacctgagggccac

SEQ ID NO: 60535 - DNA, 201 bp, Homo sapiens
acatgtaattagagtccctaaaggagagaatggaggaaaggaagatgacagtaaagatatgtcaaaaataagggaggaaaattgtcaaaatcggataaaartgataaacctatgggttcaagaagcccagtgaaactcaaacacatgactaatgacaactacaaaaggctaattatcatcaaattggttaaagccagagac

SEQ ID NO: 60536 - DNA, 201 bp, Homo sapiens
gagggaagtccagagaccctgcccttgcccctgtggctgcccgggctgccctgaccaactgcacatgagccgcaatgacgggagcccttggattccatagygactttcctcacactgtgcttctaagtcagcttataagtacagtttgctgagctatctggaattttccctagagagagaatgcattggccaaccaatatg

SEQ ID NO: 60537 - DNA, 201 bp, Homo sapiens
aagagaaggtgatgccagagtcatactggaagagaagtaagacttgtcagagaaagaagagggtgaggatgttccaggtaaataggacagcaaatggagtyttccacagatggaaaactatgatttcattccgagttgttgtgacacaatgtataaggtcgccaggattagagtaactatcatttataaagttgtaattca

SEQ ID NO: 60538 - DNA, 201 bp, Homo sapiens
gtaaagatatgtcaaaaataagggaggaaaattgtcaaaatcggataaaaatgataaacctatgggttcaagaagcccagtgaaactcaaacacatgactwatgacaactacaaaaggctaattatcatcaaattggttaaagccagagactaagagaaaatcttaaaagcatccagagaaaaaaagatacattcatttgg

SEQ ID NO: 60539 - DNA, 201 bp, Homo sapiens
caaatcttcactgaatgtaaagaagagttactatatctggaagaaaaagtctgttcacagaggggtggtgcctggagcctggagagggaagtccagagacyctgcccttgcccctgtggctgcccgggctgccctgaccaactgcacatgagccgcaatgacgggagcccttggattccatagcgactttcctcacactgt

SEQ ID NO: 60540 - DNA, 201 bp, Homo sapiens
caaaatcggataaaaatgataaacctatgggttcaagaagcccagtgaaactcaaacacatgactaatgacaactacaaaaggctaattatcatcaaattsgttaaagccagagactaagagaaaatcttaaaagcatccagagaaaaaaagatacattcatttggcagacttcttgtcatgaactatgtaagtcaaaaga

SEQ ID NO: 60541 - DNA, 201 bp, Homo sapiens
tttctactaaaaatacaaaagttagccaggcgtggtggcagacgcttgtaatcccagctacttgggaggctgaagcaggagaatcacttgagcctgggagrcagaggttgcagtgagccaagattgcgccattgcactatacccttggtgacagagtgcgactccatctcaaaaaaaaaaaaattgcatgcgtcaatgaag

SEQ ID NO: 60542 - DNA, 201 bp, Homo sapiens
ttgggaggctgaggcaggcagatcacttgaggagtttgagaccagcctggccaacatggtgaaaccctgtttctactaaaaatacaaaagttagccaggcrtggtggcagacgcttgtaatcccagctacttgggaggctgaagcaggagaatcacttgagcctgggaggcagaggttgcagtgagccaagattgcgccat

SEQ ID NO: 60543 - DNA, 201 bp, Homo sapiens
attaggaagaaaaaatctgtttttatttaacaaactttaattgaatacccatttttttccttccttccttctttccttccttcctttctttctttctttttctttctttctttcgacagtctccctttgtcattgaggctggagtgcagtggtgtgatcacagctcactgcagcttcaacctcctgggctcaagcaagcct

SEQ ID NO: 60544 - DNA, 201 bp, Homo sapiens
gattctagtctgagactatactaagtcaaaactccctttcatgctagtggaaattattaaagccacagaagccagactggtatcatttctggaagtgatgrcgtgggctcccctcccgacattattgtggatgacatttccactaaaggtcttcccagaaatgctgtaacagaagatctcactaattcactagtacccact

SEQ ID NO: 60545 - DNA, 201 bp, Homo sapiens
cattaggaagaaaaaatctgtttttatttaacaaactttaattgaatacccatttttttccttccttccttctttccttccttcctttctttctttctttttctttctttctttcgacagtctccctttgtcattgaggctggagtgcagtggtgtgatcacagctcactgcagcttcaacctcctgggctcaagcaagcc

SEQ ID NO: 60546 - DNA, 201 bp, Homo sapiens
gttgatgctaacttctacaaactgattcaaaatggatttaaaatggatcagccattttatgctacagaagaaatgtaagttcaagtcagactgtaatttgrttgaaatcagaaaggtacagtctgtctacttccaaatgcatgaccaaaaaaagtcaaactccttagtgcaaagcgtataggattctttttttaaaaaata

SEQ ID NO: 60547 - DNA, 201 bp, Homo sapiens
gcattaggaagaaaaaatctgtttttatttaacaaactttaattgaatacccatttttttccttccttccttctttccttccttcctttctttctttctttttctttctttctttcgacagtctccctttgtcattgaggctggagtgcagtggtgtgatcacagctcactgcagcttcaacctcctgggctcaagcaagc

SEQ ID NO: 60548 - DNA, 201 bp, Homo sapiens
acgcaacagcttatggaattagcaaaacaggagtctcaatccaggttgccgtcaaaatgctgaaaggtacagtatagtggaaggacagcaacaaagatgcmcaaaaatgggaggcacagtttcccacccatgccttcttctcttttccatccttttaatggttactgtttgccttgtttcaaggctaaaaatggagtggat

SEQ ID NO: 60549 - DNA, 201 bp, Homo sapiens
gcaagaatccccagagagactgtttcacaggttggggcggagtcctccctgtgcccttgtgactcatgtgtcacagtgaccgggagaagcagaaactgccrgtgtggtgaatctccatggaaagatctaactctagagaaacagattttgtcacttggagtctctgtcattttcccttttgattagcctccttatttgccc

SEQ ID NO: 60550 - DNA, 201 bp, Homo sapiens
caaatgtcctgacctccgtctcctgccggctggccatttgtagaaaacccctaggcgaaagaggaagctttgcatctcccaatcagcctaattagttagtycccttggaattcccatggggtcaggacacggttgtcattgcagttgtcattgtttccagggttaactgtcataagcatgaggaaaggcagtttaaagcca

SEQ ID NO: 60551 - DNA, 201 bp, Homo sapiens
aagtgaggccataattggctttgacagtaagaaagagatctttttgtggaccagaaactgtggaaaatccctgagacaatgaaagcagttaaaattgcacygcagagggaaaacccaccacagaggatgcctgggaaaaacaaggacaagggtaacacaaaggcagcaagaagtcctgggacactgcagaagttctgaagc

SEQ ID NO: 60552 - DNA, 201 bp, Homo sapiens
aacacaatttcagtttttaccccactttccaatcacatccaaattccaggtaagaggctgggtcagggtttcgtaattacacatcatagaacgtaggcaargtgtgctgttcaaacacacttcgttgaccagtttctaaaggcaccgtgaagtctgtgggtcctgcaacctagagatttcctgaatctttgctatagtttc

SEQ ID NO: 60553 - DNA, 201 bp, Homo sapiens
ctccaccccctgggctcaggctcctcagcagctggggctacaggcgtgcaccaccacgctcagctaagttttttatttttggtagagacggggtttcaccrtgttgcctaggctgatctgggactcctgagctcaaactatctgcccgcctcggcctcccaaagtgttgggattacaggcgtgagccactgtgccaggcct

SEQ ID NO: 60554 - DNA, 201 bp, Homo sapiens
tgtcagaactcaagatgatgacccagctgggaagccacgagaatattgtgaacctgctgggggcgtgcacactgtcaggtaacccacttccacgaaaatcrcctcatcaaaaagactgtagcttgatgacaaagaggatgtttgctctctctctctctctctctttttaattctttgtcttttctcagtcacagtgtgaac

SEQ ID NO: 60555 - DNA, 201 bp, Homo sapiens
atgaaagccagctacagatggtacaggtgaccggctcctcagataatgagtacttctacgttgatttcagagaatatgaatatgatctcaaatgggagttyccaagagaaaatttagagtttggtaagaatggaatgtgccaaatgtttctgcagcatttcttttccattggaaaatctttaaaatgcacgtactcaccat

SEQ ID NO: 60556 - DNA, 201 bp, Homo sapiens
aacatggcgaaaccccgtctctactaaaaacacaaaattagctgggcctggtggcgcgtgcctgtaatcccagcaactcgggaggctgaggcaggagaatygcttgaacctgggacgcagaggttgcagtgagccgagatcacgccattgcactccagcctggggaacaagagtgaaactccgtctcaaaaaaaaaaaaaa

SEQ ID NO: 60557 - DNA, 201 bp, Homo sapiens
actcttttgttgcaggccccttccctttcatccaagacaacatctcattctatgcaacaattggtgtttgtctcctcttcattgtcgttttaaccctgctratttgtcacaagtacaaaaaggtaaaagcaaaggtaaaaattcattattctttcctctatctgcagaactgcctattcctaactgactcatcatttcatc

SEQ ID NO: 60558 - DNA, 201 bp, Homo sapiens
tttaactgcctgaaacttttgataggtcagagagatgaattctcttgttcacaatacacagtcagaattaccttggcttacgagttcagggcacagaacaytggtgtcacacaaacgtgggctcaaaagctgcaattacgcagtggcgttttgtggattttttttgtagagatgggatctcagtagattgccaaggctggt

SEQ ID NO: 60559 - DNA, 201 bp, Homo sapiens
cctttcccattctcctccattaaacaacgctccccttgtcatgctccgaaacctcaaatctgaacttttacttctcctatcacagaaacttcccacactcyaactgcttattacccctctaccttcaccaccaaattgtaaattctgtgagaacagaaacccaattttttgaatttgctgttgtgtcctcaatttccgtca

SEQ ID NO: 60560 - DNA, 201 bp, Homo sapiens
tgaccaatttcatacttggagtttgttcagaagagtgaaaaatgtttcaagtgctatctcttctaaaccatggcaaaccacactctattaagacagcacaraagactgaggaagaaaaatgtttacgaaacattttgctttggtctgcctcatgataagtaattgtactggtcatttctttttccactgaattgactggtg

SEQ ID NO: 60561 - DNA, 201 bp, Homo sapiens
catgcattaggaagaaaaaatctgtttttatttaacaaactttaattgaatacccatttttttccttccttccttctttccttccttcctttctttctttctttttctttctttctttcgacagtctccctttgtcattgaggctggagtgcagtggtgtgatcacagctcactgcagcttcaacctcctgggctcaagca

SEQ ID NO: 60562 - DNA, 201 bp, Homo sapiens
atttttgaagaacatccagtttcttaggccttctatccttttatcttcacatcaggcctcccctttgaatcatgcgtgtcactgtccccttcttgtctctyaccccctccctgatattcctctgggtgcccctcagtttcctctgtaggcccttgacttcatcaaacatttgttgagccccagctacatgccaagcactgt

SEQ ID NO: 60563 - DNA, 201 bp, Homo sapiens
caggcaagaatccccagagagactgtttcacaggttggggcggagtcctccctgtgcccttgtgactcatgtgtcacagtgaccgggagaagcagaaactsccggtgtggtgaatctccatggaaagatctaactctagagaaacagattttgtcacttggagtctctgtcattttcccttttgattagcctccttatttg

SEQ ID NO: 60564 - DNA, 201 bp, Homo sapiens
agggtacaagcaaagctgtcattgtgcaacacctggttcacaatggatatattttgggtcaaaggatacacacacacacacacacacacacacacacacamaattttctagaaagaaaagtgaagtgtaggaggcagtctggacagttcacattaaaactgtcaaaaacaaagaaaaagaagtagacagtaacaagggctg

SEQ ID NO: 60565 - DNA, 201 bp, Homo sapiens
gaatgtatttaaaaagtcatttaaaggtcacttttatgatgttatctgtgagcctgttaaaaacaacagtggctgagggtggtggctcacgcctgtaatcscagcactttgggaggcctaggtgggtggatcacttgaggccaggagtgcaagaccagcctggtcaacatggtgaaaccctgtctctactaaaaaaatata

SEQ ID NO: 60566 - DNA, 201 bp, Homo sapiens
ggcccaagtgatcctcccaccttggcttcacaaagtattggtattataggagtgaaccactatgcccagccagtgagcttatttcacacgttcttttctayagggaaacctcaagtgctcgcagaagcatcggcaagtcaggcgtcctgtttctcggatggatacccattaccatcttggacctggaagaagtgttcagac

SEQ ID NO: 60567 - DNA, 201 bp, Homo sapiens
catcgctgagtgacactcttttgttgcaggccccttccctttcatccaagacaacatctcattctatgcaacaattggtgtttgtctcctcttcattgtcrttttaaccctgctaatttgtcacaagtacaaaaaggtaaaagcaaaggtaaaaattcattattctttcctctatctgcagaactgcctattcctaactga

SEQ ID NO: 60568 - DNA, 201 bp, Homo sapiens; identical to SEQ ID NO: 17531

SEQ ID NO: 60569 - DNA, 201 bp, Homo sapiens
agatgtatcagaatgtggatggccgtgtttcggaatgtcctcacacctaccaaaacaggcgacctttcagcagagagatggatttggggctactctctccrcaggctcaggtcgaagattcgtagaggaacaatttagttttaaggacttcatccctccacctatccctaacaggctgtagattaccaaaacaagattaat

SEQ ID NO: 60570 - DNA, 201 bp, Homo sapiens
aactacaggcttctccacctgcacaagttctgagaagttagactatccagagcaagaggggcaggaacttcctggtctcactgagaatcttcggccaatcycaactcccaatgggcatatgactcacacggtgatcatcttaaaatgcagattctgagtcagtgatttgaaagggacctgaaatcttgcaattgtaacaag

SEQ ID NO: 60571 - DNA, 201 bp, Homo sapiens
ggcagcaagcaagagagagaatcttctctggggagtcggaccagccggtgagaaaagacctaaatatacacctacagagattgagccacaagccacatcayagagcttaggatagacgctcagcacttcattcttatatgtgaagagactgtcaaagattgtcagtcatttggggaaaatatctaaatcatgggcaaacag

SEQ ID NO: 60572 - DNA, 201 bp, Homo sapiens
catcagatggtaatcagtgttctgtctctttcccacattcagatgtatcagaatgtggatggccgtgtttcggaatgtcctcacacctaccaaaacaggcracctttcagcagagagatggatttggggctactctctccgcaggctcaggtcgaagattcgtagaggaacaatttagttttaaggacttcatccctccac

SEQ ID NO: 60573 - DNA, 201 bp, Homo sapiens
tattaaaacctagggcaactactttgagatgagtacctattcaacaaacagaactatgatacggattctgtttgcttttgtatcatcagtggcaagaaacracaccggatactacacttgttcctcttcaaagcatcccagtcaatcagctttggttaccatcgtaggtaatgcaggctgctcacacaatctttattccta

SEQ ID NO: 60574 - DNA, 201 bp, Homo sapiens
aggcatagaacatgtccatcactgcagactgttttattggacagccctgctctaagtatctctgctcctgatttaaactagactaaacttgcataaaatcraatttcctacatactttcatagtggccaatttcctctgattacactttgttttgttgtttggttgcaagataaatgcatgttttctttttaaggtgtgca

SEQ ID NO: 60575 - DNA, 201 bp, Homo sapiens
agtccagctgttgttaaaaaggaggaaaaagtgcttcatgaattatttgggatggacataaggtgctgtgccagaaatgaactgggcagggaatgcaccargctgttcacaataggtaacactataatatcatgcactttcattttcagtgaccggttcttagcaactatcagggactaacagtaactgcgtaggtgatca

SEQ ID NO: 60576 - DNA, 201 bp, Homo sapiens
accatgcttgaccctcctgtatacttttaaaattatctctagattacttataatacctaatacgatgcaaatgctttataatacctaaacaactatgtgamtagttattataccctattgtttagggaataatgatgacaagggaaaaaagtcggtacatgttcagtacagatgcaaccccatttttttcggaatattttc

SEQ ID NO: 60577 - DNA, 201 bp, Homo sapiens
cctgcagcgcgaggcgcgccgctccaggcggcatcgcagggctgggccggcgcggcctggggaccccgggctccggaggccatgccggcgttggcgcgcgrcggcggccagctgccgctgctcggtaaggccccgctcgctcgctcgcagcccctcgcggtccctcagcccccaccccgcagtgtggacccgggcgcgcgc

SEQ ID NO: 60578 - DNA, 201 bp, Homo sapiens
gacaggttcttgctcattgcagcctcaaattcctggaatcaagcgatcctcccacctcagcttcctgagtactttttaaaaattctcttttgcagagatgrggatcttgctatgttgtgcaggctagtctcaaactgctggcctcaagcaatcctcctgcctcagcctcccaaagtgctgggattactggtgtgagccacc

SEQ ID NO: 60579 - DNA, 201 bp, Homo sapiens
caccccacctggccctatttttctttttaatttattttttttagacagagtctcactccgtcacccaggctggagtgcagtggcgtgatctccgctcactrcaaccttcacctcctgggttcaagcaattatcgtgcctcagcctcttgagtagctgggattacaggcatctgccaccacgcctggctaatgcatctttag

SEQ ID NO: 60580 - DNA, 201 bp, Homo sapiens
aaaatcacatgactcaatcatgctatatggtagcctggaaagagcattgacctggagttctgagggttgaataccagctgtaccactctgtctcccaattktgtccattatagcaaatcactttacttctctaagcatcagttttctcacctgtaaaatgggttgttaagttagattatcttttgagctttgaggacttgg

SEQ ID NO: 60581 - DNA, 201 bp, Homo sapiens
acagaaaaacattactcataggtgtattgatttaaattttcaaaaaatacatgcagaaatagcccaatagtaagtgctgaaggaaaatgttgttttcctcsggatttgtatgagaaactatgcaagattcttttttttaagaacaacaaattttcttttctttttctttttctttttttttttttttgagatgaggtctca

SEQ ID NO: 60582 - DNA, 201 bp, Homo sapiens
cctctcaaagtgctgggattacaggtgtgagccaccacacctggctgtctgattccattttaaaaagaaaagaaaactctttgttttgggagtttctgaacaaagctgaacctttcctgtcctcagaggcacctgcttcccggttttaattcctttgcttgagggctccatgaaggtcattcgattctatccactacgtca

SEQ ID NO: 60583 - DNA, 201 bp, Homo sapiens
tactcgggaggctgaggcaggagaaccacttaaaccagggagtctgaggttgcagtaagctgagatagcgccattgcactccagcctgggcaacaagagcraaactccgtctcaaaaaaaaaagagaaagaaaatcagtacaaagctctgccccagtaacctacccatcttgtgtcttgattctagtctgagactatacta

SEQ ID NO: 60584 - DNA, 201 bp, Homo sapiens
aaagcaccttgtccagggtgaacatccagtaaatgtgaaaagtcaaattaaactgtattcccactagaaacaaataatcatcttagctgatttacgatctmctcctactcatcatagactgctcatatgtagtcattcagtttctaccccaccagctggttgtctcttatgtgggaaagtgaattccatttggaaccacaa

SEQ ID NO: 60585 - DNA, 201 bp, Homo sapiens
gcggtggctcacgcctgcaatcccagcattttgggaggccgaggtgggtggatcacctgaggtcaggagttcgagaccagcctgaccaacatggcgaaacsccgtctctactaaaaacacaaaattagctgggcctggtggcgcgtgcctgtaatcccagcaactcgggaggctgaggcaggagaatcgcttgaacctggg

SEQ ID NO: 60586 - DNA, 201 bp, Homo sapiens
caggcgcggtggctcacgcctgcaatcccagcattttgggaggccgaggtgggtggatcacctgaggtcaggagttcgagaccagcctgaccaacatggcraaaccccgtctctactaaaaacacaaaattagctgggcctggtggcgcgtgcctgtaatcccagcaactcgggaggctgaggcaggagaatcgcttgaac

SEQ ID NO: 60587 - DNA, 201 bp, Homo sapiens
catttttagctttttgtttttccgattatttccctcgatattactccatttattcctaaagctattttccagtcagaaaagagatgctggccaggcgcggkggctcacgcctgcaatcccagcattttgggaggccgaggtgggtggatcacctgaggtcaggagttcgagaccagcctgaccaacatggcgaaaccccgt

SEQ ID NO: 60588 - DNA, 201 bp, Homo sapiens
gaattaccttggcttacgagttcagggcacagaacattggtgtcacacaaacgtgggctcaaaagctgcaattacgcagtggcgttttgtggattttttttgtagagatgggatctcagtagattgccaaggctggtctcaaacttctggcctcaagcagtccacccatctcagcctcccaaagtgttgggattacaggtg

SEQ ID NO: 60589 - DNA, 201 bp, Homo sapiens
cttttgtttaccatttgacccttaaaactggctctagaactttgttctcctcttgagcattcatttgtaattttaaaacttgtttagccaaatggtacttmttttctaattgcagctgtaaagaagaaagtccagctgttgttaaaaaggaggaaaaagtgcttcatgaattatttgggatggacataaggtgctgtgcca

SEQ ID NO: 60590 - DNA, 201 bp, Homo sapiens
catgctattctctcttctctgaagcccgcagatttgtctatccagattgtggattgtacccagctttaatttttaaaaactttttacaggggctgggcacrgtggctcacgcctgtaatcccagcattttgggaggcccaggcaggtggatcacctgaggttgggagttcgagaccagcctggccaacatggagaaattcc

SEQ ID NO: 60591 - DNA, 201 bp, Homo sapiens
agctcccctctgagctcttagctgaaaccatagatatgggcttgtttaccttttgaccttttgtttaccatttgacccttaaaactggctctagaactttrttctcctcttgagcattcatttgtaattttaaaacttgtttagccaaatggtacttcttttctaattgcagctgtaaagaagaaagtccagctgttgtta

SEQ ID NO: 60592 - DNA, 201 bp, Homo sapiens
tctctgctaaaaatacaaaataaaccaggcgtggtggcgcatgcctgtaatcccagctactcaagaggctgaggcaggagaatcgcttgaaccccagaggyggaggttgcggtgagctgaaatcatgcattgcactccagcctggcaacaagaacgagattatggatttctggcaagaatttcccaggagcgtgcccttcc

SEQ ID NO: 60593 - DNA, 201 bp, Homo sapiens
cctgctactagtattccagcctggaataccacaatatttcaaaggagtggtttagaacccgttagcttgaccagctcctctagacatattcaggtttcccytgatacgtagttggattgattagattcctgtcaaccctctgtagaacctatagagaactgagaatcactgatgaatcactgatgtgtgccgtgggctctc

SEQ ID NO: 60594 - DNA, 201 bp, Homo sapiens
cgcatgcctgtaatcccagctactcaagaggctgaggcaggagaatcgcttgaaccccagaggcggaggttgcggtgagctgaaatcatgcattgcactcmagcctggcaacaagaacgagattatggatttctggcaagaatttcccaggagcgtgcccttcccagagcatcatattcagagtgacaggaagtcatttgg

SEQ ID NO: 60595 - DNA, 201 bp, Homo sapiens
tactttttattcagagtgaagctaccaattacacaatattgtttacagtgagtataagaagtaagtccagcctgctactagtattccagcctggaataccrcaatatttcaaaggagtggtttagaacccgttagcttgaccagctcctctagacatattcaggtttcccttgatacgtagttggattgattagattcctg

SEQ ID NO: 60596 - DNA, 201 bp, Homo sapiens
tttggaagacaattgggcactttcttaaaaagttacaaatacactgaccatataacctaggcattcaattccttagtatttacccaagagaaatgaaagtrtatatccatattaagacttttatataaatagcagctttattagtaacagcaaaagtggaaacagcccaaatgtgtgtccacaggtggatagattaaaaca

SEQ ID NO: 60597 - DNA, 201 bp, Homo sapiens
gagaaatgaaagtgtatatccatattaagacttttatataaatagcagctttattagtaacagcaaaagtggaaacagcccaaatgtgtgtccacaggtgratagattaaaacaaattgtgttatatatctatacaacagattactacttggtaattaaaaggaatgaactactgatatctactacagtatggacaaatat

SEQ ID NO: 60598 - DNA, 201 bp, Homo sapiens
gtttacagtgagtataagaagtaagtccagcctgctactagtattccagcctggaataccacaatatttcaaaggagtggtttagaacccgttagcttgaycagctcctctagacatattcaggtttcccttgatacgtagttggattgattagattcctgtcaaccctctgtagaacctatagagaactgagaatcactg

SEQ ID NO: 60599 - DNA, 201 bp, Homo sapiens
aagatcttctttgctttgcatatcaagttgccaaaggaatggaatttctggaatttaagtcggtatgctccttttaaagaaaaaacaaaccaaaaaaaagatttgaaaagatgtgcttatatatgttttcttgtttattttaacttgtatcccttaaagtctgccttttctcccctgttcactgttggagtcacctagcgt

SEQ ID NO: 60600 - DNA, 201 bp, Homo sapiens
gtgatggagaactgaaaatagtagaaatcagccaggtacagtagctcacacctgtaatcccagcactttgggaggccaaggtgggtggatcgcttgagctsaggagtttgagaccagcctgaggaacatggtgaaaccccgtgtctatcaaaaatacaacaacaacaaaaaaattaaccagccatggtggtgtgcgcctgt

SEQ ID NO: 60601 - DNA, 201 bp, Homo sapiens
gaagatcttctttgctttgcatatcaagttgccaaaggaatggaatttctggaatttaagtcggtatgctccttttaaagaaaaaacaaaccaaaaaaaagatttgaaaagatgtgcttatatatgttttcttgtttattttaacttgtatcccttaaagtctgccttttctcccctgttcactgttggagtcacctagcg

SEQ ID NO: 60602 - DNA, 201 bp, Homo sapiens
tgaggggctggccgtggtggctcacgcctgtaatcacgccttgggaggccgaggcaggcaggtcacctgaggtcaggagttcaagaccagcctggcccaayatggagaaaccttgtctctactaaaaatacaaaaattagctgggtatggtggtgcacgcctgcaatcccagctacttgggaggctgaggcaggaggattg

SEQ ID NO: 60603 - DNA, 201 bp, Homo sapiens
aatctcagctaattgcaacctctgcctcccacattcaagcgattctcctgcctcatcctcccaagtagctgggattacaggtgcctgccaccacgcctggstaatttttgtatttttagtagagacgaggtttcaccatattggccaggccagtcttgaacttctgacctcaagtgatccacccacctcggcctcccaaag

SEQ ID NO: 60604 - DNA, 201 bp, Homo sapiens
tgctgccctgcctctcctgcaccatccaacatctcactgcagtatccagcaacccacaggcctgctgggcgtggtggacagtccccaagatcaggttatcygtgtcaaaatattgagtggttgatgagtgctccaagtaggcactagagcctgctgagagcactcagaggtttctgcacaagctcagtggatttgagccct

SEQ ID NO: 60605 - DNA, 201 bp, Homo sapiens
caaaatattgagtggttgatgagtgctccaagtaggcactagagcctgctgagagcactcagaggtttctgcacaagctcagtggatttgagccctcatcrttgttcattgctatgtaagtcaagggttggtcataggtcctgccttggactgtcatttcaggaagcagggcagctacagcagcagtccccaacgtttttg

SEQ ID NO: 60606 - DNA, 201 bp, Homo sapiens
ctgtgttgcctgggctggtgtctaattcttggactcaagtgatcctcccatcttggcctcccaaagtgctgggactacaggcgtgagccatcgtgcctggmccagatgtaattcttgtaaatttaccctagtaaatggttttaaagaatggattgagaataatccgcaattttctagggaggaaatgtatcctttacaggg

SEQ ID NO: 60607 - DNA, 201 bp, Homo sapiens
cagatgtaattcttgtaaatttaccctagtaaatggttttaaagaatggattgagaataatccgcaattttctagggaggaaatgtatcctttacagggayattgcctgattgtctgtggggagtagagtatatgtagagtggttgttaggactgaaaatgattattactgaaacaggatgtgagagattataatgagttg

SEQ ID NO: 60608 - DNA, 201 bp, Homo sapiens
tcatagctcactgcagcctcgacctccttggctctagcaatgctctcacctcagcctcacaggagtgtgccaagacaattggctaattttttttttttttkgtagatacggtgtctcaccatattgcccaggatggttgcaaactcctggctcaagtgaggctgccttggcctcctaaagtgctgggattacaggtgtggg

SEQ ID NO: 60609 - DNA, 201 bp, Homo sapiens
acccctgtttagttcccaggcttgaaagctcagcatcattttggactactttctttctattactttcacatttggtcagttaccaagtgttgtcgatcccytttaggagttctcatataatcatctcatattctctagtctcactgccacttccctaagtcaagccctcgttaactccctcataatcacagtgatatccta

SEQ ID NO: 60610 - DNA, 201 bp, Homo sapiens
aactaaagttttaattttatttaattttaatttgttaaaattggaatgtaaatagccccatgcagctaggggctactgtgttggacagcgcaggcccacaygcgtgctagaccatatgcaaactgtaaggaacggtccagatgttctgaccaagggaggcagctgtgcagttggcagaggcaccacctgcgtgtgctttct

SEQ ID NO: 60611 - DNA, 201 bp, Homo sapiens
accaatttcatacttggagtttgttcagaagagtgaaaaatgtttcaagtgctatctcttctaaaccatggcaaaccacactctattaagacagcacaaargactgaggaagaaaaatgtttacgaaacattttgctttggtctgcctcatgataagtaattgtactggtcatttctttttccactgaattgactggtgtc

SEQ ID NO: 60612 - DNA, 201 bp, Homo sapiens
cctccacctcaagcgattctcctgcctcagcctcccgaatagctgggattacaggcgtgtgccaccgtgcccagctaattttttgtatctttagtagagayggagtttcaccatgttggccaggctgatctcgaactccttacctcaagtgatcctcctcctttggcctcccaaagtgttgggattgcaggcgtgagccat

SEQ ID NO: 60613 - DNA, 201 bp, Homo sapiens
tcgggtgtgcgttgagaccccagagctcagggacagtgtacgaagctgccgctgtggaagtggatgtatctgcttccatcacactgcaagtgctggtcgaygccccagggaacatttcctgtctctgggtctttaagcacagctccctgaattgccagccacattttgatttacaaaacaggtaagtggaggaataccttc

SEQ ID NO: 60614 - DNA, 201 bp, Homo sapiens
gattacactttgttttgttgtttggttgcaagataaatgcatgttttctttttaaggtgtgcatgtatcaacattatcatttttattttgttttacagttsttttttctgcaatgatatttgggactattacaaatcaagatctgcctgtgatcaagtgtgttttaatcaatcataagaacaatgattcatcagtggggaa

SEQ ID NO: 60615 - DNA, 201 bp, Homo sapiens
ccaaagtgctgggatttcaggagtgagccaccgcccctggctgagggccattctttatatcttttttcttgaattgtgtattcaattctttttcccagttktctactgtgttttggttctgtgtccctcaattttcaaaggttctttttatattaggggtattcgccctttacttgtaatatatgttggcatattttcttc

SEQ ID NO: 60616 - DNA, 201 bp, Homo sapiens
aactcctgttgatgggcatcaactttacttttttttctttctctttctttgacatttttatttttattattattattattattattattattattattatwattatttcggatggaggcttgccctctcacccatgctggagtgcaatggtgcgatctcggctcactgcatcctccacctcaagcgattctcctgcctcag

SEQ ID NO: 60617 - DNA, 201 bp, Homo sapiens
gtatctctgctcctgatttaaactagactaaacttgcataaaatcaaatttcctacatactttcatagtggccaatttcctctgattacactttgttttgytgtttggttgcaagataaatgcatgttttctttttaaggtgtgcatgtatcaacattatcatttttattttgttttacagttgttttttctgcaatgata

SEQ ID NO: 60618 - DNA, 201 bp, Homo sapiens
atagtattccacttttcagaaatttttattttaactaactcctgttgatgggcatcaactttacttttttttctttctctttctttgacatttttatttttattattattattattattattattattattattattattatttcggatggaggcttgccctctcacccatgctggagtgcaatggtgcgatctcggctca

SEQ ID NO: 60619 - DNA, 201 bp, Homo sapiens
catagtattccacttttcagaaatttttattttaactaactcctgttgatgggcatcaactttacttttttttctttctctttctttgacatttttatttttattattattattattattattattattattattattattatttcggatggaggcttgccctctcacccatgctggagtgcaatggtgcgatctcggctc

SEQ ID NO: 60620 - DNA, 201 bp, Homo sapiens
ttaactctcataatcccattttatgaaatgtggaaattgaggctaaattacttgcccaatcacagaaggcaaagccaacaccctttattccttctttttttctgaaattgccttataaaaacacataattccacctccagagataacattgcagactttttctatgtaagcaccatgatagaaacatacaatatggatctt

SEQ ID NO: 60621 - DNA, 201 bp, Homo sapiens
tttaactctcataatcccattttatgaaatgtggaaattgaggctaaattacttgcccaatcacagaaggcaaagccaacaccctttattccttctttttttctgaaattgccttataaaaacacataattccacctccagagataacattgcagactttttctatgtaagcaccatgatagaaacatacaatatggatct

SEQ ID NO: 60622 - DNA, 201 bp, Homo sapiens
aaatactttgttccaaagtggtacaaaagttcgctttctgctgaggcagggagaggggttttgctctgttgaatacttgggagtcttggctgacttcccttgtgggtgacaccttggccctcctctgttcctatgggaactcgggtgacttttgaaactttagcttccccctcccttactgcgtcccaaaaggatgcttac

SEQ ID NO: 60623 - DNA, 201 bp, Homo sapiens
atattctagttattaggtggatagtggctccgtgggtatttgttgttgttatgctttgaaatttacactccatatattctttcatatatatatatatatawcaaacagtacatagtattttcaaacaaaatttattgtaaggagagaggctggaattcagtatagggaaactttctttaaaaaaaaaaaagtttgtcagaa

SEQ ID NO: 60624 - DNA, 201 bp, Homo sapiens
ccctggattggtcagtttgcagttcctcattgattaagctaagttgcattttgctgctcatattgaattgggtttgttttttgctttttgttgttgttgtttttgtagagacggggttttggcatgttacctaggctggtctcgaactcctgggctcaagcgatcctcccgcctcaccctccctaagtgctgggattacag

SEQ ID NO: 60625 - DNA, 201 bp, Homo sapiens
tccctggattggtcagtttgcagttcctcattgattaagctaagttgcattttgctgctcatattgaattgggtttgttttttgctttttgttgttgttgtttttgtagagacggggttttggcatgttacctaggctggtctcgaactcctgggctcaagcgatcctcccgcctcaccctccctaagtgctgggattaca

SEQ ID NO: 60626 - DNA, 201 bp, Homo sapiens
gtccctggattggtcagtttgcagttcctcattgattaagctaagttgcattttgctgctcatattgaattgggtttgttttttgctttttgttgttgttgtttttgtagagacggggttttggcatgttacctaggctggtctcgaactcctgggctcaagcgatcctcccgcctcaccctccctaagtgctgggattac

SEQ ID NO: 60627 - DNA, 201 bp, Homo sapiens
ttaaagagaatcctggcttttcttccaagcctgaatccctcacttccagctgcccccagtatataggtagattttccatttgcacatcaaaatccacctaygtcatttattttatttcatttctatttccccaagcctgctcttattcttgtatttattgatttctgtttatacccctgtttagttcccaggcttgaaagc

SEQ ID NO: 60628 - DNA, 201 bp, Homo sapiens
ccattttatgaaatgtggaaattgaggctaaattacttgcccaatcacagaaggcaaagccaacaccctttattccttctttttttctgaaattgccttawaaaaacacataattccacctccagagataacattgcagactttttctatgtaagcaccatgatagaaacatacaatatggatctttgtataaacatgaaa

SEQ ID NO: 60629 - DNA, 201 bp, Homo sapiens
ggaattagaaaacaaagcactcgaggaggtaataggacaagtttgtattctgaaaatgcaggaacaattaactaatagtctggattgaaaacattaaatgmaaactctgttttattaaaacctagggcaactactttgagatgagtacctattcaacaaacagaactatgatacggattctgtttgcttttgtatcatcag

SEQ ID NO: 60630 - DNA, 201 bp, Homo sapiens
tctccctttgtcattgaggctggagtgcagtggtgtgatcacagctcactgcagcttcaacctcctgggctcaagcaagcctcctacctcagcctcctgastacctgggaccacaggcacgtgccaccacacctcattaattttttgaaaaattttttggtagagatgagatctcactgtattgctcaggctaatcttgaa

SEQ ID NO: 60631 - DNA, 201 bp, Homo sapiens
ggaacccttatggataaggtgcaaagctgttcatgtgaaccatggattcgggctcacctgggaattagaaaacaaagcactcgaggaggtaataggacaartttgtattctgaaaatgcaggaacaattaactaatagtctggattgaaaacattaaatgcaaactctgttttattaaaacctagggcaactactttgaga

SEQ ID NO: 60632 - DNA, 201 bp, Homo sapiens
tgtttagccaaatggtacttcttttctaattgcagctgtaaagaagaaagtccagctgttgttaaaaaggaggaaaaagtgcttcatgaattatttgggayggacataaggtgctgtgccagaaatgaactgggcagggaatgcaccaggctgttcacaataggtaacactataatatcatgcactttcattttcagtgac

SEQ ID NO: 60633 - DNA, 201 bp, Homo sapiens
aaagtaaaaggaacaaactgttccaaagctaaatatggtcatcttttaggtcttgggaagaagcacttttccaaatcattctttaagcaaaggtattgacyacattttactctgggagggtattcctgctcatttgagaagcccacaaaatgcctcggcttcaacaacatatccacggttctttgtgttcctctcatctca

SEQ ID NO: 60634 - DNA, 201 bp, Homo sapiens
gaaaccatagatatgggcttgtttaccttttgaccttttgtttaccatttgacccttaaaactggctctagaactttgttctcctcttgagcattcatttgtaattttaaaacttgtttagccaaatggtacttcttttctaattgcagctgtaaagaagaaagtccagctgttgttaaaaaggaggaaaaagtgcttcat

SEQ ID NO: 60635 - DNA, 201 bp, Homo sapiens
tcttttttttaagaacaacaaattttcttttctttttctttttctttttttttttttttgagatgaggtctcactctgtcacctaggctatagtgcagtgrtgcaatattggctcactgcaacctccacctcccaggctcaagtgatcctcccacctcagcctcccaagtagctggtaccacaggtgcacaccaccacacc

SEQ ID NO: 60636 - DNA, 201 bp, Homo sapiens
acggcaaaaccccatctctacaaagatcagtcgggcatggttgcttgcacctgtagtcctagctactcaagaagctgaggtaggagaatcccttgagcccwggaggttgaggctgcagtgcgcattgctccactgcactctagcctgggcgacagtgagaccctgtctcaaaaaaaaatagaggttgggaactgtctctag

SEQ ID NO: 60637 - DNA, 201 bp, Homo sapiens
gatctctgcacaaccaatcacctcaacaagtgtttggatttctgttccaggagcagctgacagacgaagaaaagtgctggacaggaagggagaattctgaygccaacatgcagcgaagtatcatgtgagcaccctcccttgcccctgagtctttccttctccaagtcctctgtttctttctctaaatctgtacttaaaaaa

SEQ ID NO: 60638 - DNA, 201 bp, Homo sapiens
tttaaaaatatattgtgaaggggtaacgtattccaattgttctgcctgcaaaagcatgcatattaaaaaatctccctccagcgtctgtccctcctgaggcracagcattaccagttttttgtcttccaactgagatgttctgtacatatacaagatatgtggatacatttatagtctttcttttgtttttgttttttgaga

SEQ ID NO: 60639 - DNA, 201 bp, Homo sapiens
tttttaaaaatatattgtgaaggggtaacgtattccaattgttctgcctgcaaaagcatgcatattaaaaaatctccctccagcgtctgtccctcctgagrcaacagcattaccagttttttgtcttccaactgagatgttctgtacatatacaagatatgtggatacatttatagtctttcttttgtttttgttttttga

SEQ ID NO: 60640 - DNA, 201 bp, Homo sapiens
ccagtttatagaaggggaaatggagacatggggaggcaaactaagccacttgtctcctgccactggctcaaagcaaggaccatgctggggtcctgaccatyacagtcaccagggcgggcgccaggctcagttctctccctgactcatcctcctcaagcctcgccaacccctcagggcagctgagatgggaggtgctggtgc

SEQ ID NO: 60641 - DNA, 201 bp, Homo sapiens
cagcgccggcctactgagttttttgattccaaaattgagtttgagttgtggtgccaacatgtggcggccaaggctgtagagagtagtggagacttagaggygtgtggtgcgggacagagagtactgattccagaaaacgaaaggggaccccatgggttgaagaagatttctgtgcaaaggaagggaaagtcaaagaaaacc

SEQ ID NO: 60642 - DNA, 201 bp, Homo sapiens
gtgaggtctgcctcggcttgggcgcgggccctgcagcaggaagccagggtttgtttgccatgacagtgagagcaaatccattgagggctcacatcatggarcatttcttgggagccctgccctgtgccccgtgccttacctcatcagttcctaccagcaactctgtgagactggtcttgttaccctcacctccagtttata

SEQ ID NO: 60643 - DNA, 201 bp, Homo sapiens
ccaagaagatagacatcatcaaaggcctctttgtggcctgccgccactcagaagcccggttcatcgctaggtaagcgtgtgggcctgtgaggctacagagsgggactgcaggctcggaggtgaaaggagggagggactggcagctggaatcatcacaaatgccctgaccatccttggatgagaaaagcatgagcaggaggc

SEQ ID NO: 60644 - DNA, 201 bp, Homo sapiens
tgattctcctgcctcagcctcctgagtagttgggattacaggctggcaccaccatgcctggctaattttttgcatttttagtagagatggggtttcaccatgcgggccaggctggtcttgaactcctgacctcgtgatccgcctgtctcagccttccaaagtgctgggagtacaggcgtgagccacagcgccggcctactg

SEQ ID NO: 60645 - DNA, 201 bp, Homo sapiens
gtggcccacgcctgtaatcccagcactttgggaggctgaggcgggtggatcacctgaggtcaggagttcaagaccagcctggctgacatggtgaaatcccrtctctactaaaaatacaaaaattagctgggtgtggtggcacgcacctgtagtcccagctacttgggaggctgaggcacgagaatcgtttgtacccaggag

SEQ ID NO: 60646 - DNA, 201 bp, Homo sapiens
tgttcgttcattacggattgctttccctttcattcttttctgtgttagggttagggcgttatctcgataggtgtaggcaggttatgttatctccacatttyatttcagaccagaaaagaggtgacacacagtatctggtgacaagggtgtgttggttctgataggttgagagctgcttgtcacagctgtcaccgtgacttg

SEQ ID NO: 60647 - DNA, 201 bp, Homo sapiens
tgtcaggcatagagtaggcttcccagtaaacgcttatgtatttctccttcccttgcaactcagtctggtggttaagaggtgagctgtggagcaggccgacytggggtggaacgtactatagatgcaggttaagttcctttgaaaacccctctgtgccttagtttctgtaacagagttgttgtggagagtcagtataattga

SEQ ID NO: 60648 - DNA, 201 bp, Homo sapiens
taccagacccagcacacacggggtcggttaagaatactctgagctgcaggtaacagaaaacccaactacattggcttggacaaagaaggatctgtttttcycacaaaagaagttgcagatgctggctttcctgcccaacaatccatggcagctggggcctcttccactgtctcatgcctccacccttgatgggtcgtgttc

SEQ ID NO: 60649 - DNA, 201 bp, Homo sapiens
gatggtggagagaggctgtgaaacagggttgaggagaaggctgagagggaggagagcctgatggggacagatttgcaggggtgtgggagagaacacaggggcagcagttcaggtgagggaggaccaggcatgtgctgggacagggggtgtggggtgcagggaaggggagggctggggaaagatgctggaggcagagacagc

SEQ ID NO: 60650 - DNA, 201 bp, Homo sapiens
ggaggggctgaagggagctaaggggcggggccggggaaaagattgcgtgtgggcggggccacctggaagggggaggtgccaagggtggggctggctgggarccggaagtgctgagggggcgggggccacctggaagtgctgagggggcggggctagaagaaggtaaatcgcgggcagcagcatcacctggaaggagtgggc

SEQ ID NO: 60651 - DNA, 201 bp, Homo sapiens
atcttcagcaggaatcaggaagacaacactgggaagtacccggacatcatcagccgcatccccaaggtgggcgtctgcctcacacttgcactctgccaggrtctgtggtcaggggtgcaaaggcctgaggcccatctaggccagtgtggcacagtgcggggtttattgggaggagatcaggttgcgtttggctgcaaatga

SEQ ID NO: 60652 - DNA, 201 bp, Homo sapiens
gagagatggtggagagaggctgtgaaacagggttgaggagaaggctgagagggaggagagcctgatggggacagatttgcaggggtgtgggagagaacacaggggcagcagttcaggtgagggaggaccaggcatgtgctgggacagggggtgtggggtgcagggaaggggagggctggggaaagatgctggaggcagaga

SEQ ID NO: 60653 - DNA, 201 bp, Homo sapiens
gcagacagtggatgtcagggtgaggaggcaggaggaatgcctccaggatctccctgggtgactggatggatgacaaagccgtcggcagcttgggaccctgrtgaggggcaggcacctgcagggggcattaatcaccccagcgtggggcaggcatgagcaacctctatctgtgggcccccagggccatccaggaagtttgga

SEQ ID NO: 60654 - DNA, 201 bp, Homo sapiens
agaggtctgaaaggactttgactggagggattggaaggagtgggaggaaagaacatggtgtgtggggggccagcagcctgaaggggcccagccgccagtgstgggtggaaaggctggtgatgcggatggcccgcctgccaagggcctggagtgctcggtgcttatcatgaggacactggggagccatggaaggattgtgag

SEQ ID NO: 60655 - DNA, 201 bp, Homo sapiens
gggaggccgaggcgggcggatcatttgaggtcaggagttcgagaccagcctgaccaacacgttgaaaccccgtctctactaaaaattaaaaaaaattagcygggcatggtggtgcgcaccggtagtcccggctactccggaggagaatcacctgaacccacaaggtggaggttgcagcgagccgagatcgtgccactgcac

SEQ ID NO: 60656 - DNA, 201 bp, Homo sapiens
aacacaaaattagcccagcatggtggcgggtgcctgtaatcccggctactcaggaggctgaggtacgagaatcacttgaacccaggaggcagagattgcastgagctgagatcacgctattacaccccagcctgggtgacagagtgagactctgtctcaaaaacaaacaaacaaaattatcatgggtacggctcattctgc

SEQ ID NO: 60657 - DNA, 201 bp, Homo sapiens
ctcccccactgtaaccgtccggtgggttcaccttgcccgctgcctagacagagccgatttatctagacgggggaactgcagtggagaaagagtcattcccrcagagctggctgtgcgggagaccggagtttcatttttactcaaatcagtctccctgagcatgtggggagcagagtttttaaagataatttggcgtgtagg

SEQ ID NO: 60658 - DNA, 201 bp, Homo sapiens
gcctggccaacatggtgaaaccccatctctactaaaaacacaaaattagcccagcatggtggcgggtgcctgtaatcccggctactcaggaggctgaggtrcgagaatcacttgaacccaggaggcagagattgcagtgagctgagatcacgctattacaccccagcctgggtgacagagtgagactctgtctcaaaaaca

SEQ ID NO: 60659 - DNA, 201 bp, Homo sapiens
actttgaaggcccctgtgactatatcaggcccacctggatagtccagggtaatcccactatcggaaggtcagctgattagcaacctcaattaccctttgcyatgtaacctaacatattcccaggttccaggtattagaatagagatctcttttggagcttagactttaccctgaggcttctggggagctaggaagagtttt

SEQ ID NO: 60660 - DNA, 201 bp, Homo sapiens
agaccagcctggccaacatggtgaaaccccatctctactaaaaacacaaaattagcccagcatggtggcgggtgcctgtaatcccggctactcaggaggckgaggtacgagaatcacttgaacccaggaggcagagattgcagtgagctgagatcacgctattacaccccagcctgggtgacagagtgagactctgtctca

SEQ ID NO: 60661 - DNA, 201 bp, Homo sapiens
gacgtttgagaagatcgaggaggtgtctgctcggtaactaatgaggactgcctgggtggggggcggggtcgcttctgggtctgtcctctgcatggcggtcygtgctgccttgttccgccaaaccctgtcaacttggcctctgaccccgctcgggcgtatgatcatggatgtcagacatggtcacaaaagcggctgcaggtc

SEQ ID NO: 60662 - DNA, 201 bp, Homo sapiens
gaccatcctggctaacatggtgaaaccatgtctctatcaaaaatacaaaaaattagctgggcgtggtggcgggcgcctgtagtcccagctactcgggaggmtgaggcaggagaatggcgtgaacccgggaggcggagcttgcagtgagccaagatcgtgccactgcactccagcctgggtgacagagcaagactctgtctc

SEQ ID NO: 60663 - DNA, 201 bp, Homo sapiens
ttgttttcatccagctctgcaccgtgtgccttgaacagagcctggcacatcacagttggaaggaatgactttgctttgacccagggctctatgcaattcartctccgttttgcctccgtagacccctggatccatctggttacaatcctgccaagaacaactatcatcccgtggaagatgcctgctggaaaccgggccaga

SEQ ID NO: 60664 - DNA, 201 bp, Homo sapiens
ttcctcacctctcagatgggggcacagtgatgagaggaagcatgttcttccacccactcttccccacgtgccaggcactcagcaacgggctttccctgacscaatgctccaaatcctcacaacactgctgggagtagattctgttgttatcctggtttcctgggtgagaaaagtaaagcggggaggtgggacagtattgag

SEQ ID NO: 60665 - DNA, 201 bp, Homo sapiens
agcgaggtcctgaaacgctttgaggaggcagctttcacctgcgaatacaaatatgacgggcagagggcacaggtatggggagtgggacatgtcccttccayagacaggaaaacgtcaaagagcaggggtgtggggtcactgaggcctgagcttcaagccggcctgcgccacagactgccgagccctcgctcatctctctgg

SEQ ID NO: 60666 - DNA, 201 bp, Homo sapiens
ctatagcctttctcttttacacagttcagtagcacacactctgtgatattctgccctttgtttgaaataacagcataccttagaaactgcccaagagctartttatgtagaccagcgggtacaattttataagcttccacagttgtttcacggaattatgtcatcaccttaaaacaatttttcactaacctttaaacttaa

SEQ ID NO: 60667 - DNA, 201 bp, Homo sapiens
tcgctcttgcgtctcttttccttccctagggttccttacctggctgtggcccggacgtttgagaagatcgaggaggtgtctgctcggtaactaatgaggamtgcctgggtggggggcggggtcgcttctgggtctgtcctctgcatggcggtctgtgctgccttgttccgccaaaccctgtcaacttggcctctgaccccg

SEQ ID NO: 60668 - DNA, 201 bp, Homo sapiens
aggtgggttaaaaagtatgacgcagtgagtccaaaatctctttgatgtcacgcctctacaaatgaaacagataacgacaagaaattctttcagctttaacrtttcatgattacagtttaagtctaacaaaaaagtgttcggaggattcttgacatcaattttgtacccccaattgagaccttatcaaggaggttaaatagc

SEQ ID NO: 60669 - DNA, 201 bp, Homo sapiens
tcctcctcttgcaggacttggcaaaccttttctataaagagccagagagtaaatattttaggctttatgggacacatttggcccctgttgcaaaaccattmttagatcccagaacctgtagaaacggtccagggtcggagtttgctgaccgtggccccagccaccctctgaccctgcctccagtctttcatcctcagtctg

SEQ ID NO: 60670 - DNA, 201 bp, Homo sapiens
gacacagggaggtgcagggactcgccacaagcacacacagctggagaaaattcatccaggccgcgagagaagggagacacgcagccacaactgtcaccctygacacccccacccgcgctctcccctgaaggtcggcagctggagtccgtccgggctgaggcagccgagaaaggcgacgtggggctggtggccgagaacagc

SEQ ID NO: 60671 - DNA, 201 bp, Homo sapiens
cccacctcggcctcccaaagtgctgggattacaggcgtgagccagtacacctggcctgaactcaccagatttagtgtatgtgctggaagcctgcaggcgcrtctactctgccttaaaattcactgaacaccccttctttgccagccctgggcggcccacgaggatgaaccatagagagccggccgccctgccccagccctc

SEQ ID NO: 60672 - DNA, 201 bp, Homo sapiens
agctgctgggaggagtgggaatattttcttctcatgacgatgagatttctttttaccactattcctaagtctcctatttcaggccaagtgctagaattcckctagttagcactgaggagtagacagcaggcctgagatctcagctcaaagctaacagaaaggaaaagggtaggtgtagttatatcttccatctgcagggtc

SEQ ID NO: 60673 - DNA, 201 bp, Homo sapiens
agaagaggccacccctgagttagggctgagaccatagggtcagaaaggagggtagacagagaggtttcagtcccctctactctcaacttttggaaaatggrgtccctccttcccccgctcactctagaactgttctttcctcttccagaagcctgccctggactgctcacaggtctccccgccccgtcctgccacatctcc

SEQ ID NO: 60674 - DNA, 201 bp, Homo sapiens
ggagtttctttttgaaggggaaattcatgtttctgtttttttttttttctttctttcttaaagaaagggttttatgtgtgtttagatctctgcacaaccartcacctcaacaagtgtttggatttctgttccaggagcagctgacagacgaagaaaagtgctggacaggaagggagaattctgacgccaacatgcagcgaa

SEQ ID NO: 60675 - DNA, 201 bp, Homo sapiens
gatggatgaaatgatgagatttgctgaggagacaaccagaaaatgttcattggatgcttgaaaggaagggaaggaaacagcaaagaaaccaaagtgtttgygggcagtgcccccactctgcctgctgtagtcgcccctttacacccccatttccccaccttccagggcggcactgaaggagtggaatggagtggtgtccga

SEQ ID NO: 60676 - DNA, 201 bp, Homo sapiens
taggcagggactccatttgctcctcagcatcacccatcacagggcaggcactctggagacttccagagatgtgtgatgggtgggtgagtggatgagtgggygggtggattaatgcactgatggatgaaatgatgagatttgctgaggagacaaccagaaaatgttcattggatgcttgaaaggaagggaaggaaacagcaa

SEQ ID NO: 60677 - DNA, 201 bp, Homo sapiens
actttgggaggccgaggcgggcggatcatttgaggtcaggagttcgagaccagcctgaccaacacgttgaaaccccgtctctactaaaaattaaaaaaaawtagccgggcatggtggtgcgcaccggtagtcccggctactccggaggagaatcacctgaacccacaaggtggaggttgcagcgagccgagatcgtgccac

SEQ ID NO: 60678 - DNA, 201 bp, Homo sapiens
gcctcggcctcccaaaatgctgggattacaggcctgagccaccacacccggccctcttctgtattttgtaaggatgctttttggattcagagcctaccttmattcactatgctctcatcttaatctacaggtacatccgcaaagaccttctttccaaatgaggtcatgttgtgaggctctgagtggacctgaattttgggg

SEQ ID NO: 60679 - DNA, 201 bp, Homo sapiens
cacgatttcagctcaccgcgacctccacctcctgggttcaagtgattctcctgcctcagcctcccaggtagctgggattacaggcatgcgccaccatgccyggctacttttgtatttttaatagagacagacacttttttgttagacttaaactttaatcatgaaatgttaaagctgaaagaatttcttgtcgttatctgt

SEQ ID NO: 60680 - DNA, 201 bp, Homo sapiens
tactacgactgcttttctttcttttgagacggagttttgctcttgctgcccaggctggagtgcagtggcacgatttcagctcaccgcgacctccacctccygggttcaagtgattctcctgcctcagcctcccaggtagctgggattacaggcatgcgccaccatgcccggctacttttgtatttttaatagagacagaca

SEQ ID NO: 60681 - DNA, 201 bp, Homo sapiens
tgtaggtggaacctagccttgaaaacctttgtctatttttattttgtttgagacggagtctcgccctgtcatccaggctggagtgcagcagcacaatctcmgctcactgcaacttccgcctccagggttcaagtgattctcctgcctcagtctcctgagtagctgggactacaggcgcgtgccaccacccccagctaactt

SEQ ID NO: 60682 - DNA, 201 bp, Homo sapiens
cttcccaggttcaagcgattcttctgcctccacatcccaagtagccagaattacaggtgcctcgccaccaagcctggctaatttttgtatttttagtagaraccgggtttcaccatgttggccaggctggtctcgaactcctaatctcaggtgttctggccgcctcagcctctcaaagtgctgggattacaggcgtgagcc

SEQ ID NO: 60683 - DNA, 201 bp, Homo sapiens
cttacattgcagcctcctggcatctgcagccttttcctgctccctctgcacaccatgtccccacgtgctgtcattcctccctgctttttttttttttttttgagatggaatctcactctgttgcccaggctggagtgcagtggcacgatctcagctcattgcaccttcaacttcccaggttcaagcgattcttctgcctcc

SEQ ID NO: 60684 - DNA, 201 bp, Homo sapiens
aggcaagacgcaaacttatttttctctctcctgagtgcagagtccgggattcatgtgaccgtctcacagggtcagaggcccaggcttcctctgtgctgtcrtttgctctctgtagatgcccttgtccctgtgaacatccatattctgccaacaggaagaggagggcaccccactcaacattaagtggatgttatttgaacc

SEQ ID NO: 60685 - DNA, 201 bp, Homo sapiens
cttgagtaccgtggtaaggagaaaggaacgtgggctttggagccagccacaccgggttttgaagccttgcctgaaccccagctatgttcctctgtcctcaktaccttcatctataaagtggggatgatctcacctgtcttggagggctgacttgaggattgagggtatttgagaatgtgatcagcctgtcaggcatagagt

SEQ ID NO: 60686 - DNA, 201 bp, Homo sapiens
ccttacattgcagcctcctggcatctgcagccttttcctgctccctctgcacaccatgtccccacgtgctgtcattcctccctgctttttttttttttttttgagatggaatctcactctgttgcccaggctggagtgcagtggcacgatctcagctcattgcaccttcaacttcccaggttcaagcgattcttctgcctc

SEQ ID NO: 60687 - DNA, 201 bp, Homo sapiens
gttgagaagccagccttgagtaccgtggtaaggagaaaggaacgtgggctttggagccagccacaccgggttttgaagccttgcctgaaccccagctatgytcctctgtcctcagtaccttcatctataaagtggggatgatctcacctgtcttggagggctgacttgaggattgagggtatttgagaatgtgatcagcct

SEQ ID NO: 60688 - DNA, 201 bp, Homo sapiens
attggattggcacaagatagaactgtaagacctgcactttgggaggccaaggcgggtggctcacctgaggtcagtagttcaagaccagcctggccaacatrgtgaaatcccatctctactaaaaatacaaaaaaatagctggatgtggtggtgggcgcctgtcatcccagctactcgggaggctgaggcaggagaatcgca

SEQ ID NO: 60689 - DNA, 201 bp, Homo sapiens
cccatctctactaaaaatacaaaaaaatagctggatgtggtggtgggcgcctgtcatcccagctactcgggaggctgaggcaggagaatcgcatgaacccrggaggcagaggttgcagtgagccaagatcacaccattgcactccagcctgggcggtaagaacgaaactctgtctcaaaaaaaagaacagatgacagatga

SEQ ID NO: 60690 - DNA, 201 bp, Homo sapiens
tcaaggtcgctgccttgcttggggttgacaaggagcagggtcttacgtggcccactgctttacaggcacattggattggcacaagatagaactgtaagacctgcactttgggaggccaaggcgggtggctcacctgaggtcagtagttcaagaccagcctggccaacatggtgaaatcccatctctactaaaaatacaaaa

SEQ ID NO: 60691 - DNA, 201 bp, Homo sapiens
ctactcgggaggctgaggcaggagaatcgcatgaacccaggaggcagaggttgcagtgagccaagatcacaccattgcactccagcctgggcggtaagaaygaaactctgtctcaaaaaaaagaacagatgacagatgagggcagactgtctccagagtcaaaatgcccttgtaggttcaatgggatttttttgccatctg

SEQ ID NO: 60692 - DNA, 201 bp, Homo sapiens
ccctcaaggtcgctgccttgcttggggttgacaaggagcagggtcttacgtggcccactgctttacaggcacattggattggcacaagatagaactgtaagacctgcactttgggaggccaaggcgggtggctcacctgaggtcagtagttcaagaccagcctggccaacatggtgaaatcccatctctactaaaaataca

SEQ ID NO: 60693 - DNA, 201 bp, Homo sapiens
cgggaggctgaggcaggagaatcgcatgaacccaggaggcagaggttgcagtgagccaagatcacaccattgcactccagcctgggcggtaagaacgaaaytctgtctcaaaaaaaagaacagatgacagatgagggcagactgtctccagagtcaaaatgcccttgtaggttcaatgggatttttttgccatctgaccgt

SEQ ID NO: 60694 - DNA, 201 bp, Homo sapiens
tcctctaaatgatttccttttccttgtaaattttaccataaagttgcagttcccaaacattcttagttcacagcacccttgatgtcttagtaatttttttmtgatgctcctaggccaataccttatcagttctattaagtagttatgtccaaacaactattagatactatacatacattggaaaaaaagtaatatttgtgc

SEQ ID NO: 60695 - DNA, 201 bp, Homo sapiens
gaggcaggagaatcgcatgaacccaggaggcagaggttgcagtgagccaagatcacaccattgcactccagcctgggcggtaagaacgaaactctgtctcraaaaaaagaacagatgacagatgagggcagactgtctccagagtcaaaatgcccttgtaggttcaatgggatttttttgccatctgaccgttctgtctat

SEQ ID NO: 60696 - DNA, 201 bp, Homo sapiens; identical to SEQ ID NO: 18779

SEQ ID NO: 60697 - DNA, 201 bp, Homo sapiens
cagagtgaggacgaggacagagaagccaagaggaagaaggaggaggaaggtgagcccccagaaggagagaagtgtgtgtgtgtgtgtgtgtgtgtgtgtgragccaagaggaaggaggaggaggaaggtgagcccccagaaggagaggggtgtgtgtgtgtgtgtgtgtgtgtgtgtgtgtgtgtgaagccaagaggaagg

SEQ ID NO: 60698 - DNA, 201 bp, Homo sapiens
gaagtgagctcatgcatttgggtattggcaagggtgtcccgaggaggcgtgaggaagcaagggtgcagacgggcagcatggtatagcctgcaccactgtcrctcttgcgtctcttttccttccctagggttccttacctggctgtggcccggacgtttgagaagatcgaggaggtgtctgctcggtaactaatgaggactg

SEQ ID NO: 60699 - DNA, 201 bp, Homo sapiens
ggctgagcctctgacctcccgcttcctccctgcagcttggaactggcttcagtgacgaggagctggaggagcatcaccagagcctcaaggtgagccatggyggctgcgcctcagcctccacccctctcccccctgcccctgacagcacagtccttccatgcagggctcttggcttccaccatcttggggctccaggtgtgg

SEQ ID NO: 60700 - DNA, 201 bp, Homo sapiens
ccttctcccagctgaagaaggactaccttgatggcgtgggtgacaccctggacctggtggtgatcggcgcctacctgggccgggggaagcgggccggccgrtacgggggcttcctgctggcctcctacgacgaggacagtgaggagctgcaggccatatgcaaggtcctggggaactggggctgatggcagaagcaggagg

SEQ ID NO: 60701 - DNA, 201 bp, Homo sapiens
caccttgggcgctcccccttctcatctcttgcctccccttctcccagctgaagaaggactaccttgatggcgtgggtgacaccctggacctggtggtgatyggcgcctacctgggccgggggaagcgggccggccggtacgggggcttcctgctggcctcctacgacgaggacagtgaggagctgcaggccatatgcaagg

SEQ ID NO: 60702 - DNA, 201 bp, Homo sapiens
gaccccggcctcccagcctgtccccagtcctggaccgtttgaccagaatcctgcctgctccggcgcttgtgagccagggcttcccaaggaccacgcttctrtgtctccctcagactcctgcgaggggctgatggtgaagaccctggatgttgatgccacctacgagatcgccaagagatcgcacaactggctcaaggtgat

SEQ ID NO: 60703 - DNA, 201 bp, Homo sapiens
agagcctttctctttgcctgcccctaattaaataggaaataagttatttaagaaagcagggggcacggtgcccatcattctgcctgttagagacagtgacrgagagaggcacagttcagtgcacgtgttaggggagctcctgttccgtgccaagcactgttctttaaatcaattttcttaagatgtaatttccctaaaagt

SEQ ID NO: 60704 - DNA, 201 bp, Homo sapiens
gactgctcacaggtctccccgccccgtcctgccacatctcctgagaacaatgcttccctctctgacacctctcccatggacagttccccatcagggattcygaagcgtcgcacaggtgagaacacacgggcccctgccccttcagtcgcctgcctttctttttctcttttttttttttttttttttttttgagacatagtc

SEQ ID NO: 60705 - DNA, 201 bp, Homo sapiens
  misc_feature (1)...(201): n = A,T,C or G, or insertion/deletion polymorphism (see Tables 1-2)
tgccggccaccgcttgttaaaccccaagttcataccaaaggccatgcacagccctgcagtggcactatctgtcttggccatccatgccctgtgtgagcatnagaatcagctgaagagctgaaaaatatcctgaggtctctttctcccccccaacccttgtccccattttggtacagatgtaggcctggggctggggagtcc

SEQ ID NO: 60706 - DNA, 201 bp, Homo sapiens
cccctgcccaccacactctgctgcctcattgtaatgccggccaccgcttgttaaaccccaagttcataccaaaggccatgcacagccctgcagtggcactrtctgtcttggccatccatgccctgtgtgagcatcagaatcagctgaagagctgaaaaatatcctgaggtctctttctcccccccaacccttgtccccatt

SEQ ID NO: 60707 - DNA, 201 bp, Homo sapiens
taccctgaggcttctggggagctaggaagagttttgggcagaagagaggcagagatcatttagtcctgggcagtgtttaaaatattcatctggccaggcaygatggctcacgcctgtaatcccaacactttgggaggccaaggcgggtggatcacgaggtcagaagttcgagagcagccaggccaacatagtgaaacctca

SEQ ID NO: 60708 - DNA, 201 bp, Homo sapiens
tgtcaccctggctgctatggggaagctggattggaggggatcggtgcaggacagggaagcccagtaggcgaggctgagcagggagttggtgggaagtggayggcttaggaaatcatcaggttcactgaggaactgaatgtgggtgacaggaggagggagatgacaagagctcctaggtttccagcttgtgagaccaaatat

SEQ ID NO: 60709 - DNA, 201 bp, Homo sapiens
tgctccaaatcctcacaacactgctgggagtagattctgttgttatcctggtttcctgggtgagaaaagtaaagcggggaggtgggacagtattgaggacyggctaggaatcccagctccacctctctcagctgtgtgaccttgaggaagtgacttagcctttctgtgtctctcttctgaggatgtgaaacacttagccca

SEQ ID NO: 60710 - DNA, 201 bp, Homo sapiens
gaactgtgccatgtcactgccattagctgcagaaaagtctaggagagcaaatatctggtgaaggggaatgaggttgtcggaattagctgagagccgttaasgatccagcacctggagccagcagcatggccgccctcacagatgggcagccagttaggtggcgagagggagaccggtagatgaatgctgtcggcctcaggc

SEQ ID NO: 60711 - DNA, 201 bp, Homo sapiens
aaatggtgtcgggccctcttgccagtgactagccccatgctttaagctctcagaatccttctgacatcagggttcttccctctcaaggctttccacgaacsctgtcactagttgtgacccgcacatgtcctgttcgcctcacatttagggcttattgtctttattctcacaaagatgtctcatctctcttctccctgccgg

SEQ ID NO: 60712 - DNA, 201 bp, Homo sapiens
ctccctggacaccaaggacatcgagcagatcgccgagttcctggagcagtcagtgaaaggtgagggtgctcacttttctctcctgaggtctgcagcttgcrctgaccccggcctcccagcctgtccccagtcctggaccgtttgaccagaatcctgcctgctccggcgcttgtgagccagggcttcccaaggaccacgctt

SEQ ID NO: 60713 - DNA, 201 bp, Homo sapiens
ggctggagtgcagtggcacgatctcagctcattgcaccttcaacttcccaggttcaagcgattcttctgcctccacatcccaagtagccagaattacaggygcctcgccaccaagcctggctaatttttgtatttttagtagagaccgggtttcaccatgttggccaggctggtctcgaactcctaatctcaggtgttctg

SEQ ID NO: 60714 - DNA, 201 bp, Homo sapiens
aaagcatctgtgtgcacctgcctctttgttagtgcatcttgagagctgcagaaggaaaagggaatttatctccccgtgtttgtctttccacctcatcttcyacctctctcaggccctgggtctctcccttcacttttcagattaaactcccatcggtcacatccttcatcctggacaccgaagccgtggcttgggaccggg

SEQ ID NO: 60715 - DNA, 201 bp, Homo sapiens
attaaactcccatcggtcacatccttcatcctggacaccgaagccgtggcttgggaccgggaaaagaagcagatccagccattccaagtgctcaccaccckcaaacgcaaggtagcatcacccgctccactgcctgccaaggccccgtacttcctcatcttccacccagtcctggctgtgggtcctgcccagtgcccagaa

SEQ ID NO: 60716 - DNA, 201 bp, Homo sapiens
aagtctaggagagcaaatatctggtgaaggggaatgaggttgtcggaattagctgagagccgttaaggatccagcacctggagccagcagcatggccgccytcacagatgggcagccagttaggtggcgagagggagaccggtagatgaatgctgtcggcctcaggcacagtgccccgtctcaccttcctgcactcacgaa

SEQ ID NO: 60717 - DNA, 201 bp, Homo sapiens
ccctaaccttcctagcggcatggctacagatgaatgactcagcctctctgtgtgtcagtttcttgatctacagtaaggagctaacagtggcaggtgctttrtctgttagggtgagggctaaacagtgggataggggtgtggaactcagtagttagtacatggaagctctcaaaaaaaattagctgcaatcatcaatatccc

SEQ ID NO: 60718 - DNA, 201 bp, Homo sapiens
agtggcaggtgctttgtctgttagggtgagggctaaacagtgggataggggtgtggaactcagtagttagtacatggaagctctcaaaaaaaattagctgyaatcatcaatatcccagataatcttttttttttttttttttgagatggagtctcactctgttgcccaggctggagtgcagtggcatgatctcagctcact

SEQ ID NO: 60719 - DNA, 201 bp, Homo sapiens
gggaccgatcgaacaaaagagaaaagcaattcaaagccacaagacggattagtcagtgttgacatgtggagacaactgctttgtcctttgtttaaaaacaytcagatcacctccttcctctctgacacacactcttgcaaggtccagctggaactgatttcaaagcaaaacacaaaactgtaaatgtgctggaaaaactca

SEQ ID NO: 60720 - DNA, 201 bp, Homo sapiens
ataaaactggatcttcctcttgaaggtttcaggaagtcagtgggggttccgtgccgggagtcacaggttgtcattgtgcgaagctcctggggtttcccctygagtggaggacgggtgtgttgagggccagcgagcaggagcctgtcatcagtaagagttgatggatgtttgagtggagaggggcagtgaggggtggacaag

SEQ ID NO: 60721 - DNA, 201 bp, Homo sapiens
ataggttgttaagcaattaattgcttcactgtaattttgttaattatttgaagagatgtctgggctgattcccacgacatctaacatgcacacaggaggcygcactgaagactggctgaatggatgattggatgcgtgggtggataaatatcctataaagtaatgaggtcacccccccatctctgccatgctcaaaaccca

SEQ ID NO: 60722 - DNA, 201 bp, Homo sapiens
tagagagccggccgccctgccccagccctcgtgatgtgcttagtgtgctggggctgtgggacactgaataggttgttaagcaattaattgcttcactgtarttttgttaattatttgaagagatgtctgggctgattcccacgacatctaacatgcacacaggaggccgcactgaagactggctgaatggatgattggatg

SEQ ID NO: 60723 - DNA, 201 bp, Homo sapiens
ggcgcgtctactctgccttaaaattcactgaacaccccttctttgccagccctgggcggcccacgaggatgaaccatagagagccggccgccctgccccakccctcgtgatgtgcttagtgtgctggggctgtgggacactgaataggttgttaagcaattaattgcttcactgtaattttgttaattatttgaagagatg

SEQ ID NO: 60724 - DNA, 201 bp, Homo sapiens
cttatcagttaagttaaagggcttatttgaaattctctgttatgtgctgagatggaaatggtgttagaagttataggatgcggccgggcgcggtggcttaygcctgtaatcccagcacattgggaggccaagcagatcacaaggtcaggagatcgagaccatcctggctaacacggtgataccccatctctactaaaaata

SEQ ID NO: 60725 - DNA, 201 bp, Homo sapiens
tcggcctcccaaaatgctgggattacaggcatgagccaccgtgcccggccccatttgttcttatttaaacctagaaacccttcccatgtccagtctcttcycaggggccatccttggggttccttctggaagttcccttcagacttacttctagtccctcctcagtccactgaggagcccctccccagcagtgagggcccc

SEQ ID NO: 60726 - DNA, 201 bp, Homo sapiens
agagcctgggggatctttctaacacccagagttgactctgcccctctagggttccccagagccgtcaggagaaaatctaagcccatttggccactggctgycacctccctctctggcctcacttcctacctctctgttcctctggctctgaactcaccagattttttatttttgagacagagtcttgctctgtcgcctagc

SEQ ID NO: 60727 - DNA, 201 bp, Homo sapiens
gagaatcgcttgaacctgggaggcagaagttgcagtgagccgagatcacaccattgcactctagcctgggcaacagagcgagagtctgtctaaaaaaaaaagatttaaaaagtgcatagttaatatttgttgaataaaacttgggatgtatcatatcttgcaggtgcgttagggcagaaaaattagtgttgcctcctttgt

SEQ ID NO: 60728 - DNA, 201 bp, Homo sapiens
caggggccatccttggggttccttctggaagttcccttcagacttacttctagtccctcctcagtccactgaggagcccctccccagcagtgagggccccrccttgggcgctcccccttctcatctcttgcctccccttctcccagctgaagaaggactaccttgatggcgtgggtgacaccctggacctggtggtgatcg

SEQ ID NO: 60729 - DNA, 201 bp, Homo sapiens
aaagagccagagagtaaatattttaggctttatgggacacatttggcccctgttgcaaaaccattcttagatcccagaacctgtagaaacggtccagggtyggagtttgctgaccgtggccccagccaccctctgaccctgcctccagtctttcatcctcagtctgatccccgtagagcctgggggatctttctaacaccc

SEQ ID NO: 60730 - DNA, 201 bp, Homo sapiens
tgcccttgtaggttcaatgggatttttttgccatctgaccgttctgtctatcgtcagaagaggagaccccgaaagaaagcctcacagaggctgaagtggcmacagagaaggaaggagaagacggggaccagcccaccacgcctcccaagcccctaaagacctccagtgagtttctggtcctctcctccgccctgccccacc

SEQ ID NO: 60731 - DNA, 201 bp, Homo sapiens
gtgggcgcctgtcatcccagctactcgggaggctgaggcaggagaatcgcatgaacccaggaggcagaggttgcagtgagccaagatcacaccattgcacyccagcctgggcggtaagaacgaaactctgtctcaaaaaaaagaacagatgacagatgagggcagactgtctccagagtcaaaatgcccttgtaggttcaa

SEQ ID NO: 60732 - DNA, 201 bp, Homo sapiens; identical to SEQ ID NO: 18821

SEQ ID NO: 60733 - DNA, 201 bp, Homo sapiens
tctaggccagtgtggcacagtgcggggtttattgggaggagatcaggttgcgtttggctgcaaatgacagagcactcagtcctgcgtggtgtaagcccatrtgattttttctcacatctagaggtgggcaccccagcaccgacttggctgagcactgatgtccccctgaaccaagcttatcgctacctctatcccctgctg

SEQ ID NO: 60734 - DNA, 201 bp, Homo sapiens
tggacacctcccacccacaacccctcccccgccgtggactgcagctgggagtcactgtccagcactgggttccatggccaccctagtgcaacaaagcctcrgaaagccagagtctaactctgcagcctctccagccaggaacgcggggaggaggagtcaggacgagtttggagggggccagcctgtggataggccccaagc

SEQ ID NO: 60735 - DNA, 201 bp, Homo sapiens
gctttcttccatgctttgctcagatatcacttcctcagcgaaactttcctcaccacctatgttagcttcccatttgctgccataacaattgaccacaaacrcagtggcttaaaacagtgtcagtttattgtcttacagtttgggagtcgtgagtctcaaatgggttgcactgggctaaactcaaggtgtcagcaggtctgc

SEQ ID NO: 60736 - DNA, 201 bp, Homo sapiens
tactctagcctgggtgacagtaagactccatctcaaaaaaataaaaataaaaaatcaaatatttccttgtgtccctggccaagcaaggccccctcctctgyccaacaccatgcatccaccagaggcaaccccaggtctgctttttggtcgccacaggttggttttacctgttctagagcttcctgttggtggtataatatg

SEQ ID NO: 60737 - DNA, 201 bp, Homo sapiens
cagagagtcctgcagctggctctgtaaattatatgtggagatccgggctccacaggaaaggaccagcattctgtgagcctatgtaacaaacaggcctggcyggtgacagtggctcctgtaatcccagcactttgggagggcaaggcgggtgaatcacttgaggttaggagttcgagaccagcctggccaacatggtgaaac

SEQ ID NO: 60738 - DNA, 201 bp, Homo sapiens
aggcgggtgaatcacttgaggttaggagttcgagaccagcctggccaacatggtgaaaccctgactactaaaaatacagaaattagctggatgtggtggcrtgctcttgtagtcccagctacttgggaggctgaggcaggagaatcacttgaacgtgggaggcagaggctgcactgagcggagattgcaccactgcacgcc

SEQ ID NO: 60739 - DNA, 201 bp, Homo sapiens
acttccctggttttctgtggatactgcgtagaccagagtggggtgggggccatgagtgtacacagctttagatggcaggagcaagtgctgggcctgtggcyggctgagcctctgacctcccgcttcctccctgcagcttggaactggcttcagtgacgaggagctggaggagcatcaccagagcctcaaggtgagccatgg

SEQ ID NO: 60740 - DNA, 201 bp, Homo sapiens
gagggaaaagaaggcttgccagtggaggagacagacaggggcaggggttctagagggaacggcacatgcaaaggcccagtagtggaagaggcattgcccayttatttgagaaacagagaggctcacgtgctggggtgaagagaggctcagggggccaggtgaggcgagggacgacccaggctgacccgggagagtcccccc

SEQ ID NO: 60741 - DNA, 201 bp, Homo sapiens
tgtacacagctttagatggcaggagcaagtgctgggcctgtggccggctgagcctctgacctcccgcttcctccctgcagcttggaactggcttcagtgaygaggagctggaggagcatcaccagagcctcaaggtgagccatggcggctgcgcctcagcctccacccctctcccccctgcccctgacagcacagtccttc

SEQ ID NO: 60742 - DNA, 201 bp, Homo sapiens
gacaagagctcctaggtttccagcttgtgagaccaaatattacattctcagagacattagtttctgtctcctcttggtggggaataaaagaaaagcatctrtgtgcacctgcctctttgttagtgcatcttgagagctgcagaaggaaaagggaatttatctccccgtgtttgtctttccacctcatcttccacctctctc

SEQ ID NO: 60743 - DNA, 201 bp, Homo sapiens
agtatttacaaaggactgattacgtgttagctactggattttaggtgcctgagatctggtaggaaacaaatcagacaaaaattcctctttatagaacttargttttttgggttttttgttttttgtttcttgttttttttttaaagacagggtcttgctctgttacccaggctggagtgcagtggtgctcctgggctcggg

SEQ ID NO: 60744 - DNA, 201 bp, Homo sapiens
gcttccaccatcttggggctccaggtgtgggcaggagggcagcaggcagtggagctggctttggagtccagcatctccaggttcatgtctcagcactgccrgctactagctggtgaccctgctcaagcagcctcacctccccaagccctgtgcctcattcacaccaggggttagccaaaggacacagcaggtgccatagct

SEQ ID NO: 60745 - DNA, 201 bp, Homo sapiens
atgtgttgtgtctcttctgtcctggcaagtgtggggccttctcacctggggataggtaagcaggcaaagtgggtgggagccacagggctcggggcagttasaggaagtggacccctgaggagaccagcctggccaacatggtgaaaccccatctctactaaaaccacaaaaatgagccagtgtggtggcgtgtgcctgtag

SEQ ID NO: 60746 - DNA, 201 bp, Homo sapiens
tgtttttttcccttcctccctctccccagccctccaacacttggccttgactttgagattccagaccctctgttcctctcttcctctgctcactgcaggcsctggtgctgcccagcccacgcccttacgtgcggatagatggcgctgtgattcccgaccactggctggaccccagcgctgtgtgggaggtgaagtgcgctg

SEQ ID NO: 60747 - DNA, 201 bp, Homo sapiens
gctgtggattttgagagtcaggggaggggtgtgtgtgtgagggggtggcttactccggagtctgggattcatcccgtcatttctttcaataaataattatyggatagctactttgtgacagggtctgtgctgggctctgggggcaaagctgtcatgggtgtcacctgcatagcatgtagccatgtagccatggcctaggaa

SEQ ID NO: 60748 - DNA, 201 bp, Homo sapiens
caatctcagctcactgcaagctccccacctcccggattcacgccattctcctgcctcagcttcctgagtagctgggactacaggcgcccgccaccacaccyggctaatttctttttgtatttttagtagaggcggggtttcaccgtgttagccaggatagtctccatctcctgacctcgtgatccacccgcctcggcctcc

SEQ ID NO: 60749 - DNA, 201 bp, Homo sapiens
tgatttaatactgaaaactgaaatacctcgaactagtagttcacacactggccagcaggtgtcgctgggtttcctttgaaaaatctaaaatatcttgcagygcccagtgagttccctgcatgttggtgaacccaccgaaaacagccataaagatctgatcgattgatcatctggggcctgcatgagattacaccaattgca

SEQ ID NO: 60750 - DNA, 201 bp, Homo sapiens
tcccaggcccctcctgctgctcctctcttcccccgcccatcacatctgcagccgcatccacagctcctcctcagctcgctccatcctggcttcccacaccyaccaggtgcacttccacctctgggccactaccttctttcccagcctaaaactctctttcccagatacacgcctggctcagtcccctgctttcttccatgc

SEQ ID NO: 60751 - DNA, 201 bp, Homo sapiens
aatgctccagagtgacccccgagatgcgaggcagctggggtatttatacaccaactcctgccgatcgtggggtgagggcctctcctggggctagtttattycctgccacttccagacttctgaggttccggggaagctgtctggaacacttggaggcagttaagatctgaggggagcagtggggagctcaggggacctgct

SEQ ID NO: 60752 - DNA, 201 bp, Homo sapiens
tggctgagggcatgctgggagctccaggtggacgctgaggttggccctgggggtgtgtcaggggatcttgttcagagggagcaacattgagctatgtcccraacctcacatgctgaggcctggaggggtgacacagcttggtgtgtctggaaacaccccagtttagcagtgatataaaagaaggtggagtatgtggtgtgg

SEQ ID NO: 60753 - DNA, 201 bp, Homo sapiens
ttcaaggtccctctctttccaactccacattggcgtgaggtggatcttcctcaggtcctgcaacgagaagagtgtgtcgtagaagcacgcaggagaatccrgcctctgttaagccagatattagaggatttgcaaaagtgtaaaataatgcctctagtctcaccactttctcaaaacttgggttatgtttcatcaaaatat

SEQ ID NO: 60754 - DNA, 201 bp, Homo sapiens
ggtgtccaacttgagatgtgcagtgagttcattggattttgaagacctagcatgaaaacagaatgttggaatcatactgttttagatgtattgagcaaaayagactcttcaaaccaagttcaacctggttttttccccctttttattaacgtggctgcaagaaagtttaaggttacatacgtggcttgccagatctttcca

SEQ ID NO: 60755 - DNA, 201 bp, Homo sapiens
tcacgcctgtaatcagagcactttgggaggtgggaggatcgcttgagcccagtagttcaagaccagcctgggcaatatagaaaagaccttgtgtctattcmaaaaaaaaaaaaaaattaatattatttgggtgagcatattggatttatttttttaatttctcattttaaatttctaataggtgtaactataatattatgt

SEQ ID NO: 60756 - DNA, 201 bp, Homo sapiens
ctttccaaagcgctgagattacaggcatgagccactgcagtagcctacatttctaattttagagcttctagtagccatattaaaaggtaagaagaaacagrtaaaatcatattttctttaatccaatgtctaagatattatcctttcaatgtgtgatgaatataagaaattattaacatggaattttacactcttttcttg

SEQ ID NO: 60757 - DNA, 201 bp, Homo sapiens
gaactgatttcaaagcaaaacacaaaactgtaaatgtgctggaaaaactcagtgaaaacttttggaattctaaggaaaggaggactttttttttttttttwaaattatcttggggatgaggctggatgcagtggctcacgcctgtaatcccaacactttgggaggctgaggtgggtggatctcttgtgatgtgcacctgta

SEQ ID NO: 60758 - DNA, 201 bp, Homo sapiens
tctcaaggctttccacgaaccctgtcactagttgtgacccgcacatgtcctgttcgcctcacatttagggcttattgtctttattctcacaaagatgtctyatctctcttctccctgccggccctgcagtccctggtacgtgagcccctttcccggcgccggcagctgctccgggagaactttgtggagacagagggcgag

SEQ ID NO: 60759 - DNA, 201 bp, Homo sapiens
tccagcacagacctttcctgtctcaggaaatagcactgttgtgcccccagggctgagcttctgcctggcacatggttagcacttagtgaacgtttctgaaygaatgggaaaatgctctccctttggaggagtggccagagtgagttggccacgtctctgtcctgagggaaagacggcggcaaggctgactcctgaggtccc

SEQ ID NO: 60760 - DNA, 201 bp, Homo sapiens
ctgccatgtgcctctggcctcatcatcacaatgtggctgcaggagttccagccctcatggccatgcctgctccacgcaccagggaagagcaaagggggttsgaccctgagtcagcctcagccagtgaacaccttctgctcaagttctgttgctcatcactttgctccatggctcacccctagctgcaaggaattctgggaa

SEQ ID NO: 60761 - DNA, 201 bp, Homo sapiens
atgtgcctctggcctcatcatcacaatgtggctgcaggagttccagccctcatggccatgcctgctccacgcaccagggaagagcaaagggggttggaccytgagtcagcctcagccagtgaacaccttctgctcaagttctgttgctcatcactttgctccatggctcacccctagctgcaaggaattctgggaaatgta

SEQ ID NO: 60762 - DNA, 201 bp, Homo sapiens
gtgtgagccaccgcgcccggccctaattttgtatttgtaatagagatggggtttcactatgttggccaggctggtcttgaactcctgacctcaagtgatcsgcccgcctcggcctcccaaaatgctgggattacaggcctgagccaccacacccggccctcttctgtattttgtaaggatgctttttggattcagagccta

SEQ ID NO: 60763 - DNA, 201 bp, Homo sapiens
tggggtttcactgtgttagccaggaagatcttgatctcctgacctcgtgatccgcccacctccgcctcccaaagtgctgggattacaggtgtgagccaccrcgcccggccctaattttgtatttgtaatagagatggggtttcactatgttggccaggctggtcttgaactcctgacctcaagtgatccgcccgcctcggc

SEQ ID NO: 60764 - DNA, 201 bp, Homo sapiens
aggactttgggaggtcgaggtgggaggatcgcttaagtccaggagtgagacaccagcgtgtgcaacacggcaaaaccccatctctacaaagatcagtcggrcatggttgcttgcacctgtagtcctagctactcaagaagctgaggtaggagaatcccttgagcccaggaggttgaggctgcagtgcgcattgctccactg

SEQ ID NO: 60765 - DNA, 201 bp, Homo sapiens
ttgaggctgcagtgcgcattgctccactgcactctagcctgggcgacagtgagaccctgtctcaaaaaaaaatagaggttgggaactgtctctagagctgygctgcttaccagctgtgtggccatgggtgagttaatcactctgtgccccagtttccttatccggaaaaggaagttagaaaggtcccttctggccaggcac

SEQ ID NO: 60766 - DNA, 201 bp, Homo sapiens
ggattggggatggtgagcaatgaggtgagaaggtcctggaaaaccagcttggggaacagcgtctttgtcctaagggggacttggaatgtttgctgtggggkaagaacagggcgagagacccattcgtaatgcggggcagtgtgagcccttgccgtccggtctagcctattgagcgctttagcgtggtgagtgtgacagggg

SEQ ID NO: 60767 - DNA, 201 bp, Homo sapiens
ggcaacaagcaaaggaggaggggagcatgctaggcaaggggaacatagaaattgagaaggcctgggggctgctgagggcctggtgtgctggcgtgtagagygcaggattggggatggtgagcaatgaggtgagaaggtcctggaaaaccagcttggggaacagcgtctttgtcctaagggggacttggaatgtttgctgtg

SEQ ID NO: 60768 - DNA, 201 bp, Homo sapiens
ggaagagttttgggcagaagagaggcagagatcatttagtcctgggcagtgtttaaaatattcatctggccaggcacgatggctcacgcctgtaatcccarcactttgggaggccaaggcgggtggatcacgaggtcagaagttcgagagcagccaggccaacatagtgaaacctcatctctgctacaaaagttagccggg

SEQ ID NO: 60769 - DNA, 201 bp, Homo sapiens
caaagccaggccttgtggaaacctcccaggcccctcctgctgctcctctcttcccccgcccatcacatctgcagccgcatccacagctcctcctcagctcrctccatcctggcttcccacacccaccaggtgcacttccacctctgggccactaccttctttcccagcctaaaactctctttcccagatacacgcctggct

SEQ ID NO: 60770 - DNA, 201 bp, Homo sapiens
ctgctgggagaacattcccacccgggagtctctggatggatgctccgcacccccagctccctacttccctggttttctgtggatactgcgtagaccagagyggggtgggggccatgagtgtacacagctttagatggcaggagcaagtgctgggcctgtggccggctgagcctctgacctcccgcttcctccctgcagctt

SEQ ID NO: 60771 - DNA, 201 bp, Homo sapiens
acaaccagaaaatgttcattggatgcttgaaaggaagggaaggaaacagcaaagaaaccaaagtgtttgcgggcagtgcccccactctgcctgctgtagtygcccctttacacccccatttccccaccttccagggcggcactgaaggagtggaatggagtggtgtccgagagtgactctccggtgaagaggccagggagg

SEQ ID NO: 60772 - DNA, 201 bp, Homo sapiens
tcactctcacccaggctggagtgcaatggtgtgatctcggcccactgcactccagcctgggcgacagagcaagattccatctcaaaaaaaaaaaaaaaaaaggcatcccaatagatgctggagaccaatggcaaccttaggcagggactccatttgctcctcagcatcacccatcacagggcaggcactctggagacttcc

SEQ ID NO: 60773 - DNA, 201 bp, Homo sapiens; identical to SEQ ID NO: 18855

SEQ ID NO: 60774 - DNA, 201 bp, Homo sapiens
caaagatcagtcgggcatggttgcttgcacctgtagtcctagctactcaagaagctgaggtaggagaatcccttgagcccaggaggttgaggctgcagtgygcattgctccactgcactctagcctgggcgacagtgagaccctgtctcaaaaaaaaatagaggttgggaactgtctctagagctgcgctgcttaccagct

SEQ ID NO: 60775 - DNA, 201 bp, Homo sapiens
acccaccctgcccagcaggcttccctcaggccccaactcctattgcacctgcttagggaagccgggtgcctctcccttcatgtgtgagaggaggtgcgtgyccccagcacttgagtcagactgtcttttatgtcttgtcacatggtaaagagcctccctaaccagacataagctccttcccacagagccagggctgtggga

SEQ ID NO: 60776 - DNA, 201 bp, Homo sapiens
aacccaccctgcccagcaggcttccctcaggccccaactcctattgcacctgcttagggaagccgggtgcctctcccttcatgtgtgagaggaggtgcgtstccccagcacttgagtcagactgtcttttatgtcttgtcacatggtaaagagcctccctaaccagacataagctccttcccacagagccagggctgtggg

SEQ ID NO: 60777 - DNA, 201 bp, Homo sapiens
catgtgagcaccctcccttgcccctgagtctttccttctccaagtcctctgtttctttctctaaatctgtacttaaaaaaacaaacaaacaaacaaaaacycttacgttagattttgagttggaatttccaggagtcaagtagtatggaaaatgagccgtgggatatggaagacagtgtattgaacaacagtttttagttg

SEQ ID NO: 60778 - DNA, 201 bp, Homo sapiens
cctaacccaccctgcccagcaggcttccctcaggccccaactcctattgcacctgcttagggaagccgggtgcctctcccttcatgtgtgagaggaggtgygtgtccccagcacttgagtcagactgtcttttatgtcttgtcacatggtaaagagcctccctaaccagacataagctccttcccacagagccagggctgt

SEQ ID NO: 60779 - DNA, 201 bp, Homo sapiens
agtgtgagctacttacgatataaaggttgaggccgggcgcagtggctcatgcctataatcccaggactttgggaggtcgaggtgggaggatcgcttaagtycaggagtgagacaccagcgtgtgcaacacggcaaaaccccatctctacaaagatcagtcgggcatggttgcttgcacctgtagtcctagctactcaagaa

SEQ ID NO: 60780 - DNA, 201 bp, Homo sapiens
gaagctgcttcctcagcaggtacagctggccggggcagagcagattggaacccagatgagtctgaatgcagagtttggctggggtcagtgtgagctacttrcgatataaaggttgaggccgggcgcagtggctcatgcctataatcccaggactttgggaggtcgaggtgggaggatcgcttaagtccaggagtgagacac

SEQ ID NO: 60781 - DNA, 201 bp, Homo sapiens
ctggaaggcggggaggtgaagatcttcagcaggaatcaggaagacaacactgggaagtacccggacatcatcagccgcatccccaaggtgggcgtctgccwcacacttgcactctgccagggtctgtggtcaggggtgcaaaggcctgaggcccatctaggccagtgtggcacagtgcggggtttattgggaggagatcag

SEQ ID NO: 60782 - DNA, 201 bp, Homo sapiens
tctccagcctgggcgagactccgcctcaaaaaaaaatcagaatgagatctagagcataatgacatttaaacaaatcagcacccacatgcagcaaggtgcaygtgcctacatggggagaggtgtagggattggaaatgaagaagaaaatgatggtagggccttccagagcagggctgggaggtgctgttggaactgaggaga

SEQ ID NO: 60783 - DNA, 201 bp, Homo sapiens
acctcggcctcccaaagtgctgggattacatgcctgtaggcatgagccaccatgcccggccaaaaacctttttttaaaaactgtattcttgagtggtctcmtgtgtagccgagtagagaatcgctggtctcgtggtgacagatagggaacaggggcaaggccagactaagggagacaaagcaacagatagtgacacgaagg

SEQ ID NO: 60784 - DNA, 201 bp, Homo sapiens
acacaaggatggtgacaaagatcaggaaggtggcaaacagtgaagggtcagtgaccccaggagaggtatagaaagacgctggcagcggccaggcacagtgkctcacgcctgtaatcccagcacttgggagcctgaagcaggcagatcacttgaggtcaggagtttgagaccagcctggccaacatggtgaaaccctgtctc

SEQ ID NO: 60785 - DNA, 201 bp, Homo sapiens
actggccacgtcttgatgctgtctcatctaagtagaagacaacagtactcttttttttttgaaatggagtctcactctcacccaggctggagtgcaatggygtgatctcggcccactgcactccagcctgggcgacagagcaagattccatctcaaaaaaaaaaaaaaaaaaggcatcccaatagatgctggagaccaatg

SEQ ID NO: 60786 - DNA, 201 bp, Homo sapiens
cctctgacctcccgcttcctccctgcagcttggaactggcttcagtgacgaggagctggaggagcatcaccagagcctcaaggtgagccatggcggctgcrcctcagcctccacccctctcccccctgcccctgacagcacagtccttccatgcagggctcttggcttccaccatcttggggctccaggtgtgggcaggag

SEQ ID NO: 60787 - DNA, 201 bp, Homo sapiens
accgtgttagccaggatggtcttgatctcctgacctcgtgatccgcccacctcggcctcccaaagtgttgggattacaggtgtgagccaccatgccaggcmccaacattttatatttagttgtttgcttaatatttctgcccttcaccagagtgttagcttcttgaaggcaggaacttcgtgtgtctgggtcactgccaaa

SEQ ID NO: 60788 - DNA, 201 bp, Homo sapiens
actacaggcgcctgccaccacacccagctaattttttttgtatttttagtagaagcagggtttcaccgtgttagccaggatggtcttgatctcctgacctygtgatccgcccacctcggcctcccaaagtgttgggattacaggtgtgagccaccatgccaggccccaacattttatatttagttgtttgcttaatatttc

SEQ ID NO: 60789 - DNA, 201 bp, Homo sapiens
atacaaaaattagccaggtgtggtggtgggcgcctgtaatcccagctccttgggaggctgaggcggaaggctctcttgaacccgggaggtggaggttgcaktgagcagagattgcaccactgctctccagcctgggcgagactccgcctcaaaaaaaaatcagaatgagatctagagcataatgacatttaaacaaatcag

SEQ ID NO: 60790 - DNA, 201 bp, Homo sapiens
agagaggtcctgtatacccttggccagtttccattgtcaatatcatacattactatgatccgtttctcaccactgagatactaatgtcagtacattactcktaactgaactccatactttattattcagatttcaccagattttttttttaatgttcacgccttccaacatttttttttttttttttttgagacagagtct

SEQ ID NO: 60791 - DNA, 201 bp, Homo sapiens
gatgctatatatgccgccctgctcaagggctgtgaccggactgtcttaaaataaatagacatagaggctgggcgcagtggctcacgcctgtaatcccagcrctttgggaggctaaggtgggcggatcacctgaggtcgaaagttcaagaccagcctggctctactaaaaatacaaaaattagccaggtgtggtggtgggcg

SEQ ID NO: 60792 - DNA, 201 bp, Homo sapiens
tataaagccgtcagatctcgtgagacttcctcactatcacgagaacagcacgggaaaaacctgcccccatcgttcagttacctcccaccaggtccctccaygacacatggggattttgggagctatgattcaagacaagatgtgggtggggacacacggaccctgacaccatctctgtcccactctttggttctctctctc

SEQ ID NO: 60793 - DNA, 201 bp, Homo sapiens
aacccaggaggcagagggtgcagtgagccaagatcgtgccactacactacagcctccacgataagagtgagactccatcttttaaaaaaaaaaaaaaaaaagggtggatccaacagacacaggatcagagatggatctccaaaatagtgttgagaaaaaagacacaagatgatttacgatagtgacaatgatttcttgaca

SEQ ID NO: 60794 - DNA, 201 bp, Homo sapiens
ttagagcccagtttcactggcccagcctgggccacatacctatccctgaaccagccacagggatgcagcctggatcacgtgtccacccctggtcacaggcraaagggccagcccactcaaatcgtgtgtactgagagaatgtggggtaagaagcatcccaagaggaaaacggaggggctgttaccaggaggaaaaaatgga

SEQ ID NO: 60795 - DNA, 201 bp, Homo sapiens
gaggagggaggggaggcaaccagattccttgcaaggatgtgagccagacattgcacatgctgcgtgggttccaatcacatggcctttcccacctggaaggmaggccgggggctgtagtccccagtgggaggctaggtccccttctaaaacgtgggaggcttcgtgactgaatagcaagaaagcagaatggtcctggggccc

SEQ ID NO: 60796 - DNA, 201 bp, Homo sapiens
ccctgggaatctgtctctctccattgttcagctctactgtccttgaggttgtcctcaccctcaggcgggctctcccctcttagcggtccccttggaaagakggtgttagagcccagtttcactggcccagcctgggccacatacctatccctgaaccagccacagggatgcagcctggatcacgtgtccacccctggtcac

SEQ ID NO: 60797 - DNA, 201 bp, Homo sapiens
ggaggatcacttgagcccaggagttcgggaccagcctgggcaacatagtgagaccccacctctacaaaaacttttttaaaaaattagccaggcgtggtggygcatgcctgtggtcccagctacttgggaggctgaggcaggaggattgcttgagcccaggaggtggaggttgcagtgagccaagattgcaccactgcactc

SEQ ID NO: 60798 - DNA, 201 bp, Homo sapiens
gtcaggccagatagaatttctttctgtcacacagaagtgtccagagcaagggaggtggccagggaaggtacaggtgtgcagctgtgtcccagggatgaccyggggacccaggttcctgtgtccctctgccctccaaaggttgtcaccccaatgtctgtgatcaaatgtggctcacttccctgttctaattgtgggaggagg

SEQ ID NO: 60799 - DNA, 201 bp, Homo sapiens
cagtgtctggagatatttttggttgttacaacctagggacagagggtttgccattggcatctagtggctaaaagccaggcatgctgctaaacatccttcarttcataggacagcccccccaacaacacagaaccatcaggcccaacatgtcaatagtgtctaggttgagaaacctcgtgttaatgcagtccggcttcagga

SEQ ID NO: 60800 - DNA, 201 bp, Homo sapiens
atgggccagaaggcagtgggtcaggccagatagaatttctttctgtcacacagaagtgtccagagcaagggaggtggccagggaaggtacaggtgtgcagytgtgtcccagggatgacccggggacccaggttcctgtgtccctctgccctccaaaggttgtcaccccaatgtctgtgatcaaatgtggctcacttccctg

SEQ ID NO: 60801 - DNA, 201 bp, Homo sapiens
ggatttctgttccaggagcagctgacagacgaagaaaagtgctggacaggaagggagaattctgacgccaacatgcagcgaagtatcatgtgagcaccctyccttgcccctgagtctttccttctccaagtcctctgtttctttctctaaatctgtacttaaaaaaacaaacaaacaaacaaaaacccttacgttagattt

SEQ ID NO: 60802 - DNA, 201 bp, Homo sapiens
acctccgcctcccgggttcaagcgattcccctgcctcagcctcccgagtagctgggattacaggcacacgccaccacgcccggctaattttgtatttttartagagacggggtttctccatgttggtcagactggtctcgaactcccgacctcaggtgatccacccgcctcggcctcccaaaatgctgggattacaggcat

SEQ ID NO: 60803 - DNA, 201 bp, Homo sapiens
gccactgcgttccagcctgggcaacagagtgagactgtcttaaaaaaaagaaagacgctgacagcaagggagggcagccggcaacatgaggtttctgagtkccagacagggctgtgcatgcagaaaggccttaagggacccagagaggagcaggtgactgacacatggtgaagggtcttgacagtcatggagaggacatcc

SEQ ID NO: 60804 - DNA, 201 bp, Homo sapiens
tggctgccctctcccaggcagtgagcctcacgcccccgggccaaggtgagctcctgtggcccgtctctgcatccctcgctggagttacctcaggcttcccycctcctcttcagaggcccatgcccgccccttccccagcgggcccctgccataccaggctcctctctcctgggtgggggggagggggcgtcttgggccgcg

SEQ ID NO: 60805 - DNA, 201 bp, Homo sapiens
atggggaggcaaactaagccacttgtctcctgccactggctcaaagcaaggaccatgctggggtcctgaccatcacagtcaccagggcgggcgccaggctyagttctctccctgactcatcctcctcaagcctcgccaacccctcagggcagctgagatgggaggtgctggtgcacctacttgtgcccctccccagtctat

SEQ ID NO: 60806 - DNA, 201 bp, Homo sapiens
gtttcactctcattgcccaggctggagtgcaatggcacgatcttggctcactgcaacctccgcctcccgggttcaagcgattcccctgcctcagcctcccragtagctgggattacaggcacacgccaccacgcccggctaattttgtatttttagtagagacggggtttctccatgttggtcagactggtctcgaactcc

SEQ ID NO: 60807 - DNA, 201 bp, Homo sapiens
tggatctcttgtgatgtgcacctgtagtcccagctactcgggaggccgacgcaagacagtcgcttgaattcaggaggcggaggctgcagtcagccaagatygcaccaccgcactccagcctgggcgacagagcgagattccgtctcaaaaaaacaaaaacaaaaaacaaaactgatgagatgcccgtaaagtgttaattca

SEQ ID NO: 60808 - DNA, 201 bp, Homo sapiens
aactgatttcaaagcaaaacacaaaactgtaaatgtgctggaaaaactcagtgaaaacttttggaattctaaggaaaggaggacttttttttttttttttwaattatcttggggatgaggctggatgcagtggctcacgcctgtaatcccaacactttgggaggctgaggtgggtggatctcttgtgatgtgcacctgtag

SEQ ID NO: 60809 - DNA, 201 bp, Homo sapiens
gaggaggaggaaggtgagcccccagaaggagaggtgtgtgtgtgtgtgtgtgtgtgtgtgtgtgtgtgtgtgtgtgtgtgtgtgttttggatctgcaaggkcaggggcctgagagctcaggatgtttggaccctgccgatttgatgcctgtgtccaggcatccaggaattccacctaccaatatgggaacttttgttctga

SEQ ID NO: 60810 - DNA, 201 bp, Homo sapiens
cacggggtgactgagagcagaggtggtgatctagacaaggctggtgcttgacacaaggatggtgacaaagatcaggaaggtggcaaacagtgaagggtcartgaccccaggagaggtatagaaagacgctggcagcggccaggcacagtggctcacgcctgtaatcccagcacttgggagcctgaagcaggcagatcactt

SEQ ID NO: 60811 - DNA, 201 bp, Homo sapiens
ccacgcgtgtgtcaggaaggcttctgggtagaccatcagctgggtcgcatcagtccttctcatggggtgcacagcttcctctcctccttcctgcacccaakcctaggggagtctcctcttcagagtctagcagacctaatgccatggctgccacatgacaggactcagtaaatacttcctggataaagggagagggaggca

SEQ ID NO: 60812 - DNA, 201 bp, Homo sapiens
taagagcacgggtccaccatccactggctgtatgacctgggacaaatgactgaccttctctgagcttaggttgctttatctgtagagatgatgataatgayagcacctaccgcacagaaatatctgagttagaagataacacgtgtacgctgctcagaactgggcccagccctcagtcggggctcagtcattgtgggtcat

SEQ ID NO: 60813 - DNA, 201 bp, Homo sapiens
gatgaccacccactggtgggttctcatccgcctggggagaggatgtgctgggagcactggagctggcttagggccatgggcaccaacatttagggaagtcrggggtttcaggctttcatgagaggacagagggactgagaaaggttgacttggatcaggaaagagttacgggcttatgggagccagaggagatgagactca

SEQ ID NO: 60814 - DNA, 201 bp, Homo sapiens
cacggtagcagtggcttaggcaagacgcaaacttatttttctctctcctgagtgcagagtccgggattcatgtgaccgtctcacagggtcagaggcccagrcttcctctgtgctgtcgtttgctctctgtagatgcccttgtccctgtgaacatccatattctgccaacaggaagaggagggcaccccactcaacattaag

SEQ ID NO: 60815 - DNA, 201 bp, Homo sapiens
gggatgaccacccactggtgggttctcatccgcctggggagaggatgtgctgggagcactggagctggcttagggccatgggcaccaacatttagggaagkcgggggtttcaggctttcatgagaggacagagggactgagaaaggttgacttggatcaggaaagagttacgggcttatgggagccagaggagatgagact

SEQ ID NO: 60816 - DNA, 201 bp, Homo sapiens
gatttccctgatgttggtttttgtatttcttctctgcaccttaaaaacctcggtaatgagacttctgtaggaaaaacccagcttctgtttctaatgaggcyccctaagtttttcagtaacaaagccattctttccagctttgaagttttagacagaaacacggttttcgttttagaggtggtgcagcttggtggctgggag

SEQ ID NO: 60817 - DNA, 201 bp, Homo sapiens
tgcttgaacctgggagatggaggttgtggtgagccgagatcgtgccattgcactccagcctgaacaacagggcaagactccatctcaaaaaaaaaaaaaaattatctgagacctgtatctccatcagggtctcaatgggagacagaaaccataccagtgatttgaacagagggagtttaaaggatggtcactaggtatgca

SEQ ID NO: 60818 - DNA, 201 bp, Homo sapiens
aagagctatgggggtccttgatgggaccatgatcctgcactggagggcgggatgatggcccaggtgagaagaggccacccctgagttagggctgagaccayagggtcagaaaggagggtagacagagaggtttcagtcccctctactctcaacttttggaaaatggggtccctccttcccccgctcactctagaactgttc

SEQ ID NO: 60819 - DNA, 201 bp, Homo sapiens
ccttgttagtttgcagggcaccttttatcctaggaagaacttgtcccatcagaaagagactggactggctagcagctggagctctggggtcaggttcaggrgcttcaaattcaggatcatcgctgactcagcatgtggcttatgctactccctttttctctttaagggtcagttttcccatctgtaaaatgaggtggatga

SEQ ID NO: 60820 - DNA, 201 bp, Homo sapiens
caggctattcatttcaaagagctgggtgtcgctcacttctggtggctccgaggaacacctcagccaaggccctttccttcccatgctcaggacgcccttcygccttgcccattccttgttagtttgcagggcaccttttatcctaggaagaacttgtcccatcagaaagagactggactggctagcagctggagctctggg

SEQ ID NO: 60821 - DNA, 201 bp, Homo sapiens
tctcactgctacctccgcctcccaggttcaagcgattcttctgccttggctgaggcagcctccctagtagctgggatcaaaggcatgagccaccatgcccrgctaattttttgtatttagtagagatggggttctgccatgttggtcagtctggcctcaaactcctcacctcaggtgatccacccacctcgacctcccaaa

SEQ ID NO: 60822 - DNA, 201 bp, Homo sapiens
agtcatgtatcccaattaaacagatgagaaaagtgaggctcatgaagattataaatcttatccaagatcctgccatctctagaataaatgttaggactttwtttttttgagacggggtttcactgttgtccccaggctggagtgcaatggtgcaatctcggctcactacaacctctgcctcccgggttcaagccagtctcc

SEQ ID NO: 60823 - DNA, 201 bp, Homo sapiens
ttgccatttgtctgtcttctttagagagatagctgttcacgtcttttgcccatttgtcttctttagagagatggctgttcacgtcttttgcccatttgtcytctttagagagatggctgttcacgtcttttgcccatagttattagattgatgcaaaagtaattgtgattttgccattaaaagcaatatttgtcattatgc

SEQ ID NO: 60824 - DNA, 201 bp, Homo sapiens
tgatgtctcgctgaggaggtcctggaagctccagaccctctccacctggtcaacatggagcaagcgcttgtggagaaccaaagcccaaaagccccagatcsccttaaagcagagagggagggcaggcgggagggagggcattggcatgcggcgctgtgcatggggtgagacccagagcggtatctttgccaggatgggggc

SEQ ID NO: 60825 - DNA, 201 bp, Homo sapiens
aataaatagggaagaaaaataacgtattccaaacacctgcaatggatcaatgcctctgtatactttatctgatttaatcctcaaaaaaacaaacaaacaaaaacaaaaacacgcacacaaacacattaggagtaagcaagcagtcatgtatcccaattaaacagatgagaaaagtgaggctcatgaagattataaatctta

SEQ ID NO: 60826 - DNA, 201 bp, Homo sapiens
aatggacagttgcttgtcaaagggtacaaagttttggttagacaggaggaataacttttgagatctattgcacagcaggataactatagtaaataataatrtatgtttcaaaaatcacctaaaaagtaagttttaaatgtatcgctgggcactttggctcaggactgtaagcctagcactttggaaggacaaggtggaagg

SEQ ID NO: 60827 - DNA, 201 bp, Homo sapiens
aagcgatctgcccacctcggcctcccaaagttctgggattacaggcgtgagccaccgagcccagcctgtaagccaattttatctcaacctcatgaggtagmtctattaaacatgccaacttgacagatgagaaactgaggcacagggttaagtaacttgccacagagatctgattcccatttcatagatggagaaatggaa

SEQ ID NO: 60828 - DNA, 201 bp, Homo sapiens
ttctctcttaactttcagagctgcgggaagcatttcttgagttcgataaggaccgagatgggttcatctcttgtaaggatctggggaatctcatgaggackatgggttacatgcccacggagatggaactgattgagctcggccagcaaatccgcatgaactgtgagtccagggaatgggagggatggccggggttaggga

SEQ ID NO: 60829 - DNA, 201 bp, Homo sapiens
caataaatagggaagaaaaataacgtattccaaacacctgcaatggatcaatgcctctgtatactttatctgatttaatcctcaaaaaaacaaacaaacaaaaacaaaaacacgcacacaaacacattaggagtaagcaagcagtcatgtatcccaattaaacagatgagaaaagtgaggctcatgaagattataaatctt

SEQ ID NO: 60830 - DNA, 201 bp, Homo sapiens
ggcatgagccaccgtgcctggccagggcctctattcttagtgcctgtaacaggaagaatccaagaatttgagatcccagaagggaatgcaaagtggtcatmtggtacgaaccacttgctgcagacatactaaaaaatatcagacccagtgagaataacagacttgcttatatcccctgataaaataccttctcgttctgag

SEQ ID NO: 60831 - DNA, 201 bp, Homo sapiens
aaagggtacaaagttttggttagacaggaggaataacttttgagatctattgcacagcaggataactatagtaaataataatgtatgtttcaaaaatcacytaaaaagtaagttttaaatgtatcgctgggcactttggctcaggactgtaagcctagcactttggaaggacaaggtggaagggttgcttaaggccaagat

SEQ ID NO: 60832 - DNA, 201 bp, Homo sapiens
gcttaaggccaagattttaagaccaacctggccaaaatagtgagaccccgtctcattaaaaaaaagtttcggccgggcacagtggctcaagcctgtaatcycagcactttaggaggctgaggcaggtggatcaactgaggtcaggagttcaagatcagcctggccaacatggtgaaaccctgtctctactaaaaatacaaa

SEQ ID NO: 60833 - DNA, 201 bp, Homo sapiens
tcaataaatagggaagaaaaataacgtattccaaacacctgcaatggatcaatgcctctgtatactttatctgatttaatcctcaaaaaaacaaacaaacaaaaacaaaaacacgcacacaaacacattaggagtaagcaagcagtcatgtatcccaattaaacagatgagaaaagtgaggctcatgaagattataaatct

SEQ ID NO: 60834 - DNA, 201 bp, Homo sapiens
aagtttcggccgggcacagtggctcaagcctgtaatctcagcactttaggaggctgaggcaggtggatcaactgaggtcaggagttcaagatcagcctggycaacatggtgaaaccctgtctctactaaaaatacaaatattaaacaggtttggtggtgcgcgcctgtaatcccagctactcgggaggctgagggacgaga

SEQ ID NO: 60835 - DNA, 201 bp, Homo sapiens
atcaataaatagggaagaaaaataacgtattccaaacacctgcaatggatcaatgcctctgtatactttatctgatttaatcctcaaaaaaacaaacaaacaaaaacaaaaacacgcacacaaacacattaggagtaagcaagcagtcatgtatcccaattaaacagatgagaaaagtgaggctcatgaagattataaatc

SEQ ID NO: 60836 - DNA, 201 bp, Homo sapiens
tagaggcagaccctctgaggtctgcctgtaattagccaatgccatggacagcacccaccaaccaggcccccacctttttttttccagccatggtgggatcrataaatagggaagaaaaataacgtattccaaacacctgcaatggatcaatgcctctgtatactttatctgatttaatcctcaaaaaaacaaacaaacaaa

SEQ ID NO: 60837 - DNA, 201 bp, Homo sapiens
aaaccctgtctctactaaaaatacaaatattaaacaggtttggtggtgcgcgcctgtaatcccagctactcgggaggctgagggacgagaatcgcttgaayccaggaggtgaaggctgcagtgagctgagattgcaccactgcacttcagcctgggtgacagggtgagactgtctcaaataaaaaaaaaaaaaaaaagaaa

SEQ ID NO: 60838 - DNA, 201 bp, Homo sapiens
gcctgtaattagccaatgccatggacagcacccaccaaccaggcccccacctttttttttccagccatggtgggatcaataaatagggaagaaaaataacrtattccaaacacctgcaatggatcaatgcctctgtatactttatctgatttaatcctcaaaaaaacaaacaaacaaaaacaaaaacacgcacacaaacac

SEQ ID NO: 60839 - DNA, 201 bp, Homo sapiens
tcatggtgctggtgatggtagaggcagaccctctgaggtctgcctgtaattagccaatgccatggacagcacccaccaaccaggcccccacctttttttttccagccatggtgggatcaataaatagggaagaaaaataacgtattccaaacacctgcaatggatcaatgcctctgtatactttatctgatttaatcctca

SEQ ID NO: 60840 - DNA, 201 bp, Homo sapiens
agaaaaataacgtattccaaacacctgcaatggatcaatgcctctgtatactttatctgatttaatcctcaaaaaaacaaacaaacaaaaacaaaaacacrcacacaaacacattaggagtaagcaagcagtcatgtatcccaattaaacagatgagaaaagtgaggctcatgaagattataaatcttatccaagatcctg

SEQ ID NO: 60841 - DNA, 201 bp, Homo sapiens
aatccacttccaactcactgtcagattttccaagttggccactccttctcactcctctccaagtttgagaatggaagcgggtggcaggttttggaagcatytgttctgtccctttcttcccaggctattcatttcaaagagctgggtgtcgctcacttctggtggctccgaggaacacctcagccaaggccctttccttcc

SEQ ID NO: 60842 - DNA, 201 bp, Homo sapiens
aactccatcatctcgtggctatcatcattgtcattgctgatataatctatttctgcttctattcagtttgacacgaatggagatggggagatcaccctggyggagctacagcaggccatgcagagactcctgggggagcggctcaccccccgggagatctctgaggttgtccgggaggctgatgttaatggagacggcaca

SEQ ID NO: 60843 - DNA, 201 bp, Homo sapiens
tcctcagtgggtggccgtgtagactttgatgactttgtggagctgatgacccccaaattgcttgcagaaacagctgggatgatcggtgtccaggagatgcrggatgccttcaaggaggtgagttaacagtgtcatggtgctggtgatggtagaggcagaccctctgaggtctgcctgtaattagccaatgccatggacagc

SEQ ID NO: 60844 - DNA, 201 bp, Homo sapiens
ttatagggcagggagaagggagctgatctaactgactcgaagcacaaagtgaggtaatggaaggccagggcttgtggggtctcgctaatcctgtgccatcytcctcagtgggtggccgtgtagactttgatgactttgtggagctgatgacccccaaattgcttgcagaaacagctgggatgatcggtgtccaggagatgc

SEQ ID NO: 60845 - DNA, 201 bp, Homo sapiens
gagctgcgggaagcatttcttgagttcgataaggaccgagatgggttcatctcttgtaaggatctggggaatctcatgaggacgatgggttacatgcccasggagatggaactgattgagctcggccagcaaatccgcatgaactgtgagtccagggaatgggagggatggccggggttagggaagggatcagggcagaat

SEQ ID NO: 60846 - DNA, 201 bp, Homo sapiens
ccgtctggaataccctttcccctctcccctggctaactcctagttatgttcctggaaggtacctcccacctctcttactgggctccgtgtccctctgctgkctccccagtaatacctcccgcttgcttctgcagtaatacggattcgtggcatctctagagtttattgcctatttccttctgagaccatggaccaattcct

SEQ ID NO: 60847 - DNA, 201 bp, Homo sapiens; identical to SEQ ID NO: 18799

SEQ ID NO: 60848 - DNA, 201 bp, Homo sapiens
ccttccgtctggaataccctttcccctctcccctggctaactcctagttatgttcctggaaggtacctcccacctctcttactgggctccgtgtccctctkctggctccccagtaatacctcccgcttgcttctgcagtaatacggattcgtggcatctctagagtttattgcctatttccttctgagaccatggaccaat

SEQ ID NO: 60849 - DNA, 201 bp, Homo sapiens
atcatgcacaaagcaccactgtatttttaaattttccttccctgtctttgctcaagttgtccttccgtctggaataccctttcccctctcccctggctaaytcctagttatgttcctggaaggtacctcccacctctcttactgggctccgtgtccctctgctggctccccagtaatacctcccgcttgcttctgcagtaa

SEQ ID NO: 60850 - DNA, 201 bp, Homo sapiens
tgtaaaatgaggtggatgatgacaccttttggagaaaactaaaagaaatcatgcacaaagcaccactgtatttttaaattttccttccctgtctttgctcragttgtccttccgtctggaataccctttcccctctcccctggctaactcctagttatgttcctggaaggtacctcccacctctcttactgggctccgtgt

SEQ ID NO: 60851 - DNA, 201 bp, Homo sapiens
taagggtcagttttcccatctgtaaaatgaggtggatgatgacaccttttggagaaaactaaaagaaatcatgcacaaagcaccactgtatttttaaattwtccttccctgtctttgctcaagttgtccttccgtctggaataccctttcccctctcccctggctaactcctagttatgttcctggaaggtacctcccacc

SEQ ID NO: 60852 - DNA, 201 bp, Homo sapiens
gtgagctgagattgcaccactgcacttcagcctgggtgacagggtgagactgtctcaaataaaaaaaaaaaaaaaaagaaagaaaaaaagaaaaaaaaaaacagaacaaaactgtcttttggagctgacgttctagtggctcacattcccaaagcttttatctcagtgcttgacccacagtaagcgataggtaaactccat

SEQ ID NO: 60853 - DNA, 201 bp, Homo sapiens
gtgaaggctgcagtgagctgagattgcaccactgcacttcagcctgggtgacagggtgagactgtctcaaataaaaaaaaaaaaaaaaagaaagaaaaaaagaaaaaaaaaaacagaacaaaactgtcttttggagctgacgttctagtggctcacattcccaaagcttttatctcagtgcttgacccacagtaagcgata

SEQ ID NO: 60854 - DNA, 201 bp, Homo sapiens
caaaaacaaaaacacgcacacaaacacattaggagtaagcaagcagtcatgtatcccaattaaacagatgagaaaagtgaggctcatgaagattataaatyttatccaagatcctgccatctctagaataaatgttaggactttttttttttgagacggggtttcactgttgtccccaggctggagtgcaatggtgcaatc

SEQ ID NO: 60855 - DNA, 201 bp, Homo sapiens
tcttcctcccagctgtgaagtcttacagaagtttttctgttcctctccatggaagttatcacagcagaccttgctgtgttgagttgtattagcttccaagrcctccatcctagatagagaggaggaagggccattctctaaaccatatatgctgtatgtcccagtatggaaacacagtagaggctggttggacacctgcta

SEQ ID NO: 60856 - DNA, 201 bp, Homo sapiens
tgtgttgagttgtattagcttccaaggcctccatcctagatagagaggaggaagggccattctctaaaccatatatgctgtatgtcccagtatggaaacayagtagaggctggttggacacctgctagatctagccaggattaggtgtgcagtggacatcaagtgacatctggagaaggtggggtgggggtgggagatgat

SEQ ID NO: 60857 - DNA, 201 bp, Homo sapiens
aaacagctgggatgatcggtgtccaggagatgcgggatgccttcaaggaggtgagttaacagtgtcatggtgctggtgatggtagaggcagaccctctgakgtctgcctgtaattagccaatgccatggacagcacccaccaaccaggcccccacctttttttttccagccatggtgggatcaataaatagggaagaaaaa

SEQ ID NO: 60858 - DNA, 201 bp, Homo sapiens
gcagtggacatcaagtgacatctggagaaggtggggtgggggtgggagatgatcctcaggccaaccaaaggcaagggaaggtcaggatgacctcaagaccygggtgggcagcaagatcgtcttgagccacagcaaagtcaggtgcaacctgcattccttccagggttcaccattcactatccacgtggcctcaggtatgtt

SEQ ID NO: 60859 - DNA, 201 bp, Homo sapiens
tcctcaggccaaccaaaggcaagggaaggtcaggatgacctcaagacccgggtgggcagcaagatcgtcttgagccacagcaaagtcaggtgcaacctgcrttccttccagggttcaccattcactatccacgtggcctcaggtatgttggtgaccctcgctggcgtaagtttccttatctgtaaagtgacacttatccct

SEQ ID NO: 60860 - DNA, 201 bp, Homo sapiens
agacccgggtgggcagcaagatcgtcttgagccacagcaaagtcaggtgcaacctgcattccttccagggttcaccattcactatccacgtggcctcaggyatgttggtgaccctcgctggcgtaagtttccttatctgtaaagtgacacttatccctccaggatggttgagatgatgaaatctcatagtgacaatcacag

SEQ ID NO: 60861 - DNA, 201 bp, Homo sapiens
acgaatggagatggggagatcaccctggtggagctacagcaggccatgcagagactcctgggggagcggctcaccccccgggagatctctgaggttgtccrggaggctgatgttaatggagacggcacagttgactttgaaggtgacattgacggggcgtggtggggagcgggggcagccaccgcaggaatccacttccaa

SEQ ID NO: 60862 - DNA, 201 bp, Homo sapiens
gctgatataatctatttctgcttctattcagtttgacacgaatggagatggggagatcaccctggtggagctacagcaggccatgcagagactcctggggragcggctcaccccccgggagatctctgaggttgtccgggaggctgatgttaatggagacggcacagttgactttgaaggtgacattgacggggcgtggtg

SEQ ID NO: 60863 - DNA, 201 bp, Homo sapiens
tccacgtggcctcaggtatgttggtgaccctcgctggcgtaagtttccttatctgtaaagtgacacttatccctccaggatggttgagatgatgaaatctsatagtgacaatcacaggttttttgggttttgttttttagatggagtctcactccgtcacccaggctgcactacagtggtgcaaccttggctcactgcaac

SEQ ID NO: 60864 - DNA, 201 bp, Homo sapiens
tcctctccaagtttgagaatggaagcgggtggcaggttttggaagcatttgttctgtccctttcttcccaggctattcatttcaaagagctgggtgtcgcycacttctggtggctccgaggaacacctcagccaaggccctttccttcccatgctcaggacgcccttccgccttgcccattccttgttagtttgcagggca

SEQ ID NO: 60865 - DNA, 201 bp, Homo sapiens
actcctctccaagtttgagaatggaagcgggtggcaggttttggaagcatttgttctgtccctttcttcccaggctattcatttcaaagagctgggtgtcsctcacttctggtggctccgaggaacacctcagccaaggccctttccttcccatgctcaggacgcccttccgccttgcccattccttgttagtttgcaggg

SEQ ID NO: 60866 - DNA, 201 bp, Homo sapiens
agagtttgtgaagatgatgtctcgctgaggaggtcctggaagctccagaccctctccacctggtcaacatggagcaagcgcttgtggagaaccaaagcccmaaagccccagatccccttaaagcagagagggagggcaggcgggagggagggcattggcatgcggcgctgtgcatggggtgagacccagagcggtatcttt

SEQ ID NO: 60867 - DNA, 201 bp, Homo sapiens
gggagggcaggcgggagggagggcattggcatgcggcgctgtgcatggggtgagacccagagcggtatctttgccaggatgggggcgtctgcagaactagrttaagaaggaagagtctgtggatggaaataggaagcgtgggagggtccagttgccacccccaaaaattccaatgattcttgacatcttttcacttcacgt

SEQ ID NO: 60868 - DNA, 201 bp, Homo sapiens
gttcatctcttgtaaggatctggggaatctcatgaggacgatgggttacatgcccacggagatggaactgattgagctcggccagcaaatccgcatgaacygtgagtccagggaatgggagggatggccggggttagggaagggatcagggcagaattgggaaggatgtagaggttaagagtagagttcggggtggagagg

SEQ ID NO: 60869 - DNA, 201 bp, Homo sapiens
ttaagtaatttcccagggatcaccagcagtgcctgccacataggaagggctcaaaaaataatgttgggggcttttacaacgagatgccttactggggattyttttttttctttgcagagtttgtgaagatgatgtctcgctgaggaggtcctggaagctccagaccctctccacctggtcaacatggagcaagcgcttgtg

SEQ ID NO: 60870 - DNA, 201 bp, Homo sapiens
atccgcatgaactgtgagtccagggaatgggagggatggccggggttagggaagggatcagggcagaattgggaaggatgtagaggttaagagtagagttsggggtggagaggaggatgagagggactagaagtctggaagaaaacaggtcagattcgactcaggaaggcagcatttgaagtggttaaaagcttttagaga

SEQ ID NO: 60871 - DNA, 201 bp, Homo sapiens
cttgggagaacaaggagaccctttggagaatgggtgaccctctctccaaattccctctcatctgcattcctttccaggaaagaccactgggacaagatgarattgaaggtaacaccgtcttccccagttgcttccacgttgccatccacccacctgacctgccctcagtccctttgtgcatttctgtataaattccattac

SEQ ID NO: 60872 - DNA, 201 bp, Homo sapiens
cactgggacaagatgagattgaaggtaacaccgtcttccccagttgcttccacgttgccatccacccacctgacctgccctcagtccctttgtgcatttcygtataaattccattacatggaatttttacaatccctctctcttcccactcaactgtaattttgtagaactctttctcgtggcagttgaaggacttcccaa

SEQ ID NO: 60873 - DNA, 201 bp, Homo sapiens
aaaaaaaaaaaaaaaaaagctattgggtttgcttctgggcatgtaacgaactaaacaaggttgaattcaaggtaatgatagtattcatatctgaaaaaaawttgtatgctcatttaattcatgctcctctttgtacaggtctacagaggaggagaaacatcttaaccaactgtctgaaagtcacacaggcagttacttcca

SEQ ID NO: 60874 - DNA, 201 bp, Homo sapiens
cacctcctaaccacccacctgcctgtttcaccagctcctccccggcctcctgtttctgacctggctgcacacatgcctggcccaccatgacccctccctcrgggggcacccccacagtcacggtaccccacactgctactcggctgaggaactgcccctcggccaggcccccccacacctgctggctcgaggtgccaagtg

SEQ ID NO: 60875 - DNA, 201 bp, Homo sapiens
ttctcacctgtcaagtgggcgtggccacctgagctccctccctccggccctcctgacctggacggctgagctgctgcttgcggctggccgtgccctgcctsccactgtcctaggtggccagggtcccctggggaaattctgggcccgtcacctgagctcctgcagaagtggggctgggtgatgaagtggaagggaggctcc

SEQ ID NO: 60876 - DNA, 201 bp, Homo sapiens
ggctccccacacctggggcctttgccttccacaccgagttcatccacgtccccgtcggctgcacctgcgtgctgccccgttcagtgtgaccgccgaggccrtggggcccctagactggacacgtgtgctccccagagggcaccccctatttatgtgtatttattgttatttatatgcctcccccaacactacccttggggt

SEQ ID NO: 60877 - DNA, 201 bp, Homo sapiens
gctcccgcgacggctcggggctccccacacctggggcctttgccttccacaccgagttcatccacgtccccgtcggctgcacctgcgtgctgccccgttcrgtgtgaccgccgaggccgtggggcccctagactggacacgtgtgctccccagagggcaccccctatttatgtgtatttattgttatttatatgcctcccc

SEQ ID NO: 60878 - DNA, 201 bp, Homo sapiens; identical to SEQ ID NO: 30106

SEQ ID NO: 60879 - DNA, 201 bp, Homo sapiens
gccctcctgacctggacggctgagctgctgcttgcggctggccgtgccctgcctcccactgtcctaggtggccagggtcccctggggaaattctgggcccktcacctgagctcctgcagaagtggggctgggtgatgaagtggaagggaggctcctagaggcctccggaccctgctctgtgctcttggagggccctgggga

SEQ ID NO: 60880 - DNA, 201 bp, Homo sapiens
cagtgcaactgaggtgcatcatcccagtctaccgtggaaagctttgcagtttggaggcagaaaataatgtacaggcctgggatgctctgcggtggggaccsggggcatctggttgtacccgctccccggctccaagctgtctgactcccaccgaggctgaggacctggagtcagagtgggtcttgtcagcaggtgataggc

SEQ ID NO: 60881 - DNA, 201 bp, Homo sapiens
gtttggaggcagaaaataatgtacaggcctgggatgctctgcggtggggacccggggcatctggttgtacccgctccccggctccaagctgtctgactccyaccgaggctgaggacctggagtcagagtgggtcttgtcagcaggtgataggcacgaatcaaaaccttatccacaaggacaggcccccaccctgtgtgtgg

SEQ ID NO: 60882 - DNA, 201 bp, Homo sapiens
cccagagctgagggtgctcagtgtggatggatgtttggctcagcaaggtctcagcaaccgggtgacagatggaatacaagggaagcaggaatcttctcccragaaccatgcaccccccattcccagagatcagggtgaacagtgccccacctctgacagtctggaggtgtcgtcccaagaggcaccagctggtcactgggt

SEQ ID NO: 60883 - DNA, 201 bp, Homo sapiens
agctagcacagcctgctgggcagggatctgtggcttttggagtacattttatgtccacttgaggagtgagtagcattggcagtgggggcattgcttgccakggctatcccctggcaggggctgggcaatcaagacagggagggcttgggggactcctgggtttcccttcgggcaggcacattctgcaacaagcccagaatg

SEQ ID NO: 60884 - DNA, 201 bp, Homo sapiens
ttgtgcctgggacgccatgtcaatatttgcggtgctggattagtcagggctctacctctgacccggcgccagctgggctggcttccattccctccaggtgkgtacgggcctgggagtggctcctgtggggtccggttgcttttgggcaaggaggggcagtacaagggatgctggtcctacaagtgagatcctgagtgcccg

SEQ ID NO: 60885 - DNA, 201 bp, Homo sapiens
gggtacgggcctgggagtggctcctgtggggtccggttgcttttgggcaaggaggggcagtacaagggatgctggtcctacaagtgagatcctgagtgccygtcttatcctgacaatttgtctcatgcatatagtcatatcacttcatttccctgagcctcagtctcctcacctgtaaaatgggaacaataatggctaatg

SEQ ID NO: 60886 - DNA, 201 bp, Homo sapiens
ccgtcttatcctgacaatttgtctcatgcatatagtcatatcacttcatttccctgagcctcagtctcctcacctgtaaaatgggaacaataatggctaaygcaggccaatgtctagcacacagaaggtttccagtacattacagctattgtcacattattactattactgatactattattatcatcattacaatgatta

SEQ ID NO: 60887 - DNA, 201 bp, Homo sapiens
gaatctgttctgccttttcctttgtctgcaactgaagattgtccctttggtctggtcctcattctcgtacccctatctgtttcttatttaggggagttagragctttacatcatatcttacagatttctgtaaaatcaggaacaaaagggctgaggatgagcatggagactctttttgcagcatagagtcgcagggagccg

SEQ ID NO: 60888 - DNA, 201 bp, Homo sapiens
aggccccggcccagttaactcaccacccctgcagggtgagccagaacgtgcctcgctgccacaggattggctgttacctctcccgagaccggcccggcttyctccctccctccctccctccctccctttgtttaggtctgtgctcctctgcttcccccagagacgcctcccctgctgactgctgtagctagccttgcccca

SEQ ID NO: 60889 - DNA, 201 bp, Homo sapiens
gatggggtttcaccgtgttggccaggctagtctcgaacccctgacctcagagaaaccacccaccttggcctcccaaagtgctggaattacaggtatgagcyaccacgcccagccttctctctccatttttggcaaatcaaattcatctgtctcagactcctcatatacacccagattagagggaaatttaatctccctcct

SEQ ID NO: 60890 - DNA, 201 bp, Homo sapiens
gcgagacccccatctccacaaaaaaaaaaaaaaaaattaaaaagtggctgggcgtggtgactcacgtctgtagtcccagttacttgggaggctgaggtggraggattgcttgagcccagaaggtcaaggctgtagtgagctatgatcatgtcactgcactccagcctgggtgacacagcaagattctgtctctaaacctat

SEQ ID NO: 60891 - DNA, 201 bp, Homo sapiens
gacatagcctaaggtattgaccatgcctctctattggtcattatttcacttccaaatttttgccactataaataatatgatgacaaaaatcttcatatgtwattctttgctcggggttcttagaactagaataaatggatgaaggcgtattcccacttttattgcttttttcacatttagccaattttccttctgaaaggt

SEQ ID NO: 60892 - DNA, 201 bp, Homo sapiens
aggctgggctccaggtggcatttcccactcttgtccggtgctggatggctgtcggcatctctgtggtcccatgtcctgcacacacaaccgtagtttccacragcgctctgcagacctcccgcctgccgggctgcctgcgcttctcaccaagcacacctcacagataggggcctcctgaaccttttaaagtggttccctccc

SEQ ID NO: 60893 - DNA, 201 bp, Homo sapiens
actcaatcttgctctgaacaagattctttaatctgctatgatattgagtataagaatcagctctgtagcttggtaacaaaaattcacactgagctgtgttygcattggtttagctctcagacagactcctgattaaacaaacagaagttctgaaagggttatgttatggatgcccaggggatgaggaggaaagggaggact

SEQ ID NO: 60894 - DNA, 201 bp, Homo sapiens
ttaatgaatgagtgaatggatgatgccctcactcttgccctcctgtgcatcgtgtctctccgctttgctgcaggatggcatttcaggacttcaaggcccamtttgataaagtggagatctgcaacctcactcccgatgccctggaggaagacgcgatccacaaatgggaggtgacggtccatcagggaagctgggttcgcg

SEQ ID NO: 60895 - DNA, 201 bp, Homo sapiens
atgcaggacactcacacgtagacaatgctcccaagtgcacatgcaaccagcatacatgtggagcatgcacaagcacacacgtgtaccacacctgggcacayacaacaaggcaagtcacaggcaccttgcacatgtgggcatgtgggccgtcagcatacacaccactcccaggcatctaacccaggcccaccgcctagctgc

SEQ ID NO: 60896 - DNA, 201 bp, Homo sapiens
ccactgacatggtcctggtttgcattgtccttctgggctcagctcagagccacctgcaaactcctgcgctagccaaggtggaggaggaagaagagcagtgygcttcctacagatgagaggggtccgcacaggcaagccaagccaggaccccagaactgagcagctgccccccaccttcactccctttccagccaccacgga

SEQ ID NO: 60897 - DNA, 201 bp, Homo sapiens
cttacttaggtgggtgacctcagacaattttcttagtgacattaaacctttctacactcgtctgaaaaaaggagagactgacagttccctgcaggcttccygtagagctaaatggcatcacacacaggagccggcacagagccaggcaccgagtaggcattccttgaccttccaccccagacagtgtcaccttctcctgac

SEQ ID NO: 60898 - DNA, 201 bp, Homo sapiens
cttagtgacattaaacctttctacactcgtctgaaaaaaggagagactgacagttccctgcaggcttcccgtagagctaaatggcatcacacacaggagcyggcacagagccaggcaccgagtaggcattccttgaccttccaccccagacagtgtcaccttctcctgactcacaggccaccactcagggccagcccgttt

SEQ ID NO: 60899 - DNA, 201 bp, Homo sapiens
tgtgcatcgtgtctctccgctttgctgcaggatggcatttcaggacttcaaggcccactttgataaagtggagatctgcaacctcactcccgatgccctgraggaagacgcgatccacaaatgggaggtgacggtccatcagggaagctgggttcgcggctccacggctgggggctgccgcaatttcctgggtaggtaggc

SEQ ID NO: 60900 - DNA, 201 bp, Homo sapiens
gcaccgagtaggcattccttgaccttccaccccagacagtgtcaccttctcctgactcacaggccaccactcagggccagcccgtttcttctgtccctgargcctgcaatctgataagcagaggtactctcaagccctgtcaccaatagcacagaagtgtttcaaaggcaaagagagtgagcaggtcacatgtagctcagg

SEQ ID NO: 60901 - DNA, 201 bp, Homo sapiens
aacagttctggcagcacagtgagtggctggacgtggtgatcgatgaccgcctgcccaccttcagggaccgcttggttttcctccactctgccgaccacaaygagttctggagcgccttgctggaaaaagcctacgccaagtgagtgacagcttccccagctcaggcagcctcccgacaggagtctctacactagtctttgt

SEQ ID NO: 60902 - DNA, 201 bp, Homo sapiens
gggaccgcttggttttcctccactctgccgaccacaacgagttctggagcgccttgctggaaaaagcctacgccaagtgagtgacagcttccccagctcargcagcctcccgacaggagtctctacactagtctttgtagtgagcatctaagggctgggaaaaaatcagggctctgggtttgcaggtgaggctcggcagga

SEQ ID NO: 60903 - DNA, 201 bp, Homo sapiens
gctggttcccggggcgtgtggggccagagctggcttgtgcagacatgtgaaggagtggcctgtctactatcctcccgggctctgactcaggatcctgtccygattctgaggtgccccttcttcctcccctttcagccctcaggcccaccttgcatcaaggttgattctcaagaaagacttttacaacagcactctaacttt

SEQ ID NO: 60904 - DNA, 201 bp, Homo sapiens
ccggaacccttggggccaggttgagtggaacgggtcgtggagcgacaggtcagtcaccctatcctgcctctctggctggttcccggggcgtgtggggccaragctggcttgtgcagacatgtgaaggagtggcctgtctactatcctcccgggctctgactcaggatcctgtcccgattctgaggtgccccttcttcctcc

SEQ ID NO: 60905 - DNA, 201 bp, Homo sapiens
gagaaaatagcttttgaatcagtagactgagtaaagaggattgctgccaccaatgtggacgagcattattcagtttgctaaagatccaaataaaagaaaaygacaaaggaagggtgaattccctttccctacttgaactgggacatccatattcccctgctcttggacattggagctcctcgttctcaaacctttggactc

SEQ ID NO: 60906 - DNA, 201 bp, Homo sapiens
cccatttcccccagccccaggcaaccactcatctactttctctatagattctatttacatattctgaatattttatataaaaggaatcataggccgggtgyggtggctcacgcctgtaatcccagcactttgggaggccgagacaggcggatcacctaggtcaggagttcaagaccagcctggtcaacatggtgaaacccc

SEQ ID NO: 60907 - DNA, 201 bp, Homo sapiens
ggaaagaaggaagggagagagggaggaagggagggagggaggatggaaggaaggaaggaaggaaggaaggaaggaaggaaggaaggaaggaaggaaggaarggagaaaatatactattccaggatttgaaacccgcatatacagagggctgacttggtataggcagattccacagggcttactgtgggacttgagtatgca

SEQ ID NO: 60908 - DNA, 201 bp, Homo sapiens
gctgggaagttcagtaggtcagtcaataaatcttgaaaatgcaagataatttaaagcaaatggagccaccacggagataccattatctgtaattaagctgwgtctgggttggggctgcagggagatttctaaccaccctcccaagtactgccgaaccacttgggtggcagctatgaaatgtctgctcgcccagcccgtgct

SEQ ID NO: 60909 - DNA, 201 bp, Homo sapiens
atgagggcaggtgcatttccacactgcctggtaaccctagaaaaaaatgtcatcagatctgtgtgacatatggtcctaaaccatgctaaagccacattttatcatggaataacagctaaatgcctcagaagaacattaacggcattgcacggtgaatccttatggagcatacatttaaaactataagtgatgttttggcaa

SEQ ID NO: 60910 - DNA, 201 bp, Homo sapiens
caacctcccttcctgttcccagcagaccacacacaagctcatacacatgcatacatgtgctcaaacacacacgtgtgtagaagcacttgcaaacacatgcrtgcacacatacatgcacacacatgcacacatgtgagcaaacacatgctttcacacatgcaatgtataaataaaccacaaacagtgcacatacctgtcatg

SEQ ID NO: 60911 - DNA, 201 bp, Homo sapiens
tggggttcctgaattatgaaaggggtcacctggaggggtgatatctaaacctaggggctgtctgatggtagtatattaggcactgcaataaacaggcaagrcagggagattaggggaccacaggatcggatggagaaaatgggggctcatgtgactgcttaaagcacagcaggaaggtggctgagcgcagccctgggcggg

SEQ ID NO: 60912 - DNA, 201 bp, Homo sapiens
gtgctaaatgactagttaatgggtgcagcacaccaacatggcacaggtatacatatgtaacaaacctgcacgttgtgcacatgtaccctaaaacttaaagwataataaataaataaataaataaataaataaataaataaataaataaaaaataaaataaaataaaataaaaataaataaataaaacacaagttttaacca

SEQ ID NO: 60913 - DNA, 201 bp, Homo sapiens
tgctaaatgactagttaatgggtgcagcacaccaacatggcacaggtatacatatgtaacaaacctgcacgttgtgcacatgtaccctaaaacttaaagtataataaataaataaataaataaataaataaataaataaataaataaaaaataaaataaaataaaataaaaataaataaataaaacacaagttttaaccaa

SEQ ID NO: 60914 - DNA, 201 bp, Homo sapiens
gagcccaaagaagcttggaataggcccagacgctttgttttttagttctgttttgctttagacagagtctcactcttttaccctggctggagtgcagtggyataagcctagctcactgcagcctcaaactcatgggctcaagagatcctatcacctcagcttcctgagtagccgggactataggcacatgccatcatgctt

SEQ ID NO: 60915 - DNA, 201 bp, Homo sapiens
ctaaatgactagttaatgggtgcagcacaccaacatggcacaggtatacatatgtaacaaacctgcacgttgtgcacatgtaccctaaaacttaaagtataataaataaataaataaataaataaataaataaataaataaataaaaaataaaataaaataaaataaaaataaataaataaaacacaagttttaaccaagc

SEQ ID NO: 60916 - DNA, 201 bp, Homo sapiens
tgaagtgggtagacttttaattgtattttaagaaatctaatcaatgaaaagaaaaccagagaggcagggagatgttttttactgtggactcaggggaacayattacatctcccctatgttatgtggtgtggaaggggtgacatgggggtggctttaccctcgtccaagggctggaggactcgcaagaggccctgagatact

SEQ ID NO: 60917 - DNA, 201 bp, Homo sapiens
aatgactagttaatgggtgcagcacaccaacatggcacaggtatacatatgtaacaaacctgcacgttgtgcacatgtaccctaaaacttaaagtataataaataaataaataaataaataaataaataaataaataaataaaaaataaaataaaataaaataaaaataaataaataaaacacaagttttaaccaagcatg

SEQ ID NO: 60918 - DNA, 201 bp, Homo sapiens
cctcctggagaccaagatgtgtgtgttctagtctgtgctcttctagtccacaaggacctggcatgggagtgaggtgggtgcttggtataaagttctgttcsatgtcatcttcctctgtgctactgtcaactgaaataacaaacacagagacactctctaaaagaaaagctatttatttagggataaagcactgcaatggga

SEQ ID NO: 60919 - DNA, 201 bp, Homo sapiens
atgactagttaatgggtgcagcacaccaacatggcacaggtatacatatgtaacaaacctgcacgttgtgcacatgtaccctaaaacttaaagtataataaataaataaataaataaataaataaataaataaataaataaaaaataaaataaaataaaataaaaataaataaataaaacacaagttttaaccaagcatgg

SEQ ID NO: 60920 - DNA, 201 bp, Homo sapiens
agaacttctactagggctatgcagatggggaaatgtgaggttcaaggtctcgcacagagtccccactggggtactgcctagtggaactgtgggaaggcggycatcatcctccagacccaagaatggtggatccactggcagcttgcaccttgagcctggaaaagccacaggtactcaacaacccatgacagcagccaaagt

SEQ ID NO: 60921 - DNA, 201 bp, Homo sapiens
tgggaagaggtgggaaaaatccttcactcctctgcaggccccggcccagttaactcaccacccctgcagggtgagccagaacgtgcctcgctgccacaggwttggctgttacctctcccgagaccggcccggcttcctccctccctccctccctccctccctttgtttaggtctgtgctcctctgcttcccccagagacgc

SEQ ID NO: 60922 - DNA, 201 bp, Homo sapiens
acttccctcatgcttttcccttctaggtaagcttccgaggccagagaatcgagctcatccgaatccggaacccttggggccaggttgagtggaacgggtcrtggagcgacaggtcagtcaccctatcctgcctctctggctggttcccggggcgtgtggggccagagctggcttgtgcagacatgtgaaggagtggcctgt

SEQ ID NO: 60923 - DNA, 201 bp, Homo sapiens
acaccactcccaggcatctaacccaggcccaccgcctagctgccccttccacacatgcgtccgcagaaccccctgtgactggcacgtgtgcacaccaattmccagaaacactgacccacagaggagtcggtcacacatccagacacctccccaatttatacccgatggctaatttgtgtttacttggagagtttctgagtt

SEQ ID NO: 60924 - DNA, 201 bp, Homo sapiens
aacccagctctctcctgtcctctacagcaagcccgccagttcctcttctcccttactctctcgactccactcagctatgagtgtgccccaccaccccactmaccctgatcttgccagggacgccaccgactctcactttgctcgatcagattatcttgatccatcaggagcccttgacgtgctggattgcgggggaccaca

SEQ ID NO: 60925 - DNA, 201 bp, Homo sapiens
tgtgaccgggccaggcatgtagctgggtctgatccagcaggggaggcttgacttagacggtgggtgtgactctgctctttccatgttttagaccagaagtrctgcagaatctgaggcccggacgccgtttggtcttattaagggtcatgcctacagtgtaacgggaattgaccaggtaggcgacttgaactccaactgcag

SEQ ID NO: 60926 - DNA, 201 bp, Homo sapiens
ctccagcctgggtgacacagcaagattctgtctctaaacctatatatatttggaatccactttgtgggggaaggattatataaagaaagaaatggagaagmtgggtgggtagggagtatgtttagtccaaggccccagcctgtggtacatgcattactcagctccttgaagcccacagaggtcacagagctcacagctggg

SEQ ID NO: 60927 - DNA, 201 bp, Homo sapiens
gcagcagaaggggctggaggttgtgaccgggccaggcatgtagctgggtctgatccagcaggggaggcttgacttagacggtgggtgtgactctgctcttyccatgttttagaccagaagtgctgcagaatctgaggcccggacgccgtttggtcttattaagggtcatgcctacagtgtaacgggaattgaccaggtagg

SEQ ID NO: 60928 - DNA, 201 bp, Homo sapiens
ctggaattagtaccatcacagtaattgctgcatatgagcaggaggtagaaaccagagtttgagaggctacctgaggtcaggctagtggaaagaaggtctgrtgcagacggtgggagaagccgggcagaggaaactcggaaattcacagcaggaagctccacaaagaagagcgtccatgtgagtgatccattgccctgcccc

SEQ ID NO: 60929 - DNA, 201 bp, Homo sapiens
gagactcaaccaagagtccatgaattgtgtccgaaaagccaagaggaacttccctaggaaacccctccctttcttgcccattgcagtgccctgacaaagaygaacacctgaacaaagacttcttcagataccacgcttctcgggccagaagcaagacgttcatcaacctgagagaagtctccgaccggttcaagctgcccc

SEQ ID NO: 60930 - DNA, 201 bp, Homo sapiens
gcacctggggcagcagaaggggctggaggttgtgaccgggccaggcatgtagctgggtctgatccagcaggggaggcttgacttagacggtgggtgtgackctgctctttccatgttttagaccagaagtgctgcagaatctgaggcccggacgccgtttggtcttattaagggtcatgcctacagtgtaacgggaattga

SEQ ID NO: 60931 - DNA, 201 bp, Homo sapiens
actagttaatgggtgcagcacaccaacatggcacaggtatacatatgtaacaaacctgcacgttgtgcacatgtaccctaaaacttaaagtataataaataaataaataaataaataaataaataaataaataaataaaaaataaaataaaataaaataaaaataaataaataaaacacaagttttaaccaagcatggtgg

SEQ ID NO: 60932 - DNA, 201 bp, Homo sapiens
cgcctgagagtcccccgcacactcgcccctgcaccacagattcacactctcacgctgcattcacaccaagggcagcagtcccactgggtctggggaccccmgctttgaggagtgaaacagtggcttcctcttctgagccctctcctcagctgcctgggagctccctcaaaggtgcagactcacctcggggctcggatacag

SEQ ID NO: 60933 - DNA, 201 bp, Homo sapiens
aatttcctttctttcccaattctccttcagtcctgtgttagtcaggattcttcagagaaatagaatcactagggaaccaaatatatatacatacaattaaacacacacacacctatctatctatctatctatctatctatctatctatctatctatctatctatctatctatctacatcacacagttgacccttgagcaac

SEQ ID NO: 60934 - DNA, 201 bp, Homo sapiens
atttcctttctttcccaattctccttcagtcctgtgttagtcaggattcttcagagaaatagaatcactagggaaccaaatatatatacatacaattaaacacacacacacctatctatctatctatctatctatctatctatctatctatctatctatctatctatctatctacatcacacagttgacccttgagcaaca

SEQ ID NO: 60935 - DNA, 201 bp, Homo sapiens
gatgcttcttttttatttttaaaaagtcgtatatgacatatcgataaataatcgtatatgataaaatgtatatgacataaattttaccatttttaagtgtkcagttgagtagcattaagtacatccatgttgttgtgcagctatcaccacgatctatctccagcactttttcatcttgcaaaactgaaattctgtccctat

SEQ ID NO: 60936 - DNA, 201 bp, Homo sapiens
ttcccaattctccttcagtcctgtgttagtcaggattcttcagagaaatagaatcactagggaaccaaatatatatacatacaattaaacacacacacacctatctatctatctatctatctatctatctatctatctatctatctatctatctatctatctacatcacacagttgacccttgagcaacacaggcttgaac

SEQ ID NO: 60937 - DNA, 201 bp, Homo sapiens
tcccaattctccttcagtcctgtgttagtcaggattcttcagagaaatagaatcactagggaaccaaatatatatacatacaattaaacacacacacacctatctatctatctatctatctatctatctatctatctatctatctatctatctatctatctacatcacacagttgacccttgagcaacacaggcttgaact

SEQ ID NO: 60938 - DNA, 201 bp, Homo sapiens
ccaattctccttcagtcctgtgttagtcaggattcttcagagaaatagaatcactagggaaccaaatatatatacatacaattaaacacacacacacctatctatctatctatctatctatctatctatctatctatctatctatctatctatctatctacatcacacagttgacccttgagcaacacaggcttgaactta

SEQ ID NO: 60939 - DNA, 201 bp, Homo sapiens
gcatagagtcgcagggagccggggggtagcgggccatagggaaatcacaagcattgccaggttccctgcagacctctgtggcttgggcatcatttgcagtrggactcagcattacacggtgcacgtctcagcagcccgtgggaccgtggggctggacggccctcctcctcagcaccaccttcttgtcaaacacagctgtgc

SEQ ID NO: 60940 - DNA, 201 bp, Homo sapiens
aaggtgatgggtggtgttaaatcatgcactctgtgcgtggagcccttcctcctggaatcctgactctgaagccctgtgtagcctctttccattcttcaccrgctctaggatgtacctcctgcaactctcttctctccccttacgtatgaattccccccttcttctgaatcattccccttagcactccaacactatcatttc

SEQ ID NO: 60941 - DNA, 201 bp, Homo sapiens
gtagaaatcaagaaagtgactgagagccaaggctggaataaaatttgtcttccactcatgcagcctccatgggtgatgggaggggcaggcgccatcccgaytccctgacttcgctgtgctgctggtgacatgtgagtagggttgaaggcaccgcatggccagcctgtcaggccaattatctgggtgtgagccacttaggat

SEQ ID NO: 60942 - DNA, 201 bp, Homo sapiens
aattctccttcagtcctgtgttagtcaggattcttcagagaaatagaatcactagggaaccaaatatatatacatacaattaaacacacacacacctatctatctatctatctatctatctatctatctatctatctatctatctatctatctatctacatcacacagttgacccttgagcaacacaggcttgaacttata

SEQ ID NO: 60943 - DNA, 201 bp, Homo sapiens
attctccttcagtcctgtgttagtcaggattcttcagagaaatagaatcactagggaaccaaatatatatacatacaattaaacacacacacacctatctatctatctatctatctatctatctatctatctatctatctatctatctatctatctacatcacacagttgacccttgagcaacacaggcttgaacttatat

SEQ ID NO: 60944 - DNA, 201 bp, Homo sapiens
cacagaggtagaaatcaagaaagtgactgagagccaaggctggaataaaatttgtcttccactcatgcagcctccatgggtgatgggaggggcaggcgccrtcccgactccctgacttcgctgtgctgctggtgacatgtgagtagggttgaaggcaccgcatggccagcctgtcaggccaattatctgggtgtgagccac

SEQ ID NO: 60945 - DNA, 201 bp, Homo sapiens
agaggaaactcggaaattcacagcaggaagctccacaaagaagagcgtccatgtgagtgatccattgccctgcccctcttgaaggagcagccccaacaccwgggctgagcctgcccaaggtgatgggtggtgttaaatcatgcactctgtgcgtggagcccttcctcctggaatcctgactctgaagccctgtgtagcctc

SEQ ID NO: 60946 - DNA, 201 bp, Homo sapiens
ttctccttcagtcctgtgttagtcaggattcttcagagaaatagaatcactagggaaccaaatatatatacatacaattaaacacacacacacctatctatctatctatctatctatctatctatctatctatctatctatctatctatctatctacatcacacagttgacccttgagcaacacaggcttgaacttatatg

SEQ ID NO: 60947 - DNA, 201 bp, Homo sapiens
cacagctaccaggtcaccagacatggtgcagccgctgctgtattagccagaccccagcgtgagggcagggcacacaggcctgtgctttccaggctgtcatkgtccccatggaggctctcgtcccaccatcctctgctctggccttggctgccgccttctgagaaccaagaagcattggcagagatgagctgagatgggttg

SEQ ID NO: 60948 - DNA, 201 bp, Homo sapiens
gaagttcagtaggtcagtcaataaatcttgaaaatgcaagataatttaaagcaaatggagccaccacggagataccattatctgtaattaagctgagtctrggttggggctgcagggagatttctaaccaccctcccaagtactgccgaaccacttgggtggcagctatgaaatgtctgctcgcccagcccgtgctgacac

SEQ ID NO: 60949 - DNA, 201 bp, Homo sapiens
ccctgactctctcctctctctcttgccacccttgcaggctaaatgggagctatgaagctctgaagggaggcagcgccatcgaggccatggaagacttcacygggggtgtggcagagaccttccaaactaaagaggcccccgagaacttctatgagattctagagaaggctttgaagagaggctccctgctgggctgcttca

SEQ ID NO: 60950 - DNA, 201 bp, Homo sapiens
caatggtaaaagtcccagtctgagggcaggagagacggatgtcccagctcaggcacccaggaagagagagtgaattcccccttcctctgcctttttgttcwggtcaggtcttcacagatgagatgaggcccacctacactggggagggcaatctgttttactcaatcaacttaaatttcatgtcacccagaagcacccttg

SEQ ID NO: 60951 - DNA, 201 bp, Homo sapiens
gtgtgtccccacagctcctccagctctggtcccttgggaagtggaccaggtgactaagaaccagggatgtttgtgtgggtgcgtggcagggcctgcctgargctgttgctcgtccgctgcttgttgggctcctgaagccctttcctgccacatccatggcccctgagcttctggggaaatctgaagctagtctagaacttg

SEQ ID NO: 60952 - DNA, 201 bp, Homo sapiens
tctgccccttggtgagtgccccccacatcaggatgcaagcaaggcaacagaaactgtgtgccatctagtttctaaacataaaaaagatttattggggtcayttaaaaaggccaaaaatggttggcagaacagctcaccaaaaaaaaactgtatagatggtgttatggttagttttatgtgtcaacttgattgggccaaggg

SEQ ID NO: 60953 - DNA, 201 bp, Homo sapiens
tcccaggcatctaacccaggcccaccgcctagctgccccttccacacatgcgtccgcagaaccccctgtgactggcacgtgtgcacaccaattcccagaarcactgacccacagaggagtcggtcacacatccagacacctccccaatttatacccgatggctaatttgtgtttacttggagagtttctgagttttttcct

SEQ ID NO: 60954 - DNA, 201 bp, Homo sapiens
tccagacacctccccaatttatacccgatggctaatttgtgtttacttggagagtttctgagttttttccttttgtatttttctcctcattgggtgcgatytggtttaaaacaaaaacaaaaacagacctctcctgaacaaaacaaccaattgcaagataggagctgggaggcggtggcagctgcaggcacagttggtacg

SEQ ID NO: 60955 - DNA, 201 bp, Homo sapiens
aatcactgatgcagcaagatgctcaggatgacacagcaaagctgtaaataaatggctcccaaaaccactgtgcctaccctcctctttcaacccttttcttyttactcttagaggttaccttaggatcgctctcaggccaactgaaccagaaggaacgggtaggaggtgggtcactgcaggatacacagagaaactaccatg

SEQ ID NO: 60956 - DNA, 201 bp, Homo sapiens
ctgccagtttgctcactctcccttgctcatgttgtcccgtggttcccatgacactcccccagactccaataagtacaaaactggccagttaccggggccaytgtagcaatgacgggggtgggagaccatgggtctgagtgtcagaggtatgggagaaggattccagggggtttcaatcaccctctccccagaggatcccag

SEQ ID NO: 60957 - DNA, 201 bp, Homo sapiens
gggacaaagggcactgtttccaagtccagtgggtgggacccaagcccacctctgccccttggtgagtgccccccacatcaggatgcaagcaaggcaacagmaactgtgtgccatctagtttctaaacataaaaaagatttattggggtcacttaaaaaggccaaaaatggttggcagaacagctcaccaaaaaaaaactgt

SEQ ID NO: 60958 - DNA, 201 bp, Homo sapiens
tcctccctgttctacagtgagaggccgcagatcccctttgtgtggaaacgaccaggggtgagtggggcgagcaggggaaggagcatagatgaggccgaggytcagcagcccccgcaggaagtggaaacaggggtgctggggaggggccggctacgctcagtgcaactgaggtgcatcatcccagtctaccgtggaaagctt

SEQ ID NO: 60959 - DNA, 201 bp, Homo sapiens
actgatcctgggggacacccagactccacacagcaccaccctgacttcaagggagctgttggttaggaggagagatccttgaggggcacaaggggaagagwaagaaagaattgaatgaaagaggaggacaagaagccaaaggtatcactctgccagactcaagctcagcaaagcccagcagcctgccttgcccactccatg

SEQ ID NO: 60960 - DNA, 201 bp, Homo sapiens
agtacttagaaggtgcagatgcacctggtcttctgtagccacccaccttttgagtgacatcctctgaatgcgtggggagtaaagaacactgaagggagacyctgcccttcctcctcactggagccaaggtgtgagacgccgttggactctttgggattctttagaatgttagctatttgtgttggctcctttgtcctcctt

SEQ ID NO: 60961 - DNA, 201 bp, Homo sapiens
ggatcttcaagccatgagaatactatccccagagacagaagcaaggatggtcttgcttctacctccaagtgggacataaaagtggcaaaatagaggggagkcatactgtggttaaattaatcctgaaatcagcaggacagaattaaagccatcaaataagaaccaaagatgcccacgcttgccctctgtcccacccaggtc

SEQ ID NO: 60962 - DNA, 201 bp, Homo sapiens
gcaacctctgcctcccaggttcaagtgatactcctgcctcagcctcccaagcagctgagagtacaggcatgcgccaccacgcccgactcattttgtatctktagtagagatggggtttcaccgtgttggccaggctagtctcgaacccctgacctcagagaaaccacccaccttggcctcccaaagtgctggaattacagg

SEQ ID NO: 60963 - DNA, 201 bp, Homo sapiens
cagataaactttgaattttgaagtacaggggactttgagttagggggttacaagagaggagcaaaaactgcaggaagaaagctgagttctggaattagtamcatcacagtaattgctgcatatgagcaggaggtagaaaccagagtttgagaggctacctgaggtcaggctagtggaaagaaggtctggtgcagacggtgg

SEQ ID NO: 60964 - DNA, 201 bp, Homo sapiens
tgacagtccagggaggatgttcatattctgtgggtggctctgttcatacagtgattcaggaacccaaacgccttctattgtgtggctctgccatcttctarggtcacgtcatcatctgcacatagccagcagaagagaagaataaaataaaacattgaaaaagacactctcactttctaaaaatcttgactcagaagtaaa

SEQ ID NO: 60965 - DNA, 201 bp, Homo sapiens
gtcatgtttcttttttgtggatcattttgtgcaagtttctttggctgttttttagcctccaaagccaactccacctgaccaggagacagaggaggagcagyggtttcgggctctgtttgaacaagtcgctggtgaggtaggacatgccccacttccatctccccaccaggctgagggcctggacctgcttcctagcaaagg

SEQ ID NO: 60966 - DNA, 201 bp, Homo sapiens
atgtgttacctcccatggtgatgtttataacccagtgatatggtgaaaagctttatctgtagttgtgagtaactccagtaagcagtgtgcatatgcataartgcgtgtgtgtttgtgtgtgtgtgtgtatttggagtgtcggaatccctgaaatattacctagcatgtaactataggattctctctgatggtcactgacca

SEQ ID NO: 60967 - DNA, 201 bp, Homo sapiens
tgcttattttcttatcattcatctgtgcatgggatgctaggatgaagaaagttcagtaatagttccatgagcacctttgaggactactctttaccattcaytctgctagatgctgaagatgcctaagacttggctcctgcctctagggagatccaagtctagagagaaacccatttttagattcatatggactaatttctt

SEQ ID NO: 60968 - DNA, 201 bp, Homo sapiens
tttgagacggagttttgttcttattgcccaggctggagtgcagtggtgcgatctcgtctcactgcaacctctgcctcccaggttcaagtgatactcctgcytcagcctcccaagcagctgagagtacaggcatgcgccaccacgcccgactcattttgtatctttagtagagatggggtttcaccgtgttggccaggctag

SEQ ID NO: 60969 - DNA, 201 bp, Homo sapiens
caggcagagcctgagggcacacaggctcaagggtgattgaggtgaacagcaggaatcctcacagacacctgaaataaggagaatattgggtctagaagacrtaaaagctgtttttgtttattgttgtgtttaaatccccaacatgtgcttattttcttatcattcatctgtgcatgggatgctaggatgaagaaagttcag

SEQ ID NO: 60970 - DNA, 201 bp, Homo sapiens
taagcacagagacacccatccctccccaaccccaccagtggaatcaggaatttacatctgtgatgagaggcaggagttagggatgcagcttcaaaaggtgrtctttaggccaggcacggtggctcatgcctgtaatcccagcactttgggaggccgaggcaggaggatcacctgaagtcaggagtttgagaccagcctggc

SEQ ID NO: 60971 - DNA, 201 bp, Homo sapiens
ccgaagagttgatgttacttgaatttttacacatccaaaatataatttatgccaaatgcatgaggataaaacattctgactgctacagtttctggttagtygataactagaagtcttttactttcactctctctcctctaaaacccttctcaaatgcattggcccttgtccctgctcccaggcagagcctgagggcacaca

SEQ ID NO: 60972 - DNA, 201 bp, Homo sapiens
gagaatcacttaaaacccaggaggcagaggttgcagtgagccgagatcatgccattgcactccagcctgtgccacagagtgagactccgtctaaaaaaaawggtggtttttttggttctgattcaactttgtaatcttttaaaatgcaccccctccccagtgcctaccactcaataggctgaatggtctccaacagatatg

SEQ ID NO: 60973 - DNA, 201 bp, Homo sapiens
attttgcttcctctcccccctacaaggaactcacctgccctgaacctttcaaattaaatgagcccctttaatggtgagccacaagccacatcttggactcygaagagttgatgttacttgaatttttacacatccaaaatataatttatgccaaatgcatgaggataaaacattctgactgctacagtttctggttagtcg

SEQ ID NO: 60974 - DNA, 201 bp, Homo sapiens
tcctaggtctccctagaagtcaaggagttaagttaacttctagggaatacaccatgcttctttgtaaagccaattgaacctcttttctttgtaaattagtsttaggtatttctttatagcagtacaagaacagcctaatacagaaaattggtacagaagagtggggcattgttataaagataactgaaaatgtggaagtga

SEQ ID NO: 60975 - DNA, 201 bp, Homo sapiens
cgttggactctttgggattctttagaatgttagctatttgtgttggctcctttgtcctccttcaccatccatagatgacttgcagattgctcactcaagcrggcatgtgatgtttctaggttagatcttctacgtattccacgtaacaacagaaacctctcatcatcttggtttgcttgattttgcttcctctccccccta

SEQ ID NO: 60976 - DNA, 201 bp, Homo sapiens
tagggtatctggaagaagaaatgtctaagcagcaaagcattcaggatgtgacctggctgcttctaacaacctatactcagatatgggagcaaagatatgasttaaagctggaatatatacatttaaaagggaagcagggcataaaaatttggaaaatttgcagcctggctatatagcagagaaagaaaaagctttttcgag

SEQ ID NO: 60977 - DNA, 201 bp, Homo sapiens
cctatgattttcttgataacatttcttttctctggcttatttattgtaagaatacagtatataatataaataattataaaacatgttaattggttctttaygttatcgataagacttctggtcaatggtaggctattcggagttcagctttagggaatacaagattttttgacaatgcaggagggttggcaccccaacccc

SEQ ID NO: 60978 - DNA, 201 bp, Homo sapiens
aagcctgcaggcacacagagtgcaagactgaatgaggcttggcagcctccacctagatttcagaggatgtatggaaaagcctgcatgcctaggcaaaagcytgctgcagggacagagccctcacagagaacttctactagggctatgcagatggggaaatgtgaggttcaaggtctcgcacagagtccccactggggtact

SEQ ID NO: 60979 - DNA, 201 bp, Homo sapiens
gataacttgcttcccgtcttccttccacaccacccagccagggcaagccctgggagatgcttcaggcttagttagaaaagctctgaaagcagggtgccccrgtggcctccctaggtccctgactctctcctctctctcttgccacccttgcaggctaaatgggagctatgaagctctgaagggaggcagcgccatcgaggc

SEQ ID NO: 60980 - DNA, 201 bp, Homo sapiens
ggtactgcctagtggaactgtgggaaggcggccatcatcctccagacccaagaatggtggatccactggcagcttgcaccttgagcctggaaaagccacaggtactcaacaacccatgacagcagccaaagtcacagggacagagcttcccaaggccttgggatcccaccctttgtaccagtgttccctggatgtaggaca

SEQ ID NO: 60981 - DNA, 201 bp, Homo sapiens
actcccattgtattttggaagtataaaatggaatttgtatatcttggaacttgattttgatttgacaggctcataggtgatgggacttgccttatctcagrtgagactttggactttggaattttgagttaatgctggaatgacttaagactttgggggttattgggaaggcataattatattttgcagtgtgagaaggac

SEQ ID NO: 60982 - DNA, 201 bp, Homo sapiens
taatgttagaatgtttcatcactccaacaagaaaccctttacccattaacagtgttaaccctgtacccatttcccccagccccaggcaaccactcatctaytttctctatagattctatttacatattctgaatattttatataaaaggaatcataggccgggtgcggtggctcacgcctgtaatcccagcactttgggag

SEQ ID NO: 60983 - DNA, 201 bp, Homo sapiens
acttgcttcatgtcactgctaaacatcctaggggagccccgtgcatagcccacgcacatggcctgcacctggggcagcagaaggggctggaggttgtgacygggccaggcatgtagctgggtctgatccagcaggggaggcttgacttagacggtgggtgtgactctgctctttccatgttttagaccagaagtgctgcag

SEQ ID NO: 60984 - DNA, 201 bp, Homo sapiens
cttctatgagattctagagaaggctttgaagagaggctccctgctgggctgcttcattgatgtaagttgctcatgggctcccattccaggcactatgctgrggctgcatagtgcattccaggcactatgctggggctgtaccaggtaccccagccacacccaaggaggggcataactcttgggggcagtgtttattcctgc

SEQ ID NO: 60985 - DNA, 201 bp, Homo sapiens
gggggtgtggcagagaccttccaaactaaagaggcccccgagaacttctatgagattctagagaaggctttgaagagaggctccctgctgggctgcttcaytgatgtaagttgctcatgggctcccattccaggcactatgctggggctgcatagtgcattccaggcactatgctggggctgtaccaggtaccccagccac

SEQ ID NO: 60986 - DNA, 201 bp, Homo sapiens
catgcatacatgtgctcaaacacacacgtgtgtagaagcacttgcaaacacatgcatgcacacatacatgcacacacatgcacacatgtgagcaaacacaygctttcacacatgcaatgtataaataaaccacaaacagtgcacatacctgtcatgcctgcctgtatgcacatgtatacacatgtgtgcgcacatgcattc

SEQ ID NO: 60987 - DNA, 201 bp, Homo sapiens
cctgccccctgcatcgcctgcggctttgatgggttgaccctgagtctttcagctgatgtcaatggttagtgctgggtggaatactcagcttgtaacttggwggacaaagcccaggtgccctaccttggaacccgtgtgtgattttcaaagctgtctatgggtagcttggtcagaggggaaaaaagcaacaggatcaacatt

SEQ ID NO: 60988 - DNA, 201 bp, Homo sapiens
tggagcagggcttggcctctgggggacccagtgaacctagagcagaggggatttaaaatggtgcagcaggctgcaggctataggctagaggaattgtattyggacaggggagaagggaaaacagcatcatgctattccgatgcttacgggagtaccaccgtgcttccacccaagacgaaaaggaagacaaaagggagaccg

SEQ ID NO: 60989 - DNA, 201 bp, Homo sapiens
ttcccagccagcaattcctccctgttctacagtgagaggccgcagatcccctttgtgtggaaacgaccaggggtgagtggggcgagcaggggaaggagcayagatgaggccgaggttcagcagcccccgcaggaagtggaaacaggggtgctggggaggggccggctacgctcagtgcaactgaggtgcatcatcccagtc

SEQ ID NO: 60990 - DNA, 201 bp, Homo sapiens
actctgccgaccacaacgagttctggagcgccttgctggaaaaagcctacgccaagtgagtgacagcttccccagctcaggcagcctcccgacaggagtctctacactagtctttgtagtgagcatctaagggctgggaaaaaatcagggctctgggtttgcaggtgaggctcggcaggacccaaccctctcagggctcaa

SEQ ID NO: 60991 - DNA, 201 bp, Homo sapiens
catccccttctgacacagagttttcctatttgctgtgaaatagcaatgaaaattgtgatttatggcttccattttgcaggagactgctggctattagccgycatcgcctcccttacgcttaatcaaaaagcactggccagagtcatcccccaggaccaaagctttggccctggttatgccgggatattccatttccaggta

SEQ ID NO: 60992 - DNA, 201 bp, Homo sapiens
tgcaggtgaggctcggcaggacccaaccctctcagggctcaagcggggttggaggtggttttcctgtcgtagcctagatgtgcccatctttgggagcagtsgctacattcatgaccctttttctccctgggccatgaatctggcctttggaagagctgggaaggcaagcggaggggaattctggctgtgccgacagcactt

SEQ ID NO: 60993 - DNA, 201 bp, Homo sapiens
acccaccttttgagtgacatcctctgaatgcgtggggagtaaagaacactgaagggagaccctgcccttcctcctcactggagccaaggtgtgagacgccrttggactctttgggattctttagaatgttagctatttgtgttggctcctttgtcctccttcaccatccatagatgacttgcagattgctcactcaagcag

SEQ ID NO: 60994 - DNA, 201 bp, Homo sapiens
cgaaccacttgggtggcagctatgaaatgtctgctcgcccagcccgtgctgacactgatgtatgcagtcttggtcctctggaaagggagttgctggaattyacagagctgatgcatcaggcagccatatgtctgaaacccaagtaagcatgtcctataacagtgccaagaaggcaacagctgtttatgatagacgggcaga

SEQ ID NO: 60995 - DNA, 201 bp, Homo sapiens
aggcaagcggaggggaattctggctgtgccgacagcacttagtgcttcacacttccctcggacactggcatggctcaaacatctgggctattacgcacgtkgatatagagacatcaattgtccgtcctacgggatgcttcttttttatttttaaaaagtcgtatatgacatatcgataaataatcgtatatgataaaatgt

SEQ ID NO: 60996 - DNA, 201 bp, Homo sapiens
gatgtgcagtgcccctcaactttgagatcgtagcctataaagggaaaatgggccattgtctcccattttctgggactcacagaggtagaaatcaagaaagkgactgagagccaaggctggaataaaatttgtcttccactcatgcagcctccatgggtgatgggaggggcaggcgccatcccgactccctgacttcgctgt

SEQ ID NO: 60997 - DNA, 201 bp, Homo sapiens
gctgagtctgggttggggctgcagggagatttctaaccaccctcccaagtactgccgaaccacttgggtggcagctatgaaatgtctgctcgcccagcccrtgctgacactgatgtatgcagtcttggtcctctggaaagggagttgctggaattcacagagctgatgcatcaggcagccatatgtctgaaacccaagtaa

SEQ ID NO: 60998 - DNA, 201 bp, Homo sapiens
ctccaataagtacaaaactggccagttaccggggccactgtagcaatgacgggggtgggagaccatgggtctgagtgtcagaggtatgggagaaggattcyagggggtttcaatcaccctctccccagaggatcccagtggacccatctgctcacagggaggtccatgggccagcagcagcataggcatcacttaggagag

SEQ ID NO: 60999 - DNA, 201 bp, Homo sapiens
ccagaaagggccatattacaatgtcccaagcccagtgacatacggtgctttccagaaatgtgaactcagaaactgccaagctgagtgtgatgggcttttakgttctgatgacgttgatgttgtctactgaaaacaagtgaatctggataaaggtgattcggataaatggatcctcccagatatctgcttacacaggcggca

SEQ ID NO: 61000 - DNA, 201 bp, Homo sapiens
tcggacactggcatggctcaaacatctgggctattacgcacgttgatatagagacatcaattgtccgtcctacgggatgcttcttttttatttttaaaaartcgtatatgacatatcgataaataatcgtatatgataaaatgtatatgacataaattttaccatttttaagtgtgcagttgagtagcattaagtacatcc

SEQ ID NO: 61001 - DNA, 201 bp, Homo sapiens
acagccagaaagggccatattacaatgtcccaagcccagtgacatacggtgctttccagaaatgtgaactcagaaactgccaagctgagtgtgatgggctyttaggttctgatgacgttgatgttgtctactgaaaacaagtgaatctggataaaggtgattcggataaatggatcctcccagatatctgcttacacaggc

SEQ ID NO: 61002 - DNA, 201 bp, Homo sapiens
ctgtttgaggatgcagacttcccagccagcaattcctccctgttctacagtgagaggccgcagatcccctttgtgtggaaacgaccaggggtgagtggggygagcaggggaaggagcatagatgaggccgaggttcagcagcccccgcaggaagtggaaacaggggtgctggggaggggccggctacgctcagtgcaactg

SEQ ID NO: 61003 - DNA, 201 bp, Homo sapiens
gtgacacctctcagaaagccagaaccagggcgattcggaattagctttcccgatgttcagccctggcgagtctctcttgcctgtgtcaaacagccagaaarggccatattacaatgtcccaagcccagtgacatacggtgctttccagaaatgtgaactcagaaactgccaagctgagtgtgatgggcttttaggttctga

SEQ ID NO: 61004 - DNA, 201 bp, Homo sapiens
tctgtgctccagctaaggctgggggtggcttgtactctgctggtgacacctctcagaaagccagaaccagggcgattcggaattagctttcccgatgttcrgccctggcgagtctctcttgcctgtgtcaaacagccagaaagggccatattacaatgtcccaagcccagtgacatacggtgctttccagaaatgtgaact

SEQ ID NO: 61005 - DNA, 201 bp, Homo sapiens
aaagggagaccgacttcttttggaaggcccagtccaactgtggcctctgcggcccctagagggtagctcccccgggctggctgtcacccatttactgccaycagcgatgcctttcaggcacgctccttctcaaggcttctgctctccaccctttagaaccttttccttcggtttgatgctgacaagtccggcaccatgtct

SEQ ID NO: 61006 - DNA, 201 bp, Homo sapiens
atgttataaagaataacaagaaaatgaacagccgtgatctgttgccacccacaataagaactagaacatctggtcatgtagagtgctcacacctgtaatcrcagcgctttgggagggggaggtgggaagatctcttgagcccaggagttttagactagcctgggcaacatagcaagaccacatctctatcaaaaaaaaaaa

SEQ ID NO: 61007 - DNA, 201 bp, Homo sapiens
ggacacaagatgagaggagaagcagggtgctgagaagcctgaggaagacaattcaaagcagaggtctctcggggaaggcggcgcagcttgagctccccacrtggcgtccgcccagacactgctggaaccttccacctccagcccaggcccctcctcagtcctggtgcctggaaaagtgggaagaggtgggaaaaatccttc

SEQ ID NO: 61008 - DNA, 201 bp, Homo sapiens
ggcccggcttcctccctccctccctccctccctccctttgtttaggtctgtgctcctctgcttcccccagagacgcctcccctgctgactgctgtagctasccttgccccatcccaccccttccctctccatcctcgctcttttctctcctggtttatggtttgtctcttcctcaaatgcaatttgcaaaactctcctgaa

SEQ ID NO: 61009 - DNA, 201 bp, Homo sapiens
acaactcacttactttttgtcaaagttagaattctccaagataaaagctggacgcacaaaccagcatggagggcatctttgtctcccccttcagaagtctyccctcctgggaccagggccaccaaggcctgcccagcgactctagagtcccagatctctgctccaaggggctgtcttccttagtattatctcctctggcat

SEQ ID NO: 61010 - DNA, 201 bp, Homo sapiens
atggcttccattttgcaggagactgctggctattagccgccatcgcctcccttacgcttaatcaaaaagcactggccagagtcatcccccaggaccaaagmtttggccctggttatgccgggatattccatttccaggtaagagggagccctgggccagtgggtttacctctctggggcccggcatgagggcaggtgcatt

SEQ ID NO: 61011 - DNA, 201 bp, Homo sapiens
gcggacaggaacaagatgatttaatgaataagtgaatgatttaatgaatgagtgaatggatgatgccctcactcttgccctcctgtgcatcgtgtctctcmgctttgctgcaggatggcatttcaggacttcaaggcccactttgataaagtggagatctgcaacctcactcccgatgccctggaggaagacgcgatccac

SEQ ID NO: 61012 - DNA, 201 bp, Homo sapiens
ataaacaggcaaggcagggagattaggggaccacaggatcggatggagaaaatgggggctcatgtgactgcttaaagcacagcaggaaggtggctgagcgyagccctgggcgggacagagcatggtgaggggggaaggcagtggtgacctccctgctccaggtgctatctggagcatgctgggtcagacccagcaagacag

SEQ ID NO: 61013 - DNA, 201 bp, Homo sapiens
catccttagccagcagaatagtcttcttcacagaaaataacccaaagctgggggacccccatgctgaaattggatcagaatcaagatgcacaagactgccyagtggtgggggtggggagcttttgaagggacttgggggtcttcttgccactttgggatcccatccaagggaacagagttctgtttttgtgaactttccgg

SEQ ID NO: 61014 - DNA, 201 bp, Homo sapiens
ctagtggtgggggtggggagcttttgaagggacttgggggtcttcttgccactttgggatcccatccaagggaacagagttctgtttttgtgaactttccrggaccacccccattccacttctgccgtttcccctcttcagagatttgtggtttaatcattaaaaccacttccccagggccccaaacctgtgcacccaggc

SEQ ID NO: 61015 - DNA, 201 bp, Homo sapiens
attctccaagataaaagctggacgcacaaaccagcatggagggcatctttgtctcccccttcagaagtctcccctcctgggaccagggccaccaaggcctscccagcgactctagagtcccagatctctgctccaaggggctgtcttccttagtattatctcctctggcattgccccaaacgctgggtgaggccttcatcc

SEQ ID NO: 61016 - DNA, 201 bp, Homo sapiens
tgagccaagattgtgccactgcactccagcctgggcgacagagtgagactccatcaaaagaaagaaggaaagaaggaaaagaaagaaaagaaagaaaaatragaaagaaagaagaaagaaagaaagaaagaaagaaagaaagaaagaaagaaagaaagaaagaaagaaagaaagaaagaaagaaaggaaaaacaagagaga

SEQ ID NO: 61017 - DNA, 201 bp, Homo sapiens
tactgtgttgctgtcgttcccacagactcattttcagaatctgttctgccttttcctttgtctgcaactgaagattgtccctttggtctggtcctcattcycgtacccctatctgtttcttatttaggggagttaggagctttacatcatatcttacagatttctgtaaaatcaggaacaaaagggctgaggatgagcatg

SEQ ID NO: 61018 - DNA, 201 bp, Homo sapiens
tgccactgcactccagcctgggcgacagagtgagactccatcaaaagaaagaaggaaagaaggaaaagaaagaaaagaaagaaaaataagaaagaaagaaraaagaaagaaagaaagaaagaaagaaagaaagaaagaaagaaagaaagaaagaaagaaagaaagaaagaaaggaaaaacaagagagacccctaggtccac

SEQ ID NO: 61019 - DNA, 201 bp, Homo sapiens
ggaaaagaaagaaaagaaagaaaaataagaaagaaagaagaaagaaagaaagaaagaaagaaagaaagaaagaaagaaagaaagaaagaaagaaagaaagwaagaaagaaaggaaaaacaagagagacccctaggtccacctttatttatcatttactttaaggtaaatgataagtaatgtcactaaaaaacatgaggaag

SEQ ID NO: 61020 - DNA, 201 bp, Homo sapiens
aaagaaagaaaaataagaaagaaagaagaaagaaagaaagaaagaaagaaagaaagaaagaaagaaagaaagaaagaaagaaagaaagaaagaaagaaaggaaaaacaagagagacccctaggtccacctttatttatcatttactttaaggtaaatgataagtaatgtcactaaaaaacatgaggaagtgtgatggctgc

SEQ ID NO: 61021 - DNA, 201 bp, Homo sapiens
caccttctaaaagagccttcatgagaaaatgttcctcacgctacaggacgcagcttgtgcacaccgcctcaggagggtgacatggggctgggcacacaggstcctggcttctttcctgctatttttgtcatgtttcttttttgtggatcattttgtgcaagtttctttggctgttttttagcctccaaagccaactccacc

SEQ ID NO: 61022 - DNA, 201 bp, Homo sapiens
tgataacttgcttcccgtcttccttccacaccacccagccagggcaagccctgggagatgcttcaggcttagttagaaaagctctgaaagcagggtgcccyagtggcctccctaggtccctgactctctcctctctctcttgccacccttgcaggctaaatgggagctatgaagctctgaagggaggcagcgccatcgagg

SEQ ID NO: 61023 - DNA, 201 bp, Homo sapiens
gtgattttcaaagctgtctatgggtagcttggtcagaggggaaaaaagcaacaggatcaacatttacaaacagggcctggagctcccatgtagctgactcrcatcatttctgtctttttcctgggcaacagttctggcagcacagtgagtggctggacgtggtgatcgatgaccgcctgcccaccttcagggaccgcttgg

SEQ ID NO: 61024 - DNA, 201 bp, Homo sapiens
tgccgaccacaacgagttctggagcgccttgctggaaaaagcctacgccaagtgagtgacagcttccccagctcaggcagcctcccgacaggagtctctayactagtctttgtagtgagcatctaagggctgggaaaaaatcagggctctgggtttgcaggtgaggctcggcaggacccaaccctctcagggctcaagcgg

SEQ ID NO: 61025 - DNA, 201 bp, Homo sapiens
gacgtggtgtggggagaatcgcccctcatccccctcctctagccccaaacatcaggattctggccaaggctggcagccagcactgccgtgcaggctccagrgactctgtgctctgtgtctgacctgcctgctcctctgctggaattaggaagaagcagaaagaccctgggtggatttctgaacaatcctgtgaacacctcc

SEQ ID NO: 61026 - DNA, 201 bp, Homo sapiens
gctccacaggtccagctaataaagtccttctagtctcaccttctaaaagagccttcatgagaaaatgttcctcacgctacaggacgcagcttgtgcacacygcctcaggagggtgacatggggctgggcacacaggctcctggcttctttcctgctatttttgtcatgtttcttttttgtggatcattttgtgcaagtttc

SEQ ID NO: 61027 - DNA, 201 bp, Homo sapiens
acacctgactaacactaccttagccaggtgatcaaggccagcatcagctgtggtaaggcatgtggacggcaggtactcttgatatcatgagatgagagggsagctttacctctccggtcttccttccactaaccaatagccccactcttttttttattattatttacttttttttggagacagggtcttgctctctcaccc

SEQ ID NO: 61028 - DNA, 201 bp, Homo sapiens
tcccccatgtatgccatattctagatacaatgtagacttttcaaaaggtttacattcaggtggtccttctccaggagatcctccctgccgctgcccacctstccccctcttcctctgcctcccttcccctcgaccccgtagtcctccattgctatccaataggaaatcattctactggctcctttgtttttcaaagttttg

SEQ ID NO: 61029 - DNA, 201 bp, Homo sapiens
ggggcagcagaaggggctggaggttgtgaccgggccaggcatgtagctgggtctgatccagcaggggaggcttgacttagacggtgggtgtgactctgctytttccatgttttagaccagaagtgctgcagaatctgaggcccggacgccgtttggtcttattaagggtcatgcctacagtgtaacgggaattgaccaggt

SEQ ID NO: 61030 - DNA, 201 bp, Homo sapiens
cacctggcctgtatccttcccagctctctatctgctcgtacaaacaggcacacacttccacacacaaacatcaaggtcagttggtttgattttactgaaaygggatcttcctatctagttttctgaaatttgttttttttttttcatttcatgtactatgaaaaaaatagcagatagaagtctaatgatattttttaaaat

SEQ ID NO: 61031 - DNA, 201 bp, Homo sapiens
aacctgagtgcacctcaagtcactcaaattgggtcctgcattttaggacttaatccaactgggctgggtttacctttgttctatctatgaaagacagagaragtgagagagcgagagactttcttttaaaaaataccagtgaaatcagcctagagaacaaaccactgcaagcttgtgtggaccctgacttatttctagctg

SEQ ID NO: 61032 - DNA, 201 bp, Homo sapiens
tgtatccttcccagctctctatctgctcgtacaaacaggcacacacttccacacacaaacatcaaggtcagttggtttgattttactgaaacgggatcttyctatctagttttctgaaatttgttttttttttttcatttcatgtactatgaaaaaaatagcagatagaagtctaatgatattttttaaaattttctctat

SEQ ID NO: 61033 - DNA, 201 bp, Homo sapiens
aggacccaagaggcacggggctgggggaacaacactgcttcggcctctgcttcctcactccctctgaatggagtccagtggcctcaagcccctgcacctcygttcctctagagtcagacatgcctgtgatgtggggctcacagccccggagtttacagaggaaagtgacacccagcagcgttggtcgggctctcctacacc

SEQ ID NO: 61034 - DNA, 201 bp, Homo sapiens
tgctcgtacaaacaggcacacacttccacacacaaacatcaaggtcagttggtttgattttactgaaacgggatcttcctatctagttttctgaaatttgttttttttttttcatttcatgtactatgaaaaaaatagcagatagaagtctaatgatattttttaaaattttctctatgcatacaaacacacacacttata

SEQ ID NO: 61035 - DNA, 201 bp, Homo sapiens
acgtgtgagacctggcagaggacaggccagcatttgggaggtccttacttctgccgggcctggggttttggcgcatctaaaaacaccccgtgttcttcagmaattctcctggccaagctttcttgagtattttagacactaatgccacacatagctctccctgggcaggcgcccctggtgtctgtcactcctccaggttgt

SEQ ID NO: 61036 - DNA, 201 bp, Homo sapiens
caggcacattctgcaacaagcccagaatgtctaagctggtgacagatgaggatgcagccgtgagaagttaaatggcccaccctgaaccctactgctgagcsgggcaggctattcctgggactctattgaggcccactgacatggtcctggtttgcattgtccttctgggctcagctcagagccacctgcaaactcctgcgc

SEQ ID NO: 61037 - DNA, 201 bp, Homo sapiens
gcattgcttgccagggctatcccctggcaggggctgggcaatcaagacagggagggcttgggggactcctgggtttcccttcgggcaggcacattctgcarcaagcccagaatgtctaagctggtgacagatgaggatgcagccgtgagaagttaaatggcccaccctgaaccctactgctgagcggggcaggctattcct

SEQ ID NO: 61038 - DNA, 201 bp, Homo sapiens
gagcaacacaggcttgaacttatatggggattttcttccatctctaccacccctgagacagcaagaccaactcctcctcctccttctcagcctactcaacrtgaagataataaggatgaagacctttacaatgacccagttccacttaataaatagtaaatgtatttcctcttccctatgattttcttgataacatttctt

SEQ ID NO: 61039 - DNA, 201 bp, Homo sapiens
ggtagcgggccatagggaaatcacaagcattgccaggttccctgcagacctctgtggcttgggcatcatttgcagtgggactcagcattacacggtgcacrtctcagcagcccgtgggaccgtggggctggacggccctcctcctcagcaccaccttcttgtcaaacacagctgtgcttggggagggtgggcagagcacaa

SEQ ID NO: 61040 - DNA, 201 bp, Homo sapiens
ttcttccatctctaccacccctgagacagcaagaccaactcctcctcctccttctcagcctactcaacatgaagataataaggatgaagacctttacaatkacccagttccacttaataaatagtaaatgtatttcctcttccctatgattttcttgataacatttcttttctctggcttatttattgtaagaatacagta

SEQ ID NO: 61041 - DNA, 201 bp, Homo sapiens
ccttcactcctctgcaggccccggcccagttaactcaccacccctgcagggtgagccagaacgtgcctcgctgccacaggattggctgttacctctcccgrgaccggcccggcttcctccctccctccctccctccctccctttgtttaggtctgtgctcctctgcttcccccagagacgcctcccctgctgactgctgta

SEQ ID NO: 61042 - DNA, 201 bp, Homo sapiens
ttttcctggctgagttggcctcacctgcaatcactttcctaaaaaggcctgtgcacctttcattacagtagctctcatactatatacactgtgcccaggarggaggacagagaagggagaaaaaaaccatctcatataatcacgttgccccaagtcaccatgctgtaataaacaagctgttgggaaggaggaggcagggtg

SEQ ID NO: 61043 - DNA, 201 bp, Homo sapiens
ataaatagtatctcaaaaatattagctattttgttataatcactcccacagaaactaggcatttttcttctctagttttgtctttcaacttcagcatgtargacacatgtaataactatacctcctttgatcaatccaagattccaaagaaagatgtgcacacacaaattattcttttatgaaaataagaggaagctgggc

SEQ ID NO: 61044 - DNA, 201 bp, Homo sapiens
tcatcccccaggaccaaagctttggccctggttatgccgggatattccatttccaggtaagagggagccctgggccagtgggtttacctctctggggcccrgcatgagggcaggtgcatttccacactgcctggtaaccctagaaaaaaatgtcatcagatctgtgtgacatatggtcctaaaccatgctaaagccacatt

SEQ ID NO: 61045 - DNA, 201 bp, Homo sapiens
agccaattacgtattattacggtgagccaaatggggatactattggtacttagctcacagaattattgtaatggcttaattgattacttcataaatagtakctcaaaaatattagctattttgttataatcactcccacagaaactaggcatttttcttctctagttttgtctttcaacttcagcatgtaggacacatgta

SEQ ID NO: 61046 - DNA, 201 bp, Homo sapiens
acgcttaatcaaaaagcactggccagagtcatcccccaggaccaaagctttggccctggttatgccgggatattccatttccaggtaagagggagccctgrgccagtgggtttacctctctggggcccggcatgagggcaggtgcatttccacactgcctggtaaccctagaaaaaaatgtcatcagatctgtgtgacata

SEQ ID NO: 61047 - DNA, 201 bp, Homo sapiens
tggagcagcttccccacaggctccactggaaggccctttggtcgctgggaaacaaacttggtaaaggaattgtctttaaaaggatgcctttcccccttctytcctatcaggggtgttccaggctctcagtacaaagaacaaggagttcattcatctcaatataaatgaggtatggccaatccagaccctctgctcagggac

SEQ ID NO: 61048 - DNA, 201 bp, Homo sapiens
catggcgagagggaggttgagtcactgggacaggcaagcaactgcagcatggggtccctgaggacccaagaggcacggggctgggggaacaacactgcttyggcctctgcttcctcactccctctgaatggagtccagtggcctcaagcccctgcacctccgttcctctagagtcagacatgcctgtgatgtggggctcac

SEQ ID NO: 61049 - DNA, 201 bp, Homo sapiens
aggaaatcgtgaaaaacccagaattcattcttggaggggccaccaggactgatatctgccagggagagctgggtgagtgtaagtggatggagcatggcgaragggaggttgagtcactgggacaggcaagcaactgcagcatggggtccctgaggacccaagaggcacggggctgggggaacaacactgcttcggcctctg

SEQ ID NO: 61050 - DNA, 201 bp, Homo sapiens
ccaggaaatcgtgaaaaacccagaattcattcttggaggggccaccaggactgatatctgccagggagagctgggtgagtgtaagtggatggagcatggcragagggaggttgagtcactgggacaggcaagcaactgcagcatggggtccctgaggacccaagaggcacggggctgggggaacaacactgcttcggcctc

SEQ ID NO: 61051 - DNA, 201 bp, Homo sapiens
gcaggggaaggagcatagatgaggccgaggttcagcagcccccgcaggaagtggaaacaggggtgctggggaggggccggctacgctcagtgcaactgagktgcatcatcccagtctaccgtggaaagctttgcagtttggaggcagaaaataatgtacaggcctgggatgctctgcggtggggacccggggcatctggtt

SEQ ID NO: 61052 - DNA, 201 bp, Homo sapiens
atccatggcccctgagcttctggggaaatctgaagctagtctagaacttggttaaaactgagccagtgtttgtcttcagtccagacacagctaccaggtcrccagacatggtgcagccgctgctgtattagccagaccccagcgtgagggcagggcacacaggcctgtgctttccaggctgtcatggtccccatggaggct

SEQ ID NO: 61053 - DNA, 201 bp, Homo sapiens
aactttccagtggagacacctgactaacactaccttagccaggtgatcaaggccagcatcagctgtggtaaggcatgtggacggcaggtactcttgatatsatgagatgagaggggagctttacctctccggtcttccttccactaaccaatagccccactcttttttttattattatttacttttttttggagacagggt

SEQ ID NO: 61054 - DNA, 201 bp, Homo sapiens
gctgggtgagtgtaagtggatggagcatggcgagagggaggttgagtcactgggacaggcaagcaactgcagcatggggtccctgaggacccaagaggcayggggctgggggaacaacactgcttcggcctctgcttcctcactccctctgaatggagtccagtggcctcaagcccctgcacctccgttcctctagagtca

SEQ ID NO: 61055 - DNA, 201 bp, Homo sapiens
cctggtgcctggaaaagtgggaagaggtgggaaaaatccttcactcctctgcaggccccggcccagttaactcaccacccctgcagggtgagccagaacgkgcctcgctgccacaggattggctgttacctctcccgagaccggcccggcttcctccctccctccctccctccctccctttgtttaggtctgtgctcctct

SEQ ID NO: 61056 - DNA, 201 bp, Homo sapiens
tggcaaagatagaccacagagagccatggtctgatgtgtgtggacccatgggcctgtgcggttagctaaggagcagaatgtgccagcctcccctgcagcaygtttcttagcatcgcctttctttatacattcacagtgcctctgtgggaggatgatgggctggggcaggtttgtgccttgtgtttgaggaaaggttcaatt

SEQ ID NO: 61057 - DNA, 201 bp, Homo sapiens
atgccaggtactgcctgtgggcaacctgagcagatggcaggtcttctctctgctgcccaggaggtgggcctctgagcccagttggtgattcttaaggtcayggcccttggagtggtggcaccagggttcagacccaggactcacttcctgacaccagggccctcattttaaaccactgtgaacattggtagaaacttttta

SEQ ID NO: 61058 - DNA, 201 bp, Homo sapiens
ccatcagcgatgcctttcaggcacgctccttctcaaggcttctgctctccaccctttagaaccttttccttcggtttgatgctgacaagtccggcaccatrtctacctatgaactacggactgcactgaaagctgcaggtaaagaaaagactggagtacaggtggctgactgcatgccaggtactgcctgtgggcaacctg

SEQ ID NO: 61059 - DNA, 201 bp, Homo sapiens
gaaagtgactgagagccaaggctggaataaaatttgtcttccactcatgcagcctccatgggtgatgggaggggcaggcgccatcccgactccctgacttygctgtgctgctggtgacatgtgagtagggttgaaggcaccgcatggccagcctgtcaggccaattatctgggtgtgagccacttaggataatggctccaa

SEQ ID NO: 61060 - DNA, 201 bp, Homo sapiens
gcagaggggatttaaaatggtgcagcaggctgcaggctataggctagaggaattgtattcggacaggggagaagggaaaacagcatcatgctattccgatrcttacgggagtaccaccgtgcttccacccaagacgaaaaggaagacaaaagggagaccgacttcttttggaaggcccagtccaactgtggcctctgcggc

SEQ ID NO: 61061 - DNA, 201 bp, Homo sapiens
ggagggcccccatccttgcagtctatattgacatcatctagtttaaagtgtaatctgtactctacaactcacttactttttgtcaaagttagaattctccragataaaagctggacgcacaaaccagcatggagggcatctttgtctcccccttcagaagtctcccctcctgggaccagggccaccaaggcctgcccagcg

SEQ ID NO: 61062 - DNA, 201 bp, Homo sapiens
aaacaattgtctccacttcaacaggacatggaggtgacagcagaggaacttgagtatgttttaaatgctgtgctgcaaaagagtaagtgccaaccccatcrgggtcctggggcacctatggagggacaagcgaccacactgcctgggtcccctccctgctcctccgagccgcagatctgcttcccagggctgatttgtagg

SEQ ID NO: 61063 - DNA, 201 bp, Homo sapiens
agagtttgagaggctacctgaggtcaggctagtggaaagaaggtctggtgcagacggtgggagaagccgggcagaggaaactcggaaattcacagcaggargctccacaaagaagagcgtccatgtgagtgatccattgccctgcccctcttgaaggagcagccccaacaccagggctgagcctgcccaaggtgatgggtg

SEQ ID NO: 61064 - DNA, 201 bp, Homo sapiens
caaggccattgttgctcttcatcatgacctctgcctgaacaccaattttgtttactcctagttctccggagtggcgttctgttggtccagctgagcagaarcgtctgtgtcacactgctctggatgatggggaattctggtaccgtgcttgttcctgtgttaactgcagatacgagcaagtcccatggccctggggcgtaa

SEQ ID NO: 61065 - DNA, 201 bp, Homo sapiens
atagaataatatatatatataatgcacttcggtgaaacaatatgagagatgtgtgcatatctctctttatatggtatagatacatgaaattttacctaagygcatctctgtaaaaagaaacactgagcagggtggcatgtgtctgtaacctcaataccttgggaatccaaggcgggaggatcacttgaggccaggagtttg

SEQ ID NO: 61066 - DNA, 201 bp, Homo sapiens
atgaataagtgaatgatttaatgaatgagtgaatggatgatgccctcactcttgccctcctgtgcatcgtgtctctccgctttgctgcaggatggcatttmaggacttcaaggcccactttgataaagtggagatctgcaacctcactcccgatgccctggaggaagacgcgatccacaaatgggaggtgacggtccatca

SEQ ID NO: 61067 - DNA, 201 bp, Homo sapiens
atctgtttcttatttaggggagttaggagctttacatcatatcttacagatttctgtaaaatcaggaacaaaagggctgaggatgagcatggagactcttyttgcagcatagagtcgcagggagccggggggtagcgggccatagggaaatcacaagcattgccaggttccctgcagacctctgtggcttgggcatcattt

SEQ ID NO: 61068 - DNA, 201 bp, Homo sapiens
taggaatgggccctggcagagtatcattctccgtgggcagcagcatcccctccaagaaactttctagggccacagctggaagtgacctgagacatagaacrcgaggggaggctggtgtaggaatgaacttggggctcagacaccacccagtgttaagttcccccaaacaaagcttcctgtaaagtcagcgagactctatgg

SEQ ID NO: 61069 - DNA, 201 bp, Homo sapiens
agtggctcacgcctgtaatcccagcactttgggaggttgaggcagttggatcgtgaggtcaggagctcgagaccagctcatagcgaaactttgtctctackaaaaatacaaaaaattagtcaaatgtggtggtatgcacctgtaatcccagctactcgggaggctgaggcaggagaaccccttgaacctgggaggtggagg

SEQ ID NO: 61070 - DNA, 201 bp, Homo sapiens
agggagatttctaaccaccctcccaagtactgccgaaccacttgggtggcagctatgaaatgtctgctcgcccagcccgtgctgacactgatgtatgcagwcttggtcctctggaaagggagttgctggaattcacagagctgatgcatcaggcagccatatgtctgaaacccaagtaagcatgtcctataacagtgccaa

SEQ ID NO: 61071 - DNA, 201 bp, Homo sapiens
atttctaaccaccctcccaagtactgccgaaccacttgggtggcagctatgaaatgtctgctcgcccagcccgtgctgacactgatgtatgcagtcttggwcctctggaaagggagttgctggaattcacagagctgatgcatcaggcagccatatgtctgaaacccaagtaagcatgtcctataacagtgccaagaaggc

SEQ ID NO: 61072 - DNA, 201 bp, Homo sapiens
aagggtctagtatatcaagccaggaagccggctttccctaaggggttactggtagctagtgagaggtgcattctagaaagacccctcctgaaacagaatcygttattagacttacagggtggtcagagctgaccctagaaataatgagatttgctagtttctcttctctccattgctctttccctttctaaaccacccagg

SEQ ID NO: 61073 - DNA, 201 bp, Homo sapiens
tccacgagcgctctgcagacctcccgcctgccgggctgcctgcgcttctcaccaagcacacctcacagataggggcctcctgaaccttttaaagtggttcyctcccagggaaagcaaaatctggaaacatgtccaggctcaggcctgataaaaggatgaagtatacacagccaggaccatctcgggtcctatgtgagggag

SEQ ID NO: 61074 - DNA, 201 bp, Homo sapiens
cagcagggtcctgaaggctggtctgtcactggagccaaatgaagctcagaactgatttaaaacaaaaataaactataaaagaaggtgccaagggctataamaaacaattgtctccacttcaacaggacatggaggtgacagcagaggaacttgagtatgttttaaatgctgtgctgcaaaagagtaagtgccaaccccatc

SEQ ID NO: 61075 - DNA, 201 bp, Homo sapiens
gaagctgggaaaccactgccttgccctgcccagcttttcatgcgctttcctgggttgggatgtctctcaagttaggctctctcctagttgggctggcatgyccctaaaacatgtgacatatgagacacatagctgcagctacacaggagataggtacatctgcccacagcagggtcctgaaggctggtctgtcactggagc

SEQ ID NO: 61076 - DNA, 201 bp, Homo sapiens
tccacctgaccaggagacagaggaggagcagcggtttcgggctctgtttgaacaagtcgctggtgaggtaggacatgccccacttccatctccccaccagsctgagggcctggacctgcttcctagcaaagggttgcagtcgtggggttggtcagcaacgtcatcctgaggcatgatggagcttgttgcaaagtaagacca

SEQ ID NO: 61077 - DNA, 201 bp, Homo sapiens
ccaaagtgctgggattacaggagtgagccaccacgccaggctgcaggacactttcttagcttatctgcaaggcaaggcacatatcccttctagctctgctcctcgctccctcaagcaaaccattgaaaagttgctgttttctactggtcccagagtcatgctcacaagacattcttgggtggagaccttcatttttcagac

SEQ ID NO: 61078 - DNA, 201 bp, Homo sapiens
tgggactcagcattacacggtgcacgtctcagcagcccgtgggaccgtggggctggacggccctcctcctcagcaccaccttcttgtcaaacacagctgtrcttggggagggtgggcagagcacaaagccaaggggacattggagggcagtggacagccaggcttgccctcaagggagcccagggcaaggagtgcactgag

SEQ ID NO: 61079 - DNA, 201 bp, Homo sapiens
gacttcttcagataccacgcttctcgggccagaagcaagacgttcatcaacctgagagaagtctccgaccggttcaagctgccccctggggagtacatcckgattcccagcacttttgagccccaccaggaagctgatttctgtctgagaatcttttcagagaaaaaagccattacccggtgagtcagaggaacagcttcc

SEQ ID NO: 61080 - DNA, 201 bp, Homo sapiens
tgtctcggagggtggctgcccacggcctgggtgtggctggaatggtggcaggagtgggcaccagtgcggccccggtggccatggggaataaaccagcattrctgcctccggcctccgccgtttttctgtttcgtaaaccagcatcccggggttcctgctctgagtgaccctggcacctgtcagggagtccaggtgtgcccc

SEQ ID NO: 61081 - DNA, 201 bp, Homo sapiens
cctggggaggtgaaagtccccactccttcagggagggaaagggggcggggcactgttccagcctggagtgtgggagggatctgtttctttttttcttttctttttttttttttttgagaaagggtctccctctgttgccaggctggagtaaggctggagtgcagtggtgccatctcggctcagtgcaacctccgcctccca

SEQ ID NO: 61082 - DNA, 201 bp, Homo sapiens
ggccagggcctcaaatcctggatgacccctgcgcccacctcctgggtcctgacggcctgccgaagccagctgcctgactgcctcagcagggaccgcatgcygcttggagaaggggtggcctcgccggagctagggagcggatgtggtgggctggccggactcctgggacatgtgggtggtggcttgaccccgggcccatgg

SEQ ID NO: 61083 - DNA, 201 bp, Homo sapiens; identical to SEQ ID NO: 22115

SEQ ID NO: 61084 - DNA, 201 bp, Homo sapiens
ctaaaagaaacctgtccccacagcagccacctgccgtctccccctccctgagccctgacggccaggaatgcacttcccatctctggacttgcctgttgtasactgttgtagacgcttagagaaacggatgcattcaccgtgcccctgccctgcttttccaggtttctgaaggggctgcaggtgaggccggcccctctctca

SEQ ID NO: 61085 - DNA, 201 bp, Homo sapiens
ttccctgagctgttaccccatggggcttggcagcacccttggccagatgtgggtccagcctgggcatagctgtttaccacataacctaaaatttcctgtcycagccattcgagagcatataatcctgcggtgttgaggacattcacagggtcatgtgagcaccacctcaagccacctccttaactttttcatcacccctaa

SEQ ID NO: 61086 - DNA, 201 bp, Homo sapiens
ggtcctgacggcctgccgaagccagctgcctgactgcctcagcagggaccgcatgccgcttggagaaggggtggcctcgccggagctagggagcggatgtrgtgggctggccggactcctgggacatgtgggtggtggcttgaccccgggcccatgggcagcttgctgtggggcagtgcagggagtcctgcggccgcccag

SEQ ID NO: 61087 - DNA, 201 bp, Homo sapiens
ccaggtggggccagggcctcaaatcctggatgacccctgcgcccacctcctgggtcctgacggcctgccgaagccagctgcctgactgcctcagcagggascgcatgccgcttggagaaggggtggcctcgccggagctagggagcggatgtggtgggctggccggactcctgggacatgtgggtggtggcttgaccccgg

SEQ ID NO: 61088 - DNA, 201 bp, Homo sapiens
agcacgcagtgtctgttccatctcccagtattaggagagctgagcacagcacacacgtgcccccaggtctcgtcacacatgcgcacaccgtgccccagggsctcccctgggagtccccgtctctttattcaggataaggcctggttgctccacaaggtgtggcccacgctttcatcccccacgggcttccccactgcccag

SEQ ID NO: 61089 - DNA, 201 bp, Homo sapiens
gaagcgatgaaggaatggggagcggggacggaggttggctggcctccagctctgctctgggagcctgagctcagtggggtgggagcagttcttgcaggcckgggtctggcaggaggaggggcacacaggttgtgcggtgagagacgggactgaggcggatgggggccgtgggtggggggtgggggcacctgtggggaacac

SEQ ID NO: 61090 - DNA, 201 bp, Homo sapiens
actcccagatgtgtgcgtaagtgtccgacattttgaaggaaaggagtcaaagcccctgatttccttcttactgaagcgagttagagccagtcaaggcggcygggtgttgaccccgccccggcagttgggtgtcttttcttgggtggggtccggcagctgcatcttggcgccacagagcccccatgtacgccctcctcggtg

SEQ ID NO: 61091 - DNA, 201 bp, Homo sapiens
ttcccacccactgtcagagcctgtccccccggtggtggtctcacaccatcttcacccctcaactccaggggtgacgcttcctggcccacctgggctcctgygccttccctgaaccaccctcggtgaccagggtgggtgaccagacctggaggtggggttgccctgctggagccctgtgggaggaggggagaaggtggctcc

SEQ ID NO: 61092 - DNA, 201 bp, Homo sapiens; identical to SEQ ID NO: 22121

SEQ ID NO: 61093 - DNA, 201 bp, Homo sapiens; identical to SEQ ID NO: 22120

SEQ ID NO: 61094 - DNA, 201 bp, Homo sapiens
cgaaggcgtccatccaggctttgcttggctcctggggtcagcgggggctgaaggaacagaagcgtggttgagtgctcaggaaccgctcccatgcggcgggygccaccacccgctgggatctggaagttgcccctgcgtcacccctgctgtggccgggaggcctctgtggtcaggcaggtggcactgactcccacccccgct

SEQ ID NO: 61095 - DNA, 201 bp, Homo sapiens; identical to SEQ ID NO: 22122

SEQ ID NO: 61096 - DNA, 201 bp, Homo sapiens
accgctaccctcctgtgtccggccctacagatgctgggcacaggatgaggcgctgccattcctggtgacctgacatggatttctatccccaggtggggccrgggcctcaaatcctggatgacccctgcgcccacctcctgggtcctgacggcctgccgaagccagctgcctgactgcctcagcagggaccgcatgccgctt

SEQ ID NO: 61097 - DNA, 201 bp, Homo sapiens
cagccgaggctgcaggcctgcctgcgggagagtgagctggggtccccataagcccatccctccctgttgtcagcagggtccgagcatccagaaagtgcttytgcctctgtgcccctcctgaggcagcaggcggggtggctgggaaccagacatgcccgctgggccgccagctccagggcagtggcccacctcaatgaccag

SEQ ID NO: 61098 - DNA, 201 bp, Homo sapiens; identical to SEQ ID NO: 22134

SEQ ID NO: 61099 - DNA, 201 bp, Homo sapiens
cctgtggggtggactcagacccacaccccaggactgcccgcctgggaagcaccaggctcgtggctgctgctccgggtggggcttgcaggcttccgctgttytgcagaacacggtgacgaacgcaccagcttgaattgggcgcttccctgagctgttaccccatggggcttggcagcacccttggccagatgtgggtccagc

SEQ ID NO: 61100 - DNA, 201 bp, Homo sapiens
tggccgggaggaggatgtggggcagccgaggctgcaggcctgcctgcgggagagtgagctggggtccccataagcccatccctccctgttgtcagcagggwccgagcatccagaaagtgcttctgcctctgtgcccctcctgaggcagcaggcggggtggctgggaaccagacatgcccgctgggccgccagctccagggc

SEQ ID NO: 61101 - DNA, 201 bp, Homo sapiens
ggcctttccccccctgccctcagcagggctgaccttgctcgagtgggcagccatgaggctctctcagtagaaaggggtacctggctggcatcggtcctcartgctggcctctgaggtggccctgggtttccttttcagttaaaaaccaccacaacagccgtcatcagcaaggacttcaccgaggaccggatttggctgaat

SEQ ID NO: 61102 - DNA, 201 bp, Homo sapiens
cgggtaagaaactctccacgaggagtctggcaggcagaggcctggtgttcagctgtgaccccgggcaggtgggcaggagcagggcgggcagggtgctgacrgctgggccacacgctgtctcattgtctctgcagtccgctgcctggcccggaagcggaggaactcacgggatggggacccgctgccctccagcctcagctg

SEQ ID NO: 61103 - DNA, 201 bp, Homo sapiens
ccgggtaagaaactctccacgaggagtctggcaggcagaggcctggtgttcagctgtgaccccgggcaggtgggcaggagcagggcgggcagggtgctgayggctgggccacacgctgtctcattgtctctgcagtccgctgcctggcccggaagcggaggaactcacgggatggggacccgctgccctccagcctcagct

SEQ ID NO: 61104 - DNA, 201 bp, Homo sapiens
tccttttcagttaaaaaccaccacaacagccgtcatcagcaaggacttcaccgaggaccggatttggctgaatggccgggaggaggatgtggggcagccgmggctgcaggcctgcctgcgggagagtgagctggggtccccataagcccatccctccctgttgtcagcagggtccgagcatccagaaagtgcttctgcctc

SEQ ID NO: 61105 - DNA, 201 bp, Homo sapiens
cctgctctgccgcaggtaccttttgttgcccttgtcgcaggccgcaagctctgcaggccgtgaacagagagtgtccgagagtggaactagcggaggtgggrgacagacggctgggccggtgaatgctggcctcaaaggctgatggcccagaagccctgtcatctggaaatccccatttgccgtggggtgtgggacgttcct

SEQ ID NO: 61106 - DNA, 201 bp, Homo sapiens
gctgaagggctttctcaccccagctctggctatgcccagttctctgagaaaggagctcagtggggaggtggtccctccagcggaccagggaaggggtcacygtgctgggagcagcctccttgggcctcaggaaaccaccaagtgcctcggatggtggctgcccacggcgcttctgctgagaccctgcccccggcccaggtg

SEQ ID NO: 61107 - DNA, 201 bp, Homo sapiens; identical to SEQ ID NO: 22111

SEQ ID NO: 61108 - DNA, 201 bp, Homo sapiens; identical to SEQ ID NO: 22114

SEQ ID NO: 61109 - DNA, 201 bp, Homo sapiens
tgtctgctttcctccaagttgtacaggattgccttttatatttaagtctgtgatccaaggttgtccagttagcccagaaaggctatccttcctctattgarttgcttttgcacttttgtaaaaaaaaaaatcagctgggcatgtttgtgtgggtctatttctggattttctcttctgctattttttttttttttttttttt

SEQ ID NO: 61110 - DNA, 201 bp, Homo sapiens
atggtgaaacccccgtctctactgaaaaaaaataaaatatgtattctagatattagtctcctgttggacatgtggtttgcaggtattgtctcccaaactarctaatctttttgtcctcttaacaaagagccagtttttcattttaaagaagttcagtgtatcaatgttgatgtcaagtctaagacctctttgcttagccct

SEQ ID NO: 61111 - DNA, 201 bp, Homo sapiens
catctaacgttttctttctttctttcttttctttccagaagccgccaccacgactggctaatttttttgtgtttcccttaccaataaagctgccataaaaygttgtatacaggtttttgtgtgaacatacatttccattcttctgggataaatgcccaggagtgcggttgctgggtcagatggtagatatatatatatgcc

SEQ ID NO: 61112 - DNA, 201 bp, Homo sapiens
cagtaccgtgggcatgcgggccagtgtggagaccagccccctgcttcgggtaaggccaggagcgggtggtcccggggccctgggagtcacgcttgtgcccrgctctgccctcagcctctgtctgggcccgagtgttctcacacctgcggcagccccgccaagaccacgtgcaggagccaaatgcagagatggggctcgagc

SEQ ID NO: 61113 - DNA, 201 bp, Homo sapiens
tgttcctggggcatatgagcagtgagatgtgaggagttctcagagctgggctccttttgtttgggaaggtggaggggaggcaggccgcggtgggagcgatscgcacctgggcactcacggatgctggagtagaagcgatgaaggaatggggagcggggacggaggttggctggcctccagctctgctctgggagcctgagc

SEQ ID NO: 61114 - DNA, 201 bp, Homo sapiens
ttacctaaaggctaggatgagatggcctagcgacgactcccagccagcacgcagtgtctgttccatctcccagtattaggagagctgagcacagcacacaygtgcccccaggtctcgtcacacatgcgcacaccgtgccccaggggctcccctgggagtccccgtctctttattcaggataaggcctggttgctccacaag

SEQ ID NO: 61115 - DNA, 201 bp, Homo sapiens
gttgaggacattcacagggtcatgtgagcaccacctcaagccacctccttaactttttcatcacccctaaaagaaacctgtccccacagcagccacctgcygtctccccctccctgagccctgacggccaggaatgcacttcccatctctggacttgcctgttgtagactgttgtagacgcttagagaaacggatgcattc

SEQ ID NO: 61116 - DNA, 201 bp, Homo sapiens
cctgacggccaggaatgcacttcccatctctggacttgcctgttgtagactgttgtagacgcttagagaaacggatgcattcaccgtgcccctgccctgcktttccaggtttctgaaggggctgcaggtgaggccggcccctctctcagctgagcttcaggctgcgctggccatggagccgacccccggtggggtcaaata

SEQ ID NO: 61117 - DNA, 201 bp, Homo sapiens
cctgtctcagccattcgagagcatataatcctgcggtgttgaggacattcacagggtcatgtgagcaccacctcaagccacctccttaactttttcatcamccctaaaagaaacctgtccccacagcagccacctgccgtctccccctccctgagccctgacggccaggaatgcacttcccatctctggacttgcctgttg

SEQ ID NO: 61118 - DNA, 201 bp, Homo sapiens
ataaactccaaaaattagttgtgtattatttggactactatttcaatcattcagaaatttgttttaaaaaatccttgcagtcttgctgctgacttcatagygtgcagtagtgtgatatggagatgatgcactgtctttcagaagccttggctctatgccttctagctgggcctggggcaagtcatttagcctctgtggacc

SEQ ID NO: 61119 - DNA, 201 bp, Homo sapiens
ccttaagaaacgtcaaaggatggtgattggaaaagagaagaagcagcacacaagggttttgtcttagaagcatttattttatttatttatttattattacttttttttttttttgagatgcagtctcactctatcgcccaggctggaatgcagagaagcatgtatttaagcaccccagtcctcagctatgcagtgccccgc

SEQ ID NO: 61120 - DNA, 201 bp, Homo sapiens
acatgcagactgaattattctggtggtttttgttgttttgttttgttttgttttgttttgagacagagtcttactctgtcacccaggctagagtgcagtgrcacgatctcagctcactgcaacctccacctcccgggttcaagtacttctcccaccctagccccccgagtagctgggactacaggtgtatgtcaccacgcc

SEQ ID NO: 61121 - DNA, 201 bp, Homo sapiens
catgcagactgaattattctggtggtttttgttgttttgttttgttttgttttgttttgagacagagtcttactctgtcacccaggctagagtgcagtggmacgatctcagctcactgcaacctccacctcccgggttcaagtacttctcccaccctagccccccgagtagctgggactacaggtgtatgtcaccacgccc

SEQ ID NO: 61122 - DNA, 201 bp, Homo sapiens
gaggccttggtgggcctcacttgaggtcaggcattcaagaccagcctggccaacatggtgaaaccccatctttactaaaaatacaaaaattaaccaggcgkggtggcacgcagctgtaatcccagctactcgggaggctgagtcaggagaatcgcttgaacccaggaggcggaggttgcagtggcagcgagccgagatcat

SEQ ID NO: 61123 - DNA, 201 bp, Homo sapiens
aggtagtgtaataaagttatttctgtaggaaactgggaattcattggctatttgactctgaatgtaacctctttaaagctgatgaacgagtggccccttakatttgaagtggtaaggtagtcataagttaggctcccagacactggcattcaacgtgattttgaagtgtgatagaccatgtatacacttgattgtgcacca

SEQ ID NO: 61124 - DNA, 201 bp, Homo sapiens
ttgaactatatttttttctataatctagctcttagaactctattttcctttgatactaatgattcctcttgccctcagaaatgtttacatgaaacagcacrtgactgtcctttttgttgatcccaaaactttttattgttcattctagagaggcaaataatgtccttcagtgtcactaattgagtttttaaaaggaagatt

SEQ ID NO: 61125 - DNA, 201 bp, Homo sapiens
agcaaccactgatcagatgtctatcaccacagattagttttgtgtattctggaatcccctgttaattgcatgtatttttcttttcttttcttttcttttctttttttttttgttttggtgacaggatctcactctgttacccaggctggagtgcagtgtcacaatctcagctcgctgcaacccccacctcccagctttaag

SEQ ID NO: 61126 - DNA, 201 bp, Homo sapiens
cctctgcctccctggttcaagcaattctcttgcctcagcctccctagtagctggcacctgccaccatgcccagctaatttgggtttcaccatgttagccaggctggtctcgaactcctgacctcaagtgatccacccacctcgggcttccaaagttctgggattacctgcgtgagccactgtgcccagccaaggatatttt

SEQ ID NO: 61127 - DNA, 201 bp, Homo sapiens
tcaccatgttagccaggctggtctcgaactcctgacctcaagtgatccacccacctcgggcttccaaagttctgggattacctgcgtgagccactgtgccyagccaaggatatttttcttgtagtatctccattatcaaaacgtgctggaaaggatgttttacttgtttatcaatatggtgatgcctcaggagcttttaag

SEQ ID NO: 61128 - DNA, 201 bp, Homo sapiens
tttatgttcttaccagctttcaccctaattaaatggggcactacaccgcagagtttagcctgtggtgtagcagagcccaggtcatctgtcacagagaatcrtaatcttacattctctctctcctctgaacaatagaattttgaggtgggggagaatcttagtttataatgaggcaactctagttttatcacactcagaaac

SEQ ID NO: 61129 - DNA, 201 bp, Homo sapiens
cacttttttcctactggtaattcctgtttttctaattacacaaaatgtttaacttaaactattctttgcaatgagttttagctttcctcctctatcctaayttcaaaacctttaatttaagaaccatttaaaattaatccagtggtaaccagaagaatattttaggtatcatgaccacttaatcttgtgcctgattttagt

SEQ ID NO: 61130 - DNA, 201 bp, Homo sapiens
cattctgttaggttaccagtattttactgtcatgcacccatgggtagtagaaacaaaataaaaataaatataaatgtttaactttaggtgttggcaccaayatagattatgcataaactgttgcaataaaagatactcattgtgcctgtacctgaaaaatttaccttaggttttctctggccttttttgtttaggcctgca

SEQ ID NO: 61131 - DNA, 201 bp, Homo sapiens
gaaattatacatccttcgctttccccacaaaatgaattcagaatcgacattcaagtttataattttaagctgctaattataaaaatatattaataccttakggattgaagattacatgaaataagaactacaaaagaatgctaattaataacataactccatatgctatcaaacttctgatagcactgagtttcttataaa

SEQ ID NO: 61132 - DNA, 201 bp, Homo sapiens
tatattcttctcttggtgagtaaaattatattttccttggcatcaatgcattgagatctgaatatacctgtatctatcaatccttattacacatttcttaygcagtagcttcaaataggccaaaattggcctagacacaactaaaaattgagggtttgttacatgctttctaacagaaaggttttcaacgagattaattat

SEQ ID NO: 61133 - DNA, 201 bp, Homo sapiens
cctatgaagctgatccttccaactctaataaagcacagtctacccccagccgccactatacatctgcctcagcttacttggaattattttatccaaaaccrtcccctatatgtgggactagtctcaccaaagagacacttggcttatatgaggattccattggttaaagttggtgctaataaatacaagttatttgatctt

SEQ ID NO: 61134 - DNA, 201 bp, Homo sapiens
caattaactgatataaaaatatacctgtaataatatattttagtagcacttttgcaattgctacccttaaaaccatgtcaacacttccaatataatcctgwattttacaggtgttttaattctggagggggtggggattttttttttctaaaaataatttagaatacaaatttccagtctgagaaaaatattatttgaaga

SEQ ID NO: 61135 - DNA, 201 bp, Homo sapiens
ctcccgggttcaagtacttctcccaccctagccccccgagtagctgggactacaggtgtatgtcaccacgcccagctaatttttgtattctttggaagagwtggggtttcactgtgttggccagactggtcttgaactcctgacctcaagtgatccacccattttgacctcccaaagtgctgggattacaagtgtgagcca

SEQ ID NO: 61136 - DNA, 201 bp, Homo sapiens
gtgagattatatagacgtcattcagaatatttgtttttatccttcaactcgaagagttttctcacctctttattttcaagttgaaaacattattataagaktatgttagcgggtcatttgactctgaaaaaaatagctttttaaaggttgatcacactttaatcttcaatttcaggatagtaaagaaccattataatttag

SEQ ID NO: 61137 - DNA, 201 bp, Homo sapiens
tattttcttctgaatgaaattattgtcttttatcttggctttattcacctcccacacaataagtccatctaatcatatttaagagccagaacactgatttyaacccccaaatatcactctcattgatgagagctggctgcatggattcaaatcagaatgtagctcttcttttatatgctaaaagtaatttaaaattatatc

SEQ ID NO: 61138 - DNA, 201 bp, Homo sapiens
tttttaaaaaaaactaagtatgtgcctatgcttttcctttttaaccatattgaatgtgtaatgttgagttagaagacactgtgtgaggtaagaaatggcarttcaaggggaacaagaacattcgtttattcagtcaacaaatatggattgagttcctcccataggcccagcattgtactagggaaattgctcactattttt

SEQ ID NO: 61139 - DNA, 201 bp, Homo sapiens
accctattatccccattttcatatgattttccagaggtttataaactggttcagaatatcagaactaatgtatttgaacccaaatttacaccaaagccaamgattgtgcccgttcagttaggccaaactgcctttcagatttcctatgaagctgatccttccaactctaataaagcacagtctacccccagccgccactat

SEQ ID NO: 61140 - DNA, 201 bp, Homo sapiens
ttttaaccatattgaatgtgtaatgttgagttagaagacactgtgtgaggtaagaaatggcagttcaaggggaacaagaacattcgtttattcagtcaacmaatatggattgagttcctcccataggcccagcattgtactagggaaattgctcactatttttatttttcccctctaacctaaggtggagatgataatgaa

SEQ ID NO: 61141 - DNA, 201 bp, Homo sapiens
gttagaagcagactttttcagaaacctgtttgaaaggaatgatccaggttttatgaaatcaactcaagaacccactgttcttcatctgcatcagtaccatsattacagttgttgacagtgaaggccctagagcactgcagtattctcatttgtgcatgcaaaatttaatcacatttattatgttgtatttattaaagcaga

SEQ ID NO: 61142 - DNA, 201 bp, Homo sapiens
tcaagagtgcattttgatatgacttttctattgaccaccaagaaaaaattatctgaaaaatgaaagatcccatacttgagtcctgaaagatgctatctaaytatgaattaaagcaaccagagtaaaagatccaatacaattgtaaatatctttaaaaatgtgggttgaggaagaagaattttttcatggattggtatccgt

SEQ ID NO: 61143 - DNA, 201 bp, Homo sapiens
tctttaggctcaattctgcactcagtaaactcttggttttggccctggcagaaggcctagcaactcattggtgctcatgtctgtgcaccagctgcttgccracctcagcctctgcctcaaactctgagcctttgtcctctgtgcttaagactccctgcctgagcttcccaccttagctaaccttccagaacttgacgtttc

SEQ ID NO: 61144 - DNA, 201 bp, Homo sapiens
tctttctgactttacacaagactcacccatttacctgtattaaaaattactttccaggaagtgccacagcaatttttcaacacctaagcaattttttaaayaagtggatatagtgttatatgtgtaccaacccatcctgtattaattgactgaaattacatctattcagctatattttcttctgaatgaaattattgtctt

SEQ ID NO: 61145 - DNA, 201 bp, Homo sapiens
ggtgtttttgtttttgtttttgtttttgttttgagacggagctattctcttgcctcagtctcccgagtagccgggaccacaggcgcccaccaccacgcctygctaatttttatatttctagtagagacggggtttcaccatgttggccatggctcgtctcaatctcctgaccttgtgatccaccctcctcgccctctcaaa

SEQ ID NO: 61146 - DNA, 201 bp, Homo sapiens
tttcaaaatttgattgttacatatattgtcatttcagtgactggagacaagatgtatatgtagacaaatagataaaaacagggtaattaaaccagtgtggtttttttttattttaaaggaaaacacatacgacttatgtacattgcatggcagagtattactaaaattcgcctaaacaaaccgtcacgatgttttcaggtt

SEQ ID NO: 61147 - DNA, 201 bp, Homo sapiens
tcaaaaaacagaaagttaaatgccttcaggtacataaggctgttaacgaaatgtcacataatcaaagcatttaacaaatattagttaacatcattattaaktcttcccaacccacgaaatggatggttccctggaaagtataacaacattatgcaaagttcaaagggagcctccttttaccataggaacctttaggtgtag

SEQ ID NO: 61148 - DNA, 201 bp, Homo sapiens
cagctaatttgggtttcaccatgttagccaggctggtctcgaactcctgacctcaagtgatccacccacctcgggcttccaaagttctgggattacctgcrtgagccactgtgcccagccaaggatatttttcttgtagtatctccattatcaaaacgtgctggaaaggatgttttacttgtttatcaatatggtgatgcc

SEQ ID NO: 61149 - DNA, 201 bp, Homo sapiens
ggtcttgaactcctgacctcaagtgatccacccattttgacctcccaaagtgctgggattacaagtgtgagccactgcacctgtccgaattattctgtttstgtatttatggccacagaagtttcatattggctaaatctgcacaaattatcatatagttataaatataaaagtcagatcaatatggctaagattatcaca

SEQ ID NO: 61150 - DNA, 201 bp, Homo sapiens
cagttctctgtcttcacattttaccctcttaaacttaatttttgcaaaaaatttttctattcggttttcattttcctagggaaagggaaaaattgtccctratgaaaagtgtttatagtatttaaaagagttgctcaaagtgtaagactggggaaaaaaagcttatgttgttttttttgtctttatcaaaataatggtata

SEQ ID NO: 61151 - DNA, 201 bp, Homo sapiens
tggttttctgaaaataattttttcataagtgtgagctttttttccttcttatctccaaatgtttttcattggaatatttatgaaatcctattcaaagcttkatgtaaggggtttgcttagtcaccacttagtttgaagtctgtctttactaaaacaccaaacatctttgacaacatacaaagaggagttaacattgattct

SEQ ID NO: 61152 - DNA, 201 bp, Homo sapiens
agtacagatgggtagagggtgaaaagtagcaaccaatgttagcaatttcttgtgtatccttctagagttactctgcatatacaagtatatgtgtatgtatrtatatatatatatatatatatattctttttaaaacatacagatgaaaacatattatatatactatcttgtacctagtagattcaatttcagatctgtcat

SEQ ID NO: 61153 - DNA, 201 bp, Homo sapiens
ttttgtttttgttttgagacggagctattctcttgcctcagtctcccgagtagccgggaccacaggcgcccaccaccacgcctcgctaatttttatatttytagtagagacggggtttcaccatgttggccatggctcgtctcaatctcctgaccttgtgatccaccctcctcgccctctcaaagtgctgggattacagcc

SEQ ID NO: 61154 - DNA, 201 bp, Homo sapiens
ttttgagacggagctattctcttgcctcagtctcccgagtagccgggaccacaggcgcccaccaccacgcctcgctaatttttatatttctagtagagacrgggtttcaccatgttggccatggctcgtctcaatctcctgaccttgtgatccaccctcctcgccctctcaaagtgctgggattacagccgtgagctacca

SEQ ID NO: 61155 - DNA, 201 bp, Homo sapiens
tgacagttttaattttgtagatgaatttggcatgacgtggatgaattctgtcaaggtcattattgttttcttctcaaaaccaatagaattttctcacttayttatttttagaattgtcaggtagtgtaataaagttatttctgtaggaaactgggaattcattggctatttgactctgaatgtaacctctttaaagctgat

SEQ ID NO: 61156 - DNA, 201 bp, Homo sapiens
tgaagcaaaagtggaccagcacagctttttgtgggggttagtggtaggagagtgttatagtgaagttctttgttctgttttctcagtctcatttctcattsattcattaaatcaatagatatttattttgcctgtggtatgagctaaccatttctctgggtctggataatatagcagacaacaagatccagtctttggccc

SEQ ID NO: 61157 - DNA, 201 bp, Homo sapiens
gcaaggaacctatgaacagtcactaacacaaatatgatatctcagaattcacagaagtactaaccttccccaactaaaaagggtattgggggatttagtgkatccttccatcttaaaagcttcttaagatgtacatttgaaaactagataactgttgcttaataatactttactgagaaacactgtgtactaacaattcat

SEQ ID NO: 61158 - DNA, 201 bp, Homo sapiens
cagattgcatttttcttcttttgaaagtcctaattaaattgtttgccatgttatgcaaagattcattgagattctggggagtggcagtaaatttaagcaargattatactgtgattctggggagccatagtaaattgtgtatcaacaaatctaaagggtgaatttttactttctgcttattgtctttttcaagaaaattct

SEQ ID NO: 61159 - DNA, 201 bp, Homo sapiens
tcattgagattctggggagtggcagtaaatttaagcaaagattatactgtgattctggggagccatagtaaattgtgtatcaacaaatctaaagggtgaayttttactttctgcttattgtctttttcaagaaaattctatagttaccaaaaaggtggctgaattttgacataataaaggagaaggttgagctggcctttg

SEQ ID NO: 61160 - DNA, 201 bp, Homo sapiens
tagccactttcttacttttacaaaaagttagtatggtgttttttttgtttttttgttttttggtttttttttgagatggagtcttgctctgtcacccaggytggattgcagtggggcgatctcgggtcattgcaacctccacttcccaggttcaagcgattcttttgcctcagcctcccaagtacctgggattacaagtgg

SEQ ID NO: 61161 - DNA, 201 bp, Homo sapiens
aatactgtacagattcccatcttatcagaggaagaaccagttagcataacatagaattttagggctagaagagactttcaacatcatcaagtcttacctckcggtattcaatagttcaatataattattatctttttacaggtcttagctttcctgccctaatttccaaaacaatgaagaactagtagtccccagatcccc

SEQ ID NO: 61162 - DNA, 201 bp, Homo sapiens
atatttattttgcctgtggtatgagctaaccatttctctgggtctggataatatagcagacaacaagatccagtctttggccccaaagagcatacagtacrggtactcacaacatggacaatgctagataactgcccagagagcagagaagctacatgagatcattataaacctgtgcacctgaaccactgcacaagcaat

SEQ ID NO: 61163 - DNA, 201 bp, Homo sapiens
actacgcggcctcagccacccctaatcaggccgggggcgcagccgaaatccaggagctggcctccaaacgagtggacatccagaaaaagaggttttacctrgacgtgaagcaaagctcccggggccgcttcctaaagatagccgaagtctggatagggagaggccggcaggacaacatcagaaagagtaaactgaccctct

SEQ ID NO: 61164 - DNA, 201 bp, Homo sapiens
agtatgtgtaatatatattaaacatacatatattgcacatgcatatatatacaattttttacatatatatgtaaaaatttttaaaagagatcccaatcctrttcacctttttcttgtccctggagaagtagtggtaaatgggtttcatctcgcttgtatttgcaattgattggctgccctaaagtgctgtgtttgtatcta

SEQ ID NO: 61165 - DNA, 201 bp, Homo sapiens
actcttggataatgataactaagtcttcgtttcatgaatttaacaatttgtatcagtgctaccttatgagtttttcagaaaaatgctatttgtattgaacyattttaaataattccataatctggaataattcagatttttttaatgatctgctgcaacatattggtattattgaatctcattttttctttgatttccatt

SEQ ID NO: 61166 - DNA, 201 bp, Homo sapiens
tcttttccctgcattccattttttattatttttttattttttattttttcaagacagggtcttgctttgtcacccaggccggagtgcagtggtgcagtgayggctcactgcagccttgacttctggggcttaagtgatcctcccgcctcagactcctgagtagctggtactacaggcatgcaccaccatgcccagctattt

SEQ ID NO: 61167 - DNA, 201 bp, Homo sapiens
gtaattaaaccagtgtggtttttttttattttaaaggaaaacacatacgacttatgtacattgcatggcagagtattactaaaattcgcctaaacaaaccrtcacgatgttttcaggttttatggtaatgctttgactatatagtatttggatttgaatcctcataatcacaaagtctcttagttgtttaaaacaaaaaac

SEQ ID NO: 61168 - DNA, 201 bp, Homo sapiens
tccaaatggaaactgaaatatttgttgaaatgtttaaatttgctgataacaaatgttctgaaagaagtaaactagccgggcgcagtggcgtgcgcctgtartcccagctactcgggaggctgaggcaggaggatcgcttgagcccaagagttcatatctagcctggtcaacatagcaagacccctgtctctatttttttaa

SEQ ID NO: 61169 - DNA, 201 bp, Homo sapiens
ccccaaagcgctggaagctgcgagctcgcccaagcctaaccgtgaccccaagacgcctggggctgcgagctcggcccccgcagaagtgcagcacaccctgyggcccgctccgacttccgcccttccccagccgcgactccggccgcctcagcccggacctcagcgtgtgcggccagcccagggacggcgacgagctgggca

SEQ ID NO: 61170 - DNA, 201 bp, Homo sapiens
ttcttcaacagcagcggcagcagcgacgccagcatcggcgacccctcgcagtccgacgatcctgacgatcccgacgaccccgacttccccggcagcccggwgaggcggcggcggaggtgtcccggcggccgagtgcccaaggaccggcccagcctgaccgtgaccccaaagcgctggaagctgcgagctcgcccaagccta

SEQ ID NO: 61171 - DNA, 201 bp, Homo sapiens
acaggccaggactcttgtcaagagagagggcttcaagaggccgtccggagagagcatcaggaggccagtgttcccaagggccgcattgtgccaaggggaayagacaggctggagagaactagatcaagccggaagagcaaacatcaggaggcaacggaaacctctctcctccattcccaccgctttaaaaagggccaaaag

SEQ ID NO: 61172 - DNA, 201 bp, Homo sapiens
gcaacggaaacctctctcctccattcccaccgctttaaaaagggccaaaagctgggaaaagattcgttccccacccaggacctgactcctttacagaatgyctgcttttggaccaaaaccagggcttccttcagtttccacaagaagaaaattgtgactgatgtgtcagaggtctgcagcatctataccactgccacttct

SEQ ID NO: 61173 - DNA, 201 bp, Homo sapiens
tgctctgccagcacagtctgtttaagtaagctaaatgtatcttactgccccgaaatgagaggagactggtcttgaagcctctggtgctgtttcaacctccrtccccacaggagggtggaactcccattctcacaggtttccagtcagcttttcaaacaagaattttgtttccaaatggaaactgaaatatttgttgaaatg

SEQ ID NO: 61174 - DNA, 201 bp, Homo sapiens
ttcaaacaagaattttgtttccaaatggaaactgaaatatttgttgaaatgtttaaatttgctgataacaaatgttctgaaagaagtaaactagccgggcrcagtggcgtgcgcctgtagtcccagctactcgggaggctgaggcaggaggatcgcttgagcccaagagttcatatctagcctggtcaacatagcaagacc

SEQ ID NO: 61175 - DNA, 201 bp, Homo sapiens
tcaaacaaaaaggcatctgatgctgaaaaggtttatggggaatgcagtcagaagggtcctgtcccctttagccattgccttcccacagaaaaactgcaackctgtgagaagattggggaaggggtgtttggcgaagtgtttcaaacaattgctgatcacacacccgtagccataaaaatcattgctattgaaggaccagat

SEQ ID NO: 61176 - DNA, 201 bp, Homo sapiens
aaccagggcttccttcagtttccacaagaagaaaattgtgactgatgtgtcagaggtctgcagcatctataccactgccacttctctctctggatccctcytatcagaatgttcaaaccggcctgtcatgaacagaacaagtggtgctccgtcctcttggcactcctcctctatgtatttgctaagccccttaaacactct

SEQ ID NO: 61177 - DNA, 201 bp, Homo sapiens
tctctggcctcgccctgccccgggtccccaacgccaagggacagtgtcatctcgatcggcacctccgcctgtctggttgcagcctcagccgtcccgagcgrcctccacctcccagaagtctccctggaccgagcatctctcccctgctcccaggaggaagcgacaggaggagccaaggacaccaggatggtccaccaaacc

SEQ ID NO: 61178 - DNA, 201 bp, Homo sapiens
atcttcacagcccccagcccttcaaataaagcccaaattccccagcagggcatacaaattcctcccagtctgaccccaatcaacctcgctgcctcaccccyaaaccacaaagctcacgcagcctctgcagctcactcaaggccctctcgggccaccatgtttttgcatatgctgtccctggtcccggaagcatcctctgcc

SEQ ID NO: 61179 - DNA, 201 bp, Homo sapiens
agccaacccgaagcaccgtctgggtgtgtgttccattgtgggtctctccggcattaggggttagggcttgcataggaaaagtggctcagtgttcatgtgtkgggttctgccagccactgggccactgccaggaagcccgactctgcatccaggtgatgccaacacatcctgctcagcccagtaagaatccagttcctcagg

SEQ ID NO: 61180 - DNA, 201 bp, Homo sapiens
attgtaagtctcttgctttctttttggatcgtcctcattttggcttttctgggctcatggaggaggcagggccaggcattgggcctctcccattgggagtrgggagggcacaggccaggcccttgaccatctgcccggcctggtgaggttgggggttggatgtggttggctggccgtgatgaaacaacctgagttgccacc

SEQ ID NO: 61181 - DNA, 201 bp, Homo sapiens
aacacaggctaaggaaccaaactgaatccagttcaaattccaagctctgccattcatcctctgtgggatcttagacaagcaacttcacctctctcagcctwggtttcttcatctgtagaatggtcattgcctgccccccatgggtggttgtgtggttcagtgaggagacagatatcagaggtcacacagtggcccccctgg

SEQ ID NO: 61182 - DNA, 201 bp, Homo sapiens
ttccctccagcaggggatgccctttgacctctgcttcctgctacagagctcagatttcaaggtgagcaggaaacccctccccacctctcacccccgggtcycccagctctatcaggcgaatgggctttaagtaatcaccttgattgacattcagccagagtgatgctactatacagataacacaatcatttccttgtaagg

SEQ ID NO: 61183 - DNA, 201 bp, Homo sapiens
accatctccgtcaatggctctgtgcagctgtcctacatcagcttccaggtcagactgtgcacctggcaccggtcccaggggctgggatgcagggcccagcrtagctgtgtctaggcccagctgggtgggcccaagccaatctcctacccaggtcactctggggacaacctctgcttccctgtcccagtacctgcccgcccc

SEQ ID NO: 61184 - DNA, 201 bp, Homo sapiens
ctcccagtctgtctgtttcccacccaggcccagggggcgcagacaaaaagtgagttcaacacagaggccctgggtggccgagcagacagtaggaaggaccragggtctgagaggctggccccagccagcaggccactcagggcctacaggccccatcttgcccactcaagagttccctgtctgtctgccgggcacccagag

SEQ ID NO: 61185 - DNA, 201 bp, Homo sapiens
tcagggcctacaggccccatcttgcccactcaagagttccctgtctgtctgccgggcacccagagctggggacctgggggtctccctgaattcttcattcycccttctttacgtctctccaaggcaccaagaggcccgaagccaccgacatggcccaggcctccgggattcctcaccatgacgacaggggtccagttcccc

SEQ ID NO: 61186 - DNA, 201 bp, Homo sapiens
ctctatcaggcgaatgggctttaagtaatcaccttgattgacattcagccagagtgatgctactatacagataacacaatcatttccttgtaaggtgttaytcatggctgcctagtcatcttatacacctttatctgaatctacaggtgcacctgctgcttcttttactctgaaaataagaactagaggagtcatcacgtt

SEQ ID NO: 61187 - DNA, 201 bp, Homo sapiens
gtaatcaccttgattgacattcagccagagtgatgctactatacagataacacaatcatttccttgtaaggtgttactcatggctgcctagtcatcttatrcacctttatctgaatctacaggtgcacctgctgcttcttttactctgaaaataagaactagaggagtcatcacgttgctgtttggtggtgtgtgtctttg

SEQ ID NO: 61188 - DNA, 201 bp, Homo sapiens
tggtctctccctcttgcccttgcctctgcctttcggcttctccttggctctattaatgcttctcctcactgcccggtgccttttgttttaacagaaccccygcacagtccctgttcagcctgccttctccacggtgccattctcccagtctgtctgtttcccacccaggcccagggggcgcagacaaaaagtgagttcaac

SEQ ID NO: 61189 - DNA, 201 bp, Homo sapiens
gtcgctcctctgggagtcctccccgcctggaatattgttggacgctcccccatgaccccacggagtctgtacgtatctgtgccatgccagttcaaagcacyccattgtaactgtgtttgcgttgtctgtccccgtcactccacccccatctccctatgcccatgaggcttcagagggccgggactgtgccttgttcatttg

SEQ ID NO: 61190 - DNA, 201 bp, Homo sapiens
ctcgcgcacacatgcgctctcccattgaatttcctggtttcttttcagcagactcccgccaacccacctatgatgtacccccaccccacctatgtaagtgrtttctcagggagggcggaggttctgtttgtggtgggcaggctgggggtgaagggccacttcgggggtatccactagccttgcaaaatgaaaagcgaaggg

SEQ ID NO: 61191 - DNA, 201 bp, Homo sapiens
cagcacacgcctaattgcccttccatgctctgcctaaatgtcgctcctctgggagtcctccccgcctggaatattgttggacgctcccccatgaccccacrgagtctgtacgtatctgtgccatgccagttcaaagcaccccattgtaactgtgtttgcgttgtctgtccccgtcactccacccccatctccctatgccca

SEQ ID NO: 61192 - DNA, 201 bp, Homo sapiens
aggatgtcactaccgatcataggcttaagctcttctcctgctggtgcaaatcaggccggaagtttagcgttagtggggctgcctgcagaggggttgagggrcaggtgaccgtggtggagtccgggaacacggcaggaagttccaggaaggctaacatgaaaagggaggtggatgggggagtccaagggccaaaggctcatg

SEQ ID NO: 61193 - DNA, 201 bp, Homo sapiens
tctgtgcagctgtcctacatcagcttccaggtcagactgtgcacctggcaccggtcccaggggctgggatgcagggcccagcatagctgtgtctaggcccwgctgggtgggcccaagccaatctcctacccaggtcactctggggacaacctctgcttccctgtcccagtacctgcccgccccttctcctctgtcactctg

SEQ ID NO: 61194 - DNA, 201 bp, Homo sapiens
tgtttgctaatatcagcacttttccttaagcattttctacttatttttagaaaatcatactgtaaaggcaaaatccaataattgcacaaaaacacattagrtccaaattagagaaacaaaaagatgccaaccaagcagtctctgcgacgcaagttgtatgcaagatcccagacaaatgcaaggcagaggcaccgaagccct

SEQ ID NO: 61195 - DNA, 201 bp, Homo sapiens
aattgcacaaaaacacattaggtccaaattagagaaacaaaaagatgccaaccaagcagtctctgcgacgcaagttgtatgcaagatcccagacaaatgcraggcagaggcaccgaagccctcctgtgcctgtcactggcaataacccatgccacagaagactatttgctttccctgggcctaggtttgctgtgcgctttc

SEQ ID NO: 61196 - DNA, 201 bp, Homo sapiens
gagatctcgctgttgctcaggctggtcttcaacttctgggctcaagtgacccacctgccttggcgtcccaaggtgctgtgattacaggcgtgagccactgygcccggccccaatttcacatgctctttacatttgttctcttctttcccacttaatcaggcttgtgctagcctccaacaagtgtccactggcatggaaggc

SEQ ID NO: 61197 - DNA, 201 bp, Homo sapiens
gagcagttgggactacaggagtgcactgtgatgcccagctaattaatttttttttaaagtagagatgagatctcgctgttgctcaggctggtcttcaactyctgggctcaagtgacccacctgccttggcgtcccaaggtgctgtgattacaggcgtgagccactgcgcccggccccaatttcacatgctctttacatttg

SEQ ID NO: 61198 - DNA, 201 bp, Homo sapiens
tacgatcatagctcactgcagcctccaattcctgggctcgagcaatcctcccatctcagcctctggagcagttgggactacaggagtgcactgtgatgccmagctaattaatttttttttaaagtagagatgagatctcgctgttgctcaggctggtcttcaacttctgggctcaagtgacccacctgccttggcgtccca

SEQ ID NO: 61199 - DNA, 201 bp, Homo sapiens
ccttttgttttaacagaacccccgcacagtccctgttcagcctgccttctccacggtgccattctcccagtctgtctgtttcccacccaggcccagggggygcagacaaaaagtgagttcaacacagaggccctgggtggccgagcagacagtaggaaggaccgagggtctgagaggctggccccagccagcaggccactc

SEQ ID NO: 61200 - DNA, 201 bp, Homo sapiens
agggtccctcacaaatcccacgagggtgttggagaaagcaggctggggctctagccttttgggcaggagtctcggacacaggaaggtggtaatggggtacmccaggaaacagccccatgcctccgagatgggagaggggctggggcagagcctgtgagggccacagcagggtcagagctgcctcctcagacctggcgtccc

SEQ ID NO: 61201 - DNA, 201 bp, Homo sapiens
caggtgagctaagactagaaagacaaacctactgcaggaaacaaccagaagaatgaaaagtccaactggagccccgtagagactcgggttgatgcacttcrggtcacacacacgttcctgtaactggccccacactgaagaccagactcaggtcttcattttctagaaagagggtccaggagctcaggggtggtccccatc

SEQ ID NO: 61202 - DNA, 201 bp, Homo sapiens
ttaattaattattttttttcttttgagacagggacttttttctttgacccaggctggagtgcagtggtacgatcatagctcactgcagcctccaattcctrggctcgagcaatcctcccatctcagcctctggagcagttgggactacaggagtgcactgtgatgcccagctaattaatttttttttaaagtagagatgag

SEQ ID NO: 61203 - DNA, 201 bp, Homo sapiens
ttgttcaaggaaaaataaataataaataaatgaaaccccaggtgagctaagactagaaagacaaacctactgcaggaaacaaccagaagaatgaaaagtcyaactggagccccgtagagactcgggttgatgcacttcgggtcacacacacgttcctgtaactggccccacactgaagaccagactcaggtcttcattttc

SEQ ID NO: 61204 - DNA, 201 bp, Homo sapiens
tgtctctcccttccttggggcaggaatttccaaaggactacagggatgaagctgaagggctccaaaagaaaaaaatacattcagaggtatttcaaatgtamtcatctccatttattcatttattcatttaattaattattttttttcttttgagacagggacttttttctttgacccaggctggagtgcagtggtacgatc

SEQ ID NO: 61205 - DNA, 201 bp, Homo sapiens
tgcaagcagagtaggtctctgggcttgagaagcctgtgggtaagtcagtccgagtatgcttatctgagataaggatgtccccatccactcagtatgcaacstgaggtcacctctcctctgctccccatgagcattttatgcatatataaataatacccctgcagccataaaaaggaacgagatcatgtcctttgcaggaac

SEQ ID NO: 61206 - DNA, 201 bp, Homo sapiens
ttcgtgcagtacttccaccgcgtgcccttccaccgtgtggacaccatctccgtcaatggctctgtgcagctgtcctacatcagcttccaggtcagactgtscacctggcaccggtcccaggggctgggatgcagggcccagcatagctgtgtctaggcccagctgggtgggcccaagccaatctcctacccaggtcactct

SEQ ID NO: 61207 - DNA, 201 bp, Homo sapiens
tcccattgggagtggggagggcacaggccaggcccttgaccatctgcccggcctggtgaggttgggggttggatgtggttggctggccgtgatgaaacaayctgagttgccaccccgtgggcagccacggaagaccatgccccacattcacttctgtcacctgcaaagggaggctaggctgagagacgtttccccgagagg

SEQ ID NO: 61208 - DNA, 201 bp, Homo sapiens
ttggctcactgcaacctctgcctcccaggttcaagcgattctcctgcctcagcctccctagtagctgggactacaggtgtgcaccaccacacctggctaattttttttttttttttttgtatcttcagtagaaatggggtttcactatattggccaggctggtctcgaactcctgacctcaagtgatcagctcgcctcggc

SEQ ID NO: 61209 - DNA, 201 bp, Homo sapiens
cccagctacttgagaggttgaggcaggagaatcgtttgaacccaggaggtggaggttgcagtgagccgagatcgcaccactgcactctagcctgggtgacrgagcaagactctctctctcaaaaaaaaaaaaaaaaaaaaaaaaaaaaagaaagagagagagagaaccttcatctgggattttaagcctggatagccgcag

SEQ ID NO: 61210 - DNA, 201 bp, Homo sapiens
gaggttgaggcaggagaatcgtttgaacccaggaggtggaggttgcagtgagccgagatcgcaccactgcactctagcctgggtgacggagcaagactctytctctcaaaaaaaaaaaaaaaaaaaaaaaaaaaaagaaagagagagagagaaccttcatctgggattttaagcctggatagccgcaggggctattgggaa

SEQ ID NO: 61211 - DNA, 201 bp, Homo sapiens
agtgagccgagatagtgccatgcactccagcctgggctacagagcgagactccgtgtcaaaaaaaaaaaaaaaaaaaaaaaaaagtccccaacttattaaraagcccccagtgatgtaaagtctaccctgattcaccagcaatggccatattcagcaattctcttataatgtactccccatgagccttcggcaaatatacc

SEQ ID NO: 61212 - DNA, 201 bp, Homo sapiens
cccaagaggcatgaactcactgtccacggaggaattatgtttgactgtggtcatagatcacatatttccagccagggggaggcgtggattttgtgctgatrctgaaaggagtgagggacttgggactcatctggaatattgtcctgggccagatataacattagacaagtattttcaggacattgcaagagtgatggccct

SEQ ID NO: 61213 - DNA, 201 bp, Homo sapiens
tgatgcaggagaatcaattgaacccaagaggcagagtttgcagtgagttgaaattgtgccactgcactccaacctgggagacagagtgaaactgtgtctcaaaaaaaaaaaaagtttctgtgacaacatgcattggagaactacaaattagatcctcagaattgacctttgagggagacaaagagatattggccctatttt

SEQ ID NO: 61214 - DNA, 201 bp, Homo sapiens
ctgtctcatcctcatgtcaccccaggtggcgggcttcaggactctctactctttcccctaagatgcagcttgttgagatgtttctagcactccattgcccyctgaggctcagatgagttccccttctccaagtacactctcccaggccaatgagccgaacacacatcacctcctccagatgtattctgtggcctgggctca

SEQ ID NO: 61215 - DNA, 201 bp, Homo sapiens
atataacattagacaagtattttcaggacattgcaagagtgatggccctttcttagtgggagagctgccttgaaagagtccattgtcctgacttgggggtktagtgacgttggactgcagtgagacagagttaaagcagtgcttccccaaatttaatgtgtagtggggtggcacgcacctgtagtctcagctacttggaag

SEQ ID NO: 61216 - DNA, 201 bp, Homo sapiens
gatgcaggagaatcaattgaacccaagaggcagagtttgcagtgagttgaaattgtgccactgcactccaacctgggagacagagtgaaactgtgtctcaaaaaaaaaaaaagtttctgtgacaacatgcattggagaactacaaattagatcctcagaattgacctttgagggagacaaagagatattggccctatttta

SEQ ID NO: 61217 - DNA, 201 bp, Homo sapiens
gttctagattccttctaaacaccagaacactcccagctgatgtctgttctgtgttccattttcattccaggcatggtctgagttctaggccagatgccaatttttttttttttttttttgagacggagtttcactcttgttgctcaggctggagtgcaatgctgcgatcttggctcaccacaacctctgcctcccgcgttc

SEQ ID NO: 61218 - DNA, 201 bp, Homo sapiens
agcccacgaagctgaggtcaacctgggcaacatagtaagaccctgtctctaaaaaataaacaaatacagccaggcgcggtggctcatgcctgtaatcccakcacgttgggaggctgaggtgggcggatcccttgaggtcaggagtttgagaccagcctggccaacatggtgaaacgccgtctctactaaaaaatacaaaaa

SEQ ID NO: 61219 - DNA, 201 bp, Homo sapiens
tttttttttttttgtttggagacggagtcttgctctgtcgcccaggctggagtgcagtggtgctatctcggctcactgcaagctccgcctcccaggttcaygccattctcctgcctcagcctccccagtagctgggactacaggcgcccaccaccacgcccggctaactttttgtattttcagtagagatggggtttcacc

SEQ ID NO: 61220 - DNA, 201 bp, Homo sapiens
ttggcttactgccacctctgcctcccgggttcaagagattctcctgcctcagcctcccaagtagctagaactacaggcacctgccaccatgcaccgctaattttttttttttttttttgtatttttagtagagatggggtttcactatgttggccaggctagtcttgaactcttgatccgcccacctcggcctcccaaagt

SEQ ID NO: 61221 - DNA, 201 bp, Homo sapiens
tctctactaaaaaatacaaaaattagccgggcgtggtggctcgtacctgtaatcccagctactcgaaggctgaggcaagagaattgcttgaacctgggatkgggaggttgcagtgagacgagatcgtgccaccgcgctccagcctgggtgacatagcagactctttcagaaagagagagagagagagagagagagagaaag

SEQ ID NO: 61222 - DNA, 201 bp, Homo sapiens
gaatcacttgagcttgggaggtggaagttgcagtaagccgagatccgtaccactgcactccagccagagtgctggttgctcatgcctgtaatcccagcacyttgggagaccaaggcaggcacatcacctgaggtcaggagttcaagactagcctggccaacatcgtgaaacccccgtctctactgaaaatacaaaaattag

SEQ ID NO: 61223 - DNA, 201 bp, Homo sapiens
ggagaggtcagaggcagggctccccagtgtacagcaacaataacccctcacaccagtggttttccaaagcaacctcagctttccctaaaggttcaaactcagggcaaaggggaggctgagtcactgggatcttgaaccctaactttcactttagtcagatctggtctacttttatttctcatgcgtcaagtttctgcatag

SEQ ID NO: 61224 - DNA, 201 bp, Homo sapiens
acagggccacacagcaaaatgcatggcagggtcccaattccaacctgaatttgttcaactccaaagtcacattgcctggtacatggcaggtgccctataakaagaatcattccttttctctgttactgcttgccccagaaagcaggagggacataaacgtgtggcccagggccttcaggaggacaccctccttcctctccc

SEQ ID NO: 61225 - DNA, 201 bp, Homo sapiens
ctggcactacaggtgtgagccaccacgcctggccacagttgttaatttcatttactattcactctgtattcaaatttccccaacatacttaaaatatgttyattgtttctcccccactaggacgaaaagtgtctgtcgtgtcccttgccatatcccacaccctatgacggtgactggtgcctgacactcaccagaagtaca

SEQ ID NO: 61226 - DNA, 201 bp, Homo sapiens
ccacccgcctctgcctcccgaagtgctagaccactctcagcctaatttttgtatttttagtagagatggggtttctccaggttggccaggctagtcttcartctccaaaagtgatgtgcccgcctcagcctcccaaagtgctggcactacaggtgtgagccaccacgcctggccacagttgttaatttcatttactattca

SEQ ID NO: 61227 - DNA, 201 bp, Homo sapiens
gcatccaaaaaaaaaaaagtttagaattttggagcattttggattttggattttcaggttggggatgctcagagacctgtacttgaatgtaattggagaargtcataacatcttagcccccaaaattactttagtgggtctttttcttccttgtaaacaccacatcctttatcacacctaagggcattcacattgttgtta

SEQ ID NO: 61228 - DNA, 201 bp, Homo sapiens
ctgtcagtctcctgttaaaggggccacgaccgcccgggagccgtggggggggagggggagggaggaggaatttttttggggggaaggtgggatttgggggscgctggtgggcacccctggatctggcggctgcggcctcgcggggggaggctgatcggtgacaggggcagggggctattttgggggtagaaggcagtgaga

SEQ ID NO: 61229 - DNA, 201 bp, Homo sapiens
ttcatgtcttcattcatttggtgatttatttagaatttggaaggaacacagcttgccaaggtaggcgggaggaggagggaaaaggaaagggcactctgggrcctgcttgggtgactgggtaggtaaaggaatttatttcctttacttatttttttgttgttttttggtttttgttgttgttgttttgagatggagtttcac

SEQ ID NO: 61230 - DNA, 201 bp, Homo sapiens
agggacgaatgggacccccaggccgggacagctcttctctgggtgagtacctcactctaacccttccctcctttgttccttcctcccttcctccctccctytctttcttctttgtatgttcatttgacatccattcatgtcttcattcatttggtgatttatttagaatttggaaggaacacagcttgccaaggtaggcgg

SEQ ID NO: 61231 - DNA, 201 bp, Homo sapiens
gatcttgaaccctaactttcactttagtcagatctggtctacttttatttctcatgcgtcaagtttctgcataggattttaaaaagtttctggctgggtgyggtggctcacgcctgtaatcccagcacttcgggaggccaaggtgggcagatcacttgaggtcaggagttcgagacccacctggccaacatggtgaaaccc

SEQ ID NO: 61232 - DNA, 201 bp, Homo sapiens
ctgggctgggaaaagcatcagtgaggtcgggcaagtcaggatcatgagccaagacccagcgccaacctcggcccccagccacctaatgtccctctgtcccsacacagggataggattgggagcggtctgccccttcgggctccataccacccccattccctggggaactggacggctccgatgaggaggaggcagagggga

SEQ ID NO: 61233 - DNA, 201 bp, Homo sapiens
acccactccccgctctgcccgtcttgagagaatgacccaggccttggcactgcaggcggggtccctggaagatgggggacccccacggggaaggtcagcakggacaagggatagggacagggagaagctggcttgggaagatgagaagggggtggacaaggacttgggaggagagggggcatctcagcaagcatatgctct

SEQ ID NO: 61234 - DNA, 201 bp, Homo sapiens
tttccttgtcctgtttcttctccttgcgaactttcccacgtctctgtttcgctccccacccccttgcctttccccacctccctgttcccccatctctccgrttttctcctcctctgtccctctgtcccctctgtccctctgtccctccgctgcagctgtgggtgggcatgcctgcctggtatgtggccgcctgccgggcca

SEQ ID NO: 61235 - DNA, 201 bp, Homo sapiens
tcccctcttcctactaacgggtcaggagaccaaggagatcagctgggagcaggtagggggcgcggggcggggcgtgagcgcatgaacaggctgtgcacgaygcatggatgcccctcctccgagccctgcccctgccttcaccagaacatgccatcatccccatgggggggcgctgcgccaagcttggctctggactgttcc

SEQ ID NO: 61236 - DNA, 201 bp, Homo sapiens
tcccagctacttgggaggctgaggcaggagaatcgcttgaacccaggaggtagaggttgcactgagccgagattgcaccattgtactccagcctgggtgayagagccagattccatctcataaaaaccaaacaaataaactaacaaaaaaacccaagaggcatgaactcactgtccacggaggaattatgtttgactgtgg

SEQ ID NO: 61237 - DNA, 201 bp, Homo sapiens
gtctctactaaaaaatacaaaaattagccgggcgtggtggctcgtacctgtaatcccagctactcgaaggctgaggcaagagaattgcttgaacctgggayggggaggttgcagtgagacgagatcgtgccaccgcgctccagcctgggtgacatagcagactctttcagaaagagagagagagagagagagagagagaaa

SEQ ID NO: 61238 - DNA, 201 bp, Homo sapiens
aggcaagagaattgcttgaacctgggatggggaggttgcagtgagacgagatcgtgccaccgcgctccagcctgggtgacatagcagactctttcagaaagagagagagagagagagagagagagaaagagagaaagaaagaaatttaaaaataaatataatgtatatttcgaatcacctgagggtcttgtgaaaatgccg

SEQ ID NO: 61239 - DNA, 201 bp, Homo sapiens
ggcaagagaattgcttgaacctgggatggggaggttgcagtgagacgagatcgtgccaccgcgctccagcctgggtgacatagcagactctttcagaaagrgagagagagagagagagagagagaaagagagaaagaaagaaatttaaaaataaatataatgtatatttcgaatcacctgagggtcttgtgaaaatgccga

SEQ ID NO: 61240 - DNA, 201 bp, Homo sapiens
cttaggcacagacaggcggctggacgaggtgggcgcggcaacagctcagagggctctgctcccagcggctcctcgagaggctgagctgagggggcggggcctgactattaatggtcacggttggaggcggggccaggagaggggcggggttaaaggagaggtgagacccggagaggggtggagtcaaaggaaggggcggag

SEQ ID NO: 61241 - DNA, 201 bp, Homo sapiens; identical to SEQ ID NO: 19554

SEQ ID NO: 61242 - DNA, 201 bp, Homo sapiens
ttaggcacagacaggcggctggacgaggtgggcgcggcaacagctcagagggctctgctcccagcggctcctcgagaggctgagctgagggggcggggcctgactattaatggtcacggttggaggcggggccaggagaggggcggggttaaaggagaggtgagacccggagaggggtggagtcaaaggaaggggcggagt

SEQ ID NO: 61243 - DNA, 201 bp, Homo sapiens
taggcacagacaggcggctggacgaggtgggcgcggcaacagctcagagggctctgctcccagcggctcctcgagaggctgagctgagggggcggggcctgactattaatggtcacggttggaggcggggccaggagaggggcggggttaaaggagaggtgagacccggagaggggtggagtcaaaggaaggggcggagtc

SEQ ID NO: 61244 - DNA, 201 bp, Homo sapiens
agttcagatcctgaaatggcttggctagttaaccctggaccccttccaggctggccagtaggaagtgcctattattgaaaatgcctcacctcctgaggggrtcaacagtcaatagaacttatcagctccccaccctttccaagaagagcgcagccagtggggagggacccgtaggagcagcagtctaggggactggaaagc

SEQ ID NO: 61245 - DNA, 201 bp, Homo sapiens
agcctaagggtccctttgggagccaggtggagggcgtggagctggatggggaggagagggggtagggggagaccggagaagcaaattggcaccataaccgwgggggtggagccagcgtggggggcgtggcccgaagagaccaaatggaggtggaggtatgggctaaactgaactctccaggccacgggaggggcacggctg

SEQ ID NO: 61246 - DNA, 201 bp, Homo sapiens
aggcacagacaggcggctggacgaggtgggcgcggcaacagctcagagggctctgctcccagcggctcctcgagaggctgagctgagggggcggggcctgactattaatggtcacggttggaggcggggccaggagaggggcggggttaaaggagaggtgagacccggagaggggtggagtcaaaggaaggggcggagtca

SEQ ID NO: 61247 - DNA, 201 bp, Homo sapiens
gaggcaagagaattgcttgaacctgggatggggaggttgcagtgagacgagatcgtgccaccgcgctccagcctgggtgacatagcagactctttcagaaagagagagagagagagagagagagagaaagagagaaagaaagaaatttaaaaataaatataatgtatatttcgaatcacctgagggtcttgtgaaaatgcc

SEQ ID NO: 61248 - DNA, 201 bp, Homo sapiens
ggcaacagctcagagggctctgctcccagcggctcctcgagaggctgagctgagggggcggggcctgactattaatggtcacggttggaggcggggccagragaggggcggggttaaaggagaggtgagacccggagaggggtggagtcaaaggaaggggcggagtcagacaaggcaggagtccctcaccggctgtccggc

SEQ ID NO: 61249 - DNA, 201 bp, Homo sapiens
tcccagcggctcctcgagaggctgagctgagggggcggggcctgactattaatggtcacggttggaggcggggccaggagaggggcggggttaaaggagargtgagacccggagaggggtggagtcaaaggaaggggcggagtcagacaaggcaggagtccctcaccggctgtccggctcctatacctaggacagcgccaa

SEQ ID NO: 61250 - DNA, 201 bp, Homo sapiens
ctgtggccgtgtccgtgccccgggggtagggggcgcagaatggcgcttccccttctcctctggctccggggtttgcatgggagaatcctctttccacgatkccgctgggcgacgtggcgtgggggcagggggacggtgggggagccctcgcccccgactctcggtcggcctccccgccccaggcgtcactcagtgatcacg

SEQ ID NO: 61251 - DNA, 201 bp, Homo sapiens
aaattagccaggcatggtggcaggcgcccgtagtcccagctactcaggaggctgaggcaggagaatggcatgaacccgggaggcggagcttgcagtgagcygagatagtgccatgcactccagcctgggctacagagcgagactccgtgtcaaaaaaaaaaaaaaaaaaaaaaaaaagtccccaacttattaagaagcccc

SEQ ID NO: 61252 - DNA, 201 bp, Homo sapiens
gaatctcaagacaacacaaggttcccaacctcaaacaccaagaatctcatcctaacatgctaatcaaaaacttcaactccaggctgggcacagtggctcaygcctgtaatcccagcactttgggaggctgaggccagcggatcatgaggtcatgaggtcaggagatagagaccatcctggctaacatggtgaaaacctgtc

SEQ ID NO: 61253 - DNA, 201 bp, Homo sapiens
gacgccaagcagaagctgcagcagacgctgcagaaagcggagaccttgcccgagatagaggcgcagctggcgcagcgcgtggcggcgctcaacaaggtgcsgggaggactcgggtcggggccttgcgtggggaaggggtggggcctagaggaggcggggccgtgaatctggaggggtaggagcgaggtcagaaccccggat

SEQ ID NO: 61254 - DNA, 201 bp, Homo sapiens
gccctgccctgccggagctgactccacagcccttctggctctggaggcctgaaagcctgagtccgtctcctcttacaccatccacaaggaattcttccagyccaacactcactccgctgtccaggcatcccctaggatacactcagaagtcttctatgtgctacctacacatataccccccagccagtactcaccattccc

SEQ ID NO: 61255 - DNA, 201 bp, Homo sapiens
ctcatccactcaccctttcttctctccttccctgcaaccctcttgcctggatgtctcctcctgtggatgtcctgccacctggtgagaacctgagagtaatsatgggacagggaggggtgtgtagaatcccagagtaggtggggttaggtgaggaacaggagccagctgagtcatgggaatcaggggcgggggtggagtcat

SEQ ID NO: 61256 - DNA, 201 bp, Homo sapiens
acctcaagttatctgcccacctcagcctcccaaagtgctgggattgcaggcttgagccaccaggcctggccccttgaccttgacttcaggacccctggccstaggtctgtctctgtgacccttacctctgtgctcttttcctgaccccttggtctctgactgctttcctcatgcccacaggtctctccctggcagtgccct

SEQ ID NO: 61257 - DNA, 201 bp, Homo sapiens
agagtccattgtcctgacttgggggtttagtgacgttggactgcagtgagacagagttaaagcagtgcttccccaaatttaatgtgtagtggggtggcacrcacctgtagtctcagctacttggaagactgaggcaggaggaccgcttgagcccacgaagctgaggtcaacctgggcaacatagtaagaccctgtctctaa

SEQ ID NO: 61258 - DNA, 201 bp, Homo sapiens
atactgtgttctaaaccagggtcaccccacacacaccttagtagacatctcagttaataaggagcccccgacatgactctttgaactcaatccagcatctrtgccctctgtcctcagaatcatgtccctaaggaggaagctggagctccacgaggggaggggccggccatcccaggagacaccccaccacccactccccgc

SEQ ID NO: 61259 - DNA, 201 bp, Homo sapiens
ccttcctccctccctctctttcttctttgtatgttcatttgacatccattcatgtcttcattcatttggtgatttatttagaatttggaaggaacacagcytgccaaggtaggcgggaggaggagggaaaaggaaagggcactctgggacctgcttgggtgactgggtaggtaaaggaatttatttcctttacttattttt

SEQ ID NO: 61260 - DNA, 201 bp, Homo sapiens
agattcacatgtattttttgaccttctgccgtgttttgtacattcataaaaggtgcgtgtgcgtatgtgcatgtgtgtgtgtgtgtgtatgtgtgctgatrggggccatccacagagcagggggtctccatccctgacagcttctatcctggccccttcacccttacaggcatgaactcctggaggaggcctgccgccagg

SEQ ID NO: 61261 - DNA, 201 bp, Homo sapiens
tgataggggttggggggagaggatttacagattcacatgtattttttgaccttctgccgtgttttgtacattcataaaaggtgcgtgtgcgtatgtgcatrtgtgtgtgtgtgtgtatgtgtgctgatgggggccatccacagagcagggggtctccatccctgacagcttctatcctggccccttcacccttacaggcat

SEQ ID NO: 61262 - DNA, 201 bp, Homo sapiens
tcttattttgttctctcttttgataggggttggggggagaggatttacagattcacatgtattttttgaccttctgccgtgttttgtacattcataaaagstgcgtgtgcgtatgtgcatgtgtgtgtgtgtgtgtatgtgtgctgatgggggccatccacagagcagggggtctccatccctgacagcttctatcctggc

SEQ ID NO: 61263 - DNA, 201 bp, Homo sapiens
tgggaattcaatgctgggaggaggtgtccgtgatcctgaacttgcttgcctggaaacccaggagctcctagagtttttattttttctttctttttttaaawtttttttttgtattttttacatttatattatattttttgtttcttttgtttttcttattttgttctctcttttgataggggttggggggagaggatttac

SEQ ID NO: 61264 - DNA, 201 bp, Homo sapiens
aagctacgcctcgccatccaggagatggtctcgctcacctcgccctcagcccccgcctcctcccgcactgtgagtgtccggcggccaattccagccttcgyttcctcagagccccgcctcttgccctcagtctagccaatcctgggcctgctcactcccctgtcccacgaccctgcttctcattggcttttacccccctca

SEQ ID NO: 61265 - DNA, 201 bp, Homo sapiens
gcctaagggtccctttgggagccaggtggagggcgtggagctggatggggaggagagggggtagggggagaccggagaagcaaattggcaccataaccgtrggggtggagccagcgtggggggcgtggcccgaagagaccaaatggaggtggaggtatgggctaaactgaactctccaggccacgggaggggcacggctga

SEQ ID NO: 61266 - DNA, 201 bp, Homo sapiens
ggcagtgctcgaggaggagctggaactgagcaatcaggaggtgtgggtgtggccaagacagggaatttgaatccaaggggaggggctaaggggctgcccayggggcggagccggttgggtgggttccagagagaatctattggggcaggactagggcagacaagctatggggttggactatggagagaaaccagtggggtt

SEQ ID NO: 61267 - DNA, 201 bp, Homo sapiens
ataaaataaaaaaaataaagctgggctgggaaaagcatcagtgaggtcgggcaagtcaggatcatgagccaagacccagcgccaacctcggcccccagccrcctaatgtccctctgtccccacacagggataggattgggagcggtctgccccttcgggctccataccacccccattccctggggaactggacggctccga

SEQ ID NO: 61268 - DNA, 201 bp, Homo sapiens
attccccaccctgtactgtgtgtagtaaccttctaggttctatgtccagccttgctgtgttttttatttccttctcggtcaatttaaggctctggaacagsctccccaaaacatctgtgttgcatcgtcagagtgggttgctggttttagatatcatgttggggctgggcgcggtggctcatgcctataatctcagcactt

SEQ ID NO: 61269 - DNA, 201 bp, Homo sapiens
aacgttccggactcccccgtcaggatgaaatggataaatcccactcccccttcccagggcgggagtgaactcgcccaatgcgagtttgagtccttggctgyggggaagggagggaaacccatgtggagcccggcgatcgttgtgacatcgggaagggaagtccaaagggaggaatcctggagaggaacagggaggagggtg

SEQ ID NO: 61270 - DNA, 201 bp, Homo sapiens
gtttttattttatttttgagacggagtctcactctgtcacccaggctggagtgcagtggtatgatctcagctcactgcaacctctgcctcccgggttcaarcaattctcctgcctcagcctcccaaatagctgggactacaggcacatgccaccacgcctggctaattttttttgtatttttaatagagacagggttttgc

SEQ ID NO: 61271 - DNA, 201 bp, Homo sapiens
tttctgttgggagacgggtgtcctttacccgcgggaagggggcggggcttccctcccgggccgcatgcggggagaggctgctccctcccctttttcctgcscagtcgcggggcccaagtcttccttcttcgtccgaaaggaggggaggggggactcgctgctacaagcctcgccccctgtgccactcagctccgccccgcc

SEQ ID NO: 61272 - DNA, 201 bp, Homo sapiens
aggggaggggggactcgctgctacaagcctcgccccctgtgccactcagctccgccccgccgcgtccggtcgccggtcccccgggtcatctgcgggcgggktcccctctccctcccccgtgtctcgtgtccccggggcctcaccgccccccgtgctgtggccgtgtccgtgccccgggggtagggggcgcagaatggcgct

SEQ ID NO: 61273 - DNA, 201 bp, Homo sapiens
gctggagtgcaatgctgcgatcttggctcaccacaacctctgcctcccgcgttcaagcgattctcctgcctcagcctcctgagtagctgggattacaggcrcctaccaccatgcccggctaattttttgtatttttagtagagatgggggtttctccatgttggtcagactagtctcgagttcccgacctcaggtgatcac

SEQ ID NO: 61274 - DNA, 201 bp, Homo sapiens
ctgttctgtgttccattttcattccaggcatggtctgagttctaggccagatgccaatttttttttttttttttttgagacggagtttcactcttgttgcycaggctggagtgcaatgctgcgatcttggctcaccacaacctctgcctcccgcgttcaagcgattctcctgcctcagcctcctgagtagctgggattaca

SEQ ID NO: 61275 - DNA, 201 bp, Homo sapiens
tgagacaaggtctctgttgcccaggctggagtgcactggcacaatcacagctcactgcagcctccacctcctaggctcaggtcatcttcccaccttagcckcctgagtagctgggaccacaagcactcaccaccaggcctggctaattaaaaaaaaatttttttggccaggcgcggtggctcatgccggtaatcccagcac

SEQ ID NO: 61276 - DNA, 201 bp, Homo sapiens
ctgcggggaagggagggaaacccatgtggagcccggcgatcgttgtgacatcgggaagggaagtccaaagggaggaatcctggagaggaacagggaggagkgtgctccaggctgaaccgctgctcgctctccctccaggccagacttctgggagttcccgggcagacggcgtttcggtccggacctattcctgctagtgca

SEQ ID NO: 61277 - DNA, 201 bp, Homo sapiens
gattctggccgtgattggttggggatgttctgagttggaagaatgttgactgtgattgattgggacaggatacatagactgggacctgactggttgatagyagaaaaataaaccaggatgggggctaacagtggatggggcagattggatagctggttgtggctgcatacccgttatggagacaggagccccaacgctgcc

SEQ ID NO: 61278 - DNA, 201 bp, Homo sapiens
ggtagaagtgctcaaagctctaaagtctctcttcgagcaccacaaggccctggatgagaaggtatgagaattagaagagcaggggtggagaatggaaaccyatagttgactggggctgttctgagtgggagagattctggccgtgattggttggggatgttctgagttggaagaatgttgactgtgattgattgggacagg

SEQ ID NO: 61279 - DNA, 201 bp, Homo sapiens
tggtgtccaggcacgagaggtcactgcgcatgaccgtggtgaagcgccaggcccagtccccgggtggggtctcctcggaggtagaagtgctcaaagctctraagtctctcttcgagcaccacaaggccctggatgagaaggtatgagaattagaagagcaggggtggagaatggaaacccatagttgactggggctgttct

SEQ ID NO: 61280 - DNA, 201 bp, Homo sapiens
gtctcggtgctcctttatatggctccatcttttcctccatgtgtccgccctacctgtcaccctttttctcacatctgccccttttcccttgcctcttttcmttgaccccatgccgtgtgcttgcagctgctcctggaacacctggagtgcctggtgtccaggcacgagaggtcactgcgcatgaccgtggtgaagcgccag

SEQ ID NO: 61281 - DNA, 201 bp, Homo sapiens
ttgggacaggatacatagactgggacctgactggttgatagcagaaaaataaaccaggatgggggctaacagtggatggggcagattggatagctggttgyggctgcatacccgttatggagacaggagccccaacgctgccctatcggatccgtcccaggggtgttctggaccaggggcaactgtcctaaactggatctt

SEQ ID NO: 61282 - DNA, 201 bp, Homo sapiens
attggttggggatgttctgagttggaagaatgttgactgtgattgattgggacaggatacatagactgggacctgactggttgatagcagaaaaataaacyaggatgggggctaacagtggatggggcagattggatagctggttgtggctgcatacccgttatggagacaggagccccaacgctgccctatcggatccgt

SEQ ID NO: 61283 - DNA, 201 bp, Homo sapiens
gccgtattttggggatgactccaattcatgggcgcttgtctgcctttatcacttcctcgatgtgccctcactcactactccctcagggcctctgcctttcyggcattttcctcatcacctccagcatgaaagattctgcctcccccttgagattttccaaatttcgacccctccctgcctccagctggaacaccctcagat

SEQ ID NO: 61284 - DNA, 201 bp, Homo sapiens
cagctcactgcaagctccgccttctgggttcacaccattttcctgcctcagcctcccaagtagctgggacaacaggcgcccaccaccacgcccggctaatwttttgtatttttggtagagacggggtatcaccgtgttagccaggatggtctctatctgttaacctcgtgatccacctgcctctgcctcccaaagtgttgg

SEQ ID NO: 61285 - DNA, 201 bp, Homo sapiens
aaatgggcaaatgctacaaatcagggattcccttctgcctccccaaggagccggttgttaggcatttaccagcatacaactgccaccttaccaagggcatmccagtgcatccagccgtattttggggatgactccaattcatgggcgcttgtctgcctttatcacttcctcgatgtgccctcactcactactccctcaggg

SEQ ID NO: 61286 - DNA, 201 bp, Homo sapiens
tagtagagatggggtttcaccatgttggccaggctgggctcaatctcttgacctcgtgatccaacagcctcagcctcccaaagtgctgggattacatgagygggccaccttgcccggccgttactgtgttttttttttgaaatggaatctcacactgttgcccaggctggagttcagtggtgctatctcggctcactctaa

SEQ ID NO: 61287 - DNA, 201 bp, Homo sapiens
agggaggagaattgcttgaaccgggacccgggaggtggaggctgcagtgagccgagatcgcatcactgcactccagcctgggtgacagatcactccagctaaaaaaaaaaaaaaaaaaaaaaaagaaagtagggaaaggaaaagaaaagaaaagaaaagaaaaaaattagccaggtatgctggtgtgtgcctgtagtcgca

SEQ ID NO: 61288 - DNA, 201 bp, Homo sapiens
actcttccctcacctgcccatggccccagatcctggcatatggcgacatgaaccacgagtgggtggggaacgactggctgcccagcctggggctgccccartaccgcagctacttcatggagtcgctggtggacgctcgaatgttagatcaccttaacaagaaggagctccggggccaactcaagatggtggacagctttc

SEQ ID NO: 61289 - DNA, 201 bp, Homo sapiens
gtcaggatcatgagccaagacccagcgccaacctcggcccccagccacctaatgtccctctgtccccacacagggataggattgggagcggtctgcccctkcgggctccataccacccccattccctggggaactggacggctccgatgaggaggaggcagaggggatgtttggggccgagctgctgtcccccagtgggca

SEQ ID NO: 61290 - DNA, 201 bp, Homo sapiens
tcttacaggccaccttgaacttgaccttttgtccatagtaatcccttcatgattttccaaaccccttgactatcatcagggccaccctgatacaaaccccratcaccttgatagccctaatcctgcaatgacttcctgagactctcaggaccccttgactctccttgagcctggaaggccttcagaaacccaccaaagtcc

SEQ ID NO: 61291 - DNA, 201 bp, Homo sapiens
agcctcccaaagtgctgggattacaggcgtgagccaccgtgcccggcctacaatattttaaatagctttgtgcatgaaacaaagttttgactgcattttgwttgtgacttgtcacatgaggtcaggtgggggattttcctcttgtggcttcgtgtcagcacgtaagtttagggccaagcactgtggctcacacctgtaatt

SEQ ID NO: 61292 - DNA, 201 bp, Homo sapiens
tctctccctctccctcttcccccacccgccccccgccccccgtttctctccctatttgtctccctcggactctccctcatctcgtccacgtctcttttccytgtcctgtttcttctccttgcgaactttcccacgtctctgtttcgctccccacccccttgcctttccccacctccctgttcccccatctctccggttttc

SEQ ID NO: 61293 - DNA, 201 bp, Homo sapiens; identical to SEQ ID NO: 32321

SEQ ID NO: 61294 - DNA, 201 bp, Homo sapiens; identical to SEQ ID NO: 32323

SEQ ID NO: 61295 - DNA, 201 bp, Homo sapiens; identical to SEQ ID NO: 32448

SEQ ID NO: 61296 - DNA, 201 bp, Homo sapiens; identical to SEQ ID NO: 32471

SEQ ID NO: 61297 - DNA, 201 bp, Homo sapiens; identical to SEQ ID NO: 32578

SEQ ID NO: 61298 - DNA, 201 bp, Homo sapiens; identical to SEQ ID NO: 32290

SEQ ID NO: 61299 - DNA, 201 bp, Homo sapiens; identical to SEQ ID NO: 32268

SEQ ID NO: 61300 - DNA, 201 bp, Homo sapiens; identical to SEQ ID NO: 32489

SEQ ID NO: 61301 - DNA, 201 bp, Homo sapiens; identical to SEQ ID NO: 32220

SEQ ID NO: 61302 - DNA, 201 bp, Homo sapiens; identical to SEQ ID NO: 32292

SEQ ID NO: 61303 - DNA, 201 bp, Homo sapiens; identical to SEQ ID NO: 32269

SEQ ID NO: 61304 - DNA, 201 bp, Homo sapiens; identical to SEQ ID NO: 32464

SEQ ID NO: 61305 - DNA, 201 bp, Homo sapiens; identical to SEQ ID NO: 31803

SEQ ID NO: 61306 - DNA, 201 bp, Homo sapiens; identical to SEQ ID NO: 31804

SEQ ID NO: 61307 - DNA, 201 bp, Homo sapiens; identical to SEQ ID NO: 31868

SEQ ID NO: 61308 - DNA, 201 bp, Homo sapiens; identical to SEQ ID NO: 32167

SEQ ID NO: 61309 - DNA, 201 bp, Homo sapiens; identical to SEQ ID NO: 31806

SEQ ID NO: 61310 - DNA, 201 bp, Homo sapiens; identical to SEQ ID NO: 32319

SEQ ID NO: 61311 - DNA, 201 bp, Homo sapiens
gcgatttcattgattgcttgaccagatgggtaaggcatgggtcccagctctctaaactctatccatgccgcccaccaacaggtgcctggcacgcggcagcmcatctcctctgcccacagtaacagcaggacccggagagccatttccaggagtagacgtcggtaatgacgacgcattttttttttggcgtcaccgaaacca

SEQ ID NO: 61312 - DNA, 201 bp, Homo sapiens
gaaggtatttgggtggaagaaagccagtaagcccatggggctggctgggggcaggaccacgcgttatgaccaccgtcctgttcctacccccaggagccccrtttgaccccgtgcggctactggataatgctgtatccaatgttatctgttcttgtcttcgggaaccgctatcgctatggggacccggagttcctgaggctc

SEQ ID NO: 61313 - DNA, 201 bp, Homo sapiens
ggtgtgggagagtcccttgcactgccaagacggggccactggaaggtatttgggtggaagaaagccagtaagcccatggggctggctgggggcaggaccamgcgttatgaccaccgtcctgttcctacccccaggagccccgtttgaccccgtgcggctactggataatgctgtatccaatgttatctgttcttgtcttcg

SEQ ID NO: 61314 - DNA, 201 bp, Homo sapiens
aacagcaggacccggagagccatttccaggagtagacgtcggtaatgacgacgcattttttttttggcgtcaccgaaaccacgagcaccaccctgtgctaygggctcctcattctgcttaagtacctagaggtggcaggtgtgcaacccggagagacccagaatgggaggctgcagtctggggatggctggagggtcctgg

SEQ ID NO: 61315 - DNA, 201 bp, Homo sapiens
tcctttcccgtccccaccacaggaatcttgttttctaaccggccgtgctggtggacactgcgcaattttgcacttggagcgcttaagaagttcgggttggrtacgcggaccgtcgaggcgcgcgtcctggaggaggcggcttgtctgctagacgaatttcaagccaccattgcttcggcctggccgggagagcggaagggc

SEQ ID NO: 61316 - DNA, 201 bp, Homo sapiens
ccactggaaggtatttgggtggaagaaagccagtaagcccatggggctggctgggggcaggaccacgcgttatgaccaccgtcctgttcctacccccaggrgccccgtttgaccccgtgcggctactggataatgctgtatccaatgttatctgttcttgtcttcgggaaccgctatcgctatggggacccggagttcctg

SEQ ID NO: 61317 - DNA, 201 bp, Homo sapiens
ccagtaagcccatggggctggctgggggcaggaccacgcgttatgaccaccgtcctgttcctacccccaggagccccgtttgaccccgtgcggctactggrtaatgctgtatccaatgttatctgttcttgtcttcgggaaccgctatcgctatggggacccggagttcctgaggctcctgaacctcttcagtgacaactt

SEQ ID NO: 61318 - DNA, 201 bp, Homo sapiens
ggctctggggtacctggtgctcactgtgcacctgtgtacccggcaaagcagatgtgcctgggcacaggcctggcccactcgggtatcttcctattccttayggccaccttacagaggttctgcctgctccctgtggtacgccctggcaccatcaacctcacctgcagtgcactggcctgggcagtgtccccccagacttcc

SEQ ID NO: 61319 - DNA, 201 bp, Homo sapiens
ggctggctgggggcaggaccacgcgttatgaccaccgtcctgttcctacccccaggagccccgtttgaccccgtgcggctactggataatgctgtatccartgttatctgttcttgtcttcgggaaccgctatcgctatggggacccggagttcctgaggctcctgaacctcttcagtgacaacttctgcatcattagttc

SEQ ID NO: 61320 - DNA, 201 bp, Homo sapiens
ctgggggcaggaccacgcgttatgaccaccgtcctgttcctacccccaggagccccgtttgaccccgtgcggctactggataatgctgtatccaatgttayctgttcttgtcttcgggaaccgctatcgctatggggacccggagttcctgaggctcctgaacctcttcagtgacaacttctgcatcattagttccagatg

SEQ ID NO: 61321 - DNA, 201 bp, Homo sapiens
aaagaagcaaagggaacgaagccggccgcaggagtcggaggcccctaaagggatgtagccagtgacccggcgcttcctggatagggcgtggccggctcccsggcccgcctcctttcccgtccccaccacaggaatcttgttttctaaccggccgtgctggtggacactgcgcaattttgcacttggagcgcttaagaagtt

SEQ ID NO: 61322 - DNA, 201 bp, Homo sapiens
cggcgctaaagcgtaaggttagaatggaggttcatcctgcagccaacaggagaaaagagcctaagagtcaaagcccgagagccagcctaggtcagggatgragcccagcaaaggcggggccaatgtgtggatagggcacttggaggtctggtaaagaagcaaagggaacgaagccggccgcaggagtcggaggcccctaaa

SEQ ID NO: 61323 - DNA, 201 bp, Homo sapiens
ttagtgctacaggcggatgcggtctctggccgcgggtccatggcagtcttcgaacgcttcacacgcggaaacagtgaggccccggcgctggacttgccggyccggacgctccaggctgggcgggtaaatggtagaggcgggcaaatgggggcggggcctaatagagactccagctaatgaggtgcaaacggccgagagagg

SEQ ID NO: 61324 - DNA, 201 bp, Homo sapiens
gacacccacctgcacagccactgtctgcccaaaggtacccactgagtctggggatcccgtgcgggacccgggtgcatgagatcagccagaatcagcaggtktgcgctgtgcagaccaaaacacaatcagttacccctggagcaggaaggcagctctgccttcccttaggctttttgttgttgttgtttgagacggagtctg

SEQ ID NO: 61325 - DNA, 201 bp, Homo sapiens
ctaaggcctagtggccttgtgcagggcccatgttgagacagaccctgtctctccagatgtacatttgcctgtccctcatggactggctcccgggcccgcaycaccgaatcttccgaaacttttcggagctgcgggtcatctctgagcaaattcaacgacactggcagatgcggcagccagcggagccccgcgatttcattg

SEQ ID NO: 61326 - DNA, 201 bp, Homo sapiens
atgggtcccagctctctaaactctatccatgccgcccaccaacaggtgcctggcacgcggcagcacatctcctctgcccacagtaacagcaggacccggasagccatttccaggagtagacgtcggtaatgacgacgcattttttttttggcgtcaccgaaaccacgagcaccaccctgtgctatgggctcctcattctgc

SEQ ID NO: 61327 - DNA, 201 bp, Homo sapiens
gtgcccctggggctgccgcgcaccctcaccctcgacacccacctgcacagccactgtctgcccaaaggtacccactgagtctggggatcccgtgcgggacscgggtgcatgagatcagccagaatcagcaggtgtgcgctgtgcagaccaaaacacaatcagttacccctggagcaggaaggcagctctgccttcccttag

SEQ ID NO: 61328 - DNA, 201 bp, Homo sapiens
ggatcccgtgcgggacccgggtgcatgagatcagccagaatcagcaggtgtgcgctgtgcagaccaaaacacaatcagttacccctggagcaggaaggcasctctgccttcccttaggctttttgttgttgttgtttgagacggagtctggctctgtcattcaggctagaatgcagtggcatgatcttggctcactgcaac

SEQ ID NO: 61329 - DNA, 201 bp, Homo sapiens
gcggaagggcctggtgtgggagagtcccttgcactgccaagacggggccactggaaggtatttgggtggaagaaagccagtaagcccatggggctggctgrgggcaggaccacgcgttatgaccaccgtcctgttcctacccccaggagccccgtttgaccccgtgcggctactggataatgctgtatccaatgttatctg

SEQ ID NO: 61330 - DNA, 201 bp, Homo sapiens
aggaggggggtttcaaaggatgagacaacaggagagaagcagcagagaggccgggggaagcagaggtttgggaacagagaaggtagctggaggcgcagcascgagcagagggcagagccaggagtgggagccaggcgggccccagtggcagggctcttgggcctccctccctgcagattattagattctaagaattgtaca

SEQ ID NO: 61331 - DNA, 201 bp, Homo sapiens
cctttggtccacagggccatttcaagcaagttcaatgacctggtcccttagagctccatatcccagtcccagcccttctttgcagctgggcctctctatayccctggatgaacagcttgctcaggccccagggtggctgcctcggccctcccagctcttacactcagctccagtggcttctcctttctgtcaagacttagc

SEQ ID NO: 61332 - DNA, 201 bp, Homo sapiens
acagcctccctctgcagaggtttaaaccttcttacaccctttcctcttgattttattctccctccagattatcacctttagggactacctacccattttgytaggtgaccacatgcagaagtggatacccccatatcaaggctacagtgaatctgtggatcccagaatttccaatgtcttcaccttcgccttccgctttgg

SEQ ID NO: 61333 - DNA, 201 bp, Homo sapiens
tacagtgaatctgtggatcccagaatttccaatgtcttcaccttcgccttccgctttggccacttggaggtcccctctagtatgttccgcctggatgagarttatcagccatgggggccagaaccagaactccccctccacaccctcttcttcaacacttggaggatggtcaaagatggtatgccctttcagggaagtgct

SEQ ID NO: 61334 - DNA, 201 bp, Homo sapiens
tgcagataaaaaacaatggattccctccttccccatcccaaaggctgtaagcccagactttctagggctgatagagctggagtggacatggccccaaaggrggctgtgaacaggaagtccccgggatgagacagcctcagtctctccaccctagggtacaattcctggagagccttctgtgacctctcacagccgcagaca

SEQ ID NO: 61335 - DNA, 201 bp, Homo sapiens
cccattatgcaacgttcctcagcagaacatatggaagaaaaagctgactccatgaactagagctttaaaaataccttttttttttttttttttttttttttgagacagggtcttactctgtcacccaggctggagtgcaagggcgcaatctcagctcactgcggccttgacctcctgggctcacatgatcctcctacctca

SEQ ID NO: 61336 - DNA, 201 bp, Homo sapiens
ccagtctttccattcttctgtatttctttcagaactggagattggatgaactttcctcagttgcccctgaatcattcctgtggtttatcattcctcttgcyctgacattgttacattaaagtgacacacaaagactgtcactttagcatcaaggtcataaacttagcacaaagatgacaaagatagtacgtttcatatgcc

SEQ ID NO: 61337 - DNA, 201 bp, Homo sapiens
ggttctggactacttttgtgggctttaggtccaccaaagcttagtttcctgagccttgcaatgctattctggtctacttcactcttctggtgtttgggggsttcccactcaatccctgctggtgctgtctgcaaggcaggaaagtacttccctggctgcctgctgttgctgagcaaccttctaggggaacaggaaccactg

SEQ ID NO: 61338 - DNA, 201 bp, Homo sapiens
gggtcttcacgaacgagcagaaggactctctacagaaaatgtccttctcacgccttgtctgtgacaacacccgcatcaccaaggtcccacgggacccattytgggccaacagctacccctatgacttcgtggattgctcagccatcgacaagctggacctgtcaccctgggcctcagtgaagaattaggggcccgcgctgc

SEQ ID NO: 61339 - DNA, 201 bp, Homo sapiens
gacccctgtctctacaaaaaatttaaaaactagcaacacatggtggcacatgcctgtagtcccagctactctggaggctgaaacaggaggatcacttgagyccacgaggttgaggcttcagttagccaagataatgccattgcactccagcctgggcaacagagcaagactgtccagatagatagatagatgatgatagat

SEQ ID NO: 61340 - DNA, 201 bp, Homo sapiens
tgtgtgtctctggaagcggcacctttccccggggcgggggagccccgcgccttcagggggtgggcgcagttcagagaccccaaatttgagaggcccccttmtctgcgtcccctccgcctcgagcagaggctccttcccccatggggtcctgggctttggagccccggagccggcctgccgaagctcagcgaggatcgtgct

SEQ ID NO: 61341 - DNA, 201 bp, Homo sapiens
ggaagacgcgcaacggcttccctctcccgctggtgagggcaggccgggccggggtgaaggatgggagccagaggggacgggatgcactacccaaacacgcwgtgaaaggaggaggagggatcggtgggggcagcaggggtgcgcgatggagatctgcacagacccccaccttccgctagagggcagcagagctcggagccc

SEQ ID NO: 61342 - DNA, 201 bp, Homo sapiens
atcccagcctggacttgacttcactgtctctggaggtgggctgtggtgctcctgctcccgtggtgagatgcgacccgtgcagcccttaccgcaccattacsggagactgcaataacaggtggcggggcttggggtgtgggggccgaccattccagccactccgccccgccctgccaaggcctttgtcccttgggcactcta

SEQ ID NO: 61343 - DNA, 201 bp, Homo sapiens
agacacaaaaccgagttctttcttgtttttcataaaaatatgcactcacaccaagaatttacaattttaaatagatttcctggcctggtgcagtggctcaygcctgtaatcccaacactttgggaggcttaggtgggaggattgcttgaggccacaagttcgagaacagcctgggcaacatagcaagacccctgtctctac

SEQ ID NO: 61344 - DNA, 201 bp, Homo sapiens
tggacaaaccccctggccaccctgacattgcagaaggccagctcttaggccaagatacctttatagatcttttggattttgtgttcacatatatcccacakcaatccagacacaaaaccgagttctttcttgtttttcataaaaatatgcactcacaccaagaatttacaattttaaatagatttcctggcctggtgcagt

SEQ ID NO: 61345 - DNA, 201 bp, Homo sapiens
gacaccgagctggggagtagcgagtactccaaagcccagtgtgatgagtactgtatccagggagacaactgcttccccatcatggtacggccctgcagctrggcatctctgactagccccttgcccaccctgatgtagcagacattcccagctcatcagctaggatctctggatagatctgggatactgatttggtagttt

SEQ ID NO: 61346 - DNA, 201 bp, Homo sapiens
ggagccccgcgccttcagggggtgggcgcagttcagagaccccaaatttgagaggcccccttctctgcgtcccctccgcctcgagcagaggctccttcccycatggggtcctgggctttggagccccggagccggcctgccgaagctcagcgaggatcgtgctggtttcaggaggaagcctgcgctgggcgccgccaacag

SEQ ID NO: 61347 - DNA, 201 bp, Homo sapiens
caaggttactggagtgagcctgtagcagatgcacccatggcagcaaggggaagagcccagggcccacagggcaccagtagagtcaactgccctccgatccygtacaggggcaacgtgggcgccttccctcaggaaacgcacactctagggagagggcagacattgagaaaaaaagtaaccttattctttcctctcgctgtc

SEQ ID NO: 61348 - DNA, 201 bp, Homo sapiens
ttgctgagccgctggtggaaaggggtcgggtggggcctctcctggcctgcctcttgggcaagcagttccagcagatccgtgatggagacaggcaagtgcgycctcagccagggagggaagggcagggcccttctccaagaggggtgtcccaaggtcctgcgtgagcgctgactccggatctcagtgtgagtagggcttttc

SEQ ID NO: 61349 - DNA, 201 bp, Homo sapiens
aggaaactggcttgcagggagcaatgcatcctgcagggaaggagggaggggaactcaaaggcaggctccagccttggtaacagcgtttctcacacctgtgmcaagacaggtacagcatctcccgaccacaggctgtcagggcagaattgaacattctggatcacttggtcccacctcctcccatagcaagccaggacccca

SEQ ID NO: 61350 - DNA, 201 bp, Homo sapiens
tgtgctcttctctccctccttccagcctgggatgtccaggtgacccacattcaactaagagaaaatgtctggtggaggcagaggcaagccatgaatgatgwtcccactcttcccccaacctaagcatggcttctgggtctcccttggcaggtggaattgatcctctggtgcggggcctgctggccaagaaatccaagctga

SEQ ID NO: 61351 - DNA, 201 bp, Homo sapiens
ccgcgagcataaccggctggccagagaactaaagagactcaaccctcagtgggatggagagaagctctaccaggaagcccggaaaatcctgggagccttcrtgcaggtagggagtcccaggagcactgtcacctggtcccacctggctcccactcctggctctgccctctgctggctgctgtgcctcaggctctctcctct

SEQ ID NO: 61352 - DNA, 201 bp, Homo sapiens
atttaccaaaatccctaggtgatagtaggcacattacagtgtgagaggcttgccgagggactatctctgccctctccctctgcaacctccagatgctgaayttctctgctctaggagttttattcattcagcatgcacccaacacctattatgtattgacatgcttaggtcctgggaaaacaaataaataagatggagccc

SEQ ID NO: 61353 - DNA, 201 bp, Homo sapiens
tgaacacagtgctgaagagcaagatgctggccaagaagttactgggtctctacgggacccctgacaacatcgacatctggataggggccattgctgagccrctggtggaaaggggtcgggtggggcctctcctggcctgcctcttgggcaagcagttccagcagatccgtgatggagacaggcaagtgcgtcctcagccag

SEQ ID NO: 61354 - DNA, 201 bp, Homo sapiens
tcaggcacctgccaccacgtcctgctgatttttgtatttttagtagagatagggtttcaccgtgttggccaggctggtctcaaactcctgaccttaagcgktccacccaccttggcctcccaaaatgctgagattacagacatgagccaccgcgcctggccatcattctattttttggtacccaccaaccatctccacctc

SEQ ID NO: 61355 - DNA, 201 bp, Homo sapiens
tgcctcaggctctctcctctgttcccacacctccgtttcccccggcccctctgctgcttctctcttgttgtctcattctttgaaatccccttcctttcatwtcttcagcttctctgtctcaaaatgaatctctggatttggagtgttggaaagtcacttgtgcgttggtcccttcagtgtgcctgcctgggtgccattact

SEQ ID NO: 61356 - DNA, 201 bp, Homo sapiens
gactgtccagatagatagatagatgatgatagatatatagatatatagatatatagatagatagatagatagatagatagatagatagatagatagatagdctctcctaaagattagagggcacagggagaagtcctttatccccttatgagacacctggtctttggccatttaactgttcccccatcgttactcctctct

SEQ ID NO: 61357 - DNA, 201 bp, Homo sapiens
gagtcaggccaaggtccaagtcaacaaggccttcctggactcccgaaccaggtacgtgagacacacacacacacacacacacacacacacacacacacacacttcccttcacaggcttcctgttcatgacaagcacatctaggccagcccggatgagccaatgaggtgaacaatgataaaacttacccttccatcctccta

SEQ ID NO: 61358 - DNA, 201 bp, Homo sapiens
tgagtcaggccaaggtccaagtcaacaaggccttcctggactcccgaaccaggtacgtgagacacacacacacacacacacacacacacacacacacacacacttcccttcacaggcttcctgttcatgacaagcacatctaggccagcccggatgagccaatgaggtgaacaatgataaaacttacccttccatcctcct

SEQ ID NO: 61359 - DNA, 201 bp, Homo sapiens
tggggtggggggaagtaacagagagaatcttggccagagaggtatttattcatgccttgccccttctctagagttagctggcaaaaagtacaacaagatayaaattattagggggaccacgaaagggcagagggaaaaattggaggcaggcaggggtgaaggaggctgaaatgacctgatccatatacagaggtctcctgg

SEQ ID NO: 61360 - DNA, 201 bp, Homo sapiens
gtgagtcaggccaaggtccaagtcaacaaggccttcctggactcccgaaccaggtacgtgagacacacacacacacacacacacacacacacacacacacacacttcccttcacaggcttcctgttcatgacaagcacatctaggccagcccggatgagccaatgaggtgaacaatgataaaacttacccttccatcctcc

SEQ ID NO: 61361 - DNA, 201 bp, Homo sapiens
  misc_feature (1)...(201): n = A,T,C or G, or insertion/deletion polymorphism (see Tables 1-2)
tgagatgcgacccgtgcagcccttaccgcaccattacgggagactgcaataacaggtggcggggcttggggtgtgggggccgaccattccagccactccgncccgccctgccaaggcctttgtcccttgggcactctaggcagatctgccactgccttgcccacctgggctggcgttcccaccttccccaccttctcaaga

SEQ ID NO: 61362 - DNA, 201 bp, Homo sapiens
aggcttttctgtgtctgaaaactatgtcagagaatcataaactcttagggctggaaggtaccatagacctctcttatccaccttgtttaggaactgagacytaagcaatttaatgtgtccagagtcacacaggaatttgggggaaaacagtgacagaatggtgctccctgtgctgttcttgagacagtgtgatgaaatctg

SEQ ID NO: 61363 - DNA, 201 bp, Homo sapiens
gcttgaacccgggaggcagaggttgcagtgagctgagatcgcaccattgcactctagcctgggcgacaaaagcaagactccacctcgggaaaaaaaaaaagagagagagagagagagaaaagataaaaacacagttattttgtgtttcagggtttgagatgtccagggtcctctaaagcaaggcagggcccctgcagccgg

SEQ ID NO: 61364 - DNA, 201 bp, Homo sapiens
agagagaaaagataaaaacacagttattttgtgtttcagggtttgagatgtccagggtcctctaaagcaaggcagggcccctgcagccggatctagaggtratgctgccagggaggatggtgctagggctctctagactcagatgagggctgccagtgtcctctactctccctccacatgcctggtgcctcttggcctgtg

SEQ ID NO: 61365 - DNA, 201 bp, Homo sapiens
tttttgtccttttgctattgttctagtggtgtttggggagggagaggaggtaagtgcactttttttatttaccgtgtttcaatagaagtcctcatttttamtttttttttaaacacagttattactagtgagtttgaacacctttccataaatttatttgtcatttgtatatctcaattcgtgaatttctcattcatgtac

SEQ ID NO: 61366 - DNA, 201 bp, Homo sapiens
ccagcagggggcacccttgggatttggatgagacccttttctgaggcattcactgctctttggagtagctgtagaaatgctggcagagggagagaacccawcccacatacccatcaagtgcctttaaaaggtcactatctcacggcacagactgttaccctgtggtgttttctgggtggtacattagctaactgcatattg

SEQ ID NO: 61367 - DNA, 201 bp, Homo sapiens
ggaaactgaggctcagagaggataaatgacttccccaaggttgtgaggcaatgaagtggcagatcagggactggaccccaggtcttcctggggctcattastttttttagccccatcacttaacttaaaagacaaggctgaggccaaccacatgggaaagcaaaggaactggttttgctaagaaagtcaggctcctcctcc

SEQ ID NO: 61368 - DNA, 201 bp, Homo sapiens
aagtttgctatgtctatgtccctctgtcacacagctcctatgttttatggctacccagtggggctctgtagtcctaaggatcaccttggaggtgaccaggygcctgttatcctgcctctcatgatgataatgatcatggtgatcctgtctagcactttgacaaagccaggagcctgcataaagttgcccccaccatagtca

SEQ ID NO: 61369 - DNA, 201 bp, Homo sapiens
caagctctaaccactcttcccacattgctggcagacttcattaactgattataagactctaccactgaaccaggatccaggctcagaatcctcaacagagygctgcaggctaccactaaaaattagttaacgtacacccttgagacaaaaccctctttgccgttccccttatgttcattctgagcaaataataggtgttta

SEQ ID NO: 61370 - DNA, 201 bp, Homo sapiens
ccattgatttacatcctctatgaggagataatgaattgttttttttcaaagcagtacatctgcttatactgccttgccacccccttctattctgcctgaattttttttttttttttttttttggaacagaagctcactctgtcacccaggtggagtgcagtggcatgatctcggctcactgcaacctctgcctcccaggtt

SEQ ID NO: 61371 - DNA, 201 bp, Homo sapiens
tttttaatactcaggatgatgaatatgcgataagcaagctctaaccactcttcccacattgctggcagacttcattaactgattataagactctaccactraaccaggatccaggctcagaatcctcaacagagcgctgcaggctaccactaaaaattagttaacgtacacccttgagacaaaaccctctttgccgttccc

SEQ ID NO: 61372 - DNA, 201 bp, Homo sapiens
tctctaatggaaaaagtagacaacatccaagtatagatgggtaatgtaatcagagaagtggaaacttacaaagaaccttttaaaatgctaaaaataaaacaaaaaaaaaatggtaccagaaaggaagaatgtcttgaatggcctcatcaatagattggacaaagctgaggaaggaattagtgagcttgaagataatgtcag

SEQ ID NO: 61373 - DNA, 201 bp, Homo sapiens
gtcccctctttaagtaactttggaaatgagcagagtctgtaagatgaaggcaataggaactgcaaaaaagtactgtattccacttgataaaattgttcccygtggggatacaaattaacaattatcatactgctgtgtatgtacacaggaattgaacaattaagtaaatagcagctagtgggagccaggttacttactgtt

SEQ ID NO: 61374 - DNA, 201 bp, Homo sapiens
gcatcaaaatatgtgagacaaaaactgatagaactgcaaagagaaatcaacaaattgaccattatagttaaagattttaatacatcttttagtagttgatrgatcaagcaggcataaaattagtaaggacataattgactgaacagttccattcatcagcttgctctaaatgatatttatagaatacttcatccaacaaca

SEQ ID NO: 61375 - DNA, 201 bp, Homo sapiens
gtagaggaaacacaatgaaaccaaaagctggttctttgaaaagatcaataaatctgataaacctctagccagactaaccaagaaaaaaaaaagagaaaacrcaaattactaatattataaaagaaaattgggctaggcttagtgactcacacctgtcatcccagcacttgggaggctgaggtgggaggatcacttgaggcc

SEQ ID NO: 61376 - DNA, 201 bp, Homo sapiens
gcgggtaggaagagattaatgtcccaaaataggttcaggcaaagaactgtaggatttctgagaagggcttgctcctgactaacccccttctcctccaaccsgtgagggcgtggcattcgagctgggtgttggggaatgggcaggatctgacctcatgggccagagaattctagatggagggaacaacagtaccaaatggct

SEQ ID NO: 61377 - DNA, 201 bp, Homo sapiens
tcgcacaaggagaaatagatgaactgaataggcctatatcaatttaaaatttcaatcaataattaataaccttccaaaaaagaaagcaccaagcccaggtwgtttcactggtaaattctaccaaacatttaaagaagaaatgataccagttctctacaatctctcccagaaaatagaaacagagggagtacttgcaaattc

SEQ ID NO: 61378 - DNA, 201 bp, Homo sapiens
caaagaactgtaggatttctgagaagggcttgctcctgactaacccccttctcctccaacccgtgagggcgtggcattcgagctgggtgttggggaatggrcaggatctgacctcatgggccagagaattctagatggagggaacaacagtaccaaatggcttggagatttttttttttttaatattgggatggatggcca

SEQ ID NO: 61379 - DNA, 201 bp, Homo sapiens
ggcttgctcctgactaacccccttctcctccaacccgtgagggcgtggcattcgagctgggtgttggggaatgggcaggatctgacctcatgggccagagwattctagatggagggaacaacagtaccaaatggcttggagatttttttttttttaatattgggatggatggccatgggacaaggcagagagaggggactg

SEQ ID NO: 61380 - DNA, 201 bp, Homo sapiens
ttttattttcttcatataatttacttcattaggcagttgttttgtttgcttgtttattgtgcatcatttcctctagaacacaaggtcctattcatgagaamagacaccttgtttgtctttctaacccttgaatgccagctcttaacccagtggctggcacatgggaggcaccactccatatttgctgaatgaatgacaaaa

SEQ ID NO: 61381 - DNA, 201 bp, Homo sapiens
gggtggagagaagggggcatgtttgtgaggcatttataggtagggtcaacaggagagtagtgggttggaggtacagggttggttaggggcaaggatgatgscccaggcttttctgctttgagcaattggatagataggacaggatgctattaactgagatgggggatgggggacactgaagtgggagcagcttggggggaa

SEQ ID NO: 61382 - DNA, 201 bp, Homo sapiens
tttaaaatgagaaattttaactgctctggaaattgataaagaatcttttaaattgatatgaaatgtgtctctcatttcaaaatgactagccatgcaatcaytgaattcacagagcaaattactgaactttcccttcatatattgagaaaatatggtgctgagttacattttaaagatagttaagaaataaaatatttgcac

SEQ ID NO: 61383 - DNA, 201 bp, Homo sapiens
gtgaggcatttataggtagggtcaacaggagagtagtgggttggaggtacagggttggttaggggcaaggatgatggcccaggcttttctgctttgagcarttggatagataggacaggatgctattaactgagatgggggatgggggacactgaagtgggagcagcttggggggaaacaagtatgttcactttagggcag

SEQ ID NO: 61384 - DNA, 201 bp, Homo sapiens
ggtacagggttggttaggggcaaggatgatggcccaggcttttctgctttgagcaattggatagataggacaggatgctattaactgagatgggggatggrggacactgaagtgggagcagcttggggggaaacaagtatgttcactttagggcaggttaattcacatatctgagagagagagtcccaagtggggctatgt

SEQ ID NO: 61385 - DNA, 201 bp, Homo sapiens
tcactttagggcaggttaattcacatatctgagagagagagtcccaagtggggctatgtaggaggcattcagaagcatctggagctcacacaaatttagckagccaaaagaaagatataagagattgatagaaatgtggtgctggaacagggataaaaaggacatggctactgatcagacaaggaaagggataaaaaagag

SEQ ID NO: 61386 - DNA, 201 bp, Homo sapiens
agtcccagctactcaagaggctaaggcaggagaatcgcttgaacccgggaggcagaggttgcagtgagctgagatcgcaccattgcactctagcctgggcracaaaagcaagactccacctcgggaaaaaaaaaaagagagagagagagagagaaaagataaaaacacagttattttgtgtttcagggtttgagatgtcca

SEQ ID NO: 61387 - DNA, 201 bp, Homo sapiens
caatgaattaaactagaaattaataacagaaagcatggaaaattccaaaatattttcagattaaataacataatactaaataacacatgggtcaaagaagraactccagagaaattttaaaataatttaaatgaaaatgaaaatgcaacttatcaaaatttctgggatgcagcaaaagcagtgcttagaggaaaatttata

SEQ ID NO: 61388 - DNA, 201 bp, Homo sapiens
gacaaagttggaggactgacactgcccaatttcaagacttaccatatgaagacattacaaggaaaggaaactgtagaccaaaatctctcaaaaacataaawccaaaaatcttcatcaaaatattagcagagcaaatccaacaatgtataaaatgaattatacaccacaatcaagtgagatttattccagatatgaaaggct

SEQ ID NO: 61389 - DNA, 201 bp, Homo sapiens
ttaaaaactgctatggaaaagatactgttaagagaatgaggccaggcatggtggctcaagcctgtaatccctgcactttgggaggccgaggtgggcagatyactaggtcaggagatcgagaccatcctggctaacacgattaaaccccgtctctactaaaaaatacaaaaaattagctgggtgtggtggcgggtgcctgta

SEQ ID NO: 61390 - DNA, 201 bp, Homo sapiens
gatcgagaccatcctggctaacacgattaaaccccgtctctactaaaaaatacaaaaaattagctgggtgtggtggcgggtgcctgtagtcccaggtactygggaggctgaggcaggagaatggcgtgaacccaggaggaggagcttgcagtgagccgagatcacgccactgcgctccagcctgggcgacagagcgggaca

SEQ ID NO: 61391 - DNA, 201 bp, Homo sapiens
tctcgttgttgggaatgcaaataatggtaaagctatttttgaaggctgtttggcagtctcccacaaagctaaacataggcttactatataatcactctacygggtatttacccagttaaattgaaaacctacattcacacaaaaacctgcatgcaaatatttacagcacctttattcataattgcccaaaactggtagcaa

SEQ ID NO: 61392 - DNA, 201 bp, Homo sapiens
agtcagttcactctgccctgctccctgacctatgggaatgggaccagattaaaggaccctctgaaggctacttggactcaggtcaatggcacagatcacaraaggtttatgcaccaaacgaacaggaaaccttgcagagtgccctgggactgcaggcagaagacatcccaggggcttctctgaaactctgacctccacttc

SEQ ID NO: 61393 - DNA, 201 bp, Homo sapiens
catcaccacttttagcaacataaacttccgccttgatctggctgccctgagcaatgatctaaactgctcagtactgacaaatgaaaagaacccatggctcmagagtcactgtggcagaaagacgccaaaagccttctctggcttcctttcgaggccacacagcctcacagtaatttcagccaacttctgcagcccatgcaa

SEQ ID NO: 61394 - DNA, 201 bp, Homo sapiens
ctgctacttggctgtatatagaacaacctccttaactgagatttagctgggagcgcacacattttctgtatggacaaatcctggattggcttcgttatttsgtggcctggcaacctgtggtgataggaatagttcaaggcattaactattcactagggctggaataggacagcagaccccagaagcaacatactgcatggt

SEQ ID NO: 61395 - DNA, 201 bp, Homo sapiens
actatgcagccataataaagaatgagataatgtcctttgcagggacttggatggagctggaagccattatcctcagcaaactaacacaggaacagaaaacygaagactgcctattctcacttgtacatgggagctgaacaatgagaacacatggacacagagaggggaacaacacacactggggcctatcgggagcgggag

SEQ ID NO: 61396 - DNA, 201 bp, Homo sapiens
gcagggtgctggcaggggaaattggttgaagtcataagtgagcagatagccaacaaagatcagggaaagaaggggtttggaggtgagaaaaagagtgaagyatcaggtgcaggggggaacttaagactatccaagtggagcccaaggtctgaatcttagcagatcaagaaatacaaagagtgctttgcctagaaataatcc

SEQ ID NO: 61397 - DNA, 201 bp, Homo sapiens
tttgacagacatgtgtccataaatgctgacctaaattgccctatcatccagagagaagctagcttttaattgttgttcttggcatgtataagactagctaytgagagctttgaacatgtttataagattcacaacattgctggctcttttctacaaggggctacatagtgaaatttatctccatgacttgatattgtaacc

SEQ ID NO: 61398 - DNA, 201 bp, Homo sapiens
aaaaccgaagactgcctattctcacttgtacatgggagctgaacaatgagaacacatggacacagagaggggaacaacacacactggggcctatcgggagygggagggagagcatcaggaaaaatagctaatgcatgtgggtcttagtacctagctgatgggttgacaggtgcagcaaaccaccatggtacatgtttacct

SEQ ID NO: 61399 - DNA, 201 bp, Homo sapiens
gattaaggagacaccaaaccacaaatccaagaaactcagagaacaccaagtagggtaaataccaagaaatctatacctgggtatgtcaaattcacactacrgaaagccaaagatgaaggaaaaccttaaaagcagccagagaggggaaaaacaaactatgcaaacaagaagaaagtgaagtaaaatatttaaagtattgaa

SEQ ID NO: 61400 - DNA, 201 bp, Homo sapiens
atgtattttgcaactctggagaaaccactagaaataattgtaaaggagtataattgatatactaatagaggagagaaaatggaatctcataaaatacccakttaaaaccagagaaggcagagagagagggagaaagatgcaaggaacaagtgcaacaaatagaaaatagttacatacatggtagatattaatccaactata

SEQ ID NO: 61401 - DNA, 201 bp, Homo sapiens
ccaagatatcctttaaaagctggataaataaactgtggtacattcatgcaatggaatactattcaataataaaaagaaataagctattgtgtcatgaaaaracatggatgaactttggtgaaacaagtcatagtgaaacaaaccaatgtgaaaaagctacatactgtatggtttcaattatatgacattctgaaaaccaca

SEQ ID NO: 61402 - DNA, 201 bp, Homo sapiens
accaaataaataaaaaagatttgaaggatagaaaacatgtcaatatctattgtttaatagatggggagttttaaaaaagcaattgaaagacaagtaaaggyataaaacagcaagaaagtctagggagagataaaggaagtagggataaccacatctttgaccaacagctgtgctcccacttaaggtggttgctgagacatg

SEQ ID NO: 61403 - DNA, 201 bp, Homo sapiens
agtacaatgtctgtacattgaacattgttactcactattaattaaatctaggcatcaagagaaatttgacatcttctagaaattgttcatacttatggatytacaggaagagaactggttttattaaaatatagtccagctgtggctccaaactatcatggattgtaactccatggattagaagaaattgattagtcttat

SEQ ID NO: 61404 - DNA, 201 bp, Homo sapiens
tacacacatgcccagatggtgacccctgtggcattattaatgagttccagatgccaggcttccttctttgcatgtatgtgcctcgatttcatatatttcaygtgtttatttatgagggacagcattcctacatttcatatatggcagttactatttaaaatgagaaattttaactgctctggaaattgataaagaatcttt

SEQ ID NO: 61405 - DNA, 201 bp, Homo sapiens
aaatctaggcatcaagagaaatttgacatcttctagaaattgttcatacttatggatttacaggaagagaactggttttattaaaatatagtccagctgtrgctccaaactatcatggattgtaactccatggattagaagaaattgattagtcttatattttggcttagatctaaagtataaaatataagagcatagtag

SEQ ID NO: 61406 - DNA, 201 bp, Homo sapiens
attctcctttcatcaaaaaattctttgttaattaattggaaaatacatgtcttatgtatatagaatacttgtgcaataaggcatcttttaaaataaaataygcaaattatttatgttattgtatctagcatactccaattgccaacatttaaggattagtaaaacattaacaataactaaaacctttcagctctgtctgaa

SEQ ID NO: 61407 - DNA, 201 bp, Homo sapiens
gcccattcatcattctgtacaattagccaaatgaaaggtatctttgttttagcttgatctgtaattcttttcagattcattatgtgcatggcaacacaaaraaaccatggtacttttgggcagcatctgattcatcaggaaattcctcctgctatgatatgtggttggggagaacgtgagtgatgtgatccagatgcatga

SEQ ID NO: 61408 - DNA, 201 bp, Homo sapiens
caaataagtctttctccatatactgattattgtttcctttggaactcttttggttcacctagaccaattgctccctggattctcctttcatcaaaaaattmtttgttaattaattggaaaatacatgtcttatgtatatagaatacttgtgcaataaggcatcttttaaaataaaatacgcaaattatttatgttattgta

SEQ ID NO: 61409 - DNA, 201 bp, Homo sapiens
atgattatcattgtattaagcttttttcctagggagccacaagtgtgttactgtactttttatcaataaaattattgatacatatttccctggacatggargaaagatactcttcacttcccccactgtcctaattctcagatatacccagacaaatcttgaaaggatgaagctaccacctgtgttggaagcctcagttca

SEQ ID NO: 61410 - DNA, 201 bp, Homo sapiens
gtggagattctatgtgccaagggctgcctgtcccagtgcctggcagtggcttcctgcattcagagagtggcatgtgctctcctttctgactgtgctctgtycatttcctctgatagttctacagtgtcagccggttgcctacaaggagcttatcggacaatatctgtgcagtctgtgggcagaagatcattgtggagcttg

SEQ ID NO: 61411 - DNA, 201 bp, Homo sapiens
tccctacctgcagtgctggctgcaggcttgagtggtagcaaggatctgctgggacagggaagatggaagtttcaatgtacctgtactagtttcctaggtcytccataacaacaaaaaaatgtattatctcacagttctggaggccaggagttcaaaatctaggtgtcaacagggtcatgctccctccaaagactctagggg

SEQ ID NO: 61412 - DNA, 201 bp, Homo sapiens
tcattgaggccagcattaccctcataaaaaaaccagaaagacaaagttggaggactgacactgcccaatttcaagacttaccatatgaagacattacaagraaaggaaactgtagaccaaaatctctcaaaaacataaatccaaaaatcttcatcaaaatattagcagagcaaatccaacaatgtataaaatgaattatac

SEQ ID NO: 61413 - DNA, 201 bp, Homo sapiens
ggcttgtggctgcatccctccggttcctgcttctgtcttcacacggccatctactctgccttgctattctgtgtctgtgtctctggatgtcaaatcttccrctcctttctcttgcaaggacactaggcattggatttaggacctgccccaaatccagatggtcttattctgaggtcctcaattacatctgcaaatacccta

SEQ ID NO: 61414 - DNA, 201 bp, Homo sapiens
ttaccaatgaatacagccctctaaacctaacattcctacctggcactcacatgtggtccagggtcatcactagtttctgagttcattgttctggctttgcyacttggtttagaaagatttttctaacaggtgggttttgtgagggaagagttgaaagtgacaaaatcagtttggaggcagcagttcaggtgagagataatg

SEQ ID NO: 61415 - DNA, 201 bp, Homo sapiens
caccacgtctggctaatttttgtagagacagggtttggccatgttgcccaggctggtctcaagctcctgagctcaagaaattcatccacccccgcctcccraactgctgggattacaggcatgagccaccacaccaggccatggtgctgcatacttttactgtcaatagcagagggtcaaagttgctgaatgcttaagtaa

SEQ ID NO: 61416 - DNA, 201 bp, Homo sapiens
gcaatccacagccctcctgagggtcttagcacacacattctgctctgcactgcccgcatgctggtgggcttcggtgtcttttgccctgtggtgtcccagtrtccctttccgctggcccatctgctggtcagtttcagaattggctgctctggactcctctctcattctccttggacttagaggtttttgtccttttgctat

SEQ ID NO: 61417 - DNA, 201 bp, Homo sapiens
ttttgccctgtggtgtcccagtgtccctttccgctggcccatctgctggtcagtttcagaattggctgctctggactcctctctcattctccttggacttrgaggtttttgtccttttgctattgttctagtggtgtttggggagggagaggaggtaagtgcactttttttatttaccgtgtttcaatagaagtcctcatt

SEQ ID NO: 61418 - DNA, 201 bp, Homo sapiens
tgtggtgtcccagtgtccctttccgctggcccatctgctggtcagtttcagaattggctgctctggactcctctctcattctccttggacttagaggtttwtgtccttttgctattgttctagtggtgtttggggagggagaggaggtaagtgcactttttttatttaccgtgtttcaatagaagtcctcatttttacttt

SEQ ID NO: 61419 - DNA, 201 bp, Homo sapiens
ctgggtagcaaggaaattctggactctactgttcctgaaaataggtacccgcaataagcaggaaaatggcaggagaagtggggcttgagatttggaaaacygaacacatccataacagtgatatgacatattgagcatttagtgtgccaagtcaataaacatcaatacattagctcacacaaccttcagaacaactttagg

SEQ ID NO: 61420 - DNA, 201 bp, Homo sapiens
tgggttacttggcgatcatgtttacaatgtgtggattcaatctgtttttcaagtaagtatctccaattaagacattaatatctccaagcacttgcttggcrcactcacctggtcatgttctcttaatccagaagcatctggccctacaattttccatgcacacatgttttatagtagatatccacacgtagtcttctctgg

SEQ ID NO: 61421 - DNA, 201 bp, Homo sapiens
aaaccaatagaaagggaagaaagaagcaccctacaaaataattttttaaaattaggagctttaaggagaatttatatttggtctgcaaatttaaaagattrctattaacagtggacctacaattgtgctagagtaattcttactgaactaatttctcttctacaaaattctcaagtacctagatctccttttatatatatc

SEQ ID NO: 61422 - DNA, 201 bp, Homo sapiens
aaattaaatttatggcaaattattcacttttaaaagagatctttcccttaagaaaaaaaaaaactggctggggggatgatcacaaagaatcctggtataaytgaaatatgatttaacttacaaaaagtttttttcagttaatacatagcaactctggcatggtaatcaagggcttcaagatgtgagcttgatttgtggctt

SEQ ID NO: 61423 - DNA, 201 bp, Homo sapiens
aacagatccatggttgccaaggctttagggaaggagcgtggttgaataggtgaagcacaggaaatgtagagtggtgaaactcttctgtgtgatacgataamggtggatatataacactatacatttctcaaaatccatagaaagtgtgaaccttaaatttatgcaaattttaaaaataatttaggaagtcagagaatccaa

SEQ ID NO: 61424 - DNA, 201 bp, Homo sapiens
aacctccttaactgagatttagctgggagcgcacacattttctgtatggacaaatcctggattggcttcgttatttggtggcctggcaacctgtggtgatrggaatagttcaaggcattaactattcactagggctggaataggacagcagaccccagaagcaacatactgcatggttgaaatccttggtccaacatttaa

SEQ ID NO: 61425 - DNA, 201 bp, Homo sapiens
ttaagtatttggtgcaatggctccaacagggagtgagctggggaaggtgagagagtcagagacagggctcaggacttggggatgagagggtggggctaaayatctggagcaagactcttaatgcagtttggagtgaaaagcaggaaagagactccaagaggatgtgcagggaaagggatgtgaggcaaacagggccttctg

SEQ ID NO: 61426 - DNA, 201 bp, Homo sapiens
agcaatgatctaaactgctcagtactgacaaatgaaaagaacccatggctcaagagtcactgtggcagaaagacgccaaaagccttctctggcttcctttygaggccacacagcctcacagtaatttcagccaacttctgcagcccatgcaagtttctgtctccacttaactcacccctgcccactcccccacgcagttca

SEQ ID NO: 61427 - DNA, 201 bp, Homo sapiens
aaatgtgtctctcatttcaaaatgactagccatgcaatcattgaattcacagagcaaattactgaactttcccttcatatattgagaaaatatggtgctgrgttacattttaaagatagttaagaaataaaatatttgcacacataatacattctaatgattttttgctttcttttcctttttgatctccaaagcctattt

SEQ ID NO: 61428 - DNA, 201 bp, Homo sapiens
tattgttctagtggtgtttggggagggagaggaggtaagtgcactttttttatttaccgtgtttcaatagaagtcctcatttttactttttttttaaacayagttattactagtgagtttgaacacctttccataaatttatttgtcatttgtatatctcaattcgtgaatttctcattcatgtactttgcccttttggac

SEQ ID NO: 61429 - DNA, 201 bp, Homo sapiens
caactggcacctggtggatagaggccagggatgctggtaaacatcctccaatgcagaacagctccccacaacaaaaattatctggcctaaaatgtcaatgrtgccaagactgaaaaaccctggtttaagtaaaccagttttcccttcatgcatgaacaacttctgccaacagtccaggaaaaggaggattagaatagccaa

SEQ ID NO: 61430 - DNA, 201 bp, Homo sapiens
atattgaaggacctgcatggcttcttttaactgcatatagtaaaatgaaagaagagataaatgatttaaagatggaatttataagtaaaagagaaacaatrtaaaatttggaaaactcacagcctggctacgtaaagaataaaaagacttgcagtacagccaagtgaccctttgataaaggggattaacacagctagaagg

SEQ ID NO: 61431 - DNA, 201 bp, Homo sapiens
catgcaactccagcctaggagagctatgggcatgcagcatgcaactccagcctaggagagctatgggcatgcagcatgcaactccagcctaggagagctayggacatgagattctaacctgtgagagttgtgtgggctaagcctagcaaagccatgggggggcaaggctgttcctgaggcctcaaggttccaaaccctacc

SEQ ID NO: 61432 - DNA, 201 bp, Homo sapiens
tatgcccagaaagtaggacatggagtcaaagaagagtatcctcaagtcttaggatttagtattgtttaccttgttaagttttagactggcttggggcctgytactcctttcttcttgcctatttctcccttttggaatgggaatatctatcctctgcctgacctgtcattgtattttggaagaagagaacttgttaatttc

SEQ ID NO: 61433 - DNA, 201 bp, Homo sapiens
aatttctagagtcctcatgtaggaagaaacctggattcataaggaatcagttcatagccttatgcattctttctttaaaattaatcattatctctaaattkatgtagaaaaaaatgttctttttccatagtaatacaggtgtggattttgcataggaagcccccgaccttgaaaggaaacaatgctccaggagcccttgac

SEQ ID NO: 61434 - DNA, 201 bp, Homo sapiens
ctggtctgaaactcctaacctcaggtgatccacccgccttggcctcccaaagtgctgggattacaggtatgagccactgcgcctggccagatttgatgatytttgaggtggcatatgcacaaagaccatccttgtcctatatttgaagcagctgctcttgtgtcaggtcttggagggtgtgtgtcactgcaccagtaagtg

SEQ ID NO: 61435 - DNA, 201 bp, Homo sapiens
gtatgagccactgcgcctggccagatttgatgatttttgaggtggcatatgcacaaagaccatccttgtcctatatttgaagcagctgctcttgtgtcagstcttggagggtgtgtgtcactgcaccagtaagtgtaagtgtggcacttacacactggctctacctggccaaagacagacctgcctatgcctcagaatccc

SEQ ID NO: 61436 - DNA, 201 bp, Homo sapiens
cagaatcccctttaaggacttgtggccatttgaagggtctgaccttagatgactcaggctacactggactaggtggacaccctggaccctgacctctgttrgttagctggagtcatctgagttgtttcctgttgctaactgcacaagctgtgctacctgcagtgcctctccagggacttgcttttgactgccacctccccc

SEQ ID NO: 61437 - DNA, 201 bp, Homo sapiens
gtgaccaggcgcctgttatcctgcctctcatgatgataatgatcatggtgatcctgtctagcactttgacaaagccaggagcctgcataaagttgcccccmccatagtcaaggacagattcaggtctcatggtgccttgagactctgctgggttagctcatagactttgttggtctctggaatatattctacttctttgca

SEQ ID NO: 61438 - DNA, 201 bp, Homo sapiens
tgtaagccaaacctgttttttgtttttttgttttttgttttttgttttttttgctaaatgcgcaaggttgagggctttttcagatgacctcattttgctgrttccagcctgcagcaggagaggatgtacaagatgcaccggggccacgattccatgcacgtggaaatgatcttgatcttcctctgcgttctggtcattgcc

SEQ ID NO: 61439 - DNA, 201 bp, Homo sapiens
gcagatagtttgggatttgcagtgcagaggaaatgaacacacataatttatttatttttttctttttttccttgtttccttccttccttccttccttcctycctccctccctctctctctttctttctctttccttctttcttttaatattgcatggcccattcatcattctgtacaattagccaaatgaaaggtatcttt

SEQ ID NO: 61440 - DNA, 201 bp, Homo sapiens
aataattttccagattgaagcattgctctatttaaatcaaccttcctgcctattaatagctgtgaaatactagaaaatattactgggccaataaagcattrtgtctgctcaaatctttttaaaatgaggcaagacacaaatacatacatacttaaatacatatgtatataacattgcagaacctcctttaaaagtttaaat

SEQ ID NO: 61441 - DNA, 201 bp, Homo sapiens
gaaatggtttatttagaaaataaagtatagaaatataatgttaactgctcctgtgtgatgtcaaaagtggaaagaaggtgggaaattcttatttcatgtgrgatactactaaatacctggatgttttcaagtagtcgcatttttagcacagcatagtccaagcatccgggtatttgaatttttccctttccagctggtaat

SEQ ID NO: 61442 - DNA, 201 bp, Homo sapiens
ttataaaggattattattttcacattcttttatgcataattcagatcatgtacttaaagaggacacagactaattcaaaaagctcagaatattttcagatrcaactttttaacaagtatgcccgtcttctgaggtggtcttttaaatttgtctagatagattatgttctgcggtctgtaggagctgtgtacatcagagcag

SEQ ID NO: 61443 - DNA, 201 bp, Homo sapiens
gtattattaatggcccattttagcatgagtcatattagtgagaaatgggcaaatatgagtcatattaacaaggatgggttatctgagtcttgctctgcagmagttctgccagtgtgcaagtttttcagcattgagattttgaaaatgaaaaagaacattagagagaatgtggacatttctgtgctggctcaatggcccctg

SEQ ID NO: 61444 - DNA, 201 bp, Homo sapiens
attactaatattataaaagaaaattgggctaggcttagtgactcacacctgtcatcccagcacttgggaggctgaggtgggaggatcacttgaggccaagwgttcaagaccagcctgggcaacataatgagaccccatctctacaaaaaatttgaaaattagccaggcatcatggcacgtgcctgtagtcctagctactca

SEQ ID NO: 61445 - DNA, 201 bp, Homo sapiens
aaaggtatctttgttttagcttgatctgtaattcttttcagattcattatgtgcatggcaacacaaagaaaccatggtacttttgggcagcatctgattcmtcaggaaattcctcctgctatgatatgtggttggggagaacgtgagtgatgtgatccagatgcatgagccacccgttgccagtagtgcagatgtgtttta

SEQ ID NO: 61446 - DNA, 201 bp, Homo sapiens
aaatataatgttaactgctcctgtgtgatgtcaaaagtggaaagaaggtgggaaattcttatttcatgtgggatactactaaatacctggatgttttcaartagtcgcatttttagcacagcatagtccaagcatccgggtatttgaatttttccctttccagctggtaatcttgatatgttatagatgtaggcaaagcct

SEQ ID NO: 61447 - DNA, 201 bp, Homo sapiens
aaacaaatacagtcactgatccatgacaaaggacaaaggcaattcaatagagaaagatagtctttccaacaaatggttgtggaacaactggattttcacaygccaaaaaaaaaaaaatagacacagacacagaacatacaatacaccttttagaaaaattaattcgaaatgaatcttgggcctaaatgaaaaatgcaaaac

SEQ ID NO: 61448 - DNA, 201 bp, Homo sapiens
atggtgccttgagactctgctgggttagctcatagactttgttggtctctggaatatattctacttctttgcacatcaatccatctaattattggtattgycccaaaggaacaggttgagtagccccatccccctgcatgtctctattgaggggctactcaatctgtggctcaagatgagaggccaggctttcccatgctg

SEQ ID NO: 61449 - DNA, 201 bp, Homo sapiens
ctctggaatatattctacttctttgcacatcaatccatctaattattggtattgccccaaaggaacaggttgagtagccccatccccctgcatgtctctaytgaggggctactcaatctgtggctcaagatgagaggccaggctttcccatgctgcagccttgactttgccccatgctttgcattccttcttggggattca

SEQ ID NO: 61450 - DNA, 201 bp, Homo sapiens
gtgaaatatagttcagagaaattaaaaaccttggccaagggcatataactaattagttgcagagaggctagaatccaacctcactagttatttgctctcakatcaagaacaagctcattaaatatctctgaatttctagtacagtggctgatccatagtaagtgttcagtactattagttgactccgaaagcatccaatag

SEQ ID NO: 61451 - DNA, 201 bp, Homo sapiens
gggtctgacaatgaaaacccaagaagtgctctcatgcttccagcaggggaggggaaaagtgaccactctgaagcagatccagaatgttctccataataagrcctaccacagcaagggaaaagattgatcagagcctcatccaatatgaggggagagaaataacccaactccagctccctctagccttcctgtgtcacctaa

SEQ ID NO: 61452 - DNA, 201 bp, Homo sapiens
acaaatagaccaccaaacaaatacagtcactgatccatgacaaaggacaaaggcaattcaatagagaaagatagtctttccaacaaatggttgtggaacarctggattttcacatgccaaaaaaaaaaaaatagacacagacacagaacatacaatacaccttttagaaaaattaattcgaaatgaatcttgggcctaaat

SEQ ID NO: 61453 - DNA, 201 bp, Homo sapiens
aagtcatgactccaccactagaccctgaagatgggaccattccatgccatcatgaaccagacattgccttttcatatctagaagcctccctaacaagatgsttcagctttcatgaattctgcatccgaggttggtgtatcgttgggaaaaagcagacttgcccttactgcaaagagaaagttgatttgaagaggatgatca

SEQ ID NO: 61454 - DNA, 201 bp, Homo sapiens
aggagctgtgtacatcagagcagcttattataaatacctaaagcaaaagaaatggtttatttagaaaataaagtatagaaatataatgttaactgctcctrtgtgatgtcaaaagtggaaagaaggtgggaaattcttatttcatgtgggatactactaaatacctggatgttttcaagtagtcgcatttttagcacagca

SEQ ID NO: 61455 - DNA, 201 bp, Homo sapiens
aaaactttacaatcaaagcttaccaacccttatatttgaaatcccctgttgctttttgtaagccaaacctgttttttgtttttttgttttttgttttttgktttttttgctaaatgcgcaaggttgagggctttttcagatgacctcattttgctggttccagcctgcagcaggagaggatgtacaagatgcaccggggcc

SEQ ID NO: 61456 - DNA, 201 bp, Homo sapiens
gaaatgagcagagtctgtaagatgaaggcaataggaactgcaaaaaagtactgtattccacttgataaaattgttccccgtggggatacaaattaacaatkatcatactgctgtgtatgtacacaggaattgaacaattaagtaaatagcagctagtgggagccaggttacttactgttggaatgcgagtttacagaaaag

SEQ ID NO: 61457 - DNA, 201 bp, Homo sapiens
ttagaccctttgggaacaaggaaaggccttggaaggtcacagagggtgctggggtacacgcaggacccttccacacagcagaaggaaatagcctggggctstcatcatttcatcccctgggctaggggagggctctttgggtggaggggacatgggatgagggctgggcccactactggtgatatctgcactggggctggg

SEQ ID NO: 61458 - DNA, 201 bp, Homo sapiens
cccacaacccatttaaaccatgatgttcagaaggtcccttctgactggaactcagtgaaatagagcacctattaaaatcatattgaaaccttatgctagtratatcatagatcttaagtatttggtgcaatggctccaacagggagtgagctggggaaggtgagagagtcagagacagggctcaggacttggggatgagag

SEQ ID NO: 61459 - DNA, 201 bp, Homo sapiens
ctggttctttgaaaagatcaataaatctgataaacctctagccagactaaccaagaaaaaaaaaagagaaaacgcaaattactaatattataaaagaaaaytgggctaggcttagtgactcacacctgtcatcccagcacttgggaggctgaggtgggaggatcacttgaggccaagtgttcaagaccagcctgggcaaca

SEQ ID NO: 61460 - DNA, 201 bp, Homo sapiens
ataaataatataaattttggcaaaaattgatgaaattaaaaataggaaatcagtagaggaaacacaatgaaaccaaaagctggttctttgaaaagatcaayaaatctgataaacctctagccagactaaccaagaaaaaaaaaagagaaaacgcaaattactaatattataaaagaaaattgggctaggcttagtgactca

SEQ ID NO: 61461 - DNA, 201 bp, Homo sapiens
tgcaactctggagaaaccactagaaataattgtaaaggagtataattgatatactaatagaggagagaaaatggaatctcataaaatacccagttaaaacmagagaaggcagagagagagggagaaagatgcaaggaacaagtgcaacaaatagaaaatagttacatacatggtagatattaatccaactatatcaataat

SEQ ID NO: 61462 - DNA, 201 bp, Homo sapiens
atcacacctggtggagtaggtggcagcacagacagcccttgaatatcagttgcttcaagtgcagaaggtggttcaccatagaagtgatgtaaatgacaacwcatttcaggagctagcccacaacccatttaaaccatgatgttcagaaggtcccttctgactggaactcagtgaaatagagcacctattaaaatcatattg

SEQ ID NO: 61463 - DNA, 201 bp, Homo sapiens
tagtagaggggaccctctcagagcttgcctgtttctccaccatcaccacttttagcaacataaacttccgccttgatctggctgccctgagcaatgatctmaactgctcagtactgacaaatgaaaagaacccatggctcaagagtcactgtggcagaaagacgccaaaagccttctctggcttcctttcgaggccacaca

SEQ ID NO: 61464 - DNA, 201 bp, Homo sapiens
ggctgcaaagctcctgctcccaaaagcatgctatggcttcattaattcaacaaaccgctttgcacagagaaaccctgcagtttaaaggttattagtcctaraacatctctaatgctggcggaagtttgagagaggccccttaaggcagggaaatgggtcaccagtgtgtgcggagttcaaggaaccatattctggtactgg

SEQ ID NO: 61465 - DNA, 201 bp, Homo sapiens
aaggaatgccaagtaaattgaccaaagtcccatgggcagtaagcagcaaagccttggatcagaccaaagaactacttggctgcaaagctcctgctcccaamagcatgctatggcttcattaattcaacaaaccgctttgcacagagaaaccctgcagtttaaaggttattagtcctaaaacatctctaatgctggcggaag

SEQ ID NO: 61466 - DNA, 201 bp, Homo sapiens
gcgcaaggttgagggctttttcagatgacctcattttgctggttccagcctgcagcaggagaggatgtacaagatgcaccggggccacgattccatgcacstggaaatgatcttgatcttcctctgcgttctggtcattgcccagatagtgctggttcagtggagacagaggcatggccgatcctacaatgtgagtcatcc

SEQ ID NO: 61467 - DNA, 201 bp, Homo sapiens
tccaatggtcactttaattaccattgtcagcttccaaagatttgtataactccgttgtatcattcacaaatccttccaaagtgcttatcatcacatactgygcccacaggcttgcttttgccctccctgttctgtggataaaatccatatcctcatcatgataaaactggaatgagataaagtgtgtaaaatgtaaaatag

SEQ ID NO: 61468 - DNA, 201 bp, Homo sapiens
tgtttctccccatttttcactccacagattggtctacaaatggtttcttttgatctacaaactcagctatgcatttggtgttgtgggttacttggcgatcrtgtttacaatgtgtggattcaatctgtttttcaagtaagtatctccaattaagacattaatatctccaagcacttgcttggcgcactcacctggtcatgt

SEQ ID NO: 61469 - DNA, 201 bp, Homo sapiens
aaagtatagaaatataatgttaactgctcctgtgtgatgtcaaaagtggaaagaaggtgggaaattcttatttcatgtgggatactactaaatacctggakgttttcaagtagtcgcatttttagcacagcatagtccaagcatccgggtatttgaatttttccctttccagctggtaatcttgatatgttatagatgtag

SEQ ID NO: 61470 - DNA, 201 bp, Homo sapiens
gggggattccagggagaaatgcagactgtgcaaggggatctaactgcattaaaaatatggaaaacaacctcactgaagggtagagaggggaaaagtatcgycccctctttaagtaactttggaaatgagcagagtctgtaagatgaaggcaataggaactgcaaaaaagtactgtattccacttgataaaattgttccccg

SEQ ID NO: 61471 - DNA, 201 bp, Homo sapiens
acagtggctcatgcctgtaattccagcactttgagagcccaaggtaggaggactgcttgagccaagagctcgagaccagcttgggcaacaaagtgacaccytatctctaccaaaaaaaaaaaaaaattagccagatgtagcggcaggcacctgtagttccagctacttggaggctgaggagggaggatcgcttgagcctag

SEQ ID NO: 61472 - DNA, 201 bp, Homo sapiens
gcccatttctgcttctgctggcgtcaattgcaaacccaatcttaatttattcttcgttcataggacaattcttcttaggctacatccaggtaccaggaggmtttgggggtggaggagggtaggtcttacctggaggaacccaaatcccatccgtaaaacgaggacaaaaataactcttaagggcaaagataactcttaaac

SEQ ID NO: 61473 - DNA, 201 bp, Homo sapiens
aagttaaatcatttccaaatgctttgaacagcatttaactagaaataaaatttcattcaacatcaccctctccaccttcttttatgtgcagttactttccrtatctgcagcaagtagacagaagagtgccaaaaaagaatccttctctgacttcacaaatcagtagaaggcctgatgactacatgcccagaacttgggttt

SEQ ID NO: 61474 - DNA, 201 bp, Homo sapiens
tctagggatgacttagtagtttcaagaattccacatctctgtcctctacatgtgtctcctggtacacagccagatgtgaagtagaaaaatcagtgtaaagyaaagacatggaaacaacccatcaatgatagactggaaaaagaaagtgtggtacgtatacaccatggaatactatgcagccataataaagaatgagataat

SEQ ID NO: 61475 - DNA, 201 bp, Homo sapiens
aaaactatagttgatgatgcataaaacagttcagaatcaacagtgcatctgggtaatacttattataaataccagtcacattatatagcatctgaagaagwagaagatataaaaagtatgctagatgtattctgactctatactgttacctagaatttttttaatccctaacagttgtttttcttttctttttttgaactc

SEQ ID NO: 61476 - DNA, 201 bp, Homo sapiens
gatatggggggttaagatttttttaaagcttcccagtgtttcctaacttacagacaaggtcaagaacgactgctctaggttttcatcgaggctaccccagracgttaaaagagatgacaaactattttgttgattttctctacaattgtgcaaaactaagcatccagctaaaatgggaacattcagccatcatgggaatgt

SEQ ID NO: 61477 - DNA, 201 bp, Homo sapiens
gaaagacaaagttggaggactgacactgcccaatttcaagacttactgtaaagctacagtaataaatatagcatggtactggtgaaagaatagacacatargtcaatggaacagaatagagagcccacaaatagaccaccaaacaaatacagtcactgatccatgacaaaggacaaaggcaattcaatagagaaagatagt

SEQ ID NO: 61478 - DNA, 201 bp, Homo sapiens
cttagtcataaatctatcaaaatatgtacaggatctatacagagaaaggagatataaattaatggaaagattattccatattcatagattggaagattcartatcaatatgtccagtcttcctgacttgatctatagatctatagattaaacacaatctcaactaaaatctcagcaaggtactttgtgtatgtcaacaaac

SEQ ID NO: 61479 - DNA, 201 bp, Homo sapiens
aatttgaaattaaaacacaataccatttacagttgcaccaaaaaaaataaatacttagtcataaatctatcaaaatatgtacaggatctatacagagaaargagatataaattaatggaaagattattccatattcatagattggaagattcagtatcaatatgtccagtcttcctgacttgatctatagatctatagatt

SEQ ID NO: 61480 - DNA, 201 bp, Homo sapiens
taatggggagagactttgccgagatctgctcagactacatggcttccactataggggtaagtgttgctttcattttctgaaaccatgtatgacacaaagaraaatggtctcatcttacatgtctgcatccattttcagaaacaaataagtctttctccatatactgattattgtttcctttggaactcttttggttcacct

SEQ ID NO: 61481 - DNA, 201 bp, Homo sapiens
acctttcagctctgtctgaaaccctgcctaatgcaaataaaaactatagttgatgatgcataaaacagttcagaatcaacagtgcatctgggtaatacttrttataaataccagtcacattatatagcatctgaagaagtagaagatataaaaagtatgctagatgtattctgactctatactgttacctagaattttttt

SEQ ID NO: 61482 - DNA, 201 bp, Homo sapiens
acagctatggaaagcagctcaaatacaaatcccccagaatagctctcacatcaaagttactctaaacttctgggaccataacagaaattgaaaaggagagmtcatcaaccctttactcagaaaacagggaaggcaatcagatggagagtcagccctgggtgaaagggcttttcctatggcagcatagcaatctgattttat

SEQ ID NO: 61483 - DNA, 201 bp, Homo sapiens
tgccaacatttaaggattagtaaaacattaacaataactaaaacctttcagctctgtctgaaaccctgcctaatgcaaataaaaactatagttgatgatgyataaaacagttcagaatcaacagtgcatctgggtaatacttattataaataccagtcacattatatagcatctgaagaagtagaagatataaaaagtatg

SEQ ID NO: 61484 - DNA, 201 bp, Homo sapiens
tatgtgtgtatttgattgtctaagaacctccttcagcatgaaagctccagcagaaaagccatgtggtctgccttgctcgctcctgtatttccaggacctaraacagtctcagcaaacggcagggcctcaataaatatttattgaatgaataaatgaacagtaacgtacaatcttatgatgtaagaccctaactccagcata

SEQ ID NO: 61485 - DNA, 201 bp, Homo sapiens
tactccaattgccaacatttaaggattagtaaaacattaacaataactaaaacctttcagctctgtctgaaaccctgcctaatgcaaataaaaactatagytgatgatgcataaaacagttcagaatcaacagtgcatctgggtaatacttattataaataccagtcacattatatagcatctgaagaagtagaagatata

SEQ ID NO: 61486 - DNA, 201 bp, Homo sapiens
atactccaattgccaacatttaaggattagtaaaacattaacaataactaaaacctttcagctctgtctgaaaccctgcctaatgcaaataaaaactatakttgatgatgcataaaacagttcagaatcaacagtgcatctgggtaatacttattataaataccagtcacattatatagcatctgaagaagtagaagatat

SEQ ID NO: 61487 - DNA, 201 bp, Homo sapiens
aatcaaacacataaatgaaaaaaaaaatacccacaaggttctcttagataccatcaacaggaaatattttccaaactccagctgtttggaaatatgccacrttcttatttccttatactgttgttttcaatagaatcaaagctagagattccatggattttggcattgtgtctttgttctacggcctctactatggagtaa

SEQ ID NO: 61488 - DNA, 201 bp, Homo sapiens
aaccactggtcagagtcagcttgtctaggcactgcagtcctaagaagcacttgaaggctatctcaagaattcctttgtccagttggcactgagtgctacartttgagggaaattcagaggattttaaattatttcatttaaaaaagaaaaatcaaacacataaatgaaaaaaaaaatacccacaaggttctcttagatacc

SEQ ID NO: 61489 - DNA, 201 bp, Homo sapiens
tggagatggaaactgttacaagctgctgaggcctacgtatagctgagcctgaaaccactggtcagagtcagcttgtctaggcactgcagtcctaagaagcwcttgaaggctatctcaagaattcctttgtccagttggcactgagtgctacaatttgagggaaattcagaggattttaaattatttcatttaaaaaagaaa

SEQ ID NO: 61490 - DNA, 201 bp, Homo sapiens
aggaagagtaaccattcctgaaggctatttttaagtgaagcacatgagggacgtagacaaatttaaaaagaattcacatacgcatatacacagaaacacakgagcatgatagttctattcatataatgcttattgctatatacatctgtgttctgtgtgttataaatttacttttagaaactaaaaactgatttataagtc

SEQ ID NO: 61491 - DNA, 201 bp, Homo sapiens
ctggactcccctttgacttctcatcccactttttgttcacctccaaggcactcctgctgaaaccactcaaggttaaccctaggaccaaatgagaagggggygctgtggggaggcagggtcccaggaagagtaaccattcctgaaggctatttttaagtgaagcacatgagggacgtagacaaatttaaaaagaattcacat

SEQ ID NO: 61492 - DNA, 201 bp, Homo sapiens
gcaggagaatcgcttgaacccgggaggcagaggttgcagtgagctgagatcgcaccattgcactctagcctgggcgacaaaagcaagactccacctcgggaaaaaaaaaaagagagagagagagagagaaaagataaaaacacagttattttgtgtttcagggtttgagatgtccagggtcctctaaagcaaggcagggcc

SEQ ID NO: 61493 - DNA, 201 bp, Homo sapiens
caggagaatcgcttgaacccgggaggcagaggttgcagtgagctgagatcgcaccattgcactctagcctgggcgacaaaagcaagactccacctcgggaaaaaaaaaaagagagagagagagagagaaaagataaaaacacagttattttgtgtttcagggtttgagatgtccagggtcctctaaagcaaggcagggccc

SEQ ID NO: 61494 - DNA, 201 bp, Homo sapiens
ttgggatttgcagtgcagaggaaatgaacacacataatttatttatttttttctttttttccttgtttccttccttccttccttccttcctccctccctcyctctctctctttctttctctttccttctttcttttaatattgcatggcccattcatcattctgtacaattagccaaatgaaaggtatctttgttttagct

SEQ ID NO: 61495 - DNA, 201 bp, Homo sapiens
aaccaagaaaaaaaaaagagaaaacgcaaattactaatattataaaagaaaattgggctaggcttagtgactcacacctgtcatcccagcacttgggaggytgaggtgggaggatcacttgaggccaagtgttcaagaccagcctgggcaacataatgagaccccatctctacaaaaaatttgaaaattagccaggcatca

SEQ ID NO: 61496 - DNA, 201 bp, Homo sapiens
ctacaactgacatacttaatggtgagaaactggatgatttccctctaagataaggaagaaggaaagaatgtcctgtctcaccactcctattcaacattgtrcaggaagtccttgctagtgcagcaagataggaaataaaaggtatgcagattagaaagaaaaattaaaaccatcttacatgattgtctatatggaaaatct

SEQ ID NO: 61497 - DNA, 201 bp, Homo sapiens
gctagtgatatcatagatcttaagtatttggtgcaatggctccaacagggagtgagctggggaaggtgagagagtcagagacagggctcaggacttggggrtgagagggtggggctaaatatctggagcaagactcttaatgcagtttggagtgaaaagcaggaaagagactccaagaggatgtgcagggaaagggatgtg

SEQ ID NO: 61498 - DNA, 201 bp, Homo sapiens
agctgggagcgcacacattttctgtatggacaaatcctggattggcttcgttatttggtggcctggcaacctgtggtgataggaatagttcaaggcattawctattcactagggctggaataggacagcagaccccagaagcaacatactgcatggttgaaatccttggtccaacatttaatattaatttttttaatttta

SEQ ID NO: 61499 - DNA, 201 bp, Homo sapiens
agcacctattaaaatcatattgaaaccttatgctagtgatatcatagatcttaagtatttggtgcaatggctccaacagggagtgagctggggaaggtgaragagtcagagacagggctcaggacttggggatgagagggtggggctaaatatctggagcaagactcttaatgcagtttggagtgaaaagcaggaaagaga

SEQ ID NO: 61500 - DNA, 201 bp, Homo sapiens
cagttgcttcaagtgcagaaggtggttcaccatagaagtgatgtaaatgacaacacatttcaggagctagcccacaacccatttaaaccatgatgttcagraggtcccttctgactggaactcagtgaaatagagcacctattaaaatcatattgaaaccttatgctagtgatatcatagatcttaagtatttggtgcaat

SEQ ID NO: 61501 - DNA, 201 bp, Homo sapiens
acggacatcgacgagtgcgaaaacggcggcttctgctccggggtgtgccacaacctccccggtaccttcgagtgcatctgcgggcccgactcggcccttgyccgccacattggcaccgactgtgactccggcaaggtggacggtggcgacagcggctctggcgagcccccgcccagcccgacgcccggctccaccttgact

SEQ ID NO: 61502 - DNA, 201 bp, Homo sapiens
ctgcctcgcaggggctgcgcgcagcggcaagaagtgtctgggctgggacggacaggagaggctgtcgccatcggcgtcctgtgcccctctgctccggcacsgccctgtcgcagtgcccgcgctttccccggcgcctgcacgcggcgcgcctgggtaacatgcttggggtcctggtccttggcgcgctggccctggccggcc

SEQ ID NO: 61503 - DNA, 201 bp, Homo sapiens
cgcagagactctgagcggcctccgtccaggagcctggctccgtccaggagcctgtgcctcctcacccccagctttgctaccaaagcaccttagctggcatkacagctggagaagaccctccccgcaccccccaagctgttttcttctattccatggctaactggcgagggggtgattagagggaggagaatgagcctcggc

SEQ ID NO: 61504 - DNA, 201 bp, Homo sapiens
cccgactcggcccttgcccgccacattggcaccgactgtgactccggcaaggtggacggtggcgacagcggctctggcgagcccccgcccagcccgacgcycggctccaccttgactcctccggccgtggggctcgtgcattcgggcttgctcataggcatctccatcgcgagcctgtgcctggtggtggcgcttttggcg

SEQ ID NO: 61505 - DNA, 201 bp, Homo sapiens
tggggctcccctctgcggcccgttgtgcgtcgctgtctccgctgctgaggccactgtgcccagcgagccgatctgggaggagcagcagtgcgaagtgaagsccgatggcttcctctgcgagttccacttcccagccacctgcaggccactggctgtggagcccggcgccgcggctgccgccgtctcgatcacctacggcac

SEQ ID NO: 61506 - DNA, 201 bp, Homo sapiens
cacggccctgtcgcagtgcccgcgctttccccggcgcctgcacgcggcgcgcctgggtaacatgcttggggtcctggtccttggcgcgctggccctggccrgcctggggttccccgcacccgcagagccgcagccgggtggcagccagtgcgtcgagcacgactgcttcgcgctctacccgggccccgcgaccttcctcaa

SEQ ID NO: 61507 - DNA, 201 bp, Homo sapiens
cttcgagtgcatctgcgggcccgactcggcccttgcccgccacattggcaccgactgtgactccggcaaggtggacggtggcgacagcggctctggcgagyccccgcccagcccgacgcccggctccaccttgactcctccggccgtggggctcgtgcattcgggcttgctcataggcatctccatcgcgagcctgtgcct

SEQ ID NO: 61508 - DNA, 201 bp, Homo sapiens
ctcaatgccagtcagatctgcgacggactgcggggccacctaatgacagtgcgctcctcggtggctgccgatgtcatttccttgctactgaacggcgacgscggcgttggccgccggcgcctctggatcggcctgcagctgccacccggctgcggcgaccccaagcgcctcgggcccctgcgcggcttccagtgggttacg

SEQ ID NO: 61509 - DNA, 201 bp, Homo sapiens
tgccctcattttatgtcattaaatggggctcacaaaccatgcaaatgctatgagatgcatggagggctgccctgtaccccagcacttgtgttgtctggtgrtggcaccatctctgattttcaaagctttttccagaggctattattttcactgtagaatgatttcatgctatctctgtgtgcacaaatatttattttcttt

SEQ ID NO: 61510 - DNA, 201 bp, Homo sapiens
gctggccctggccggcctggggttccccgcacccgcagagccgcagccgggtggcagccagtgcgtcgagcacgactgcttcgcgctctacccgggccccrcgaccttcctcaatgccagtcagatctgcgacggactgcggggccacctaatgacagtgcgctcctcggtggctgccgatgtcatttccttgctactgaa

SEQ ID NO: 61511 - DNA, 201 bp, Homo sapiens
aaaatggccatttgctttttcaccagatttgctaatttatcctgaaatttcagattcccagagcaaaataattttaaacaaaggttgagatgtaaaaggtrttaaattgatgttgctggactgtcatagaaattacacccaaagaggtatttatctttacttttaaacagtgagcctgaattttgttgctgttttgatttg

SEQ ID NO: 61512 - DNA, 201 bp, Homo sapiens
aaatcaaagtccaggaggccacctccaatgacccatggggcccatccagctctctgatgaccgagattgcagacctgacctacaacatggtggccttctcrgggatcatgagcatgatgtggaagcggctcaatgaccatagcaagaactggcagcatgtgtacaaggagctgctgctgctggactaccccatcaagacag

SEQ ID NO: 61513 - DNA, 201 bp, Homo sapiens
tttgtaacaaagaaaagtgatgactttatctatcagatagcagatgaaaaacattgtgaaaaattactcagaggcagaaatcaaagtccaggaggccaccwccaatgacccatggggcccatccagctctctgatgaccgagattgcagacctgacctacaacatggtggccttctcggggatcatgagcatgatgtggaa

SEQ ID NO: 61514 - DNA, 201 bp, Homo sapiens
tatctatcagatagcagatgaaaaacattgtgaaaaattactcagaggcagaaatcaaagtccaggaggccacctccaatgacccatggggcccatccagstctctgatgaccgagattgcagacctgacctacaacatggtggccttctcggggatcatgagcatgatgtggaagcggctcaatgaccatagcaagaact

SEQ ID NO: 61515 - DNA, 201 bp, Homo sapiens
ccattcttcctcatatgctcaaagatggtggattgggccaacaggctccaacacgacctctgccatcagcagagctgacaactgctagcctggcttttacracttttgatcttctggggcataagcaaacacgttggatttggaacagtgatctcccagcaacaaatgggattgcctttctgggttactgtgcagattgtc

SEQ ID NO: 61516 - DNA, 201 bp, Homo sapiens
ccaacaggctccaacacgacctctgccatcagcagagctgacaactgctagcctggcttttacaacttttgatcttctggggcataagcaaacacgttggwtttggaacagtgatctcccagcaacaaatgggattgcctttctgggttactgtgcagattgtcctcagatcctggaatccaaagaggagctcaatgcttt

SEQ ID NO: 61517 - DNA, 201 bp, Homo sapiens
ggcccaacccccttattcacgagccgcggccgtgactctgcccggtgacgtggggaggccgaactttacgtaacccgcccggcgccccacgcgtgccggcwcagggcatatctggggcccggaggcccaggcttggggaaggggctccagtcacggtgttgcccacgggccacagcctacccgcaccgcgccgctctcttt

SEQ ID NO: 61518 - DNA, 201 bp, Homo sapiens
atctagtagtcggggagatcaagagaggtatgggacctgaagaggatggcagactgtgcagtgcggtgcacaccggtctccaggttgttttcaccctcctrtctcctcccaggagctaacgtgtaagcaaacatgtttggatagagggctggtgccacgccccaggctcaccccgcccgcacagccgtcgtccacccctcc

SEQ ID NO: 61519 - DNA, 201 bp, Homo sapiens
ggcgcggcgctgccttcaatggcccaacccccttattcacgagccgcggccgtgactctgcccggtgacgtggggaggccgaactttacgtaacccgcccrgcgccccacgcgtgccggcacagggcatatctggggcccggaggcccaggcttggggaaggggctccagtcacggtgttgcccacgggccacagcctacc

SEQ ID NO: 61520 - DNA, 201 bp, Homo sapiens
ggaattctgctgggccgtcaaattcaacccgcaccaacgtgggcaggagggccacagtgtcctgccaggagcagagggctgaaggtctgcaggaggaagarccactatcctggtggggggcacctgctgcccaccctgcccccagcgtgcctggggggagcacacctgggcatggaggagtccagggtgctgggccacaca

SEQ ID NO: 61521 - DNA, 201 bp, Homo sapiens
ggcctgggtgaggtgggcagggaccaaggcctggcgcctgggcctcgctggccttgctctgcgtgctgacttcatcctgatagtaccttgattttcctacygtgacttccccttctgtcgacttcctcaccaactttaaaattccgtattgagagcagtttcctaagttacctcaaatcctattcagaagaaggttcttcc

SEQ ID NO: 61522 - DNA, 201 bp, Homo sapiens
ctaacgtgtaagcaaacatgtttggatagagggctggtgccacgccccaggctcaccccgcccgcacagccgtcgtccacccctcccctttcttacagatraagctgaggctcggccagggactgtgatatacccacatccccggaactaggtgatcgcggtgcaggaaccaggtaggtctgagtctggatcatgcctctg

SEQ ID NO: 61523 - DNA, 201 bp, Homo sapiens
gggcagcctgggccattagctcctgatgtcatcgatttgggtgaggggacagggaagtcagaggaagctggccagtggctctcacgcagacttacagcagyggagtggtgcctgattcctggtacagctgctcccactgagtctccagggatctgtggttcaggaccccctgcaaccccctcccagacccctgtactggtg

SEQ ID NO: 61524 - DNA, 201 bp, Homo sapiens
aaccagcaagctctcagatgccaactgctgcctggacgccatctgctactactacatggccaaggagttccaggaggcgtctgcactggccgtggctcccmgtgctaaggcccacaaaagccaggactctctgtgcgtgaccctcgcctaagaggcgtgctgtgggcgctgtgggccaggtctcgggggctccgggaggtg

SEQ ID NO: 61525 - DNA, 201 bp, Homo sapiens
cgtgtgcgcggtcctctgggtgctggtcatcggctccctggtggctcgctggctcctggggattcaggagggcggcttctgcttcaggagcacccggcacratttcaactccatggcgttcccgctgctgggattctacctgcccctggccgtggtggtcttctgctccctgaaggtggtgactgccctggcccagaggcc

SEQ ID NO: 61526 - DNA, 201 bp, Homo sapiens
cttcttcgaagcctacgtgcacctcgaaactcttgcaacatttgcatttttctccctaatagttcagtgtttgttttattataaacaggaaaatttaaatrttgtagttagagtttttttcttcttcttagagatggggtttcactctgtctcctaaggctggagtgcagtggtgggatcatagctcacttcagcctcaac

SEQ ID NO: 61527 - DNA, 201 bp, Homo sapiens
gtcagcaaatatctgctgtacttcaccagaggtgggatctaaggagacagaatgaagccagggggcagaatgtttcgtttctgtctgaaacctgtgccctscatccctcatggactggggacctggagttcccggggaccaccgtggggaaatgcgtcccagcactaatggtccccagcagctgcagtcacggggtttggg

SEQ ID NO: 61528 - DNA, 201 bp, Homo sapiens
gccgggcttggactgatcaggtgccgtgccttctgctgaccccagaggccagaccctgtggccagagtgagggatgggagttgagatcgggcggatgaaawcccaaatctgagcctcctgcccgaggatgaggcccctctccaatgaacatcatggcccatggagactgggcagggaacccaagggcgcacactggggact

SEQ ID NO: 61529 - DNA, 201 bp, Homo sapiens
ttgaagggacaccagaaaaacagtcataaagataaaccgtaatgtgttgttttatttcttatttatttatttatttatttttgagatggagtctccctctrtcgcccaggctggagtgcagtggcgtgatctcggctcaccacaacctccgcctcccgggttcaagcaattctcttgtctcagcttcccgagtagctggga

SEQ ID NO: 61530 - DNA, 201 bp, Homo sapiens
ctctgttgcaaccaggctggagtgcagtagcacgatctcagctcattgcaatctctgcctcccaggctcaggtgctcctcccgccttagcctcctgagtarctgggattacaggcatgcacccccatgcgtggctaattttttttttttttactttttgtaaagatggggtcttgctatgttgcccaggctggtctcaaac

SEQ ID NO: 61531 - DNA, 201 bp, Homo sapiens; identical to SEQ ID NO: 52964

SEQ ID NO: 61532 - DNA, 201 bp, Homo sapiens
tgcggtcccccaggcaggctgcggccgtgtgcgcggtcctctgggtgctggtcatcggctccctggtggctcgctggctcctggggattcaggagggcggyttctgcttcaggagcacccggcacaatttcaactccatggcgttcccgctgctgggattctacctgcccctggccgtggtggtcttctgctccctgaagg

SEQ ID NO: 61533 - DNA, 201 bp, Homo sapiens
cacctccagtccctgcttgacggcggccgggcttggactgatcaggtgccgtgccttctgctgaccccagaggccagaccctgtggccagagtgagggatgggagttgagatcgggcggatgaaaacccaaatctgagcctcctgcccgaggatgaggcccctctccaatgaacatcatggcccatggagactgggcaggg

SEQ ID NO: 61534 - DNA, 201 bp, Homo sapiens
tccagtccctgcttgacggcggccgggcttggactgatcaggtgccgtgccttctgctgaccccagaggccagaccctgtggccagagtgagggatgggagttgagatcgggcggatgaaaacccaaatctgagcctcctgcccgaggatgaggcccctctccaatgaacatcatggcccatggagactgggcagggaacc

SEQ ID NO: 61535 - DNA, 201 bp, Homo sapiens
ggctgcggtcccccaggcaggctgcggccgtgtgcgcggtcctctgggtgctggtcatcggctccctggtggctcgctggctcctggggattcaggagggyggcttctgcttcaggagcacccggcacaatttcaactccatggcgttcccgctgctgggattctacctgcccctggccgtggtggtcttctgctccctga

SEQ ID NO: 61536 - DNA, 201 bp, Homo sapiens
ccagtccctgcttgacggcggccgggcttggactgatcaggtgccgtgccttctgctgaccccagaggccagaccctgtggccagagtgagggatgggagttgagatcgggcggatgaaaacccaaatctgagcctcctgcccgaggatgaggcccctctccaatgaacatcatggcccatggagactgggcagggaaccc

SEQ ID NO: 61537 - DNA, 201 bp, Homo sapiens
ttcgtgctgcactccctgcgagacacctcagacacgccgctgtgccagctctcccagggcatctacctgaccaacaggtacatgagcatcagcctggtcayggccatcgccgtggaccgctatgtggccgtgcggcacccgctgcgtgcccgcgggctgcggtcccccaggcaggctgcggccgtgtgcgcggtcctctgg

SEQ ID NO: 61538 - DNA, 201 bp, Homo sapiens
aggctggtggtcccaggatagggcaaaagaacgggagtgagaactctccacacagtgcttcttctggggttaaggaccctctgcctcagtggctcctgggygtgattaaacttgccatttcctgggcccatcctagacaggctgctgcaagccagccaggccgggatcctgctgccccggggaggacgtggggaaaatccc

SEQ ID NO: 61539 - DNA, 201 bp, Homo sapiens
tgttggggtctcaggggtggctgaggctgatgaagacttggagcctgtgtctgggtagcagcttgttggagtgtgggatgtgacatttaaaaacaagaatraagaataccccgtgctgtggccccgaggtgagcagctactttggtgaactcgtgtcactcacagccccatcctgggtcctggggtgtggtgtgctgtgtg

SEQ ID NO: 61540 - DNA, 201 bp, Homo sapiens
ggccaggtttctctcctggatcactcagtgcagaatcaaagggcacttttctgcttttgtgtgcagaagccgagggtgaccttgtcatcagaaggggaagyggggcctcagaggcgtgctgctggctccaatccccaaagcctcctgggcaggaagtggaagggccccatccccacggtccctggcagcgggagctccctg

SEQ ID NO: 61541 - DNA, 201 bp, Homo sapiens
aagcccgcagcccgagtgttggacaagcttgctgcagaggctcccctagatagggctgcaggggtggcgtccggcagctctagctggagaagcaggaggargggcaggaaggaatcctgttcggagctcctcgcgtcacacatacagcccagcggggtgaagtgggaggggctggcgctgctgcagggggctaaccttggg

SEQ ID NO: 61542 - DNA, 201 bp, Homo sapiens
aggagttttgtgtttgtgggtgtggggtcggggctcacctcctcccacatccctgcccagaggtgggcagagtgggggcagtgccttgctccccctgctcrctctctgctgacctccggctccctgtgctgccccaggaccatgaatggcacctacaacacctgtggctccagcgacctcacctggcccccagcgatcaag

SEQ ID NO: 61543 - DNA, 201 bp, Homo sapiens
tgccccatgacagcaggcagatcccaggagagaagagctcaggagatgggaagaggatctgtccaggggttagacctcaagggtgacttggagttctttayggcacccatgctttctttgaggagttttgtgtttgtgggtgtggggtcggggctcacctcctcccacatccctgcccagaggtgggcagagtgggggcag

SEQ ID NO: 61544 - DNA, 201 bp, Homo sapiens
ggctggcgtggacagtggaggggtgactttgtgggtggtcctgatagtgacggagaggaggatactcagctccacccctgggcggcccctgagcagcacgrctgggcctgaaggggcagggctgccgtcacaggctctggcccctgggagctcaaggggtgaatccctgatcccaggtgtgggactgggatggggcctcag

SEQ ID NO: 61545 - DNA, 201 bp, Homo sapiens
accaaaactatgcaaaggacgcatgaggatccaagcgactcatttaggatggcagcttcactgcaaaaggagtctcgattcagacctcaagacatgcttcktgggtctcactcaggaaggaagtggaggcaagtcagaatgtggtgagaagagagggtttattgaaagttgctccattacagagcagggtgtcgtcagaaa

SEQ ID NO: 61546 - DNA, 201 bp, Homo sapiens
ctccggctccctgtgctgccccaggaccatgaatggcacctacaacacctgtggctccagcgacctcacctggcccccagcgatcaagctgggcttctacrcctacttgggcgtcctgctggtgctaggcctgctgctcaacagcctggcgctctgggtgttctgctgccgcatgcagcagtggacggagacccgcatcta

SEQ ID NO: 61547 - DNA, 201 bp, Homo sapiens
gtggctccagcgacctcacctggcccccagcgatcaagctgggcttctacgcctacttgggcgtcctgctggtgctaggcctgctgctcaacagcctggcsctctgggtgttctgctgccgcatgcagcagtggacggagacccgcatctacatgaccaacctggcggtggccgacctctgcctgctgtgcaccttgccct

SEQ ID NO: 61548 - DNA, 201 bp, Homo sapiens
aaggagcccgggatcagccctgaactcactgtgtattctcttggagccttgggtgggcagggacggcccaggtacctgctctcttgggaagagagagggayagggacaagggcaagaggactgaggccagagcaaggccaatgtcagagacccccgggatggggcctcacacttgccacccccagaaccagctcacctggc

SEQ ID NO: 61549 - DNA, 201 bp, Homo sapiens
ccagggcatctacctgaccaacaggtacatgagcatcagcctggtcacggccatcgccgtggaccgctatgtggccgtgcggcacccgctgcgtgcccgcrggctgcggtcccccaggcaggctgcggccgtgtgcgcggtcctctgggtgctggtcatcggctccctggtggctcgctggctcctggggattcaggaggg

SEQ ID NO: 61550 - DNA, 201 bp, Homo sapiens
ctcgcctaagaggcgtgctgtgggcgctgtgggccaggtctcgggggctccgggaggtgctgcctgccaggggaagctggaaccagtagcaaggagcccgrgatcagccctgaactcactgtgtattctcttggagccttgggtgggcagggacggcccaggtacctgctctcttgggaagagagagggacagggacaagg

SEQ ID NO: 61551 - DNA, 201 bp, Homo sapiens
tgggccaacctcctggtgttcgtggtctgcttcctgcccctgcacgtggggctgacagtgcgcctcgcagtgggctggaacgcctgtgccctcctggagaygatccgtcgcgccctgtacataaccagcaagctctcagatgccaactgctgcctggacgccatctgctactactacatggccaaggagttccaggaggcg

SEQ ID NO: 61552 - DNA, 201 bp, Homo sapiens
ctcccagggcatctacctgaccaacaggtacatgagcatcagcctggtcacggccatcgccgtggaccgctatgtggccgtgcggcacccgctgcgtgccmgcgggctgcggtcccccaggcaggctgcggccgtgtgcgcggtcctctgggtgctggtcatcggctccctggtggctcgctggctcctggggattcagga

SEQ ID NO: 61553 - DNA, 201 bp, Homo sapiens
gggactgccctgaagtgcctgcggagacagccaaggggcagatggagagaggtagggggtgggctggggacagcgtttcctgtacacaggtggaacctggyggcaaggggcccttcccagagacagtcagagtctctaaatgtccagtttcttccccaagtccacacagcccagaagaatccgctgggaccatgtggccct

SEQ ID NO: 61554 - DNA, 201 bp, Homo sapiens
tggggactccgggtgtcctcgaagaagggcctgagcagcagcagaggaccccaggcgaccgtgcctgagccgggcgccgacgacgactgagcacctgataygtccccggcactcgcagccccgcggccggagtcgctgtgggtgagcggtcgtcgagcttcacagaggccgggctctgtgccagggccccgacagggcagg

SEQ ID NO: 61555 - DNA, 201 bp, Homo sapiens
tgggctgtggctggcaggtatgtgcctcattggtctcaaggtggagctgaacgtaaacggcttttctctggctctcccaggctcctgcttccctgacatcscctcacagacttcccttcaaagcagggctgtccaatcttttggcttccccgggccgcattggaataagaagaattgccttgggccaaacatgaaatacac

SEQ ID NO: 61556 - DNA, 201 bp, Homo sapiens
tccctgcttgacggcggccgggcttggactgatcaggtgccgtgccttctgctgaccccagaggccagaccctgtggccagagtgagggatgggagttgagatcgggcggatgaaaacccaaatctgagcctcctgcccgaggatgaggcccctctccaatgaacatcatggcccatggagactgggcagggaacccaagg

SEQ ID NO: 61557 - DNA, 201 bp, Homo sapiens
ggcggccgggcttggactgatcaggtgccgtgccttctgctgaccccagaggccagaccctgtggccagagtgagggatgggagttgagatcgggcggatgaaaacccaaatctgagcctcctgcccgaggatgaggcccctctccaatgaacatcatggcccatggagactgggcagggaacccaagggcgcacactggg

SEQ ID NO: 61558 - DNA, 201 bp, Homo sapiens
gcggccgggcttggactgatcaggtgccgtgccttctgctgaccccagaggccagaccctgtggccagagtgagggatgggagttgagatcgggcggatgaaaacccaaatctgagcctcctgcccgaggatgaggcccctctccaatgaacatcatggcccatggagactgggcagggaacccaagggcgcacactgggg

SEQ ID NO: 61559 - DNA, 201 bp, Homo sapiens
cggccgggcttggactgatcaggtgccgtgccttctgctgaccccagaggccagaccctgtggccagagtgagggatgggagttgagatcgggcggatgaaaacccaaatctgagcctcctgcccgaggatgaggcccctctccaatgaacatcatggcccatggagactgggcagggaacccaagggcgcacactgggga

SEQ ID NO: 61560 - DNA, 201 bp, Homo sapiens
gctcagggtccctccaaaagtccctggaacgagggtgaagtgttgctcatgaatcagagagaaagcaagcaggaccctcaagaagggaggagagagaccaytgggcgtgcagcactttgcactcgggggaagggctcctgaaacttggaagtcagcaaatatctgctgtacttcaccagaggtgggatctaaggagacaga

SEQ ID NO: 61561 - DNA, 201 bp, Homo sapiens
aaagcctgggccttgatttcctgaacttttctgggaggcactccacgggcgagacaaggacccatgaacagggcacttcttcgaagcctacgtgcacctcraaactcttgcaacatttgcatttttctccctaatagttcagtgtttgttttattataaacaggaaaatttaaatgttgtagttagagtttttttcttctt

SEQ ID NO: 61562 - DNA, 201 bp, Homo sapiens
ccatccccacggtccctggcagcgggagctccctgaggctgatggtgctggtgtctgtcgaggaagacaggcctgaggagctgaggcgggaggccagctayggtccacggcctggacacagattcctgtgcgggactggggcagtaggtgggcatctgtgctggccatgttagctcccaggggccccatgccatctgggct

SEQ ID NO: 61563 - DNA, 201 bp, Homo sapiens
gccccatgacagcaggcagatcccaggagagaagagctcaggagatgggaagaggatctgtccaggggttagacctcaagggtgacttggagttctttacrgcacccatgctttctttgaggagttttgtgtttgtgggtgtggggtcggggctcacctcctcccacatccctgcccagaggtgggcagagtgggggcagt

SEQ ID NO: 61564 - DNA, 201 bp, Homo sapiens
tgtcatcagaaggggaagcggggcctcagaggcgtgctgctggctccaatccccaaagcctcctgggcaggaagtggaagggccccatccccacggtcccyggcagcgggagctccctgaggctgatggtgctggtgtctgtcgaggaagacaggcctgaggagctgaggcgggaggccagctacggtccacggcctggac

SEQ ID NO: 61565 - DNA, 201 bp, Homo sapiens
aggcagaggccacccgcaaggctgcccgcatggtctgggccaacctcctggtgttcgtggtctgcttcctgcccctgcacgtggggctgacagtgcgcctygcagtgggctggaacgcctgtgccctcctggagacgatccgtcgcgccctgtacataaccagcaagctctcagatgccaactgctgcctggacgccatct

SEQ ID NO: 61566 - DNA, 201 bp, Homo sapiens
tgcaggttcccgagccaggaagtggcacttaggagtgaggatcttaggagcggggctcttggacaggagggcgagtgagttgggagggcctcaagcggggrcccgatggctctctctgctgagaagggagggccctagggatggggacagagagctggcagttgaagggccaaggagcaggcagcttcccagtcacagagc

SEQ ID NO: 61567 - DNA, 201 bp, Homo sapiens
gcctggcgctctgggtgttctgctgccgcatgcagcagtggacggagacccgcatctacatgaccaacctggcggtggccgacctctgcctgctgtgcacyttgcccttcgtgctgcactccctgcgagacacctcagacacgccgctgtgccagctctcccagggcatctacctgaccaacaggtacatgagcatcagcc

SEQ ID NO: 61568 - DNA, 201 bp, Homo sapiens
ctgggtgttctgctgccgcatgcagcagtggacggagacccgcatctacatgaccaacctggcggtggccgacctctgcctgctgtgcaccttgcccttcrtgctgcactccctgcgagacacctcagacacgccgctgtgccagctctcccagggcatctacctgaccaacaggtacatgagcatcagcctggtcacggc

SEQ ID NO: 61569 - DNA, 201 bp, Homo sapiens
gtccttgggctgacaggtgctgctgcctctgagccctccctgctaagagctgtgtgctgggtaaggctggtggccctttgggctccctgtccaggatttgygctctggagggtagggcttgctgggctggggactggaggggaacgtggagctccttctgcctcctttcctgccccatgacagcaggcagatcccaggaga

SEQ ID NO: 61570 - DNA, 201 bp, Homo sapiens; identical to SEQ ID NO: 44244

SEQ ID NO: 61571 - DNA, 201 bp, Homo sapiens; identical to SEQ ID NO: 44247

SEQ ID NO: 61572 - DNA, 201 bp, Homo sapiens; identical to SEQ ID NO: 44255

SEQ ID NO: 61573 - DNA, 201 bp, Homo sapiens; identical to SEQ ID NO: 44100

SEQ ID NO: 61574 - DNA, 201 bp, Homo sapiens; identical to SEQ ID NO: 44107

SEQ ID NO: 61575 - DNA, 201 bp, Homo sapiens; identical to SEQ ID NO: 43963

SEQ ID NO: 61576 - DNA, 201 bp, Homo sapiens; identical to SEQ ID NO: 43964

SEQ ID NO: 61577 - DNA, 201 bp, Homo sapiens; identical to SEQ ID NO: 43966

SEQ ID NO: 61578 - DNA, 201 bp, Homo sapiens; identical to SEQ ID NO: 43968

SEQ ID NO: 61579 - DNA, 201 bp, Homo sapiens; identical to SEQ ID NO: 43969

SEQ ID NO: 61580 - DNA, 201 bp, Homo sapiens; identical to SEQ ID NO: 43971

SEQ ID NO: 61581 - DNA, 201 bp, Homo sapiens; identical to SEQ ID NO: 43973

SEQ ID NO: 61582 - DNA, 201 bp, Homo sapiens; identical to SEQ ID NO: 43976

SEQ ID NO: 61583 - DNA, 201 bp, Homo sapiens; identical to SEQ ID NO: 43979

SEQ ID NO: 61584 - DNA, 201 bp, Homo sapiens; identical to SEQ ID NO: 43982

SEQ ID NO: 61585 - DNA, 201 bp, Homo sapiens; identical to SEQ ID NO: 44111

SEQ ID NO: 61586 - DNA, 201 bp, Homo sapiens; identical to SEQ ID NO: 43990

SEQ ID NO: 61587 - DNA, 201 bp, Homo sapiens; identical to SEQ ID NO: 43994

SEQ ID NO: 61588 - DNA, 201 bp, Homo sapiens; identical to SEQ ID NO: 44112

SEQ ID NO: 61589 - DNA, 201 bp, Homo sapiens; identical to SEQ ID NO: 44113

SEQ ID NO: 61590 - DNA, 201 bp, Homo sapiens; identical to SEQ ID NO: 44114

SEQ ID NO: 61591 - DNA, 201 bp, Homo sapiens; identical to SEQ ID NO: 44115

SEQ ID NO: 61592 - DNA, 201 bp, Homo sapiens; identical to SEQ ID NO: 44116

SEQ ID NO: 61593 - DNA, 201 bp, Homo sapiens; identical to SEQ ID NO: 44290

SEQ ID NO: 61594 - DNA, 201 bp, Homo sapiens; identical to SEQ ID NO: 44120

SEQ ID NO: 61595 - DNA, 201 bp, Homo sapiens; identical to SEQ ID NO: 44121

SEQ ID NO: 61596 - DNA, 201 bp, Homo sapiens; identical to SEQ ID NO: 44291

SEQ ID NO: 61597 - DNA, 201 bp, Homo sapiens; identical to SEQ ID NO: 43996

SEQ ID NO: 61598 - DNA, 201 bp, Homo sapiens; identical to SEQ ID NO: 44122

SEQ ID NO: 61599 - DNA, 201 bp, Homo sapiens; identical to SEQ ID NO: 43998

SEQ ID NO: 61600 - DNA, 201 bp, Homo sapiens; identical to SEQ ID NO: 44124

SEQ ID NO: 61601 - DNA, 201 bp, Homo sapiens; identical to SEQ ID NO: 44125

SEQ ID NO: 61602 - DNA, 201 bp, Homo sapiens; identical to SEQ ID NO: 43999

SEQ ID NO: 61603 - DNA, 201 bp, Homo sapiens; identical to SEQ ID NO: 43817

SEQ ID NO: 61604 - DNA, 201 bp, Homo sapiens; identical to SEQ ID NO: 44000

SEQ ID NO: 61605 - DNA, 201 bp, Homo sapiens; identical to SEQ ID NO: 43818

SEQ ID NO: 61606 - DNA, 201 bp, Homo sapiens; identical to SEQ ID NO: 44002

SEQ ID NO: 61607 - DNA, 201 bp, Homo sapiens; identical to SEQ ID NO: 44003

SEQ ID NO: 61608 - DNA, 201 bp, Homo sapiens; identical to SEQ ID NO: 43819

SEQ ID NO: 61609 - DNA, 201 bp, Homo sapiens; identical to SEQ ID NO: 44004

SEQ ID NO: 61610 - DNA, 201 bp, Homo sapiens; identical to SEQ ID NO: 43820

SEQ ID NO: 61611 - DNA, 201 bp, Homo sapiens; identical to SEQ ID NO: 44006

SEQ ID NO: 61612 - DNA, 201 bp, Homo sapiens; identical to SEQ ID NO: 44008

SEQ ID NO: 61613 - DNA, 201 bp, Homo sapiens; identical to SEQ ID NO: 44010

SEQ ID NO: 61614 - DNA, 201 bp, Homo sapiens; identical to SEQ ID NO: 43821

SEQ ID NO: 61615 - DNA, 201 bp, Homo sapiens; identical to SEQ ID NO: 43822

SEQ ID NO: 61616 - DNA, 201 bp, Homo sapiens; identical to SEQ ID NO: 43824

SEQ ID NO: 61617 - DNA, 201 bp, Homo sapiens; identical to SEQ ID NO: 44013

SEQ ID NO: 61618 - DNA, 201 bp, Homo sapiens; identical to SEQ ID NO: 44015

SEQ ID NO: 61619 - DNA, 201 bp, Homo sapiens; identical to SEQ ID NO: 44016

SEQ ID NO: 61620 - DNA, 201 bp, Homo sapiens; identical to SEQ ID NO: 44302

SEQ ID NO: 61621 - DNA, 201 bp, Homo sapiens; identical to SEQ ID NO: 44304

SEQ ID NO: 61622 - DNA, 201 bp, Homo sapiens; identical to SEQ ID NO: 44306

SEQ ID NO: 61623 - DNA, 201 bp, Homo sapiens; identical to SEQ ID NO: 44308

SEQ ID NO: 61624 - DNA, 201 bp, Homo sapiens; identical to SEQ ID NO: 44135

SEQ ID NO: 61625 - DNA, 201 bp, Homo sapiens; identical to SEQ ID NO: 44136

SEQ ID NO: 61626 - DNA, 201 bp, Homo sapiens; identical to SEQ ID NO: 44017

SEQ ID NO: 61627 - DNA, 201 bp, Homo sapiens; identical to SEQ ID NO: 44137

SEQ ID NO: 61628 - DNA, 201 bp, Homo sapiens; identical to SEQ ID NO: 44138

SEQ ID NO: 61629 - DNA, 201 bp, Homo sapiens; identical to SEQ ID NO: 44018

SEQ ID NO: 61630 - DNA, 201 bp, Homo sapiens; identical to SEQ ID NO: 44139

SEQ ID NO: 61631 - DNA, 201 bp, Homo sapiens; identical to SEQ ID NO: 44020

SEQ ID NO: 61632 - DNA, 201 bp, Homo sapiens; identical to SEQ ID NO: 44021

SEQ ID NO: 61633 - DNA, 201 bp, Homo sapiens; identical to SEQ ID NO: 43849

SEQ ID NO: 61634 - DNA, 201 bp, Homo sapiens; identical to SEQ ID NO: 44022

SEQ ID NO: 61635 - DNA, 201 bp, Homo sapiens; identical to SEQ ID NO: 44023

SEQ ID NO: 61636 - DNA, 201 bp, Homo sapiens; identical to SEQ ID NO: 43850

SEQ ID NO: 61637 - DNA, 201 bp, Homo sapiens; identical to SEQ ID NO: 44024

SEQ ID NO: 61638 - DNA, 201 bp, Homo sapiens; identical to SEQ ID NO: 44025

SEQ ID NO: 61639 - DNA, 201 bp, Homo sapiens; identical to SEQ ID NO: 44141

SEQ ID NO: 61640 - DNA, 201 bp, Homo sapiens; identical to SEQ ID NO: 43851

SEQ ID NO: 61641 - DNA, 201 bp, Homo sapiens; identical to SEQ ID NO: 44026

SEQ ID NO: 61642 - DNA, 201 bp, Homo sapiens; identical to SEQ ID NO: 44027

SEQ ID NO: 61643 - DNA, 201 bp, Homo sapiens; identical to SEQ ID NO: 43852

SEQ ID NO: 61644 - DNA, 201 bp, Homo sapiens; identical to SEQ ID NO: 44028

SEQ ID NO: 61645 - DNA, 201 bp, Homo sapiens; identical to SEQ ID NO: 44029

SEQ ID NO: 61646 - DNA, 201 bp, Homo sapiens; identical to SEQ ID NO: 44030

SEQ ID NO: 61647 - DNA, 201 bp, Homo sapiens; identical to SEQ ID NO: 44031

SEQ ID NO: 61648 - DNA, 201 bp, Homo sapiens; identical to SEQ ID NO: 44032

SEQ ID NO: 61649 - DNA, 201 bp, Homo sapiens; identical to SEQ ID NO: 44035

SEQ ID NO: 61650 - DNA, 201 bp, Homo sapiens; identical to SEQ ID NO: 44034

SEQ ID NO: 61651 - DNA, 201 bp, Homo sapiens; identical to SEQ ID NO: 44037

SEQ ID NO: 61652 - DNA, 201 bp, Homo sapiens; identical to SEQ ID NO: 44039

SEQ ID NO: 61653 - DNA, 201 bp, Homo sapiens; identical to SEQ ID NO: 44042

SEQ ID NO: 61654 - DNA, 201 bp, Homo sapiens; identical to SEQ ID NO: 44044

SEQ ID NO: 61655 - DNA, 201 bp, Homo sapiens; identical to SEQ ID NO: 44045

SEQ ID NO: 61656 - DNA, 201 bp, Homo sapiens; identical to SEQ ID NO: 44046

SEQ ID NO: 61657 - DNA, 201 bp, Homo sapiens; identical to SEQ ID NO: 44312

SEQ ID NO: 61658 - DNA, 201 bp, Homo sapiens; identical to SEQ ID NO: 44313

SEQ ID NO: 61659 - DNA, 201 bp, Homo sapiens; identical to SEQ ID NO: 44315

SEQ ID NO: 61660 - DNA, 201 bp, Homo sapiens; identical to SEQ ID NO: 44317

SEQ ID NO: 61661 - DNA, 201 bp, Homo sapiens; identical to SEQ ID NO: 44320

SEQ ID NO: 61662 - DNA, 201 bp, Homo sapiens; identical to SEQ ID NO: 44323

SEQ ID NO: 61663 - DNA, 201 bp, Homo sapiens; identical to SEQ ID NO: 44321

SEQ ID NO: 61664 - DNA, 201 bp, Homo sapiens; identical to SEQ ID NO: 44148

SEQ ID NO: 61665 - DNA, 201 bp, Homo sapiens; identical to SEQ ID NO: 44047

SEQ ID NO: 61666 - DNA, 201 bp, Homo sapiens; identical to SEQ ID NO: 44149

SEQ ID NO: 61667 - DNA, 201 bp, Homo sapiens; identical to SEQ ID NO: 44150

SEQ ID NO: 61668 - DNA, 201 bp, Homo sapiens; identical to SEQ ID NO: 44151

SEQ ID NO: 61669 - DNA, 201 bp, Homo sapiens; identical to SEQ ID NO: 44048

SEQ ID NO: 61670 - DNA, 201 bp, Homo sapiens; identical to SEQ ID NO: 44152

SEQ ID NO: 61671 - DNA, 201 bp, Homo sapiens; identical to SEQ ID NO: 44154

SEQ ID NO: 61672 - DNA, 201 bp, Homo sapiens; identical to SEQ ID NO: 44153

SEQ ID NO: 61673 - DNA, 201 bp, Homo sapiens; identical to SEQ ID NO: 44155

SEQ ID NO: 61674 - DNA, 201 bp, Homo sapiens; identical to SEQ ID NO: 44049

SEQ ID NO: 61675 - DNA, 201 bp, Homo sapiens; identical to SEQ ID NO: 44051

SEQ ID NO: 61676 - DNA, 201 bp, Homo sapiens; identical to SEQ ID NO: 44158

SEQ ID NO: 61677 - DNA, 201 bp, Homo sapiens; identical to SEQ ID NO: 44055

SEQ ID NO: 61678 - DNA, 201 bp, Homo sapiens; identical to SEQ ID NO: 44060

SEQ ID NO: 61679 - DNA, 201 bp, Homo sapiens; identical to SEQ ID NO: 44062

SEQ ID NO: 61680 - DNA, 201 bp, Homo sapiens; identical to SEQ ID NO: 44064

SEQ ID NO: 61681 - DNA, 201 bp, Homo sapiens; identical to SEQ ID NO: 44066

SEQ ID NO: 61682 - DNA, 201 bp, Homo sapiens; identical to SEQ ID NO: 43876

SEQ ID NO: 61683 - DNA, 201 bp, Homo sapiens; identical to SEQ ID NO: 44071

SEQ ID NO: 61684 - DNA, 201 bp, Homo sapiens; identical to SEQ ID NO: 44072

SEQ ID NO: 61685 - DNA, 201 bp, Homo sapiens; identical to SEQ ID NO: 44073

SEQ ID NO: 61686 - DNA, 201 bp, Homo sapiens; identical to SEQ ID NO: 44167

SEQ ID NO: 61687 - DNA, 201 bp, Homo sapiens; identical to SEQ ID NO: 44331

SEQ ID NO: 61688 - DNA, 201 bp, Homo sapiens; identical to SEQ ID NO: 44168

SEQ ID NO: 61689 - DNA, 201 bp, Homo sapiens; identical to SEQ ID NO: 44332

SEQ ID NO: 61690 - DNA, 201 bp, Homo sapiens; identical to SEQ ID NO: 44169

SEQ ID NO: 61691 - DNA, 201 bp, Homo sapiens; identical to SEQ ID NO: 44333

SEQ ID NO: 61692 - DNA, 201 bp, Homo sapiens; identical to SEQ ID NO: 44170

SEQ ID NO: 61693 - DNA, 201 bp, Homo sapiens; identical to SEQ ID NO: 44334

SEQ ID NO: 61694 - DNA, 201 bp, Homo sapiens; identical to SEQ ID NO: 44172

SEQ ID NO: 61695 - DNA, 201 bp, Homo sapiens; identical to SEQ ID NO: 44335

SEQ ID NO: 61696 - DNA, 201 bp, Homo sapiens; identical to SEQ ID NO: 44174

SEQ ID NO: 61697 - DNA, 201 bp, Homo sapiens; identical to SEQ ID NO: 44337

SEQ ID NO: 61698 - DNA, 201 bp, Homo sapiens; identical to SEQ ID NO: 44176

SEQ ID NO: 61699 - DNA, 201 bp, Homo sapiens; identical to SEQ ID NO: 44339

SEQ ID NO: 61700 - DNA, 201 bp, Homo sapiens; identical to SEQ ID NO: 44179

SEQ ID NO: 61701 - DNA, 201 bp, Homo sapiens; identical to SEQ ID NO: 44182

SEQ ID NO: 61702 - DNA, 201 bp, Homo sapiens; identical to SEQ ID NO: 44192

SEQ ID NO: 61703 - DNA, 201 bp, Homo sapiens; identical to SEQ ID NO: 44074

SEQ ID NO: 61704 - DNA, 201 bp, Homo sapiens; identical to SEQ ID NO: 44075

SEQ ID NO: 61705 - DNA, 201 bp, Homo sapiens; identical to SEQ ID NO: 44076

SEQ ID NO: 61706 - DNA, 201 bp, Homo sapiens; identical to SEQ ID NO: 43892

SEQ ID NO: 61707 - DNA, 201 bp, Homo sapiens; identical to SEQ ID NO: 43893

SEQ ID NO: 61708 - DNA, 201 bp, Homo sapiens; identical to SEQ ID NO: 43896

SEQ ID NO: 61709 - DNA, 201 bp, Homo sapiens; identical to SEQ ID NO: 44343

SEQ ID NO: 61710 - DNA, 201 bp, Homo sapiens; identical to SEQ ID NO: 44196

SEQ ID NO: 61711 - DNA, 201 bp, Homo sapiens; identical to SEQ ID NO: 44344

SEQ ID NO: 61712 - DNA, 201 bp, Homo sapiens; identical to SEQ ID NO: 44197

SEQ ID NO: 61713 - DNA, 201 bp, Homo sapiens; identical to SEQ ID NO: 44345

SEQ ID NO: 61714 - DNA, 201 bp, Homo sapiens; identical to SEQ ID NO: 44078

SEQ ID NO: 61715 - DNA, 201 bp, Homo sapiens; identical to SEQ ID NO: 44198

SEQ ID NO: 61716 - DNA, 201 bp, Homo sapiens; identical to SEQ ID NO: 44346

SEQ ID NO: 61717 - DNA, 201 bp, Homo sapiens; identical to SEQ ID NO: 43912

SEQ ID NO: 61718 - DNA, 201 bp, Homo sapiens; identical to SEQ ID NO: 44347

SEQ ID NO: 61719 - DNA, 201 bp, Homo sapiens; identical to SEQ ID NO: 44348

SEQ ID NO: 61720 - DNA, 201 bp, Homo sapiens; identical to SEQ ID NO: 44200

SEQ ID NO: 61721 - DNA, 201 bp, Homo sapiens; identical to SEQ ID NO: 44349

SEQ ID NO: 61722 - DNA, 201 bp, Homo sapiens; identical to SEQ ID NO: 44201

SEQ ID NO: 61723 - DNA, 201 bp, Homo sapiens; identical to SEQ ID NO: 44350

SEQ ID NO: 61724 - DNA, 201 bp, Homo sapiens; identical to SEQ ID NO: 44351

SEQ ID NO: 61725 - DNA, 201 bp, Homo sapiens; identical to SEQ ID NO: 44212

SEQ ID NO: 61726 - DNA, 201 bp, Homo sapiens; identical to SEQ ID NO: 44213

SEQ ID NO: 61727 - DNA, 201 bp, Homo sapiens; identical to SEQ ID NO: 44081

SEQ ID NO: 61728 - DNA, 201 bp, Homo sapiens; identical to SEQ ID NO: 44082

SEQ ID NO: 61729 - DNA, 201 bp, Homo sapiens; identical to SEQ ID NO: 44083

SEQ ID NO: 61730 - DNA, 201 bp, Homo sapiens; identical to SEQ ID NO: 44352

SEQ ID NO: 61731 - DNA, 201 bp, Homo sapiens; identical to SEQ ID NO: 43931

SEQ ID NO: 61732 - DNA, 201 bp, Homo sapiens; identical to SEQ ID NO: 44355

SEQ ID NO: 61733 - DNA, 201 bp, Homo sapiens; identical to SEQ ID NO: 43933

SEQ ID NO: 61734 - DNA, 201 bp, Homo sapiens; identical to SEQ ID NO: 44356

SEQ ID NO: 61735 - DNA, 201 bp, Homo sapiens; identical to SEQ ID NO: 43935

SEQ ID NO: 61736 - DNA, 201 bp, Homo sapiens; identical to SEQ ID NO: 43936

SEQ ID NO: 61737 - DNA, 201 bp, Homo sapiens; identical to SEQ ID NO: 44219

SEQ ID NO: 61738 - DNA, 201 bp, Homo sapiens; identical to SEQ ID NO: 44357

SEQ ID NO: 61739 - DNA, 201 bp, Homo sapiens; identical to SEQ ID NO: 44220

SEQ ID NO: 61740 - DNA, 201 bp, Homo sapiens; identical to SEQ ID NO: 44358

SEQ ID NO: 61741 - DNA, 201 bp, Homo sapiens; identical to SEQ ID NO: 44359

SEQ ID NO: 61742 - DNA, 201 bp, Homo sapiens; identical to SEQ ID NO: 44223

SEQ ID NO: 61743 - DNA, 201 bp, Homo sapiens; identical to SEQ ID NO: 44225

SEQ ID NO: 61744 - DNA, 201 bp, Homo sapiens; identical to SEQ ID NO: 44228

SEQ ID NO: 61745 - DNA, 201 bp, Homo sapiens; identical to SEQ ID NO: 44090

SEQ ID NO: 61746 - DNA, 201 bp, Homo sapiens; identical to SEQ ID NO: 44093

SEQ ID NO: 61747 - DNA, 201 bp, Homo sapiens; identical to SEQ ID NO: 44095

SEQ ID NO: 61748 - DNA, 201 bp, Homo sapiens; identical to SEQ ID NO: 44239

SEQ ID NO: 61749 - DNA, 201 bp, Homo sapiens; identical to SEQ ID NO: 44240

SEQ ID NO: 61750 - DNA, 201 bp, Homo sapiens; identical to SEQ ID NO: 43955

SEQ ID NO: 61751 - DNA, 201 bp, Homo sapiens; identical to SEQ ID NO: 44366

SEQ ID NO: 61752 - DNA, 201 bp, Homo sapiens; identical to SEQ ID NO: 39884

SEQ ID NO: 61753 - DNA, 201 bp, Homo sapiens; identical to SEQ ID NO: 41102

SEQ ID NO: 61754 - DNA, 201 bp, Homo sapiens; identical to SEQ ID NO: 39625

SEQ ID NO: 61755 - DNA, 201 bp, Homo sapiens; identical to SEQ ID NO: 41827

SEQ ID NO: 61756 - DNA, 201 bp, Homo sapiens; identical to SEQ ID NO: 39630

SEQ ID NO: 61757 - DNA, 201 bp, Homo sapiens; identical to SEQ ID NO: 38503

SEQ ID NO: 61758 - DNA, 201 bp, Homo sapiens; identical to SEQ ID NO: 40327

SEQ ID NO: 61759 - DNA, 201 bp, Homo sapiens; identical to SEQ ID NO: 40328

SEQ ID NO: 61760 - DNA, 201 bp, Homo sapiens; identical to SEQ ID NO: 38077

SEQ ID NO: 61761 - DNA, 201 bp, Homo sapiens; identical to SEQ ID NO: 41931

SEQ ID NO: 61762 - DNA, 201 bp, Homo sapiens; identical to SEQ ID NO: 40329

SEQ ID NO: 61763 - DNA, 201 bp, Homo sapiens; identical to SEQ ID NO: 38641

SEQ ID NO: 61764 - DNA, 201 bp, Homo sapiens; identical to SEQ ID NO: 42723

SEQ ID NO: 61765 - DNA, 201 bp, Homo sapiens; identical to SEQ ID NO: 38642

SEQ ID NO: 61766 - DNA, 201 bp, Homo sapiens; identical to SEQ ID NO: 39108

SEQ ID NO: 61767 - DNA, 201 bp, Homo sapiens; identical to SEQ ID NO: 38643

SEQ ID NO: 61768 - DNA, 201 bp, Homo sapiens; identical to SEQ ID NO: 38644

SEQ ID NO: 61769 - DNA, 201 bp, Homo sapiens; identical to SEQ ID NO: 38645

SEQ ID NO: 61770 - DNA, 201 bp, Homo sapiens; identical to SEQ ID NO: 42924

SEQ ID NO: 61771 - DNA, 201 bp, Homo sapiens; identical to SEQ ID NO: 38646

SEQ ID NO: 61772 - DNA, 201 bp, Homo sapiens; identical to SEQ ID NO: 41939

SEQ ID NO: 61773 - DNA, 201 bp, Homo sapiens; identical to SEQ ID NO: 38647

SEQ ID NO: 61774 - DNA, 201 bp, Homo sapiens; identical to SEQ ID NO: 41942

SEQ ID NO: 61775 - DNA, 201 bp, Homo sapiens; identical to SEQ ID NO: 38651

SEQ ID NO: 61776 - DNA, 201 bp, Homo sapiens; identical to SEQ ID NO: 39959

SEQ ID NO: 61777 - DNA, 201 bp, Homo sapiens; identical to SEQ ID NO: 39478

SEQ ID NO: 61778 - DNA, 201 bp, Homo sapiens; identical to SEQ ID NO: 40346

SEQ ID NO: 61779 - DNA, 201 bp, Homo sapiens; identical to SEQ ID NO: 39961

SEQ ID NO: 61780 - DNA, 201 bp, Homo sapiens; identical to SEQ ID NO: 39962

SEQ ID NO: 61781 - DNA, 201 bp, Homo sapiens; identical to SEQ ID NO: 39963

SEQ ID NO: 61782 - DNA, 201 bp, Homo sapiens; identical to SEQ ID NO: 39905

SEQ ID NO: 61783 - DNA, 201 bp, Homo sapiens; identical to SEQ ID NO: 41851

SEQ ID NO: 61784 - DNA, 201 bp, Homo sapiens; identical to SEQ ID NO: 41853

SEQ ID NO: 61785 - DNA, 201 bp, Homo sapiens; identical to SEQ ID NO: 40840

SEQ ID NO: 61786 - DNA, 201 bp, Homo sapiens; identical to SEQ ID NO: 42166

SEQ ID NO: 61787 - DNA, 201 bp, Homo sapiens; identical to SEQ ID NO: 40842

SEQ ID NO: 61788 - DNA, 201 bp, Homo sapiens; identical to SEQ ID NO: 42167

SEQ ID NO: 61789 - DNA, 201 bp, Homo sapiens; identical to SEQ ID NO: 42395

SEQ ID NO: 61790 - DNA, 201 bp, Homo sapiens; identical to SEQ ID NO: 39218

SEQ ID NO: 61791 - DNA, 201 bp, Homo sapiens; identical to SEQ ID NO: 38526

SEQ ID NO: 61792 - DNA, 201 bp, Homo sapiens; identical to SEQ ID NO: 38530

SEQ ID NO: 61793 - DNA, 201 bp, Homo sapiens; identical to SEQ ID NO: 38535

SEQ ID NO: 61794 - DNA, 201 bp, Homo sapiens; identical to SEQ ID NO: 41295

SEQ ID NO: 61795 - DNA, 201 bp, Homo sapiens; identical to SEQ ID NO: 38536

SEQ ID NO: 61796 - DNA, 201 bp, Homo sapiens; identical to SEQ ID NO: 42748

SEQ ID NO: 61797 - DNA, 201 bp, Homo sapiens; identical to SEQ ID NO: 38244

SEQ ID NO: 61798 - DNA, 201 bp, Homo sapiens; identical to SEQ ID NO: 42749

SEQ ID NO: 61799 - DNA, 201 bp, Homo sapiens; identical to SEQ ID NO: 39979

SEQ ID NO: 61800 - DNA, 201 bp, Homo sapiens; identical to SEQ ID NO: 38691

SEQ ID NO: 61801 - DNA, 201 bp, Homo sapiens; identical to SEQ ID NO: 38692

SEQ ID NO: 61802 - DNA, 201 bp, Homo sapiens; identical to SEQ ID NO: 38693

SEQ ID NO: 61803 - DNA, 201 bp, Homo sapiens; identical to SEQ ID NO: 43045

SEQ ID NO: 61804 - DNA, 201 bp, Homo sapiens; identical to SEQ ID NO: 40390

SEQ ID NO: 61805 - DNA, 201 bp, Homo sapiens; identical to SEQ ID NO: 39819

SEQ ID NO: 61806 - DNA, 201 bp, Homo sapiens; identical to SEQ ID NO: 38340

SEQ ID NO: 61807 - DNA, 201 bp, Homo sapiens; identical to SEQ ID NO: 39820

SEQ ID NO: 61808 - DNA, 201 bp, Homo sapiens; identical to SEQ ID NO: 39821

SEQ ID NO: 61809 - DNA, 201 bp, Homo sapiens; identical to SEQ ID NO: 41683

SEQ ID NO: 61810 - DNA, 201 bp, Homo sapiens; identical to SEQ ID NO: 39912

SEQ ID NO: 61811 - DNA, 201 bp, Homo sapiens; identical to SEQ ID NO: 38557

SEQ ID NO: 61812 - DNA, 201 bp, Homo sapiens; identical to SEQ ID NO: 43292

SEQ ID NO: 61813 - DNA, 201 bp, Homo sapiens; identical to SEQ ID NO: 43294

SEQ ID NO: 61814 - DNA, 201 bp, Homo sapiens; identical to SEQ ID NO: 38560

SEQ ID NO: 61815 - DNA, 201 bp, Homo sapiens; identical to SEQ ID NO: 42660

SEQ ID NO: 61816 - DNA, 201 bp, Homo sapiens; identical to SEQ ID NO: 38562

SEQ ID NO: 61817 - DNA, 201 bp, Homo sapiens; identical to SEQ ID NO: 42663

SEQ ID NO: 61818 - DNA, 201 bp, Homo sapiens; identical to SEQ ID NO: 42666

SEQ ID NO: 61819 - DNA, 201 bp, Homo sapiens; identical to SEQ ID NO: 42776

SEQ ID NO: 61820 - DNA, 201 bp, Homo sapiens; identical to SEQ ID NO: 38727

SEQ ID NO: 61821 - DNA, 201 bp, Homo sapiens; identical to SEQ ID NO: 42778

SEQ ID NO: 61822 - DNA, 201 bp, Homo sapiens; identical to SEQ ID NO: 42780

SEQ ID NO: 61823 - DNA, 201 bp, Homo sapiens; identical to SEQ ID NO: 42206

SEQ ID NO: 61824 - DNA, 201 bp, Homo sapiens; identical to SEQ ID NO: 38733

SEQ ID NO: 61825 - DNA, 201 bp, Homo sapiens; identical to SEQ ID NO: 42782

SEQ ID NO: 61826 - DNA, 201 bp, Homo sapiens; identical to SEQ ID NO: 42207

SEQ ID NO: 61827 - DNA, 201 bp, Homo sapiens; identical to SEQ ID NO: 39270

SEQ ID NO: 61828 - DNA, 201 bp, Homo sapiens; identical to SEQ ID NO: 42208

SEQ ID NO: 61829 - DNA, 201 bp, Homo sapiens; identical to SEQ ID NO: 42787

SEQ ID NO: 61830 - DNA, 201 bp, Homo sapiens; identical to SEQ ID NO: 43303

SEQ ID NO: 61831 - DNA, 201 bp, Homo sapiens; identical to SEQ ID NO: 42790

SEQ ID NO: 61832 - DNA, 201 bp, Homo sapiens; identical to SEQ ID NO: 39851

SEQ ID NO: 61833 - DNA, 201 bp, Homo sapiens; identical to SEQ ID NO: 39558

SEQ ID NO: 61834 - DNA, 201 bp, Homo sapiens; identical to SEQ ID NO: 39420

SEQ ID NO: 61835 - DNA, 201 bp, Homo sapiens; identical to SEQ ID NO: 39853

SEQ ID NO: 61836 - DNA, 201 bp, Homo sapiens; identical to SEQ ID NO: 39424

SEQ ID NO: 61837 - DNA, 201 bp, Homo sapiens; identical to SEQ ID NO: 39854

SEQ ID NO: 61838 - DNA, 201 bp, Homo sapiens; identical to SEQ ID NO: 42354

SEQ ID NO: 61839 - DNA, 201 bp, Homo sapiens; identical to SEQ ID NO: 39855

SEQ ID NO: 61840 - DNA, 201 bp, Homo sapiens; identical to SEQ ID NO: 41806

SEQ ID NO: 61841 - DNA, 201 bp, Homo sapiens; identical to SEQ ID NO: 43015

SEQ ID NO: 61842 - DNA, 201 bp, Homo sapiens; identical to SEQ ID NO: 42574

SEQ ID NO: 61843 - DNA, 201 bp, Homo sapiens; identical to SEQ ID NO: 39288

SEQ ID NO: 61844 - DNA, 201 bp, Homo sapiens; identical to SEQ ID NO: 38055

SEQ ID NO: 61845 - DNA, 201 bp, Homo sapiens; identical to SEQ ID NO: 42690

SEQ ID NO: 61846 - DNA, 201 bp, Homo sapiens; identical to SEQ ID NO: 42442

SEQ ID NO: 61847 - DNA, 201 bp, Homo sapiens; identical to SEQ ID NO: 38373

SEQ ID NO: 61848 - DNA, 201 bp, Homo sapiens; identical to SEQ ID NO: 42691

SEQ ID NO: 61849 - DNA, 201 bp, Homo sapiens; identical to SEQ ID NO: 42692

SEQ ID NO: 61850 - DNA, 201 bp, Homo sapiens; identical to SEQ ID NO: 42694

SEQ ID NO: 61851 - DNA, 201 bp, Homo sapiens; identical to SEQ ID NO: 38609

SEQ ID NO: 61852 - DNA, 201 bp, Homo sapiens; identical to SEQ ID NO: 43062

SEQ ID NO: 61853 - DNA, 201 bp, Homo sapiens; identical to SEQ ID NO: 38610

SEQ ID NO: 61854 - DNA, 201 bp, Homo sapiens; identical to SEQ ID NO: 43063

SEQ ID NO: 61855 - DNA, 201 bp, Homo sapiens; identical to SEQ ID NO: 38613

SEQ ID NO: 61856 - DNA, 201 bp, Homo sapiens; identical to SEQ ID NO: 42698

SEQ ID NO: 61857 - DNA, 201 bp, Homo sapiens; identical to SEQ ID NO: 38615

SEQ ID NO: 61858 - DNA, 201 bp, Homo sapiens; identical to SEQ ID NO: 42826

SEQ ID NO: 61859 - DNA, 201 bp, Homo sapiens; identical to SEQ ID NO: 38616

SEQ ID NO: 61860 - DNA, 201 bp, Homo sapiens; identical to SEQ ID NO: 38617

SEQ ID NO: 61861 - DNA, 201 bp, Homo sapiens; identical to SEQ ID NO: 42829

SEQ ID NO: 61862 - DNA, 201 bp, Homo sapiens; identical to SEQ ID NO: 42831

SEQ ID NO: 61863 - DNA, 201 bp, Homo sapiens; identical to SEQ ID NO: 42834

SEQ ID NO: 61864 - DNA, 201 bp, Homo sapiens; identical to SEQ ID NO: 42217

SEQ ID NO: 61865 - DNA, 201 bp, Homo sapiens; identical to SEQ ID NO: 38988

SEQ ID NO: 61866 - DNA, 201 bp, Homo sapiens; identical to SEQ ID NO: 41744

SEQ ID NO: 61867 - DNA, 201 bp, Homo sapiens; identical to SEQ ID NO: 39883

SEQ ID NO: 61868 - DNA, 201 bp, Homo sapiens; identical to SEQ ID NO: 42561

SEQ ID NO: 61869 - DNA, 201 bp, Homo sapiens
ctagaggggccatcaggcggaagaagagggatggggacaggtgtgggagtccggatggggttggattttctttgctttgggccagagaagatgctagggtkaggcttggagatggagtaggaagagaagttagaataggggtgaggttggagttggggttataggtggggattgcgttgtttgaggtggataatgtgatag

SEQ ID NO: 61870 - DNA, 201 bp, Homo sapiens
actgccaaagccggtatgaaggcaggggctcagggtcctgagggagcctggttcggggggaagagctcctagatttgggggaagacggaggcagacgccasaactcctgggttctgaaagacgaggaggccggatgtcaagcccctgggttaggaaggagtgtgtgtttcaaagccttcgatctctgaaggaggaaggaga

SEQ ID NO: 61871 - DNA, 201 bp, Homo sapiens
ctccccacactgggtgctgtctgcggcccactgccaaagccggtatgaaggcaggggctcagggtcctgagggagcctggttcggggggaagagctcctakatttgggggaagacggaggcagacgccagaactcctgggttctgaaagacgaggaggccggatgtcaagcccctgggttaggaaggagtgtgtgtttcaa

SEQ ID NO: 61872 - DNA, 201 bp, Homo sapiens
gattttgagatgggcatgggtttgatttgattttgaatggtgaggatgtgggctgagttggatttaacttagtacagttgcactggagttgcatgggggtragattggatataggttgggtgagttgtattgagctgtgttgaattggggttggggttggggttgggttggctctgtttgggataaactgggctgtattga

SEQ ID NO: 61873 - DNA, 201 bp, Homo sapiens
ctacgagcgtggacgctttaactgtggcgcttccctcatctccccacactgggtgctgtctgcggcccactgccaaagccggtatgaaggcaggggctcarggtcctgagggagcctggttcggggggaagagctcctagatttgggggaagacggaggcagacgccagaactcctgggttctgaaagacgaggaggccgg

SEQ ID NO: 61874 - DNA, 201 bp, Homo sapiens
tgcacacacacacatacacattcctacctcatccttacaacaatcttcattttacagatgaggaaacagaggcacagacaggtcgaataacttactcaaartttcacagctagtacattcgaacccaggcttaaggacccatctttgtccagaccctgtatgcaagtgtctgtgacactggatgccaagactcacactaga

SEQ ID NO: 61875 - DNA, 201 bp, Homo sapiens
agggtcgggagacctcgggttgcccactctttgatctttctgtcctctacttgcgggtaaccactggcccgcactccactggcgggaaaaccactcgcccscacagcttcatgagagtgcgcctgggagagcacaacctgcgcaagcgcgatggcccagagcaactacggaccacgtctcgggtcattccacacccgcgct

SEQ ID NO: 61876 - DNA, 201 bp, Homo sapiens
ttgcccagtggagaggggtcctggtcctgtgaccttgaatgtctctaatcatgtccttaagcataatgccattctgtgtgtgtgtgtgtgtgtgtgtgtgkacatgcacgtgtgcagtgggtatacaaggccctgtatgttcacatcctctccacatgcatgagccagatccccatatgtgaaacccaatcagtgactcca

SEQ ID NO: 61877 - DNA, 201 bp, Homo sapiens
tgtgacactggatgccaagactcacactagagatgttgaatttaggtctgaacaatatccaattctgtgtgtgtgtttgtgtgtgcatgtgtgtgtgtgttgtattcatgtcttaaccatccatattcatatacacatatgaacatctgtgctgtgattcttttttttttttttttttttttttgagatggagtttcactc

SEQ ID NO: 61878 - DNA, 201 bp, Homo sapiens
ccaagaaattaattgtaacctgatgcctctcttctggagaaattggggggtggactttcattaacgttctgccacaaatgaccctcactcctgggggcccytgagacccccacgcctccagcctcccctccggctctctctgtgcactcacctacctgcctcgcgcctgcctgctgcgcccagctggggcctccaccttcc

SEQ ID NO: 61879 - DNA, 201 bp, Homo sapiens
aggcagaagcataagcctggcccaggtagtgccccttcaggtgtgcaagccaggcacggtgcttagagcttacatacaacgtctatgtgtggtgggcaccmccgacctcatttgacaagggaaggggctgtggctcagagggacggccacaacatcaaggtcaccttgggtgtcaggcaaactccagattgaactcagctg

SEQ ID NO: 61880 - DNA, 201 bp, Homo sapiens
agtcccacacctgccactccctgtctcttacagggtctttgaggggattaaatgtggttgtgtgtgaggcagaagcataagcctggcccaggtagtgcccyttcaggtgtgcaagccaggcacggtgcttagagcttacatacaacgtctatgtgtggtgggcaccaccgacctcatttgacaagggaaggggctgtggct

SEQ ID NO: 61881 - DNA, 201 bp, Homo sapiens
atgactggtttcaagtgaccacctgtctgaacctgtatccagtgcccctgtctccacccccaaccacagaggacttcttgccctctggtctgttccccttsctctctctcccagagtcttatagcaaatggggtgggggctagagttctggagaaaacaggcagcggttgtaaataaacaacagggcaggcggagcatggt

SEQ ID NO: 61882 - DNA, 201 bp, Homo sapiens
ctgagctgagtcctggggcaaccgcttccttgctgtgtgtccttgagggaactgcttcacctctctgggcttcgaatgccttctctataagacagcacccrcttgagacaataacagtgaggtctcaatagcataacagaggtaatatacatagcaagcattagacaagtgctgagaggccaacagcacagacagactcca

SEQ ID NO: 61883 - DNA, 201 bp, Homo sapiens
ctggccaaccttgactatttattataggtaattctgtgcagatgtctgacttatgttggccatctccaggatggacctgaactttcacacgtatgtccctrtgactaaatccaggtgtcatttgcaaaaaacaactaatattattaagtagctaccagggctaggtatcactcaccatacatacacacatgcacacacaca

SEQ ID NO: 61884 - DNA, 201 bp, Homo sapiens
cagtgaggtctcaatagcataacagaggtaatatacatagcaagcattagacaagtgctgagaggccaacagcacagacagactccagcttgagtcccacrcctgccactccctgtctcttacagggtctttgaggggattaaatgtggttgtgtgtgaggcagaagcataagcctggcccaggtagtgccccttcaggtg

SEQ ID NO: 61885 - DNA, 201 bp, Homo sapiens
agactccagcttgagtcccacacctgccactccctgtctcttacagggtctttgaggggattaaatgtggttgtgtgtgaggcagaagcataagcctggcycaggtagtgccccttcaggtgtgcaagccaggcacggtgcttagagcttacatacaacgtctatgtgtggtgggcaccaccgacctcatttgacaaggga

SEQ ID NO: 61886 - DNA, 201 bp, Homo sapiens; identical to SEQ ID NO: 45806

SEQ ID NO: 61887 - DNA, 201 bp, Homo sapiens
ggggattaaatgtggttgtgtgtgaggcagaagcataagcctggcccaggtagtgccccttcaggtgtgcaagccaggcacggtgcttagagcttacatacaacgtctatgtgtggtgggcaccaccgacctcatttgacaagggaaggggctgtggctcagagggacggccacaacatcaaggtcaccttgggtgtcagg

SEQ ID NO: 61888 - DNA, 201 bp, Homo sapiens
tctggcttggactggccaggtgcagcctcggtgcccagctgttcagcccgtaccctccgcccttcggaggacgacctcacccttcctttgttaagcccctygtccaccacatccgcattcccctggtctcacgggggcctttggcccagttcctgactgtgatggggagagtgtgggcatttggtctggctgtgcaaatcc

SEQ ID NO: 61889 - DNA, 201 bp, Homo sapiens
tgaaacccaatcagtgactccacagatctggcttgggggctgatctagagatggataaatatgtcctgccctggctgcctctggcttcagctgcatgtctytgaccttgaatgcccagccccgtgtctgggtgctgccccagacagcaagtccacatctgagtgttggccttctgggttggtgtctgcagctctaactcta

SEQ ID NO: 61890 - DNA, 201 bp, Homo sapiens; identical to SEQ ID NO: 43334

SEQ ID NO: 61891 - DNA, 201 bp, Homo sapiens; identical to SEQ ID NO: 42596

SEQ ID NO: 61892 - DNA, 201 bp, Homo sapiens; identical to SEQ ID NO: 43336

SEQ ID NO: 61893 - DNA, 201 bp, Homo sapiens; identical to SEQ ID NO: 42598

SEQ ID NO: 61894 - DNA, 201 bp, Homo sapiens; identical to SEQ ID NO: 38499

SEQ ID NO: 61895 - DNA, 201 bp, Homo sapiens; identical to SEQ ID NO: 42600

SEQ ID NO: 61896 - DNA, 201 bp, Homo sapiens; identical to SEQ ID NO: 38500

SEQ ID NO: 61897 - DNA, 201 bp, Homo sapiens; identical to SEQ ID NO: 42601

SEQ ID NO: 61898 - DNA, 201 bp, Homo sapiens; identical to SEQ ID NO: 38501

SEQ ID NO: 61899 - DNA, 201 bp, Homo sapiens; identical to SEQ ID NO: 38505

SEQ ID NO: 61900 - DNA, 201 bp, Homo sapiens; identical to SEQ ID NO: 41394

SEQ ID NO: 61901 - DNA, 201 bp, Homo sapiens; identical to SEQ ID NO: 38506

SEQ ID NO: 61902 - DNA, 201 bp, Homo sapiens; identical to SEQ ID NO: 38507

SEQ ID NO: 61903 - DNA, 201 bp, Homo sapiens; identical to SEQ ID NO: 38508

SEQ ID NO: 61904 - DNA, 201 bp, Homo sapiens; identical to SEQ ID NO: 38509

SEQ ID NO: 61905 - DNA, 201 bp, Homo sapiens; identical to SEQ ID NO: 38510

SEQ ID NO: 61906 - DNA, 201 bp, Homo sapiens; identical to SEQ ID NO: 42610

SEQ ID NO: 61907 - DNA, 201 bp, Homo sapiens; identical to SEQ ID NO: 42612

SEQ ID NO: 61908 - DNA, 201 bp, Homo sapiens; identical to SEQ ID NO: 42614

SEQ ID NO: 61909 - DNA, 201 bp, Homo sapiens; identical to SEQ ID NO: 42616

SEQ ID NO: 61910 - DNA, 201 bp, Homo sapiens; identical to SEQ ID NO: 42618

SEQ ID NO: 61911 - DNA, 201 bp, Homo sapiens; identical to SEQ ID NO: 40737

SEQ ID NO: 61912 - DNA, 201 bp, Homo sapiens; identical to SEQ ID NO: 43350

SEQ ID NO: 61913 - DNA, 201 bp, Homo sapiens; identical to SEQ ID NO: 42619

SEQ ID NO: 61914 - DNA, 201 bp, Homo sapiens; identical to SEQ ID NO: 42621

SEQ ID NO: 61915 - DNA, 201 bp, Homo sapiens; identical to SEQ ID NO: 43120

SEQ ID NO: 61916 - DNA, 201 bp, Homo sapiens; identical to SEQ ID NO: 42622

SEQ ID NO: 61917 - DNA, 201 bp, Homo sapiens; identical to SEQ ID NO: 41614

SEQ ID NO: 61918 - DNA, 201 bp, Homo sapiens; identical to SEQ ID NO: 40342

SEQ ID NO: 61919 - DNA, 201 bp, Homo sapiens; identical to SEQ ID NO: 40344

SEQ ID NO: 61920 - DNA, 201 bp, Homo sapiens; identical to SEQ ID NO: 41410

SEQ ID NO: 61921 - DNA, 201 bp, Homo sapiens; identical to SEQ ID NO: 41615

SEQ ID NO: 61922 - DNA, 201 bp, Homo sapiens; identical to SEQ ID NO: 41412

SEQ ID NO: 61923 - DNA, 201 bp, Homo sapiens; identical to SEQ ID NO: 41616

SEQ ID NO: 61924 - DNA, 201 bp, Homo sapiens; identical to SEQ ID NO: 41617

SEQ ID NO: 61925 - DNA, 201 bp, Homo sapiens; identical to SEQ ID NO: 42627

SEQ ID NO: 61926 - DNA, 201 bp, Homo sapiens; identical to SEQ ID NO: 40347

SEQ ID NO: 61927 - DNA, 201 bp, Homo sapiens; identical to SEQ ID NO: 38525

SEQ ID NO: 61928 - DNA, 201 bp, Homo sapiens; identical to SEQ ID NO: 38528

SEQ ID NO: 61929 - DNA, 201 bp, Homo sapiens; identical to SEQ ID NO: 38532

SEQ ID NO: 61930 - DNA, 201 bp, Homo sapiens; identical to SEQ ID NO: 38533

SEQ ID NO: 61931 - DNA, 201 bp, Homo sapiens; identical to SEQ ID NO: 40377

SEQ ID NO: 61932 - DNA, 201 bp, Homo sapiens; identical to SEQ ID NO: 38534

SEQ ID NO: 61933 - DNA, 201 bp, Homo sapiens; identical to SEQ ID NO: 38537

SEQ ID NO: 61934 - DNA, 201 bp, Homo sapiens; identical to SEQ ID NO: 42636

SEQ ID NO: 61935 - DNA, 201 bp, Homo sapiens; identical to SEQ ID NO: 42638

SEQ ID NO: 61936 - DNA, 201 bp, Homo sapiens; identical to SEQ ID NO: 42644

SEQ ID NO: 61937 - DNA, 201 bp, Homo sapiens; identical to SEQ ID NO: 42026

SEQ ID NO: 61938 - DNA, 201 bp, Homo sapiens; identical to SEQ ID NO: 42646

SEQ ID NO: 61939 - DNA, 201 bp, Homo sapiens; identical to SEQ ID NO: 41630

SEQ ID NO: 61940 - DNA, 201 bp, Homo sapiens; identical to SEQ ID NO: 42649

SEQ ID NO: 61941 - DNA, 201 bp, Homo sapiens; identical to SEQ ID NO: 43132

SEQ ID NO: 61942 - DNA, 201 bp, Homo sapiens; identical to SEQ ID NO: 41631

SEQ ID NO: 61943 - DNA, 201 bp, Homo sapiens; identical to SEQ ID NO: 42651

SEQ ID NO: 61944 - DNA, 201 bp, Homo sapiens; identical to SEQ ID NO: 43133

SEQ ID NO: 61945 - DNA, 201 bp, Homo sapiens; identical to SEQ ID NO: 41633

SEQ ID NO: 61946 - DNA, 201 bp, Homo sapiens; identical to SEQ ID NO: 42652

SEQ ID NO: 61947 - DNA, 201 bp, Homo sapiens; identical to SEQ ID NO: 41634

SEQ ID NO: 61948 - DNA, 201 bp, Homo sapiens; identical to SEQ ID NO: 41636

SEQ ID NO: 61949 - DNA, 201 bp, Homo sapiens; identical to SEQ ID NO: 41637

SEQ ID NO: 61950 - DNA, 201 bp, Homo sapiens; identical to SEQ ID NO: 41638

SEQ ID NO: 61951 - DNA, 201 bp, Homo sapiens; identical to SEQ ID NO: 41640

SEQ ID NO: 61952 - DNA, 201 bp, Homo sapiens; identical to SEQ ID NO: 41725

SEQ ID NO: 61953 - DNA, 201 bp, Homo sapiens; identical to SEQ ID NO: 43389

SEQ ID NO: 61954 - DNA, 201 bp, Homo sapiens; identical to SEQ ID NO: 41461

SEQ ID NO: 61955 - DNA, 201 bp, Homo sapiens; identical to SEQ ID NO: 38553

SEQ ID NO: 61956 - DNA, 201 bp, Homo sapiens; identical to SEQ ID NO: 41463

SEQ ID NO: 61957 - DNA, 201 bp, Homo sapiens; identical to SEQ ID NO: 38554

SEQ ID NO: 61958 - DNA, 201 bp, Homo sapiens; identical to SEQ ID NO: 41727

SEQ ID NO: 61959 - DNA, 201 bp, Homo sapiens; identical to SEQ ID NO: 38555

SEQ ID NO: 61960 - DNA, 201 bp, Homo sapiens; identical to SEQ ID NO: 41466

SEQ ID NO: 61961 - DNA, 201 bp, Homo sapiens; identical to SEQ ID NO: 41469

SEQ ID NO: 61962 - DNA, 201 bp, Homo sapiens; identical to SEQ ID NO: 38559

SEQ ID NO: 61963 - DNA, 201 bp, Homo sapiens; identical to SEQ ID NO: 38563

SEQ ID NO: 61964 - DNA, 201 bp, Homo sapiens; identical to SEQ ID NO: 38564

SEQ ID NO: 61965 - DNA, 201 bp, Homo sapiens; identical to SEQ ID NO: 40780

SEQ ID NO: 61966 - DNA, 201 bp, Homo sapiens; identical to SEQ ID NO: 38565

SEQ ID NO: 61967 - DNA, 201 bp, Homo sapiens; identical to SEQ ID NO: 42668

SEQ ID NO: 61968 - DNA, 201 bp, Homo sapiens; identical to SEQ ID NO: 42670

SEQ ID NO: 61969 - DNA, 201 bp, Homo sapiens; identical to SEQ ID NO: 42672

SEQ ID NO: 61970 - DNA, 201 bp, Homo sapiens; identical to SEQ ID NO: 42675

SEQ ID NO: 61971 - DNA, 201 bp, Homo sapiens; identical to SEQ ID NO: 42677

SEQ ID NO: 61972 - DNA, 201 bp, Homo sapiens; identical to SEQ ID NO: 42683

SEQ ID NO: 61973 - DNA, 201 bp, Homo sapiens; identical to SEQ ID NO: 42685

SEQ ID NO: 61974 - DNA, 201 bp, Homo sapiens; identical to SEQ ID NO: 42686

SEQ ID NO: 61975 - DNA, 201 bp, Homo sapiens; identical to SEQ ID NO: 42688

SEQ ID NO: 61976 - DNA, 201 bp, Homo sapiens; identical to SEQ ID NO: 40470

SEQ ID NO: 61977 - DNA, 201 bp, Homo sapiens; identical to SEQ ID NO: 42040

SEQ ID NO: 61978 - DNA, 201 bp, Homo sapiens; identical to SEQ ID NO: 42041

SEQ ID NO: 61979 - DNA, 201 bp, Homo sapiens; identical to SEQ ID NO: 42043

SEQ ID NO: 61980 - DNA, 201 bp, Homo sapiens; identical to SEQ ID NO: 42044

SEQ ID NO: 61981 - DNA, 201 bp, Homo sapiens; identical to SEQ ID NO: 38602

SEQ ID NO: 61982 - DNA, 201 bp, Homo sapiens; identical to SEQ ID NO: 38603

SEQ ID NO: 61983 - DNA, 201 bp, Homo sapiens; identical to SEQ ID NO: 38604

SEQ ID NO: 61984 - DNA, 201 bp, Homo sapiens; identical to SEQ ID NO: 42046

SEQ ID NO: 61985 - DNA, 201 bp, Homo sapiens; identical to SEQ ID NO: 40807

SEQ ID NO: 61986 - DNA, 201 bp, Homo sapiens; identical to SEQ ID NO: 43426

SEQ ID NO: 61987 - DNA, 201 bp, Homo sapiens; identical to SEQ ID NO: 40809

SEQ ID NO: 61988 - DNA, 201 bp, Homo sapiens; identical to SEQ ID NO: 43427

SEQ ID NO: 61989 - DNA, 201 bp, Homo sapiens; identical to SEQ ID NO: 40811

SEQ ID NO: 61990 - DNA, 201 bp, Homo sapiens; identical to SEQ ID NO: 43428

SEQ ID NO: 61991 - DNA, 201 bp, Homo sapiens; identical to SEQ ID NO: 42703

SEQ ID NO: 61992 - DNA, 201 bp, Homo sapiens; identical to SEQ ID NO: 40813

SEQ ID NO: 61993 - DNA, 201 bp, Homo sapiens; identical to SEQ ID NO: 43429

SEQ ID NO: 61994 - DNA, 201 bp, Homo sapiens; identical to SEQ ID NO: 42705

SEQ ID NO: 61995 - DNA, 201 bp, Homo sapiens; identical to SEQ ID NO: 43431

SEQ ID NO: 61996 - DNA, 201 bp, Homo sapiens; identical to SEQ ID NO: 38384

SEQ ID NO: 61997 - DNA, 201 bp, Homo sapiens; identical to SEQ ID NO: 43432

SEQ ID NO: 61998 - DNA, 201 bp, Homo sapiens; identical to SEQ ID NO: 40033

SEQ ID NO: 61999 - DNA, 201 bp, Homo sapiens; identical to SEQ ID NO: 38386

SEQ ID NO: 62000 - DNA, 201 bp, Homo sapiens; identical to SEQ ID NO: 38388

SEQ ID NO: 62001 - DNA, 201 bp, Homo sapiens; identical to SEQ ID NO: 41221

SEQ ID NO: 62002 - DNA, 201 bp, Homo sapiens; identical to SEQ ID NO: 42717

SEQ ID NO: 62003 - DNA, 201 bp, Homo sapiens; identical to SEQ ID NO: 42056

SEQ ID NO: 62004 - DNA, 201 bp, Homo sapiens; identical to SEQ ID NO: 42719

SEQ ID NO: 62005 - DNA, 201 bp, Homo sapiens; identical to SEQ ID NO: 39936

SEQ ID NO: 62006 - DNA, 201 bp, Homo sapiens; identical to SEQ ID NO: 41227

SEQ ID NO: 62007 - DNA, 201 bp, Homo sapiens; identical to SEQ ID NO: 43203

SEQ ID NO: 62008 - DNA, 201 bp, Homo sapiens; identical to SEQ ID NO: 39937

SEQ ID NO: 62009 - DNA, 201 bp, Homo sapiens; identical to SEQ ID NO: 40547

SEQ ID NO: 62010 - DNA, 201 bp, Homo sapiens; identical to SEQ ID NO: 41234

SEQ ID NO: 62011 - DNA, 201 bp, Homo sapiens; identical to SEQ ID NO: 42061

SEQ ID NO: 62012 - DNA, 201 bp, Homo sapiens; identical to SEQ ID NO: 42063

SEQ ID NO: 62013 - DNA, 201 bp, Homo sapiens; identical to SEQ ID NO: 42064

SEQ ID NO: 62014 - DNA, 201 bp, Homo sapiens; identical to SEQ ID NO: 42065

SEQ ID NO: 62015 - DNA, 201 bp, Homo sapiens; identical to SEQ ID NO: 40831

SEQ ID NO: 62016 - DNA, 201 bp, Homo sapiens; identical to SEQ ID NO: 40834

SEQ ID NO: 62017 - DNA, 201 bp, Homo sapiens; identical to SEQ ID NO: 40835

SEQ ID NO: 62018 - DNA, 201 bp, Homo sapiens; identical to SEQ ID NO: 40836

SEQ ID NO: 62019 - DNA, 201 bp, Homo sapiens; identical to SEQ ID NO: 40837

SEQ ID NO: 62020 - DNA, 201 bp, Homo sapiens; identical to SEQ ID NO: 42160

SEQ ID NO: 62021 - DNA, 201 bp, Homo sapiens; identical to SEQ ID NO: 40838

SEQ ID NO: 62022 - DNA, 201 bp, Homo sapiens; identical to SEQ ID NO: 39960

SEQ ID NO: 62023 - DNA, 201 bp, Homo sapiens; identical to SEQ ID NO: 38404

SEQ ID NO: 62024 - DNA, 201 bp, Homo sapiens; identical to SEQ ID NO: 43235

SEQ ID NO: 62025 - DNA, 201 bp, Homo sapiens; identical to SEQ ID NO: 38405

SEQ ID NO: 62026 - DNA, 201 bp, Homo sapiens; identical to SEQ ID NO: 43236

SEQ ID NO: 62027 - DNA, 201 bp, Homo sapiens; identical to SEQ ID NO: 43237

SEQ ID NO: 62028 - DNA, 201 bp, Homo sapiens; identical to SEQ ID NO: 38407

SEQ ID NO: 62029 - DNA, 201 bp, Homo sapiens; identical to SEQ ID NO: 38409

SEQ ID NO: 62030 - DNA, 201 bp, Homo sapiens; identical to SEQ ID NO: 38412

SEQ ID NO: 62031 - DNA, 201 bp, Homo sapiens; identical to SEQ ID NO: 42740

SEQ ID NO: 62032 - DNA, 201 bp, Homo sapiens; identical to SEQ ID NO: 38413

SEQ ID NO: 62033 - DNA, 201 bp, Homo sapiens; identical to SEQ ID NO: 38414

SEQ ID NO: 62034 - DNA, 201 bp, Homo sapiens; identical to SEQ ID NO: 43242

SEQ ID NO: 62035 - DNA, 201 bp, Homo sapiens; identical to SEQ ID NO: 38415

SEQ ID NO: 62036 - DNA, 201 bp, Homo sapiens; identical to SEQ ID NO: 38417

SEQ ID NO: 62037 - DNA, 201 bp, Homo sapiens; identical to SEQ ID NO: 38418

SEQ ID NO: 62038 - DNA, 201 bp, Homo sapiens; identical to SEQ ID NO: 41542

SEQ ID NO: 62039 - DNA, 201 bp, Homo sapiens; identical to SEQ ID NO: 41545

SEQ ID NO: 62040 - DNA, 201 bp, Homo sapiens; identical to SEQ ID NO: 41547

SEQ ID NO: 62041 - DNA, 201 bp, Homo sapiens; identical to SEQ ID NO: 41301

SEQ ID NO: 62042 - DNA, 201 bp, Homo sapiens; identical to SEQ ID NO: 41549

SEQ ID NO: 62043 - DNA, 201 bp, Homo sapiens; identical to SEQ ID NO: 39261

SEQ ID NO: 62044 - DNA, 201 bp, Homo sapiens; identical to SEQ ID NO: 41551

SEQ ID NO: 62045 - DNA, 201 bp, Homo sapiens; identical to SEQ ID NO: 41553

SEQ ID NO: 62046 - DNA, 201 bp, Homo sapiens; identical to SEQ ID NO: 40854

SEQ ID NO: 62047 - DNA, 201 bp, Homo sapiens; identical to SEQ ID NO: 39980

SEQ ID NO: 62048 - DNA, 201 bp, Homo sapiens; identical to SEQ ID NO: 40855

SEQ ID NO: 62049 - DNA, 201 bp, Homo sapiens; identical to SEQ ID NO: 43276

SEQ ID NO: 62050 - DNA, 201 bp, Homo sapiens; identical to SEQ ID NO: 42408

SEQ ID NO: 62051 - DNA, 201 bp, Homo sapiens; identical to SEQ ID NO: 43277

SEQ ID NO: 62052 - DNA, 201 bp, Homo sapiens; identical to SEQ ID NO: 38435

SEQ ID NO: 62053 - DNA, 201 bp, Homo sapiens; identical to SEQ ID NO: 38436

SEQ ID NO: 62054 - DNA, 201 bp, Homo sapiens; identical to SEQ ID NO: 38437

SEQ ID NO: 62055 - DNA, 201 bp, Homo sapiens; identical to SEQ ID NO: 42765

SEQ ID NO: 62056 - DNA, 201 bp, Homo sapiens; identical to SEQ ID NO: 38439

SEQ ID NO: 62057 - DNA, 201 bp, Homo sapiens; identical to SEQ ID NO: 38440

SEQ ID NO: 62058 - DNA, 201 bp, Homo sapiens; identical to SEQ ID NO: 42766

SEQ ID NO: 62059 - DNA, 201 bp, Homo sapiens; identical to SEQ ID NO: 38441

SEQ ID NO: 62060 - DNA, 201 bp, Homo sapiens; identical to SEQ ID NO: 42767

SEQ ID NO: 62061 - DNA, 201 bp, Homo sapiens; identical to SEQ ID NO: 38442

SEQ ID NO: 62062 - DNA, 201 bp, Homo sapiens; identical to SEQ ID NO: 38443

SEQ ID NO: 62063 - DNA, 201 bp, Homo sapiens; identical to SEQ ID NO: 38446

SEQ ID NO: 62064 - DNA, 201 bp, Homo sapiens; identical to SEQ ID NO: 38447

SEQ ID NO: 62065 - DNA, 201 bp, Homo sapiens; identical to SEQ ID NO: 42090

SEQ ID NO: 62066 - DNA, 201 bp, Homo sapiens; identical to SEQ ID NO: 41338

SEQ ID NO: 62067 - DNA, 201 bp, Homo sapiens; identical to SEQ ID NO: 41572

SEQ ID NO: 62068 - DNA, 201 bp, Homo sapiens; identical to SEQ ID NO: 41344

SEQ ID NO: 62069 - DNA, 201 bp, Homo sapiens; identical to SEQ ID NO: 40863

SEQ ID NO: 62070 - DNA, 201 bp, Homo sapiens; identical to SEQ ID NO: 41573

SEQ ID NO: 62071 - DNA, 201 bp, Homo sapiens; identical to SEQ ID NO: 41574

SEQ ID NO: 62072 - DNA, 201 bp, Homo sapiens; identical to SEQ ID NO: 41346

SEQ ID NO: 62073 - DNA, 201 bp, Homo sapiens; identical to SEQ ID NO: 41577

SEQ ID NO: 62074 - DNA, 201 bp, Homo sapiens; identical to SEQ ID NO: 40083

SEQ ID NO: 62075 - DNA, 201 bp, Homo sapiens; identical to SEQ ID NO: 42097

SEQ ID NO: 62076 - DNA, 201 bp, Homo sapiens; identical to SEQ ID NO: 41579

SEQ ID NO: 62077 - DNA, 201 bp, Homo sapiens; identical to SEQ ID NO: 41581

SEQ ID NO: 62078 - DNA, 201 bp, Homo sapiens; identical to SEQ ID NO: 40263

SEQ ID NO: 62079 - DNA, 201 bp, Homo sapiens; identical to SEQ ID NO: 42569

SEQ ID NO: 62080 - DNA, 201 bp, Homo sapiens; identical to SEQ ID NO: 40264

SEQ ID NO: 62081 - DNA, 201 bp, Homo sapiens; identical to SEQ ID NO: 38470

SEQ ID NO: 62082 - DNA, 201 bp, Homo sapiens; identical to SEQ ID NO: 38471

SEQ ID NO: 62083 - DNA, 201 bp, Homo sapiens; identical to SEQ ID NO: 38472

SEQ ID NO: 62084 - DNA, 201 bp, Homo sapiens; identical to SEQ ID NO: 38474

SEQ ID NO: 62085 - DNA, 201 bp, Homo sapiens; identical to SEQ ID NO: 42808

SEQ ID NO: 62086 - DNA, 201 bp, Homo sapiens; identical to SEQ ID NO: 38476

SEQ ID NO: 62087 - DNA, 201 bp, Homo sapiens; identical to SEQ ID NO: 38478

SEQ ID NO: 62088 - DNA, 201 bp, Homo sapiens; identical to SEQ ID NO: 38479

SEQ ID NO: 62089 - DNA, 201 bp, Homo sapiens; identical to SEQ ID NO: 41367

SEQ ID NO: 62090 - DNA, 201 bp, Homo sapiens; identical to SEQ ID NO: 38481

SEQ ID NO: 62091 - DNA, 201 bp, Homo sapiens; identical to SEQ ID NO: 42576

SEQ ID NO: 62092 - DNA, 201 bp, Homo sapiens; identical to SEQ ID NO: 39994

SEQ ID NO: 62093 - DNA, 201 bp, Homo sapiens; identical to SEQ ID NO: 38482

SEQ ID NO: 62094 - DNA, 201 bp, Homo sapiens; identical to SEQ ID NO: 39995

SEQ ID NO: 62095 - DNA, 201 bp, Homo sapiens; identical to SEQ ID NO: 42101

SEQ ID NO: 62096 - DNA, 201 bp, Homo sapiens; identical to SEQ ID NO: 42102

SEQ ID NO: 62097 - DNA, 201 bp, Homo sapiens; identical to SEQ ID NO: 39179

SEQ ID NO: 62098 - DNA, 201 bp, Homo sapiens; identical to SEQ ID NO: 41601

SEQ ID NO: 62099 - DNA, 201 bp, Homo sapiens; identical to SEQ ID NO: 40297

SEQ ID NO: 62100 - DNA, 201 bp, Homo sapiens; identical to SEQ ID NO: 40299

SEQ ID NO: 62101 - DNA, 201 bp, Homo sapiens; identical to SEQ ID NO: 42592

SEQ ID NO: 62102 - DNA, 201 bp, Homo sapiens; identical to SEQ ID NO: 41602

SEQ ID NO: 62103 - DNA, 201 bp, Homo sapiens; identical to SEQ ID NO: 41604

SEQ ID NO: 62104 - DNA, 201 bp, Homo sapiens; identical to SEQ ID NO: 42594

SEQ ID NO: 62105 - DNA, 201 bp, Homo sapiens; identical to SEQ ID NO: 40304

SEQ ID NO: 62106 - DNA, 201 bp, Homo sapiens; identical to SEQ ID NO: 42595

SEQ ID NO: 62107 - DNA, 201 bp, Homo sapiens; identical to SEQ ID NO: 40305

SEQ ID NO: 62108 - DNA, 201 bp, Homo sapiens
ggacagggcccaagaagatggggtgggtgctgtacctccctcttccttccctggggtatctgtgggccacggcagggcccacagctgttgctagtagcctscttggggccagtgggtttgatttatttttgtgtttgtgtggtttgagggcaggcatcccttccccaccctttgcgtccctgctacagtgacccctctttc

SEQ ID NO: 62109 - DNA, 201 bp, Homo sapiens
ccctgccctgccgtggcgcccatgcacctgcccgcgtgtcctgtgctttagctgaggggccgaggccctgccctgccgtggcgcccatgcacctgcccgcrtgtcctgtgctttagctgaggggctgaggccctgccctgccatggcgcccgtgcatctgcccgcgtgtcctgtgctttagctgaggggcaccttgggccc

SEQ ID NO: 62110 - DNA, 201 bp, Homo sapiens
cctttcagctccgaggcctccaggtcgttgttccctgttcactttcttctagcctcgttagacaccccaaactctgaccccagtccacgggggctctgacrtctctttcccctgcactccctcttgaccctgcccagacctccccatgctggcccgcaccttcccacctgctcctgtctggcctcctgcattcccgctctg

SEQ ID NO: 62111 - DNA, 201 bp, Homo sapiens
ccgccgacgccccgcacctgcccgctcaggccagcagcccctgatgtccctgccctggagactttcactatcttccatcccatttgtccccaacgttgacyggccactgaggttgggggttcatgtggaggtttgcaacccccactaggcccaggtctggaaatgggaggcctggaggtgaggggtaggtgggctatggac

SEQ ID NO: 62112 - DNA, 201 bp, Homo sapiens
tcttctgccacgtgcttctgcctgtccccccactccctcctgtcgctgtttcctccacagtggttggcaagacgtggcccctgtggcctctgcctcgtgcrtctgaaggacatcccagccacagcatcacatcagactggaacagtggcgggatggggctgggcatcaggcagcatgcatgtgtcatgtcacggacacctc

SEQ ID NO: 62113 - DNA, 201 bp, Homo sapiens
gcccggggcgtcctgcggagagccccacagtgggaggcccttgtagcggggagcccggtgactgctgggggtcagctgctggcggcccctgtggagacctsgcgacctgccaagggctccggacctgcctgggtggacccagggtgggcgtgcttctggctgcagggccgggccacaggcttccctctggctttctgccct

SEQ ID NO: 62114 - DNA, 201 bp, Homo sapiens
cgcggtccttgctctgcagaggggagggaggagtgtcaggccccggcagagcccagcgccagtctgcgcctctctggcctccctgctgggtgccatctcargtggccagcgccaaggcacctccttcccggctctccccagcttccctcaagcgttttggggaggggagcatactgctgcacagccgaaattgtaaaatta

SEQ ID NO: 62115 - DNA, 201 bp, Homo sapiens
tggtcctcagctggcggctttgctcctgactgccccagtggcttccgtgtctagcctgacacccgtgtcagcccagggacagaggccccgggaggctgcartccagccctcacagaggacagggccgtgggcaggacctgcggcgccgggtgccagccacagcccccagaggcccccttagagctgggtgttctcggcctt

SEQ ID NO: 62116 - DNA, 201 bp, Homo sapiens
cttccccccgaccatgctgcccccgtcccaggcggggctcggcaggagcgccatgtggggcccctgggaggagtcctgtggctttgacatgaatgggggtrcgggtggttggcggtgggtcttggtcctcagctggcggctttgctcctgactgccccagtggcttccgtgtctagcctgacacccgtgtcagcccaggga

SEQ ID NO: 62117 - DNA, 201 bp, Homo sapiens
gcctcaacagctccagtgggtgggcagttgcaggcttttgctcttacagttgacctgacagtaacatgctgtttctcacatgtgcacaccattcttggggmaaattccaagagaatttctaggtcaaaggataaatgcttttttttgtttgagacagggtctcactctgtcactcaggctggagggcagtggtgcgatgtt

SEQ ID NO: 62118 - DNA, 201 bp, Homo sapiens
tgggtgggcccctttggccatccctagctcttacccctcatgcagctccctgcaggggactccacactccactgggagccgagtgtcctagggacgccctsgagaggagccccaggagaaggccccagcccccggcaggcctgtgttacaggtgtgcctgcctgtgccctgttggggagccctgcccgtgtggcctcgcct

SEQ ID NO: 62119 - DNA, 201 bp, Homo sapiens
cttcgggcgctgggcctggctgagcgctgtcgccccctggtggactctgtgccccacagctgtcccacggggatgctgcgcccctgggaacccagcacctycgaaggccacctctgccccctgcccagagcctgcctgtgccgtggcctgtccacatccagcacaggggccacggggcacagagcgctgggtgacaagtct

SEQ ID NO: 62120 - DNA, 201 bp, Homo sapiens
acctggccatcaatgcatttaattgtgaaggtgcttggagcgtccctccgctaggcggtgatgccatgcactactgcagccgcccctcagctgctttcccrccaccagcctccctcatggtgttgctgcttcatcttttcctcttgtttagtgatgtttttctttcattaagaatgaggctcgcacagctgggcttaactg

SEQ ID NO: 62121 - DNA, 201 bp, Homo sapiens
cagagcgctgggtgacaagtcttttgtcacctgccaggaccctgggactgcggcccatgagcagcgaggctgggactccagcgtgcggtgcttcagcccckgccactgtgagggttcgggagcccagcccggtacccgtccgcagaggccaggcgggggcagccgaccgcagccgggtgtggaactgcccttgtgcgcgtc

SEQ ID NO: 62122 - DNA, 201 bp, Homo sapiens
acaagtcttttgtcacctgccaggaccctgggactgcggcccatgagcagcgaggctgggactccagcgtgcggtgcttcagccccggccactgtgagggktcgggagcccagcccggtacccgtccgcagaggccaggcgggggcagccgaccgcagccgggtgtggaactgcccttgtgcgcgtctggggcttggggcc

SEQ ID NO: 62123 - DNA, 201 bp, Homo sapiens
aaagtgttgggattacaggagtgagccactgtgcctggccttcaactgcttcctaagagtctaagttcttgttccaccctttaaggccagtgaaggacccraacactgtgtgtgccggtgtcacgcagccagcagggctctgctcagaggcagctgtggtcctgctcagagagaggagtgggtgggttggtgcgtggttgc

SEQ ID NO: 62124 - DNA, 201 bp, Homo sapiens
cttccaggggccaagtggcactggtgcatgaggagatgcccctctctccagtcaaggctcgtggaggcaggacacccactgccctcgctggggctgggagccccccctccgctgggcagcacagctcgctccactccttgtggccacctgcagcgccctcctcaccctcagggcccccgggtgcccgacaggcccgagtcg

SEQ ID NO: 62125 - DNA, 201 bp, Homo sapiens
tctctgctagctcagccctgtcttggttgtggggatcatcaaattgggtggtggaggggatggacagccagcccctcacagccccctcggccgcggccgckctgggttgttgaaactgccccattgctttgtgaagcgaattcaactcatcctggctcccatgggctgaatggcccgcaggccactctaggcgccaggttc

SEQ ID NO: 62126 - DNA, 201 bp, Homo sapiens
ggtgagcgccaccaagcccagctaattttttgtatttttagtagagacagggttttccatgtaggccagtctggtctcgaactcttaacctcaactgatcygcctgcctcggtctcccaaagtgctgggatgacaggtgtgagccactgggcccggccttcccagataatttaaggagagtttggcctgtgccggagcata

SEQ ID NO: 62127 - DNA, 201 bp, Homo sapiens
ggaaccctgggctcgggccccctgtcgctgtggttctggggtctgggtgctggtgccgtctgctggagagtggtctggagctgcagctctgtggagtctgraaaggggctgcccagtgattctcaccagctagtcagtggtggagaagttgcctgggtgtggaccacagagctggggatggaaccaggggccagggctggt

SEQ ID NO: 62128 - DNA, 201 bp, Homo sapiens
tggccaggctggtcttgaactcctgacctcaggtgatccacccgcctcagcctcccaaagtgttgggattacaggagtgagccactgtgcctggccttcarctgcttcctaagagtctaagttcttgttccaccctttaaggccagtgaaggacccgaacactgtgtgtgccggtgtcacgcagccagcagggctctgctc

SEQ ID NO: 62129 - DNA, 201 bp, Homo sapiens
gccgccaagatggccccgtcatgcccagttagtggcctcaggttaggcctgtttctgtgtcatcccgaaggcagtccagggctccttacgcctgtatctcygccacctcccactcgcatcgtgggtccacggggccgggccaccaggggctctgccagacaccctcgcccgccacagccatctggaggattctgcccccga

SEQ ID NO: 62130 - DNA, 201 bp, Homo sapiens
gggcgtggggactacctggccgtggtgctggccacccaaggccacacccaggtgctgattcaccagctgagccgtcgccgcagccagagtccgttccgccrcagccacggacaggtgcagcgagtggccttccaccctgcccggcccttcctgttggtggcgtcccagcgcagcgtccgcctctaccacctgctgcgccag

SEQ ID NO: 62131 - DNA, 201 bp, Homo sapiens
ggtgggcgtgcttctggctgcagggccgggccacaggcttccctctggctttctgccctcaggcctttagcattgacatgcacacgaccctgcctcctttmtaaggactgtgtagaattacgtggcattcagtgagcagctgcacgtggtgttctagggcacctttggatgctcaggtgctcctgaggggtgtgccaggga

SEQ ID NO: 62132 - DNA, 201 bp, Homo sapiens
tgctgaggcctgtgccaggctggagctgctcagagatttcggggtggtgggcttcctgggatccccccaaggtcaaagggtaccctgtatcccctgaagtraccattttctctctctctctgcaggccagcactccttgcccgaggacagagatggcgagcgcccggattggggatgagtatgcggaggacagctctgatg

SEQ ID NO: 62133 - DNA, 201 bp, Homo sapiens
cctcactgccgccgcctcctcaggtctacaggggccacagtgaccttgtccggtgcctcagtgtctctcctgggggccagtggctggtttcaggtgggtcygagctgggggcagccttgagctggggggcaggtgggatggccaggtgttgagagctgtctctgccgcatccaggctctgacgacggctccctgcggctct

SEQ ID NO: 62134 - DNA, 201 bp, Homo sapiens
aatttctaggtcaaaggataaatgcttttttttgtttgagacagggtctcactctgtcactcaggctggagggcagtggtgcgatgttggctcaccaaaayctcaacttcctgggctcaagggatcctcctacctcagcctccctggtagctgggactacagggtccccgccaccatgcctggctagttttgttttgtttt

SEQ ID NO: 62135 - DNA, 201 bp, Homo sapiens
gaggcctcagaggaggagcgccaagtgggcctgcggctgcgcatctgccacgggaaggtacgtggggcgccttgggggtgaggctgcagcgggaggggccyggctcagccactcagccagccttgctctcctgcagccagtgacgcaggtgacctggcacgggcgtggggactacctggccgtggtgctggccacccaagg

SEQ ID NO: 62136 - DNA, 201 bp, Homo sapiens
agtggaggccctgggggctggggagccaggggtggcactgtgcttaggggccgtgtctgggcctggctcacagggaggactcggtgctgctgctgaacccrgctctgggggaccggctggtggcgggcagcacagatcagctgttgagcgccttcgtcccgcctgaggagccccccttgcagccggcccgctggctggagg

SEQ ID NO: 62137 - DNA, 201 bp, Homo sapiens
cgggggcgtgcccgccttcgctctggggttcctgcgcccgagcactttactgcccccacgggtgagaggtgggcctgttttccccatcagccttggttccrccagtaaacccgatccggttggagccatcctcacctccgcagtcgagggcagaatctgttttccaggttgggatgtgaattctcagtggcgcccactctg

SEQ ID NO: 62138 - DNA, 201 bp, Homo sapiens
tggggccccaccttgggctgggggttcgctcagctggtttggactttgaggaggaggagactaagcaggacctggctttctcccctctggccccggcgccrgggcccagcacccctgctggaaccttcagtagggtgagatgcagcaggtgagcctcccgccctggccttgccctgagcacttcaacagataaaaccctga

SEQ ID NO: 62139 - DNA, 201 bp, Homo sapiens
gtttttcttctttcagggttgctttctctatggatcaaggtaagaaggaagaaaagctaggtctcctatctatctcacacagcagattttaaaatattttwaaaatattttaaatactttcaattttttaatattttaaaaacttttaaaactaactactgtatcgtgtacctatgaaatttcgttttcagtgcaattcaa

SEQ ID NO: 62140 - DNA, 201 bp, Homo sapiens
taagcttccaacacagcaggttcagagaggttaggaaaaataagcaagggaaagaaacaagtactgatctaacaatgacggaagctgactccatgccttaktggatgcttgcggaggatggcactatcttggctgggctgactgtattagcaatgcatgtatctaaatcagctctaaaacccatagagagactggcacttt

SEQ ID NO: 62141 - DNA, 201 bp, Homo sapiens
tctggttggtcttgactcacaacccattcctcattctggcctctccatcctcacaggacccccagccaggggaaacttcccagcttccagcgggaagtgcygcttccccaaattgggcagcacctggggatgcctctagatgcataatcacctcagaggtcctgagccagagtccagagattctttctgagattctggcaa

SEQ ID NO: 62142 - DNA, 201 bp, Homo sapiens
gggtatagaaagatgttcaggacttagaatataccttttctcatggttctcttatcccaacgtataaattgtgacaatttgtttaaaagattgaactaaaytatgatattctctttgtcttccaaatttatttagacttggtatcctgttctttctctggaatttcctttgcttttctttttgtcagtaagctaaattact

SEQ ID NO: 62143 - DNA, 201 bp, Homo sapiens
gctggggctggatgacagagcctcagcagtgacagggaagcctgcttacttccctcatgctcagagtgccttttggccacgggcttatttcagctgtcttktgttccatttctgaggctctaaagggatgctctgggaactgggatctaggaataaatcaagatgagtggggcaaggttaataccctgattagatcagcct

SEQ ID NO: 62144 - DNA, 201 bp, Homo sapiens
gagagtggtgctccatgttccaaggaagaaaagcaacccacagctcctcctgcccgtgcagcagatgaccagaaagacgagaaagggaaacaaactcccaytcatggtgaggctgcttgtttctcaaacacacttttccaatgcctccacaagttgtttgtttctgtattttgaaagcactcaacatgcagagtatttgct

SEQ ID NO: 62145 - DNA, 201 bp, Homo sapiens
agaggcctaaaaagccaggtggacagagaccacatgtgaccccaaacagaaacaggctgctggaaactaactctctctctctctagctgatacttattcarcacttactgtatgtcaggtactattctaaaaactttacgtatagtaactcagttttcacacagatgcaattattttccatactttagagatgagaacatt

SEQ ID NO: 62146 - DNA, 201 bp, Homo sapiens
tgcagcagatgaccagaaagacgagaaagggaaacaaactcccattcatggtgaggctgcttgtttctcaaacacacttttccaatgcctccacaagttgyttgtttctgtattttgaaagcactcaacatgcagagtatttgctaaccacaggcagagtacccagtcaggatgtaccaactcaaactcctccctggggca

SEQ ID NO: 62147 - DNA, 201 bp, Homo sapiens
aatgctggggtggccatggaagaattctgcccaacagaggatgatgttccttaagcttccaacacagcaggttcagagaggttaggaaaaataagcaaggsaaagaaacaagtactgatctaacaatgacggaagctgactccatgccttagtggatgcttgcggaggatggcactatcttggctgggctgactgtattag

SEQ ID NO: 62148 - DNA, 201 bp, Homo sapiens
ttacatcagggaagtttctagtcaaaatgttattcctgtctacagggaaaaacaaaagcaaaacacaaaagaacactgcttctaatggcatcatagcaagsagtttatctagaaagatgatgccagcagtcacctcttttccaggaagacagaaacaaaaaccgttctcctcgagaggccaacagtgtagaagcccctttt

SEQ ID NO: 62149 - DNA, 201 bp, Homo sapiens
acacatttatttaaaaatatcccaacaaagtgttgcaaaatttcccttgattgcaatgattctttaagctgttaacattaatcttgggtggatgcaggagytgtccactggctttccaaaaggcatccaatgcctttaaggcagcataagagaaacactgcccctctcgatgaactgggtccctgagtctggcagtactgc

SEQ ID NO: 62150 - DNA, 201 bp, Homo sapiens
tacctggctccaaagccttttcctttccagatggtacactgcccacatctcttagtttatcggcacagggtcaagaaggtggtgagggtatggactgacayggcatctacggagctttccatacttataccaagacgcccccctgtaaagagtggactgtccggtagccgggcaaggtggctcataccttaatcccagcac

SEQ ID NO: 62151 - DNA, 201 bp, Homo sapiens
gcagcttcttctctagcaactgttaatttaatagactactacttatggtgaaacaaaaaacaatcccactctgaagaaagcactgaagacctataaccagyggtgaatttcttccgtattgctcagtggaaacaaaagaaagctcaaatgggtgagtttttcttctttcagggttgctttctctatggatcaaggtaagaa

SEQ ID NO: 62152 - DNA, 201 bp, Homo sapiens
gcctttagaaggacacaatgggatgggggggaatcaaagggtgatagtcttaacaataaatagaggttgagatcctaatcaagaatcaaagcaatacattytgagttggcattcacaaatgagtaagtcaaatggtgtggggcataatgctggggtggccatggaagaattctgcccaacagaggatgatgttccttaagc

SEQ ID NO: 62153 - DNA, 201 bp, Homo sapiens
gaaggatcacttgaggtcaggagttcgagaccagcctagccaacatggtaaaaccctgtctttactaaaaatgcaaataatagccaggcatggtggtacgygcctgaaatcccagctacttgggaaactgagggatgagaatcacttgaacccaggaggtagaggttgcagtgagccgagatcatgctactgcactctgac

SEQ ID NO: 62154 - DNA, 201 bp, Homo sapiens
gagaccacatgtgaccccaaacagaaacaggctgctggaaactaactctctctctctctagctgatacttattcagcacttactgtatgtcaggtactatyctaaaaactttacgtatagtaactcagttttcacacagatgcaattattttccatactttagagatgagaacattgaggcatagagaggttaagtaattt

SEQ ID NO: 62155 - DNA, 201 bp, Homo sapiens
caaagactcaaggaccatttgaacaaagacatccacatctataccacagatgacttggcatctatggaggagtggaggtgagcaccactctaccatgtagrggaagcagccactgtggaggctgggcttgtggagattccttctggatgccctcagatctgtcattaatggggacaaagcagaatcaagggactgctctat

SEQ ID NO: 62156 - DNA, 201 bp, Homo sapiens
ttggcatttagaagcttcattcaacttttggccttttcaaggctaaatgaatcttagggaagaaataaaaagttcccattgattcacttaaaaaaagattkcttgcaattaacagatctaaatctatgaaaaagggagcatttatggtaatttccataatctctcactttctctagacatttcaaatcaaattgtaataat

SEQ ID NO: 62157 - DNA, 201 bp, Homo sapiens
tgatgattattcctgtctaataaatgtggtatgtctttccatttattccagttgtcttctgtatcttttaatagtatggttatcttaaggtgttttctctytttattttaattggatgtagaatcttcagtaatatcatctagcaagttatttgcatattgtacagttgtatgatgataaatttgtatgttatttctggca

SEQ ID NO: 62158 - DNA, 201 bp, Homo sapiens
aatttggagagttcgagcacgattaattttgtgtgttcagctcaaaggaaaaagcttcctcataggagaaatgcattaatggatgagcgaatgaataagargctttataacccaaccaaccagaagccgaggggctcactatattaaattataccagctctcaatacaatgggtcaaaatgtattttattttaaattctaa

SEQ ID NO: 62159 - DNA, 201 bp, Homo sapiens
agtcagttaccagggaactcacaaaatttggagagttcgagcacgattaattttgtgtgttcagctcaaaggaaaaagcttcctcataggagaaatgcatkaatggatgagcgaatgaataagaagctttataacccaaccaaccagaagccgaggggctcactatattaaattataccagctctcaatacaatgggtcaa

SEQ ID NO: 62160 - DNA, 201 bp, Homo sapiens
ccatctcaagcctaaaaatgcctattactccaatcctgtactcacttgctccctgccagagacaacacaaagagatgagtatacacactcaggaaaacttygcccgggccttcgaggtagggcgaggactgtgcaccacacgagatgacttgaaaacctgtaggaaggttgtatctcagtgccacttgctttgaggagact

SEQ ID NO: 62161 - DNA, 201 bp, Homo sapiens
ggaagggaaaaaccagaagcgcacaggccatttagcgcaatgtagcgcgtctcacaccagaagttgtttacacactcttggacgcctgagttctccttgayttttgtttttcttcattttatctatcttcgtttatccatcttctagttcatctacttaaccttcttgtaactcagtgctgccaagtggattcggcatcag

SEQ ID NO: 62162 - DNA, 201 bp, Homo sapiens
cacttctagtcttggctcctgagccccaggtactctattcctgaagatccttgcagatatcaatcatcccaagaatgggctagtggtttccgggtttcatraataaagctgtcccattctcatcactaatcaaggtaagagagttacatcttatttctctgccttggtttcatcatctatggaagagcagtcatactggat

SEQ ID NO: 62163 - DNA, 201 bp, Homo sapiens
tctaatttagtcaaacactaccctctctttctccaaaataattattcttaatttatttcacctaacttctgttttttacatcttagcaatgtgaccaccaraagctggagcaactgctttctgattcagaaaataaaagtttattctgatttttatttctgtcttccatacagtcagttaccagggaactcacaaaatttg

SEQ ID NO: 62164 - DNA, 201 bp, Homo sapiens
attactccaatcctgtactcacttgctccctgccagagacaacacaaagagatgagtatacacactcaggaaaacttcgcccgggccttcgaggtagggcsaggactgtgcaccacacgagatgacttgaaaacctgtaggaaggttgtatctcagtgccacttgctttgaggagactcactgggtaactgtttgagggtg

SEQ ID NO: 62165 - DNA, 201 bp, Homo sapiens
gaatgaagttactttcacagtgatgaccctgagtattgagaaaaagttggattatgttcattatattctttttaatgcaagcaatgtaaaacgtcctttakaaatgtttcctttaaaaattatttaaattgtattgcttaaaaaatatgactctttcaactcagttatcacttaaggtttcctggaatattctgctgttta

SEQ ID NO: 62166 - DNA, 201 bp, Homo sapiens
aaaatttggagagttcgagcacgattaattttgtgtgttcagctcaaaggaaaaagcttcctcataggagaaatgcattaatggatgagcgaatgaataasaagctttataacccaaccaaccagaagccgaggggctcactatattaaattataccagctctcaatacaatgggtcaaaatgtattttattttaaattct

SEQ ID NO: 62167 - DNA, 201 bp, Homo sapiens
tctcaattaccttagatgaaaaactgccttgcccacctgggagcatcattatcttatcatagaatgaagttactttcacagtgatgaccctgagtattgasaaaaagttggattatgttcattatattctttttaatgcaagcaatgtaaaacgtcctttagaaatgtttcctttaaaaattatttaaattgtattgctta

SEQ ID NO: 62168 - DNA, 201 bp, Homo sapiens
tttagaacatatttgtaggatatgaaattacctacgtatgtgactcttataagaccagagaaaaaggctagaattatatatatatatatatgaaaatagcrtcagcaattccacaaggccatcaacttggggtatgaactatccgtgaaggactagtgatggctgaacttcaaccacactctgaacagcataaaaatgaga

SEQ ID NO: 62169 - DNA, 201 bp, Homo sapiens
aaagagatgagtatacacactcaggaaaacttcgcccgggccttcgaggtagggcgaggactgtgcaccacacgagatgacttgaaaacctgtaggaaggytgtatctcagtgccacttgctttgaggagactcactgggtaactgtttgagggtggctctaatgctctgcaacagtccctgcagggacaaagagaaattt

SEQ ID NO: 62170 - DNA, 201 bp, Homo sapiens
ccctaggaaatgtagtgacattaaccaaacacacaaagccatctcaagcctaaaaatgcctattactccaatcctgtactcacttgctccctgccagagayaacacaaagagatgagtatacacactcaggaaaacttcgcccgggccttcgaggtagggcgaggactgtgcaccacacgagatgacttgaaaacctgtag

SEQ ID NO: 62171 - DNA, 201 bp, Homo sapiens
cacatttaacgcctccctcacgcatcactcaactgactggcaagccaccccttccccttcgactctcttccaaaaatgcttacgaacttgaaatccagcaraaaaggggccacagtgactacgtactcatgattctgttttactcttctaaattcacggtctacttactattaacttatatacacgttaatatttaagttc

SEQ ID NO: 62172 - DNA, 201 bp, Homo sapiens
cgaagtcctcaccgtggcctccagggccctacataactgactcagtttaccccatcccccaccaagatgcaccaagctctccaagctcctcgcctttcccytccctttcctttaggtcttcgtccaaatgtcacctctctagagaccttctctgaataccctacgtaaaaaggtacccggatacctgcctggcaccacgta

SEQ ID NO: 62173 - DNA, 201 bp, Homo sapiens
caattattaagtaaattaagtcatatgttagaaaataagtgctgtggcaaaatccagattaaaatcaccaatcactagtcaggagaccccatcagctacgsaaagaccatacaggtagtgtgcagagacaccagagaggtcaccctgtttgatcgacaaaagtatgctcattagaaggtaaaccacaggactatggggtct

SEQ ID NO: 62174 - DNA, 201 bp, Homo sapiens
aggtagtgtgcagagacaccagagaggtcaccctgtttgatcgacaaaagtatgctcattagaaggtaaaccacaggactatggggtctttatctcttttytccctgcaggattctcagctcaagaagagcacctggcacaggtcagggactcagaagcatttgttgaagaaatggaagtgctcacccactgagttcttgc

SEQ ID NO: 62175 - DNA, 201 bp, Homo sapiens
ctactaacgccagcacatgctgtgatgggattcccccagcagtgcccacacgatgctgggcccacacagcctgtgacacctgctggccacttcgctcccayggagaagcctctttcacgttcatatgtgctggggatctgtgtctgctgagagctgagctgcctgcctgggatcagccagatggagcaggcagagacggca

SEQ ID NO: 62176 - DNA, 201 bp, Homo sapiens
aagagggagttcttaacctctgtggcagagcaacctgaaaacagaattatactccatatacatagctacaatgcctcatgcagaatgctcttcccaaaacygtgctcaaggatacaaacccaggctgtccaatttggggaaatcattgtttgagggtggcacagacaagcagtcggcttggggtttgctccctgtgcacag

SEQ ID NO: 62177 - DNA, 201 bp, Homo sapiens
gaagagcacctggcacaggtcagggactcagaagcatttgttgaagaaatggaagtgctcacccactgagttcttgcttctgcagcattcctggcaggtaaccctctcgagttggctgaaatctttccaagaatgaaaagctgggcttttacaacaaactaacaagcaaaccccaaccaaccacccccacacacccccagg

SEQ ID NO: 62178 - DNA, 201 bp, Homo sapiens
ctgtgtctgctgagagctgagctgcctgcctgggatcagccagatggagcaggcagagacggcacggaccacactccagaggaacacgccatggatggctrtattgttgatgtttcagatatccaaaaagtaaattataaatcttagcggtgatttagctatcctatttgccaaaggtagtttacacgggtgtttcaaatt

SEQ ID NO: 62179 - DNA, 201 bp, Homo sapiens
acatccagtgtgaacatgcattcagcaaacatttcctgagccctgctttgtgccaggctgttctcagtgctcaggatacacaaggaagaaataaataaaarataaggtttctgtccttgtaaagcttatattcgtgtccgtgtgtgcatgcctgtgtgtatgtataagaatacattcaatagacacaattattaagtaaat

SEQ ID NO: 62180 - DNA, 201 bp, Homo sapiens
aaatcttatgagataaggaacaacttcaattcttaatatatttttctaatttatgaataaaccaacaaccaacatgcttcatccaggcaggatgaagcactgtctccctcgcccacacccttttccacagctgccctcccagcccagcatcttttatcacctagaagggccaaggaggctggtttgtgcaactcaacaagc

SEQ ID NO: 62181 - DNA, 201 bp, Homo sapiens
gaaatcttatgagataaggaacaacttcaattcttaatatatttttctaatttatgaataaaccaacaaccaacatgcttcatccaggcaggatgaagcactgtctccctcgcccacacccttttccacagctgccctcccagcccagcatcttttatcacctagaagggccaaggaggctggtttgtgcaactcaacaag

SEQ ID NO: 62182 - DNA, 201 bp, Homo sapiens
agaagagcacctggcacaggtcagggactcagaagcatttgttgaagaaatggaagtgctcacccactgagttcttgcttctgcagcattcctggcaggtmaccctctcgagttggctgaaatctttccaagaatgaaaagctgggcttttacaacaaactaacaagcaaaccccaaccaaccacccccacacacccccag

SEQ ID NO: 62183 - DNA, 201 bp, Homo sapiens
tgtctgctgagagctgagctgcctgcctgggatcagccagatggagcaggcagagacggcacggaccacactccagaggaacacgccatggatggctataytgttgatgtttcagatatccaaaaagtaaattataaatcttagcggtgatttagctatcctatttgccaaaggtagtttacacgggtgtttcaaattact

SEQ ID NO: 62184 - DNA, 201 bp, Homo sapiens
tgtgcacagctcgatcatcaaggaaaggcctcttccgggcctcaaagctccctttgtgaggaatgaggcccactgtcgaggctcacacaggcagctgtaaycaggctgcccctctctctgggtgtttgttttgatagaggttcatttatgccagagacaatgcccgctctctttgttctgcccccagcaggaagcagtgca

SEQ ID NO: 62185 - DNA, 201 bp, Homo sapiens
acaactgatcctccctttcatttttagagtaacaaacccagcttgtactacccatgcctacaacagcccagatgtggcactcaaggttgaaaaggggccayaacttggtaacgggacacacatgaccccatgcaggagaacagccagggccatgaggaaagggactttggtgcacaatggcaggtacctatgcccttgctg

SEQ ID NO: 62186 - DNA, 201 bp, Homo sapiens
aaagcaggtgtggcatttatcagtgctgctgtcatccatagagaagccaggaacaacgaaatgtaactctgtgtacacagaactctgccaccccacacagrgcagatggggcagccatcagaaatgcggggcatggacccaaacgccagcatagcaccacacccccaaatgaggggggaacaggctcagcaccccaagaca

SEQ ID NO: 62187 - DNA, 201 bp, Homo sapiens
cccacggagaagcctctttcacgttcatatgtgctggggatctgtgtctgctgagagctgagctgcctgcctgggatcagccagatggagcaggcagagayggcacggaccacactccagaggaacacgccatggatggctatattgttgatgtttcagatatccaaaaagtaaattataaatcttagcggtgatttagct

SEQ ID NO: 62188 - DNA, 201 bp, Homo sapiens
aaaacccagtgtggtcgtctctgttctcaatgtctaccttggaagagggagttcttaacctctgtggcagagcaacctgaaaacagaattatactccatayacatagctacaatgcctcatgcagaatgctcttcccaaaactgtgctcaaggatacaaacccaggctgtccaatttggggaaatcattgtttgagggtgg

SEQ ID NO: 62189 - DNA, 201 bp, Homo sapiens; identical to SEQ ID NO: 40385

SEQ ID NO: 62190 - DNA, 201 bp, Homo sapiens; identical to SEQ ID NO: 38840

SEQ ID NO: 62191 - DNA, 201 bp, Homo sapiens; identical to SEQ ID NO: 40452

SEQ ID NO: 62192 - DNA, 201 bp, Homo sapiens; identical to SEQ ID NO: 39215

SEQ ID NO: 62193 - DNA, 201 bp, Homo sapiens; identical to SEQ ID NO: 39336

SEQ ID NO: 62194 - DNA, 201 bp, Homo sapiens; identical to SEQ ID NO: 39338

SEQ ID NO: 62195 - DNA, 201 bp, Homo sapiens; identical to SEQ ID NO: 40345

SEQ ID NO: 62196 - DNA, 201 bp, Homo sapiens; identical to SEQ ID NO: 52277

SEQ ID NO: 62197 - DNA, 201 bp, Homo sapiens
cggggagcagctcctgggcagcctgctgcggcagctgcagctcaaagaggtgcccaccctggacagggccgacatggaggagctggtcatccccacccacrtgagggcccagtacgtggccctgctgcagcgcagccacggggaccgctcccgcggaaagaggttcagccagagcttccgaggtgaggccctccctccctg

SEQ ID NO: 62198 - DNA, 201 bp, Homo sapiens
gggcagcctgctgcggcagctgcagctcaaagaggtgcccaccctggacagggccgacatggaggagctggtcatccccacccacgtgagggcccagtacrtggccctgctgcagcgcagccacggggaccgctcccgcggaaagaggttcagccagagcttccgaggtgaggccctccctccctgctgcccctggtccca

SEQ ID NO: 62199 - DNA, 201 bp, Homo sapiens
tagtgtagccatcgagggacttgacttgtgtgtgtttctgaagtgttcgagggtaccaggagagctggcgatgactgaactgctgatggacaaatgctctrtgctctctagtgagccctgaatttgcttcctctgacaagttacctcacctaatttttgcttctcaggaatgagaatctttggccactggagagcccttgc

SEQ ID NO: 62200 - DNA, 201 bp, Homo sapiens
gtcaaactggtaagccggaataaagagacaggcaattacatttattttgaaatggacaacttttcagagtgctgtgggaatgaatgagacaatgtatacarttcttcctctgactcttaggagatcctcagtaaatatcggttattaattttcaagttatttctagctgtccatcctatatcacaaacatccagctttttg

SEQ ID NO: 62201 - DNA, 201 bp, Homo sapiens; identical to SEQ ID NO: 52279

SEQ ID NO: 62202 - DNA, 201 bp, Homo sapiens
ctataaagctgcccaggcttggctctcagcacatccagctgcctgagaccctcctgcagccttctcaagggacagccccactctgcctcttgctcctccarggcagcaccatgcagcccctgtggctctgctgggcactctgggtgttgcccctggccagccccggggccgccctgaccggggagcagctcctgggcagcc

SEQ ID NO: 62203 - DNA, 201 bp, Homo sapiens
tccagccataggcgcctagtgtagccatcgagggacttgacttgtgtgtgtttctgaagtgttcgagggtaccaggagagctggcgatgactgaactgctratggacaaatgctctgtgctctctagtgagccctgaatttgcttcctctgacaagttacctcacctaatttttgcttctcaggaatgagaatctttggcc

SEQ ID NO: 62204 - DNA, 201 bp, Homo sapiens
gctgtgcctcggatggtgcgctcgtgccaaggaggctccagccataggcgcctagtgtagccatcgagggacttgacttgtgtgtgtttctgaagtgttckagggtaccaggagagctggcgatgactgaactgctgatggacaaatgctctgtgctctctagtgagccctgaatttgcttcctctgacaagttacctcac

SEQ ID NO: 62205 - DNA, 201 bp, Homo sapiens
accatgcagcccctgtggctctgctgggcactctgggtgttgcccctggccagccccggggccgccctgaccggggagcagctcctgggcagcctgctgcrgcagctgcagctcaaagaggtgcccaccctggacagggccgacatggaggagctggtcatccccacccacgtgagggcccagtacgtggccctgctgcag

SEQ ID NO: 62206 - DNA, 201 bp, Homo sapiens; identical to SEQ ID NO: 52207

SEQ ID NO: 62207 - DNA, 201 bp, Homo sapiens
tccatcccttttcaaatatgtgctcagtggcattgtctttttgtttgtttgtttgtttgtttgagacagtgtctcactctgttgcccaggctggaggactrtggcacaatcacagctcattgcagccttgacctcctgggctcaagtgatcctctcagctcagccttctgagtacctgggactacaggtgtgtgccaccat

SEQ ID NO: 62208 - DNA, 201 bp, Homo sapiens
tagatttatgattttgacttttgaatagactatatacttttaaaaagctgctgctgcttctagttttaggtaactttgttttgtcttttttattataagawtggcttatgccagatctttaatgttgtaaaagtatccattgctcaccagccatataggagctggccagtagggtttgggcagcagcctttggtgtggagc

SEQ ID NO: 62209 - DNA, 201 bp, Homo sapiens
acctgaacccgggaggcggaggttgcagtgaaccaagatagtgcccctacactccagcctgggacagagcaagactctgactcaaaaaaaaaaaaaaaaaagttgcttcaagaggaaacacaatgttactttgtcagaatgagctttaacttagtaattttctgttcattttaggaaaagtgggctactttgttttggctt

SEQ ID NO: 62210 - DNA, 201 bp, Homo sapiens
cacctgaacccgggaggcggaggttgcagtgaaccaagatagtgcccctacactccagcctgggacagagcaagactctgactcaaaaaaaaaaaaaaaaaagttgcttcaagaggaaacacaatgttactttgtcagaatgagctttaacttagtaattttctgttcattttaggaaaagtgggctactttgttttggct

SEQ ID NO: 62211 - DNA, 201 bp, Homo sapiens
tatatacagattaacattttgcaaactacctttttaatgttcatatacattaatatttaaacctaagacatcaaggctaactactaagcagagaaatgttrttcctggaagggatgtagtatttttggaaaatatcttaagtttatgcctgttaaatagtgtgtagttcttgaagtagcatgtgttaggcaattttttttt

SEQ ID NO: 62212 - DNA, 201 bp, Homo sapiens
gactggggcagaagaaggagaaaataaactcgttttgagaaatttcatgtgatgagggttttttgttttttatgctcatgtatctggttctctttgctgcrttgactctaaaaatgaggttatccactttccaaaggacaagtttcagaataagacttgaggccacatgaattcttggacagtattttacttcttttactt

SEQ ID NO: 62213 - DNA, 201 bp, Homo sapiens
ttagaataggaaaaatcttttgtaaattagaacacttaaaaaataagttaggacactggaagtcttagggaattaattctgccaaaatacaccttgcccarctcccatctttctgtaagctataaggagttgttcataatgaagaaacagacccctttaggcaacaacaaaatcagagaagagctgaagatttggggaata

SEQ ID NO: 62214 - DNA, 201 bp, Homo sapiens
tgatatggaaaggtttcaactctcaattaatcagcaactattttttttttttggcctaggctgacccgtttctcaaaattaaaagccactcatatttgggrtctgataaataagtgtttgtgggctggcaagtgtgggaacctaatgtccatttaaatcttgatttttgtataattaagttgtaaattatatatgtcttac

SEQ ID NO: 62215 - DNA, 201 bp, Homo sapiens
agccaaagtttcttttttggtccttagtttccttacctgaaaagtggaataatttctggcacatatggtttggtacatcacatgaaatatatatatgaagkgcccggttttgtgtctaatatatagtgctgactcagaattttataattcttaatgaggttaggaaaaaaaagaaaagaaatttaatgattaaatatctaa

SEQ ID NO: 62216 - DNA, 201 bp, Homo sapiens
ggaggtaatgcttttcagatgtatatggaaagttagattccaaggattaaaaaaaaatgaaattcttaaacaaattttggattccaagtccagattcaccrgctagttccaatgggtttgaggggatgacgtataatgtctgtgtttgataagactaaaagctttttgaaagtgtgtgatagccaagaggtaaacttttgc

SEQ ID NO: 62217 - DNA, 201 bp, Homo sapiens
acagctgggtgtggtggcttatgcctgtaatcccaggactttgggaggctgaggcaggtggatcacgaggtcaggagattgagaccatcctggctaacacrgtgaaatcccgtctttactaaaaatgcaaaaaattagccgggcatggtggtgggtgcctgtagtcccagctacttgggaggctgaggcaggagaatggca

SEQ ID NO: 62218 - DNA, 201 bp, Homo sapiens
attttctccaggggaaacaccaaattctgtggtggcttaggtgaaggagtaaggctctttactcagcttttgtttttaattgtaactgtgcagatgtctcmtatgtcctatggccagttatttaaaatagtgaaagccaaatgctagtttggtggtgtgcaggcataactcaattatctgacaagagaaaaagaatggttg

SEQ ID NO: 62219 - DNA, 201 bp, Homo sapiens
caaaatcagtggtcagtatctttgagctaaagtgatatgccaagaattgagatggaagaaaaattgcacaattagtttatattggtcttactccaattatrgcctccatctagccttgggcatatccattggttcttaattgcagaattatggccacatgaaccatttcaataagtgtttatctaaattcagcacaaatat

SEQ ID NO: 62220 - DNA, 201 bp, Homo sapiens
ttatgtttttctgtctgtcttcattaggggtatgataatgaaactgccatattggatactctattaatgtcttgagatgtctggtgctttgttattttttmacatcatgagaaataagaagccactattaatgagtgatacaatttggcaaaacttttcaaatactaaaacactaaattagtaaaaatctggtaatattag

SEQ ID NO: 62221 - DNA, 201 bp, Homo sapiens
attattttcttcttaagagagcttgatttcatcaaaagacaggaagcagaaagaaagaaaatagaagatttggaaaaagctcatcttgtggaagtgcaagscctccaagtgcgggtaagttgtgttccctaagacactaaataataagatggttttgctgtacttggaggggagcgctagtttagagttttataaatggat

SEQ ID NO: 62222 - DNA, 201 bp, Homo sapiens
cagaaacgttgacatgaagtaacattgtgttttacagttatcaaagtcaccattatgtttttctgtctgtcttcattaggggtatgataatgaaactgccrtattggatactctattaatgtcttgagatgtctggtgctttgttattttttaacatcatgagaaataagaagccactattaatgagtgatacaatttggc

SEQ ID NO: 62223 - DNA, 201 bp, Homo sapiens
agaaagggagggaggaagcaaataagaaaggaaagaaggattttatgttattcctaatggatttctccacaaagtgaaatagactataagagtggtcaacrtggaataactgctgccaaaccctttctgcttctattgtgggcccaagagttcaatttattcagaaggaaattgacatttattttagaaagcatgtctgct

SEQ ID NO: 62224 - DNA, 201 bp, Homo sapiens
accagccaagttttgctgtaacctaactattaagaaggccctttcaaagatataaatgttttgtagctgagcccctgtttaaggagtctcccccatgtccycccctcctctgttccaggaccggccacaggccattagcaaaggagagccagagaagaaaactttgactctgactttccccctaaatctcccagactctca

SEQ ID NO: 62225 - DNA, 201 bp, Homo sapiens
atgtccaaataactgcaacactcatgggttacagagtgttttcgtgtacattgcctcagctggtcttctcagcgctcattgtaacatctcccagctacctytcattcaggaaataattaggcagtctccttttaactttgcatagtcctagccattaagagttgctttaggattgatctggaagaatttggcactttcttt

SEQ ID NO: 62226 - DNA, 201 bp, Homo sapiens
agagaggtcaggactgccaggtagatttgggagtccccattataaaggaagagatagtcaagtatcttattacagtgagattaaggagatgcagtccagtrcaagaccttaggatttggccatcaggagatcatttattatttgaaaatgaaaaccaggttgccacagcttaaagttgaggcacccaatctgggggctcag

SEQ ID NO: 62227 - DNA, 201 bp, Homo sapiens
tttaaagctttacaggatttattgcttattaaaagcattgggcctctgcaagtatagatagagtacaattatatcaacgctcagaagagagagagattgcrtccagctgaggttggtaaacaaaacctatccaaggaagtacaattagaatagccatcaaagcacttaagggaaaaaaagggtaggtaaggagggaatagc

SEQ ID NO: 62228 - DNA, 201 bp, Homo sapiens
atttttgttaggtatatttgatcaggttaaggaagttctcttcaattgccatttatttatttgccatgtgttaaaaaattgtgaatggatattgagtttcrttgaacttttaaaatacatctatatagatataatcatataagatttctcctttaatgatattaataggtacttttcatgttaaaccacttgaattcatgg

SEQ ID NO: 62229 - DNA, 201 bp, Homo sapiens
tggatagtgtcttctttttgtccatgaattaaaaggcaattaatttaaaaagatcattttttctgagacaaggtctcactttgttacccaggctggaatgyagtggtgcaatcatggctcactgcagcctcaacttcctagacttcagtgatctttccacctcagcctcccctagtagttggggccacaggcatgtgccac

SEQ ID NO: 62230 - DNA, 201 bp, Homo sapiens
ctttgggtcttctttaatatatttattatataattatacaacttttgtttaaaacattttttgctactgttgtggatagtgtcttctttttgtccatgaawtaaaaggcaattaatttaaaaagatcattttttctgagacaaggtctcactttgttacccaggctggaatgtagtggtgcaatcatggctcactgcagcc

SEQ ID NO: 62231 - DNA, 201 bp, Homo sapiens
atccatcttttgcatcttgtaacttctctttgtgcatcctggtaatccttttgtcattctcctggcatttatagcatacttgaaacttgggactccatggwctttcagaacttttccaggtttaaacagagagctctggggacaatgtatttcccaagagagagaaaggctaagtactccaattattattattcattttgt

SEQ ID NO: 62232 - DNA, 201 bp, Homo sapiens
tagagtaagtgtgatgtggtgctcagaatgtatattctgttgatttggggtggagatttctgtagatgtctgttaggtcacttggaccagagctcagttcragtcctgaatatccttgttaattttctgcctccttgaggtgtctgatatacacagtggggtgttaaaatctcccactattattgtgtgggagtctaaatc

SEQ ID NO: 62233 - DNA, 201 bp, Homo sapiens
gtcatttggtttgattgccccacaaagcataagatgtaaactgattaagggtatgaaagcaaagtgaaagacctcagatcttgtgcacattttgttttccyattatttcttttattgactgtagtgcatgatacctaatcaaggctccaatgtcttgcacaattcctactttaatgctagtggttttcagtgtccttacaa

SEQ ID NO: 62234 - DNA, 201 bp, Homo sapiens
aaggttatttttagaaatgactgggtgcccttttgcaaaaactgttttgaactatttatatgaattgtagtatcaaatagtgccaaatttggatacaaatrtccttttaggcagcaaagtactatttaaagtatgaattaaagtatttggaaaatgtttgcccttatcgtttaacacattcatgttttactcgtgaattaa

SEQ ID NO: 62235 - DNA, 201 bp, Homo sapiens
tatgaattgtagtatcaaatagtgccaaatttggatacaaatgtccttttaggcagcaaagtactatttaaagtatgaattaaagtatttggaaaatgttygcccttatcgtttaacacattcatgttttactcgtgaattaagcacaaatcgtagaacagatttgtattggtacagccaatgtatttgagtggagcccaa

SEQ ID NO: 62236 - DNA, 201 bp, Homo sapiens
cataacaggaacttagtcacttgtaggtttgtaaatgtgattcaaggatttctgtgaaatttgaatattgctaccaagtgctgcttcatttcattttcacrcctacctactcagtgagtggaccaccagttaggtaatactgcatgttatcttcccaaaagtgtgaacaaggagggttatataaggcattttatactttgt

SEQ ID NO: 62237 - DNA, 201 bp, Homo sapiens
ttaatcaatattgttgactattttataaatatttcaatgcctactatgtgcctaaaagtattctatgagaaatgtattgaatctactttttgaatcttcaytgggtttcgggatagaaactttagagtcaaatgaattttctgggattcactgtacatcaactaatcccctagtcttaatttaaatcttttcaacatcagg

SEQ ID NO: 62238 - DNA, 201 bp, Homo sapiens
ccctttcttaatgagactttctaaattttaatatgatggataactcaattttaaagtatagtttctattttttatagcagctttattgagatataattcayataccataaaatttttagtatacttgcagaattggtcagccacaatcaattttagaaatttccatcaccccatccctggctcacattagccacaggcagc

SEQ ID NO: 62239 - DNA, 201 bp, Homo sapiens
cctgccacagagggagatactcttacaaatggagcttttcttcatagatctaagtttcccttacaaaacagtatcttctactctgttttttttttttttaattatacttttaagttttagggtacatgtgcacaacgtgcaggttagttacatatgtatacatgtgccatgctggtgtgctgtacccattaactcatcatt

SEQ ID NO: 62240 - DNA, 201 bp, Homo sapiens
tttgaatatttgcaatactttatgtattaggcaagcctttgtgacatattcaacaatatctttacaccagatagtagagaataagcagaaaaaccacaatragtgatgcacataggtcttggcctcatgtgggggcattgtggggaacctggcattggcatatcccattggcatatccacctgcacatgtgccattttatt

SEQ ID NO: 62241 - DNA, 201 bp, Homo sapiens
tgaaggaaaagtgcaccttatttgacctcagctgggaacgtgcccattgggcaactcaaagtttttgtcactctgacctgtcagcaaatgccaaaaaagcyctacagatttgaggtaacaaataagttttagcaagtgggcaacttttcaaatattgaaatccacgaataatgagaattgactacaagtagttttgccaaa

SEQ ID NO: 62242 - DNA, 201 bp, Homo sapiens
ggtcagcaacgcacttgaggaggcaatctgatgcttagcagagcttaagcactgtgctgggagactccctgctctcttcagagctggcaggcaggagtgtktaagtctgctgaagctgcgcccagagccaccctttcccccaggtgctctgtcccaaggagatgggagttttatctataagcctctgactggggctgctgc

SEQ ID NO: 62243 - DNA, 201 bp, Homo sapiens
gcagtgacctctaccttggccctgactcagctggtatgatggttctttgtgcaaatattttctcaaccttcaatttgtcacaagtagctaagcattatccygtgaataatagatttatgattttgctagcattagcacagtgactaggatactaacttattccagctgtgtttcctgggtttgagttttcttcccaggaac

SEQ ID NO: 62244 - DNA, 201 bp, Homo sapiens
ggcacaaatctactttctgtctctatacatttggctctcctggccatttcatgtaaatggaatacagtatgtggtcttttgtgactggcttttttttttttaactagagaaacgttttcaaggttcattcatgttgtagcatttatcagtacttaattcatttttattgcaaaataatattccattgacttgataatacca

SEQ ID NO: 62245 - DNA, 201 bp, Homo sapiens
cattactttttagcacaagaagaatagcatcactaccaaaaccagctgagatatcttattttatttatttatttatttatttatttatttatttatttatttagatagagtctcactctgttgcccaggctggagtgcagtggcatgatcttagctcttggcaacctcggactgccgggttcaagcgattcttgtgcctca

SEQ ID NO: 62246 - DNA, 201 bp, Homo sapiens
gcattactttttagcacaagaagaatagcatcactaccaaaaccagctgagatatcttattttatttatttatttatttatttatttatttatttatttatttagatagagtctcactctgttgcccaggctggagtgcagtggcatgatcttagctcttggcaacctcggactgccgggttcaagcgattcttgtgcctc

SEQ ID NO: 62247 - DNA, 201 bp, Homo sapiens
aagaaattgttgatcgtgtgcaactgtttgagttgcattactttttagcacaagaagaatagcatcactaccaaaaccagctgagatatcttattttattwatttatttatttatttatttatttatttatttatttagatagagtctcactctgttgcccaggctggagtgcagtggcatgatcttagctcttggcaacc

SEQ ID NO: 62248 - DNA, 201 bp, Homo sapiens
gctctggttaccctaacaggagttggcgattttctgaattgtgtcaataccacatttacaaatcattttttttcatatctgagggacatcagtggaaattrggatggagaagtcccattataactggctaaatgataagcatctaacggaatatcaaattagaggaagtaaaagatttttttctagagatttgtaaaacag

SEQ ID NO: 62249 - DNA, 201 bp, Homo sapiens
gctacagtagcagtgttgagtcgttgtgacagagactgtgtatctcacaaacctaaaatattttactctgtggcccctgaaaggtaaagaaagcttcctgwtgcctggtctagaagtatattttcttatactcaaaattgctggataaactctgaaaatggcttcatcattggttgccatttatctagaatttttaaaaag

SEQ ID NO: 62250 - DNA, 201 bp, Homo sapiens
atttcacacagtagacactttaatttacaacttgctgcactgcagcacttttctaggccttttactatgtaataaggcattcttgtagctgctgaggcttyacaaatatagatacactttcttagttcagattttttctttcttttcaattttcagttgcaaatcaaacatgcagttacagaagcagagattcaaaaattg

SEQ ID NO: 62251 - DNA, 201 bp, Homo sapiens
tttagatttctctaatggctaatgattttgcatctttttattgcctttttttgcaatcatatgtgtatcttattttgtgaaaaatttgcttaaatattttytgattttttaaaaattaagttgttttcttactgttttaagagttatttattctgaatataagtaatatatttattctgaatattttgttgaagtccgctt

SEQ ID NO: 62252 - DNA, 201 bp, Homo sapiens
cagctagaatagttcacgtctttgtctcctgaattctttatattgttgtaattcaaaatattttgtctattcattcagtgaactaaccaagagcattatcygtattgtcatatttcatgatggtgcttttgatattcagctattggttttacttagtgggaaataatgaacgtacaagtaattgtttctgtaggtcttagg

SEQ ID NO: 62253 - DNA, 201 bp, Homo sapiens
aaaacgtgtagaaaagctggaacttttcccagtggagctagagaaaggttcgtgagtgctacagtgttaatatcattatgttgctatgttaataatacagrattatttttccaaaatgtagccttttttctaaggattggataaaattttaattctaacagaggatcttatttattaagtttcaaaaatagttgatatgga

SEQ ID NO: 62254 - DNA, 201 bp, Homo sapiens
tattttattgaggatttttgcatcaatgttcgtcagggatattggtctaaaattctctttttttgctgtgtctctgccaggctttggtatcagggtgatgyttgcctcataaaatgagttagggagaattctctctttttctattgattggaatagtttcaaaaggaatgggaccagctcctttctgtacctctgatagaa

SEQ ID NO: 62255 - DNA, 201 bp, Homo sapiens
cccactgatttcttggttatttcttggttacaggctgtcatggtggtcacctgatccttacctgatgttactggttaccttgagattttatcagtgtctgyggtctcttcatcagttctctccaaaggtttctctcactgattatctttcaatattcttagacttgaatgaagcagtcccagagacagagcgcctggattc

SEQ ID NO: 62256 - DNA, 201 bp, Homo sapiens
ttcagtatgatactggctgtgggtttgtcataaatagctcttattattttgagataggttccatcaatacctagtttattgagagtttttagcatgaaggsctgttgaattttatcgaaggccttttttgcatctattgagataatcatgtggtttttgtctttggttctgtttacatgctggattacatttattgatttg

SEQ ID NO: 62257 - DNA, 201 bp, Homo sapiens
tttgtattatagagcatacaatccaaatatgagctagataaggcataaaacgtgcaagtactacatacagtgtttctaattatattacagctttcatctaygtggtgttccacattttatatttaagcaagagcttataagattgactctctcccagttatcacaactaatgaactcttaatgggcagctacaaatataga

SEQ ID NO: 62258 - DNA, 201 bp, Homo sapiens
gtcatctgcaaacagggacagtttgacttcctcgtttcctaatcgaataccttttatttctttctcttgcctgatttccctggccagaacttccaacactrtgttgaataggagtggtgagagagggcatccctgtcttgtgccagttttcaaagggaatgctttcagtttttgcccattcagtatgatactggctgtggg

SEQ ID NO: 62259 - DNA, 201 bp, Homo sapiens
actagagtaatcatggtagcgcattaattagttatgtaaatgagggcatgctactcaagttctctgagcttcaggagagaaaaaaaatacttgattggtayctcatggggctgttgtaaggaacaaatgagatagagtatgtggcatgatttgtattatagagcatacaatccaaatatgagctagataaggcataaaacg

SEQ ID NO: 62260 - DNA, 201 bp, Homo sapiens
tttttccaattctgtgaagaaagtcattggtagcttgatggggatggcattgaatctataaattaccttgagcagtatggccattttcatgatactgattyttcctatccatgagcatggaatattcttcaatttgtttgtgtcatcttttatttcattgagcagtggtttgtagttctccttgaagaggtcgttcacatc

SEQ ID NO: 62261 - DNA, 201 bp, Homo sapiens
gtgaagtttacttccagacttgagattgaccttccagaaggagaataggcttctgaagcctgagctctattcactctctgtcacagattaactgtgtggtrcaagttaatacacaaattgaccttctttaagcctcagttttcttatatgagaaataagctgggaccagaatcccaaggttattttgagttgtaatattag

SEQ ID NO: 62262 - DNA, 201 bp, Homo sapiens
tgttacaagttgctgtgattattacagagaagagtttctttttttaatttaatttaattttttttaattatactttaagttctagggtacctgtgcacaaygtgcaggtttgttgcatatgtatacacgtgccatgttggtttgccgcacccattaactcatcatttacattaggtatttctcctaatgctatccctcccc

SEQ ID NO: 62263 - DNA, 201 bp, Homo sapiens
gctggagttcagtggcatgatctcggctcactgcaaccactgcctcccaggttcaagcgattcttctgcctcagcctcctgagtagctgggactacaggcrcgtgccaccatgcccggctaatttttgtatttttagtagagatgggatttcaccatattggccaggctggtcttgaatccctgacctcatgatccacccg

SEQ ID NO: 62264 - DNA, 201 bp, Homo sapiens
gtcaaaaataacgtcaatctagtgaaaaaaactgtatgactcacagtattactgtagggaactggtctctgtgtaatatgatatatagcatcctaatttcwtagagcatttttcataacagctgctaaaatcatcaaatccattaaattcttttaaaggatccaatttgtagcagtattgaaaatagtcttaaaatgcagg

SEQ ID NO: 62265 - DNA, 201 bp, Homo sapiens
acgccatcacacctggctaatttttgtatttttagtagagacagggtttcaccatgttgttgaactcctgacctcatgatctgcccacctcggcctcccaragtgctgagattacaggcatggcatgagccactgtacccggcctctttccagtttttctatgcaactatatgcatatgtttaccactagaaaatgtattt

SEQ ID NO: 62266 - DNA, 201 bp, Homo sapiens
gtattgttagtattttggattttggctattctaatacatgtagtgggtatcatgttgttgttttaatttgcagttccctaatgacatatgtggagcatctkttcatctacttatttaccatgtgtatatcttcattggtgggatatatctgtttaatcaaattgattgttttgttattgttggcttttaagaatttttaaa

SEQ ID NO: 62267 - DNA, 201 bp, Homo sapiens
atttcttaaaccttggtaaaattgatcccacatttgtggctaaccttgtaagtattatggggaaggagaccctccaattcattttaaattgtgattatatrgcatttgcataggcctgagatgttttccttaagttcgactattgtgtatatgatattctaatgtgttacttaaaatatgctttcaaacactgggtataat

SEQ ID NO: 62268 - DNA, 201 bp, Homo sapiens
atgtgaggatctagctttatttttcttcataaggttagcataatttcctaataccatttattgtataatccaccttctcttcattattttgacatattttrtatctcataaaccaaagttttatatatttgaatttggatctttctggactctctgtttcatcaatctgtctactcctacactagtaataacaattattgt

SEQ ID NO: 62269 - DNA, 201 bp, Homo sapiens
tatttcttaaaccttggtaaaattgatcccacatttgtggctaaccttgtaagtattatggggaaggagaccctccaattcattttaaattgtgattatayagcatttgcataggcctgagatgttttccttaagttcgactattgtgtatatgatattctaatgtgttacttaaaatatgctttcaaacactgggtataa

SEQ ID NO: 62270 - DNA, 201 bp, Homo sapiens
ggaagattgaggctgcagtgagctgtgattgagccaccacactccagcctgggcaacagagcaagaccctgtttcaaaaaagaaaaagaagggctgggccygaaatctatgattttcatatctgtattatatacagtttcttgcttagcgtctagaattacctattatttaggatagattcctaaaaaaatataattttat

SEQ ID NO: 62271 - DNA, 201 bp, Homo sapiens
aaacctgtaagtaagtcttttgaaaaataaaggctggctggaagattgaggctgcagtgagctgtgattgagccaccacactccagcctgggcaacagagyaagaccctgtttcaaaaaagaaaaagaagggctgggcccgaaatctatgattttcatatctgtattatatacagtttcttgcttagcgtctagaattacc

SEQ ID NO: 62272 - DNA, 201 bp, Homo sapiens
gctggttcttagcaaagatcgatatttttgataagcctctaaccaggctaagaaaaaaagagagatgacacaaattagtaatattaaaaatgagagagaamaattcactgtggatggcatgggcactaaaaggacaataaaagaatattatgagcccctctgtgcccacaagtttgacaaccaagatgaaatagaccaatt

SEQ ID NO: 62273 - DNA, 201 bp, Homo sapiens
atgttttattcttttttttttttttttgagatgaagtctcgctctgtcacccaggctggagtgcagtggtgtgatctcggcccactgcacctctgactcckgggttcaggcgattctcctgcctcagcctcccgagtagctgagactataggcatgtgccaccacgtctggctaattttttatatttttagtggagacggg

SEQ ID NO: 62274 - DNA, 201 bp, Homo sapiens
tgaaggatgacttgggtatcttggtcttctttttcattttcttttttttttttttttgaaatggaatcttgctctgtcacccaggctggagttcagtggcrtgatctcggctcactgcaaccactgcctcccaggttcaagcgattcttctgcctcagcctcctgagtagctgggactacaggcgcgtgccaccatgcccg

SEQ ID NO: 62275 - DNA, 201 bp, Homo sapiens
aaagataataagcactaatgttaaatgctacttagcaaatggatgcaaagctttgacagtaattttaggttatttctagatagtgtggacttaaaaaaagytttttagaaagctgttttcagttgacttagagttacttgtaatctgttattatcaaggtcaccccatggaagatctctgaatacccaatgaggcaagtgt

SEQ ID NO: 62276 - DNA, 201 bp, Homo sapiens
agcctcccaaagtgttgggtttacaggcatgagccactgtgcctggcctacgttttttttaaaaaaaacttattattacagataattatcttgtgggcatmttttcaccttgtattacagataattttcttttcaacctccagctggtgttattttcaggtgaagtcttcatcttaggctattatacatacatatgtacat

SEQ ID NO: 62277 - DNA, 201 bp, Homo sapiens
gaagttgtctggctgtggtgtccaggcacttttaattgaaagggaatctctgtgttatcgtggtatcagcagctatcaaataataggcattccatcaaacrgcaagggtgacctcttccaagatgcacataaactgctgcctgttcctactttggtttctgatagttattttttctcttaaccaaaagataattacagata

SEQ ID NO: 62278 - DNA, 201 bp, Homo sapiens
ccactgcacctctgactcctgggttcaggcgattctcctgcctcagcctcccgagtagctgagactataggcatgtgccaccacgtctggctaattttttrtatttttagtggagacggggtttcagtgtgttagccaggatggtctcgatctcctgacctcgtgatccacctatctcagcctaacatgttttattcttaa

SEQ ID NO: 62279 - DNA, 201 bp, Homo sapiens
agagcccaagatccttcccaagttgaatttacattaaggagataagatttctccctccaccctccccagaggctgcagaggggacagctttccctctcctrtataatcaaccagattcatgtttttggagttcctcacctagagtgtagaccatgtgtaggatgacatctggttcccccagcatgctgatctcaatatttt

SEQ ID NO: 62280 - DNA, 201 bp, Homo sapiens
tacggcattgtttattatgttggattttagttctttggtgagtcatgcataatacattatctgttatatttaacatgttttattcttttttttttttttttgagatgaagtctcgctctgtcacccaggctggagtgcagtggtgtgatctcggcccactgcacctctgactcctgggttcaggcgattctcctgcctcag

SEQ ID NO: 62281 - DNA, 201 bp, Homo sapiens
aagatatatgtaaatgagttcattacttataagagatattacataaaccatttaaatgccaggaaacagctacctctgaaatggtatctttggattatgargacgaatttgaagccattctttctcccagttcctaggagtgacttatgattctcttttttccaaaaatgatagcaagccagtaaattatagctaaaaaag

SEQ ID NO: 62282 - DNA, 201 bp, Homo sapiens
tattttttacctaatttctacacaattagtttcttttgattttgcactgttattcaatgcaatacctgaaagaaataagttttttttttttttttttttttgtcaaggctcacacaccagaagaactaatgataaatattctttgtaatcttctagaaattttagatgcatatataaatacatatatatataaataaatac

SEQ ID NO: 62283 - DNA, 201 bp, Homo sapiens
atggaataactagaagaaaatacaggggttacaactagaaatagagaacagagagggcttcaaaagtaataattttatagtttaggcttgatggaggtacrtggttgtctttttttttttctttcttcatatgagttacatatatggtatacatttttatataaatgttttagactagaaactttaaaataattaaaaggt

SEQ ID NO: 62284 - DNA, 201 bp, Homo sapiens
ggtagcttgaagctgttcttttagctttgctgcagatttataaaatgttcaacatttccatttacctctggacaggctgtagttttttttgttttttttttgttttttttttttttaaggattaagatccttgaagctagaggtctttgaaactgcatctgagtggaagaggtctagtgtaaagtgactcattcttaaaca

SEQ ID NO: 62285 - DNA, 201 bp, Homo sapiens
ggggcaccttccagatgccagtcagatctctcctgtatgaggtatctgtcgacccctgctgggaggtgtctcccaatcaggaggtacaggggtcagcaacscacttgaggaggcaatctgatgcttagcagagcttaagcactgtgctgggagactccctgctctcttcagagctggcaggcaggagtgtttaagtctgct

SEQ ID NO: 62286 - DNA, 201 bp, Homo sapiens
tatggcttaaattaatctgaattctaatttaccttttaccttgagcttggctgctgttttcaatttatatgcattttatacattaactgctaccctcaatytcctgtcaactttgtagtaagtgatactctgtcaaatgctactctatgatgcatttaaataaagataaaaggtcaatctaggcttttctaaagttaccat

SEQ ID NO: 62287 - DNA, 201 bp, Homo sapiens
attgatacttgtgtatgcttcacgaagttctcgtgctgtgttttttagctccatcaggtcatttatgttcctctctaaactggttattctagttagcaatwcatctaaccttttttcaaagttcttagcttctttgcattgggttagaacatgctcctttagcttggaggagtttgttattacccatgttctgaagcctac

SEQ ID NO: 62288 - DNA, 201 bp, Homo sapiens
cagtgcctttttttatttctctaagtgtgtacttcatttccagaagttgtaattgtttttctttatggtatctgtttttctggagcatttttcatccatayactgtattttttccttaatttctttaagctggttttcatctttctctggtatctacttgagtagtttagtaatcaaccttctgaattctttatctggcaa

SEQ ID NO: 62289 - DNA, 201 bp, Homo sapiens
cactgcaagctccgcctcccgggttcacgccattctcctgcctcagcctcccaagtagctgggactacaggcgcccgccactacgcccggctaattttttrtatttttagtagagacggggtttcaccgttttagccgggatggtctcgatctcctgacctcgtgatccacccgcctcggcctcccaaagtgctgggatta

SEQ ID NO: 62290 - DNA, 201 bp, Homo sapiens
aagaggtccttcacattcctttaagttgtattcgtaggtagtttattctctttgtagcaattgtgaatgtgagttcacgtattatttggctctctgtttgtctcttattggtgtataggaatgcttgtgatttttgcacattgatttttttatcctgagattttgctgaaattgcttatcagcttaaggagattttgggct

SEQ ID NO: 62291 - DNA, 201 bp, Homo sapiens
gaagaggtccttcacattcctttaagttgtattcgtaggtagtttattctctttgtagcaattgtgaatgtgagttcacgtattatttggctctctgtttgtctcttattggtgtataggaatgcttgtgatttttgcacattgatttttttatcctgagattttgctgaaattgcttatcagcttaaggagattttgggc

SEQ ID NO: 62292 - DNA, 201 bp, Homo sapiens
tgaagaggtccttcacattcctttaagttgtattcgtaggtagtttattctctttgtagcaattgtgaatgtgagttcacgtattatttggctctctgtttgtctcttattggtgtataggaatgcttgtgatttttgcacattgatttttttatcctgagattttgctgaaattgcttatcagcttaaggagattttggg

SEQ ID NO: 62293 - DNA, 201 bp, Homo sapiens
ttgaagaggtccttcacattcctttaagttgtattcgtaggtagtttattctctttgtagcaattgtgaatgtgagttcacgtattatttggctctctgtttgtctcttattggtgtataggaatgcttgtgatttttgcacattgatttttttatcctgagattttgctgaaattgcttatcagcttaaggagattttgg

SEQ ID NO: 62294 - DNA, 201 bp, Homo sapiens
gaagctaaaagaattcattacctggagaatactattataagaaatgtcaggggaagtctttaataatgtaaataatataaaacgaaattctagacctacasaaggaaatgaagagaaatagaaattatgtgggtaaatataggctacttcattttttaaaaaattatttaaaggattattaactttttaaaacaaaggaca

SEQ ID NO: 62295 - DNA, 201 bp, Homo sapiens
catttctcaaaataagacatagaaatgactgatatatgtgaagatgctcaacatcagtaatcatcagagaaatgcaaaataaaactgtactaagatatccrcttaccccaattagaatggctgttattaaagagacaaaaggtaacagacgctgacaaggatgtggagaaaaaggaactcttacacaccactgctggggat

SEQ ID NO: 62296 - DNA, 201 bp, Homo sapiens
tcaacccaacaacaacagtgtaacaaatgggtaaaagaaatgatttgacaatttgtggaagtagacaggtgacttacaaacatatgaaaaaatgtttaccygcactagtaatcagtgaaatgcaattgaaatcacattgtaatatctttttacagctgtatgattggcagtacttaaaggatctgagcataccaagtattc

SEQ ID NO: 62297 - DNA, 201 bp, Homo sapiens
ttacagaagacagaatgggagacactataattttgctttggggtactttaaatctgaggtgctatcaagtcacctaactggtccagaagtatgaactgtcyatacagaatcaggaacccaggtaggaggtacagatgattgctgcatttgattttttgcttacagagcattcacctatttattttaataaagaaattacca

SEQ ID NO: 62298 - DNA, 201 bp, Homo sapiens
ttcaacttaattttaatagctaatggcaattgccatgtatggatggatatgagaaagttttcagaaaaatgagatatttatcttgaggaagatttggctgktgggaggaggagacataatagcttttttcagatattcagtgtaagtgagtttgcacaagttttaaaatctttggaagctaacttgatatcagcaagcaaa

SEQ ID NO: 62299 - DNA, 201 bp, Homo sapiens
gattcatgcttctctgcaacatggatgaacctggaggacattatactaagtgaactaagtcaggcacagaaagataaatactgtgttctcactcatatatrggagctaaaacatgagcggatagaggtagagagtagaattgtggttattagaggctaggagaggttggttaacagatacaaaattatagctagaagagag

SEQ ID NO: 62300 - DNA, 201 bp, Homo sapiens
tcaaggctgtttcattctgtttccaggtaaaatttggggcttgaggtactcttcccaaggtactcaagacctcagagtttaatgtttgcttttcatgatastctttaccccactctcccttccattcagaggtccagtcacccctgggggattttcatgggagagtgtaaacttctgtactggagaagcttaaaagtctca

SEQ ID NO: 62301 - DNA, 201 bp, Homo sapiens
ccttgtgcttccccttcttagcatctagtattttctgttctactttacttctatgagatcaacatttttttagcttcctcatatgaatgagacatgtggtrtttaactttctgtttttggcttattttacttaacataatgtccgccagttccatccttgttattgcaaattacaggatttccttcttttttatggctgaa

SEQ ID NO: 62302 - DNA, 201 bp, Homo sapiens
tagtttacctttctttgggctagctcacatggattacagaagtgagcttactatttatatgaacaaatataaattgacctttactttctctttttttcccrtagttttgcaagaaaaaacttacttttatgatttttacatgtattaatctttacatttccttttcctcctttttgtacattaactgctgaattcagagtt

SEQ ID NO: 62303 - DNA, 201 bp, Homo sapiens
ttttaaaatttcaattttcggtgctagtatctagaaatgcagtgggttttaaaaatacttttattttatatcttttaatcttactggactctattagtagmagtagcttggaaattttgtcagattttttacccagactgccatgttgtctgtgaataaagatacttttacatcttccttttctctttgctcgagttactg

SEQ ID NO: 62304 - DNA, 201 bp, Homo sapiens
tgaaactagcagagtggtaaaattaactaaaagcttaactatctaaaaaacataataatatcttctagatagaaatatgggtcccagattatccattcctsaaatgctctataggattgtgtatttatgtggcaatattaaaaaacgtggaacagataacttgctataaataagccacaacttagaattcatgcttttagt

SEQ ID NO: 62305 - DNA, 201 bp, Homo sapiens
tagtatctagaaatgcagtgggttttaaaaatacttttattttatatcttttaatcttactggactctattagtagaagtagcttggaaattttgtcagaktttttacccagactgccatgttgtctgtgaataaagatacttttacatcttccttttctctttgctcgagttactgaactggctaaagcctccagctgaa

SEQ ID NO: 62306 - DNA, 201 bp, Homo sapiens
cctgactaccttgtcaaataccaaaaagttcagttttgcagccagagaatatcctgtttgaaagactttgtgatgactcattttatgggtcaacgttggtrggccacagtacccagatatgtgggtaaacattattctagagtctatgaagtatcttttagatgagatgaacatttaaagcagtgggctaaagcagattac

SEQ ID NO: 62307 - DNA, 201 bp, Homo sapiens
aagcctaacaaatttatttaaccgaagttttatctgacacaagagccctcagaaatgaagacttaaagacccagggaaaactgtgtattttttttttcatwggtgcgatgaacaaataaatagtcatgtagaagtatgattggactgaaaagatataatctattgggatcatagaggaaacttagaaaggcctgtttgttc

SEQ ID NO: 62308 - DNA, 201 bp, Homo sapiens
gtgaaatgaatgatgttgaagatacaggggttagccttagaaatattttatgtaactagactttgggtcaggcgaggcttgcagattaacagcttttggartaataacctaactagtactccatttgatcctgttttgtggtatgtaggattctggtgagtgatccacttagaaggttaaatgtatcctactgtagaatgt

SEQ ID NO: 62309 - DNA, 201 bp, Homo sapiens
atgcacttaagttatatagaaataattttatccttttggatcttgctttaaaaagttttgaacagtacaagaacagcatctggtccatggctcataattayttcactagtgagacaaagtccttctgaatacccagtctatttctccataaattacaatgttttccagtctggtagaaggactggatatatcttggggaaa

SEQ ID NO: 62310 - DNA, 201 bp, Homo sapiens
ctatcatttgaccaagcactcccactactgaatatctccccaaaggaaaagaaatggtatcaaaaagagacttgtgcttgtatgtttaacagaatactatycaatggaaatagtcttggaaatagcaaagtcatggaatcaacctaagtattcatcaatagatgactggataaagaaaatggggcatgtatacactatgga

SEQ ID NO: 62311 - DNA, 201 bp, Homo sapiens
attacccattgcttgtttttgtcaggtttgtcaaggatcagatggttgtatgtgtggcattatttccgaggcctctgttctgttccattggtctatatatytgttttgggtagcagtaccatgctgttttggttactgtagccttgtagtatagtttgaagtcaggtaacatgatgcctctagctttgttctttttgctta

SEQ ID NO: 62312 - DNA, 201 bp, Homo sapiens
atttatgaatcacattttaaaattcatatctgaaattttttattggatgttggatattatgactattatactattgtctagattttattatcttcttttamattttttgaaatttgttttgagtgctgtcaaagctactgtggtttagcttcattttttgaggcttttatcaaaacttcgttatagtgggtctggtgacac

SEQ ID NO: 62313 - DNA, 201 bp, Homo sapiens
tcagaactcaagcatcttgcagcccagtgagaccactgggaattatttagcttgcagctccccagtaataggtcacccagtctcatagaattttctcctcygtgtatatgtgtaacttagtagttagctattggcgtaaggggcctctgtgaagatttctggagtttttctctgccaagctctgagctcactagtactcag

SEQ ID NO: 62314 - DNA, 201 bp, Homo sapiens
aaatggtatttctagttctagatccttgaggaatcaccacaatgtctttcacagtggttgaactaacttacactcccaccaacagtgtaaaagtgttcctrtttctccacatcctctccagcatctgctgtttcctgactttttaataattgccattctaactagcatgagatggtatctcattgtggttttcatttgtat

SEQ ID NO: 62315 - DNA, 201 bp, Homo sapiens
tgtccctgcaaaggacatgaacttatcctttttatggctgcatagtattccatggtatatatgtgccacaatttctctatccagtctgtcattgatgggcrtttgggttggttccaagtctttgctattgtgaacattgctgtaataaacatacgtgtgcatgtgtctttttagtagaatgatttgagtatatacccagta

SEQ ID NO: 62316 - DNA, 201 bp, Homo sapiens
tacataggtatacatgtgccatggtggtttgctgcacccatcaacctgtcatctacattaggtatttctcctaatgctatccctcgcctaaatccccaccygctgacaggccctggtgtgtgatgttcccctccctgtgtccatgtgatctcattgttcaactccaaattatgaatgagaacatgtggtgtttggttttct

SEQ ID NO: 62317 - DNA, 201 bp, Homo sapiens
tctatacccctattctattcatttgtagaatgttgtctgtaatacttgattggattttctatttctttggctgttaagataattaaataccttttcaccaagctttaaagatccttgaactatatggacttctttctctctctctctttttttttttttttcttcatgttcttcctatctggcagaagcacagaaatctta

SEQ ID NO: 62318 - DNA, 201 bp, Homo sapiens
ggtctatacccctattctattcatttgtagaatgttgtctgtaatacttgattggattttctatttctttggctgttaagataattaaataccttttcaccaagctttaaagatccttgaactatatggacttctttctctctctctctttttttttttttttcttcatgttcttcctatctggcagaagcacagaaatct

SEQ ID NO: 62319 - DNA, 201 bp, Homo sapiens
tggtctatacccctattctattcatttgtagaatgttgtctgtaatacttgattggattttctatttctttggctgttaagataattaaataccttttcaccaagctttaaagatccttgaactatatggacttctttctctctctctctttttttttttttttcttcatgttcttcctatctggcagaagcacagaaatc

SEQ ID NO: 62320 - DNA, 201 bp, Homo sapiens
tctctctggctgcccttaacattttttccttcatttcaactttggtgaatttgacaattatgtgtcttggagttgctcttctcaaggagtatctttgtggmgttctctgtatttcctgaatttgaatgttggcctgccttgctagattggggaagttttcctggataatatcctacagagtgttttccaacttggttccat

SEQ ID NO: 62321 - DNA, 201 bp, Homo sapiens
agtctagctgcttgggtgtcatgcttgacaggggttaaaacttgaagttccttatctcttaaacatttttatgtttctgagttcaatcctgttaagattaytgacaacattcttggaagactgtgtcctaaggaaggaagaattttgaaaataaatgattttgctagatagaatgggagaaaagaaattcttggagtacat

SEQ ID NO: 62322 - DNA, 201 bp, Homo sapiens
ttcaagagaaaattagctgcaattaagaaccttctttttattgtaaacatattgagtgttaatattctttggttctagtttatttctaaacaaaaacctgygtgccatagaagtagaattttagatcttttattttctatgtaaaggttgatttcttaactttattcatgttgaatttcatattattctatttaatttatc

SEQ ID NO: 62323 - DNA, 201 bp, Homo sapiens
ccagagatgaattcaagcagtctaagttaactactcttcatgcttggcacatggttgaaagaacaagaagtatatcttgtcaatagcgattgcaaatcctmtaaaatcacctaagtgtatggattttctggatgccttagcacatagccatgtatgtttgtgtgcatatacattatttgtttttgtagatttatatataaa

SEQ ID NO: 62324 - DNA, 201 bp, Homo sapiens
cctcccaaagtgctgagattataggcgtgaaccactgtgcccagccgatggtataacatttaaattggatttccttttaaatttttatgttttatgacctrtgcttcataaccaggtaaatgaaatatgtcaaatattttaatatactttgtaaaatcaaataatgaagatttgttgaatgaaccccttttctaaaatcca

SEQ ID NO: 62325 - DNA, 201 bp, Homo sapiens
tgacagcagattatttcagatgtttactggtatttatttgtaatagaaatatttaaagtttcttgttttttgttaatttaattaattttttttgagacaakgtcttgctctgtcaccctggctgtagtgcagtgatgcagtcatggctcactgcagccctgacctctggggctcaagtaattctcctgcctcagcctccca

SEQ ID NO: 62326 - DNA, 201 bp, Homo sapiens
taatctagcgtcatttcccagtcacttcaggaagcccttcagtagcatactcctgacagatgatgtttcagcttctgcttgaataattctaccgatggagrgtttattactttggaaggtaaaaggaaagttagaaggaggggcatgctggtgtgtgtagggaggtggtgcactcactcttctttttatttaattttaatt

SEQ ID NO: 62327 - DNA, 201 bp, Homo sapiens
ctagacacaggtccatactatataaaacaaaaagggttcagttagtgtattttgatgcttttcttgtcaaaagtgatggatttgtagaaattctcttaatrtacatacagaattaaaataatcgcatatttttaattttaggcctcatgtgtactaagaaaatcttgtccattctgaataatgtgaatttacacaattcat

SEQ ID NO: 62328 - DNA, 201 bp, Homo sapiens
gtgaggtactattttattcatcacactagttattgcctgaatactttgtttgtttgtttgtttttgtttgtgtgtgtgtgtgtgtctgtgttgtgttttgktttttttttttttttgagacagaatctcactctgttgcctaggctggagtgcagtggtgcaatctcggctcactgtaacctctgcctcctgggttcaagt

SEQ ID NO: 62329 - DNA, 201 bp, Homo sapiens
tactgtaaccatctataagatgagtgatttgaagcagatatttatttagtttactatgtattgtctgttggagcatattactatatagtctatattactawtaaatatcattaactagtaataataatggtaacatcgagaggtacttgatattctgtcaggttggacaagtgtgcctcttgaagccttgaatttcttacc

SEQ ID NO: 62330 - DNA, 201 bp, Homo sapiens
gtagcttgaagctgttcttttagctttgctgcagatttataaaatgttcaacatttccatttacctctggacaggctgtagttttttttgttttttttttkttttttttttttttaaggattaagatccttgaagctagaggtctttgaaactgcatctgagtggaagaggtctagtgtaaagtgactcattcttaaacat

SEQ ID NO: 62331 - DNA, 201 bp, Homo sapiens
agaaaacaaattaaaatgcttgaatcacatgatttaccaaaccagttaaacacaaatccagaagcaagaggaaagctatggagtaagttaacacacttcargttcaaaccaggttggaaggaccacgctacctgtcctggataaacaatgttcctatgtcccatctttctttcacataacccttccccattaatgatgtgg

SEQ ID NO: 62332 - DNA, 201 bp, Homo sapiens
ttttagatacaaggatatagagtggttcattattcaaagattcatccacatacaatttaaaggaaaagcccttaaattttttaaatttcatgtcaaattgktatgaaaagatgtcaatttggtaacatttaccactttaaagaaagactgtaaattaacacatgatggaagctgcctaaatttatgcaaactataaattta

SEQ ID NO: 62333 - DNA, 201 bp, Homo sapiens
agttagaaaataagctttgggctccatagtatgacaatagtgtcttccataataacatagtccctctgtctttgccgtcattttatggctgttttgccttrgtgctttgcctgtccctaggaatgtatggagaggaagacagggtgcagctgggttctcgatgggtcagccacaggaataataagtggcctttaaggatga

SEQ ID NO: 62334 - DNA, 201 bp, Homo sapiens
ttctaacttcttgaaaccaatgctgaatttattgtcatacttgattgtttaaatatgagagcagttaaaattatgaacctgtctcttattatgcctttggscacatctcgtttcaacgtgcattcttctcattttcatcacttcataaatagtctatattttttatttttactttcattttctctttgacttgaacaattg

SEQ ID NO: 62335 - DNA, 201 bp, Homo sapiens
tctgcaactggattttcagctctgcaaatctgagtaattttccagttaaaagcaatgagaggagcaatggaaggaagaaagagaattctaccaagacctgwgtctaggcagagaaaatggatttagaaaccaagaagtaattttcactcaagatagttgcaggaagaaattatttaatggtgtgacagtatggagatttca

SEQ ID NO: 62336 - DNA, 201 bp, Homo sapiens
aaattatatgtttgaatatgtgtactcttacgcctaaaataattcattgcattatttagagaatctaggttttaaggcagagtgactattcaataatcaarttgttaccttttcttgagaccacagtgaattaccaacagtagtagtaaaatgatgctaaatgcatgagccttttggaggatctcattagatacccttact

SEQ ID NO: 62337 - DNA, 201 bp, Homo sapiens
gggattacaggcatgagccaccgcgcccagccaagataccttatttaaattaagattcatcatgcagttctgatgtagttcttttgtaagtagtgcggcaraatttttcatacccatcattgtgtcctaaacactcaaaataatgcttcatacatgatataggtgttcaggaagtgtttgtagaatgagaaaataaatctg

SEQ ID NO: 62338 - DNA, 201 bp, Homo sapiens
attctaacttcttgaaaccaatgctgaatttattgtcatacttgattgtttaaatatgagagcagttaaaattatgaacctgtctcttattatgcctttgsccacatctcgtttcaacgtgcattcttctcattttcatcacttcataaatagtctatattttttatttttactttcattttctctttgacttgaacaatt

SEQ ID NO: 62339 - DNA, 201 bp, Homo sapiens
ggaaagagaatattagtgaacaatgacttctactttgagactttgaacaccaagagaggcaggcctcagatgatcaaggtaatgttaattggctaaaaaaattgaggaatattttttgtgagaatatcaaggggaaaaagaggagacagggacatttatttatgattcatatcaaactggaaggtagttttcaattgtgac

SEQ ID NO: 62340 - DNA, 201 bp, Homo sapiens
tccaggtgaaaatttcctacctattggaaatataatttgtagtttttgactgatttatcttatattgataaaagatagggcatttaggaagaatttttatrcatattattttgttttctccctcaacttctttgtaaggtaggtgaacagatgaggtaaatgatgcagataggctaatcgtctctctccaagtcacacagt

SEQ ID NO: 62341 - DNA, 201 bp, Homo sapiens
agaggtagctgaggtgggtgtctccaggtaggacacgtgaagatgggaataagttcaggggacctgagaaaggtgcttggtgcctaaagtcagaggaaagycaaattagggattccttttagggaggtgaggagagcaacttagacgtgatgttgcatttgtgagcttggaacccagagttaaaagaaaatatacagaatt

SEQ ID NO: 62342 - DNA, 201 bp, Homo sapiens
actgttgcgttaaggatcgttttcaacatataacattcaaaccatagcagttggcaatataataaaagtagacccaaatatacgactgctaaattcaaagrattattatgttgttttatgtacatttaatgaatagctttaaatttttttatgtttaagtatgtatcatttgaccatcttatcaagaaataataaagcatg

SEQ ID NO: 62343 - DNA, 201 bp, Homo sapiens
gggcctcccaaagtactaggattacaggcgtgagccactgcacctcgccccaagttgctttcatttttaattcactcttaatttttcacctttttctagatagctagttcagaattattctagatatatacatcttagtaagtatggtgatttaaaattactttggacaactttaagtttactttttttaaaaaaggaatt

SEQ ID NO: 62344 - DNA, 201 bp, Homo sapiens
ttaaaatagggagaggtaactttcaatcccaaacatagatcaaatacttagtaatttgtttgacctataatgctggttctcaaccctggctactctttacratcacctgggagcttcttaaaattaccagtgtgatcttaaccccagagattctgatttattgttggtctgggttagggcctaggcatggttaattggatt

SEQ ID NO: 62345 - DNA, 201 bp, Homo sapiens
ctgttgcgttaaggatcgttttcaacatataacattcaaaccatagcagttggcaatataataaaagtagacccaaatatacgactgctaaattcaaagarttattatgttgttttatgtacatttaatgaatagctttaaatttttttatgtttaagtatgtatcatttgaccatcttatcaagaaataataaagcatgt

SEQ ID NO: 62346 - DNA, 201 bp, Homo sapiens
cctggctactctttacaatcacctgggagcttcttaaaattaccagtgtgatcttaaccccagagattctgatttattgttggtctgggttagggcctagrcatggttaattggattccttaggtaattctaatgtgtagtcagaattgaaaaccactgccttagaaacacacagttgaactttcttttatcttcatatgg

SEQ ID NO: 62347 - DNA, 201 bp, Homo sapiens
tgcaggtttgttacatatgtatacgtgtgccatgttggtgtgctgcacccattaactcatcatttacattaggtatatctcctaatgctatccctcccccytcccccaaccccacaagagactctggtatgtgatattccccttcctgtgtccaagtgttctcattgttcagttcccacctatgagtaagaacatggggtg

SEQ ID NO: 62348 - DNA, 201 bp, Homo sapiens
attatcctagaacagagataatggaagtaatttttcatggaaaaactatatactttcgtttgtaagctgttagaattggcattttgttggttgggtgccargctgctagactatgcaccacgtgggcagggattttgttttgctcaatgttgtattcctgatgaaaggtaaatgattttaattttgataaagtgatttatt

SEQ ID NO: 62349 - DNA, 201 bp, Homo sapiens
ttattcatcacactagttattgcctgaatactttgtttgtttgtttgtttttgtttgtgtgtgtgtgtgtgtctgtgttgtgttttgttttttttttttttttgagacagaatctcactctgttgcctaggctggagtgcagtggtgcaatctcggctcactgtaacctctgcctcctgggttcaagtgattctacttcct

SEQ ID NO: 62350 - DNA, 201 bp, Homo sapiens
atagatgaaaacatatagtcagttgactttctttttttcttttttttttttttttgagacggagtcttgctttgtcacccaggctggagtgcagtggcgcratctcggctcactgcgaaccccgcctcccaggttcacaccattctcctgcctcagcttcccaagtagctgggactaaaggtgcccgccatcacacccggc

SEQ ID NO: 62351 - DNA, 201 bp, Homo sapiens
agatcttaagaacttatttatttatttatttatttatttatttatttatttatttgagatggagtttcactcttttgcccaggctggagtgaagccgcacratctccgctcactataacctccgcctcccaggttcaagtgattctcctgcttcagctccccgagtagctgggattacaggcatgcatcaccagacccggc

SEQ ID NO: 62352 - DNA, 201 bp, Homo sapiens
tttattcatcacactagttattgcctgaatactttgtttgtttgtttgtttttgtttgtgtgtgtgtgtgtgtctgtgttgtgttttgttttttttttttttttgagacagaatctcactctgttgcctaggctggagtgcagtggtgcaatctcggctcactgtaacctctgcctcctgggttcaagtgattctacttcc

SEQ ID NO: 62353 - DNA, 201 bp, Homo sapiens
ctcacttccttctttttcataccagctttcaattgcttgtttctaaacaatgcgttatctttgattaaattagaccagtaataaaagctcgtgaatccttraatgaaaagcacacattctggtcttcttgaccctgcattccaaaattattctctaatgtttataaccaccttggtagataaagtcttctttttccttctc

SEQ ID NO: 62354 - DNA, 201 bp, Homo sapiens
ttttattcatcacactagttattgcctgaatactttgtttgtttgtttgtttttgtttgtgtgtgtgtgtgtgtctgtgttgtgttttgttttttttttttttttgagacagaatctcactctgttgcctaggctggagtgcagtggtgcaatctcggctcactgtaacctctgcctcctgggttcaagtgattctacttc

SEQ ID NO: 62355 - DNA, 201 bp, Homo sapiens
acctgggaggtggaggttgcagtgagctgagattatgccattgcgcttcagcctgggggacagagtgagactccatctcaaataaataaacaaacacacaracaaaccaagcttcagttttttctcctgtaaaattgaaataatgtctattttatggttttatggtaagaaacaaattacatgataaatatggtcagctaa

SEQ ID NO: 62356 - DNA, 201 bp, Homo sapiens
gcagtgggtggtactggttgttcctttccatgtttaatgcttccttcaggagctcttgtagggcaggtctggtggtgacagaatctctcagcatttgcttktctgtaaaggattttatttctccttcacttatgaagcttagtttggctggatatgaaattctgggtttaaaattcttttctttaagaatgctgaatattg

SEQ ID NO: 62357 - DNA, 201 bp, Homo sapiens
tgtgaggtactattttattcatcacactagttattgcctgaatactttgtttgtttgtttgtttttgtttgtgtgtgtgtgtgtgtctgtgttgtgttttgttttttttttttttttgagacagaatctcactctgttgcctaggctggagtgcagtggtgcaatctcggctcactgtaacctctgcctcctgggttcaag

SEQ ID NO: 62358 - DNA, 201 bp, Homo sapiens
ttattttagaatatatgtttgtaaatatgcgtgtgtgtgtgtgtgtgtgtgtgtgtgtatatgtatatgtccacatatgtttgtatttatatatgtgtatsttaacaaagtctacagttattcaatattcttactctccttgtgaaccatttaggtcatttttgttattctgcttcttgtgtttacaaaattgctcgtatt

SEQ ID NO: 62359 - DNA, 201 bp, Homo sapiens
caggtaatgtgatgcctccagatttgttctttttgcttattcttgctttggctatgcaggctctttttttgttccatagaaatttttaggattttttttttctagttctgtgaagaatgatgatagtgttttgataggaattgcattgaatttgtagattgcttttggcagtgtggtcattttcacaatattgattctacc

SEQ ID NO: 62360 - DNA, 201 bp, Homo sapiens
atttttaaaattgtttattctgttattttagaatatatgtttgtaaatatgcgtgtgtgtgtgtgtgtgtgtgtgtgtgtatatgtatatgtccacatatrtttgtatttatatatgtgtatcttaacaaagtctacagttattcaatattcttactctccttgtgaaccatttaggtcatttttgttattctgcttcttg

SEQ ID NO: 62361 - DNA, 201 bp, Homo sapiens
ctttccaattaccccaacaccttttgttgaatagggtatcctttccccacttcatgtttttgtttgctttgtcaaacatcagttggctgtaaatatttggstttatttctgggttctctattctgttccttttttctacatgcctatttttataccagtaccatgctgttttggtatagccatgtagtataatttgaagtc

SEQ ID NO: 62362 - DNA, 201 bp, Homo sapiens
tcgatatgatattggctatgggtttgtcataaatagttcttattattttgagagatgtgccatcagtacctagtttattgagtgtttttatcatgaagagktgttgaattttatcgaaggccttttccacatctattgagataatcatgtggtttttgtcattcgttctacttatgtgatggattatgtttattgatttgc

SEQ ID NO: 62363 - DNA, 201 bp, Homo sapiens
ccactagcagggagcttagttatttttaaaattgtttattctgttattttagaatatatgtttgtaaatatgcgtgtgtgtgtgtgtgtgtgtgtgtgtgkatatgtatatgtccacatatgtttgtatttatatatgtgtatcttaacaaagtctacagttattcaatattcttactctccttgtgaaccatttaggtca

SEQ ID NO: 62364 - DNA, 201 bp, Homo sapiens
attttttaatgttaagtatgtagtaaggtatattaatctagctctcaatatagaaaggaaaaatatgtaagaatatgcagttacaaataaggagcaagagyttggttgtctaggacttttaactcttaactactgtcagcaaactagtgaaagtggctggagttaaatttaccactacatgctcatcgaaatcaagttaaa

SEQ ID NO: 62365 - DNA, 201 bp, Homo sapiens
gtttcaaaagggaaacagaataaaagtttggaaaacttgcagcctgacaatgagatagaaaagaaaatcccatttcctgaagtgaaattcaaatcagctgyagaaatttgcacaagtaataagtagctgagtgttaatccccaagacaatgggggaaaatgtctccagggcatatcagaggtcttcagggcagcccctccc

SEQ ID NO: 62366 - DNA, 201 bp, Homo sapiens
tccactagcagggagcttagttatttttaaaattgtttattctgttattttagaatatatgtttgtaaatatgcgtgtgtgtgtgtgtgtgtgtgtgtgtrtatatgtatatgtccacatatgtttgtatttatatatgtgtatcttaacaaagtctacagttattcaatattcttactctccttgtgaaccatttaggtc

SEQ ID NO: 62367 - DNA, 201 bp, Homo sapiens
aagagactcacctaacacataaagactcacataaacttaaagaagcagaaaaaggcatttcatgcaaatggacaccaaaagcgaggagtagctattcttayaaaagacaaaactttaaagcaacagcaattaaaaaaaagacaaagagggacattatataatggtaaaaggctttgtccaacaggaaaatatcacaatcct

SEQ ID NO: 62368 - DNA, 201 bp, Homo sapiens
actgttttgtcttagctttcataatctcaagctatttgtctgtctgtctatctatctatctatctatctatctatctatctatctatctatctatctatcttaggcgaagattttgattaaccctcatacttggctctgatatatcaggttgaggctagaagcagaaggtggtgtcttagtttgttttgtgctgctatggc

SEQ ID NO: 62369 - DNA, 201 bp, Homo sapiens
gatggggttttctaaatatataatcatgtcatctgcaaacagagacaatttgacttcctctcttcctatttgaagaccctttatttctttctcttgcctgwttgtcctggccagaacttccaatactatgttgaataggagtggtgagagagggcatccttgtcttgtgctggttttcaaagggaatgcttccagttttgg

SEQ ID NO: 62370 - DNA, 201 bp, Homo sapiens
cacatcaggaaggggaaaggagttacagagatacaaagatagagacttgcatttatttctggtaaagtaggttaacattacctatttagccatttaaaatkagccatttaaaatatgtaatagtaacttagagctgtgcacaaggtcatggcagatttggaatcagagatgaggtcctgaaagaaccagtgctgggcttag

SEQ ID NO: 62371 - DNA, 201 bp, Homo sapiens
ccaactatctgctgccttcaagagactcacctaacacataaagactcacataaacttaaagaagcagaaaaaggcatttcatgcaaatggacaccaaaagygaggagtagctattcttacaaaagacaaaactttaaagcaacagcaattaaaaaaaagacaaagagggacattatataatggtaaaaggctttgtccaac

SEQ ID NO: 62372 - DNA, 201 bp, Homo sapiens
cactgttttgtcttagctttcataatctcaagctatttgtctgtctgtctatctatctatctatctatctatctatctatctatctatctatctatctatcttaggcgaagattttgattaaccctcatacttggctctgatatatcaggttgaggctagaagcagaaggtggtgtcttagtttgttttgtgctgctatgg

SEQ ID NO: 62373 - DNA, 201 bp, Homo sapiens
ctcttaggttttctgaagcagtttttgtaatactagattggtttgttctttgagtgcttcattcagtttcctctaagaccatttaggacttttttttttttgcattatgagttttaaatttttcattcaacctctttgaagactatagcactctactttaaaaccattttttggagtcaattttggtaaggttatattttc

SEQ ID NO: 62374 - DNA, 201 bp, Homo sapiens
aaattgaagaggacacaaacaaaacaaagagcccatgctcatggattaggagaattaacgttgttaaaatgaccacactccccagagcagtctactgattsagtacaatccctgtctaaatatcaatgtcatttttcacagaaatagaaaaaagatcctaaaatgtgtaagaaaccaagtacggctcaaataccaaagtga

SEQ ID NO: 62375 - DNA, 201 bp, Homo sapiens
tcactgttttgtcttagctttcataatctcaagctatttgtctgtctgtctatctatctatctatctatctatctatctatctatctatctatctatctatcttaggcgaagattttgattaaccctcatacttggctctgatatatcaggttgaggctagaagcagaaggtggtgtcttagtttgttttgtgctgctatg

SEQ ID NO: 62376 - DNA, 201 bp, Homo sapiens
gccaagatcgcaccactgcactccagcctgggtgacagagcaagactgtctctcaataaataaataaataaataaataaataaataaataaataaataaataaaagtttgccaactgctgatttagaaaattgtgatcatttctttaggtgaatattcctgacaaactggtttaaaatcatgtttaaatatctgcaaattt

SEQ ID NO: 62377 - DNA, 201 bp, Homo sapiens
atcactgttttgtcttagctttcataatctcaagctatttgtctgtctgtctatctatctatctatctatctatctatctatctatctatctatctatctatcttaggcgaagattttgattaaccctcatacttggctctgatatatcaggttgaggctagaagcagaaggtggtgtcttagtttgttttgtgctgctat

SEQ ID NO: 62378 - DNA, 201 bp, Homo sapiens
tcaagtaatgttaaagttgtttaaacagtgtactaataaaacctttcactaagtatggggagactgtgtagggggtgtgtgtgtgtgtgtgtgtgtgtgtktttgtgtatatattttttccctccaaaagtgatctaacaacttaaataattaagaattctaaacatactggtgggaaatgttaccaaatggtaaaacatt

SEQ ID NO: 62379 - DNA, 201 bp, Homo sapiens
catgtaataaatttcctttccagatgggctgctatatctggttgggtggaataatattctctgaagatgaaataaggtataatcttgtaaagtgcatgaayactctgtttctggatcccaaagtggattattatccttaactcaaggcatttgggtcattaaaaagtcacatcctaggctctttgtgtggtttaagttttt

SEQ ID NO: 62380 - DNA, 201 bp, Homo sapiens
aaaaatgactttttctcataatcataagtcatttgttttctcatagctaataattaatattaatttctttttatattatagaataagagaaacaacccctscatgtattttactttaatttagttttatcttttcctatctggttcagtatttttatctcttcagctctctataagtttactactcaagggagttcttcag

SEQ ID NO: 62381 - DNA, 201 bp, Homo sapiens
gcagtctgcaccttggataattctagtacacagcagagcatccagattatcactgttttgtcttagctttcataatctcaagctatttgtctgtctgtctrtctatctatctatctatctatctatctatctatctatctatctatctatcttaggcgaagattttgattaaccctcatacttggctctgatatatcaggt

SEQ ID NO: 62382 - DNA, 201 bp, Homo sapiens
aagaaccttttaaggtactttgccttcaagtaatgttaaagttgtttaaacagtgtactaataaaacctttcactaagtatggggagactgtgtagggggtgtgtgtgtgtgtgtgtgtgtgtgtgtttgtgtatatattttttccctccaaaagtgatctaacaacttaaataattaagaattctaaacatactggtggg

SEQ ID NO: 62383 - DNA, 201 bp, Homo sapiens
ctccctttttgggggctccgagtcatagttagggcattcatggatatatgaagtttttttgttcaggatggttttcagggaatagttctgttgagatccarctttttgtctttgcggaggcttcctttataacagttttgtcagtgcttcttaaactttaatatgcatatgaatcacttgggagatcttgttagcatcaag

SEQ ID NO: 62384 - DNA, 201 bp, Homo sapiens
attatgtcacccaggcttgagtgcaatggcatgattttagctcactgcaacctctgcctcccaggttcaagcaattctgccacagcctcccgaggtgcacrccaccacgcccagttaattgttgtatttttagtagagatggggtttcgccatgttggccagactggtttcaagcccctgacctcaagtgatcggccctcc

SEQ ID NO: 62385 - DNA, 201 bp, Homo sapiens
gtaatgaataacacaattactctttcttgctgcttccattgttaaatatgcaagtggattcacttggaaaatttgagagctgctttctactggtcatggtrgtggccatagtgtttaggttattctccaattaagattttttttgctgcagagggtggtaataccttattagatccaattaaagtatttattgaaggctta

SEQ ID NO: 62386 - DNA, 201 bp, Homo sapiens
cagatattggtactttaaatctacacaagacaatgtattaacgttaagtatgctacaaataattggtgaaatgaatgatgttgaagatacaggggttagcyttagaaatattttatgtaactagactttgggtcaggcgaggcttgcagattaacagcttttggagtaataacctaactagtactccatttgatcctgttt

SEQ ID NO: 62387 - DNA, 201 bp, Homo sapiens
attgaatctataaattactttgggcagtatggccattttcacaatgttgattcttcctatccatgagtatggaatgtttttccatttgtttgtgtcctctyttatttccttgagcagtggtttgtagttctccttgaagaggtccttcacattcctttaagttgtattcgtaggtagtttattctctttgtagcaattgtg

SEQ ID NO: 62388 - DNA, 201 bp, Homo sapiens
ggaagccatttcttaactgtagacttaattttaagactttgaaaaccatcaagtttctgtttaaacagaaagaattcctttctgtttaatagtactctcarctgaactctattctttttacattttactacaagcagcaagaagaaatcaggctgcaccttcaccactgtgtttagaagtctacttagccagatcaccctg

SEQ ID NO: 62389 - DNA, 201 bp, Homo sapiens
ctcaccaggatcacttggagaaaaatctcttagtattctgagagggcctagactcccactgagtcctccaaaaggactgaagatagaggtttcctagagcktctggctcctctctttctttttagtgctggttctctctaatcttctttgtaaactcccattctctgaaagacaaatgcttttagggactctgcatggcat

SEQ ID NO: 62390 - DNA, 201 bp, Homo sapiens
ccagcagagcaaggaacccgaggactccacatctaatcaacagactcccgacagcattgacaaagatggtcctgaagaaccttgtgctgaaagtaaggcartgccaaagtccgaaatcccttcaccacaaagccaactgttagaagatgctgaagctaatttggttggaagggaggcagcaaagcaacagaggaaagaact

SEQ ID NO: 62391 - DNA, 201 bp, Homo sapiens
atggccgattaagtagatttgcagtaggtgtacactggcagcctagaggaagattaatctgaagacaggttgagagcacctggaacattttaggatttagrtgatctgactattaagtgttgccaagtcatgggacctggtaactaccatgttactgatggggagactggatcttagagagttagaggatcttgtcaaaaa

SEQ ID NO: 62392 - DNA, 201 bp, Homo sapiens
aatcttctgtacctctaatttcttacatagtaagtggaagttcaacaactggaagatctctgtggtctttagcgtcctcaccctctctctatgctttctcrttcagcaaacatttgtcaagtgtctactctgtggcagaatttgtgtaagaacttggggatagtctgtcttcagatgagctcagagtctagtaggagagag

SEQ ID NO: 62393 - DNA, 201 bp, Homo sapiens
attacccatggccagatttcctagttattttctcattgcaaaagaatgtgaaacaaactgattaagtgtaaaataactcttaactcttatttagactatcrtagtcatcttcaaaactctttgagatcatcttgagaattcacagttttctattctttttgttgctagcaggtgaaattatgtacctttggaaccctctgt

SEQ ID NO: 62394 - DNA, 201 bp, Homo sapiens
ttaaaattagccatttaaaatatgtaatagtaacttagagctgtgcacaaggtcatggcagatttggaatcagagatgaggtcctgaaagaaccagtgctrggcttagctgtcagttttgcaggttaagctagactgttagcgtatccgtacaaaatagttatgaagattaatgttgccttctgtagaatgattttgcctg

SEQ ID NO: 62395 - DNA, 201 bp, Homo sapiens
ttaaaaaatatttgtttatgtctaatccatcctcacattaactcatggtatgtttctgggtagtttgttgtctccaaattttataaaccacaaaaatgtgytgctgctgagatgtcagtaattaattatttttataaataatcttttgtcaactctggtgccttagctgttcttaggtttttaaagaatatcctgataaag

SEQ ID NO: 62396 - DNA, 201 bp, Homo sapiens
tcgtgaattaagcacaaatcgtagaacagatttgtattggtacagccaatgtatttgagtggagcccaagtattgatatgtcagagggtggtcattttgcyttatttttttaatcaatattgttgactattttataaatatttcaatgcctactatgtgcctaaaagtattctatgagaaatgtattgaatctactttttg

SEQ ID NO: 62397 - DNA, 201 bp, Homo sapiens
aaaaaaaagaaaaaaaaaaccctgaagctttgactcccaacctcatcatgagtaagcttaatctggcagagtatttaagctagatgagtctggaattagcwagaagactttttgttttttgttttcctttaaagcaaatctctaatactactaccacattgctaccaaaggcattactacttagagctagaggaaaagtag

SEQ ID NO: 62398 - DNA, 201 bp, Homo sapiens
ctcctggccatttcatgtaaatggaatacagtatgtggtcttttgtgactggcttttttttttttaactagagaaacgttttcaaggttcattcatgttgyagcatttatcagtacttaattcatttttattgcaaaataatattccattgacttgataataccacatttagtttattcattttgatattagttgatggat

SEQ ID NO: 62399 - DNA, 201 bp, Homo sapiens
aattttgatgaagttcaattcatctagttttttttgtcacttatactttgatctcatatcctagaagactttacatattctgagatcataaagatttactygttcatcttcctctaagagttttgtagtttttagtctttcttatatttaggtctatgatccattttagttaattttgtataaggtgtgaggaagggatat

SEQ ID NO: 62400 - DNA, 201 bp, Homo sapiens
tgagctactgattgtagggggaaataatgatgctatttacttttgtgattttcttcaaactgaacaatcaagttaaaacctaagataatgtttcaaaagtmatcactatatatgtggtcttatccttttatccttattttctctgtaagtgattccttttctgctcttctgatttcttaatatttttcactttcttcagtt

SEQ ID NO: 62401 - DNA, 201 bp, Homo sapiens
gaaggtacacaaaataaatttttagggcatgaaaagttgaaaggaatagctaatatattgagtagagaaataggaatttaacattatcacagtggactgaygtgctatgtcatggcaaataatatgttatttaatgtgaataaatatatatgtctgcattaatgatatataaaatattcacttaatttcgaggaaacagtg

SEQ ID NO: 62402 - DNA, 201 bp, Homo sapiens
agtacctagtttattgagtgtttttatcatgaagaggtgttgaattttatcgaaggccttttccacatctattgagataatcatgtggtttttgtcattcrttctacttatgtgatggattatgtttattgatttgcatatgttgaaccagccttgcatcccagggatgaagccaacttgatcatgatggataactttttt

SEQ ID NO: 62403 - DNA, 201 bp, Homo sapiens
gaatgcatgagaagtctagagaaggacttctcaattctagggaacctgatctggagaaaagatttctgacaatgagcataaaattattccaccttcttatraaaggcaggactaggatcactgagtatatagaaattttagggaagtagattacattaatatgtaatgatgtgaaaagttggaatcactcaatatggattg

SEQ ID NO: 62404 - DNA, 201 bp, Homo sapiens
agtttagtcaatttttaattactgtatattcttcccatccatttacacagttcagtggtttccttccttcattcatattccttaaatagtttttgttccayggactatcattttttattatatagtttctctgtccctgctgattgcattagtctagtactagcaaacagagggttatccaaatgtttaagaactaaacca

SEQ ID NO: 62405 - DNA, 201 bp, Homo sapiens
ttcccttctagtagttataaaatgttttatgaaattatttggatacacaaatagagaaacaaagaatttaaaaaatgcaactctcattccttgtcatgtctcatatgaaggacaagaaatccctttaatcttaacagaggtctttaaagttcagattataaaattacattcccaattattaatgcatgcatggggattatc

SEQ ID NO: 62406 - DNA, 201 bp, Homo sapiens
tgtccttggttcttccatcttccctttatcatccttcccatgtgtccccatgaacttggtaaaaacccaagggaatacaggttgcaaacccaagagagggytgaggtttatgaggtgctgtggtctccacaggttcacattgctagtctgaaaactccacatttctgtccttctgtcagactcactcacttctgataagaa

SEQ ID NO: 62407 - DNA, 201 bp, Homo sapiens
atcagcatacagaaaataagtgctgtttctatacaaaaataatgaactagctgagaaagaacacaagaagacaaccaaatttacaatagttaaaaaaaaaatacctaggaataagtttaaccaaggagatgaaagaccttcacaaggaaaactacaaacactgatgaaaaaaattgaagaggacacaaacaaaacaaagag

SEQ ID NO: 62408 - DNA, 201 bp, Homo sapiens
aaatgttgtttggccagttgtttatacatttgaaaaaaaataaaattagattgccaacacatattataattttagaaaatttccaggtggataactgcctraatacagaaaatcagaatgttaatgcattttgaagaaaacataggcccaaggcagtggctcacagctgtgatcctagcactttgggatgccaaggcagga

SEQ ID NO: 62409 - DNA, 201 bp, Homo sapiens
cttagcaaggaaacagttccttgacgctcaaatcataaaggaagagctgcaaagagggcaataaaaagtgttttcttctcttggtccctgagcaattaaaytggtaacctaatctgatgttagggagtatagaccataaactgtgtttaattagtttgcacccagtgtcatttcacacagtagacactttaatttacaact

SEQ ID NO: 62410 - DNA, 201 bp, Homo sapiens
aattttctatagtttaacctgcaaataaatgtaattacaatgacaattttacctgaatagtaaaactttgcttttagttttaaatattttcacctttattwtaattagttcatgaaaatagaatttaaaattacaaatcatagtattttagaaagatacaaaaacaagcacttgtcttcatatctttctaaaatactatgg

SEQ ID NO: 62411 - DNA, 201 bp, Homo sapiens
agaataagaacaagacaaggatgcctactttcgtccacttcattcagcattgtaatggaggtcccagccattgtaataaggtatgtgttatggattgaatygtgtacctcaagaagttatgttgaagtcctaacctctggtacctttcaatgtattcttatctggaaatagggtctttgcaatgtaatcaagttaaaatga

SEQ ID NO: 62412 - DNA, 201 bp, Homo sapiens
cacaggaaagacctgtccccataattcaatcacttcccaccaggttcctcccatgacatgtgggaattgtgggcgtaacaattgaagatgagatttgggtrgggacacagccaaaccatatcaatacctcaacataataaaggccacatatgacaaactcacagctaacattgtattgagtggggaaaagctgaaagcctt

SEQ ID NO: 62413 - DNA, 201 bp, Homo sapiens
aatagggtctttgcaatgtaatcaagttaaaatgaggccatgctgatttagggtgggtcctaatccaatatgactggtgtccttattagaagagaagagaygcagtgggaagacagccatatgaagatggagacagatactggaattatattccctcaagccaaggaacttctaggacaaccagaagctagaagagggaag

SEQ ID NO: 62414 - DNA, 201 bp, Homo sapiens
aaaattgaagcagaggaacttctccctgattctttctatgaggcaagcattaccctgataccaaaaggagataaggacagaaccaaaaggaaaactgcagrccaatattcccaatgaacacagaggcaaaatttctcagcgaaatactagcaaaccaagtccaacagtacattaaaaagataatacaccatgattaagtgg

SEQ ID NO: 62415 - DNA, 201 bp, Homo sapiens
cccaaaacatgcttaaccaggaggctgattcatctgctgactccaagaacatgaagatgaacatgatagacagactgtccaccatctgaatgttcattcamcacccattcattcagtaacccttactcaggcccagatgagcagcacatttcttgccaacaatcattaaatgtccaagaaggctctcgttatcatcttctg

SEQ ID NO: 62416 - DNA, 201 bp, Homo sapiens
aaagaaccttttaaggtactttgccttcaagtaatgttaaagttgtttaaacagtgtactaataaaacctttcactaagtatggggagactgtgtagggggtgtgtgtgtgtgtgtgtgtgtgtgtgtttgtgtatatattttttccctccaaaagtgatctaacaacttaaataattaagaattctaaacatactggtgg

SEQ ID NO: 62417 - DNA, 201 bp, Homo sapiens
tggataggaacttgataataatgcctatcatgcacaagcaatttaggtgactaggaaatatcattctctacagccacacccttttttttttttttttttttctttgaggcagagacagtctcactctgtcctccaggctggagtgcagtggcactatctcagctcactgcaaccttcacctcctgggttcaaaccgattct

SEQ ID NO: 62418 - DNA, 201 bp, Homo sapiens
gcctgattgccctggccagaacttccaacactatgttgaataggagtggtgagagagggcatccctgtcttgtgccagttttcaaagggaaggcttccagwtttgggccattcagtatgatattggctgtgggtttgtcataaatagctcttattattttgagatatgtcccaacaatacctaattcattgagagttttta

SEQ ID NO: 62419 - DNA, 201 bp, Homo sapiens
gcctcaccttcctgagtagctgggactacaggtgcgtgccaccacgtggggctaatttttgtatttttagtagagacggggtttcaccatgttggccaggrtggtctccatctcttgacctcgtgatccacccgccttggctttccacagtgctgggattacagaagtgagccactgcgcctggcctgaaaatcattctga

SEQ ID NO: 62420 - DNA, 201 bp, Homo sapiens
aaaaagtcaggaatgaattaactttgtctataaataagcacacacagatatagattttctctgacaatttaggcatacacacatctctgcatatatatatwcacatatttagtgtcatatatatgtatatatatgacatatatatacacagcatatttagcgtcctatcatcatgtaggaagatttcagtgctgtaattat

SEQ ID NO: 62421 - DNA, 201 bp, Homo sapiens
gatatgaacagacacttttcaaaacaagaaatttatgtggccaacaaacatatgaaaaaaagcttatcatcactggtcattggagaaatgtgaatcaaaaygacaatgagataccatctcataccagttagaatgacaatcattaaaaagtcaggaaacaacagatgctggagaggatatggagaaataggaatgctttta

SEQ ID NO: 62422 - DNA, 201 bp, Homo sapiens
caataataagtatgatacatctttttcatatgcctctcttcatttacaaagatggtgctgggcattccaatctacctgaagcattttttttttttttttttggtcaggagaggtaacagggtttgaacccatcttcattccactatgcattctcccgtgtgactgctgtcacatacctgagagacagatggttgggagtgc

SEQ ID NO: 62423 - DNA, 201 bp, Homo sapiens
cccagtgccatgatagccttgaaaccaacagcctgaaatcacggtgaaaaccaccaccttggcagccacttcagggggcttatagtattggattgccttaraaatcccattttcattgaattgtcattgtttgacctgtgtggtgattgtctggataaccccactcacaaagattatttttatttgacctgactcagtgct

SEQ ID NO: 62424 - DNA, 201 bp, Homo sapiens
cttccgtctcccgagttcaagcgattctcccacctcagcctcctgagtagctggaattacaggcacgcaccaccatgcctggcttaatttttctttttttmgtagagacggggtttcaccatgttggccaggctggtctcaaactcctgacctcaggtgatctacccacctcggcctcccaaagtgctgggattacaggag

SEQ ID NO: 62425 - DNA, 201 bp, Homo sapiens
agttttagggtacatgtgcacaacgtgcaggttagttacatatgtatacatgtgccatgctggtgtgctgtacccattaactcatcatttagcattaggtrtatctcctaaagctatccctcccccctccccccaccccacatcagtccccagagtgtgatgttccccttcctgtgtccatgtgttctcactgttcaattc

SEQ ID NO: 62426 - DNA, 201 bp, Homo sapiens
aagggctgggcccgaaatctatgattttcatatctgtattatatacagtttcttgcttagcgtctagaattacctattatttaggatagattcctaaaaawatataattttattaatttataatattatttataattttattaaattatatttaaattaattaaaaataaaattattttaaagccctttatatataattca

SEQ ID NO: 62427 - DNA, 201 bp, Homo sapiens
ttcatttcctgccacagagggagatactcttacaaatggagcttttcttcatagatctaagtttcccttacaaaacagtatcttctactctgttttttttytttttaattatacttttaagttttagggtacatgtgcacaacgtgcaggttagttacatatgtatacatgtgccatgctggtgtgctgtacccattaact

SEQ ID NO: 62428 - DNA, 201 bp, Homo sapiens
ctcactgcagccttgaactcctgcgcacaagggatcttcctgccccagcctcccaagtagctgggactacaggtgtgtgccacagtgcctggataattacwttttttttttttttttttgtagattcagggtcttgctatattgtctaggctggtcttgaactcctgggctcaagtgaccctcttgcctcaccctcccaaa

SEQ ID NO: 62429 - DNA, 201 bp, Homo sapiens
tattaggattttgtacttgtgaagtaaatatataggatgaagtcctagaagtataattcctgtgtcaaagactacattgcttttttttgtttttttttttkttgttgttttttttgagacggagtttctctcttgttgcccaggctggagtgcaatggcgcgatcttggctcaccccaacctctgcctcccaggttcaagt

SEQ ID NO: 62430 - DNA, 201 bp, Homo sapiens
ttctcttttctctctaaatgttgggtcattattaagtttatgtctctatatcagggattgtgtgttcaggtttggttacaaaatggttagtgctcctgtawtttttttagccagcattgattaacagagttaatcactttctgtctttaaaagagactgataagggcttatgatataaagtttatttgggaaattatctgt

SEQ ID NO: 62431 - DNA, 201 bp, Homo sapiens
ccctgacctctggggctcaagtaattctcctgcctcagcctcccatgcagctaggactacaggcaagcgccaccatgcctgttattattttttttttttttgtagagatgaagtctcactatgttgtctaggcttgtcttgaactcctgggttcaagcgaccctcctgccttggcctcccgaagtgctgagattaaaggca

SEQ ID NO: 62432 - DNA, 201 bp, Homo sapiens
atattacatattatatattatgtaatataatatataatatattatatgtatatttattacatataatataatatataatattatattaaatatatatattwaatatatatatttatatattatatttataattattatatataataattattatatatataataattattatatataataatataagttatataatataat

SEQ ID NO: 62433 - DNA, 201 bp, Homo sapiens
gatgatttcttaaagatcgatgaactgctggtttctttttaaagggcattcacaaaagcgaccaaaacttgggctaaagtattgctttcaaatatacttakgtgtagcttgtatttgtgagtgtgtgtatgtgtttgtgtgtgtgtgagattttgataggtatctccaaattgtgtttggaactttttttttttttttttt

SEQ ID NO: 62434 - DNA, 201 bp, Homo sapiens
atgtggagactcacattgtgaacttttgccccaagaactaccacaggaaaataccaggaaagccaagagaatccacagaccttttgaaggaactggatcascgctgcaggctccctaaaatgccaaaaaagtgtgagtctgcttgctttctcaacagggaagctcgtgatttagggtgagttctcagccctggtcataagc

SEQ ID NO: 62435 - DNA, 201 bp, Homo sapiens
gggagggaatggggggtgtgtgtaggggagaggggagggtgtttgtggctttaaaaagaatggtcagggtaaaaggagattgtcgatgctttacaaaaaamgaaaaaaacaggcaccacactccaaagcctttcttgtttgtctgcatgggccatgcatgcgtgctgggccaggagccgagtttggagacggtttaagtga

SEQ ID NO: 62436 - DNA, 201 bp, Homo sapiens
tattaatctttacatttccttttcctcctttttgtacattaactgctgaattcagagtttgagtcattatgtggatttttggttgttaaggagagcatccrgcctgttaatgctctcaaatggggtatccctcagaaacctctccttgcaaaagtagcttatggatattatcttttacctgggtagaggggtttcagctgc

SEQ ID NO: 62437 - DNA, 201 bp, Homo sapiens
gtatcattaagattaggtagtatttcttttcttttgtataattatcagtgttgagtatcattaagattaggtagtatttcttttcttttttttttttttttgagacagagtctcgctctgccgcccaggctggagtgcaatggcacaatctcggttccctgcaacctctgactcctgggttcaagcaattctcctgcctca

SEQ ID NO: 62438 - DNA, 201 bp, Homo sapiens
ttgaactatattctccaggtaatatggagaaacttaggaggactttttatgcccttctccatctccattagaaagtaatacttgctcattatacagaattyggaaagtacaaaaaagtatacaaaagaaatgtaaaatcattcgtaaattcattctctctcctctgtcactctactccatcccgtcttccagtgctgtttc

SEQ ID NO: 62439 - DNA, 201 bp, Homo sapiens
caccggggtatgaaaaaatactcctgcagctagcttggtgtctgcctaaacagccacccagttttgtgcttgaaacccagggccctggtggcataggcacyggagggaatctcctggtctaaaggttgcaaagaccgtgggaaaagtgtagtatctgggccagaatgcaccattcctcacagcacagtccctcacggcttc

SEQ ID NO: 62440 - DNA, 201 bp, Homo sapiens
gctggaggtctactccagacccagtttacctgggtatcaccagtggaggctgcagatcagcaaagattgctgcctgttccttgctctggaagctttgtccyagaggggcaccctccagatgccagccggagctctcctgtgtgaggtgtctattggtccctgctgtgaggtgtttcccagtcaggagacacaggtgtcagc

SEQ ID NO: 62441 - DNA, 201 bp, Homo sapiens
ctcctaatgctatccctcccccaaccccccaccccactacaggcctcagtgtgtgatgttccccgccctgtgcccaagagttctcatcgttcaattcccayctatgagcaagaacatgcagtgtttggttttccatccttgctatagtttgctcagaatgatggtttccagcttcatccatgtccctacaaaggacatgaa

SEQ ID NO: 62442 - DNA, 201 bp, Homo sapiens
tcttctccttcctctgctttataagaaaacaagactggttaataaaaaaaacaaaacttataaataaatgacacatttgccttaaaagggaaacttgaacyttaatgaggggtggtttattttttcagataacttgggtgtcttttggttgtattgaatgttttgtgcttttcaaaatcatatcatgaataataatattag

SEQ ID NO: 62443 - DNA, 201 bp, Homo sapiens
cctgactcttttaaatgttctcttctccttcctctgctttataagaaaacaagactggttaataaaaaaaacaaaacttataaataaatgacacatttgcyttaaaagggaaacttgaaccttaatgaggggtggtttattttttcagataacttgggtgtcttttggttgtattgaatgttttgtgcttttcaaaatcat

SEQ ID NO: 62444 - DNA, 201 bp, Homo sapiens
ttataaaatgttaacagtatgaatttgattctcctaaatatttcatattttaaatctcctcagaagtatattatcccaagcaattttctcaattatttgargctgcgtgaagaatttgagcaagatgttcatcagatttttgttagttcatttaagatatatcaaactttatttattgataacaggcatgtaaaaattaat

SEQ ID NO: 62445 - DNA, 201 bp, Homo sapiens
ggtggaaggcaaggaggagcaagtcacatcttacatcttacatggatgacagcaggcaaagagagagtgcttatgtagggaaactcccatttttaaaaccrtcttatctcgtgagacccattcactatcacaagaacagcacaggaaagacctgtccccataattcaatcacttcccaccaggttcctcccatgacatgtg

SEQ ID NO: 62446 - DNA, 201 bp, Homo sapiens
tgaagcataacaggaacttagtcacttgtaggtttgtaaatgtgattcaaggatttctgtgaaatttgaatattgctaccaagtgctgcttcatttcattytcacacctacctactcagtgagtggaccaccagttaggtaatactgcatgttatcttcccaaaagtgtgaacaaggagggttatataaggcattttatac

SEQ ID NO: 62447 - DNA, 201 bp, Homo sapiens
gaggagaactggaggaggatgaatgttgaaaaattatctgttgggcacaatgttcattgttaaggtgatgagtatgctagaagctcaaaccccactactaygcaatatatccatgtaacaaatctgcatatataccctctaaatgaatgaaaaaaaatttttaatgcaatataacaatttaaaaatttttttagggcacaa

SEQ ID NO: 62448 - DNA, 201 bp, Homo sapiens
tgtctctgattcaggtgtcttgggtcttctgctggcatgagggaagccattgcgggctaacttgtagcttgcaagtagggtaaaatctcagacccttcatrgttcttgacattaccaaggtaattaaaagggaaaaggaaaatcttttcagaaatggcaccatattaactggatatccatctggaaaacaattaacattaa

SEQ ID NO: 62449 - DNA, 201 bp, Homo sapiens
taaaacttaaaaccatactacttagaaaaaataggctgggcgtggtggctcacgcctgtaatcctagcactttgggaggccaaggcaggcagatcacttgrggttaggagttcgagaccagcctggctaacatggtgaaactccatctctactgaaagtacaaaaattagttgggtgtggtggcaggcgcctgtaatccca

SEQ ID NO: 62450 - DNA, 201 bp, Homo sapiens
catagaaaagagctacatttttgttgttatttatttatttatttgtattatactttaagttctagggtacatgtgcagcacgtgcaggtttgttacataggtatacatgtgccatggtggtttgctgcacccatcaacccgtcatctacattaggtatttctcctactgctatccctcccctagccaccagcccccatcct

SEQ ID NO: 62451 - DNA, 201 bp, Homo sapiens
tttattagagttggagtttcaccgtgttagccaggagggtgttaatctcctgaccctgtgatctgcccgccttggcctcccaaagtgttgggattacaggmgtgagccaccatgcccggccttctctagttcttttaattgtgatgttagggtgtcgattttagatctttcctgctttctcttgtgggcatttagtgctat

SEQ ID NO: 62452 - DNA, 201 bp, Homo sapiens
tttaagaatgttgaatattggcccccactctcttctggcttgtagggtttctgcagagagattcactgttagcctgatgggcttgcctttgtgggtaaccygacatttctctctggctgcccttaacattttttcctttatttcaaccttggtgaatctgacgattatgtgtcttgcagttgctcttcttgaggagtaact

SEQ ID NO: 62453 - DNA, 201 bp, Homo sapiens
tgacagcacaatcactggttattttgtaaagaaatttattttaaaacagtatgacggccaaaaaaaagctattggaaggagaggaagagaggacacacctrggttacatttggcctcttttaagtctgtgagacatgtttaaaaatctttaaagaaagcttactttgtcactatcccatttctgctataatcaacataatt

SEQ ID NO: 62454 - DNA, 201 bp, Homo sapiens
acaccacctgttccccaaaaacctattataacaacaacaaaaaaattttaactgccacaaagattatatttgcttcaatataaattaggaagtttttccgyatttttttattttcagaaattacttttataaaagagacttaatgatgtagataagatagaaagtaccgttcctggaagtttgttattattcagcttttaa

SEQ ID NO: 62455 - DNA, 201 bp, Homo sapiens
catagatttggtcttttcacatagtcccatatttcttggaggctttattcattccttttcattcctttttctctaatattgtcttcatgctttatttcatyaagttgatcttcaatctcttgataccctttcttcagtttgatcaatttggctattgatacttgtgtataattcacgaagttcttgggctttgcttttcag

SEQ ID NO: 62456 - DNA, 201 bp, Homo sapiens
caacatataaaagagataatatatcatagctaggttgggtttagccaggaatgcaagtatggtttaacattggaaaatctgtcactttttatatttgacaytgtactggaaggcaagtaaaagaaattaaagaaataaattgtaaagaaatgaaactgttattcacatatgatgagattgtctatttaaaaaatctcaaaa

SEQ ID NO: 62457 - DNA, 201 bp, Homo sapiens
ctatgtggcataggcaccaaggattcaggactggaacagcatactgggcctgccctttcctcctggggtttcgctctttagttgtggagttgtggggaatwtagggcaggtggcttattcagggattctgggagaggagactgggaacctcgtgtgggaaaggggtagttgggccctctattaaacagcagctgatggcca

SEQ ID NO: 62458 - DNA, 201 bp, Homo sapiens
ttaaattatttcaactagactggtccaagtcatctgtagtcagtcagtcagtcactcagctagtaaatgcctgaggcaaaacctcggatttctgtttcctrttatttctactgtaccctatctgtattcagaagtgatggtctattttataatctgtctgcttcaaatcactttggcaaccattatgatatatagcctttt

SEQ ID NO: 62459 - DNA, 201 bp, Homo sapiens
tgtaatataatacagatgctggtctatttctaatgtctttgaaatgtacattgatataatgggacaacatgctttattataaacacgtttaaacattcatrtgtttcatattggtgtgtcaaaagatccatcaacaatttaattgtagtattttatactccataaactagtacatattcaggtaaaacaaatattcttcat

SEQ ID NO: 62460 - DNA, 201 bp, Homo sapiens
atagtcccatatttcttggaggctttattcattccttttcattcctttttctctaatattgtcttcatgctttatttcattaagttgatcttcaatctcttgataccctttcttcagtttgatcaatttggctattgatacttgtgtataattcacgaagttcttgggctttgcttttcagctccatcagatcatttatgt

SEQ ID NO: 62461 - DNA, 201 bp, Homo sapiens
tgcagtttcttcctagtgtcaataggctttgtaatttggtatgtttttgcagtggctcgtatcgattattcctttccaagtttagtgcttccttcaggagmtcttgtaaggcaggcctggttgtgagaaaatctctcagcctttgcttgtctgtgaaggattttatttctcctttgcgtatgaagcttagtttggctgggt

SEQ ID NO: 62462 - DNA, 201 bp, Homo sapiens
attaaggtgtaaatttctcacacatcgtgttttgtcctttgtttcttttttgagactacaacctctgcctcccaggttcaggtgattctcatgcctcagcytcccgaatagctggaattacagccagctaattttcacatttttagtagacacagggtttcaccacgttggtccagctggtctcgaactcctgacttcaat

SEQ ID NO: 62463 - DNA, 201 bp, Homo sapiens
ttaaagtctgttttctcttagagtgggatcgcaacctctgctttttttttgttttccatttgcttggtaaatatttcttcatccctttattttgagcctaygtgtatcttagcacatgagataggtctcctgaatacagcacaccgataggttttgagcctttatccaatttgccagtctgtgtcttttaattggggcatt

SEQ ID NO: 62464 - DNA, 201 bp, Homo sapiens
ggtgctcagaatgtatattctgttgatttggggtggagatttctgtagatgtctgttaggtcacttggaccagagctcagttcaagtcctgaatatccttsttaattttctgcctccttgaggtgtctgatatacacagtggggtgttaaaatctcccactattattgtgtgggagtctaaatctctttgtaggtctctaa

SEQ ID NO: 62465 - DNA, 201 bp, Homo sapiens
ggattcattgatttttttgaatggtttttcatgtctctatctccttcagttctgctctcatattaggtatttctcgtcttctgctagcttttgaattatttatttgcccgttgcttttctagttcttttttttgtttgtttgagatggagtcttgctctgttgcccaggctggagtgcagtggcgcgatcttggctcactg

SEQ ID NO: 62466 - DNA, 201 bp, Homo sapiens
tggattcattgatttttttgaatggtttttcatgtctctatctccttcagttctgctctcatattaggtatttctcgtcttctgctagcttttgaattatttatttgcccgttgcttttctagttcttttttttgtttgtttgagatggagtcttgctctgttgcccaggctggagtgcagtggcgcgatcttggctcact

SEQ ID NO: 62467 - DNA, 201 bp, Homo sapiens
cctggattcattgatttttttgaatggtttttcatgtctctatctccttcagttctgctctcatattaggtatttctcgtcttctgctagcttttgaattatttatttgcccgttgcttttctagttcttttttttgtttgtttgagatggagtcttgctctgttgcccaggctggagtgcagtggcgcgatcttggctca

SEQ ID NO: 62468 - DNA, 201 bp, Homo sapiens
gatgagcattttttcatgtttgttggccgcataaatgtcttcttttgaaaagtgttcatattctttgctcactttttgatggggttggtttttttttttttcttgtaaatttatttaagttctttctagattctggatattagccctttgtcagatggatagattgcaaaaattttctcccattctgtaggttgcctgttc

SEQ ID NO: 62469 - DNA, 201 bp, Homo sapiens
tttaatgatcgccattctaactggtgtgagatggtgtctcattgtggttttgatttgcatttctctaatgaccagtgatgatgagcattttttcatgtttkttggccgcataaatgtcttcttttgaaaagtgttcatattctttgctcactttttgatggggttggtttttttttttttcttgtaaatttatttaagttc

SEQ ID NO: 62470 - DNA, 201 bp, Homo sapiens
aacatgaactcatccttttcaaataacatgaactcagccatagctgcatagtattccgtggtgtatatgtgtcacattttctttatccagtctgtcattgmtgggcatttgggttggttccaagtctttgctattgtgaacagtgctgcagtaaacatacgtgtgcatgtgtctttacagtagaatgatttataatccttt

SEQ ID NO: 62471 - DNA, 201 bp, Homo sapiens
ttttgaatagaaatcaaccagatgagctagcattaaagtttggattcagaattttcatttatcaattgcagaaatataggtaattataagataactgcatmctgaagtaatttatatccagatataaatgtacgtgatcagtttgatcagttttccttttcacaaataaagtgttaaacatcaaagtggtttttagtataa

SEQ ID NO: 62472 - DNA, 201 bp, Homo sapiens
ctttgaatgatgtgcaaagagctatggcgctggacgcggtggctcatgcctattaccccagcacttcaggaggccaaggcaggcaaattgcttgagcccargagtttgagaccaggctgggcaacgtagggagactccatctctacaaaaaatacagaaactagtcagatgtggtggtgcacacccgtggtctcagctact

SEQ ID NO: 62473 - DNA, 201 bp, Homo sapiens
tattgtttctgtttgaaatttggggaaactgagtcccagaatttcctggttttaggtcttatttcacttgtcatgctggtggatgtcaaagatgcagtttwtcaccattcctgtgtagctagccaaaggtatccatccgtgcttctcttggttgcataaaattatggtgagagttagtagatggtgcaggttcatggacga

SEQ ID NO: 62474 - DNA, 201 bp, Homo sapiens
attaaaaaaatattctaagcaatacaatagcatttattctaaatatatttaaaattaaggtgtaaatttctcacacatcgtgttttgtcctttgtttcttktttgagactacaacctctgcctcccaggttcaggtgattctcatgcctcagcctcccgaatagctggaattacagccagctaattttcacatttttagta

SEQ ID NO: 62475 - DNA, 201 bp, Homo sapiens
aattatttgtacatttgtatcaattattcagaattatggaatattctagtttgagaagtaagagatacttgattttatagtgttaatagcaagaaaaaatrctttactttcttgcctatatttttgtttaatctttttaacaaccttaagagtagagcattatgatttctgttctatagcagatgagacctaaatgcaggg

SEQ ID NO: 62476 - DNA, 201 bp, Homo sapiens
aaatatttttcctatagtaaagagaacatataatgcatgaatgtagtactcattaatgctatatatttgttaaaatagaaaaatgttttatatttaaataytccacattgtacatagagcccaattttttagcataggaaaaaatgtgaaattttagcttatatttatatatcttttctccttctgtcagtgactgccacc

SEQ ID NO: 62477 - DNA, 201 bp, Homo sapiens
agatatgagttctaggctgttcttgctggaatgactttagggagtacagaaatgatccacccaagagccagttatagctaatatggttgctgcaactgtgwgttatgaatatactcctcttgctgcaatccagtaatcaggaagccagagttacactgctaatgctgtagtcacaattgcctcttgacacccagaaaattg

SEQ ID NO: 62478 - DNA, 201 bp, Homo sapiens
tagtcacaattgcctcttgacacccagaaaattggaaagtgccacaaaaagcactgctaacaccttgcatttctttatctttgtttgcagttaaaacagtygaaaggatgtaggaaaatggcttctgcttcgcttctgtgttcattatcttagatgaattgcttctaatttgcagaagcgaattctcatccagaatttgaa

SEQ ID NO: 62479 - DNA, 201 bp, Homo sapiens
ttttttgttttatccctctggcttttttcaattggtagtatgacagttgacaggcatgtaagaccattccatgtccatgtattagcatttttaatagctcygtagtataaatgtgccctaacttattattcatcctttctttattgatggatattagattatttccgatgtttttgcttctatgaataatgctgcatcttg

SEQ ID NO: 62480 - DNA, 201 bp, Homo sapiens
gcgtgcgcgcgtgtgtgtgtgcgtgcacacacgtgcactttaacactggattaatataaaaattagatattgagtctcccagtttcagttctgacattttragatcaaggaagttgttaatcttggctaggtgtggtggctcacacctgtaatcccaacactttgggaggccaaggcaggaggattgtttgagcccaggag

SEQ ID NO: 62481 - DNA, 201 bp, Homo sapiens
ggtcaaaatacatggccagtaatgtagtacatccttgggaacaggacattatttgcttcactcactggtggggagagggtcctaccatccatctcgaggcscttgggcaataggttttacttgggaaggtgatgtcagggaaggcaggtagccaggtgtgcttttactgccctcagggagttcctagtctacttgtgcatg

SEQ ID NO: 62482 - DNA, 201 bp, Homo sapiens
ttaactagtatatttttgcaggtatttgctttaggagaagctcctaagaaaaaatgattcaatcttaaaaaggccaaaatctaaatgaatatttatgtttrgacattaattatgtcattctgccagaccagtttttaaaaattatcagacacaccttcactaaactttgttagacaacttcaagttatatataagaataga

SEQ ID NO: 62483 - DNA, 201 bp, Homo sapiens
ttcattgctctcagtattgggtggcgtattcacaaagagaatttaaagaaatgacttatttccctcagcaacataattttatttggtaaaataatcaaatrctcagaaaaaacaactcttgtttctgtattaaagatgccactgatactagtagatttttagaaacgcacttgtatatggcataggtttgtcactttggat

SEQ ID NO: 62484 - DNA, 201 bp, Homo sapiens
gtatttattctcccttgttcattcccatgcagttgaagctaaaactctttgtgatgaatgttgagcctctgtcctatagaggacctcccctgcttaaccgmgagttcctcaatgtaactgtgtctcctaggtcgtataagaaggcattgattatttattttacaattaggaatttaggcaaagcccttagattcagagatg

SEQ ID NO: 62485 - DNA, 201 bp, Homo sapiens
tacatatacatatatatctgtttctgtgttgatctatctatatttaaaaatctacagtgtgtaatgctatttatcattgccacaacttaatgtctacacasaatgataggaagctttatcaaatatgtctttattttgctttcatttgtaaggattattttcactggatatagaattctgaatgaaatctcactagatagg

SEQ ID NO: 62486 - DNA, 201 bp, Homo sapiens
gcacttcatgtgaaaatttataatggattatcattgcttctagttgctcttagtgggcaaacataaaatatatatgtacacacacgaatatatatatacayacacacacacacacacatacacacacacatacatatacatatatatctgtttctgtgttgatctatctatatttaaaaatctacagtgtgtaatgctatt

SEQ ID NO: 62487 - DNA, 201 bp, Homo sapiens
gggcacttcatgtgaaaatttataatggattatcattgcttctagttgctcttagtgggcaaacataaaatatatatgtacacacacgaatatatatatayacacacacacacacacacatacacacacacatacatatacatatatatctgtttctgtgttgatctatctatatttaaaaatctacagtgtgtaatgcta

SEQ ID NO: 62488 - DNA, 201 bp, Homo sapiens
gcccctggtattagtcagttcttgcactgctgtaaagaaatacctgagactgagtaatttataaagaaaagaggtttaattggctcatggttctacaggcygtacaggaagcatagcggcctctgcttctggggagacctcaggaaacttactgaggtcatggcggaaggtaaagaggaagcaggctcgacttacatgggc

SEQ ID NO: 62489 - DNA, 201 bp, Homo sapiens
cagggttttaccgtgttggccaggctggtctcgaactcaggtgattcacctgcctcagcctcccaaagtgctggaattacaggcgtgaaccaccttgcccrgccaagaacatttttaatgcttgtttatataagaagatatttggctaggcctttgattttttgaaaggaagatcctaaatataaagtgcatgacctatta

SEQ ID NO: 62490 - DNA, 201 bp, Homo sapiens
agtcatttggtttgattgccccacaaagcataagatgtaaactgattaagggtatgaaagcaaagtgaaagacctcagatcttgtgcacattttgttttcytattatttcttttattgactgtagtgcatgatacctaatcaaggctccaatgtcttgcacaattcctactttaatgctagtggttttcagtgtccttaca

SEQ ID NO: 62491 - DNA, 201 bp, Homo sapiens
attacttgcttcaatttgcacctttcataaggattaaaataaattgagatcttaagaacttatttatttatttatttatttatttatttatttatttattwgagatggagtttcactcttttgcccaggctggagtgaagccgcacaatctccgctcactataacctccgcctcccaggttcaagtgattctcctgcttca

SEQ ID NO: 62492 - DNA, 201 bp, Homo sapiens
gatgaaattgtaaaagtcatttggtttgattgccccacaaagcataagatgtaaactgattaagggtatgaaagcaaagtgaaagacctcagatcttgtgmacattttgttttcctattatttcttttattgactgtagtgcatgatacctaatcaaggctccaatgtcttgcacaattcctactttaatgctagtggttt

SEQ ID NO: 62493 - DNA, 201 bp, Homo sapiens
cttggctcactgcaacctccgcctctcggattcaaacgattctcctgcctcagcctccagagtagctgggactacaggtgcgcgccaccacgcccggctawtttttgtatttttagtagagacgggattttgccttcttggccaggctgctctcgaactccggacctcaggtgatccacccacctttgcctcccaaagtgt

SEQ ID NO: 62494 - DNA, 201 bp, Homo sapiens
gctggagtgcagtggcatgatcttagctcttggcaacctcggactgccgggttcaagcgattcttgtgcctcagccttctgagtagatgggattacaggtkcctgccaccacgccaggctaattttttgtatttttagtagagatagggtttcaccatgttgactgggctggtcttaaaatcctgacctcaactgatctgc

SEQ ID NO: 62495 - DNA, 201 bp, Homo sapiens
ttactttttagcacaagaagaatagcatcactaccaaaaccagctgagatatcttattttatttatttatttatttatttatttatttatttatttatttagatagagtctcactctgttgcccaggctggagtgcagtggcatgatcttagctcttggcaacctcggactgccgggttcaagcgattcttgtgcctcagc

SEQ ID NO: 62496 - DNA, 201 bp, Homo sapiens
gattctggtgttccacccctcaccccggtggatagcaatgtgcccttctcgtctgaccacatagctgaatttcaagaagaaccactggacccagaaatggkgcctctctcctctatgtggggagacacttcactgttttctacttcaaagtctgatcatgatgtggaagaatctccttgccatcaccaaaccaccaacaag

SEQ ID NO: 62497 - DNA, 201 bp, Homo sapiens
attactttttagcacaagaagaatagcatcactaccaaaaccagctgagatatcttattttatttatttatttatttatttatttatttatttatttatttagatagagtctcactctgttgcccaggctggagtgcagtggcatgatcttagctcttggcaacctcggactgccgggttcaagcgattcttgtgcctcag

SEQ ID NO: 62498 - DNA, 201 bp, Homo sapiens
tacagccactctgggggacagactgacagttctttaatgaaaataaacacactctcatgatctgacccagctgaaaacttttgtccacacaaaaacttacrcatagatgtttatagcagttttatttataactactccagtttggaagccaccaggatgtcctacactgggtgaatgtaaaaagtgtggtagatccagaca

SEQ ID NO: 62499 - DNA, 201 bp, Homo sapiens
tttgcaatgataaagggagatgattaaaaataaaggggcctacaaatgtaagaaatttagtattagtggaaagaaccatgggctgggatttctaaaacctkgctttggcacctaatagccttccaaggtaagctcactagacacaggtccatactatataaaacaaaaagggttcagttagtgtattttgatgcttttctt

SEQ ID NO: 62500 - DNA, 201 bp, Homo sapiens
cctacccccaccaagcttgagtgtcccagttcgacttcagactgctgtgctggtagtgagaatttcaagccagtggatcttagcttgctggactccatagrggtgggatctgctgagctagaccacttggctccctgacttcagccccctttccaagggagtgaatggttctgtcttgctggtgttacaggtgccaccggg

SEQ ID NO: 62501 - DNA, 201 bp, Homo sapiens
attgtggagaatcctaaatgaagttgattttctggacagtttgatgatttcttaaagatcgatgaactgctggtttctttttaaagggcattcacaaaagygaccaaaacttgggctaaagtattgctttcaaatatacttatgtgtagcttgtatttgtgagtgtgtgtatgtgtttgtgtgtgtgtgagattttgatag

SEQ ID NO: 62502 - DNA, 201 bp, Homo sapiens
agaaatagaaggatgattatcttaagttatgtttacactttggtaatatttgaaaatggatgtatatactggaaatgtctgtaagtgtcttgtttttgcayctaatttatgatctattatattgcattttcttaaatatcttagaagtatttttctttataactttgtatattgaatgtttagataaatgtccaactgaca

SEQ ID NO: 62503 - DNA, 201 bp, Homo sapiens
gcctctccacaccatcttgtatttttacttacactgttactcatcacgattagggtcaaagaagataggcttattaatattattcctctgagcagttgcaraggataatgaattctgtacccttgaagagcaattgaagaattgtctctctaaaacatctatcctttcatcacatggagaaagcacccagaattccctcaa

SEQ ID NO: 62504 - DNA, 201 bp, Homo sapiens
cctaatgtgtactgtgtcattttgggactgtggaaaccttggattctgatctagaccttgtttcaccccttttgctttcgttttgcaagacttggaggggrgacgggaacatcaaggactctgaaaaatgtgtggttgaggtgttttgcctcagatgttgggaggggttaaggtgcgggagaagatacaggctgagagaga

SEQ ID NO: 62505 - DNA, 201 bp, Homo sapiens
ggtagatgacccaggaaagttgcgagccagtgtattgtgactgtgatatggactgttggtggagtacataaatagaacattacctctgaccctgtatgtgygtgtataaattgattacaacagaatcccatagtaacatggaatttaagaaaatcatttgtgttataaggggactcctaagtccagataatcaaaaacaaa

SEQ ID NO: 62506 - DNA, 201 bp, Homo sapiens
aataatgagaattgactacaagtagttttgccaaaaattgtaaattatggaataacctgtgtagtcacttaaatgcttgcagaatctggagaattaatgaraacttttgatgtggtataacatattaaaatgactttactgtaacatctttgatttaaataatgaaattaaccacatttgtataatgtcttataaaatttt

SEQ ID NO: 62507 - DNA, 201 bp, Homo sapiens
ttaagctttaggtatggatatcattagcttatctgatcaatacactattatcagaattttaagaagttcaggttaactagtattttctgaaaacagaaackcaacatccctacaaaattatggagaaaacacagctatgtatttcagacaaaatttttaaatcagtctgatttgtccaaagaatcagtttttagctttaaa

SEQ ID NO: 62508 - DNA, 201 bp, Homo sapiens
tcatcactggattaagctgacaataaactactgttattcttcaagaaacatccatcttctgcacagaccaaagtagtgatttaatttgagtgcacagctcrgttgtactttgtcttgggatgtgaaaagccagaaagaatgtcactcccatagtgatatcactcccacagaacaataaggataaagacagataatctacac

SEQ ID NO: 62509 - DNA, 201 bp, Homo sapiens
ggagacagggacatttatttatgattcatatcaaactggaaggtagttttcaattgtgactatacactaaagattgtcacttgattcacatgtattcaggrcttataaaactaagtcatcatacttagaaatggtttcatgctatcacggtgtctgtcagaattagcaggcaatatctcattataggaaattttaagtata

SEQ ID NO: 62510 - DNA, 201 bp, Homo sapiens
gacagggacatttatttatgattcatatcaaactggaaggtagttttcaattgtgactatacactaaagattgtcacttgattcacatgtattcagggctyataaaactaagtcatcatacttagaaatggtttcatgctatcacggtgtctgtcagaattagcaggcaatatctcattataggaaattttaagtatatta

SEQ ID NO: 62511 - DNA, 201 bp, Homo sapiens
ttatgattcatatcaaactggaaggtagttttcaattgtgactatacactaaagattgtcacttgattcacatgtattcagggcttataaaactaagtcaycatacttagaaatggtttcatgctatcacggtgtctgtcagaattagcaggcaatatctcattataggaaattttaagtatattagtgattttttaaaaa

SEQ ID NO: 62512 - DNA, 201 bp, Homo sapiens
gtcatcatacttagaaatggtttcatgctatcacggtgtctgtcagaattagcaggcaatatctcattataggaaattttaagtatattagtgattttttwaaaaatgtaaaattttgagattttaggatttggagaataactacctgagcccatcctctttgttgtgaattagcaatgggacagaagtatttgtaatata

SEQ ID NO: 62513 - DNA, 201 bp, Homo sapiens
gtacccaggggttacatcagttcatggggttttaaaatcacagatactcacagaggaatgagagatacaggatacaacttcagcaggggcacagccaagcytcatgggaaactgaaaaatattcttcaaaatatccctgaatctggtgatttgccactgtagagacgtaggtgtcttctcggaagtggcctctcattgcct

SEQ ID NO: 62514 - DNA, 201 bp, Homo sapiens
cactgatttcttggttatttcttggttacaggctgtcatggtggtcacctgatccttacctgatgttactggttaccttgagattttatcagtgtctgtgrtctcttcatcagttctctccaaaggtttctctcactgattatctttcaatattcttagacttgaatgaagcagtcccagagacagagcgcctggattcaa

SEQ ID NO: 62515 - DNA, 201 bp, Homo sapiens
gagtatttattctcccttgttcattcccatgcagttgaagctaaaactctttgtgatgaatgttgagcctctgtcctatagaggacctcccctgcttaacygagagttcctcaatgtaactgtgtctcctaggtcgtataagaaggcattgattatttattttacaattaggaatttaggcaaagcccttagattcagaga

SEQ ID NO: 62516 - DNA, 201 bp, Homo sapiens
ttcctcagagatacccaattataagagtatgggactgcagagaaaatatttatatgtttctacacagctagagctttctaggcatttttactagaatgtgsaacctaagctaaaaaacaagcctcagaaaataaattatgaggctgagtgttgtgattcacacctgtaatcgcagcactttgggaggccaaggcaggaggt

SEQ ID NO: 62517 - DNA, 201 bp, Homo sapiens
aacagctttcactgtgttacttggcagaaatcttctttatgggcagtctgcagtctgaatctaagagctacagtttaattcttcctgaaagctgtcctgtrttcagtcactgcttcatcagtatggcctatggtatagaaatgggacagccactctagatggatgagaggtggacaggcaggatagatacagcactaggtt

SEQ ID NO: 62518 - DNA, 201 bp, Homo sapiens
tctgtgcattagtggaggaatattttaagtacctttcataataattattactctgttcaagttttcaatttcagggggacgattttggtattttgcatttytcaagaaatttagatatttcctttaggctattatacttattaacttatatttttataaaataatttttaagtattgaagtattttatatttataagtagt

SEQ ID NO: 62519 - DNA, 201 bp, Homo sapiens
tgattaaagtcatttaatcagataagatcttatgaaaatggttcctgattttaggtaatgtggttattggtaccacctcagtcctggaaggcagtcatgtyagcctcaaccttttggccagggtttttctggacagtagaattgctctaacccctagacttcctccttgtatgccaaggtttgagtctatgtaattattga

SEQ ID NO: 62520 - DNA, 201 bp, Homo sapiens
ctgagtcttcaggtgaacgaaccactctcagaagtgcctctcctcacaggaatgcatatcgaactgagtttcaggcactgaaaagtacctttgacaaaccyaagtcagatggggaacaaaaaacaaaagaaggtgagggctcccagcagagcagggggaggaaatatggctccaatgtcaacagaattaaaaacctattta

SEQ ID NO: 62521 - DNA, 201 bp, Homo sapiens
gtatctccaaattgtgtttggaacttttttttttttttttttaccaaagaccaatcagaatgataactttttgacttttaacttcccatttcaatgagtartctcttctgtttgccacgtggctaagccatttggaaaaaaaaatgtatgttatttgactagacataaattcaaataagtaaatgaattcagaaattcatt

SEQ ID NO: 62522 - DNA, 201 bp, Homo sapiens
atgtgtttgtgtgtgtgtgagattttgataggtatctccaaattgtgtttggaacttttttttttttttttttaccaaagaccaatcagaatgataacttyttgacttttaacttcccatttcaatgagtaatctcttctgtttgccacgtggctaagccatttggaaaaaaaaatgtatgttatttgactagacataaat

SEQ ID NO: 62523 - DNA, 201 bp, Homo sapiens
ataggcagaagggacttgccttgtctcggatgagatgttgaactgtggacttttgagttaatgctgaaataagttaagactatgggggactgtttggaagrtgtaattggttttgaaatgtcaggacatgtgatttggcaggggctggggcagaatgatatggtttggctgtgtcctcacccaaatctcctcttgaattgt

SEQ ID NO: 62524 - DNA, 201 bp, Homo sapiens
caattttgtcaaagattagatgtctgtaggtgatagagtttggctgtgtccccacccaaatctcatcttgaattgtaagtcccacagttcccacatgttgwgggaggaacctggtgggaggtgattgaattttgggggtggaggcattcctacattattcttgtgatagtgaatgaacctcatgagatctgatgattttaa

SEQ ID NO: 62525 - DNA, 201 bp, Homo sapiens
gtgggtcctaatccaatatgactggtgtccttattagaagagaagagacgcagtgggaagacagccatatgaagatggagacagatactggaattatattscctcaagccaaggaacttctaggacaaccagaagctagaagagggaaggaagaattttttcctagaggctttggagggagcatggcccagtaacacctta

SEQ ID NO: 62526 - DNA, 201 bp, Homo sapiens
ttacagagctttgcccatttctatccagttttgattagtctaagcagagcaggtttgtgggattttgcctgtgtgtgagcttggctgggcttacatggagstgactcaagggctagcacttgcttttgggagttgaaatgtcagttttctcaaaactctcatatgccttttggtttctacactcacagatttccaccattc

SEQ ID NO: 62527 - DNA, 201 bp, Homo sapiens
tctccttcagttccactctgatcttagtgatttcttgtcttctgctagcttttgaatgtgtttgctcttgcttctctagttcttttaattgtgatgttagrgtgtcaattttctatctttcctgctttctcttgtgggcatttagtgctataaatttccttctacacactgcaaatgtgtcccagagattctggtatgtag

SEQ ID NO: 62528 - DNA, 201 bp, Homo sapiens
aagtcacttctatcactttttcatgagattatgttttgtatattttatagtttttggctgccagggcctctttgctatttttgataattaatcgttgtttrtaactgttaaaacatctgaatttctttattctttttgaaacacctctatgatttagaaacaagaagcccagcggaaagtcatgtagaatgactgactatt

SEQ ID NO: 62529 - DNA, 201 bp, Homo sapiens
caacctttgttttattatttgactcttacagatagtgctaaacctcaagtatgaattctctttatatgagaccagaacactgtggaaatacaggattttarataggcctttacaatgcatatattttacataatttcaccctaaaaatgtaacatgtatttggcaaaggaagggcttttgttgctgtcattctccctcatg

SEQ ID NO: 62530 - DNA, 201 bp, Homo sapiens
tttgggaggctgaggcaggcggatcacaatgtcaggggatcaagaccatcctggctaacacggtgaaaccccgtctctactaaaaatacaaaaaaaattakcctggtgtggtggcgggtgcctgtagtcccagctactcaggaggctgaggcaggagagtggtgtgaacctgggagtcagaggttgcagtgagccgagatc

SEQ ID NO: 62531 - DNA, 201 bp, Homo sapiens
gtttctgagttcagtaggacttaataccttaaatagaacttaattcctgaggtaatcagaaatgagatattttctttcattttattttctctcattattgkatatatatgaaaatggctttaggttatgtttactagttttataacctgacttcttagttacactgctaatcttttccagtttattttttagttatattct

SEQ ID NO: 62532 - DNA, 201 bp, Homo sapiens
ttttctttccctcaaatatctgacttcagtaagcaatgattgttatgagataaatgtttgctcttaattatatcaacttctttttatttttttgtttctartaatcactttgttttctggttttcgctttgtggtctgtgtctttgttactttcacttaagtagtgatcttcaaacagttaatttatataatctgtgattt

SEQ ID NO: 62533 - DNA, 201 bp, Homo sapiens
aacctccgcctgctgggttcaagcgattctcctgcctcagcttcctgagtagctgggattacagatgctcaccacaatgcctggctaatttttgtattttyagtagtgacggggtttcgccatattggccaggctggtctccaactcctgacctcaagtgatccacctgccttggcctcccaaagtgctgagattacaggc

SEQ ID NO: 62534 - DNA, 201 bp, Homo sapiens
accagaggagataatgatcatccggtccagtttttcctcagagatacccaattataagagtatgggactgcagagaaaatatttatatgtttctacacagytagagctttctaggcatttttactagaatgtggaacctaagctaaaaaacaagcctcagaaaataaattatgaggctgagtgttgtgattcacacctgta

SEQ ID NO: 62535 - DNA, 201 bp, Homo sapiens
ggtagctgcacttctccttttcctcacctcctcattatcacctacctgttatttctctctttaggcatttttgaacagaattgaaggaaaacgccattcargtctgctatttgcctgtaaacagagtggatacaatctcactgaccacccaatagtcactgttaaaatcttttcaattcttatgatgacagctgatggata

SEQ ID NO: 62536 - DNA, 201 bp, Homo sapiens
aagactagttctctgtgttgcatttttatgccaactttagctgctgccagaatcttggatgccctaaataccagtgcttacagtggaagccagcagggtgkaccagacagtgaaaaagattcctttgctcatgttgtcagcttatctgaaatcttgaacagctgtttgaatgaatgaatgaagtacatattaaagggagtt

SEQ ID NO: 62537 - DNA, 201 bp, Homo sapiens
acccatcaaaaggagagaagtctttttttatattgtctaccatatgatacaaaaattaattttggtaatattaacaaatgttccttttttggtaatacttsattcctgacataaacattacatctatgttattaagtcatgtcttctagaatacagcctgaactatgcataagacttctttgttttgaagttataaatttt

SEQ ID NO: 62538 - DNA, 201 bp, Homo sapiens
ttatgattaaagtcatttaatcagataagatcttatgaaaatggttcctgattttaggtaatgtggttattggtaccacctcagtcctggaaggcagtcakgtcagcctcaaccttttggccagggtttttctggacagtagaattgctctaacccctagacttcctccttgtatgccaaggtttgagtctatgtaattat

SEQ ID NO: 62539 - DNA, 201 bp, Homo sapiens
ttacttctatgagatcaacatttttttagcttcctcatatgaatgagacatgtggtgtttaactttctgtttttggcttattttacttaacataatgtccrccagttccatccttgttattgcaaattacaggatttccttcttttttatggctgaatagtactccattgtgtataaatacaccacattttctttatctct

SEQ ID NO: 62540 - DNA, 201 bp, Homo sapiens
taggtccatcccattcataaaaacaatgcaaaaaggtcctaaacaaaatattagcaaaccatatgaagcaacatataaaagagataatatatcatagctasgttgggtttagccaggaatgcaagtatggtttaacattggaaaatctgtcactttttatatttgacattgtactggaaggcaagtaaaagaaattaaaga

SEQ ID NO: 62541 - DNA, 201 bp, Homo sapiens
atttgaacaattgaaaaattttaaatgtatatctgaatatatctgtgattcatgatttaatttctgtttaatcgaagtattgatcacttgtttttttttttctttctttctcttttcttttttttaataatctgaaaggttgccatggaggatttcaataaatctctcagacaatcagcactatttcatgacactcggggg

SEQ ID NO: 62542 - DNA, 201 bp, Homo sapiens
cgaaatcccttcaccacaaagccaactgttagaagatgctgaagctaatttggttggaagggaggcagcaaagcaacagaggaaagaacttgcaggtggtratttcacctctcctgatgcttctgcatccagttgtggaaaagaagtacctgaagattcaaataattttgatggttcccatgtgtacatgcacagtgacta

SEQ ID NO: 62543 - DNA, 201 bp, Homo sapiens
gtatcacctgtgtggcactcttttgtgacatttgtatcttgtacactgtcactatcatagtcttaaatttctttatgtgattaatatacatgtccaaataytatatagcactgggcacttttcacaggatcatccacaaaacttggggtgagtgtgaaggatcatattgtattagagtctttacaaagtttcatgttacag

SEQ ID NO: 62544 - DNA, 201 bp, Homo sapiens
agttaagggtaaattttctggagaaattaacgtatatactggtatttttttttaaccatgacagcgttttgttgttgttgttgttgttgttgttgttgttkttttgagacagagtctcattctgttgcccaggctggagtgcagtggcgcgatcttggctcactgcagccttcgcctcctgggttcaatctattctcctgc

SEQ ID NO: 62545 - DNA, 201 bp, Homo sapiens
acgatggcccttcatattccaagttcactgagactcgaaagatgtttgagagaagtgtgcatgaatcaggacagaacaaccgctattccccaaagaaagaraaagctggagggagtgaacctcaggatgaatggggaggttccaagtccaacagaggcagtactgattccttggacagccttagctcccgaactgaggctg

SEQ ID NO: 62546 - DNA, 201 bp, Homo sapiens
accaaagagcaatgcagaaaaagaaaaggtctgcagaaagtggctgagtgggagaaagaggtgtaatctagttacctgtttctctgcagcccttatttggycaaagaatataagttatcaagaaaagtaggtagatgacttgttctctaagaatattttaactcacaacccaactttaacaaatattgaaggcagtgagat

SEQ ID NO: 62547 - DNA, 201 bp, Homo sapiens
aggaccgagcagtggtcaaaaagaaactcaaggaaatgaagatgtctctagagaaggctcggaaggcccaagagaaaatggaaaaacaaagagaaaagctraggagaaaggagcaagagcaaatgcagaggaagtccaaaaagacagaaaagatgacgtcaactacagccgagggtgctggtgagcagtaacacataccct

SEQ ID NO: 62548 - DNA, 201 bp, Homo sapiens
aagaaatgacttatttccctcagcaacataattttatttggtaaaataatcaaatgctcagaaaaaacaactcttgtttctgtattaaagatgccactgayactagtagatttttagaaacgcacttgtatatggcataggtttgtcactttggatctttaaactaacatttgtttataacattggctgcatgaggcatgc

SEQ ID NO: 62549 - DNA, 201 bp, Homo sapiens
tatttattgaaccacaccccttctcatactatctttccccccaaaggaagtgaattaattcactacctcttgttattacagtttttcattttaaaaacaaraaacacttaagttttccttttctcttatttcaaagttatatatttagccacctgagttatgctatgcgtcaaaatgtttgttgttgttgttgttgttggt

SEQ ID NO: 62550 - DNA, 201 bp, Homo sapiens
tacagatgagaaaatcgttagcattttgctattgcagtattttgacaccagcagcagcaacaatagcggtcactcgttttgagcacctaccatgtgccagmccttgtgttaaatacataggcaccatctaacttaatcttatgacagctttcttatgctaaggaactgttttgtccttactttatagatgaaaagattaaa

SEQ ID NO: 62551 - DNA, 201 bp, Homo sapiens
attcatcacactagttattgcctgaatactttgtttgtttgtttgtttttgtttgtgtgtgtgtgtgtgtctgtgttgtgttttgttttttttttttttttgagacagaatctcactctgttgcctaggctggagtgcagtggtgcaatctcggctcactgtaacctctgcctcctgggttcaagtgattctacttcctca

SEQ ID NO: 62552 - DNA, 201 bp, Homo sapiens
attcatcttgaatccttggggcaggttggggccagtaaatgaggaggacagaggcatggaagttttcttgggcttgggtagaagctggtgcctaccccaamctgggaatataagtagaggaacaggtatatatagaggaaaggaaaagttttacttcagaaatgaccaatttgcttataaaagattcatgtgttgaggtct

SEQ ID NO: 62553 - DNA, 201 bp, Homo sapiens
tattcatcacactagttattgcctgaatactttgtttgtttgtttgtttttgtttgtgtgtgtgtgtgtgtctgtgttgtgttttgttttttttttttttttgagacagaatctcactctgttgcctaggctggagtgcagtggtgcaatctcggctcactgtaacctctgcctcctgggttcaagtgattctacttcctc

SEQ ID NO: 62554 - DNA, 201 bp, Homo sapiens
gatttttctctcttctggccctcatctctccaaccccaaatgctttttttgttgcattagtttatggtgttgtcctggagaaataagggatggtgaaaacmatcataatcataacgtcatgcagtcagttagcatattctaggcactgtggttaactctttcatatcactacaatgaattctcatagcaacctctttaaat

SEQ ID NO: 62555 - DNA, 201 bp, Homo sapiens
tttgaccagaggaataaaaaggaaaagacaccaccaggtatggagaagctgagttaggagaccctatgaggtggtgccctctaaagaggagcagtagacartgacaggaaagaatgattcaaggacccttgagacataccttgactaggtaacaggtaagaaagtgaggcaaaactatcatgggcttcacgcctcagaaca

SEQ ID NO: 62556 - DNA, 201 bp, Homo sapiens
tcagtgttcctgggaacgcactttggcaaatgtgtgagataaagatgtaaggttgcctagcaccaagctctgtgataggcagaatcaggcttttagtcgcrtgatgtccaaataactgcaacactcatgggttacagagtgttttcgtgtacattgcctcagctggtcttctcagcgctcattgtaacatctcccagctac

SEQ ID NO: 62557 - DNA, 201 bp, Homo sapiens
tgttgaaaacattttttagctatgtggagacttgcctgaatgctgtctcctatttaggtagaggccaataagatgatagctggaaaagcttcgattgtctrtcatgaagaccaggatggaataaaagaaaaataagtaatgcagttgtgatattctgcagtatacttcggctctcttaataagatcatgctgtaagcagtg

SEQ ID NO: 62558 - DNA, 201 bp, Homo sapiens
aagttacacatacttaaaatatgattggttttgttattataaaatgttaacagtatgaatttgattctcctaaatatttcatattttaaatctcctcagargtatattatcccaagcaattttctcaattatttgaggctgcgtgaagaatttgagcaagatgttcatcagatttttgttagttcatttaagatatatcaa

SEQ ID NO: 62559 - DNA, 201 bp, Homo sapiens
ggtgttacttgtttttaaatgcatgatggttatttccagcatgacactgcaaaccttatctaacattttattgaaacacatatggtggctaactttcacaygttgtttggtctccttttatctgtgttcgcttttctttctcaaacagaaacgtgattaatgttacttgaatttaattcttttcagtttcaatttaaatct

SEQ ID NO: 62560 - DNA, 201 bp, Homo sapiens
atggatacagagaagtgaaacgctcccttatggctagtgggaatgcagaatttcactgccacttaggaaaacagtttggaagttttttttaaagttaaatrtacacttaactttttgatccagcaattccactccaagatattttccaatagaaatgaaaacatatgtctacataaagtcttgcatgtgaatgacaacttt

SEQ ID NO: 62561 - DNA, 201 bp, Homo sapiens
ttcctctcctcactatgtacgctcaagtttttgtcctcattttgtttctttttaattctggagcaacctttcactttatctgagaactaaaattctgtccyttttcttgaaaaataaacatttatcctattacatcacctacatagttacactttttcttaaaactgtccctgctaaaatagactcagttacccatattac

SEQ ID NO: 62562 - DNA, 201 bp, Homo sapiens
actaagtggagcacagaggatttttttagggcaatgaaaccattctgtatgatactataatggtggatacatgtcatccatcatacatttgtcaaaacccrtagaatgtgcaataccaagagtgaatgcttatgtcagctgtgggctttgaacaataatgatgtgtctttaaaggtttttttttttttctgtaatatgtga

SEQ ID NO: 62563 - DNA, 201 bp, Homo sapiens
taatgctttgcatagagaaggtttgaaataaatcttttgagtgaacattcagctgtctacatttaaaacaaagaatgtggaatatgactatcttgtgtccyaaattaacttattaacagtcttcctccttttcagagtagttaaggaaataacctctttgcccctttaataaattatatataatgatagtagtatttccag

SEQ ID NO: 62564 - DNA, 201 bp, Homo sapiens
aatgtttttcagataggtatctaattcttttcataatttattaaatagaccactctaatttgaatagaaaaggagtggaacagaatagaatataaaaatgratctatcccagagctcaaactatattgccttaataagcgaagttttattatgtgttttgatatccactagggcctgattctacccttattctttttcaaa

SEQ ID NO: 62565 - DNA, 201 bp, Homo sapiens
tgggggacagagtgagactccatctcaaataaataaacaaacacacaaacaaaccaagcttcagttttttctcctgtaaaattgaaataatgtctattttrtggttttatggtaagaaacaaattacatgataaatatggtcagctaagctcagctgagaatcagatgcctttggtgggttgtagtttgatggtactcttc

SEQ ID NO: 62566 - DNA, 201 bp, Homo sapiens
ccaaaaccctggggctaacttgcaacctttatgttccttagaaaactttggccttaacattctggtccaagcatggcctaatgtttttacctttgtttccrttaagcacacctgggataagccagaattttcaaaaagaaattcttaaataccaagggagaatggtaagaaaatactttttaaaactgacaaatgtattac

SEQ ID NO: 62567 - DNA, 201 bp, Homo sapiens
atctgtcgaatgtttccctgtggaaaagaggattttaatatatttttctcttgctgacttgagtaaagatttctgattatcctagaacagagataatggargtaatttttcatggaaaaactatatactttcgtttgtaagctgttagaattggcattttgttggttgggtgccaggctgctagactatgcaccacgtggg

SEQ ID NO: 62568 - DNA, 201 bp, Homo sapiens
attagttattgatttgcttttgtaaagcaacagcagaaaatgttgcccttatctgattgtaatatttctagaactagagctctcttaaaacatttcctgcraagatatttttcactttttaaagaaaaatgtttccatgctctcacaggataagtagagagagggcaaaagttcagtctcactatttaagtttctgtgtaa

SEQ ID NO: 62569 - DNA, 201 bp, Homo sapiens
gtctaaaagttggtttattttatttatttaattctatgaaaaagaatctagaaaagttataaaatgcatgggataataacattaagttatctttatggaaktttccactaccatgtagggaagctataaattgctgcctacttaatagcaaacagttacttatttaaaaaagagctgtaattacaggccatcaactacatc

SEQ ID NO: 62570 - DNA, 201 bp, Homo sapiens
ggaaggggggagggatagcattagaagatatacctaatgtaaataaggagttaatgggtgcagcacaccatcatggcacatggatacatatgtaacaaacytgcacgttgtgcacatgtacactagaacttaaagtataatgaagaaaatatatattaaaaaaagactcttgctttaaagaaagaggttgctgcctactct

SEQ ID NO: 62571 - DNA, 201 bp, Homo sapiens
aagaaagccctctgtaaaaggaggattgaaagagaaaatttcagcttcccctttctgactgcttactatcattacagggcgcctttgcgaaggaattccarcaagggaaagaagtggaaagaaaaagaaaaagaagccagtaggttttctgcaggtagcaggtacggttgtgtgattaagaacacgtgtatttctatacct

SEQ ID NO: 62572 - DNA, 201 bp, Homo sapiens
catagacattcaacttcactggcaaaaatcaaacaattggcaaagataaagtgtcacagtaaaatgtgatagccagcacatggaaaaacaggaaaattcayaaaactgtttcattaaaataatttggcattatccattaaaatagaagatgtgaaaatcctatggcccgacaaatttacttcgatgtgtatatatatcctc

SEQ ID NO: 62573 - DNA, 201 bp, Homo sapiens
tatttattctcccttgttcattcccatgcagttgaagctaaaactctttgtgatgaatgttgagcctctgtcctatagaggacctcccctgcttaaccgaragttcctcaatgtaactgtgtctcctaggtcgtataagaaggcattgattatttattttacaattaggaatttaggcaaagcccttagattcagagatgc

SEQ ID NO: 62574 - DNA, 201 bp, Homo sapiens
gagagttcctcaatgtaactgtgtctcctaggtcgtataagaaggcattgattatttattttacaattaggaatttaggcaaagcccttagattcagagaygcattgacttttgaattgtgactttaaaaataataataattgatctttttcacaaatgtgtatatcctagatgatgccaaagatcccaaatcactaaggg

SEQ ID NO: 62575 - DNA, 201 bp, Homo sapiens
taaccctggttttaatatttatgtaactttttgcagaaataatttaaaatagggagaggtaactttcaatcccaaacatagatcaaatacttagtaatttrtttgacctataatgctggttctcaaccctggctactctttacaatcacctgggagcttcttaaaattaccagtgtgatcttaaccccagagattctgatt

SEQ ID NO: 62576 - DNA, 201 bp, Homo sapiens
gtgttccacccctcaccccggtggatagcaatgtgcccttctcgtctgaccacatagctgaatttcaagaagaaccactggacccagaaatggggcctctstcctctatgtggggagacacttcactgttttctacttcaaagtctgatcatgatgtggaagaatctccttgccatcaccaaaccaccaacaagaaaatat

SEQ ID NO: 62577 - DNA, 201 bp, Homo sapiens
aaataaggacttggcttgcatgataagtaacatttctttatatagctattcagttgagctattgaaagtaaaacatacaaacaaacaaacaacaatagcaraaaacgctttgtgttgttgttgacagaaaagttgaagcttttcaatggtgttttcctctctcatgtcgcataaccatgatggtgataagcgtacaattat

SEQ ID NO: 62578 - DNA, 201 bp, Homo sapiens
cagtgtgtgcacatgacaggcctaacagatctcaagaaaactgttctttcatggctgttgatttcatgtagatttttgcatgtacacttcacatacacatrtgtttacatctctatgatgtatattagtagccatttcctttctaacattggtacttagtagtttgatttttttttaaacaaatcttattttatgtagtaa

SEQ ID NO: 62579 - DNA, 201 bp, Homo sapiens
ttctgcttatccgttttacaaaaactgtatgaagatggctacatacttcttggtgtttttttgtttgtttttgagacagaatcttactctgtcacccaggytggggtacagtagtgtaaccatggctcactgcatccttgaccttggggctcaagtggtccttccatctcagcctcccaagtagcagggactacagatata

SEQ ID NO: 62580 - DNA, 201 bp, Homo sapiens
aaacacttggacacaggaaggggaacatcacacaccggggcctgtcatggggtcggggaaggggggagggatagcattagaagatatacctaatgtaaatraggagttaatgggtgcagcacaccatcatggcacatggatacatatgtaacaaacctgcacgttgtgcacatgtacactagaacttaaagtataatgaag

SEQ ID NO: 62581 - DNA, 201 bp, Homo sapiens
acattctgttatggtagcttaataataatccttaaaagcaggaacagttagcctttgaactgtgttcttttccagttgtttggctcctctaagtattttcwtttgtctatgaattttagaattagcttgtcaatttatacaaaagagcctgctggtattttgatttgtattgtttggaatctgtgaatcaatttggggaga

SEQ ID NO: 62582 - DNA, 201 bp, Homo sapiens
tatggtctcctggaggtgagacagggtttatttgctaatagcctgttgagcaattcagttgtcttaccattgtctcctttccctgcctgatcttttttcaytgaatggccataataattttttttttttttgagagacggagtttcgcgcttgttgcccaggctggagtgcaatgctgcgatcttggctcatcgcaacctc

SEQ ID NO: 62583 - DNA, 201 bp, Homo sapiens
atgaaaagatcatgattttaactgagtaatttaggacagaggttggcaaactatggcccctaggccaaatctagacctctgtttgcttttgtaaataaagktttattgaatacagccatactcatgcctgtaagtattgtctatggctgctttcctactgtaaaggcagagcaagtagttgtctgccttcccagcactttg

SEQ ID NO: 62584 - DNA, 201 bp, Homo sapiens
taaatccagcctttttgttcagcataattgtccatgttgtgcaagtatcaatactttctaacttcttgttgctagctaggattcttttttttatggctgtrccacaattcatttgtttgttcgcctgatgacagatgtgggaattgttttcagttttgggtattacaaatagagctgctatgaacagatgtatacaaattt

SEQ ID NO: 62585 - DNA, 201 bp, Homo sapiens
ttctggatttcagttttctcatgtgcaaaataaggattatagagccaaatgagacccaaggttgtcttaagcactaacattatgtgatactttgaatattrcacagtggaaaacattaaacaagtgtgtgctaaatcggagttgttcaccatttctctctcatttttcttttttttaacttttaaaactgacacgtaataa

SEQ ID NO: 62586 - DNA, 201 bp, Homo sapiens
agtggaggaatattttaagtacctttcataataattattactctgttcaagttttcaatttcagggggacgattttggtattttgcatttttcaagaaatktagatatttcctttaggctattatacttattaacttatatttttataaaataatttttaagtattgaagtattttatatttataagtagttatccctttt

SEQ ID NO: 62587 - DNA, 201 bp, Homo sapiens
taatgaatgtaggcttatgataaagtggtttcaattaacaaaagtattgctgtgataaagtagtttcacctttgagtaaaacttgttgattgcactaagtrgaccatttttgccatttcattctggaaaccagagattgcggattttaaattttcttttaatctcctgaatcagcctggattataacatgctgtattttct

SEQ ID NO: 62588 - DNA, 201 bp, Homo sapiens
atatttgcttcaatataaattaggaagtttttccgtatttttttattttcagaaattacttttataaaagagacttaatgatgtagataagatagaaagtwccgttcctggaagtttgttattattcagcttttaattcagcatattaaaggtaatgacagaaaccacaattacttttgcactaaccttatataaaccatc

SEQ ID NO: 62589 - DNA, 201 bp, Homo sapiens
aactcatccatttttatggctgcatagtattccatggtgtatatgtggcacattttctttatccagtctatcattgatgggcatttgggttggttccaagyctttgctattgtggacagtgctgcaataaacatacatgtgcatgtgtctttatagtagaatgatttataatatcctttgagtatatacccagtaatgaga

SEQ ID NO: 62590 - DNA, 201 bp, Homo sapiens
gttgtacagttttaaaaacagaattattcttttgaattgcgtttcataagttcagttcttattgcctttcccacctcaatgattatcccagaaatctgaamattttataataatgaatgtaggcttatgataaagtggtttcaattaacaaaagtattgctgtgataaagtagtttcacctttgagtaaaacttgttgatt

SEQ ID NO: 62591 - DNA, 201 bp, Homo sapiens
tctggagtttttctctgccaagctctgagctcactagtactcagccctacaaactctggcctcttcagtctccctagagtcttatttttaactcctcaacygagtgagactgctgtgatctacttgggattcctagcctgcactgttatggaaagggtcttatggaaaagggatttactcagtttttttccttcactcatg

SEQ ID NO: 62592 - DNA, 201 bp, Homo sapiens
cttcaacgaatgcctattgaattcatccttattttctaaggaaagtggcaatggatcagaacgagaagatccaggttttagttctggttttaatggtgatycactgtgaggaaaagaccaggttggctgtcttctccaatctttagtcttcccgtgtctaaaatgagttcagaagagcctacagttggagcgtccactggg

SEQ ID NO: 62593 - DNA, 201 bp, Homo sapiens
  misc_feature (1)...(201): n = A,T,C or G, or insertion/deletion polymorphism (see Tables 1-2)
tctatgtggggagacacttcactgttttctacttcaaagtctgatcatgatgtggaagaatctccttgccatcaccaaaccaccaacaagaaaatattacnagaaaaaggtattgttaatttctttttctgacttcataacacctcagcttgtacagtataaaaatgactttttctcataatcataagtcatttgttttct

SEQ ID NO: 62594 - DNA, 201 bp, Homo sapiens
cattttttttcatatctgagggacatcagtggaaattaggatggagaagtcccattataactggctaaatgataagcatctaacggaatatcaaattagargaagtaaaagatttttttctagagatttgtaaaacaggttatatgccagtagaaggcatgaaaatattttcctcgttcctgttatataaacaacctaata

SEQ ID NO: 62595 - DNA, 201 bp, Homo sapiens
gaactttaccttcatagaatttaattgatttgcccagggttatgcagcaggcagttaatgtcaacctggggcttgctcctcctgtgtagatgtttttccawcatactatgccaccttcagttacttatgcatctaatgatgcttaaatttctttataaaatttggaaataatctcaatatcatagactaaggaagaaacac

SEQ ID NO: 62596 - DNA, 201 bp, Homo sapiens
aaaccacagcttgtcaagggcaggtggccatcagcacactgcttcaccacagtcgatgcctgctttgaacccacagctagacttctagattggctgcctcrccaccactgtatttttaaaactctggagtccccctgattcagcagtcagaaattattgtacacatacccacactacaaactagtttctaattagaatcat

SEQ ID NO: 62597 - DNA, 201 bp, Homo sapiens
ctgagctggaatccaaggtagtagtccttacttttccattaggcaagtctctgaattcctgggaccttggtttcctaccaaaaaataagtggattgggctracactgcatggctctgacttcccattcacctctgcgtacactgtccagtatggttgcctctagtcagataaggctagtctatattgggatatgtgtagga

SEQ ID NO: 62598 - DNA, 201 bp, Homo sapiens
attccccataactgtctagcccatttttagctgcatttatcaatttaatattcagttttctttttaagtacagtatttcaaatgcctgaagcctgacaaayttacattcttaacaggcaaacacttttccatacttaaaaaagctcttgaaaatctaataagttactgtttaactgtagtgactctaaacgtcccaatata

SEQ ID NO: 62599 - DNA, 201 bp, Homo sapiens
aggtagaatcagtggacacatttctctttcagatttctattcatacaaattttcttaaacacctaagcaatatatctgttattcttaaacttagcatttakattttgatagtatggattttatttacgtgatcctcttctatttcattttaaacccctccagtatggggaagactcattaagggaatagtttcaccatctc

SEQ ID NO: 62600 - DNA, 201 bp, Homo sapiens
gagctttagatggacatgtttctcacagctgttatccattagggtctctagatcccatttagatgaggctagctttacaacctcaaactccttggtggatrttagaaccttatagaattacttcattcgatttaggtaaatacaagtctgcaatcttcctctggttgcaactaattttcttcaattaacttcttttactcc

SEQ ID NO: 62601 - DNA, 201 bp, Homo sapiens
caactaattttcttcaattaacttcttttactcctgggcttaaattctgtatttcttttatacttcatctgttctggcagtttctgaactcttaatgataytttgatgacatccagttagatgctgaatacttcacacacctgtattcaaagttagaatgacaacaacaaagatcaccttggaatgtttagctggcaattt

SEQ ID NO: 62602 - DNA, 201 bp, Homo sapiens
tcttgattgcctataaaggaattaaatatgcatttatataataaagtagttgtgaagtttttgaacataattagaaaaaagactctttgttgatcgagtayaaaatgtgcttcatgaagcgtttgattagttaaaatatgaaaaattttagttgaagagcttttaatagggcttatctttagtcagtcattttatacataa

SEQ ID NO: 62603 - DNA, 201 bp, Homo sapiens
tgcttgaacccgggaggcggaggtttgagtgagccaagatcgcaccactgcactcctgggcgatagagcgagactccgtctcaaaaaaaaaaaaaaaaaaagattgggagagtagataataataccatactttattgatgaagaactttaccttcatagaatttaattgatttgcccagggttatgcagcaggcagttaat

SEQ ID NO: 62604 - DNA, 201 bp, Homo sapiens
tttgagaaccatcggcttaatgtaacagacaaaatatttagtatatttgtaatacttatttactaaatcatgttttcttatacaacttatttcttatacarattatttcatacgtagccagttcattatttgaaaaatcaaggtcagattgcccctgttagctgatattttaacctcttgattgcctataaaggaattaaa

SEQ ID NO: 62605 - DNA, 201 bp, Homo sapiens
tgccagtgtcatataaccatctctcatattttttttccatttagcaggatcaagtataatgtagggtgtcctttttctttttcttttaatttttttttaastacagctcattggaacttagcctatttcatccagatgtgtaacatcctccttaatactatttttcttcttattcccagttactctgagaattctttccct

SEQ ID NO: 62606 - DNA, 201 bp, Homo sapiens
ggaggatatagtttccatgagcttcccatactgagaatgacattctaattcatttatgaactttttccctgaaaaagtggtagggcaagttttattgttttaagagtgttttaaaggaaaagtctaacataaagcttgcatttggatgcttgtattgttttcaccttgtactttaaaaatctttagcacaatttattgaag

SEQ ID NO: 62607 - DNA, 201 bp, Homo sapiens
tcactcttccatttttgttagtttgtattgcagtgtgttaaaatttactgtaattttcatttttcagttcagatactctgtgtttttttttttttttttttgagatggagtttttgctcttgttgcccaggctggagtgcaatggcacaattgcagctcactgcaacctccacctcccaggttcaagcaattcccctgccc

SEQ ID NO: 62608 - DNA, 201 bp, Homo sapiens
caggagactggggcagaagaaggagaaaataaactcgttttgagaaatttcatgtgatgagggttttttgttttttatgctcatgtatctggttctctttkctgcgttgactctaaaaatgaggttatccactttccaaaggacaagtttcagaataagacttgaggccacatgaattcttggacagtattttacttcttt

SEQ ID NO: 62609 - DNA, 201 bp, Homo sapiens
ttttttggtgatttttttgagtttttccttctcatttgttttgtcccctccactagcagggagcttagttatttttaaaattgtttattctgttattttaraatatatgtttgtaaatatgcgtgtgtgtgtgtgtgtgtgtgtgtgtgtatatgtatatgtccacatatgtttgtatttatatatgtgtatcttaacaaa

SEQ ID NO: 62610 - DNA, 201 bp, Homo sapiens
atgttaatgaggctggttttagaaccatatgtgaaaaaaaaccccactgacttagggtttcaaagagatgtaaaattaacactcttatctagatacaaatratgagttatctaagtattgaacacattttgaagattttatttaagtcattaatgatggaactagtcagatattataaacagttcaaagaagcacaaattt

SEQ ID NO: 62611 - DNA, 201 bp, Homo sapiens
tgttaggaaaactggctagccatatgcagaaaactgaaactggaccccttccttacaccttatacaaaaattatttcaagatggattaaagacttaaacayaacatctaaaaccataaaaaccctagaagaaaacctaggcaataccattcaggacacaagcataggcaaagacttcatgactaaaacacaaaaagcaata

SEQ ID NO: 62612 - DNA, 201 bp, Homo sapiens
acagtggaaaagtgaaatgagaaacgtctactttctaaaaaaatgaaaataagaagttatgagtcaaaatatatgttgagagtaaaccattctgtaggtgyaaagtaggcagagtttcagctttagaatagatgtaatacaaatacatatacatatacttatactgtttcatatcctaacatcctggattgataacctgcc

SEQ ID NO: 62613 - DNA, 201 bp, Homo sapiens
taatatcattgtactgtagtcatagatacttggaaagctgaggtaggaagatagcttgagctcaggagttggaggctggcttaggagttgaaggctgcagkgagctatgattgcgctactgcactccagcctgggcaacagggtgagaccttgtctcctaaggaaaaaaaagtggtatgtagagatggtcagctccccgaa

SEQ ID NO: 62614 - DNA, 201 bp, Homo sapiens
aaacagtatcttaactatatagataaagtaatactccttttgcatcaagtgtgatagtaggagaggaggtatttcttccagtaaaaatcaagatgtattcrtatcctttgagctagtaagcctacttctcatagtgtattctatgtaaataattcaaaaggatgaaagttctctgtagcgttatttaaactagtgaacagt

SEQ ID NO: 62615 - DNA, 201 bp, Homo sapiens
cttgggtaaaatcccagactgtataaacaattcctttttaaaatggatttggttattttcaaagaaaagatacattttctgtattaatgcttaaatttccytaagagcttttatgataattaagcttaaaataccaaagatggatatggttacatattttgctgatttcaaagtttggagaatagttaatgaacaactact

SEQ ID NO: 62616 - DNA, 201 bp, Homo sapiens
gagtacagtggttattcacaggtgtggtcataattcactgaagcttcaaactcctgggctcaagtgatcctactgcaccaagccttcctagtagcttggastacagttgcgctccactgcacccagcttataattttttgattaacagcaattctaagagaatattatgtaatgaagtgtgagaataattagtgcagtggt

SEQ ID NO: 62617 - DNA, 201 bp, Homo sapiens
tgtatatatttgatgttaaaagcttttatcaaattgtgtgtgtgtatgtatatacacacatacatgtatatgtacgtatacatacacacacacacacacayatatattttaagagatgtgttgcccaggctggagtacagtggttattcacaggtgtggtcataattcactgaagcttcaaactcctgggctcaagtgatc

SEQ ID NO: 62618 - DNA, 201 bp, Homo sapiens
tgtgttctgtttaggctattagctgagcctttatttaccatttttggtgcttttgttatcgatgttatgttttaaaaatatatacatgtttctggaactayatatatgtctgtgtgtgtatacgtatatgtacacatatatacgtctatatacatatatatgtgtatatatttgatgttaaaagcttttatcaaattgtgt

SEQ ID NO: 62619 - DNA, 201 bp, Homo sapiens
cagtctcactctgttgcccaggctggagtgcagtggcacaatcttggttcactgcaacctccacctcctggattcaagcgattctcctgcctcagcctctygaataactgggattacaggcatgcgccaccaccacactggctaatttttgtatttttagtagagaggggatttcaacatgttggccaggctggtcttgaa

SEQ ID NO: 62620 - DNA, 201 bp, Homo sapiens
attcacacctgtaatcgcagcactttgggaggccaaggcaggaggtcaatagcataataaacccctatctctacaaaaaataaaaaagttagccaggcacrgtggcacacgcctataagtcctagctactctggaagctgaggtgtgaagattgcttgagcccaggaggtccaggctgcagggagccatgactgtgccact

SEQ ID NO: 62621 - DNA, 201 bp, Homo sapiens
aaactcctgggctcaagtgatcctactgcaccaagccttcctagtagcttggactacagttgcgctccactgcacccagcttataattttttgattaacarcaattctaagagaatattatgtaatgaagtgtgagaataattagtgcagtggtttgaactttaagacatacgaattttatgttcatgaataatgtacatt

SEQ ID NO: 62622 - DNA, 201 bp, Homo sapiens
ggttaaaaatgtttttacaagtgcagctacgtagtcattgttgtttgattttcatatccactgaatattttaatgaagttctggggaagttttatttacaygctcccacctcccccacccccaggtgattatttggaaacctgtgtctgtgctgtgtggcagcctctctgatgctctgcgggtgcagtgagagagttgtat

SEQ ID NO: 62623 - DNA, 201 bp, Homo sapiens
ggaggctgggcagtgcagagttaaacatgggggaacagctcagaaatcacatagaagtttcctaattactcctttctttttttccttgcctcccctgacarccacactcactccaagattctgatactgcctctgattagggtgaggtctctgattgagaatcaatagttttgataaagagggaaaatagcatgagaacca

SEQ ID NO: 62624 - DNA, 201 bp, Homo sapiens
tgtctagcctcataaggtattttcaatactgagcatagtgccaaccagtgagctggtgcttaataaggatttgaagtaagaatcaatggctcaaaagagagagaaagtatgaagtgtaatttctgtatctgcagtcagcattcacaggctcagtagtttgagaaacctgtatttcctgctttgactttttcactatttctt

SEQ ID NO: 62625 - DNA, 201 bp, Homo sapiens
ttaatgcagccatgggatattgggatctgttgaccttgctactgctgtgtgttcagcatttcagcaacactggcaaacacaacacagttcctcttcccccyacctaacccaagaaattgaacaggaaattgatttttaaggaaaccaccattttcaggtttcctctcctggggaacattctggctggtcttcagcctgcct

SEQ ID NO: 62626 - DNA, 201 bp, Homo sapiens
gtgttaggaaaactggctagccatatgcagaaaactgaaactggaccccttccttacaccttatacaaaaattatttcaagatggattaaagacttaaacrcaacatctaaaaccataaaaaccctagaagaaaacctaggcaataccattcaggacacaagcataggcaaagacttcatgactaaaacacaaaaagcaat

SEQ ID NO: 62627 - DNA, 201 bp, Homo sapiens
aagatccagataagctcagttacaaatgaaacgggagatactacagctgataccacagaaatagaaaagatcattcaaggctactatgaaaacctttacaygcataaactagaaaatctagaggagatgtttaaattcctggaaatatacaatcaccctagattaaaccaggaagatataaaaatctctgaacagaccaat

SEQ ID NO: 62628 - DNA, 201 bp, Homo sapiens
tagcatgtaatgaaccatattttattgaaagtatgaggctgttcccttcactggaagttcctaggggacacagattgtcatttattcattgttatatcctyagcactgagcacacggtagttaaaaataaatttgaactgaacttgaaacttgaaaatcaatatccaatgttttaattttaaagtcttggcctgtctttta

SEQ ID NO: 62629 - DNA, 201 bp, Homo sapiens
gttgagcattttttcatacatttgttagccacttatatatatcttctttgagaactgtctattcatgtccctagcccacttttttatgggattttttttttgtcttactgattggcattctctatagattctgggtattagtcctgtgtcggatgtatagatggcaaagattttctcccactcttggggttttctgtttac

SEQ ID NO: 62630 - DNA, 201 bp, Homo sapiens
attgctagctcttatcttttttttctgtcatcttccttaatgtggtttatttaaaaaatttctttgactggtcctgtttcaaattgaatgattatgctgtwgaaaagatcagaaatggtcctggctctcatctttcttgggcaagccaatttttaaactaatctgtaaatttcattaaaccatgtgaacaaacagtaaaac

SEQ ID NO: 62631 - DNA, 201 bp, Homo sapiens
gctttcaaaagcataagctatcagagatagaatcagttggttctcctctaagttcctttttggggggtagaaactgaaatatgccatgctgtacgtagttstgaggattgaaagagttcttgcagtattttctcatataatcttagacacgtatcgtgatgtggatacgctattcctgtgtttttaaagggagagataaat

SEQ ID NO: 62632 - DNA, 201 bp, Homo sapiens
tgtttgtataataaaagaaaaggaaaacatttagccttaaagtaaaataagttggctctgttagcctctagagttcttaaaaataattataagtctcttcrgaatccctctaaatgtcttcatctcctttattgtctttatctgcttaaaactgcttctcttgaaagaccagaatgcaagatcaaaaaatcaaatattata

SEQ ID NO: 62633 - DNA, 201 bp, Homo sapiens
cgccgcccccgccgccggcaccccagcccgggcccggggcgacgcccgccctaccggccgcgctgcttcctccgaactccggctcggcggcgccctctccygccgccctgggcgccttctcggacgtgctggtccgctgcgaggtgtcccgcgtgctgctgctgctcctcctgcaaccaccgcccgccaagctgctgccgg

SEQ ID NO: 62634 - DNA, 201 bp, Homo sapiens
  misc_feature (1)...(201): n = A,T,C or G, or insertion/deletion polymorphism (see Tables 1-2)
gaaccacctccttcacctcgttctgcaagaaaccatctccccctcaggacagggagtctgatccatcccattcacccagtgacttctttttgcccaggccnggactttttgcatcagtcacgttaaccagatgactttgcctgttaccaaacctcatgcatccacgtttgcgtctggggaggaataaaaagacatcgttcc

SEQ ID NO: 62635 - DNA, 201 bp, Homo sapiens
acattttgatagaatcagagtagaggacatggctgtcttctaaaaagccacgacatgaaaatgacaatccctttcgtctccttcctccgctgcttccaccyaacgcagcctcctgcctccgcctttgtttcatagtgaggattttattttgcacggcgccctccctctaaatacctaccctagatgatttcatcctgcccc

SEQ ID NO: 62636 - DNA, 201 bp, Homo sapiens
ggaaacccagctccagccttggtgtgtacctggaatggggtggtctttgaccttgaagtgccacagaaggcaacccagaaccacactggaacctaccgctrcacagccactaaccagctgggctctgtcagcaaagacattgctgtcattgttcaaggtaacctttgctgccctgctgccaggcccaggatggaaacccct

SEQ ID NO: 62637 - DNA, 201 bp, Homo sapiens
acacacgctcacctgcgtcccaaagggaaacccagctccagccttggtgtgtacctggaatggggtggtctttgaccttgaagtgccacagaaggcaaccyagaaccacactggaacctaccgctgcacagccactaaccagctgggctctgtcagcaaagacattgctgtcattgttcaaggtaacctttgctgccctgc

SEQ ID NO: 62638 - DNA, 201 bp, Homo sapiens
ctcagctccttgggatactgtttctgcagaccaaccacggttagaggaatccagttgctctgccaaacagacctggctggaagggatggaacacacgctcrcctgcgtcccaaagggaaacccagctccagccttggtgtgtacctggaatggggtggtctttgaccttgaagtgccacagaaggcaacccagaaccacac

SEQ ID NO: 62639 - DNA, 201 bp, Homo sapiens
gacagcatttgggtgaggggaggagagggagcagggggtgaagtagggagggagtgtggtgcactgaactcagctccttgggatactgtttctgcagaccmaccacggttagaggaatccagttgctctgccaaacagacctggctggaagggatggaacacacgctcacctgcgtcccaaagggaaacccagctccagcc

SEQ ID NO: 62640 - DNA, 201 bp, Homo sapiens
ctgaactcagctccttgggatactgtttctgcagaccaaccacggttagaggaatccagttgctctgccaaacagacctggctggaagggatggaacacamgctcacctgcgtcccaaagggaaacccagctccagccttggtgtgtacctggaatggggtggtctttgaccttgaagtgccacagaaggcaacccagaac

SEQ ID NO: 62641 - DNA, 201 bp, Homo sapiens
catttgggtgaggggaggagagggagcagggggtgaagtagggagggagtgtggtgcactgaactcagctccttgggatactgtttctgcagaccaaccayggttagaggaatccagttgctctgccaaacagacctggctggaagggatggaacacacgctcacctgcgtcccaaagggaaacccagctccagccttggt

SEQ ID NO: 62642 - DNA, 201 bp, Homo sapiens
ctctgtcagcaaagacattgctgtcattgttcaaggtaacctttgctgccctgctgccaggcccaggatggaaacccctcaggggtttgggattcttatcyaagcatgaaaataagaaagattctactaggttgggaagaatgagactcagaagtgggcctggtgggctggggtgggtgatccttgtactctcagactttc

SEQ ID NO: 62643 - DNA, 201 bp, Homo sapiens
actcagaggagcgtcctttggggccagagtaacttacggcctggtaagaaagacacagtgaaaccacttataatttgggaaatctcccctcactgccaaawgagcagtggcaagtaggaagtagaagtggaaacaagggataagagttagacctgaattttagtcccaggtctactattaactctgtgtgactttgcataa

SEQ ID NO: 62644 - DNA, 201 bp, Homo sapiens
cctctaacttgaagttaaccctgttctttgaccctctattcatgataagtcggtccgtcggaaagcatactcagaggagcgtcctttggggccagagtaayttacggcctggtaagaaagacacagtgaaaccacttataatttgggaaatctcccctcactgccaaatgagcagtggcaagtaggaagtagaagtggaaa

SEQ ID NO: 62645 - DNA, 201 bp, Homo sapiens
aaaaaaaaacctgagttttaacttggtgactgttgactccctcctgacagcgaggcggtggtgaaccgagtgtttgacaagctgtccccgctgcacgagcrcatctactgtgcactctctggttcagctgctgatgcccaagccgtggccgacatggccgcctaccagctggagctccatgggtatgaagctctggagttc

SEQ ID NO: 62646 - DNA, 201 bp, Homo sapiens
cactctagcgtgggtgacagagaaagaccctatcttaagaaaaaaaaaagaaaagaaaaagaaaaaacaaacaaaaaaaacacccaaccctatataggtaktattattacttctataggacacatagaggtttggaaagattaaatcacttgaccaaggtcacaaaataagttctgaggctgggatctgggattcagtctt

SEQ ID NO: 62647 - DNA, 201 bp, Homo sapiens
cctgggaggctgagtgggaggatcgcttaggcctgggagtttgaggctacagtgagctgtgattgcgccactgcactctagcgtgggtgacagagaaagamcctatcttaagaaaaaaaaaagaaaagaaaaagaaaaaacaaacaaaaaaaacacccaaccctatataggtattattattacttctataggacacataga

SEQ ID NO: 62648 - DNA, 201 bp, Homo sapiens
atgcctgtagtcccagctgcctgggaggctgagtgggaggatcgcttaggcctgggagtttgaggctacagtgagctgtgattgcgccactgcactctagygtgggtgacagagaaagaccctatcttaagaaaaaaaaaagaaaagaaaaagaaaaaacaaacaaaaaaaacacccaaccctatataggtattattatta

SEQ ID NO: 62649 - DNA, 201 bp, Homo sapiens
tcggctgcgcgttgtgcgctgtcccaggttggaaaccagtgccccaggcggcgaggagagcggtgccttgcagggatgctgcgggcgggagcaccaaccgrggacttaccccgggcgggagaagtccacaccggggtaatgggtctgggcttgagggttggcagaggggtggaggagatgcagcggccaggggaccctgga

SEQ ID NO: 62650 - DNA, 201 bp, Homo sapiens
gggttggcagaggggtggaggagatgcagcggccaggggaccctggaagcgcgcgcggagaagtgaatgcagagaccaacgggagcgcagggaggtcgcckgtagcagccagcgcttgcaacccgcaatgagcatagagtatttcttttctgaggggggtcgtctagagtgtccgtgaagggaacaggcacgcgaggctgg

SEQ ID NO: 62651 - DNA, 201 bp, Homo sapiens
agaagtgaatgcagagaccaacgggagcgcagggaggtcgcctgtagcagccagcgcttgcaacccgcaatgagcatagagtatttcttttctgagggggktcgtctagagtgtccgtgaagggaacaggcacgcgaggctggtggaaaaagcgggtgctttgactcttagctggaagcgtcaacgggaagctactctaaa

SEQ ID NO: 62652 - DNA, 201 bp, Homo sapiens
ttgggcaatacggataaaccagggctgttctgagtaaatcaaatgaggatacacagtcactgtgagaaccagtggtgtgctaagcacagtggctcacacckgtaatgccaacaatttgggaggctgaggcaggaggattacttgagcccaggagtttgaggccagcctaggcaagatggtgaaaccctgtctccacaaaaa

SEQ ID NO: 62653 - DNA, 201 bp, Homo sapiens
tctccctgcctcctgcctttccacttgcaccagttttcccaccccagcctcagggcggggctgcctcgtcacttgtctcggggcagatctgccctacacamgttagcgccgcgcgcaaagcagccccgcagcacccaggcgcctcctggcggcgccgcgaaggggcggggctgtcggctgcgcgttgtgcgctgtcccagg

SEQ ID NO: 62654 - DNA, 201 bp, Homo sapiens
aacaggaagagaaatacaggggtggccatttaagttaatgccgggcctggtacacttttaagagtgaaaaggggcaggacaaatgcaaagctcaatggggytcttgggcaatacggataaaccagggctgttctgagtaaatcaaatgaggatacacagtcactgtgagaaccagtggtgtgctaagcacagtggctcaca

SEQ ID NO: 62655 - DNA, 201 bp, Homo sapiens
tttcccaggtatatggaaccctgggaggaatgctgactcgacagccttttgccattggtggctccggcagcacctttatctatggttatgtggatgcagcrtataagccaggcatgtctcccgaggagtgcaggcgcttcaccacagacggtaaccagccaagtggaagggtacctggggagggctttgaaacatgggaag

SEQ ID NO: 62656 - DNA, 201 bp, Homo sapiens
gaccaaaaaaaaaaaaatagactgaccttgtttcccaagatcatagtcaattactctgtgttgggtctacaccacatctgcacatactatgagcccttccrttggagataattttcacttgcggagctgcttcacttctacctgtaggagcctcatctccacctctctacagtggagaggattccactaggcaagttggaa

SEQ ID NO: 62657 - DNA, 201 bp, Homo sapiens
tgggaggctgaggcaggaggattacttgagcccaggagtttgaggccagcctaggcaagatggtgaaaccctgtctccacaaaaaacaataaaaaaaagtaaaaaaaaaaatgaactgggcatagtggtgcacacctgtagtcccagctactcaggaggctgaggtggaaagatcatctgagccggggagatcaaggctgt

SEQ ID NO: 62658 - DNA, 201 bp, Homo sapiens
atgtagctttatcttccctcacttcttcttgattcttttcttgacctggaaaagtcagcttaaacttctcagtcaaattatctcttggtacaaatttaccyccctggctgctgagatatgtatttacctcttgatcggaaattccataactgaaacttttattttcaaccatctgtatgtgttccttgctgcttctctcct

SEQ ID NO: 62659 - DNA, 201 bp, Homo sapiens
tcccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaagtgaggtgatgggactctttcctttaaggctaag

SEQ ID NO: 62660 - DNA, 201 bp, Homo sapiens
gtggaccatcgagtcatcttgggcaatgaactgccaaaattctatgatgagtgaaccttccccagacttctctttcttattttgtaataaactctctaggrccaaaacctggtatggtcattgggaaatgagtgctcagggagatggagcttaggggaggtgggtgcttccctcctagatgtcagcatacactctttcttc

SEQ ID NO: 62661 - DNA, 201 bp, Homo sapiens; identical to SEQ ID NO: 24879

SEQ ID NO: 62662 - DNA, 201 bp, Homo sapiens
tgtaaatcactatcctgatataaataatcaggaagaaggtgatattgtgacccaccataatatcaggcagttaccatacgagaaatcaaggtcgttgggayggaagtaaccttatctgcttttccccataagagcagggtccttgcagccaaaagaaagttatgtgggtggggctgagcaaaagagtgagcaattgaaagc

SEQ ID NO: 62663 - DNA, 201 bp, Homo sapiens
ggaaattccataactgaaacttttattttcaaccatctgtatgtgttccttgctgcttctctcctgccttgcccctggccatgctaaccactgccctcctygattttttccaatgttcagtaaattggaagagctcacttctgatgaaatggggggtgagagtggaggattgtggaccaaaaaaaaaaaaatagactgacc

SEQ ID NO: 62664 - DNA, 201 bp, Homo sapiens
gtcttgtttcggctcttgctggcacttgaatctgtcagtttctgcatctgtaaagtggagataatatagtacctcatgagacggttattttgagaaccacrttctatatgtgaacacagtttaaaagctgtaaatcactatcctgatataaataatcaggaagaaggtgatattgtgacccaccataatatcaggcagtta

SEQ ID NO: 62665 - DNA, 201 bp, Homo sapiens
ttccaggagctggacactgggaaatggaaaagtcttgtttcggctcttgctggcacttgaatctgtcagtttctgcatctgtaaagtggagataatatagyacctcatgagacggttattttgagaaccacattctatatgtgaacacagtttaaaagctgtaaatcactatcctgatataaataatcaggaagaaggtga

SEQ ID NO: 62666 - DNA, 201 bp, Homo sapiens
acctctgaaagcatagtactttggggatatgagataccagggcttcattgcagggtgcagagaccacttaatgtctcagtgggaaggaagggcttgatgawtctttaacctgaggatccctttcccaggtatatggaaccctgggaggaatgctgactcgacagccttttgccattggtggctccggcagcacctttatct

SEQ ID NO: 62667 - DNA, 201 bp, Homo sapiens
ctcctgcctttccacttgcaccagttttcccaccccagcctcagggcggggctgcctcgtcacttgtctcggggcagatctgccctacacacgttagcgcmgcgcgcaaagcagccccgcagcacccaggcgcctcctggcggcgccgcgaaggggcggggctgtcggctgcgcgttgtgcgctgtcccaggttggaaacc

SEQ ID NO: 62668 - DNA, 201 bp, Homo sapiens
cccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaagtgaggtgatgggactctttcctttaaggctaaga

SEQ ID NO: 62669 - DNA, 201 bp, Homo sapiens
aggccaaggcgggtggttcacctgaggtcaggagttcgtgaccagtctggccaacatggtgaaacctcatctctacttaaaatacaaaaattagctgggcrtggtgcctgtaatcccagctactcgggaggctgaggcagggagaatcgcttgaacccgggaggcaaaggtggcagtgagccaagattgcgccattgcact

SEQ ID NO: 62670 - DNA, 201 bp, Homo sapiens
ccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaagtgaggtgatgggactctttcctttaaggctaagac

SEQ ID NO: 62671 - DNA, 201 bp, Homo sapiens
catgcgtgtgacatgccttaagggcacagcaaagactttgagaactgaatgaagattagatcttttaaaattggaagacttcggccaggcgcggtggctcrtgcctgtaattccagcactttgggaggccaaggcgggtggttcacctgaggtcaggagttcgtgaccagtctggccaacatggtgaaacctcatctctac

SEQ ID NO: 62672 - DNA, 201 bp, Homo sapiens
aaagaataatgacaataaccaaaagaagctacatttgtggcattggctaaatgttttataaattttatctcttaaaattcaaaccaaaaaaccccctgtaytcacacctgtaatcccagcactttgggaggtcaaggcgggaggattgcttgagcccaggagttagtgaccagcctgggcaacatagtgagaaccccatct

SEQ ID NO: 62673 - DNA, 201 bp, Homo sapiens
aggagtaccaggttacccctgagctgcacatgcgtgtgacatgccttaagggcacagcaaagactttgagaactgaatgaagattagatcttttaaaattrgaagacttcggccaggcgcggtggctcgtgcctgtaattccagcactttgggaggccaaggcgggtggttcacctgaggtcaggagttcgtgaccagtct

SEQ ID NO: 62674 - DNA, 201 bp, Homo sapiens
gaatggagttgaccttccccaaaagccactatgataagctatttggtgggtgcttgggtctctgaatttgtggaggaggatctggggtctgaatgtgtatrtgacctgtcccagtagtgtacagggatgagtaaaggaatagggtctgagagggggacaggagatagatttttgagggtcttctttccatctgtgcttagg

SEQ ID NO: 62675 - DNA, 201 bp, Homo sapiens
gcctcaggtgcagagctgcactgcgtggtagcacaagccctgagttaacaagagaaataccggctttctggccagaggaatgaagaaaaagggcccctgcrggcaggaatgtgtaggggaatctccaaactgagagtacaggcggaaattccctaattctgagtctgaaccctcaggagtaccaggttacccctgagctgc

SEQ ID NO: 62676 - DNA, 201 bp, Homo sapiens
taaaggaatagggtctgagagggggacaggagatagatttttgagggtcttctttccatctgtgcttagggatcaaaaagatgattctgtcaagcagatayctggtttctcatttaccatatattgaactattttgtctcttctcccactcctaaccaatttcctcacatgcaaaatgagtatatggggttaggtcaatat

SEQ ID NO: 62677 - DNA, 201 bp, Homo sapiens
agcgcagggaggtcgcctgtagcagccagcgcttgcaacccgcaatgagcatagagtatttcttttctgaggggggtcgtctagagtgtccgtgaagggamcaggcacgcgaggctggtggaaaaagcgggtgctttgactcttagctggaagcgtcaacgggaagctactctaaagcgctttcgctttcactctggtccc

SEQ ID NO: 62678 - DNA, 201 bp, Homo sapiens
ggtagtttacagttccaacattcaatgccattttgctaacaagtgggcagtcaacaggcatattcaacagaaatactagtaggatctcaggctaaacataygaattcaaaactctaaaacaatcacatccccctggagtgtaaagaaaaaaatctaaaattacaaatgcctggagttgtttctagccatgatatttaactt

SEQ ID NO: 62679 - DNA, 201 bp, Homo sapiens
agcgcttgcaacccgcaatgagcatagagtatttcttttctgaggggggtcgtctagagtgtccgtgaagggaacaggcacgcgaggctggtggaaaaagsgggtgctttgactcttagctggaagcgtcaacgggaagctactctaaagcgctttcgctttcactctggtcccggacagtgggggctggttaaatcaaga

SEQ ID NO: 62680 - DNA, 201 bp, Homo sapiens
ctactgccaccactcgtggcttgggggcggctttgttagagaggaatagcctctaacttgaagttaaccctgttctttgaccctctattcatgataagtckgtccgtcggaaagcatactcagaggagcgtcctttggggccagagtaacttacggcctggtaagaaagacacagtgaaaccacttataatttgggaaatc

SEQ ID NO: 62681 - DNA, 201 bp, Homo sapiens
ttggctccctgcgacctgtgcttcccaggttcaagcgattctcctgcctcaacctccccagtagctaggactataggtgcgcaccaccacacctagctaayttttttgtatttttagtagagatggggtttcaccacgttggccaggatggtctcaatctcttaacttcgtgatctgcccaccttggcctcccaaagtgct

SEQ ID NO: 62682 - DNA, 201 bp, Homo sapiens
ggtggtagtgtaaattagtttggccattgtggaagacagtgtgatgattcctcaaggatctagaaccagaaataccatttgacccagcaatctcattactytgtgtatacccaaaggattataaatcattcttctataaagacacatggacatgtatgtttattgaagcactgtttacaatagcaaagtcttggaactacc

SEQ ID NO: 62683 - DNA, 201 bp, Homo sapiens
gtttcaattatagcctaccactaaatagctctgtgtaaccttctatgagttttgtaacctctgtgtgacagtttcctcatttataaaatgtatatacttgwgatacacgtgatgaggattaaatgaggtaatacatctgaagtgctgccacttcctatgaactgagcacgtgtaagcagttgtcatcagtttgcagttgct

SEQ ID NO: 62684 - DNA, 201 bp, Homo sapiens
gggctacaaaaggtgaattaagtttggtgttaattgagaagctccttagatttcacacttctagagaagtttagtatagtccagcattatagtacggagamcacactagattcgagttacagatatagcgtctttcaagtatatatatatatatatatatatatatatatatatatatatatatatatatagttgtgcctc

SEQ ID NO: 62685 - DNA, 201 bp, Homo sapiens
gacagtcgtaatgacgtcttaagatatttttcaatataagagctttatttttactgaaataaatgttcccatttcagcttcaatggactacagacagtggraatattctcaaagagaccatgacagttacatttgcagaaggtaggttttcttgaatacctttaaaatataaattcaaatggtgtttaactggaaggaact

SEQ ID NO: 62686 - DNA, 201 bp, Homo sapiens
cagtatattgctattaactgtagtcactatgaacttattcctcgtaattgaaattttgtatcctttgaccacagtctgcttttcttttctttcctttcttttcttttcttttctttttttaaatttacacaccactatacaaacagggaacacagctttctttcctaatatgagggtttaaagaaggagtgtccaatcttt

SEQ ID NO: 62687 - DNA, 201 bp, Homo sapiens
atacaattatttctaccacttttatatcctggctgttcaatataaattctaaaaattataaaattacagtagtcagtattataatttaaagtaaacaagtrtcagagaaattctcaataaagcattattcctttactctcaataaagcataaattttctttacctattacaaatacataagttttagttaggtatattctt

SEQ ID NO: 62688 - DNA, 201 bp, Homo sapiens
agtatattgctattaactgtagtcactatgaacttattcctcgtaattgaaattttgtatcctttgaccacagtctgcttttcttttctttcctttcttttcttttcttttctttttttaaatttacacaccactatacaaacagggaacacagctttctttcctaatatgagggtttaaagaaggagtgtccaatctttt

SEQ ID NO: 62689 - DNA, 201 bp, Homo sapiens
agctccttagatttcacacttctagagaagtttagtatagtccagcattatagtacggagaccacactagattcgagttacagatatagcgtctttcaagwatatatatatatatatatatatatatatatatatatatatatatatatatagttgtgcctctgtatctatgggttctgtatccatggcttcaacaaactg

SEQ ID NO: 62690 - DNA, 201 bp, Homo sapiens
tatattgctattaactgtagtcactatgaacttattcctcgtaattgaaattttgtatcctttgaccacagtctgcttttcttttctttcctttcttttcttttcttttctttttttaaatttacacaccactatacaaacagggaacacagctttctttcctaatatgagggtttaaagaaggagtgtccaatcttttgg

SEQ ID NO: 62691 - DNA, 201 bp, Homo sapiens
ccaaaccacaagtatttttctattgatcatcatttaggttgtttccaacttttcattattacaaagaatgctgtagtcaaacctccacactatatatactytaatgaaaagctgtaattagtttttctagagtatatgccttaaagtagaattgctggttgtgaattatgcccatttcatctttacaagattatcttaaaa

SEQ ID NO: 62692 - DNA, 201 bp, Homo sapiens
tgtattataggtaatccagagaggatttaaagtttgtgggaggatatgcttagattttatgcaaatacgatgccattttatatcaggaactgagcatctgyagatttttatttctgatggaggtcctggaaccagtcttccatggatatggagggacaatcccattctagatctaccgaattaaaattaatggaggttaaa

SEQ ID NO: 62693 - DNA, 201 bp, Homo sapiens
tttagtagagacagggtttcaccatgttggccagtctggtctcaaactcctgaccacaagcgatccacctacctgggcctcccagaatgctgagattaccrgcatgagccactgtgcccagcctgtttttttaaaaaattaaacttttgatagtttttattatttgcttatctctgtggttcatttttttagacattgaat

SEQ ID NO: 62694 - DNA, 201 bp, Homo sapiens
gctaggctggtctcaaactcctgacctcaggtgatccacctgcctcagcctcccaaagtgcagggattataggtgtgagccgttgcacccagccaactgtaaaaaaaaaaaaaaaatgttttaattgtagtagttgtagatatttatggggtacatgaaatgttttgatactgacatgcaatgtataataatcatagcatg

SEQ ID NO: 62695 - DNA, 201 bp, Homo sapiens
gctgaggcagagaattgcttgaacccgggaggcggaggttgcagtgagctgagattgcaccactgcactccagcctgggtgacagagcgagacatcatttaaaaaaaaaaaaaaaaagactgggcacagtggcttatacctgtaatcccaacactttagaatgccaaggcaggcggatcacgaggtcaggagattgagacc

SEQ ID NO: 62696 - DNA, 201 bp, Homo sapiens
gcatatttatatatattcctctcctatcccagaatgctggaagaaccccttctggggcctcttcagccactttcttctaatacacctatatgggcctgccrtcttaggagctgtgaggtgagttataaataatcattacctagaattacttaactgattataaccacaggtcatccccaaatgccacttttgagtacaact

SEQ ID NO: 62697 - DNA, 201 bp, Homo sapiens
tgcagtgagccgagattgtgccactgtactccagcctgggtgacagagcgagacgctgtctcgaaaaaaaaaaaaaattcattatagttcctaaatttttwaatttgttttatcacatttttatgcatagaattcctctgtggcaaaatgtttaaaatgctttttgctaacttttatttcagtttttgtttttgttttaaa

SEQ ID NO: 62698 - DNA, 201 bp, Homo sapiens
gattcatagtaattttgtacatattataaaaggaatgttatgtcatttacctctaaaagatgcggtaaattttactttctaaagtacttttgagcaatattttatttatttatttatttatttatttatttatttttgagacagagtctcactctgtcgccaggctgtagtgccgtggcacaatcttggctccctgcgacc

SEQ ID NO: 62699 - DNA, 201 bp, Homo sapiens
attcatagtaattttgtacatattataaaaggaatgttatgtcatttacctctaaaagatgcggtaaattttactttctaaagtacttttgagcaatattttatttatttatttatttatttatttatttatttttgagacagagtctcactctgtcgccaggctgtagtgccgtggcacaatcttggctccctgcgacct

SEQ ID NO: 62700 - DNA, 201 bp, Homo sapiens
ttcatagtaattttgtacatattataaaaggaatgttatgtcatttacctctaaaagatgcggtaaattttactttctaaagtacttttgagcaatattttatttatttatttatttatttatttatttatttttgagacagagtctcactctgtcgccaggctgtagtgccgtggcacaatcttggctccctgcgacctg

SEQ ID NO: 62701 - DNA, 201 bp, Homo sapiens
ggaagcaaaaaaaactgtggactataagaaattatctgctacataaattattgaagcttttcagaatttacaactctggtgacttctgatgtcttagaaargaaggtgaatatagtcaaagcgtggcattgagataattggactgaagaccagtttgatgagaagcttttatttaaaactgatatatttgttgccagttcc

SEQ ID NO: 62702 - DNA, 201 bp, Homo sapiens
tcatagtaattttgtacatattataaaaggaatgttatgtcatttacctctaaaagatgcggtaaattttactttctaaagtacttttgagcaatattttatttatttatttatttatttatttatttatttttgagacagagtctcactctgtcgccaggctgtagtgccgtggcacaatcttggctccctgcgacctgt

SEQ ID NO: 62703 - DNA, 201 bp, Homo sapiens
ggtttcaccatgttgtctaggctggtctcaaactcctgacctcaggcagtcctccagcctcagcctcccaaaatgtggggattacaggtgtgagccatcacgcctggcctgtatatcttcttttgagagatgtctgttcagctcatttgtccatttctaaatgaaattatttatttattaatccctcgtggaatagtttgc

SEQ ID NO: 62704 - DNA, 201 bp, Homo sapiens
ttaaaccatgagaaacccccaccatgatccaatcacctcccaccaggccccacctccaacattgggggttataattgaacatgagatttgggtggggacayggacccagaccatatcagagtctcacaaacctgttatggcacctgagttttggggtacaggttagcactctgtggcagagttggatgtagattgaccaca

SEQ ID NO: 62705 - DNA, 201 bp, Homo sapiens
gatgtgacgtgactacagtatattgctattaactgtagtcactatgaacttattcctcgtaattgaaattttgtatcctttgaccacagtctgcttttcttttctttcctttcttttcttttcttttctttttttaaatttacacaccactatacaaacagggaacacagctttctttcctaatatgagggtttaaagaag

SEQ ID NO: 62706 - DNA, 201 bp, Homo sapiens
atgtgacgtgactacagtatattgctattaactgtagtcactatgaacttattcctcgtaattgaaattttgtatcctttgaccacagtctgcttttcttttctttcctttcttttcttttcttttctttttttaaatttacacaccactatacaaacagggaacacagctttctttcctaatatgagggtttaaagaagg

SEQ ID NO: 62707 - DNA, 201 bp, Homo sapiens
tgtgacgtgactacagtatattgctattaactgtagtcactatgaacttattcctcgtaattgaaattttgtatcctttgaccacagtctgcttttcttttctttcctttcttttcttttcttttctttttttaaatttacacaccactatacaaacagggaacacagctttctttcctaatatgagggtttaaagaagga

SEQ ID NO: 62708 - DNA, 201 bp, Homo sapiens
gtgacgtgactacagtatattgctattaactgtagtcactatgaacttattcctcgtaattgaaattttgtatcctttgaccacagtctgcttttcttttctttcctttcttttcttttcttttctttttttaaatttacacaccactatacaaacagggaacacagctttctttcctaatatgagggtttaaagaaggag

SEQ ID NO: 62709 - DNA, 201 bp, Homo sapiens
tttaatttcctcttatactttgtttttaatgcttttttatgactgacattttgaagctgataactagcacagttaactgtagctaattcactaagtctggytaattccagtagtaataaccctaagatgccctgatctgggaactatggtccattttttacggttgctttttctcatgtgttcttactgctgggccctttc

SEQ ID NO: 62710 - DNA, 201 bp, Homo sapiens
acttaatacactttattatatatttagtactttgttttagctacttactatgagcagaaacttcagccgcctgtcatttttttaaaactaatctttgattmcttacggcagccagaaatgaattccaagccgtaaataaaattccatttcacaccttttatgctttaggttttaaatgtgaaatattagcattctttttta

SEQ ID NO: 62711 - DNA, 201 bp, Homo sapiens
cagcagtgtgtgaaaatttcatttccccacttttacttcatgacttagcattgccagatgtttaaaaatctttgtttgtttgtttgtttgtttttttgagwcggggtctcactctgtcacccaggctggagtacagtggtgtgatctcagctcactgcaatctcaatctccttggctcaagagatcctcctgcctcagctt

SEQ ID NO: 62712 - DNA, 201 bp, Homo sapiens
ctgagggagggtctactttcagattcactcttgtggctgtcagcaggccttattccttgccacgtgggcctttccacagagctcccttaccacttggcagmtgattacctccagagagagcaattcaagcaagagtaagagagagtacccaaatgatagttacagtctttttgcagcctaatatcaaaaattacttcctac

SEQ ID NO: 62713 - DNA, 201 bp, Homo sapiens
tggcgggcgcctatagtcccagctactctggaggctgaggcaggagaatggtgtgaacctgggaggcggagcttgcagtgagccgagagcttgcagtgagygccactgcactccagtactgggtgatagagcaagactccgtctcaaaacaaaacaaaacaaaaaaaacaaaaaaaaactttactttgacggagttaattg

SEQ ID NO: 62714 - DNA, 201 bp, Homo sapiens
gttagttaattagcaaacatgagttcacttaaaatgttcagttcctctgtgatatcatgaaataaacctgattttaaaaattcagatatagttataaaacrcacagaatataaattttatacatagagactttaagtgtcttgatcatccttgtatctccagcacatagaacagtcacttggatgtgtagtaataattcat

SEQ ID NO: 62715 - DNA, 201 bp, Homo sapiens
aaaatttctcataaaaaaccttgtgctatatatattacatttgttaggacattattgttgttgcttttctaagtagagtacatgtatgtatatacatatakgtgtgtgtgtgtgtgtgtgtgtgtgtgtgtgtgtagttttagctttttgtccccctaccttttgttagtcatggtttttcagtggtttcctaaagttact

SEQ ID NO: 62716 - DNA, 201 bp, Homo sapiens
agacaaaactctgtctactaaaaatacaaaaattagcctggcgtggtggcacacgcctatagtcccagctacttgggaggctgaggcaggagaactgcttraacccaggaggtggaggttgcagtgagccaagattgcgccactgtgctccagcctgggtgacagagtgagactccgtctcaaaaaaaaaaaaattatatg

SEQ ID NO: 62717 - DNA, 201 bp, Homo sapiens
gctcaagggatagctgttatatttagtgtattcaagaattttgagctgggcgtggtggctgacacctgtgatcccagcactttgggaggctgaggcgggcrtatcacctgaggtcaggagttcaagaccagcctggccaacatggtgaaaccctgtctctactaaaaatacaaaaattagctgggcgtggtggtgggtgcc

SEQ ID NO: 62718 - DNA, 201 bp, Homo sapiens
tggggtctcactatgttgtccaggttgcctggggtcaagcttgacctcccaaaatgctaggattacaggcatgagcaaccgcactctgtcctagctgtacytttgtaaccatcaaccatttggctgttcccttccctaccctacccttccccacctctagtaaccattattctactccctacttctatgaaatcaaccttt

SEQ ID NO: 62719 - DNA, 201 bp, Homo sapiens
ctgaggcaggagaatcgcttgaacccaggaggtggaggttgcagtgagctgagatcataccactgtactccagcctggtgacagagggagactccgtctcaaaaaaaaaaaaaaaaaaaaaattgggttaatggctgaggaaatattttctgcattttggttcaaaatattgtttagtaatcttttattttttgaatttct

SEQ ID NO: 62720 - DNA, 201 bp, Homo sapiens
tttttcataatggctgtactaatttacaccaacagtgtatgagttcccttttctccaaatccttgccagcatttgttattttttgtctttttgataatagmcattctaaccgaggtgagatgatagctcattgtgattttgatttgtatttacccgattcttagagattttttttaaagatatatacccgttgaccattcg

SEQ ID NO: 62721 - DNA, 201 bp, Homo sapiens
ttgctagggcaaaggctgtatcttttaaaaatgttgacaaatattgcaaagttgctttttagagcgattttatcaatttagcagcaaattatgagaccaaygtagtaagttttagatagattaggactacagagtagtcattgctcttggtaagaatgaaaaatgtgaaccaatgaaagattttacaatgtcctttatgaa

SEQ ID NO: 62722 - DNA, 201 bp, Homo sapiens
gctgaggcaggagaatggcgtgaacccaggaggcggagcttgcagtgagccgagatcatgccactgcactccagcctgggcgacagcgagactccgtctcaaaaaaaaaaaaaaaaaattgctctcaaaagtgattgtacaggtccagaatccctttgaatttttttggaccaggtatatttcagaattctgaattttttg

SEQ ID NO: 62723 - DNA, 201 bp, Homo sapiens
aaaataaataaataaataaataaataaataaataaataaataagtaatccaggcatgaggtgattatgccttccaggagaatgaagagaaggcaaatctasgggaaaaaaatagtaaaatctgtaagtacttagatatttttaaataatgtttacttttaatttgctaagtattaatacaactgagaatatggcatatatt

SEQ ID NO: 62724 - DNA, 201 bp, Homo sapiens
gaggcaggagaatcactggaatctgggaggtggaggttgtggtgagctgagatcatgccattgcactccagcctgggcaacaagagcaaaactccatctcaaaaaataaataaataaataaataaataaataaataaataaataagtaatccaggcatgaggtgattatgccttccaggagaatgaagagaaggcaaatct

SEQ ID NO: 62725 - DNA, 201 bp, Homo sapiens
aggcaggagaatcactggaatctgggaggtggaggttgtggtgagctgagatcatgccattgcactccagcctgggcaacaagagcaaaactccatctcaaaaaataaataaataaataaataaataaataaataaataaataagtaatccaggcatgaggtgattatgccttccaggagaatgaagagaaggcaaatcta

SEQ ID NO: 62726 - DNA, 201 bp, Homo sapiens
ggcaggagaatcactggaatctgggaggtggaggttgtggtgagctgagatcatgccattgcactccagcctgggcaacaagagcaaaactccatctcaaaaaataaataaataaataaataaataaataaataaataaataagtaatccaggcatgaggtgattatgccttccaggagaatgaagagaaggcaaatctag

SEQ ID NO: 62727 - DNA, 201 bp, Homo sapiens
ttttttccaactgtaaatgatataaaaaatcacatccatgaggtacagaaatccttgagaaatggagatacggtatataactcagagattattccagcaayggtatgattacaaccataattccttattacagagtctttctcagcttctattaatatttagtctaataagaatggctagtgttaggccatctgaataact

SEQ ID NO: 62728 - DNA, 201 bp, Homo sapiens
ggagaatcactggaatctgggaggtggaggttgtggtgagctgagatcatgccattgcactccagcctgggcaacaagagcaaaactccatctcaaaaaataaataaataaataaataaataaataaataaataaataagtaatccaggcatgaggtgattatgccttccaggagaatgaagagaaggcaaatctagggga

SEQ ID NO: 62729 - DNA, 201 bp, Homo sapiens
tttcaatataagagctttatttttactgaaataaatgttcccatttcagcttcaatggactacagacagtgggaatattctcaaagagaccatgacagttmcatttgcagaaggtaggttttcttgaatacctttaaaatataaattcaaatggtgtttaactggaaggaacttaagatattatctcatctaatcaaattt

SEQ ID NO: 62730 - DNA, 201 bp, Homo sapiens
cttatagaaaatataatcaattactttataatattgcattttaatatatcaatgaataaataagacttctttcatatattatactgaaaaataaaatatcraagtttccattaaacctatttaataaaatgttaaaagagcaattttattttaaatatgtacatcagctgtgtttttccccttcagattaaatattttagc

SEQ ID NO: 62731 - DNA, 201 bp, Homo sapiens
aagaattagtatcacagggaatagaacaagtgtatgcagtaaggaaacagctaaggtacaatagaagagcattgttcttttacatttttcagttttgtttsttgctttaaataatacagtgaacattggagatattttccaaaatatatgctatcagggtagataaggaatatagtttattaatttattaaaataatctta

SEQ ID NO: 62732 - DNA, 201 bp, Homo sapiens
tacaaaagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatg

SEQ ID NO: 62733 - DNA, 201 bp, Homo sapiens
tttatatgtttgtatatgtaagtaagacttactaatgttttctttccttaaagctgtatatttgaaagattttgacattgccaccaccaagttacttttawtctagtgtctagaatagatggacacttgaattaatatcaatagttggttttggcccacagggagtagagctgtggtaatggagtgtcagtatgggccaag

SEQ ID NO: 62734 - DNA, 201 bp, Homo sapiens
attcttatggtcttattcaagatattgatgttactttgttcttgtttttgttgttaagatgtccctgaagagaaacccagtaacagaaacttaccaactgyaagagtggatactctagcagacaataccagcaattacattcttcatcctcaaacatccttcccattgcccaaaaagtcagtgaccgggtgagtccacggg

SEQ ID NO: 62735 - DNA, 201 bp, Homo sapiens
atagcccaaggtaactacaggctttttggaatttttgcaattgattttttacttgattaggatataagtgataatttaaaatcttaaaaacgagaagcaaytaaaagatattttgtagccatatattaaaaatggactgattttgtagctttacaaaattgccccaattgagaactactgtagtagacctaagtggctcgg

SEQ ID NO: 62736 - DNA, 201 bp, Homo sapiens
ccctcaactgtaggaccacagtgaaagtctataaatatttacaaatattttaatttaattggatataaagcaaatcttagaagagttaagagatcattttwaattttatttgatatgaaataaccatatataattttttcttaaaggattaatcctttcctttatgagtattaacctaagtaattatgattcctactttgg

SEQ ID NO: 62737 - DNA, 201 bp, Homo sapiens
cgtgactacagtatattgctattaactgtagtcactatgaacttattcctcgtaattgaaattttgtatcctttgaccacagtctgcttttcttttctttcctttcttttcttttcttttctttttttaaatttacacaccactatacaaacagggaacacagctttctttcctaatatgagggtttaaagaaggagtgtc

SEQ ID NO: 62738 - DNA, 201 bp, Homo sapiens
tacagtatattgctattaactgtagtcactatgaacttattcctcgtaattgaaattttgtatcctttgaccacagtctgcttttcttttctttcctttcttttcttttcttttctttttttaaatttacacaccactatacaaacagggaacacagctttctttcctaatatgagggtttaaagaaggagtgtccaatct

SEQ ID NO: 62739 - DNA, 201 bp, Homo sapiens
actgattttgtagctttacaaaattgccccaattgagaactactgtagtagacctaagtggctcggagttattggtatatatttcttcattttcttttttwaaatatatcttccttttcaaagcttgtcaaactaatgttaagtgggatgcttgtctattaatggtaaaaattgtatatatataatctctgtctacaccag

SEQ ID NO: 62740 - DNA, 201 bp, Homo sapiens
acagtatattgctattaactgtagtcactatgaacttattcctcgtaattgaaattttgtatcctttgaccacagtctgcttttcttttctttcctttcttttcttttcttttctttttttaaatttacacaccactatacaaacagggaacacagctttctttcctaatatgagggtttaaagaaggagtgtccaatctt

SEQ ID NO: 62741 - DNA, 201 bp, Homo sapiens; identical to SEQ ID NO: 39402

SEQ ID NO: 62742 - DNA, 201 bp, Homo sapiens; identical to SEQ ID NO: 39372

SEQ ID NO: 62743 - DNA, 201 bp, Homo sapiens; identical to SEQ ID NO: 36530

SEQ ID NO: 62744 - DNA, 201 bp, Homo sapiens; identical to SEQ ID NO: 36542

SEQ ID NO: 62745 - DNA, 201 bp, Homo sapiens; identical to SEQ ID NO: 36492

SEQ ID NO: 62746 - DNA, 201 bp, Homo sapiens
ttggaaaatgctgccagtccgcaggaaaaagttgttactgctgctgtctgtgaccaagaggacactttatttcttgaaacaactgggggcaaactggctcycagataaggcttcagtccctactcatgtgaggaaaccagccctggtaggttccatgcacaagaatacaggacaaggagcagcttttttcacctcatgcaa

SEQ ID NO: 62747 - DNA, 201 bp, Homo sapiens
tatattctgactagaaataacaccattttctctttgcagcacctgagagtttattcagtgacgataatactcacaagaccctttttggatttgtggcccamcccacaagttatagttccttctctgaatatttcatccagattgtgaagagcagcttctggcagccacagttgtactatgtgacccctacttcccatgccc

SEQ ID NO: 62748 - DNA, 201 bp, Homo sapiens
gtgtttcatggaacctggaggttccttagagacccctcagaagcagacctagtggtcagagtaaaagctgaggagtaagctgtgcctctccctccccaggmcccatcccaaccacagaagttccacttgcatcagttttatataccagactattgcatgaaattacattttgacagatgattattcttaaaaaatatataa

SEQ ID NO: 62749 - DNA, 201 bp, Homo sapiens
atttgcataggactatgccttgattccttagagtatcattgtgagatggttgtatattctgactagaaataacaccattttctctttgcagcacctgagartttattcagtgacgataatactcacaagaccctttttggatttgtggcccaacccacaagttatagttccttctctgaatatttcatccagattgtgaag

SEQ ID NO: 62750 - DNA, 201 bp, Homo sapiens
aaatctttcctggctttaagagatatggggatagaaaagtttaatccctttttgattcttgatgtagcaaaaatgctaaattaatggagtcctaattcatyagtctttactaaattttattctgaatcatggaaatcagtttcttttaagaaggaagatttcctttggaagcttttgttggagtggaggaggtgaaaagag

SEQ ID NO: 62751 - DNA, 201 bp, Homo sapiens
tgtgaactactaaaagtaaatctgcatggacttcttgcctggtgagttacacagaaaatgaaagtgattatcagtggctgtggcaagatgaaaggaaccaygccaggacttctgagggaaggtaagattttgttatttatttcaagaaattgaaaagttgagagaaatgcacccagccatccccctatgcattcattcatc

SEQ ID NO: 62752 - DNA, 201 bp, Homo sapiens
aatttttgacgatgaaatttgaattaatggtatgtggctttatgtagcaagctaactggaaggaacacaagcaaaacagtctatattttatgcactattayttaagggaatgtaattatatttatttttaattatatttattttatgttcatgtagtaactaaaattcatatttattcctcttctctccacttcatacaaa

SEQ ID NO: 62753 - DNA, 201 bp, Homo sapiens
tcctcttgcattttcaggaagagtgtttgggactgaaaaatccttgtctggatctagtcctcagccactcagaagctggcatgccatgactcaaagagccrcccgtctggaatgaagacagtgacccgtaactcccacctgaagagcaggtgcttggaaaatgctgccagtccgcaggaaaaagttgttactgctgctgtc

SEQ ID NO: 62754 - DNA, 201 bp, Homo sapiens
tgaacatagatcagatgaaggggctgggggaagatagcagacatgaggttacaggtatggggactacaaggtgtaagctatgccagggagtttgaacttgrccctgtaggaaataaggaggcaacgtacttagttaaaattattatcattgttatgttaaaatatgcataacataaaatttaccatttcacccatttaaaa

SEQ ID NO: 62755 - DNA, 201 bp, Homo sapiens
tgggatgtgggaaactggaaaggaaacttgaattgatttgagttgacacgagattacactatttgggaagaatccagaattcaatcagcagccttggaccragaaagtccaggtctgagcattggctttcccccttatcagaggatgacttaacctctgggagtttcggtaatcccagccacaaaacaagggtaatcagac

SEQ ID NO: 62756 - DNA, 201 bp, Homo sapiens
ctcctcttgcattttcaggaagagtgtttgggactgaaaaatccttgtctggatctagtcctcagccactcagaagctggcatgccatgactcaaagagcygcccgtctggaatgaagacagtgacccgtaactcccacctgaagagcaggtgcttggaaaatgctgccagtccgcaggaaaaagttgttactgctgctgt

SEQ ID NO: 62757 - DNA, 201 bp, Homo sapiens
agagtattgctaaggtagagaatggagaatgttgactctcacagccctctgacaaattagaatcctagaataagacaactttaaatgtgtagactcggacygtggctattcaatggacaattttagatttgcataggactatgccttgattccttagagtatcattgtgagatggttgtatattctgactagaaataacac

SEQ ID NO: 62758 - DNA, 201 bp, Homo sapiens
cagtgacatcctatttggggtgactggttcagggagacttgagtgcaaacagagcattactcactctggcagactagggttctttgctgaaatattggggmctgatggcttctgactggtagtaataaatcctgttcctctcgagcaaagaaaagccaaatctaaaccaaatgtgagcaggagtgtgaaatggaaagctgg

SEQ ID NO: 62759 - DNA, 201 bp, Homo sapiens
tggacaattttagatttgcataggactatgccttgattccttagagtatcattgtgagatggttgtatattctgactagaaataacaccattttctctttrcagcacctgagagtttattcagtgacgataatactcacaagaccctttttggatttgtggcccaacccacaagttatagttccttctctgaatatttcat

SEQ ID NO: 62760 - DNA, 201 bp, Homo sapiens
gatatgaatcccagaacactgagctcaaaacccaaagcccagaatttgaagctcaaagttccaaattccaggaaggtgcggagatgcttctgaaccccgasgaaaagagtcctttgaatatctccgtaggagttcaccccctggactccttcactcaggggtttggggagcagcccacaggggacctgcccatagggccac

SEQ ID NO: 62761 - DNA, 201 bp, Homo sapiens
tatgaatcccagaacactgagctcaaaacccaaagcccagaatttgaagctcaaagttccaaattccaggaaggtgcggagatgcttctgaaccccgaggraaagagtcctttgaatatctccgtaggagttcaccccctggactccttcactcaggggtttggggagcagcccacaggggacctgcccatagggccacct

SEQ ID NO: 62762 - DNA, 201 bp, Homo sapiens
gaaactctcgttgagtcaggagcgggtaaaaggtaggtggggtggggagtggggccccggggtggggcctgggcctctgcgtgcaaaccccagcctccctyttcttcctcaggctttggagcccctgagtttgagttcaataaaaactttatgtggtaaacgagacttgtccttaaaatgtgtgcgtgcacagcgccctgg

SEQ ID NO: 62763 - DNA, 201 bp, Homo sapiens
ccgcacctacagctgccccgactgcggcaagaccttcaatcgctcctccactctcatccagcaccagcgctcccacacgggcgagcggccctacaggtgckccgtgtgcggcaagggcttctgccgctcctccacgcttctgcagcatcaccgggtccacagtggcgagcggccttacaagtgcgatgactgcggaaaggc

SEQ ID NO: 62764 - DNA, 201 bp, Homo sapiens
gaagtcgaagagataccatttgggcttgaaccccagagccctgggtttgagccacaaagcccagagtttgaaccccaaagccccagatttgagcctgaaarcccggggtttgagtcccgaagccctgggcttgtgcccccaagccctgagtttgcacccagaagccctgaatcagattctcagagccctgagtttgaatcc

SEQ ID NO: 62765 - DNA, 201 bp, Homo sapiens
agatgcttcagaatcccctgggtctcacaggagcccttcgaggtccaggtcggcggggtggccgggccaggggtgggcagggccctcggcctaacatctgyggcatctgcgggaagagcttcgggcggggctccaccctgatccagcaccagcgcatccacaccggtgagaagccctacaaatgtgaggtctgcagcaagg

SEQ ID NO: 62766 - DNA, 201 bp, Homo sapiens
gaaccccggagccctggctatgaatctgagagctctagatatgaatcccagaacactgagctcaaaacccaaagcccagaatttgaagctcaaagttccarattccaggaaggtgcggagatgcttctgaaccccgaggaaaagagtcctttgaatatctccgtaggagttcaccccctggactccttcactcaggggttt

SEQ ID NO: 62767 - DNA, 201 bp, Homo sapiens; identical to SEQ ID NO: 29629

SEQ ID NO: 62768 - DNA, 201 bp, Homo sapiens
cgacctctgcgccctcgggagtccgggtcctcacgcgcatcccgagccctgggggcctggatgcggcccacggccccgactcaagggcgaggctcaggggrgagggcgcaagacgcctccgcacagaactgtgaccgaggagcaggggggctgccggggagggcgcacctgtccccgtgcacgcgctgtggcctccgtgga

SEQ ID NO: 62769 - DNA, 201 bp, Homo sapiens
acatcacagctgggtgggggctgggtgttgggtccaaggaggtggctgtccaaggtcacacagcctgtgggtcctgggctgccaccagggggtctcccaamatccccattccgtcacccatctgtccttcatgcccgtgatggcagctttatcccaggtcccagcagaagccgcggctgcaggggcagttaggcaggcagg

SEQ ID NO: 62770 - DNA, 201 bp, Homo sapiens
cggtggcgggcggggctgagcggcggcggagcacgcggaggggcgtgagaggccgagaggcggtccctcggctggggcatagaggcttccccggtggaaawgagccgcggcctctgcgggtgaggggcccgaccggccagccagctcgccagggtggaaagggaccccccacgggtcctgcggcctcgagtctggggggct

SEQ ID NO: 62771 - DNA, 201 bp, Homo sapiens
ctactcagattttctccccaactgttctctcattttgataagagggatcccagacagactctggaagcgccgttttgcgggtgggaactgaagggaaaagkcctctctctgagcctgtgtttcgggccagcttttcctgaaggagggtctgattcccaccaggtccccagggccctggccggtgggggcaggcctggctga

SEQ ID NO: 62772 - DNA, 201 bp, Homo sapiens
atggatgagttttggtgacacaggcttagtggtagtggaggggggcaggcagaagagataaggggtggctgccctggagccttgatggggtgagagacccyggggtccagggcaaaggggtcactcctcggccgggctgctctatctccagatcccctcacccggcacatggccaggcacctggggcagtgtcagctgaat

SEQ ID NO: 62773 - DNA, 201 bp, Homo sapiens
cgcgcgcggcgcacagtgaccaggtgagcacgcgccgcccagggacccccgcctgctcctcggactgctctccctgcccgctgatccttcccgccgctctmgaagcgctggttctcccagcaggccccttctctgggttttcctgtctccttctccccccgccgcccccccaacacttcatcagggagacacctgacaccg

SEQ ID NO: 62774 - DNA, 201 bp, Homo sapiens
ggtgcagatgggggacggcctcccccggggctccccccacaacagcgcaggtgagtcggtggcgggcggggctgagcggcggcggagcacgcggaggggcstgagaggccgagaggcggtccctcggctggggcatagaggcttccccggtggaaatgagccgcggcctctgcgggtgaggggcccgaccggccagccagc

SEQ ID NO: 62775 - DNA, 201 bp, Homo sapiens
gctagccccagacatgcacactcttgctgtcacccaaacacgcgcagacacccgcacactcgagctgccagcattgggagctgggggcggggcgggtgccyttcaggagcagggactcggctcctctgcccgccccgcggggcttgctgcagatgccaggggttattttaagcctggatcaatggatgagttttggtgaca

SEQ ID NO: 62776 - DNA, 201 bp, Homo sapiens
cctaaggaaaggaagcaggaaaggacgctccagaaagtagagctcagaagctctgagaagaatcacaaatgagaaggtttttttttgtttttttttttttktttgtttgtttgtttttttaagacggagtctcaatctgtttcccaggctggagggcaatggtgtgatctcagctcactgcaaactctgcctcccaggttc

SEQ ID NO: 62777 - DNA, 201 bp, Homo sapiens
aggtgtggtggcaggcaccttataatcccagctactagggaagctgaggctggagaatcacttgaaccggggaggtggaggttgcagtgagccaagattgygccattgcactccagcctggacaacagagcgagactctgcttcaaaagataaaaaaattaaaaaaaaggattcctggaggaggccgctgatggggtctga

SEQ ID NO: 62778 - DNA, 201 bp, Homo sapiens
ccctaaggaaaggaagcaggaaaggacgctccagaaagtagagctcagaagctctgagaagaatcacaaatgagaaggtttttttttgtttttttttttttgtttgtttgtttgtttttttaagacggagtctcaatctgtttcccaggctggagggcaatggtgtgatctcagctcactgcaaactctgcctcccaggtt

SEQ ID NO: 62779 - DNA, 201 bp, Homo sapiens
gctggaaaggggttccaggaagagagggcagcctgcgtgaccagacagggggcaaatgagcctgggtcaggtgttggcaagggccctgtcgtggggtaggrgtgcctcccgggtgtgctgaactggccagaatgtggattcgggactcatagtgcaggttccaggccagaccctgcccttcctggctgtgtgccagtcaca

SEQ ID NO: 62780 - DNA, 201 bp, Homo sapiens
attttttatcgttggcagttttttaaaaattaccatttcaatctttctgctttttattggtctgttcacagtttctatttcttcctgatttattctaggarggttgtatatttccaggaatctgtcttctctaggttttctagtttgtgcctgtgaatgtgttcatattagccttgaatgatattttatatttctgtaata

SEQ ID NO: 62781 - DNA, 201 bp, Homo sapiens
tcttcccaccagtgctgaacatcacgtggctgcgcaatggggagccagtcattgagggtattgcagagaccatcttcctgcccagcaagaaactcagattmcacaggttccactatctgaccctcgttcccatggccgaggacacctgtgacctccagggggagcactggggcctgcaccagcctctcctcaggcactggg

SEQ ID NO: 62782 - DNA, 201 bp, Homo sapiens
accctgctgctgcatcccacacctcctgctcttggcacccgtgagcttctgctgcctttcctttatgctgctgtctgggtctttggggttgatgtgggatmtgggagaattttgaaacggatcattgctgtcaggatgaaggtggagaggggcattctgaagatctttgttttggggagttggggtggtggtgaatgtttc

SEQ ID NO: 62783 - DNA, 201 bp, Homo sapiens
tgttttgtgcctttcttttcactctgggtcatggtagccatattgttgaaggttcacttcccagatcctcttttcttggctgcttcctgtctgtacagccrcttcctgtttgtccagtttgttttgtggccatcttggccatgtttaattttccttggccctggcatcactcttgcatccaagtgtttgtcattttatttt

SEQ ID NO: 62784 - DNA, 201 bp, Homo sapiens
tcacagggctgaggtggtggaaagaggagaagcaagtggggtttagtgtgctggccctgtcacctgtgagttttaacctttgactccacagggtatgctcktggaggggccccctggtttagaaggccctgtggtgagtctagcagtgacctggtggccattgttttcttagagatccctcctatgtgttcatctgtgcct

SEQ ID NO: 62785 - DNA, 201 bp, Homo sapiens
tgttttgtggccatcttggccatgtttaattttccttggccctggcatcactcttgcatccaagtgtttgtcattttattttgtgtcccttagttgttctmatatcttccagtattctctgtcagttggactgcttcctgtctactctgctacatcttctgcctgccttgcagttatggctgccttttctaccctgctgct

SEQ ID NO: 62786 - DNA, 201 bp, Homo sapiens
ttttgtgtagtgctggattggtagcggtgaagtctctcagcatttgtttgtctgaaaaagactttatctctccttcatttatgacgcttagttttgctggrtacaaaattcttgcctggaaattattttgtttgaggaggctaaagataagaccccagtcttttctggcttataggctgctgttaatctgataggttttcc

SEQ ID NO: 62787 - DNA, 201 bp, Homo sapiens
gctcctctcagggtggcaactaatgacttttatacaactcaagccagtggtcactgttctgtttctgtcttatgtgtgtcattagtgtgtttgagatgccycctctcctctttcctggaagttttctcctgtctcttgtcttttatgaacccacttcctctctgttttcctaccaatttctagtcctctgcttttcagcct

SEQ ID NO: 62788 - DNA, 201 bp, Homo sapiens
gtggcaggactgtccacagccacttattctatccttcagtcttcatctctccatctatccatcccttgaacctatctctctcctcatccaccccatccatycactcattcaccagtccacctacgcacacatccaccacccactcccgcaaccatttacccacctatgcatcacaaacttacccatctactcatgcatgaa

SEQ ID NO: 62789 - DNA, 201 bp, Homo sapiens
actgttctgtttctgtcttatgtgtgtcattagtgtgtttgagatgccccctctcctctttcctggaagttttctcctgtctcttgtcttttatgaacccrcttcctctctgttttcctaccaatttctagtcctctgcttttcagcctctttcttcatgtctgtgtttgtctggatgcaggagcacacactcagatccct

SEQ ID NO: 62790 - DNA, 201 bp, Homo sapiens
cattgtacctgttttgtgcctttcttttcactctgggtcatggtagccatattgttgaaggttcacttcccagatcctcttttcttggctgcttcctgtckgtacagccacttcctgtttgtccagtttgttttgtggccatcttggccatgtttaattttccttggccctggcatcactcttgcatccaagtgtttgtca

SEQ ID NO: 62791 - DNA, 201 bp, Homo sapiens
atgtgctgatgagaagaatgtatattctacagttgttgagtagaatgttctgtaaatatctgttaagtttatttcttctagtgtaacttaagtccattgtytcattgttgactttctgtcttgatgactttctagtactgtcagtggagtattgaagtccccactattattgtgttgctgtctatctcatttctcatgtct

SEQ ID NO: 62792 - DNA, 201 bp, Homo sapiens
cttttcttctgctgggtttgggtttggtttgttcttgtttctctagttccttgaggtgtgactttacattttgtatttgtgctctttcagactttttgatrtaggcatttaatgctatgaactttcctcttaggactgtttttactgtgtccgagtggttttcacaagttgtgtcactattatcattcagttcagagaatt

SEQ ID NO: 62793 - DNA, 201 bp, Homo sapiens
tgctcctctcagggtggcaactaatgacttttatacaactcaagccagtggtcactgttctgtttctgtcttatgtgtgtcattagtgtgtttgagatgcmccctctcctctttcctggaagttttctcctgtctcttgtcttttatgaacccacttcctctctgttttcctaccaatttctagtcctctgcttttcagcc

SEQ ID NO: 62794 - DNA, 201 bp, Homo sapiens
ctagttttgccctctgccttgtgatcttttactgccctctgaagcatgtgatccctgtgacccattccctattcatagacccccaccccttttgaaatccrtaataaaaacttgctggttttgcggctcaggtgggcatcatggaacctgctgacatgtgatatcacccccggagacccagctgtaaatttctctcttttg

SEQ ID NO: 62795 - DNA, 201 bp, Homo sapiens
ttcttaggtcatttaacataatcccaaatttcttggaggctttgtttatttattaaagttcttttttctttgtctttgtctgactgggttaattcgaaagkcttgttgtttgagctatgaagttctttcttctacttgttggatcctattgttgaaactttccagtgcattttgtatttctctaagtgtgtctttcatttc

SEQ ID NO: 62796 - DNA, 201 bp, Homo sapiens
atccattatccttcctggaactcaaccactctctccttcaatacactcatgcacccatctcctcacccactcacttcacatccaaccgttcactcaaccaygtattcaattccacccatctatctattcactcatctgattccatctactctgtacctcccgctcatctacccactaagccttgcatgcataattccctct

SEQ ID NO: 62797 - DNA, 201 bp, Homo sapiens
cacccattaactgatgggcatttggggtggttccatatttttgcaattgtgaatcatggtgctgtaaacatgtgtgtgcaagtgtctttttcatacaatgrcttttttcctccagtagtgggattgctggatcaaatggtagatctatttctagttctttaaggcatcgctgtactgttttccataggttgtactagttta

SEQ ID NO: 62798 - DNA, 201 bp, Homo sapiens
ttgctgtcaggatgaaggtggagaggggcattctgaagatctttgttttggggagttggggtggtggtgaatgtttcaccttctccccacccttatcttgsctatggcctggatttgggaacaggcatctgaatggaggtgtgcaagggagggaactggttggcttggagtgtacatgagggccagaagaagggcaaagca

SEQ ID NO: 62799 - DNA, 201 bp, Homo sapiens
acccatctatccattatccttcctggaactcaaccactctctccttcaatacactcatgcacccatctcctcacccactcacttcacatccaaccgttcaytcaaccatgtattcaattccacccatctatctattcactcatctgattccatctactctgtacctcccgctcatctacccactaagccttgcatgcataa

SEQ ID NO: 62800 - DNA, 201 bp, Homo sapiens
catgtgtgtgcaagtgtctttttcatacaatggcttttttcctccagtagtgggattgctggatcaaatggtagatctatttctagttctttaaggcatckctgtactgttttccataggttgtactagtttaatttcccaccagtagcatagaagtgttctcttttcatcacacctaccccaacgtctattttttttttt

SEQ ID NO: 62801 - DNA, 201 bp, Homo sapiens
tcctgtctcggcctctcaaatcactgagattacaggtatgggccactgtgcccagcctattatcgattttctcccatttcattcagtcctcaacccaatgyactctctctttttctttccctcatctctgatgctcctctcagggtggcaactaatgacttttatacaactcaagccagtggtcactgttctgtttctgtc

SEQ ID NO: 62802 - DNA, 201 bp, Homo sapiens
caactcaagccagtggtcactgttctgtttctgtcttatgtgtgtcattagtgtgtttgagatgccccctctcctctttcctggaagttttctcctgtctsttgtcttttatgaacccacttcctctctgttttcctaccaatttctagtcctctgcttttcagcctctttcttcatgtctgtgtttgtctggatgcagga

SEQ ID NO: 62803 - DNA, 201 bp, Homo sapiens
gttctttaaggcatcgctgtactgttttccataggttgtactagtttaatttcccaccagtagcatagaagtgttctcttttcatcacacctaccccaacrtctatttttttttttatttttaaattatgaccattgttacaggagtaagttggtatcacatagtggttttgatttgcatttccctgataattagtgatgt

SEQ ID NO: 62804 - DNA, 201 bp, Homo sapiens
ccatctgctgtcctcctcaccccatgttcctgccctggcctacgccttcattacttcccaccagagggcttaaaagtgctactggtcttgccttgagtccmgcctcctccagcccatccttcctacaggtgccccatccaaacacaaatctgaccgtgttactctcctgcttaagatacttcacaacttcctatgtcctgt

SEQ ID NO: 62805 - DNA, 201 bp, Homo sapiens; identical to SEQ ID NO: 20441

SEQ ID NO: 62806 - DNA, 201 bp, Homo sapiens
acatttgaagtgtggaatttgcttcaaaatgtgccaacctttagttttcagattttgtaaatataataaatacaaagtaacctaagctgaaccaattacakctgtgtagcccagtctatacaccatgtatttttctttttcctttgggattcatttctgtaggtgagtaatcctctagaccctaaactcagtgggggaccc

SEQ ID NO: 62807 - DNA, 201 bp, Homo sapiens
ttacaggagtaagttggtatcacatagtggttttgatttgcatttccctgataattagtgatgtagagcattttttcatatgtttgtcaaccatttgtatrttttcttttgagaattgtctgttcctctgcttagcccactttttgatgggagtatttgtttatttcttgctgatttgtttgagttttttgtagattctgg

SEQ ID NO: 62808 - DNA, 201 bp, Homo sapiens; identical to SEQ ID NO: 20625

SEQ ID NO: 62809 - DNA, 201 bp, Homo sapiens
agaactccttttagcattttgtgtagtgctggattggtagcggtgaagtctctcagcatttgtttgtctgaaaaagactttatctctccttcatttatgamgcttagttttgctggatacaaaattcttgcctggaaattattttgtttgaggaggctaaagataagaccccagtcttttctggcttataggctgctgtta

SEQ ID NO: 62810 - DNA, 201 bp, Homo sapiens
ttttataccattcccatgctgttttggtgactatagccttgcagtatattttgaagtcaggtaatgtgatgctccagatttattcgttttgcttaatcttrctttggctatgtgggctcttttgtagttccatatgaattttaggattgtttttttctagctctgtaaagaatgatgatggcattttgatggggattgcat

SEQ ID NO: 62811 - DNA, 201 bp, Homo sapiens
taccttttcttttttggagaaagactgaaagactcaaagtcctctttctgaaagaggctcttcaggatttggagaggttgtgtttgctgaggtgggactgrgaactggggtgcagggaaccctgagatctccttggcaggcatgagagttttgtgaacagaagtatttagaggaagcctgtggggcttgtgggtagggctg

SEQ ID NO: 62812 - DNA, 201 bp, Homo sapiens
tagtgattcctgtggcctctcatgtcattactgccatcaaatccatctgctgtcctcctcaccccatgttcctgccctggcctacgccttcattacttccyaccagagggcttaaaagtgctactggtcttgccttgagtcccgcctcctccagcccatccttcctacaggtgccccatccaaacacaaatctgaccgtgt

SEQ ID NO: 62813 - DNA, 201 bp, Homo sapiens
ccaatggcagtaggctccttgggttctatccccttttggagcccccaccgaggtaagcgtctttcccaaggagcctgtggatctgggccagcccaacaccytcgtctgccatgttgacaagttcttcccaccagtgctgaacatcacgtggctgcgcaatggggagccagtcattgagggtattgcagagaccatcttcct

SEQ ID NO: 62814 - DNA, 201 bp, Homo sapiens
aattacatctgtgtagcccagtctatacaccatgtatttttctttttcctttgggattcatttctgtaggtgagtaatcctctagaccctaaactcagtgrgggaccctcaccatccgtgtgcggcactgaacctgctgtcacactatgcatctaagtagaggactggttctccccatgctgggctgggaggggaaatcct

SEQ ID NO: 62815 - DNA, 201 bp, Homo sapiens
aaaaatcattttgaaaaattaattcaatagtttttggggagcaggtggtgtttggttatatggataagttctttagtggtgatttctgaggttttggtgcrcccatcacctgaggaatgtacactgtatccagtgtgtagtcttttatcccttacccagctcctactcatacctggaagtcctcaaagtccattatataat

SEQ ID NO: 62816 - DNA, 201 bp, Homo sapiens
aacctcatcagtgattctagttttgccctctgccttgtgatcttttactgccctctgaagcatgtgatccctgtgacccattccctattcatagacccccrccccttttgaaatccataataaaaacttgctggttttgcggctcaggtgggcatcatggaacctgctgacatgtgatatcacccccggagacccagctgt

SEQ ID NO: 62817 - DNA, 201 bp, Homo sapiens
ttgagtcccgcctcctccagcccatccttcctacaggtgccccatccaaacacaaatctgaccgtgttactctcctgcttaagatacttcacaacttcctrtgtcctgtgggataaaatgcaaacacttgccatcagcacacaaggcaggttacagtgctgcctggcccacatctcccctggcttcagtcacactgaagaa

SEQ ID NO: 62818 - DNA, 201 bp, Homo sapiens
gaacctcatcagtgattctagttttgccctctgccttgtgatcttttactgccctctgaagcatgtgatccctgtgacccattccctattcatagaccccyaccccttttgaaatccataataaaaacttgctggttttgcggctcaggtgggcatcatggaacctgctgacatgtgatatcacccccggagacccagctg

SEQ ID NO: 62819 - DNA, 201 bp, Homo sapiens
gtaatgtgatgctccagatttattcgttttgcttaatcttactttggctatgtgggctcttttgtagttccatatgaattttaggattgtttttttctagytctgtaaagaatgatgatggcattttgatggggattgcattgaatttgtagattgcttttggcagtatggtcattttcacaatgttgattctacccttcc

SEQ ID NO: 62820 - DNA, 201 bp, Homo sapiens
tcctatgcctgtctttactttaatctcttaatcctgtcatctttgtaagctgaagatgtatgtcacctcaggaccctgtgatgattgcgttaactgcatarattgtttgtaaagcatgtgtgtttgaacaatatgaaaactgggcaccttgaaaagaacaggataacagcaattttcagggaacaagggagataaccataa

SEQ ID NO: 62821 - DNA, 201 bp, Homo sapiens; identical to SEQ ID NO: 20563

SEQ ID NO: 62822 - DNA, 201 bp, Homo sapiens
gtctccagaggacccaaaatcgaggttggagttgagatgggggcaggcctggtgtcctggctgctcatgggccccactggggttacatgtgtgtctccctyaggctgcccatgggccccgggggctgaagggagagaagagagagcctgcagtgctggaacctgtaagtcatgctggtcacagggctgaggtggtggaaag

SEQ ID NO: 62823 - DNA, 201 bp, Homo sapiens
actcccgcaaccatttacccacctatgcatcacaaacttacccatctactcatgcatgaaggcttatatccactcacctgtccatcctccccctgcttaaygactctccccttctttacacacatctattcgactatgcttttgttcatctgtcctcttcaacttatccatccatctattcactcacccacccactcacac

SEQ ID NO: 62824 - DNA, 201 bp, Homo sapiens
gagatgggggcaggcctggtgtcctggctgctcatgggccccactggggttacatgtgtgtctcccttaggctgcccatgggccccgggggctgaagggaragaagagagagcctgcagtgctggaacctgtaagtcatgctggtcacagggctgaggtggtggaaagaggagaagcaagtggggtttagtgtgctggccc

SEQ ID NO: 62825 - DNA, 201 bp, Homo sapiens
tgtgtagatctctagcgaggccagggaagttttccttgattattccctcaaatatgttttccaaacttttagatttttgttcttcctcaagaatgccaatyattcttaggtcatttaacataatcccaaatttcttggaggctttgtttatttattaaagttcttttttctttgtctttgtctgactgggttaattcgaaa

SEQ ID NO: 62826 - DNA, 201 bp, Homo sapiens
ttcttcctcaagaatgccaatcattcttaggtcatttaacataatcccaaatttcttggaggctttgtttatttattaaagttcttttttctttgtctttktctgactgggttaattcgaaaggcttgttgtttgagctatgaagttctttcttctacttgttggatcctattgttgaaactttccagtgcattttgtatt

SEQ ID NO: 62827 - DNA, 201 bp, Homo sapiens
gaggctttgtttatttattaaagttcttttttctttgtctttgtctgactgggttaattcgaaaggcttgttgtttgagctatgaagttctttcttctacytgttggatcctattgttgaaactttccagtgcattttgtatttctctaagtgtgtctttcatttccagaagttggattgtttcttctttatgatatctac

SEQ ID NO: 62828 - DNA, 201 bp, Homo sapiens
ttcctatcttcaggactgctgatctctgcagaataactagatgtccacttatgtggcaggactgtccacagccacttattctatccttcagtcttcatctytccatctatccatcccttgaacctatctctctcctcatccaccccatccatccactcattcaccagtccacctacgcacacatccaccacccactcccgc

SEQ ID NO: 62829 - DNA, 201 bp, Homo sapiens
ctgtttcctgttaagatgtttatcaatgacaatgtgtgcccagcgggatgtggaacctcatcagtgattctagttttgccctctgccttgtgatcttttaytgccctctgaagcatgtgatccctgtgacccattccctattcatagacccccaccccttttgaaatccataataaaaacttgctggttttgcggctcagg

SEQ ID NO: 62830 - DNA, 201 bp, Homo sapiens
ttattctatccttcagtcttcatctctccatctatccatcccttgaacctatctctctcctcatccaccccatccatccactcattcaccagtccacctaygcacacatccaccacccactcccgcaaccatttacccacctatgcatcacaaacttacccatctactcatgcatgaaggcttatatccactcacctgtcc

SEQ ID NO: 62831 - DNA, 201 bp, Homo sapiens
ctgaatggaggtgtgcaagggagggaactggttggcttggagtgtacatgagggccagaagaagggcaaagcatcctgctgggagaggaactgtggggtgyattgtagggggctgctctggggcttggataactgagcccaagaactgtatgttttgcaaaaggcagttatgaggcctgagtttggaatatctctgggaaa

SEQ ID NO: 62832 - DNA, 201 bp, Homo sapiens
atctttgtaagctgaagatgtatgtcacctcaggaccctgtgatgattgcgttaactgcataaattgtttgtaaagcatgtgtgtttgaacaatatgaaawctgggcaccttgaaaagaacaggataacagcaattttcagggaacaagggagataaccataaggtctgactgcctgcagggccaggcagaacagagtcat

SEQ ID NO: 62833 - DNA, 201 bp, Homo sapiens
ggccccactggggttacatgtgtgtctcccttaggctgcccatgggccccgggggctgaagggagagaagagagagcctgcagtgctggaacctgtaagtyatgctggtcacagggctgaggtggtggaaagaggagaagcaagtggggtttagtgtgctggccctgtcacctgtgagttttaacctttgactccacaggg

SEQ ID NO: 62834 - DNA, 201 bp, Homo sapiens
agggaactggttggcttggagtgtacatgagggccagaagaagggcaaagcatcctgctgggagaggaactgtggggtgcattgtagggggctgctctggrgcttggataactgagcccaagaactgtatgttttgcaaaaggcagttatgaggcctgagtttggaatatctctgggaaatgctctccaaatttacttgga

SEQ ID NO: 62835 - DNA, 201 bp, Homo sapiens
tgttggagttatccttttatcattgtataatgtccctctttgtcttttttaactgttgttgctttaaaatctgttttgactgatataagaatagctactcytgcttgcttttgttttccatttgtatggaatatctttttccactcctttaccttaagtttttgtgagtccttacacattagatgactcttgaagactgaa

SEQ ID NO: 62836 - DNA, 201 bp, Homo sapiens
agagttttgtgaacagaagtatttagaggaagcctgtggggcttgtgggtagggctggtctggtctccagaggacccaaaatcgaggttggagttgagatkggggcaggcctggtgtcctggctgctcatgggccccactggggttacatgtgtgtctcccttaggctgcccatgggccccgggggctgaagggagagaag

SEQ ID NO: 62837 - DNA, 201 bp, Homo sapiens
ggttggagttgagatgggggcaggcctggtgtcctggctgctcatgggccccactggggttacatgtgtgtctcccttaggctgcccatgggccccggggkctgaagggagagaagagagagcctgcagtgctggaacctgtaagtcatgctggtcacagggctgaggtggtggaaagaggagaagcaagtggggtttagt

SEQ ID NO: 62838 - DNA, 201 bp, Homo sapiens
agagatattggtctgtagttttcttttttattatgtcctttcctggttttggtattagggcgatcctggcttcatagaataatttagggaggattctctcyttctctgttttggaatagtttcagtaggattggtaccaattctcttctttgaatgtctgattgaattcagctgtgagtccatgtgaatctgtgatttttt

SEQ ID NO: 62839 - DNA, 201 bp, Homo sapiens
ccatccttcctacaggtgccccatccaaacacaaatctgaccgtgttactctcctgcttaagatacttcacaacttcctatgtcctgtgggataaaatgcraacacttgccatcagcacacaaggcaggttacagtgctgcctggcccacatctcccctggcttcagtcacactgaagaactgcagttctccttgcaactt

SEQ ID NO: 62840 - DNA, 201 bp, Homo sapiens
gaggattctctccttctctgttttggaatagtttcagtaggattggtaccaattctcttctttgaatgtctgattgaattcagctgtgagtccatgtgaayctgtgattttttatcgttggcagttttttaaaaattaccatttcaatctttctgctttttattggtctgttcacagtttctatttcttcctgatttattc

SEQ ID NO: 62841 - DNA, 201 bp, Homo sapiens
catttcaatctttctgctttttattggtctgttcacagtttctatttcttcctgatttattctaggagggttgtatatttccaggaatctgtcttctctargttttctagtttgtgcctgtgaatgtgttcatattagccttgaatgatattttatatttctgtaatatcagtggcattttcttccattttgtttctaatt

SEQ ID NO: 62842 - DNA, 201 bp, Homo sapiens
gcttataggctgctgttaatctgataggttttcctttataggttacctgatgcttttgcctcacagctcttaagattctttcctttgtcctgactttagayaacctgatgactatgtgcctgggcgataatctttctgtgataaatttcccaggtggtctttgagcttcttgtatttggttgtgtagatctctagcgaggc

SEQ ID NO: 62843 - DNA, 201 bp, Homo sapiens
cttcaaatcaactgtatgttttcccctagaagtttaaattcagtatgtctcaaacagaaaattttaccttctctcaatcacttaattatcacctttgcagkcacggatgccacaattctccacgttgcgtggttattctcgacttcttcatatccctacttctggcatgtgatttagtgattcctgtggcctctcatgtca

SEQ ID NO: 62844 - DNA, 201 bp, Homo sapiens
tgaggtggtggaaagaggagaagcaagtggggtttagtgtgctggccctgtcacctgtgagttttaacctttgactccacagggtatgctcgtggaggggmcccctggtttagaaggccctgtggtgagtctagcagtgacctggtggccattgttttcttagagatccctcctatgtgttcatctgtgccttccccacat

SEQ ID NO: 62845 - DNA, 201 bp, Homo sapiens
gaaccctaaactctctgtaattcactgtaataataattcactttttgttatcaaccagttgctgcttcttatgtatcaggtaaagctaagatactatcccrtaggtctttcaaatgccaacaacttgtatttccaggtgaaactacacttgaaaactacactccacaagacaattttgtgaatgttatgtgaatgataata

SEQ ID NO: 62846 - DNA, 201 bp, Homo sapiens
cttcttatgtatcaggtaaagctaagatactatcccataggtctttcaaatgccaacaacttgtatttccaggtgaaactacacttgaaaactacactccwcaagacaattttgtgaatgttatgtgaatgataatacttttaaatttactctgcctaaaatgtaagtgttgtggataaaattatagaaggtatcattttt

SEQ ID NO: 62847 - DNA, 201 bp, Homo sapiens
atgagggccagaagaagggcaaagcatcctgctgggagaggaactgtggggtgcattgtagggggctgctctggggcttggataactgagcccaagaactrtatgttttgcaaaaggcagttatgaggcctgagtttggaatatctctgggaaatgctctccaaatttacttggagtatggatacttaacctgtgcagggt

SEQ ID NO: 62848 - DNA, 201 bp, Homo sapiens
tttctttcatttgcatttctcattttctgtgttattccttcatgttcccaataaccttcctgttacctgtttgcttcctgcattctgtgtagcatcctacrtattcacccattctccatcttctccttcatgcagcagaccatgtgtcaacatatgcggagtttgtgcagacgcacagaccctctggggagtatatgtttg

SEQ ID NO: 62849 - DNA, 201 bp, Homo sapiens
gtgtcattagtgtgtttgagatgccccctctcctctttcctggaagttttctcctgtctcttgtcttttatgaacccacttcctctctgttttcctaccamtttctagtcctctgcttttcagcctctttcttcatgtctgtgtttgtctggatgcaggagcacacactcagatccctgctatcctgactttgtgtacttt

SEQ ID NO: 62850 - DNA, 201 bp, Homo sapiens
ccctcctatgtgttcatctgtgccttccccacatatgctcaggcctcctcctcagaactccggagggtccttccaataaaagttttttaaaaaatcatttygaaaaattaattcaatagtttttggggagcaggtggtgtttggttatatggataagttctttagtggtgatttctgaggttttggtgcacccatcacctg

SEQ ID NO: 62851 - DNA, 201 bp, Homo sapiens
tcctgttacctgtttgcttcctgcattctgtgtagcatcctacgtattcacccattctccatcttctccttcatgcagcagaccatgtgtcaacatatgcrgagtttgtgcagacgcacagaccctctggggagtatatgtttgaatttgatgaggaggagcagttctacgtgaacctggatgagaaggagatggtctggc

SEQ ID NO: 62852 - DNA, 201 bp, Homo sapiens
tttattaactgaatgaaaattaacatttgaagtgtggaatttgcttcaaaatgtgccaacctttagttttcagattttgtaaatataataaatacaaagtracctaagctgaaccaattacatctgtgtagcccagtctatacaccatgtatttttctttttcctttgggattcatttctgtaggtgagtaatcctctaga

SEQ ID NO: 62853 - DNA, 201 bp, Homo sapiens
caaaatgtgccaacctttagttttcagattttgtaaatataataaatacaaagtaacctaagctgaaccaattacatctgtgtagcccagtctatacaccrtgtatttttctttttcctttgggattcatttctgtaggtgagtaatcctctagaccctaaactcagtgggggaccctcaccatccgtgtgcggcactgaa

SEQ ID NO: 62854 - DNA, 201 bp, Homo sapiens
cctctggggagtatatgtttgaatttgatgaggaggagcagttctacgtgaacctggatgagaaggagatggtctggcctctaccagagtttattcacacytttgactttggtgctcagaggggtattgctggcatcgtcatggcaaggaagcacttgaacacccggatcaatggtccaaacagacttgggccacaaatgg

SEQ ID NO: 62855 - DNA, 201 bp, Homo sapiens
ctttcggcagtgtttttaattttcctcgtacaggtgtttaacctctattgcgggaagtcagggaccctgaatggagggaccggctgaagccacagtggaakaacataaattgtgaagatttcatggacatttatcacttccccaatcaatactcttataacttcctatgcctgtctttactttaatctcttaatcctgtca

SEQ ID NO: 62856 - DNA, 201 bp, Homo sapiens
tgcttcctgtctactctgctacatcttctgcctgccttgcagttatggctgccttttctaccctgctgctgcatcccacacctcctgctcttggcacccgygagcttctgctgcctttcctttatgctgctgtctgggtctttggggttgatgtgggatctgggagaattttgaaacggatcattgctgtcaggatgaagg

SEQ ID NO: 62857 - DNA, 201 bp, Homo sapiens
ggtatggagcgccctccctctgccctcacggccttggcaccacctttatttcctgggcccatcgcccctcagcacctgccttcctcaatcccatgttttayggtcactttatccaaatttcaccatctcatggtttcgaatacccaacacctcccacatccaaggccagcccctgctctctgtaccttataactctgtctt

SEQ ID NO: 62858 - DNA, 201 bp, Homo sapiens
atcctctagaccctaaactcagtgggggaccctcaccatccgtgtgcggcactgaacctgctgtcacactatgcatctaagtagaggactggttctccccrtgctgggctgggaggggaaatcctcacttagggaccaccaaccatgcagtgtcatttggcttcacttcctcttccaggccgaaccctaaactctctgtaa

SEQ ID NO: 62859 - DNA, 201 bp, Homo sapiens
tctgttttggaatagtttcagtaggattggtaccaattctcttctttgaatgtctgattgaattcagctgtgagtccatgtgaatctgtgattttttatcrttggcagttttttaaaaattaccatttcaatctttctgctttttattggtctgttcacagtttctatttcttcctgatttattctaggagggttgtatat

SEQ ID NO: 62860 - DNA, 201 bp, Homo sapiens
aggatttttgcatctattttcatcagagatattggtctgtagttttcttttttattatgtcctttcctggttttggtattagggcgatcctggcttcataraataatttagggaggattctctccttctctgttttggaatagtttcagtaggattggtaccaattctcttctttgaatgtctgattgaattcagctgtga

SEQ ID NO: 62861 - DNA, 201 bp, Homo sapiens
ttccagcctggcaaattctagtcatactggttctctgctctcgaaccctgtttcctgttaagatgtttatcaatgacaatgtgtgcccagcgggatgtggmacctcatcagtgattctagttttgccctctgccttgtgatcttttactgccctctgaagcatgtgatccctgtgacccattccctattcatagaccccca

SEQ ID NO: 62862 - DNA, 201 bp, Homo sapiens
aaaaattaattcaatagtttttggggagcaggtggtgtttggttatatggataagttctttagtggtgatttctgaggttttggtgcacccatcacctgasgaatgtacactgtatccagtgtgtagtcttttatcccttacccagctcctactcatacctggaagtcctcaaagtccattatataattcttatgcctttg

SEQ ID NO: 62863 - DNA, 201 bp, Homo sapiens
agtgccctcaggcttgctaggattaggaaattccagcctggcaaattctagtcatactggttctctgctctcgaaccctgtttcctgttaagatgtttatyaatgacaatgtgtgcccagcgggatgtggaacctcatcagtgattctagttttgccctctgccttgtgatcttttactgccctctgaagcatgtgatccc

SEQ ID NO: 62864 - DNA, 201 bp, Homo sapiens
agcttgtattttgttgaggatttttgcatctattttcatcagagatattggtctgtagttttcttttttattatgtcctttcctggttttggtattagggygatcctggcttcatagaataatttagggaggattctctccttctctgttttggaatagtttcagtaggattggtaccaattctcttctttgaatgtctga

SEQ ID NO: 62865 - DNA, 201 bp, Homo sapiens
cctgcagtgccctcaggcttgctaggattaggaaattccagcctggcaaattctagtcatactggttctctgctctcgaaccctgtttcctgttaagatgyttatcaatgacaatgtgtgcccagcgggatgtggaacctcatcagtgattctagttttgccctctgccttgtgatcttttactgccctctgaagcatgtg

SEQ ID NO: 62866 - DNA, 201 bp, Homo sapiens
cacacctcctgctcttggcacccgtgagcttctgctgcctttcctttatgctgctgtctgggtctttggggttgatgtgggatctgggagaattttgaaayggatcattgctgtcaggatgaaggtggagaggggcattctgaagatctttgttttggggagttggggtggtggtgaatgtttcaccttctccccaccctt

SEQ ID NO: 62867 - DNA, 201 bp, Homo sapiens
gagatttatgctttaaggaggttctattttggtgtattttggagttttgtttgaagacttagaactccttttagcattttgtgtagtgctggattggtagyggtgaagtctctcagcatttgtttgtctgaaaaagactttatctctccttcatttatgacgcttagttttgctggatacaaaattcttgcctggaaatta

SEQ ID NO: 62868 - DNA, 201 bp, Homo sapiens
ttgtatttgtgctctttcagactttttgatataggcatttaatgctatgaactttcctcttaggactgtttttactgtgtccgagtggttttcacaagttrtgtcactattatcattcagttcagagaattttgcatcttgatttcactgttgacccaaagatcattcaggagcaaattatttaatttccatgtatttgta

SEQ ID NO: 62869 - DNA, 201 bp, Homo sapiens
cttctctcaatcacttaattatcacctttgcaggcacggatgccacaattctccacgttgcgtggttattctcgacttcttcatatccctacttctggcaygtgatttagtgattcctgtggcctctcatgtcattactgccatcaaatccatctgctgtcctcctcaccccatgttcctgccctggcctacgccttcatt

SEQ ID NO: 62870 - DNA, 201 bp, Homo sapiens
cagggctgaggtggtggaaagaggagaagcaagtggggtttagtgtgctggccctgtcacctgtgagttttaacctttgactccacagggtatgctcgtgraggggccccctggtttagaaggccctgtggtgagtctagcagtgacctggtggccattgttttcttagagatccctcctatgtgttcatctgtgccttcc

SEQ ID NO: 62871 - DNA, 201 bp, Homo sapiens
tcatggtttcgaatacccaacacctcccacatccaaggccagcccctgctctctgtaccttataactctgtcttcccttggtgccccagaggtccatgaamtaatccaggtgcctgagaccatggagatgctggtctgtgccctcggcctgctggtgggcctggcgggggtccttaatggcaccattgtctcaaagaccaa

SEQ ID NO: 62872 - DNA, 201 bp, Homo sapiens
cctgctctctgtaccttataactctgtcttcccttggtgccccagaggtccatgaactaatccaggtgcctgagaccatggagatgctggtctgtgccctsggcctgctggtgggcctggcgggggtccttaatggcaccattgtctcaaagaccaagcgatctgacagcatccccgggtccaggggctcctatgagtcat

SEQ ID NO: 62873 - DNA, 201 bp, Homo sapiens
ctctggggcttggataactgagcccaagaactgtatgttttgcaaaaggcagttatgaggcctgagtttggaatatctctgggaaatgctctccaaatttmcttggagtatggatacttaacctgtgcagggtttttacatttttgaactccttcaaattctaaataaaattttgtgcataagggcatataccttttcttt

SEQ ID NO: 62874 - DNA, 201 bp, Homo sapiens
tccttttcctgtaatctggattttcgagttccccagtggggacatgggtccggaggcaggtttttcccctctcacgctttgggaacgcacagtttttcacytgtctggtggagtttgcagtggcccctcccttctttaaaaggatctgtgaattctttcgattttctgggtattctcctgcagtggttcctttcttgaggg

SEQ ID NO: 62875 - DNA, 201 bp, Homo sapiens
tttactgatttgtctgattgctctggctaggatttccagtactatgttgaatagaagtggtgagagtgggcatccttatcttgttccagttctcagggggwatgctttgaacttttccccgttcagtataaggtcggctgtgggtttgtcatagatggtttttattaccttaagttatgatctttgtatgtcaagtttgct

SEQ ID NO: 62876 - DNA, 201 bp, Homo sapiens
aattaccatttcaatctttctgctttttattggtctgttcacagtttctatttcttcctgatttattctaggagggttgtatatttccaggaatctgtctyctctaggttttctagtttgtgcctgtgaatgtgttcatattagccttgaatgatattttatatttctgtaatatcagtggcattttcttccattttgttt

SEQ ID NO: 62877 - DNA, 201 bp, Homo sapiens
aatacaaagtgttgacaagaattcagagcaatggagaacacccacacactgttggtggacatcccaatgggtgtgagcactttgaaaaataatttggcatmtcttactaaagttgaacatatcctccagccagcagtttcacccccagatataaacctcaaagaaacacatatgtgccaagagacaagtataagaatgttc

SEQ ID NO: 62878 - DNA, 201 bp, Homo sapiens
aattaaaaataaataaataagtttgacacattttcacctacaagtattcttatacaaacaaatgatatttgaatctgattaagattccagggcctggtggygcacacctgaagatcccagatccaactaccaatttataggaaatacatgggatagtggaatatgggacaacacagggacataattttaaaattccaaagg

SEQ ID NO: 62879 - DNA, 201 bp, Homo sapiens
ggaaaaaataattctagaaggagcaaatcttatagactgaaatattttggagtatgaggtataggctaacagaaggtgaagtaatgcccatgtttttctgwgatgtgccaagagtcatatctaatatgagaactaatttcttcctcacagcaacacttaaggaaagtagcctgaaattgtctagagtcctggattacacgc

SEQ ID NO: 62880 - DNA, 201 bp, Homo sapiens
caggtatgcatgcccaagtatgaaattttggtgtcagagttcatgataggaattctgtaataaagaaactcttaaagggtcaaaagcaactagaagaaatkagctgaaacgggaaatcggaaaagagaagagtaagtttgtttctgggttgaatggagtgtctagtgctaactctacgaaaggatgtattttatctagatt

SEQ ID NO: 62881 - DNA, 201 bp, Homo sapiens
gtcatctatcttaccagcatcttgataccatgtttccaccccttaagtcacacaaatatctcctctccctttcctctctctctccaaaaattgtgacataktttcgtagcagctcacaggtgaaatactttcatgtcatttttaacttacaaagccttatgttttcctgaaaatcagggacaaacaaaaggaatatttgaa

SEQ ID NO: 62882 - DNA, 201 bp, Homo sapiens
ataggggctttgaactcaccaattggcaaaatctgacaatacaaagtgttgacaagaattcagagcaatggagaacacccacacactgttggtggacatcycaatgggtgtgagcactttgaaaaataatttggcatatcttactaaagttgaacatatcctccagccagcagtttcacccccagatataaacctcaaaga

SEQ ID NO: 62883 - DNA, 201 bp, Homo sapiens
taggagaattgcttgaaccccaggaggcggaggttgcagtgagccgagattgcgccactgcactccagcctgggggacagagagagactctgtctccattaaaaaaaaaaaaaattatgtgtgatgatagcattgttatatattttaaaaatcattcctatctttgcagaggtacacatgaaatagttacagaaaaaatga

SEQ ID NO: 62884 - DNA, 201 bp, Homo sapiens
tctgacaatacaaagtgttgacaagaattcagagcaatggagaacacccacacactgttggtggacatcccaatgggtgtgagcactttgaaaaataattyggcatatcttactaaagttgaacatatcctccagccagcagtttcacccccagatataaacctcaaagaaacacatatgtgccaagagacaagtataaga

SEQ ID NO: 62885 - DNA, 201 bp, Homo sapiens
ataattaccacaaaagtcaggattgtggttacgtctggtatggggtgggaagaggaggtttaattagagaagacaaactggggatttctgaggtgctaacwtaccctattgttgttttgcgatagggtcttgctacactgcccaagctggagtgtaatggctattcacaggcacgaccatagctcactgcagccttgaact

SEQ ID NO: 62886 - DNA, 201 bp, Homo sapiens
acacctataatcccagcacttcgggaggctgagataagaggatcactgagcctagaagttacagaccaccctgggcaataaaatgagaccccacttctagaaaaaaaaaattaaaattagccgggtatgtggctcacacctgtagtcccagctattcaggaggctgagtcaggaggattgtttgaacccagaaacttgagg

SEQ ID NO: 62887 - DNA, 201 bp, Homo sapiens
taagtgaaacatgaggagataaagcaatgaaacaggctggttatggggagaaaagcgagcttccaatggccaagacctaacacactaccttctatttaaarctcaattactgtcttaaaggaaactgattggctgggcgctgtggctcatgcctgcaatcccagcgctttgggaggccaaagcgggtggatcatttgaggt

SEQ ID NO: 62888 - DNA, 201 bp, Homo sapiens
agatcacaccactgcactccagcctgggtgacagagtgagactctgtctcaaaaacaaaaacaaaaacaaaaagttaagatggtaaattttatgtatgtgwattttacctcaattttaaattttttaagtttttgtgtagctgctgggggtttaaaaatttttttaaagagtgttgtgtctaccttaggtcagaaacagaa

SEQ ID NO: 62889 - DNA, 201 bp, Homo sapiens
gtcaggagttggagaccagcctgaccaacatggtgaaaccccatctctaacaaaaatacaaaaattagctgggcatggtggcactgtagtcgtagctactygggaggctgaggcaggggaattgcttgaacccaggaagcagatgttgcagtgaactgagatcatgccactgcactccagcctgggcaacagagcaagact

SEQ ID NO: 62890 - DNA, 201 bp, Homo sapiens
gcgctgtggctcatgcctgcaatcccagcgctttgggaggccaaagcgggtggatcatttgaggtcaggagttggagaccagcctgaccaacatggtgaamccccatctctaacaaaaatacaaaaattagctgggcatggtggcactgtagtcgtagctacttgggaggctgaggcaggggaattgcttgaacccaggaa

SEQ ID NO: 62891 - DNA, 201 bp, Homo sapiens
ttctagaaaaaaaaaattaaaattagccgggtatgtggctcacacctgtagtcccagctattcaggaggctgagtcaggaggattgtttgaacccagaaasttgaggctgcagtgagctgcgattgtgtcactgcacttcagcttgagcaacagagcaagatcttgtctctaaaaaataataattaaaaataaataaataa

SEQ ID NO: 62892 - DNA, 201 bp, Homo sapiens
caggaggatcgcttgaacccagaaggtggaggttgcagtgagcccagatggtaccattgcactccagcctgggtgacacagcaagactccatctcaaaaawatataaataaataaataaataaataataaataaaataaaattccagaacctaggaaactgtatggaacaaatatcttggtttcttcaacgaaaatttgta

SEQ ID NO: 62893 - DNA, 201 bp, Homo sapiens
aaaaaaaaaaaaaaaaaaaaaaagggagatgtcaatgctgaaaaaaaaagaagaggaaggtgaggaagttgaaaataagaaggaaaaggaggaagatgaaraggatgaggaagagaagaaagatgaagatgatcataatgaataagttggttctagtgcagtgtttgtccttgtttataaattatttagcacccctgtaca

SEQ ID NO: 62894 - DNA, 201 bp, Homo sapiens; identical to SEQ ID NO: 57641

SEQ ID NO: 62895 - DNA, 201 bp, Homo sapiens; identical to SEQ ID NO: 57642

SEQ ID NO: 62896 - DNA, 201 bp, Homo sapiens; identical to SEQ ID NO: 57733

SEQ ID NO: 62897 - DNA, 201 bp, Homo sapiens; identical to SEQ ID NO: 57729

SEQ ID NO: 62898 - DNA, 201 bp, Homo sapiens; identical to SEQ ID NO: 57663

SEQ ID NO: 62899 - DNA, 201 bp, Homo sapiens; identical to SEQ ID NO: 57631

SEQ ID NO: 62900 - DNA, 201 bp, Homo sapiens; identical to SEQ ID NO: 57653

SEQ ID NO: 62901 - DNA, 201 bp, Homo sapiens; identical to SEQ ID NO: 57615

SEQ ID NO: 62902 - DNA, 201 bp, Homo sapiens; identical to SEQ ID NO: 23045

SEQ ID NO: 62903 - DNA, 201 bp, Homo sapiens; identical to SEQ ID NO: 23048

SEQ ID NO: 62904 - DNA, 201 bp, Homo sapiens; identical to SEQ ID NO: 23052

SEQ ID NO: 62905 - DNA, 201 bp, Homo sapiens; identical to SEQ ID NO: 22626

SEQ ID NO: 62906 - DNA, 201 bp, Homo sapiens; identical to SEQ ID NO: 23058

SEQ ID NO: 62907 - DNA, 201 bp, Homo sapiens; identical to SEQ ID NO: 23060

SEQ ID NO: 62908 - DNA, 201 bp, Homo sapiens; identical to SEQ ID NO: 24247

SEQ ID NO: 62909 - DNA, 201 bp, Homo sapiens; identical to SEQ ID NO: 24248

SEQ ID NO: 62910 - DNA, 201 bp, Homo sapiens; identical to SEQ ID NO: 23842

SEQ ID NO: 62911 - DNA, 201 bp, Homo sapiens
gatgcacagagcatggaagatgcagctaaggatgcacacagcctattctctactgagccagaacccatagtggcctcaatagtcttaaaaaagagcacacrgctgggcacagtggctcacgcctgtaatcccagcactttgggaggccaaggcgggcagatcacgaggtcaggagatcgagaccattctggctaatacggt

SEQ ID NO: 62912 - DNA, 201 bp, Homo sapiens
cagcacagttccaaagggaagcagagaggcgggatgtgaaaaccagagatggggacttgaggggaataactggagggatggggttgagaggggacatgggygaagctgcagaggaacaggcagaaggatgcagagcacagagggatacacacaacacaggacaatgtgcagagcacggggtaatgcacacagcacgggaga

SEQ ID NO: 62913 - DNA, 201 bp, Homo sapiens
agaaagttgccctccttggcagcgttgagctctgaaacccctgtcttctaagctcacctcctctgagctgccagaggggctgcctgggcaggctcattcayagggcaccctggccctgtcacgcagtcacgagcaaaggagaggaagaggggaaggagagcaggcaaggcagtgggaaggtgacagggccctgaagagaag

SEQ ID NO: 62914 - DNA, 201 bp, Homo sapiens
gcagcaggtgagcccaggtcaaggtgacaggcgaggtgaacgaattttccacagcacagttccaaagggaagcagagaggcgggatgtgaaaaccagagayggggacttgaggggaataactggagggatggggttgagaggggacatgggcgaagctgcagaggaacaggcagaaggatgcagagcacagagggatacac

SEQ ID NO: 62915 - DNA, 201 bp, Homo sapiens
aaaaaagagcacacggctgggcacagtggctcacgcctgtaatcccagcactttgggaggccaaggcgggcagatcacgaggtcaggagatcgagaccatyctggctaatacggtgaaaccccgtctctactaaaaatacaaaaaaattagccgggcatggtggtgggtgcctgtggtcccaactactcaggaggctgagg

SEQ ID NO: 62916 - DNA, 201 bp, Homo sapiens
ggggaaggagagcaggcaaggcagtgggaaggtgacagggccctgaagagaagagtgtgaagaaggggtagtccttagtcacaggcagagagctccaggakggtggaggagtctggtgaccttgacaatggagatgcagcaggtgagcccaggtcaaggtgacaggcgaggtgaacgaattttccacagcacagttccaaa

SEQ ID NO: 62917 - DNA, 201 bp, Homo sapiens
tggggaggattcgcagagcatgggggtggggatgcacagagcacgggtgggaggatgagcagagcatggagtggggatgcacacagcacggtggggaggawgcgcagagcacggggagtagatgcacagagcacggtggggagggtgcgcagagcatggggagaggatgcacagagcatggtggggaggatgcacagagca

SEQ ID NO: 62918 - DNA, 201 bp, Homo sapiens
gaaggatgcagagcacagagggatacacacaacacaggacaatgtgcagagcacggggtaatgcacacagcacgggagaaagcacagagcacagggagagratgcacagggcaccgggagaggaggcacagagcacagggggaggcacagagcatggaggggaggatgcacagagcacggggagaggatgcacagagcaca

SEQ ID NO: 62919 - DNA, 201 bp, Homo sapiens
ggtgaacgaattttccacagcacagttccaaagggaagcagagaggcgggatgtgaaaaccagagatggggacttgaggggaataactggagggatggggytgagaggggacatgggcgaagctgcagaggaacaggcagaaggatgcagagcacagagggatacacacaacacaggacaatgtgcagagcacggggtaat

SEQ ID NO: 62920 - DNA, 201 bp, Homo sapiens
agagcacagagggatacacacaacacaggacaatgtgcagagcacggggtaatgcacacagcacgggagaaagcacagagcacagggagagaatgcacagrgcaccgggagaggaggcacagagcacagggggaggcacagagcatggaggggaggatgcacagagcacggggagaggatgcacagagcacagggaggatg

SEQ ID NO: 62921 - DNA, 201 bp, Homo sapiens
ggccaaggcgggcagatcacgaggtcaggagatcgagaccattctggctaatacggtgaaaccccgtctctactaaaaatacaaaaaaattagccgggcayggtggtgggtgcctgtggtcccaactactcaggaggctgaggcaggagaatggcgtgaacctgggaggcagagcttgcagtgagccgagatcatgccact

SEQ ID NO: 62922 - DNA, 201 bp, Homo sapiens
cgagcaaaggagaggaagaggggaaggagagcaggcaaggcagtgggaaggtgacagggccctgaagagaagagtgtgaagaaggggtagtccttagtcayaggcagagagctccaggagggtggaggagtctggtgaccttgacaatggagatgcagcaggtgagcccaggtcaaggtgacaggcgaggtgaacgaattt

SEQ ID NO: 62923 - DNA, 201 bp, Homo sapiens
caaaggagaggaagaggggaaggagagcaggcaaggcagtgggaaggtgacagggccctgaagagaagagtgtgaagaaggggtagtccttagtcacaggyagagagctccaggagggtggaggagtctggtgaccttgacaatggagatgcagcaggtgagcccaggtcaaggtgacaggcgaggtgaacgaattttcca

SEQ ID NO: 62924 - DNA, 201 bp, Homo sapiens
acaggcagagagctccaggagggtggaggagtctggtgaccttgacaatggagatgcagcaggtgagcccaggtcaaggtgacaggcgaggtgaacgaatkttccacagcacagttccaaagggaagcagagaggcgggatgtgaaaaccagagatggggacttgaggggaataactggagggatggggttgagaggggac

SEQ ID NO: 62925 - DNA, 201 bp, Homo sapiens
ctctgaaacccctgtcttctaagctcacctcctctgagctgccagaggggctgcctgggcaggctcattcacagggcaccctggccctgtcacgcagtcaygagcaaaggagaggaagaggggaaggagagcaggcaaggcagtgggaaggtgacagggccctgaagagaagagtgtgaagaaggggtagtccttagtcac

SEQ ID NO: 62926 - DNA, 201 bp, Homo sapiens
cgcggtaactgtcctcttgagagccatcttgcctagctgggccaagccgagatagcacactcaacgcccagcatgccgaggaggaggagacgccgagggtyctccggtgctggcggccgggggcggacctgctctcgcaccgtccgagcggagctttcgttttcagtgagccaggtggagcgcagtctacgggagggccac

SEQ ID NO: 62927 - DNA, 201 bp, Homo sapiens
gtggagcgcagtctacgggagggccactacgctcagcgcctgagtcgcacggcgccggtctacctcgctgcggttattgagtacctgacggccaaggtccyggagctggcgggcaacgaggcccagaacagcggagagcggaacatcactcccctgctgctggacatggtggttcacaacgacaggctactgagcaccctt

SEQ ID NO: 62928 - DNA, 201 bp, Homo sapiens
gagctggcgggcaacgaggcccagaacagcggagagcggaacatcactcccctgctgctggacatggtggttcacaacgacaggctactgagcaccctttkcaacacgaccaccatctctcaagtggcccctggcgaggactagcttctgacacccggcccctgggacctgacaggtccactcgtccacccacccggcccc

SEQ ID NO: 62929 - DNA, 201 bp, Homo sapiens
acgcggtaactgtcctcttgagagccatcttgcctagctgggccaagccgagatagcacactcaacgcccagcatgccgaggaggaggagacgccgagggycctccggtgctggcggccgggggcggacctgctctcgcaccgtccgagcggagctttcgttttcagtgagccaggtggagcgcagtctacgggagggcca

SEQ ID NO: 62930 - DNA, 201 bp, Homo sapiens
ttcgtgattccatataaattttaggattgtttttctatttttgtgaagaatgtcattagtcttttcatgaggattgcactgaatctataaattgctttggwtagtactgtcattttaaaaatattaattctgtcaatccttgagcatgaaatatctttccattttttggtgtgtgttctcttcaacttctttttccagtgt

SEQ ID NO: 62931 - DNA, 201 bp, Homo sapiens
gtcccacctctcaccttgacttttgctgtttgcagggatatttctttcttcaggcacttgtgatgctttctgtgggttgaggcaggtacagttcccctgcyggggagccgaaggtgatggggaagctgcttgtcgacctctatctcactttttccagggtagaaactatgagtggggaggaattttccccatgcttcatga

SEQ ID NO: 62932 - DNA, 201 bp, Homo sapiens
ccttctctctttttccattttcccaaatttaaattcatgaaatatatataagttctctaaattaaaaacaacaggatattttaccaactttctgttctgarctaatttaaaatttatgtttccaatccccagagatatgaactaaaaagcctgaaataaatgtagatcagtcacttgagctgacatatgaagcagtcaact

SEQ ID NO: 62933 - DNA, 201 bp, Homo sapiens
ctccatcccacgtgtgtggccaacaggttcaggacgtctgccttttggtgtcggagtgccacagggtggcactggtgtctggcatgtgctgtgccctgttbctgcccatgggggttctgtgccactgtttccacagcccgtggtacatgaaaatgatgtgggcctggctctaggccaaaaggaagcacaggaaagcttgca

SEQ ID NO: 62934 - DNA, 201 bp, Homo sapiens
aacccctacacagactggcataccacaaagttggactcagcagttatttggctaagatatatatatagatatatagatatatatctatattatatatatakagagagagagattgagagagatggagtctcaactctgtcttgcccaggctggagtgcagtggcatgatctcagctcactgcagcctccgcctcttaggtt

SEQ ID NO: 62935 - DNA, 201 bp, Homo sapiens
  misc_feature (1)...(201): n = A,T,C or G, or insertion/deletion polymorphism (see Tables 1-2)
aggccttcagtctatggctaggatcattccccagcatttctgttaagctgcagaagataattaacacctagacctgcctggagtggccactaatgaagctnagcgggaagggttttagttaaagaaaactcctagtttttagttcgaccattgtggaagacagtgtggtgattcctcaaggatctagaactagaaatacca

SEQ ID NO: 62936 - DNA, 201 bp, Homo sapiens
ttaacacaaaatattaatataaatactaattatacatcttccagaggttgcacctagaaactttttggagtaagtaagactgtccatctaagtgcccaataggacaaaaaccttgcaggctttgaaagattcttacacacccataggaaacgattacatcattgtatgtaatttggggaattccttcttagatacttggcc

SEQ ID NO: 62937 - DNA, 201 bp, Homo sapiens
tcccacctctcaccttgacttttgctgtttgcagggatatttctttcttcaggcacttgtgatgctttctgtgggttgaggcaggtacagttcccctgccrgggagccgaaggtgatggggaagctgcttgtcgacctctatctcactttttccagggtagaaactatgagtggggaggaattttccccatgcttcatgac

SEQ ID NO: 62938 - DNA, 201 bp, Homo sapiens
tgtatggataaatgaaattgctttcttgatttctttttcagattgttcactgttagtgtatataaatgttactaattttttttttttttgatacagggccyggctctgttgcctagaatggagggcagtggtgcgatctcagctcactgcaacctccacatctggggcttgtgatcctctcacttcagcatcccaagtagg

SEQ ID NO: 62939 - DNA, 201 bp, Homo sapiens
tataattttccttgtatggataaatgaaattgctttcttgatttctttttcagattgttcactgttagtgtatataaatgttactaattttttttttttttgatacagggcctggctctgttgcctagaatggagggcagtggtgcgatctcagctcactgcaacctccacatctggggcttgtgatcctctcacttcagc

SEQ ID NO: 62940 - DNA, 201 bp, Homo sapiens
gagtgatgcctctggcttcattctttttgctcaggactgctttggctattcagagtctttcgtgattccatataaattttaggattgtttttctatttttrtgaagaatgtcattagtcttttcatgaggattgcactgaatctataaattgctttggttagtactgtcattttaaaaatattaattctgtcaatccttga

SEQ ID NO: 62941 - DNA, 201 bp, Homo sapiens
ccctggctggttgtctttggaacaaactgcttctgtgcagatggaatgaccaacacatttcgtccttaagagagcagtggttcctcaggttctgaggagargaaggtgtccaggcagcaccatctctgtgcgaatccccagggtaaaggcgtgggtcattgggtttgctccccttgctgctgctccatccctgcaggaggc

SEQ ID NO: 62942 - DNA, 201 bp, Homo sapiens; identical to SEQ ID NO: 19930

SEQ ID NO: 62943 - DNA, 201 bp, Homo sapiens
gccaatggttttcatgatgattacagcatacacagtgatcacataaacgatgacagctatggggcacacaggccatttgcttacatgcctcgtatcatgaytgattactgctttgttagaacacagaagagaccctattttatttaaggcagaaccccgaagatacgtatttccaatacagaaaagaatttttaataaaaa

SEQ ID NO: 62944 - DNA, 201 bp, Homo sapiens
gccctctcaacttctccctcacctccttccctaggggtagacagagatgtaccaaaccttccggctggaaagcccagtggccggcgccgaggctcgtggcrtcacgccccccccgccagggctgtacctccgtctccctggtcctgctgctcacaggacagacggctcgctcccctcttccagcagctgctcttacaggca

SEQ ID NO: 62945 - DNA, 201 bp, Homo sapiens; identical to SEQ ID NO: 19865

SEQ ID NO: 62946 - DNA, 201 bp, Homo sapiens; identical to SEQ ID NO: 19918

SEQ ID NO: 62947 - DNA, 201 bp, Homo sapiens; identical to SEQ ID NO: 20171

SEQ ID NO: 62948 - DNA, 201 bp, Homo sapiens
agctgcagcagcagctggagagcaagagtcacccagcctgtgcgccagaatgcagaggctcctgacctcacagccagtccctgatagaacacacgcaggarcagagtcccctccccctccaggctgccctctcaacttctccctcacctccttccctaggggtagacagagatgtaccaaaccttccggctggaaagccca

SEQ ID NO: 62949 - DNA, 201 bp, Homo sapiens; identical to SEQ ID NO: 19860

SEQ ID NO: 62950 - DNA, 201 bp, Homo sapiens; identical to SEQ ID NO: 19921

SEQ ID NO: 62951 - DNA, 201 bp, Homo sapiens
tggaacgagcctcctccttggaagatggaagaccgtgttcgtggccgacctggcctctcctggcctgtttcttaagatgcggagtcacatttcaatggtasgaaaagtggcttcgtaaaatagaagagcagtcactgtggaactaccaaatggcgagatgctcggtgcacattggggtgctttgggataaaagatttatga

SEQ ID NO: 62952 - DNA, 201 bp, Homo sapiens
taaaagatttatgagccaactattctctggcaccagattctaggccagtttgttccactgaagcttttcccacagcagtccacctctgcaggctggcagcygaatggcttgccagtggctctgtggcaagatcacactgagatcgatgggtgagaaggctaggatgcttgtctagtgttcttagctgtcacgttggctcct

SEQ ID NO: 62953 - DNA, 201 bp, Homo sapiens
accatctctgtgcgaatccccagggtaaaggcgtgggtcattgggtttgctccccttgctgctgctccatccctgcaggaggctcgcgctgaggcaggacygtgcggccatggctgctgcattcattgagcacaaaggtgcagctgcagcagcagctggagagcaagagtcacccagcctgtgcgccagaatgcagaggct

SEQ ID NO: 62954 - DNA, 201 bp, Homo sapiens
gaacttgatcaagacccagaccaccccaggtctccttcgtgggatgtcatgacgtttgacatacctttggaacgagcctcctccttggaagatggaagacygtgttcgtggccgacctggcctctcctggcctgtttcttaagatgcggagtcacatttcaatggtacgaaaagtggcttcgtaaaatagaagagcagtca

SEQ ID NO: 62955 - DNA, 201 bp, Homo sapiens; identical to SEQ ID NO: 19923

SEQ ID NO: 62956 - DNA, 201 bp, Homo sapiens
catttcgtccttaagagagcagtggttcctcaggttctgaggagaggaaggtgtccaggcagcaccatctctgtgcgaatccccagggtaaaggcgtgggkcattgggtttgctccccttgctgctgctccatccctgcaggaggctcgcgctgaggcaggaccgtgcggccatggctgctgcattcattgagcacaaagg

SEQ ID NO: 62957 - DNA, 201 bp, Homo sapiens
ctgaggagaggaaggtgtccaggcagcaccatctctgtgcgaatccccagggtaaaggcgtgggtcattgggtttgctccccttgctgctgctccatcccygcaggaggctcgcgctgaggcaggaccgtgcggccatggctgctgcattcattgagcacaaaggtgcagctgcagcagcagctggagagcaagagtcacc

SEQ ID NO: 62958 - DNA, 201 bp, Homo sapiens
ggcgccacacccaggtgatgcagggggaagccaggctgtattccggggtcaaagcaacactaactcacctctctgctcatttcagacagcttgcctttttytgagatgtcctgttttgtgttgctttttttgttttgttttctatcttggtttccaccaaggtgttagatttctcctcctcctagccaggtggccctgtga

SEQ ID NO: 62959 - DNA, 201 bp, Homo sapiens
cttgccagtggctctgtggcaagatcacactgagatcgatgggtgagaaggctaggatgcttgtctagtgttcttagctgtcacgttggctccttccaggktggccagacggtgttggccactcccttctaaaacacaggcgccctcctggtgacagtgacccgccgtggtatgccttggcccattccagcagtcccagtt

SEQ ID NO: 62960 - DNA, 201 bp, Homo sapiens
ccctccaaacagaatctagattttccatctttccatctccaccccagccaaccttatgcatcatctctggaggtctgcaaaagtcttttcacttcttccctttttttttttttaaacctgccagggttggggaggggatctcccccgctccaccgccccccccgcctccccccccccccgcctgcctccaccccacccctt

SEQ ID NO: 62961 - DNA, 201 bp, Homo sapiens
tgcccactggctgggtgaagtggctcacgcctgtaatctcagcacttgtggggctgaggcaggcagatcagttgaagccaggagtttgagaccagtttcaygtggccaacatggtgaaaccccgtctactaaaaatacaaaaataagccagatgtggtgtcatgtgcctgtagtcccagctactcaggagagtgagacagg

SEQ ID NO: 62962 - DNA, 201 bp, Homo sapiens
tttattaagtagtgagtattccgtcattggaagtattaagcccaagctaaatggtcaactgtcagggaaggatggtgagaggattccagtgggttagagghcaaagagcgtctaccaggtgcaaaagtcttaattaacaaagtactatcaaaaccaaattcatgtttgggaaactgtatatccacatgcaaaagaatgaaa

SEQ ID NO: 62963 - DNA, 201 bp, Homo sapiens
ccaaaaactttaaaaatggacaaagaggccaggtgtagtggctcaagtctgtaatctcaccactttgtgaggcagaggcaggaggattgcttgagctcagragtttaagaccagcctgggcaacatagtgaaactttgtctctacagaaaaatttaaaaattagccaggcatgctgcacacctgtagtcccagcttacttg

SEQ ID NO: 62964 - DNA, 201 bp, Homo sapiens
tcatctgaaacctttaaaatatacagatgttggccgaacatggtggcttacacctataatcctagcactttgggaggctgagatgggaggtttacttgaayccaggagtttgagaccagcctgggcaacatagtgagaccctatgtctattttttaaaaagattttttaaaattaaagacagatgcccagtccctatcaca

SEQ ID NO: 62965 - DNA, 201 bp, Homo sapiens
ttgtccaggcttgtcttgaaccccagcctcaagcaaatcagcctcccaaagtgctgggattaaaggcaggagccatggagcacctggcccaagtgtttaaygagcttctgggcacttctgataccaggtgccctcagaccgcactttgaaaactcctcaaggaggcctctcaatcacctgatcaccaaaccctgtgtgagg

SEQ ID NO: 62966 - DNA, 201 bp, Homo sapiens
ggagttcaagaccaccctagccaacatggtgatatcctgtctctacttaaaatgcaaaaattagctgggcatgatggcatgtgcctgtaatatcccagccwcttgggaggctgaggcaggagaatcacttgaacccaggaggcggaggttgcagtgagctgagattgtaccactgcactccagcctgggggagagagttga

SEQ ID NO: 62967 - DNA, 201 bp, Homo sapiens
gcacctgtagtcccagctacttgggaggctgaggcaggagaattgcttgaacctgggaggcggagggtgcagtgagccgagatctcgccaccgcactctakcccggcagcagagcgagagttcgtctcaaaaaaaaaaaaagaaagaaagaaagaaagaaagctatgccccttgaagaataatcaaagatccaaaagagtt

SEQ ID NO: 62968 - DNA, 201 bp, Homo sapiens
ccactggactgtgtcccatctaccattgtattcccaggacccacttgatataaataggctggatgaataactgagtgaataaaggatggaaatcgtccatygaaacagtcaacatttattcagcaccttctgcgtgcatcgttgtgggtggtggagatgcagcagggaagaccatgggcaaaatatccccctcagaggggt

SEQ ID NO: 62969 - DNA, 201 bp, Homo sapiens
gacaagctctgggtgaggggatggaggggaccccatgcctggagctcaggaaggaggatttggagttcaaggcagaagtggcaatgagattttaaccgatygttttctgctcagggaacttcagggttccctctggattcttgacctgcttcagtttgctgactcactggctttgggcaagtcattttccctctccgtgcc

SEQ ID NO: 62970 - DNA, 201 bp, Homo sapiens
ctctacctggctccagagcttgtgtttatgcccctgcaccgatacggccttccatgaagcccggcccagaaagctttggagtctggttacatctctgccaygcaggcctggccttcccaggacaagaggtgaggaggggggctgtcggggtcctcactgtgtctggactcagaaatcccaaagagaggatgaagtgtagaa

SEQ ID NO: 62971 - DNA, 201 bp, Homo sapiens
ggacggaaacactgaggccgtcaggggagtggcagctggccacagactgaaccatagacttggggcccagacctggggcccctcacggagcctcagagggygaaagggacttgctcaagtccacgcagcggtggtgggtgagctttgtcttaacaacgagcactttctacttcatcacagaccatgagtggcattgtgttt

SEQ ID NO: 62972 - DNA, 201 bp, Homo sapiens
aaaggccactgtggcttaatcaaatcaggcacccacaaagcttcaagactggaaaagatgccttggctaacccacccatttagtggacggaaacactgagsccgtcaggggagtggcagctggccacagactgaaccatagacttggggcccagacctggggcccctcacggagcctcagagggtgaaagggacttgctca

SEQ ID NO: 62973 - DNA, 201 bp, Homo sapiens
ggaaacccagcccttgttccacttgccaagcgaagtgcccatggagctctgcctgcccagagtggggtgcctttttcttatttgccctagggcttcatgtragctgctgggtgtcctgccccagctctggttccagccactgtgtgtccttgggcaaggtcatttccctccctggccttggtttcccattggagaagtttt

SEQ ID NO: 62974 - DNA, 201 bp, Homo sapiens
caacggcagataccaggtaggtcccctccctttctcttccttgagctcctaaaatgccaatcataccaccctctgcactcggcaaaggccactgtggcttratcaaatcaggcacccacaaagcttcaagactggaaaagatgccttggctaacccacccatttagtggacggaaacactgaggccgtcaggggagtggca

SEQ ID NO: 62975 - DNA, 201 bp, Homo sapiens
cagccctcttcctggagctgggatctgacacttgctgataccaacggcagataccaggtaggtcccctccctttctcttccttgagctcctaaaatgccamtcataccaccctctgcactcggcaaaggccactgtggcttaatcaaatcaggcacccacaaagcttcaagactggaaaagatgccttggctaacccaccc

SEQ ID NO: 62976 - DNA, 201 bp, Homo sapiens
gagtgcatgtgggtctgtatgagtgtgagcatgactgtgtgtgagggtgtgggtccgtgagtgtgagagtgagtgtgtgggtctgtgtgagtgtacctgastgtgagagtgtgtgggtgtgactgtgagtgtgtgtgtgggggggctgtatgagtgtgagcatgactgtgtgtatgtgcgtccgtgtgtgagtgtgactgt

SEQ ID NO: 62977 - DNA, 201 bp, Homo sapiens
gtgggtctgtatgagtgtgagcatgactgtgtgtgagggtgtgggtccgtgagtgtgagagtgagtgtgtgggtctgtgtgagtgtacctgactgtgagastgtgtgggtgtgactgtgagtgtgtgtgtgggggggctgtatgagtgtgagcatgactgtgtgtatgtgcgtccgtgtgtgagtgtgactgtgagtgtgt

SEQ ID NO: 62978 - DNA, 201 bp, Homo sapiens
tgactgtgtgtgagggtgtgggtccgtgagtgtgagagtgagtgtgtgggtctgtgtgagtgtacctgactgtgagagtgtgtgggtgtgactgtgagtgwgtgtgtgggggggctgtatgagtgtgagcatgactgtgtgtatgtgcgtccgtgtgtgagtgtgactgtgagtgtgtgggtctgagtgtgaaagtgtgtg

SEQ ID NO: 62979 - DNA, 201 bp, Homo sapiens
tgtctggggattcccaaggcccccagggaggccccagctgagcctgcaggagctgcggagggagttcacagtcagcctgcatctcgccaggaagctgctckccgaggttcggggccaggcccaccgctttgtaagtccccctaatgcagctggcgctggagatgggcagacccccaatcccttctggcccccactaacaga

SEQ ID NO: 62980 - DNA, 201 bp, Homo sapiens
aaatataataaaaattagccaggcgtggtggctactcaggaggctgaggcaggagaattgctttaacctgggaggtgaaggttgcagtgagtcgagatcgygccactgcactgcagcctgggtgacagagtgagaatctgtcttaaaaaaaaaaaagctcccatactgtggattcgccccaggcaggttaccctgctagga

SEQ ID NO: 62981 - DNA, 201 bp, Homo sapiens
actgtgtgtgagggtgtgggtccgtgagtgtgagagtgagtgtgtgggtctgtgtgagtgtacctgactgtgagagtgtgtgggtgtgactgtgagtgtgkgtgtgggggggctgtatgagtgtgagcatgactgtgtgtatgtgcgtccgtgtgtgagtgtgactgtgagtgtgtgggtctgagtgtgaaagtgtgtgac

SEQ ID NO: 62982 - DNA, 201 bp, Homo sapiens
gccatccttggcctgtggacctttcctgaccatctccctccccttcaggacccggagcgtctctgcttcatctccaccacgcttcagcccttccatgcccygctgggagggctggggacccagggccgctggaccaacatggagaggatgcagctgtgggccatgaggctggacctccgcgatctgcagcggcacctccgc

SEQ ID NO: 62983 - DNA, 201 bp, Homo sapiens
tgaggcaggagaattgctttaacctgggaggtgaaggttgcagtgagtcgagatcgcgccactgcactgcagcctgggtgacagagtgagaatctgtcttaaaaaaaaaaaagctcccatactgtggattcgccccaggcaggttaccctgctaggatccacctgccgtggtggaaactggacaaacctgtccttttgact

SEQ ID NO: 62984 - DNA, 201 bp, Homo sapiens
gtgtacctgactgtgagagtgtgtgggtgtgactgtgagtgtgtgtgtgggggggctgtatgagtgtgagcatgactgtgtgtatgtgcgtccgtgtgtgwgtgtgactgtgagtgtgtgggtctgagtgtgaaagtgtgtgactgtgagtgtgtgagtgtgtgggtgtgactgtgagtgtgtgtgggtctgtatgagtgt

SEQ ID NO: 62985 - DNA, 201 bp, Homo sapiens
gacagtggagatggaaggaatggggacacagctgggctgaggtgggggaagagctacagggatggactggaggctggagcgtggaatgggaaggagacccrgatagggagggggtgggtgtgatatggccatccttggcctgtggacctttcctgaccatctccctccccttcaggacccggagcgtctctgcttcatctc

SEQ ID NO: 62986 - DNA, 201 bp, Homo sapiens
tcaagcgattctcctgcctcaacctcctgagtagctgggattacaggtgcccaccaccatgcccagctaatttttgtatttttagtagagacaaggtttcrccatgttggccaggatggtcttgatctcttgacctcatgatccgcccgcctcggtctcctaaattgttgggattacaggtgtgagtcaccgcacccagcc

SEQ ID NO: 62987 - DNA, 201 bp, Homo sapiens
gcggtgcgatctcagctcactgtaacatctgcctcccaggttcaagcaattctcctgcctcagcctcctgagtagctaggactacaggcgtgcaccatcakgcctggctaatttttttgtatttttagtttcaccatgttggccaggctggtctcagactcctgacctcgcgctctgcccgcctcggcttcccaaagtgct

SEQ ID NO: 62988 - DNA, 201 bp, Homo sapiens
tctgggcacatggaggaaggatggagttggggttaggaatgggaatgaggctgaagatgggatggaaacacatgggcaggaggtatgatgggatggtggargagggaagggaacagggctgtggatggagagtgcttcagggactgagagggggtgggttagagaagatcattggcataggagtgaaagggaggctggaaa

SEQ ID NO: 62989 - DNA, 201 bp, Homo sapiens
gcctcaacctcctgagtagctgggattacaggtgcccaccaccatgcccagctaatttttgtatttttagtagagacaaggtttcaccatgttggccaggmtggtcttgatctcttgacctcatgatccgcccgcctcggtctcctaaattgttgggattacaggtgtgagtcaccgcacccagcctccattgtggttttg

SEQ ID NO: 62990 - DNA, 201 bp, Homo sapiens
agcatgggatggagaagggatggggattgctggtggggaagggaatggaatagggttaggaatgaggttggagatgggatggaaagatggaaagagtgagwctgggcacatggaggaaggatggagttggggttaggaatgggaatgaggctgaagatgggatggaaacacatgggcaggaggtatgatgggatggtggag

SEQ ID NO: 62991 - DNA, 201 bp, Homo sapiens
atgaggctggagattgagctggagatgcattggggatagaacctggataaggctgaatatgtcattggacatagagatgaaagacaggcatggtgacttamacctataaacccagcactttgggaggcccaggtggaaggactgcttgaggccaggagttcaagaccagtctgggcaacatagtgaaactttgtctctaca

SEQ ID NO: 62992 - DNA, 201 bp, Homo sapiens
gcgcagtggctcacgactgtaatcccagcactgtgggaggctgatgtgggtggatcacctgaggtcaggagttcgagaccagcctgaccaacatgaagaawccccacctctactaaaaataccaaattagccgggtatggtgctgtgcgcctgtaatcccagctactcgggaggctgaggcaggagaattacttgaaccca

SEQ ID NO: 62993 - DNA, 201 bp, Homo sapiens
tgtgggttcatgagtgtgagagtgactgtgtgggtccgtaagtgtgggagagtgagtgtgactgtgtgggtccatgagtgtgacagtgtgactgtgagagwgtgtgagtgtgggtctgtgagtgtgagagtgtgtgggagtgactgtgagtgcatgtgggtctgtatgagtgtgagcatgactgtgtgtgagggtgtgggt

SEQ ID NO: 62994 - DNA, 201 bp, Homo sapiens
tgtgagtgtgaaagtgaggtgtgtgggtgagagtttgggtataggtatgtcagtgtgtgaggatgagtgtgagtgtgagagtatgtgggtacgtgaacgayttttttttttttctgagactaagtctcactctgtcgcccaggctggagtgcagcggtgcgatctcagctcactgtaacatctgcctcccaggttcaagca

SEQ ID NO: 62995 - DNA, 201 bp, Homo sapiens
tgtgagtgtgtgggtgtgactgtgagtgtgtgtgggtctgtatgagtgtgagcgtgaccgtgtgtgtgtaggtccatgagtgtgagactgtgagtgtatgrgactgtgagtgtaagagtgtgggagtgtgtgggtgggtgtgtgaatgtgagtgttgtgagtgtgaaagtgaggtgtgtgggtgagagtttgggtataggt

SEQ ID NO: 62996 - DNA, 201 bp, Homo sapiens
tgaaagtgtgtgactgtgagtgtgtgagtgtgtgggtgtgactgtgagtgtgtgtgggtctgtatgagtgtgagcgtgaccgtgtgtgtgtaggtccatgwgtgtgagactgtgagtgtatgggactgtgagtgtaagagtgtgggagtgtgtgggtgggtgtgtgaatgtgagtgttgtgagtgtgaaagtgaggtgtgt

SEQ ID NO: 62997 - DNA, 201 bp, Homo sapiens
atcccatgctctgagtgtgtgtgagtgtgagagtgtgagtgtgactgagtgtccatgagtgtgtgggttcatgagtgtgagagtgactgtgtgggtccgtragtgtgggagagtgagtgtgactgtgtgggtccatgagtgtgacagtgtgactgtgagagtgtgtgagtgtgggtctgtgagtgtgagagtgtgtgggag

SEQ ID NO: 62998 - DNA, 201 bp, Homo sapiens
ctacggacaaagacatctctccttggcagagtgagctaggattaccagctcttcagccgcagctgaaggcgggagtccatggaaccccagaagctgctgayaattggatttctgctatgctctctaacttgcctcttgttggagacagtagcttcctctcctttgcctttgtctgccttgggaatacaagaaaaaacagga

SEQ ID NO: 62999 - DNA, 201 bp, Homo sapiens
agttggactccaaaagagtggggcatttgctatctgcttaaaatgaggaagtatctatcagttgaaattaaatcgtcttccaacttgaatcatcctttgcyttcattttctccttcaaaagttgcaattttaaaatgtgaatatccttattactgttttggttataatagtaatacatatttattgcaaaaaaaatttgag

SEQ ID NO: 63000 - DNA, 201 bp, Homo sapiens
catttccaggcctagccataaaatgtcttgcacatgtgtccatgctgcctctctctttcacatatgcagggcttcaactgaaggactctaagatggtgaarccacatgatggaaggagctgggatccctgaatcaccttgtggaggagaacttaacttacatcagaatgaggcatgagtgaaggatcaattttattgtgtt

SEQ ID NO: 63001 - DNA, 201 bp, Homo sapiens
tgctgggaacaagcaagctaactagtgaaagaaacatttctggacccagttgggcaccaagtagaagcctaacaggtaaattggaatgaataagcatataggcaagccatatttttaagaagcagtttgttgaggcaagaaggtaaagtctgaaacttctttatgctcagacctacatctgctgctctcacttgactggaa

SEQ ID NO: 63002 - DNA, 201 bp, Homo sapiens
aaaggtgactagacttttctgatggataaagtgtatgagagaaaaagaagagtcattactatatatgtaaatctaagcaaacatttactttttaaagcaayttaaagtttgttacttgaatatataaaatatatcatggagttaaaaatatatagaaatttattatatttggtatctaaagtagtcaaattcatagaaaca

SEQ ID NO: 63003 - DNA, 201 bp, Homo sapiens
atgcaatcaatcaaagcaaacctatgggacgcttatataaaaggcaggtttcagctttctactgatctctctagagcgatgttgtacaatatggtagtcaytagtcacaggtggctactgagcacttgaaatgcgaatagtccaaactaagatgtattataagttggaaatgcacgccagattttgaatattttctagagg

SEQ ID NO: 63004 - DNA, 201 bp, Homo sapiens
gaggctggagagtgggaggtagaggatcaggaaaaataattaatggatactaggtttaatacctgggtgatgaaataatctgtataacaaacccctatgaracatgtttgtctatgtaacaaacctgcacatcttgcatatgtatcccgggacttaaaagttaaaaaaaatgcaatcaatcaaagcaaacctatgggacgc

SEQ ID NO: 63005 - DNA, 201 bp, Homo sapiens
cgtggatggagttggaggccattatccttagcaaactaacacatgaatagaaaaccaaatacctactacatattctcacttacaaatgggggctaaatgaygagaacacatggacacatagagggaaacaacacacactgggacctatcagaggctggagagtgggaggtagaggatcaggaaaaataattaatggatact

SEQ ID NO: 63006 - DNA, 201 bp, Homo sapiens
gacgtttttcaaaaactctggaggggcattcaacattttttaggtggcctgaactgccgaggaaaacaaatgctggccagattccaagtgaaatactgcasaggatcccccaaggcacgaagctggctggagggagctggagggagcgccccacctgccgcgggaaactcacgaggaaagtgcagaccttcggtggcgctg

SEQ ID NO: 63007 - DNA, 201 bp, Homo sapiens
gcggatcttcatccatgtccctggatggagtaaggcacactctggaggtagcagcgagtttgaagtgtctaagaaaaaggccttctgcaattcacaattcktatggctacctgcacctttcatttacccactcaaagctaaaggtagccgacgtttttcaaaaactctggaggggcattcaacattttttaggtggcctga

SEQ ID NO: 63008 - DNA, 201 bp, Homo sapiens
atgctgttttggttactatagctctgtagtataatttgaaatcagataatgtgattcctccagttttgttatttttgctcaggatagctttggctattctmagtctttcgtgcttacacataaattttagcattttttttctatttctgtgaatatgtctttggtattttgatagggattgcatttaatctataaattgct

SEQ ID NO: 63009 - DNA, 201 bp, Homo sapiens
tagcactgagctgaggtgacggcgcggaggcgccaaaatctccacttagggcaatgaaaggtcatcggtctccctcttgccggcactgaaggaaccggcgrggtgcgacaaggtggggcggggcaaggaagcggatcttcatccatgtccctggatggagtaaggcacactctggaggtagcagcgagtttgaagtgtcta

SEQ ID NO: 63010 - DNA, 201 bp, Homo sapiens
cccagccagagagaacccaacctgagtgccagcgagagcctgtccttggtcgctccgacccctcgccaggggatgtccggtaggaatagcactgagctgakgtgacggcgcggaggcgccaaaatctccacttagggcaatgaaaggtcatcggtctccctcttgccggcactgaaggaaccggcgaggtgcgacaaggtg

SEQ ID NO: 63011 - DNA, 201 bp, Homo sapiens
tcagtctgaggtacttgttatggcagccctagtaagataaaatgggaggtaccagcgtttttaaattgattaaccataaaaattaactttgaagaagattkcaggcaatattatttaaaaatttaattaataaaatcaaattgaaaaaactctattcttcagaaaaatgccagtggcacaatattagaaataaggccaaga

SEQ ID NO: 63012 - DNA, 201 bp, Homo sapiens
gcttcaactaattttgggtttggctttctcttccttttctaattctttaagatgcattgtgaggttgtttatttgaagtttttctactttttaaatgtagrcacttccatattagtattgctttcactctatcctacaggttttggtatgttgtgtttccattatcatttgtttcaagaaattttctaatctccttcttaa

SEQ ID NO: 63013 - DNA, 201 bp, Homo sapiens
tgaattcaaatattgatggaagcataacattatgaaaagcaataaagtgtattttcttctaaattaaaacaatatagggcagaagtgttctaaaaattggytgcaggctataaatcactctatatgtccccaaaactgatattttaccattcaaaataaaaattgtcaaatttttaggtatttttatatacatagagtaac

SEQ ID NO: 63014 - DNA, 201 bp, Homo sapiens
gtgtattttcttctaaattaaaacaatatagggcagaagtgttctaaaaattggttgcaggctataaatcactctatatgtccccaaaactgatattttaycattcaaaataaaaattgtcaaatttttaggtatttttatatacatagagtaactgatctataaaattttattaacaacactgatactgaatacaagaca

SEQ ID NO: 63015 - DNA, 201 bp, Homo sapiens
tatatatatgccagatggatagtttgcaaatattttctcccattctgtgagttgtctcttcactttgttaagtgtttttgtttttttttttttgctatgcraaaactttttacctggatatgatcccatttgtccatttttgctttggttgcctgtgcttttggggtattactcaagaaatctttgctcagtccaatgtcc

SEQ ID NO: 63016 - DNA, 201 bp, Homo sapiens
cctgtcttttaggtgaaagccattttaattggggtgagattatatcttattgtagttttgatttgtatttctctgatgattgattatgttgagcacctttyatacacgagtttgccatttttatgtcttcttttgaatttctgtcttttgctcattttaattgaattattagtaaaagacttatttcctatagagttgttt

SEQ ID NO: 63017 - DNA, 201 bp, Homo sapiens
agctaggatttccagtactaggttgaataacagtggtgcaagtgggcatccttgtcatgtcccagatcttagaagaaaggctttcagttttccccattcartgtgatactagctgtgggtctgttgtatgtgacttatatcatgttgaggtctatttattttatatccagttatttagtgtttttttaatcatgaatggat

SEQ ID NO: 63018 - DNA, 201 bp, Homo sapiens
gttgtatgtgtttagaaatttatccatttcttctaggttttccaatttattgacatatagttgctcaaagtagactcatgatgctttgaatttctgtggtrtttgttgcaatgccttcgtttgcatctctgattttatttatttttgtctctttttcttagtctggctaaaagtttgtcagttttgtttatcttctcaaaa

SEQ ID NO: 63019 - DNA, 201 bp, Homo sapiens
agtttgctagatcatatggcggctttatttttagctttttgaggaaactccaaattgttatccatattggttgtactaatttacattcccacaaacagtgwatgagcatcctcttttatccaaatatgtgccagcatttgttcttgcctgtcttttaggtgaaagccattttaattggggtgagattatatcttattgtag

SEQ ID NO: 63020 - DNA, 201 bp, Homo sapiens
ttcctaacctccagaactggggaaaataaatgtctgttgtttataagctacccagtttattgtattttgttacagcagcctgagtggactaagacactaartgaaacataaattttcatttaggtagatcaagtgactgatgcttcaaattaacttttctctttttctattccaagttttatatctgtgtgtgtgcatata

SEQ ID NO: 63021 - DNA, 201 bp, Homo sapiens
tctaattattttttatggctgaatagtgctctgttgtgtatatgcaccacattttctttatccatgcatctgttgaaagacccttaggttgattccaaatytgggctattgtgaatagtggtgcaataaacataggggtgaagatatttctttgatatatggatttcctttcttttgggtatatactagcagtgagtttgc

SEQ ID NO: 63022 - DNA, 201 bp, Homo sapiens
catggtctgaacgtttgtgtccctagccaaattcattgaaatcctaacccccaggtgatagtattgggaaatgaggcctatgggaggtgcttagaattagrgaccttataaagagaacccagagaactagcaaacctcttccaccatgtaaggacacagctagaagcttttatgtataaaccagaaagtgggtcctcacca

SEQ ID NO: 63023 - DNA, 201 bp, Homo sapiens
cagtgtccaattcatttagcaattgtgtgggtttaaaatttttattataaagtatttttattactattgtattgaagttatatgacatgaatttatacacytccactttatactactttttgccgtgtttcataaacagagttctttaatatgtggttaaatctgaacatttaccagagataacccctctcctttcctggc

SEQ ID NO: 63024 - DNA, 201 bp, Homo sapiens
aaatgttcatcttttagtctttctactcgagatattagtagtttatataccacaattacagtgttatactattttgtgtttttctgtgtacttaatattaycattgagttttgtgctttcagataattccttgttttttttaatgccctcttctttcagattgaagaactccctttagcttttcttgtaggacaattctgg

SEQ ID NO: 63025 - DNA, 201 bp, Homo sapiens
tgcggaaaaagctagtgctaatgattggatctttattccgtgtcaagcctgctggttcttttagatttcgtataattctcataggcactcttggtgccagstgtattagtttacttacaaataaaagctaataattatgtggtactcactatgttatatagcgtgcacattggaaaatgctttacctaataattctaagag

SEQ ID NO: 63026 - DNA, 201 bp, Homo sapiens
attaccattgagttttgtgctttcagataattccttgttttttttaatgccctcttctttcagattgaagaactccctttagcttttcttgtaggacaatwctggtgctgataaaattcctcagcttttatttatgtgagaaagtcttcatttctccttcatatttaaaggattttttgctggatatactattctaggata

SEQ ID NO: 63027 - DNA, 201 bp, Homo sapiens
ttcccacccctggagactctcctttggccccctcccctgctcttctctggtcctcatgcagctctttgattcatgcttcctgcttcttgatacaggtgttsttccccactccaaagacaaagtgtagaccacagagttttttgctctcctttgcctatctcctgcccatggcaaattcacacaggctgagcccaaatcggg

SEQ ID NO: 63028 - DNA, 201 bp, Homo sapiens
acccattatgctatactgtcctcttattagctgttttgagacacaactctttcaaacggaacaaattcatttcaaaaggaaaccaggacacaaggcataargaagctgcttgttcattgttgcacatgaggttattggcagacaaaggactgaattcatgtctcatctctctagctagagcactccactgtcccatgggac

SEQ ID NO: 63029 - DNA, 201 bp, Homo sapiens
ctgaatatatgtggcagtgagaggaaggaagagtgaaagattgataaaacatcttaaatgttaaccttttaaagtaaacatgcatctttaatattagaactagctaatgcttactgagtgcaaatggagagccaggttgtgctccaagtgacttttatatatcatctcatttaacaaacaataaggtactgcattctcccc

SEQ ID NO: 63030 - DNA, 201 bp, Homo sapiens
agttttgtttatcttctcaaaaaaacaactttttattgtttcactgatgttttgtattttttgtttcaattccatttactttagctctaatctttattacttttttttgcttcaactaattttgggtttggctttctcttccttttctaattctttaagatgcattgtgaggttgtttatttgaagtttttctacttttta

SEQ ID NO: 63031 - DNA, 201 bp, Homo sapiens
actgtgtattttcaaatagcttgtcttcaagctcactacttctttcttctgcttgatcagttctgctattaagggaatctgatccattcttccgtatgtcwactgcattgttcaactccagaatttctgcttgattctttttagttacttcaatttcttcactaaatttatctgataggattctgcattccttctctgtgt

SEQ ID NO: 63032 - DNA, 201 bp, Homo sapiens
actagatcacatgtcccttaagttcactggctctgagcccagcacagcaccagaacttgcctagaagttgcagtccttgtggcccaaactgcctttccagytttttaggaccccagagaactttagcccatggtggcaaggtttgctgaactgaagctacaatcactggggtgggcgattcccctctggctggggcttgtc

SEQ ID NO: 63033 - DNA, 201 bp, Homo sapiens
ggggcagtcaccaccgtctccagatgagcgacaccgggagtctttaaatctcccgactgagaagctctttgtgtccagatcggaggtgggcaagtctgtgrgaccagatgcccagacttgcccattgtcccccacccccaccccaatgacacttgcttctctcttgttctatctctagttcctcactccattactctgttg

SEQ ID NO: 63034 - DNA, 201 bp, Homo sapiens
tgaagcaggagaatggcatgaacccaggaggcggagcttgcagtgagctgagatcacgccactgcactccagtctgggcgacagagcgagcctccatctcaaaaaaaaaaaaaaaagaaaaaaaaaagagaatgagatcatgtcctttgcagggacgtggatggagttggaggccattatccttagcaaactaacacatga

SEQ ID NO: 63035 - DNA, 201 bp, Homo sapiens
taagatgtattataagttggaaatgcacgccagattttgaatattttctagaggggaaaaaaagtaaactatctcagtaatttttatattgatcacatgttgaatgatatatattaggtatactagattaaataaaatatattattacattagtttcacttgtttctttttacttttctagatgtggctttttaaaaaatt

SEQ ID NO: 63036 - DNA, 201 bp, Homo sapiens
aagatgtattataagttggaaatgcacgccagattttgaatattttctagaggggaaaaaaagtaaactatctcagtaatttttatattgatcacatgttgaatgatatatattaggtatactagattaaataaaatatattattacattagtttcacttgtttctttttacttttctagatgtggctttttaaaaaattt

SEQ ID NO: 63037 - DNA, 201 bp, Homo sapiens
ttcaaacttaagttgtccagctccagaatctcagaccttacccattatgctatactgtcctcttattagctgttttgagacacaactctttcaaacggaamaaattcatttcaaaaggaaaccaggacacaaggcataaggaagctgcttgttcattgttgcacatgaggttattggcagacaaaggactgaattcatgtc

SEQ ID NO: 63038 - DNA, 201 bp, Homo sapiens
agatgtattataagttggaaatgcacgccagattttgaatattttctagaggggaaaaaaagtaaactatctcagtaatttttatattgatcacatgttgaatgatatatattaggtatactagattaaataaaatatattattacattagtttcacttgtttctttttacttttctagatgtggctttttaaaaaattta

SEQ ID NO: 63039 - DNA, 201 bp, Homo sapiens
gatgtattataagttggaaatgcacgccagattttgaatattttctagaggggaaaaaaagtaaactatctcagtaatttttatattgatcacatgttgaatgatatatattaggtatactagattaaataaaatatattattacattagtttcacttgtttctttttacttttctagatgtggctttttaaaaaatttag

SEQ ID NO: 63040 - DNA, 201 bp, Homo sapiens
ggtaccctgttgctgactgctctgaatatatgtggcagtgagaggaaggaagagtgaaagattgataaaacatcttaaatgttaaccttttaaagtaaacwtgcatctttaatattagaactagctaatgcttactgagtgcaaatggagagccaggttgtgctccaagtgacttttatatatcatctcatttaacaaaca

SEQ ID NO: 63041 - DNA, 201 bp, Homo sapiens
tctcaaggttgaagataagtcaatggagagagtctacactctgatttccagtagagggtaccctgttgctgactgctctgaatatatgtggcagtgagagraaggaagagtgaaagattgataaaacatcttaaatgttaaccttttaaagtaaacatgcatctttaatattagaactagctaatgcttactgagtgcaaa

SEQ ID NO: 63042 - DNA, 201 bp, Homo sapiens
atttatccatttcttctaggttttccaatttattgacatatagttgctcaaagtagactcatgatgctttgaatttctgtggtatttgttgcaatgccttygtttgcatctctgattttatttatttttgtctctttttcttagtctggctaaaagtttgtcagttttgtttatcttctcaaaaaaacaactttttattgt

SEQ ID NO: 63043 - DNA, 201 bp, Homo sapiens
ctggaacccttgcctactttgaggtaatgtcctcagagggcctagaggacccactctctctgttctcaaggttgaagataagtcaatggagagagtctacrctctgatttccagtagagggtaccctgttgctgactgctctgaatatatgtggcagtgagaggaaggaagagtgaaagattgataaaacatcttaaatgt

SEQ ID NO: 63044 - DNA, 201 bp, Homo sapiens
acaccagtcatgccccagatgaactccagtatgaggaaaaagaggatctctggctaacactgggccctgctactaaagcaatgaacctctcttaacacccrttctagaaggggcagcactcctttcctttcaatgagattggactgtggaaggggtttgactggatgctgtacctggagatactagggaattaggcagaaa

SEQ ID NO: 63045 - DNA, 201 bp, Homo sapiens
agcacaatttattgaagtgactgttctttccccagtgtatgttcttggtgtctttgtcaaaaaggaactcactgtagatgtacggatatgtttctgggttmgatattgtattccattggtctatgtgtcagcatgccagtatcatgctgttttggttactatagctctgtagtataatttgaaatcagataatgtgattcc

SEQ ID NO: 63046 - DNA, 201 bp, Homo sapiens
aacaccagtcatgccccagatgaactccagtatgaggaaaaagaggatctctggctaacactgggccctgctactaaagcaatgaacctctcttaacaccyattctagaaggggcagcactcctttcctttcaatgagattggactgtggaaggggtttgactggatgctgtacctggagatactagggaattaggcagaa

SEQ ID NO: 63047 - DNA, 201 bp, Homo sapiens
tttttgtatatggtgactgataggggtctagtttcattcttctgcatatagatatccagttttcccagcacaatttattgaagtgactgttctttccccartgtatgttcttggtgtctttgtcaaaaaggaactcactgtagatgtacggatatgtttctgggttagatattgtattccattggtctatgtgtcagcatg

SEQ ID NO: 63048 - DNA, 201 bp, Homo sapiens
gctgaacaccagtcatgccccagatgaactccagtatgaggaaaaagaggatctctggctaacactgggccctgctactaaagcaatgaacctctcttaayacccattctagaaggggcagcactcctttcctttcaatgagattggactgtggaaggggtttgactggatgctgtacctggagatactagggaattaggc

SEQ ID NO: 63049 - DNA, 201 bp, Homo sapiens
aagacaagtggatgcatggctgaacaccagtcatgccccagatgaactccagtatgaggaaaaagaggatctctggctaacactgggccctgctactaaarcaatgaacctctcttaacacccattctagaaggggcagcactcctttcctttcaatgagattggactgtggaaggggtttgactggatgctgtacctgga

SEQ ID NO: 63050 - DNA, 201 bp, Homo sapiens
atgggagaaaagttttgcaagctatacatctgacaaaggtgtaatatccagcatctataaggaacttaaactaatttacaagaaagaaacacacaaccctrttaaaaaaccattaaaaagtgggtaatggacatgaatagaaatttctcaaaagaagacataacatgcagccaacaatcatatgaaaaaagctcaacatca

SEQ ID NO: 63051 - DNA, 201 bp, Homo sapiens
atggccattcaagtggatctggacaagggtttctcgattcccctgtgatgcttgcggtttgcactttagctctttgtatatgtgtctggattatcttcatyttcagaatccccacaccctgatggctccttatcttattgccctggctagtccagggaggaagataggctggagtcatccttggtattctcccagtcttct

SEQ ID NO: 63052 - DNA, 201 bp, Homo sapiens
agtggcacaatattagaaataaggccaagaaacgaattaaagtttgtgaatatgtagcatgaataattattcagaattctacagttttatttactgtacakatgtttatttttacattttagaaactatatttttggaaatagttttaatagaactattttgtagttatttttaaagaactacttattttgttttataagt

SEQ ID NO: 63053 - DNA, 201 bp, Homo sapiens
catagtttgagttcttagatttaagtctttaatccattttatttgatttttgtatatggtgactgataggggtctagtttcattcttctgcatatagatayccagttttcccagcacaatttattgaagtgactgttctttccccagtgtatgttcttggtgtctttgtcaaaaaggaactcactgtagatgtacggatat

SEQ ID NO: 63054 - DNA, 201 bp, Homo sapiens
agccctcagaattgtgaggaaataagtttctgttgtttaagcctctcagtctgaggtacttgttatggcagccctagtaagataaaatgggaggtaccagygtttttaaattgattaaccataaaaattaactttgaagaagattgcaggcaatattatttaaaaatttaattaataaaatcaaattgaaaaaactctatt

SEQ ID NO: 63055 - DNA, 201 bp, Homo sapiens
ccccagttctactccttcccgaaaggagccacctaggtgtggaatgccccctgggaggtgccttatgtctacaaggggaaccagtggatcaggtacgacarctccaagagcttcaccctcaaggtaaggccctccacactcttcctaatgcatggttggggagagttgggggacctaccctccagttgcccttgaattgca

SEQ ID NO: 63056 - DNA, 201 bp, Homo sapiens
tgttcaactccagaatttctgcttgattctttttagttacttcaatttcttcactaaatttatctgataggattctgcattccttctctgtgttatgttgatttttttttaatttcctcaaaacagctattttgaattctctgtatgaaagatcacaaatctctgtttctttgggattggccccttgttccttatttagtg

SEQ ID NO: 63057 - DNA, 201 bp, Homo sapiens
gctgggtgacactggaaccagtttctattatttccagcaaaggggaatgggctgggatgaggatcttagaaaagaaatggagggaggacagagaattggcytgagtacagcagggccaatctgagttatgactgctccttctgtacctgccccagttctactccttcccgaaaggagccacctaggtgtggaatgccccct

SEQ ID NO: 63058 - DNA, 201 bp, Homo sapiens
attttccatttatgctaggagcacatctcatgatccatcttcttcccactcttccttccctcccttccaccctctttcttcctaatttatgtggtttaggmagctgtaatagttagtctgcctaatgattagtaggtgagtaaatgggctagatgtcatttcagtggagatttcaaccagggatttaaaaattgacatggg

SEQ ID NO: 63059 - DNA, 201 bp, Homo sapiens
cagacaaaggactgaattcatgtctcatctctctagctagagcactccactgtcccatgggacaaaagcagggcagggagctgggtgacactggaaccagkttctattatttccagcaaaggggaatgggctgggatgaggatcttagaaaagaaatggagggaggacagagaattggcctgagtacagcagggccaatct

SEQ ID NO: 63060 - DNA, 201 bp, Homo sapiens
tctcaaacattggggaattttaaaaaatatattttccatttatgctaggagcacatctcatgatccatcttcttcccactcttccttccctcccttccacyctctttcttcctaatttatgtggtttaggcagctgtaatagttagtctgcctaatgattagtaggtgagtaaatgggctagatgtcatttcagtggagat

SEQ ID NO: 63061 - DNA, 201 bp, Homo sapiens
atgagagggttccccaaaagataccaacagcagaatgtttagcctttgaatgctgtccacagtcactctcatgccgtgcttcattggtagagccttcagcrtccttctccccaggagaggcaggttgctgtcatttttctggattcttttctccaagaaattcaactccccagcatcctattctgtgtgtcacaggaggtg

SEQ ID NO: 63062 - DNA, 201 bp, Homo sapiens
ttgatggacagctcatgttctctacctccctgtccctgtgactgattgtatccattcatctttcacaaaaaaggaagcagaatagtggcttgggataatcycaaacattggggaattttaaaaaatatattttccatttatgctaggagcacatctcatgatccatcttcttcccactcttccttccctcccttccaccct

SEQ ID NO: 63063 - DNA, 201 bp, Homo sapiens
aatctcccagtcgatgctccatgcacgaacaattctcagcattgtagtaagcccatttggaagacaagtggatgcatggctgaacaccagtcatgccccaratgaactccagtatgaggaaaaagaggatctctggctaacactgggccctgctactaaagcaatgaacctctcttaacacccattctagaaggggcagca

SEQ ID NO: 63064 - DNA, 201 bp, Homo sapiens
tggtagagccttcagcatccttctccccaggagaggcaggttgctgtcatttttctggattcttttctccaagaaattcaactccccagcatcctattctgtgtgtcacaggaggtgccatccacaaaggattctctgtgaatagtatcccctgaagtttgccatgttgctgtacagccccacaacaacctatcaactagc

SEQ ID NO: 63065 - DNA, 201 bp, Homo sapiens
tcaagccccatctccctttccccatttactggccatggctgccataggcttgccccttcccagccagagacaggatgaccctggcaccctctgaccaagayctttttgtctttaggtctggccctcctgctgcagctgggtaagtatcccatgagagggttccccaaaagataccaacagcagaatgtttagcctttgaat

SEQ ID NO: 63066 - DNA, 201 bp, Homo sapiens
gacacccccacttgcaggacctaatgaccagggagactacaaatacttttatatggtgagtgaggaagccagtcctaacagacatcttcaaagcctgtcastggatcccctgccccagactgcaaaggagaccaagaaacttgatggacagctcatgttctctacctccctgtccctgtgactgattgtatccattcatct

SEQ ID NO: 63067 - DNA, 201 bp, Homo sapiens
ccttttaaaataaaattctactctggacattatttgtttattttaaaatttaactttcagaggatgaccgaatttccctcatttccaagttttcggaagasagcttactgttatccccagataccaacaacagcttttggatcaaaggactctaaaccgagcacgttgcagctttcttcataagagctgtgacctcgtcac

SEQ ID NO: 63068 - DNA, 201 bp, Homo sapiens
gctggaactttggatcccagggataagacctagcattcaggattgaatcatttccagattaatcagtctcttccaagctccaaggactgtaagtttctctraagtgagtgaaccccgggcctcagaccccagtgtagacatcccagaactcttctctgaccaggtctccctgaagtctgctcttccttcatcatagctctt

SEQ ID NO: 63069 - DNA, 201 bp, Homo sapiens
aaagtacctggcatttagcaggcactcagtaaatggtagacgcttccactgccggtgttccttgctctctcctagactcagacttccagctttctggcctygtgtatcccggaagctccagccaatctactttctgtgctgaggggttgatatctggctccctcatcctccccaggatgccctgtcttttcttccctgaag

SEQ ID NO: 63070 - DNA, 201 bp, Homo sapiens
ccttacgagttggatgatctcggtcaagttgcttcatctctctgaataccacttaaaggtcaaatgatattaacagcttctgccttgtggggttataagarttaaagaagcaatgcgtgtaaagtacctggcatttagcaggcactcagtaaatggtagacgcttccactgccggtgttccttgctctctcctagactcag

SEQ ID NO: 63071 - DNA, 201 bp, Homo sapiens
aggaatccaatgggtaggttttatagtcgagctcacaggaccatggtataaaggacttaggtgtgagtcctggctctgccaccttacgagttggatgatckcggtcaagttgcttcatctctctgaataccacttaaaggtcaaatgatattaacagcttctgccttgtggggttataagaattaaagaagcaatgcgtgt

SEQ ID NO: 63072 - DNA, 201 bp, Homo sapiens
agctttccctagcccacagaacccaggaaggccagatcaccttatcagctaagttgatgcttttgtcccatcaggaatccaatgggtaggttttatagtcragctcacaggaccatggtataaaggacttaggtgtgagtcctggctctgccaccttacgagttggatgatctcggtcaagttgcttcatctctctgaata

SEQ ID NO: 63073 - DNA, 201 bp, Homo sapiens
gcagtttcggctcactgcaacctccacctccaaggttcaagcaattctctgcctcagcctcccaagtagctaggactacaggcatgtaccaccacaccggktttttttttttttttttttttttttttgagaaggagtttcgctcttgtcatccaggctagagtgcaatggcacaatctcagctcactgaagcctccgcct

SEQ ID NO: 63074 - DNA, 201 bp, Homo sapiens
ataggccgtctgcaggctgaggaacaaggagagccagtcccgagttccgaaactgaagaacttgggagtcctatgttcaagggcaggaagcatccagcacrgagcaagatgtaggctgggaggccaggccagtctctcttttcacatttttctgcctgctttattctggccacgctggcagctgattagatggtgcccacc

SEQ ID NO: 63075 - DNA, 201 bp, Homo sapiens
caaactgagaatgcgccactgcactacggcctggacggacagaaccagactttgtgctcccaccaaaaaaaaaaaaaaaaaaaaaaaaaagttttggaggkggaacatatttgcttattagaggtctagggtaaccactatttaaagctgtttgtctttgaatgttttaataaactgtttactttctgagtatatggtttc

SEQ ID NO: 63076 - DNA, 201 bp, Homo sapiens
tcaactctaaagctgtttaaaaggattcctgtgtcaggtcttagccaggcaaatagtcaacattcttgtttcttggtttttccttcctgaaactgacaccaaagaggagatctgaagctggccatggtggctcatgcctgttttcctactactttgggaggctgaggttggagaatcacttgaacccaggcgtttgagacc

SEQ ID NO: 63077 - DNA, 201 bp, Homo sapiens
actctaaagctgtttaaaaggattcctgtgtcaggtcttagccaggcaaatagtcaacattcttgtttcttggtttttccttcctgaaactgacaccaaagaggagatctgaagctggccatggtggctcatgcctgttttcctactactttgggaggctgaggttggagaatcacttgaacccaggcgtttgagaccagc

SEQ ID NO: 63078 - DNA, 201 bp, Homo sapiens
tctaaagctgtttaaaaggattcctgtgtcaggtcttagccaggcaaatagtcaacattcttgtttcttggtttttccttcctgaaactgacaccaaagaggagatctgaagctggccatggtggctcatgcctgttttcctactactttgggaggctgaggttggagaatcacttgaacccaggcgtttgagaccagccc

SEQ ID NO: 63079 - DNA, 201 bp, Homo sapiens
actacgtgagacatgcacacggtgtctgacacacaggacagccacataaccagcagggagaatcctgagtcacagcacccccaggtcacaaaacctgacamtgctaaccgtggcgccgtgctgtcctctcccaagaggtagtcacagccctagggtttggagtaattagttcaccatagttcttggtaatttcgtgacttc

SEQ ID NO: 63080 - DNA, 201 bp, Homo sapiens
tgttcgtcttcactgcggtatgaacacatggcagtgaacagacagatgctgctgcttgcctcacgtttgccccgcccccgggacatgcaggagaacctctrgtcgtgcacacaagtgtgcagctgtttgtggggttgcacgggaggcacaacttcaattttgctagagtctgccaaactcttttccaaagtaatttaacag

SEQ ID NO: 63081 - DNA, 201 bp, Homo sapiens
gctgaagacctctttgtagtttagtggtcaaaagcttgctgtgtaatcctaatggtttgccttttgttttaatttttttggagaaaggatctctctattgyttaggctggagtgaggtggcgtaagcatagctcactgaagcttcaaactcctgagctcaagggatactcctgtgtcaatttcctgagtagctgggactac

SEQ ID NO: 63082 - DNA, 201 bp, Homo sapiens
aagacctctttgtagtttagtggtcaaaagcttgctgtgtaatcctaatggtttgccttttgttttaatttttttggagaaaggatctctctattgcttargctggagtgaggtggcgtaagcatagctcactgaagcttcaaactcctgagctcaagggatactcctgtgtcaatttcctgagtagctgggactacaggc

SEQ ID NO: 63083 - DNA, 201 bp, Homo sapiens
ttagaatatttacattccaaatatttaaaagacaaacagctcaaactggtaggtgggacgggataaggacagtgtgaaaggtggtgtggcctgaagacctyccatccgggctctggcctgggccaggtggggtgggcctgggcagggagaaggtggtcccttgtccctgctttgcttctctaccaaatgaatgatcactac

SEQ ID NO: 63084 - DNA, 201 bp, Homo sapiens
agcatagctcactgaagcttcaaactcctgagctcaagggatactcctgtgtcaatttcctgagtagctgggactacaggcatgtaccaccatgcctggctttttttttttttttttttttttttttttgagacggagtcttgctctgttgcccaggctggagtgcagtggtgcaatctcggctcactgcaagctctgcct

SEQ ID NO: 63085 - DNA, 201 bp, Homo sapiens
acagggcattagataatactaagagatgtcctaatggatctcctgtattccatgcatactcttccttacctctgttgtggagtaagagactaattccatcttttttttttttttgagatggagtgtcgctctgtcgcccaggctggagtgcagtggtgcaatctcggctctctgcaggctccgcctcacgggttcacacca

SEQ ID NO: 63086 - DNA, 201 bp, Homo sapiens
ctccggacggcactgaccagatgtctgctggccggtggtggccgaaatcatgggacaggctgggctgaaggcttggtggcactgagtgggcagtggtcackgtgggggtgggagaagcctggtggggcgcttcctccttccttgagcagaaatgtgtgtctcgcctctcttcagattctcgcttacaaggatgacttcatg

SEQ ID NO: 63087 - DNA, 201 bp, Homo sapiens
gcatagctcactgaagcttcaaactcctgagctcaagggatactcctgtgtcaatttcctgagtagctgggactacaggcatgtaccaccatgcctggctttttttttttttttttttttttttttttgagacggagtcttgctctgttgcccaggctggagtgcagtggtgcaatctcggctcactgcaagctctgcctc

SEQ ID NO: 63088 - DNA, 201 bp, Homo sapiens
tctgctggccggtggtggccgaaatcatgggacaggctgggctgaaggcttggtggcactgagtgggcagtggtcacggtgggggtgggagaagcctggtggggcgcttcctccttccttgagcagaaatgtgtgtctcgcctctcttcagattctcgcttacaaggatgacttcatgtcagaaagggccgatcgggaacg

SEQ ID NO: 63089 - DNA, 201 bp, Homo sapiens
catagctcactgaagcttcaaactcctgagctcaagggatactcctgtgtcaatttcctgagtagctgggactacaggcatgtaccaccatgcctggctttttttttttttttttttttttttttttgagacggagtcttgctctgttgcccaggctggagtgcagtggtgcaatctcggctcactgcaagctctgcctcc

SEQ ID NO: 63090 - DNA, 201 bp, Homo sapiens
tggcatgaatgggaaccgatgaagttcctcagtgtgtgacccatggcctcttccttctcctcactgacttgtgctctgcaaaaatccaggagaagtttatktagctcctcatcaagtacctaacacacttttggccctgggaatagcctgggccccactcaaagagcttcctctcctggcacagactgaacagtagtgatg

SEQ ID NO: 63091 - DNA, 201 bp, Homo sapiens
cactagggtggccacccccgccattgcgagccacatgtctgcactgagaaactgcatttcagtagcatttgtcatccagccggaagttaaagcacacttaytttattcacctatttttataataaacgttcttgctgctgtgactgctctgagaatttgtgttggaagctggggtgcagggactgaacagtatttacagca

SEQ ID NO: 63092 - DNA, 201 bp, Homo sapiens
catatgaagatacagcaacaaggtgccactttggaagcagagagtgagcccttaccagacactgaatctgttggtgcactttgctcttgaacttcacagcytccagaactgtgagaaataaacttctattatttataaattactcagtctgtgatatttggtcatagctgcatgaatggactaagatatcatctaaattac

SEQ ID NO: 63093 - DNA, 201 bp, Homo sapiens
gggagggctcgctagctgcaaacccatgaagcagcagcacctcctctggtcttgccatggggctccttggtcaggctgaagacctctttgtagtttagtgktcaaaagcttgctgtgtaatcctaatggtttgccttttgttttaatttttttggagaaaggatctctctattgcttaggctggagtgaggtggcgtaagc

SEQ ID NO: 63094 - DNA, 201 bp, Homo sapiens
ttaaaaaagtagccaggcaggcctccgtgttaatacagtcgtacactctataacagacttgatggtgtgagtactgggtgggcttgtttttaactttctcrttctgcaagggatcttacacaagctggctacaagtcagggggatcaaacacaaacagcgcaacgtgtacactcggagacagtagattgtggagaacaaag

SEQ ID NO: 63095 - DNA, 201 bp, Homo sapiens
ggcatgagccaccacgcccagcatggggggatttttaattatttaaggaacattttaatgatttagttttgtttgtttgtttttttatttttatttttatwtttttagagacagggtcttggtctgtgacactgccacctaggctggaatgccttggggccatcatagctcactgtaaccttgaactcctgggctcaacca

SEQ ID NO: 63096 - DNA, 201 bp, Homo sapiens
gctggccttatctggtattttatgcaattacatatttattgctcatcccaacgttcaatctgaggtcggtcatggaacctgtggaagaatggagaggtttstcacctcctgcaggccctgggttcactgaggtggcagtgcagagttaaagacacagcaggaagcaagccgttgctaggttgctctcatctatgagagccc

SEQ ID NO: 63097 - DNA, 201 bp, Homo sapiens
aggcaagagagagccacgccctcaggatctacgagctgtggacatgctgccctcctgtttgtggagctgtttgtttctcctactgtcagcatttgaccaaygcaggaaggaggctccgaaatcagattttacctgggcacggtgacccctgctgaggcaggaggaggattgcttgaggccaggagttcaagaccagcctag

SEQ ID NO: 63098 - DNA, 201 bp, Homo sapiens
ggaagaggccaagtgggcaactcgagaggcaagtgccccatccggcctctgatgtagggttctaggtgttggcatacttcagggcctcgcgtcccttctcscaattcctcccttggggtgggctgcctgcacacacactggcctgctagcacttgggagggagcatgcgtagtgtgtttactggagcatgcgcatgctcac

SEQ ID NO: 63099 - DNA, 201 bp, Homo sapiens
ctgtccatctccatccccctaaaattaatccacaagtcagtaaaggagatgcaagagttagcagcaggaggtccattttctaagacagcaaagctgcaccragtccacctccgttcatgctgcttgcgtacgggtgtcatcgtgctgcctcaggattctctagcgggcctagtgtctgctctctacagaacagggaggggc

SEQ ID NO: 63100 - DNA, 201 bp, Homo sapiens
gggaggtagttcatgcttgtaatcctagtactttggaagactgaggtggaaagatactcagaggccagcctgggcaacataaagagatgccttctctaccaaaaaaaaaaaaaaaaaaaaaaaaaattgggccgggtgtggcagctcacgcctgtaatcccagcactttgggaggccgaggtaaggtgggcagatcacccg

SEQ ID NO: 63101 - DNA, 201 bp, Homo sapiens
atcctggcgcggcccagagaggccagggggaccttcagtgccctcactgcctgcagtgcttcagtgacgagcaaggggaagagctcctcaggcatgtggcygagtgctgccagtgaccgagactcacccgtgcccttgcggcctcctggcccggtgcagctgccctcagggacagggtgggtgctctcagatgccatgggt

SEQ ID NO: 63102 - DNA, 201 bp, Homo sapiens
tctgggctcactacaacctcctcttcctgggttcaagagattctcctgcctcagactccagagtagctgggactacagatgtgcaccaccacacccggcttttttttttttttttttttttttttggtatttttagtaaaggtggggtttcaccatgtcggccaggatggtctcaaacccctgaccctcaagtgatccacc

SEQ ID NO: 63103 - DNA, 201 bp, Homo sapiens
gagtgtcttctctctgtcccttcctcatgcagtcggaacacacagatgggcacacctctgtccagagtgttattgagaagttgcaggaagaaaatcgactrttaaaacagaaggtgactcacgtgagtgtctttcacatttcgtttgagaagaacacatggcttacaaactgtaagtgagggttctttccttggctgatgc

SEQ ID NO: 63104 - DNA, 201 bp, Homo sapiens
taatttaggcaattatagccttacataaacagctctaaaaagttaacgtttttcgatatcccgcaggttttcatatgcaatgttttaattatctttttagktctgtgtatttaaaaattttgacagtctgggcgtggtggttcacacctgtaatcccaggactttgggaggccaagggggggtggatcacctgaggtcagg

SEQ ID NO: 63105 - DNA, 201 bp, Homo sapiens
aactgcctaaccatcacctgatggtcacctgacatccctggtggatggaggaggccctcccctgccctgctcacacctgactagctacccactgtaacaarctgagaatgcgccactgcactacggcctggacggacagaaccagactttgtgctcccaccaaaaaaaaaaaaaaaaaaaaaaaaaagttttggaggtgga

SEQ ID NO: 63106 - DNA, 201 bp, Homo sapiens
gcttcacctccttcatgtaatgtactgtttattttggaggattctttgaaaacggaaaagtacaaatttaaggccagatattaaaaaattgtcaggtcagwtgtggtggctcgtgcctataatcccagcactttgggaggctgaggcaggcggatcactcaagtccaggaccagactgggcaaagtggtgaaaccttgtct

SEQ ID NO: 63107 - DNA, 201 bp, Homo sapiens
aagcgattctcctgcctcagcctccagagtagctaggactacaggcgagcaccaccacgcccagctaatttttgtacttttagtagaaacggggtttcacyatgttggccagaatggtctctatctcttgacctcgtgatccgcccgctttggcctcccaaagtagtgggattacaggcaggagccactgcgcccggctgg

SEQ ID NO: 63108 - DNA, 201 bp, Homo sapiens
caccatatctggcttactttttttgtattttttgtagagacaggatttcaccatgttgcccaggctggtcttgaactgacctcaagtgatccgcctgtctkggcttcccgaagtgctgggactacaggcatgaaccacagcacccggacaaaactttttttttttttaattactgacattttcaaacacacacaaaaacag

SEQ ID NO: 63109 - DNA, 201 bp, Homo sapiens
gccagaatggtctctatctcttgacctcgtgatccgcccgctttggcctcccaaagtagtgggattacaggcaggagccactgcgcccggctggtcacaattttttttttttttttttttgggacggagttttgctcttgttgcccaggctggagtgtaatggcacgatctgggctcactacaacctcctcttcctgggtt

SEQ ID NO: 63110 - DNA, 201 bp, Homo sapiens
ggagtgaggtggcgtaagcatagctcactgaagcttcaaactcctgagctcaagggatactcctgtgtcaatttcctgagtagctgggactacaggcatgyaccaccatgcctggctttttttttttttttttttttttttttttgagacggagtcttgctctgttgcccaggctggagtgcagtggtgcaatctcggctc

SEQ ID NO: 63111 - DNA, 201 bp, Homo sapiens
gcaaacccatgaagcagcagcacctcctctggtcttgccatggggctccttggtcaggctgaagacctctttgtagtttagtggtcaaaagcttgctgtgkaatcctaatggtttgccttttgttttaatttttttggagaaaggatctctctattgcttaggctggagtgaggtggcgtaagcatagctcactgaagctt

SEQ ID NO: 63112 - DNA, 201 bp, Homo sapiens
cctacctgcatcctgtccaccaggaaatcctgtggcctcatcgtccgaatacctccagaagctggctctccctaccctctccccaaccaggccctgccctmttcaccttcactcagagtgaagtcatactctgatagggcacacagagacaggctgaacatgaggctgggagaagtgggagctactgagtgttctaggtag

SEQ ID NO: 63113 - DNA, 201 bp, Homo sapiens
ccggacaaaactttttttttttttaattactgacattttcaaacacacacaaaaacagatagtatagcataatgaacatagccatcacctgactttgatarttatcaacatcttaattcttcttccatctaattatgctattttttgtgtctttttttctctattattcttaatctgtctcctaaagatttatttggtgtt

SEQ ID NO: 63114 - DNA, 201 bp, Homo sapiens
agacatgtttgccagaacctagactccccatgtgactggtcattatatgacaggcagcccatcagagagccctttagcaagaagattcccagaaatctaaytcgcacgcaagcccagggactgccctaagtctccgttggagtcaggcagagcacagctgccagcagaagctgcccagggggcaggcccatgttaaggaaa

SEQ ID NO: 63115 - DNA, 201 bp, Homo sapiens
ctaggcttgagcttttgtgggtacttttccctgttttaaattactatttcaacatcttcactcattataggtctattcagattgtctatttcttctggagycagttcttgtagcttcttcctgtctagaaatttgtccatctcatctgctatggtttatatgttcatatgttagaacttagtgcccaaggtgatagtatta

SEQ ID NO: 63116 - DNA, 201 bp, Homo sapiens
ttactatttcaacatcttcactcattataggtctattcagattgtctatttcttctggagtcagttcttgtagcttcttcctgtctagaaatttgtccatytcatctgctatggtttatatgttcatatgttagaacttagtgcccaaggtgatagtattaagaggtggggccttctgggaagtgttcaaatcatgagtgc

SEQ ID NO: 63117 - DNA, 201 bp, Homo sapiens
aagttagtttattgatttgagtgagatctttcttgtttcttaatataaacattttcaacttctgggatacatgttactatttttcaatttgggaggttttygactattatttctttgaatattttttttgctctttgctctccttttgatattcccattatacataggctggtatgcttaatggtgtcccacatttttctg

SEQ ID NO: 63118 - DNA, 201 bp, Homo sapiens
acataggctggtatgcttaatggtgtcccacatttttctgagactctttattttcattatttttttctctatgttctttggctggcataatctccatcagyctatcttcaaatccacttatttttccttctgctaattttaaaatttaggctgggtgcagtggctcatgcctgtaatctcagcactttgggaggccaaggt

SEQ ID NO: 63119 - DNA, 201 bp, Homo sapiens
tttcaaaaagaaagacatgattttaatattacttaacaatatgttaaaaaagtagccaggcaggcctccgtgttaatacagtcgtacactctataacagayttgatggtgtgagtactgggtgggcttgtttttaactttctcgttctgcaagggatcttacacaagctggctacaagtcagggggatcaaacacaaacag

SEQ ID NO: 63120 - DNA, 201 bp, Homo sapiens
ccaccacgtccagctgatttttgtatttttagtagaaagagggtttcaccatgttgaccaggctgatctgtactcctgacctaaagtgatccgcctgcctyggcctcccaaagtgctgggattacaggcgtgagccactgtgcctggccacacctagctaatttttaatttttttcaaatggagtctctgtcacccaggct

SEQ ID NO: 63121 - DNA, 201 bp, Homo sapiens
caggctgcacttgagaaggggaaaggactcgggaggaggaatgggtgggcggaaggagtcctgagaaagaaaagaaacgtttaatctgagagctgtgagcscccttaaattatcaggcccaggcagggtgtggtggctcatacctgtaatcccagcactttgggaggctgaggagggcaaatcacttcaacttaggagttc

SEQ ID NO: 63122 - DNA, 201 bp, Homo sapiens
gaggcaaggcgggcagattgcctgagcccaggagttcgagacaaggctgagcaacatggtgaaaccctgtctacaaaaagtgcaaaaaattagccgggcayggtggcacgtgcccgtgctcccagccactagggagacttaggtgggaggatcacttgagcctgggaggcagaggttgcagtgagccaagatcgcaccact

SEQ ID NO: 63123 - DNA, 201 bp, Homo sapiens
gatgatcttattttgatatcaagtgttttaaacctttgatatctgacatacttcctaaaatcaaattttaaattctaaattagtcttttttacttcaaactttttttttttttgagacggagtcttgctctgttgcccaggctggagtgcagtggcacgatctcaactcactgcaacctccgcctcctgggttcaagcaaa

SEQ ID NO: 63124 - DNA, 201 bp, Homo sapiens
attaaattaaaaatggacacaagggtccggacgcggtggctcatgcctgtaatcccagcactttgggaggccaaggcggcggatcacgaggtcaggagatygagaccatcctggctaacatggtgaaaacccatctctactaaaaatacaaaaaattagctgggcgtggtggcgggcgcctgtagtcccagctacttggga

SEQ ID NO: 63125 - DNA, 201 bp, Homo sapiens
gcaagaggatcacttgagtctgggaggtggaggctacagtgaaccatggtggcaccactgtactccagcctgggtgacagggcgagaccctatctcaaaawaaaattgtcattttaagaacctttttaaattctttaagaagtaattggggttgggtgtgttaatttcctagagctgctgtaacaaagtaacacaaactgg

SEQ ID NO: 63126 - DNA, 201 bp, Homo sapiens
aagattcccagaaatctaattcgcacgcaagcccagggactgccctaagtctccgttggagtcaggcagagcacagctgccagcagaagctgcccaggggrcaggcccatgttaaggaaagggctgtccctcgaatgtgcccttgacaggaagaggacccagacatcaaccctacaggaaggtggttctcccaggcattca

SEQ ID NO: 63127 - DNA, 201 bp, Homo sapiens
cagccgcccacaagaagttctagaagaaaagagctccaacttgaggaggaaaaagagctggcatgtctgctggaagtgctgtcataatagatttctaataytctcttttcctgactagaactagaataatcagtctataaaatcttggtgtaagaaaaacaggaaacacaactttaaccaatttggtatcaggaaaaaatt

SEQ ID NO: 63128 - DNA, 201 bp, Homo sapiens
atgtctgctggccggtggtggccgaaatcatgggacaggctgggctgaaggcttggtggcactgagtgggcagtggtcacggtgggggtgggagaagcctggtggggcgcttcctccttccttgagcagaaatgtgtgtctcgcctctcttcagattctcgcttacaaggatgacttcatgtcagaaagggccgatcggga

SEQ ID NO: 63129 - DNA, 201 bp, Homo sapiens
cactagagcagaagggaagtttagaggtcacctggtctgcaccaacaggttttagagttgtggatgccaggagccacagatgagtacagaccaaggacccrgaaggacactccgaagtcatctccagaatgttggtgggacaggatgcagggacctcacaaccagagcagtatacttgcagtcggtggccattggtgttcc

SEQ ID NO: 63130 - DNA, 201 bp, Homo sapiens
ttcaatcaatcatattttagctttgttgatcttctctaccaaatctttgttttctatttcattatctctcttatctccttctttatatattctttggtttrttctattgttcttttcctaatttctcaagtgaaatctttaactcattatgtttcaggatttttaaaaactaatttaggcaattatagccttacataaaca

SEQ ID NO: 63131 - DNA, 201 bp, Homo sapiens
actccgaagtcatctccagaatgttggtgggacaggatgcagggacctcacaaccagagcagtatacttgcagtcggtggccattggtgttccgctcacaygtgttccctggtgtcctgtgtatctggccactcaccaagcagcttattgcagcttcctggtagcctcagatagaattagttctgtgttcccagtattact

SEQ ID NO: 63132 - DNA, 201 bp, Homo sapiens
agagtgaaactctgtctcaaaaaaaaaaaaaatttgagatgaagtttcagaacagaacattgtaggctgaaaaactccagagttaatagttcaaatgcccracttctgagtgagtaattgttagttcaaacgcccaacttctgagtgagtatgtttgtgtctggtgatggggcatccacgccaggtcttcttttgctttct

SEQ ID NO: 63133 - DNA, 201 bp, Homo sapiens
cactgcccagcaccaggcctgtggccgaccccgctcccaggtgggagatggcacttggctttcatctgcctcagctgaggatgaggaggaggagctgagcstggcagagctgcctggaggaagtgtagtcacatcctccatccgaggaaactgaagcagagccaggtggtactgctggggatggggagtgcctccagttcc

SEQ ID NO: 63134 - DNA, 201 bp, Homo sapiens
ggaaatctactgatccatgatctactaagccatgatcatatggctcttctttaatatattaatgtagcaactaacattagtggattttctagctgggtgcrggggctcacacctgtaattctggcgctttgggaggctgaggtgggcagatcacttgaggccaggagttcgagaccagcctgggcaatgtggcgaaacccc

SEQ ID NO: 63135 - DNA, 201 bp, Homo sapiens
ccaagtgacagtgagggccaaagaagggttcgctggacctccaggataggctggatctgggctgtagctctctgtggggtctagtgggagagagaaggacygtgggagtttcagcatcaggagaaaccagggggctcctaggcagaaaagtaggggagcagtggcccaaggcatctgtgtgccaggcaccttccatcttgc

SEQ ID NO: 63136 - DNA, 201 bp, Homo sapiens
cactgagatacagtcagaattgtagggtacacacgagtttcaggagacttttcattcagctctgtagttgttagtgggggttggtttgggttgtggcttckgtgactcctgaccctgcgtggggcagaggttagattgctgtgtccagaatcacctggttgaacccgattgtctgcagacaggacagtgtcatgggctcca

SEQ ID NO: 63137 - DNA, 201 bp, Homo sapiens
tttcaggagacttttcattcagctctgtagttgttagtgggggttggtttgggttgtggcttcggtgactcctgaccctgcgtggggcagaggttagattsctgtgtccagaatcacctggttgaacccgattgtctgcagacaggacagtgtcatgggctccaaaggaggtaagcagggtgcatggccaggcccaccctg

SEQ ID NO: 63138 - DNA, 201 bp, Homo sapiens
ggaggtggagatggggtcaggaacatctggcagagggaggtcccagtctgtgtctccatcaggcttaagccagagctatctggtgctggtgtgccagcccytcccccagcctgcctagaaaggggtggctgcctgagggagtcacttgtatggtccccagggtgggagccccatcctgttctatggaataaagcgtcgcct

SEQ ID NO: 63139 - DNA, 201 bp, Homo sapiens
tggttgaacccgattgtctgcagacaggacagtgtcatgggctccaaaggaggtaagcagggtgcatggccaggcccaccctgggcagctgggggcccccycactggagatcctctggtttacaatgggattcagcttcctgccttccctgctgtctgtgataatggcaaatctctggcaatgagaagactttatcatgtc

SEQ ID NO: 63140 - DNA, 201 bp, Homo sapiens
ccactcccccagcagaaagaagcagccgaggtctcctgctgtactaatgtattccatctttcaaaaagaaagacatgattttaatattacttaacaatatkttaaaaaagtagccaggcaggcctccgtgttaatacagtcgtacactctataacagacttgatggtgtgagtactgggtgggcttgtttttaactttctc

SEQ ID NO: 63141 - DNA, 201 bp, Homo sapiens
caccccgattgagggtggatctgccttccccagcccactgactcaaatgttaatctccttggcaacaccctcacagacacacccagatcaatacttcctawccttcaatcaagttgacactcagtattaaccatcatgagtccaccccttgtctacttgaacccatacatagtcctgagataataatcttcaaataaagac

SEQ ID NO: 63142 - DNA, 201 bp, Homo sapiens
tgatctcggctcagctcactgctacctccgcctcccaggttcaagtgattctcccacctcaggctcccgattagctaggattacaggcgcctgccaccacrcccggctaatttttgtatttttagtagagaaggggtttcgccacgttggcctggctggtttcgaactcctgacgtcaggtgatcagcctgcctctgcctc

SEQ ID NO: 63143 - DNA, 201 bp, Homo sapiens
ataaatcttatgtcacacgataaaggagaaaggaaatgaagagattttcttagtactagcgtatacatgcacaaacgttttttatcaaaaggaggaaatactcacagcaattacagtcctggttcctgcagctggtcatgtggtcatagccgttattgatgcctaccttcttctactacccattctgtattccctttgcct

SEQ ID NO: 63144 - DNA, 201 bp, Homo sapiens
taaatcttatgtcacacgataaaggagaaaggaaatgaagagattttcttagtactagcgtatacatgcacaaacgttttttatcaaaaggaggaaatactcacagcaattacagtcctggttcctgcagctggtcatgtggtcatagccgttattgatgcctaccttcttctactacccattctgtattccctttgcctt

SEQ ID NO: 63145 - DNA, 201 bp, Homo sapiens
cacctgtaattctggcgctttgggaggctgaggtgggcagatcacttgaggccaggagttcgagaccagcctgggcaatgtggcgaaaccccgtctctacmaaaagaagaaaaaaaaaattagccaggcatggtgcatgtgcctgtagtcccggctacttggagggctgaggtgggaggactgcttgaccctggggaggtc

SEQ ID NO: 63146 - DNA, 201 bp, Homo sapiens
aaatcttatgtcacacgataaaggagaaaggaaatgaagagattttcttagtactagcgtatacatgcacaaacgttttttatcaaaaggaggaaatactcacagcaattacagtcctggttcctgcagctggtcatgtggtcatagccgttattgatgcctaccttcttctactacccattctgtattccctttgccttc

SEQ ID NO: 63147 - DNA, 201 bp, Homo sapiens
ctagtggatcactaggggtgatggcgagtggtgccacttccacttgagtgccttgattcctggacccgtgcatcctggttaagggagaaacaatatcatakcttggatgctgattcagagcatacatggccttctggagaacttggtcccagccctgcaaagtattgtcacctagttggtgttgtaattgtgacttcagaa

SEQ ID NO: 63148 - DNA, 201 bp, Homo sapiens
gagccactgtgcctggccacacctagctaatttttaatttttttcaaatggagtctctgtcacccaggctggagtgcagtggcacgatcttggctcactgyaacctctgcctcccaggttcaagcgattctcctgcctcagcttcccaaatagttaggactacaggtgcataccacaacacccagctaatttttgtatttt

SEQ ID NO: 63149 - DNA, 201 bp, Homo sapiens; identical to SEQ ID NO: 39311

SEQ ID NO: 63150 - DNA, 201 bp, Homo sapiens; identical to SEQ ID NO: 42153

SEQ ID NO: 63151 - DNA, 201 bp, Homo sapiens; identical to SEQ ID NO: 42367

SEQ ID NO: 63152 - DNA, 201 bp, Homo sapiens
gaagagaagtttagagcaaaaagaataaaaagaagtgaacaaagcctccaagaaatatgggactatgtgaaaagaccaaatctacatctgattggtgtacstgaaagtgacggggagaatggaaccaagttggaaaacactctgcaggatataggaaaacttccccaatctagcaaggcaggccaacattcaaattcagga

SEQ ID NO: 63153 - DNA, 201 bp, Homo sapiens
ttgtcagattcaccaaagttgaaatgaaggaaaaaatgttaagggcagccagagagaaaggtcgggttacccacaaagggaagcccatcagactaacagcrgatctcttggcagaaattctacaagccagaagagagtgggggccaatattcaacattcttaaagaaaagaattttcaacccagaatatcatatccagcca

SEQ ID NO: 63154 - DNA, 201 bp, Homo sapiens
tgcacccaatacaggagcacccagattcataaagcaagtccttagtgacctacaaagtgacttagactcccacacaataataatgggagactttaacaccycactgtcaacattagacagatcaatgacacagaaagttaacaaggatacccaggaattgaactcagctctgcaccaagtggacctaatagacatctacag

SEQ ID NO: 63155 - DNA, 201 bp, Homo sapiens
agaatctctgggacacattcaaagcagtgtgtacagggaaatttatagcactaaatgtccacaagagaaagcaggaaagatctaaaattgacaccctaacrtcacaattaaaagaactagaaaagcaagagcaaacacattcaaaagctagcagaaggcaagaaataactaagatcagagcagaactggaggaaatagaga

SEQ ID NO: 63156 - DNA, 201 bp, Homo sapiens
aagtcagaatttaaaaatgaacttggccaggcatggtggctcatgcctgtaatcccagcacttcgggaggtccactcggaaggatcacctgaagccaggarttcagaaacagcgtgtacaacaaagcgagacttcgtgtctctaaaaaaatttttaaagaattagccaggtatagtggcaggtgcctgtaccccgagctac

SEQ ID NO: 63157 - DNA, 201 bp, Homo sapiens
caggcaggagaaggaaataaagggtattcaattaggaaaagaggaagtcaaattgtccctgtttgcagacaacatgattgtctatctagaaaaccccatcrtctcagcccaaaatctccttaagctgataagcaacttcagcaaagtctcaggatacaaaatcgatgtgcaaaaatcacaagcattcttttacaccaataa

SEQ ID NO: 63158 - DNA, 201 bp, Homo sapiens
ttactaaagtcagaatttaaaaatgaacttggccaggcatggtggctcatgcctgtaatcccagcacttcgggaggtccactcggaaggatcacctgaagycaggaattcagaaacagcgtgtacaacaaagcgagacttcgtgtctctaaaaaaatttttaaagaattagccaggtatagtggcaggtgcctgtaccccg

SEQ ID NO: 63159 - DNA, 201 bp, Homo sapiens
tcttactaaagtcagaatttaaaaatgaacttggccaggcatggtggctcatgcctgtaatcccagcacttcgggaggtccactcggaaggatcacctgargccaggaattcagaaacagcgtgtacaacaaagcgagacttcgtgtctctaaaaaaatttttaaagaattagccaggtatagtggcaggtgcctgtaccc

SEQ ID NO: 63160 - DNA, 201 bp, Homo sapiens
tattggcctgagaggagcctgatggaaagagcctgattacagttctcatgtttcaaggaatattgtatggtaggcctataatttgtcatttttacagacartgtaaagatgaaaagcaacttaattgcgttatttaggtacagtagaaatctgaatttgtattattgttaccggtggatggagtccagcttcttggtgtct

SEQ ID NO: 63161 - DNA, 201 bp, Homo sapiens
taataggtcttaagggaattactctggttgaggaggttaaaaaaactaatctgatagctattattgaattttcaatgttttactttttaaaaaatttattwaaaaaaaaataggaagaaaagaaacggggtctcaccatgttgcccaggctggtttcaaattcctgggctcaagcaatcctcctacctcagcctcccaaag

SEQ ID NO: 63162 - DNA, 201 bp, Homo sapiens
gctacattttatctctcatttctaaactttcttactaaagtcagaatttaaaaatgaacttggccaggcatggtggctcatgcctgtaatcccagcacttygggaggtccactcggaaggatcacctgaagccaggaattcagaaacagcgtgtacaacaaagcgagacttcgtgtctctaaaaaaatttttaaagaatta

SEQ ID NO: 63163 - DNA, 201 bp, Homo sapiens
cgccttccttggcctcccaaagtattgggattacgggcatgagccactgcgcccggcctctatttagatttctttagtttttacttaatattcttgtattmgtctgttttcatgctgctaataaagatagacttgagaccgggcaatttataaaggaaagaggttgaattgactcacagttccatagggctggggaggcct

SEQ ID NO: 63164 - DNA, 201 bp, Homo sapiens
gtcagttcacagccctggctgttcctcagagatctaagtaaccactttgatgatttcagggttctcttagatatttgtaataaaccgattcctttattacyctagttcagttctgtaggcagctttctcagccctttgttgtttttgttgaggagagagtatgaaaggtttctgtaaaccttgtttgggatattcagttct

SEQ ID NO: 63165 - DNA, 201 bp, Homo sapiens
tggaggggatgtttttatttcttaaattatattttagtttatatatagtcaaggctttgaaatgaatcattttcaaagctaccaatattttaaataagtgwcttaaaaattttggagtatataattcagacctaagagtacagtttttattcatctatccatttactcaacgaacatttttattgccaggcacaatattaa

SEQ ID NO: 63166 - DNA, 201 bp, Homo sapiens
gtagcatagcctactacaaaccttgactatatgatacagcctgttgctcttattgttataaaagatttaaacattttatttataaactggtattaccaacyttcccctatttctgaatatttaggtaagaagcaaaaataagttatcctggctttgtgtagtggctcatacctgtaatcacagcactttgtgaggctgagg

SEQ ID NO: 63167 - DNA, 201 bp, Homo sapiens
gttgtccctttttgagaaaaacctgtagaagaagaaatattcttttgacaaaaaagttcttgtatcattatgtaaaacctcatagtgaaaaagctcgctctttttttttttagaaataaggtctcactctgctgcccaggctggagtgcagtggtgtgatcatagctcactgcaggcttgatctcccaaactcctgggctc

SEQ ID NO: 63168 - DNA, 201 bp, Homo sapiens
atgaacagacacttctcaaaagaagacatttatgcagccaaaaaaacacatgaaaaaatgctcatcatcactggccatcagagaaatgcaaatcaaaaccrcaatgagataccatctcacaccagttggaatggcaatcattaaaaagtcaggaaacaacaggtgctggagaggatgtggagaaataggaacacttttaca

SEQ ID NO: 63169 - DNA, 201 bp, Homo sapiens
agccaaaaaaacacatgaaaaaatgctcatcatcactggccatcagagaaatgcaaatcaaaaccgcaatgagataccatctcacaccagttggaatggcratcattaaaaagtcaggaaacaacaggtgctggagaggatgtggagaaataggaacacttttacactgttcttgggactgtaaactagttcaaccattgt

SEQ ID NO: 63170 - DNA, 201 bp, Homo sapiens
cttttacactgttcttgggactgtaaactagttcaaccattgtggaagtcagtgtggcaattcctcagggatctagaactagaaataccatttgacccagmcatcccattactggctatatacccaaaggattataaatcatgctgctataaagacacatgcacacgtatgtttatagtggcactattcacaatagcaaag

SEQ ID NO: 63171 - DNA, 201 bp, Homo sapiens
tgggactgtaaactagttcaaccattgtggaagtcagtgtggcaattcctcagggatctagaactagaaataccatttgacccagacatcccattactggstatatacccaaaggattataaatcatgctgctataaagacacatgcacacgtatgtttatagtggcactattcacaatagcaaagacttggaaccaacct

SEQ ID NO: 63172 - DNA, 201 bp, Homo sapiens
ggactgtaaactagttcaaccattgtggaagtcagtgtggcaattcctcagggatctagaactagaaataccatttgacccagacatcccattactggctrtatacccaaaggattataaatcatgctgctataaagacacatgcacacgtatgtttatagtggcactattcacaatagcaaagacttggaaccaacctaa

SEQ ID NO: 63173 - DNA, 201 bp, Homo sapiens
agggacatggatgaaactggaaaccatcattctcagcaaactattgcaaggaccaaaaaccaaacaccacatgttctcactcataggtgggaattgaacartgagaacacatggacacaggaaggggaacatcacacactggggactgttgtggggtggggggaggggggagggatagcattaggagatatacctaatgct

SEQ ID NO: 63174 - DNA, 201 bp, Homo sapiens
attgagatgaattttagttgttcctaagtactgtgtactgtgactggcagtggctcttaactgttattttttgagacagagtctcactctgttgcccaggytggaatgcagtgacacaatcatggctcactgcaacctctgcctcctgggctcaagctatcctactgcctcagcttcttgagtagctggaatcacaggcat

SEQ ID NO: 63175 - DNA, 201 bp, Homo sapiens
tgctccagtgttttagttttcattgtagggacttttcacttatttggttagttcctaggtatttaattttatttgtagttattgtaaatgggattactttmttgatttcttttttagattgtttgctattggcctatagaaatgctagatttttgtaggttgattttgtatcctgcagctttactgattttgtatgagttc

SEQ ID NO: 63176 - DNA, 201 bp, Homo sapiens
ttaagcatccattgaaatgatcatatggtttttgttcttcattttgttgatatgatgatatatcagattgattgatttgcatatgttgaactatccttgcrtccctgggataaatcctatttagtcatgatgaatgatctttttaatgtgttgttgaatttggtttgctagtattttgttgaggatttttgcatcaatttt

SEQ ID NO: 63177 - DNA, 201 bp, Homo sapiens
gaatttatccattttctctagattttctcatttattggcatatagttgatcatagcagccactaatgatcctttgaatttctgtggtatcagttgaatgtktccttctttatctctggttttacttagttgtgtcttctctttttcttagtctgtctagcagtttgtcaattttttttttcaaaaaaaaaaaaaccttttg

SEQ ID NO: 63178 - DNA, 201 bp, Homo sapiens
atggaggctgatgttctgagctccagctgagggaattttcatttatctaaagtttttatttctgtttttttttccccagccgaatttaagattcatatttytgttttaaaaagttgtgaaatgaatatagcaaagtgttaacatttgttgaattcaggagggaaggtatctacacacagtgttaattatttctgttttact

SEQ ID NO: 63179 - DNA, 201 bp, Homo sapiens
aaagtttttatttctgtttttttttccccagccgaatttaagattcatatttctgttttaaaaagttgtgaaatgaatatagcaaagtgttaacatttgtkgaattcaggagggaaggtatctacacacagtgttaattatttctgttttacttctctatatgctctaatttcttctttttaatttttttgagatagggtc

SEQ ID NO: 63180 - DNA, 201 bp, Homo sapiens
cactttgtcacccagatggagtgcagtggtgcagtctcagctcactgcaacctctgcctccctgaatcagattcaagtgattctcctgccctagcctcccragtagctgggattacaggcacgcgccaccacacctggcaaattttttgtatttttagtagagatgggtttttaccatgttggccaggctggtctcaaact

SEQ ID NO: 63181 - DNA, 201 bp, Homo sapiens
caacctagttttcatacccatacatctacgtgcaagataagtgtaatcacttttttcggaaagagtagcttttaatgcatatatttaaattattttaagayatgctctaaagcctctccattgtgctataattgtctctaacagttgaatttttgccttttcaagaatttcttctataaatgctgagggaagaaccattac

SEQ ID NO: 63182 - DNA, 201 bp, Homo sapiens
aaacaaaggaaagaacttaaataatatatagatcagatggtcagctcttgaaaaggtaggtgttaatggcagtcagatattatatcagtcttgaaggagcmcataaatcgtatattgttttgcaaccaaagaacagaaaaatgactgctatcatcaatgatgaaagctcaaatgtgatgaagaaatggaaaaaatagataa

SEQ ID NO: 63183 - DNA, 201 bp, Homo sapiens
gcaggggattataatgatcagattagcatattaagaagatgattttggcaatagtatggagtctggttgatagggaggccaggtaggaggctactgaagtrgtctggacaagagatgaagtgtacctaaactaaggcatggggatggaacggaacttagcattacaggcagttacttaaatggctaggggaagcaagagga

SEQ ID NO: 63184 - DNA, 201 bp, Homo sapiens
aaatgaatatgaatataactatatttttaaattctgatatgcattttatagaaaatttaagcaatacaggaaaatgtaaagaaagtaaaaatgaacagcamctcaactgtttagagataactactaatacatttagtagccattatgtctctctactctctatgcctgtataattaactttaatatatattgtttgatttt

SEQ ID NO: 63185 - DNA, 201 bp, Homo sapiens
agaattgaagagggtagccaagggccaaatataaatttgtattacaagctaaggaatttttatccagtcataaagagccactgaaagattttatgcagggrattataatgatcagattagcatattaagaagatgattttggcaatagtatggagtctggttgatagggaggccaggtaggaggctactgaagtagtctgg

SEQ ID NO: 63186 - DNA, 201 bp, Homo sapiens
aaagtggtgagcatttctgtgtctttttttttttttttttttttttgccaccacagctccccagtttctctggttttaataggttgtatattgttcccacstttcagccctttctttttctctcttctccttttccctactctctaaaatacctaaagggtagtagtcagataggttattttttttcaattgctaaacttc

SEQ ID NO: 63187 - DNA, 201 bp, Homo sapiens
tagtgatgaacaaaataagcttaatcacatcctaggagctaagtattctgacattataatctcttctctcagagtcccatcacagcagtcttaggattcargatctattcttgggaaacattatagaaccagtgtgtcatgtacatacaaatgagggaaaatataatggctttggtaatcctgtagttatctttcttgtca

SEQ ID NO: 63188 - DNA, 201 bp, Homo sapiens
gagtatctcttttttcttcccttttttccttccgttgtaaaattcctaaaaaatttccatgtggtaatagactcaaggtcagagtgaacacacagctaacscttttcttggtggattaatgccttgattctatttctttcactgttgtttttcttttttcttttatttcttctttcactattttattgaaattcttaaatc

SEQ ID NO: 63189 - DNA, 201 bp, Homo sapiens
aaaaaaaaagggctcagtagttttcacttaaaagacaaagaggcccactgagctattacagatgttaattaggattcatttactttaatatggtagaaagratgctatgataccactttagtgatgaacaaaataagcttaatcacatcctaggagctaagtattctgacattataatctcttctctcagagtcccatcac

SEQ ID NO: 63190 - DNA, 201 bp, Homo sapiens
agcacagtatgaaaatcagagtatgattcttttttcaaagaactagtggaagaataaaaggggaatttaaacaccattgtctaacttttgataccaataattgaagtctaagaaacatttttgggccttgcttacctcctttggttcttcatagtggaaataaaccactacccacaccacactgcatgcctgtgtgccttt

SEQ ID NO: 63191 - DNA, 201 bp, Homo sapiens
cacctcagcctcccaaagtgctgggattacaggtgtgagccaccgtgcccgtcccaaccaggcttcttaaatgaattctaagatagaaacaacaggagctkccaggactctcttaagggctgaacctaggactgtcacagtgacatttctgccatattctgctggtcacaaggcaagcccaaattcaaaaggagagaaata

SEQ ID NO: 63192 - DNA, 201 bp, Homo sapiens
gcacagtatgaaaatcagagtatgattcttttttcaaagaactagtggaagaataaaaggggaatttaaacaccattgtctaacttttgataccaataattgaagtctaagaaacatttttgggccttgcttacctcctttggttcttcatagtggaaataaaccactacccacaccacactgcatgcctgtgtgcctttg

SEQ ID NO: 63193 - DNA, 201 bp, Homo sapiens
gcgtgatcacagctcactgcaacctcaccatccctagactcaggtgatccagttcaacctcccaagtagctgtctgggactataggtgtgcaccaccacasctgtctaatttttatattttttgtggagacaaggttttgccatgttgcccaggctggtctcaaactcgtgggctcaagtgatctgcccaccttagcctcc

SEQ ID NO: 63194 - DNA, 201 bp, Homo sapiens
gattcttgtggattatttgctcaagtgaatatttcttttatttatttatgcctcagcattcacatcgtgaatatttctaaaggaaggaaaggttgtaaaayttaggagcactagaatatatagctacagggcattgttgaactttagacaagatcataggatttgacatgttttctgggtcaaatgcagagtttatctagt

SEQ ID NO: 63195 - DNA, 201 bp, Homo sapiens
agctgtctgggactataggtgtgcaccaccacacctgtctaatttttatattttttgtggagacaaggttttgccatgttgcccaggctggtctcaaactygtgggctcaagtgatctgcccaccttagcctcccaaagagctaacagacgcgagccaccgtgcccacccatgcttaatttgtttaggtgcgagatatact

SEQ ID NO: 63196 - DNA, 201 bp, Homo sapiens
ggcaggagaatcgcttgaaccctggaggcagagactgcagtgagccgagatcgcaccattgcactccagcctgggtaacaagggaaactccatctccaaaraaaaaaaaaaaaaaaaagccagacatggtagtgtatgcctgtagtcccagctacttgggaggctgaggtcgaggatcacctgagcccaggagttagaggc

SEQ ID NO: 63197 - DNA, 201 bp, Homo sapiens
aggtgattctcctgcctcagcctcccgagtagctgggattacaggcacatgccaccacagctagctaatttttgtatttttagtagagacaagttacaccrcgttggccaggctggtcttgaactcctgacctccagtgatccacctgcctcggcctcccaagtgctgggattacagacctgaggcaatgcacctggccac

SEQ ID NO: 63198 - DNA, 201 bp, Homo sapiens
  misc_feature (1)...(201): n = A,T,C or G, or insertion/deletion polymorphism (see Tables 1-2)
tcactctgttgcctaggctggagtgcagtgatgcgactgaactcctgggctcaagcaatcctactgcctcagcctcctgatagctgggactacaggcacangccaccatgctgggctaatttttttcttactttttttttttctttttgtagagatgggggtctcactgtcttgtccaggctggtcgtgaagtcctgggct

SEQ ID NO: 63199 - DNA, 201 bp, Homo sapiens
aacttttttttgttgttgttgttgttttgtttttgagacagagtctcactttattgcccaggatggagtacagtggtgcaaactctgctcactgtaacctycgcctcctgggttcaagcaattctcctgtctcagcctcctgagtagctgggactacaggcgcatgccaccatgcccagctaatttttgtatttttagtag

SEQ ID NO: 63200 - DNA, 201 bp, Homo sapiens
cgtaagtggtggccactgtcctataagaatctatgatgaaatagtaaaatagctaacatttatagagtgctttccacatgccagacactgtgctaaattcktgttgttgttgttgtttgtttttgtttttgtttttgttttttcccagacacagtcttgctctgttgcccgggctggagtgcagtagcgtgatctcggctc

SEQ ID NO: 63201 - DNA, 201 bp, Homo sapiens
agctaatttttgtatttttagtagagacggggtttcaccatgttggtcaggctggtctcgaactcctaacctcaagtgatccacgcgccgtggcctcccaragtgctgggattacaggcatgagccactgtgtccagccttaaacatgttaatctgtcttgctcaatcttccattatctctcaacccttttttttttggag

SEQ ID NO: 63202 - DNA, 201 bp, Homo sapiens
tattcctataaacagattttcacctaaaatttgaatctttatgaatcaaataaggaaaattttaagtaaacttgggctgtggataactgatgattcattamcaaaaaggtagtcatttaaaattataaaatgacacaaaaaatttaaatggaaaacatcctgtttatgcttggtcaggtctttgagttgatgtgactcaag

SEQ ID NO: 63203 - DNA, 201 bp, Homo sapiens
gtaatcccagctactcaggaggctgagtgaggcaggagaatcgcttgaacccaggaagtggaggttgcagtgatccaagattgagccattgcgctccagcytgggcagcaagagtgaaaactcgatctcaaaaaaaaaattaataatgtgtgtggtacttcaaccagtcttgaagagaatacagaactggaaagaagaata

SEQ ID NO: 63204 - DNA, 201 bp, Homo sapiens
attcctataaacagattttcacctaaaatttgaatctttatgaatcaaataaggaaaattttaagtaaacttgggctgtggataactgatgattcattacyaaaaaggtagtcatttaaaattataaaatgacacaaaaaatttaaatggaaaacatcctgtttatgcttggtcaggtctttgagttgatgtgactcaagt

SEQ ID NO: 63205 - DNA, 201 bp, Homo sapiens
cttcttctttttttttttttttttggagacagagccttgctctgtcacacgggctggagtgcagtggcacagtcatagctcactgtaacctcaacctcccwggctcaagcagtccttccacttcagcctcttgagtagctgggactacaggcatgtgccaccatgcctggttaacttttttctttctttctttctgttttt

SEQ ID NO: 63206 - DNA, 201 bp, Homo sapiens
ctgatcattttcttaacctttttaaaaagactcccctaaattcttcctcccaaagattttactgtgtttgttcacagtgggttctgtgaaaggattattayaagcccacaatccattatcctcaattctacaaatccaaaaaattctgaaaaccaaacattctttttgtaactcattcatcagcaaaaccagacctgaacc

SEQ ID NO: 63207 - DNA, 201 bp, Homo sapiens
tgaaactccatctctaccaaaaatacagaaaattagctgggtgttggcagtatgcgcctgtggtcccagctactcggtaggctgaggtgggaggaccacckgagcctggaaggtggagatttcattgagcctagatttcaccactgtactccagcctgggtgacacagtaagaccctcgtctcaaaaaaaaaaaaaaaaaa

SEQ ID NO: 63208 - DNA, 201 bp, Homo sapiens
ttggtacagattaagtctgatgttcattgattttctctctggaagatctgtccaacgctgaaaatgggatgttgaagttaccagctattattatattgggrtctgtctctctttttagctgtaacaatatttgctttatgtatctgggtgctccaacactggtatatggatccagtgttgggtccatatacaattacaatt

SEQ ID NO: 63209 - DNA, 201 bp, Homo sapiens
tactcctagtcttttttgatttccattgtcatggaatgtgtttttccatccttttattttcagtctatgtgtgtctttgtaggtgaaatgtgcttcttgtrggcaacagatcactgagtcttgtttttttgttttttgtttttttaatcccttcagccactctgtctttttattggagaatgtagtccatttacattcagt

SEQ ID NO: 63210 - DNA, 201 bp, Homo sapiens
tcagcgtatctgttgtatgttttttgattagaggttaccatgatgcttgcaaatactatcttataacctattattttacactgatagcctaacactgtttkcataaacacacaagcaaaaagaaaactaataaaaactctacaccttaacttcatccccctgctttctaactttttgttgtttttatttatatcttattgt

SEQ ID NO: 63211 - DNA, 201 bp, Homo sapiens
ctgatagcctaacactgtttgcataaacacacaagcaaaaagaaaactaataaaaactctacaccttaacttcatccccctgctttctaactttttgttgkttttatttatatcttattgtactgtctgtgtcttgaaaagttgttgtagttatttttgatttatcttttagtctacttaaaataagagtaatttacacac

SEQ ID NO: 63212 - DNA, 201 bp, Homo sapiens
ggagcaagacgtctcacatgattagaagcaggaggaagaggggcggagagctgctacacacttctaaacaaccagatcttgcgataactcactatcaggaggaacagtaccgaggggatggctctaaaccattcatcaaggaccaccctcatgatccagtcgcctcccaccaggccccacctccaacattggagattataa

SEQ ID NO: 63213 - DNA, 201 bp, Homo sapiens
gaagaggggcggagagctgctacacacttctaaacaaccagatcttgcgataactcactatcaggaggaacagtaccgaggggatggctctaaaccattcrtcaaggaccaccctcatgatccagtcgcctcccaccaggccccacctccaacattggagattataatttgacatgatatttggtggggatacagattcaa

SEQ ID NO: 63214 - DNA, 201 bp, Homo sapiens
gtggcttctttcttacctcagtgtgatgcagatatcaatgcccaaacaaaagcctttttttttttttttttttttttttgagacagagtcttgctctgtcrcccaggcttgggtgcagtggtgcaatctgcgctcactgcaacctccacctcccaggttcaagctatcttcctgcctcagcctcccaagtagctgggacta

SEQ ID NO: 63215 - DNA, 201 bp, Homo sapiens
caattatagcagtttttatcactctgtgttttaaaaatgtaagagattcttaataaaaactgatgtgattttgtgttgggcattttttaaaggatgttttyttttttaaaaaaaattatttttaaatttttatttatttatttattttgagactgggttatgagactggccaatttttgtatttttggtagagatggggtt

SEQ ID NO: 63216 - DNA, 201 bp, Homo sapiens
ctagagtgtagtggcatgatctcagctcactgcaacctccacctcccgggttcaagcagttctcctgcctcagcctcccgagtagctgggattacaggtgygggccaccatgcctagctaatttttgtatttttagtagagacagggtttcaccatgttggccaggctggtctcgaactcctgacctcatgatccgcccgc

SEQ ID NO: 63217 - DNA, 201 bp, Homo sapiens
atcacttgaggccaggagtttgagaccagcctggccaacatggcaaacccccatctctactaaaaatacaaaaattagccaggcaggtgtggtggtgcatkccggtaatctcagtttcttgggaggttcgggtgggatgatcgcttgaacctgggaggcggaggctgcagtgagccgagatcacgccactgcactccagcc

SEQ ID NO: 63218 - DNA, 201 bp, Homo sapiens
acactcttaatgccatactagctcctgtcacaggcctgacaaatagtaggcgctcaatgtatgtttgaataaattattgattttttgttcttcctggaaawggcaatgttttctatttgtcactttatgttatgctaaacaggtttgagttttaggagtcctctttactataaattgaggtggttagatgttggctaatca

SEQ ID NO: 63219 - DNA, 201 bp, Homo sapiens
ttaaatttatcctttagaaagcaattctgtagtatgaaatgtgtgtactctttacctgtgggtacataaattgccatttttatttattggacttttgggtrgtaatgaggtagggctggccagatagtattaatatgatttctaagcatgtctttctgacttctagacttgaagctacttgagggaaacagtttagcataa

SEQ ID NO: 63220 - DNA, 201 bp, Homo sapiens
cctgacttcaagtgatccactcacctcagcctcccaaagtgctgggattacaaggatgagccaccacaaccggcccactttcattaaagaagttttttttwaatttagagagcatatgattaaaagttgacttaaatttttttatttgcaaaaggcatttgcatgtttcttattggtttccaagagatctcttgaaatcat

SEQ ID NO: 63221 - DNA, 201 bp, Homo sapiens
ctttttcattattcttctgaaatattcatggactcttaacagttcctaccttgtttgcactagatcctcacatactcttaccttctggcagccagtctatrgttgcagtgggttgctcttgttttgtttcttgttgctgaggatgtaatcaataaagagtagatactcaaggtaaagtttatggatactcaaattcactta

SEQ ID NO: 63222 - DNA, 201 bp, Homo sapiens
gcacactttttcattattcttctgaaatattcatggactcttaacagttcctaccttgtttgcactagatcctcacatactcttaccttctggcagccagwctatggttgcagtgggttgctcttgttttgtttcttgttgctgaggatgtaatcaataaagagtagatactcaaggtaaagtttatggatactcaaattc

SEQ ID NO: 63223 - DNA, 201 bp, Homo sapiens
gaatctcttaaaaactcaaagcttactggattgatgttgatgtactcttactaaaatcttaactaagtctaggcaaggtggctcatgcctgtaattccagyactttgggaggctgaggcgggcagatcacttgagcccaggggttcaagaccatgggcagtgtggcgaaaccctgcctctacaaaaatgttttaaaaatta

SEQ ID NO: 63224 - DNA, 201 bp, Homo sapiens
cttcacttgactggcctttaaaaaaataaataaataataaattaaaaagagaaactatatttagtgttaggtaaatataacatggctctttaattttgatrtaatcaagaggaaagatattgtgaatctcttaaaaactcaaagcttactggattgatgttgatgtactcttactaaaatcttaactaagtctaggcaagg

SEQ ID NO: 63225 - DNA, 201 bp, Homo sapiens
aaatgatggccacagagcagaatctaaggagatttctctggatttggtcttcatagtctataactgtaaattactgtctctgcctactcctggtgagtttttgttgttgttgttgggttttttgtttgtttgttttttgtttttttgagacagaatctcactctgtcacccaggcctggagtgcagtggtacgatcgcagc

SEQ ID NO: 63226 - DNA, 201 bp, Homo sapiens
aatgatggccacagagcagaatctaaggagatttctctggatttggtcttcatagtctataactgtaaattactgtctctgcctactcctggtgagtttttgttgttgttgttgggttttttgtttgtttgttttttgtttttttgagacagaatctcactctgtcacccaggcctggagtgcagtggtacgatcgcagct

SEQ ID NO: 63227 - DNA, 201 bp, Homo sapiens
attgcagtacactcagttgagattgaaacagaataactgtgttgtgaaattttggttttcagtgaataaattttagtaattgcaagtgtatttaggcaggwccgagtgcagtggtgttgataactaattcattacaatcagttacagatttctttgttccttctccactcccactgcttcacttgactggcctttaaaaaa

SEQ ID NO: 63228 - DNA, 201 bp, Homo sapiens
atgatggccacagagcagaatctaaggagatttctctggatttggtcttcatagtctataactgtaaattactgtctctgcctactcctggtgagtttttgttgttgttgttgggttttttgtttgtttgttttttgtttttttgagacagaatctcactctgtcacccaggcctggagtgcagtggtacgatcgcagctc

SEQ ID NO: 63229 - DNA, 201 bp, Homo sapiens
tctttttgtaactcattcatcagcaaaaccagacctgaaccaaagtgaccctattcatattctttgattatctgtcctactgggacatatatggtttgctrcagaaatattaatgtatttaattataggatactgccctagatagttcatatatgtggtatatgcaccatactgcttttctaaattaaaaaatctgaattc

SEQ ID NO: 63230 - DNA, 201 bp, Homo sapiens
aggctctccatctgtctcaccaagctaggtgcagttattgtgcagaaagtttgcttaggggcagaggaagccttatctacgtaagtatttagaatttgttaaaaaaaaaaaaaaaggaaaaaggaaagcagtttatagatgaatacttaaatagtttcattttgtacaagtcacctggttttgttcccatgtgttaggaag

SEQ ID NO: 63231 - DNA, 201 bp, Homo sapiens
taaaaaaatgatcaaaaatgttacactggcctggtgcggtggttcacgcctgtaatcccagcactttgggaggccgaggtaggcggattgcttgaggtcargagttcaagatcaccctggccaacatggagaatccccatctctacgaaaaatacaaaaattagcctggtgtggtggtgggcgcctgtaatctcagctact

SEQ ID NO: 63232 - DNA, 201 bp, Homo sapiens
attctaacacctagtttttatgccaccttaaagttatactttctgtgtgttgtactttcaaatgtttaaaaaaataggccaggcgtggtgggattacaagygcttgtaatcccagcactttgggaggccaaggtgggcggatcacaaggtcaagagatccagaccatcctggctaacatgatgaaacccatctctactaaa

SEQ ID NO: 63233 - DNA, 201 bp, Homo sapiens
actgcagccttgaacttctgtgctcaagtaatcctttcacttcagtcccttgagtagctaggactgcaggtgtgcaccaccatgcctaattaaaaaaaaatttttttttttgtagagaaaaaggtcttgatatgttgcccaggctggtccaaagtgattctcctgcttcagcctcccaaagtgttgggattacaggcgtga

SEQ ID NO: 63234 - DNA, 201 bp, Homo sapiens
agatgcaaatccttctctactcacaaggtaggttttccttggattttacattttccaaaaacaagtacttttgctcccaactactgtgtttccatggggtrtattattagaaccgaataatgatcacagtcttttctgttttgtgtaaagggagcaggtatggtgggaccagcggctgagatgagactgctgtttctcttt

SEQ ID NO: 63235 - DNA, 201 bp, Homo sapiens
ttttcttttgagatggagtttcgctcttgttgcccaggctggagtgcaatggcgggatcttggctcaccgcctcctgggtttaagtgattctcctgcctcrtcctcccgagtagctgggattacaggcatgcaccaccacgcccagctaattttgtatttttagtagagacgggttttcttcatgttggtcaggctggtgt

SEQ ID NO: 63236 - DNA, 201 bp, Homo sapiens
ttgcccactccagtgttctggagaggttccccaatgttttcttttagtagtttcatagtttgaggtcttaaatttaagtttttaacccattttcatttgatttttttttttatatggtaagagatacggggtcaaccttcattcttctgcgtaaagatatccagttttcccagcaccattgactgaagagactgtcctttc

SEQ ID NO: 63237 - DNA, 201 bp, Homo sapiens
aagaaatagactagccaaatgcattttgttttgaagacttaatgatattttagtttcttgttgagtgactgatctattttgtatgttaatccatgtaataktttataagataatttatatgtatgttgtctttccatttttcataacaattgttgagagatttttaaatggcagcttgatatatctgtagttgggaaacct

SEQ ID NO: 63238 - DNA, 201 bp, Homo sapiens
ggagtgcagtggcgccgtctcagctgactgcaacctccacctgccaggttcaagtgattcttttgcctcaacttcccaaatagctgggattacaggtgcaygccaccacacttcgctaatttttgtatttgcactagagatggggtttcaccatgttggccaggctggtcttgaacttctgacctcaagtgatccacccac

SEQ ID NO: 63239 - DNA, 201 bp, Homo sapiens
ttgagtatttgaaacttgactagttcaaaatgaaatgagctgtagatgtaaaatactcactggatttcaaagatttaatatctcactaacatttttgtatrtttattacatgttggagcaatattttggatacaagaagtaaaatttattgtcatgatgaatttttcctgtttttgttgttgttgttgttgttgttgttaa

SEQ ID NO: 63240 - DNA, 201 bp, Homo sapiens
gagagtcgcttaaattcttttttttttcttcttcttttttttttgttttttgagacagatgttgcctaagctgctgtgcagtagagcgatcacagctcackgcagccttgacctcctgggctcaggtgatcctatacctcagctttccgaatagctggggctataggtatatgccaccatgtctggctaatttttaaaact

SEQ ID NO: 63241 - DNA, 201 bp, Homo sapiens
ccagggcaggtgtgtcgcttgagctcacaagtaacgagaccagccggggtaacgtggtgaaacctcatctcgacaaaaaatacaaaattagccgggcatgrtggtgtgtgcctgtagtcccaactacttgggagcctgaactggggaggatggcttgagcccaggaggcagaggttgcagtgagctagatcgtgccactgc

SEQ ID NO: 63242 - DNA, 201 bp, Homo sapiens
gttcaagcgatccttccaccctagtctcccaagtagttgggactacaggtgcatgccaccatgcccagctaatttttatatttttttttctagagatgggrctttaccatgttgcccaggctggtctcaaactcctgggttcaagcaatccacctgccctagcctcccaaagtgctgggattacaggtgtgaacctctgtg

SEQ ID NO: 63243 - DNA, 201 bp, Homo sapiens
catctgtctcaccaagctaggtgcagttattgtgcagaaagtttgcttaggggcagaggaagccttatctacgtaagtatttagaatttgttaaaaaaaawaaaaaaggaaaaaggaaagcagtttatagatgaatacttaaatagtttcattttgtacaagtcacctggttttgttcccatgtgttaggaagaaatgagt

SEQ ID NO: 63244 - DNA, 201 bp, Homo sapiens
agcccaggagtttgagaccagaatgggcaccatagcaagaccctgtctcaaaataggtaggtaggtaggtaggtaggtaggtaggtagaggtaggtaggtrggtaggtggatggatggatggatggatagatagatagatagatagatagatagatagatagatagatagaagatagagagatagtcaaccttgagagggt

SEQ ID NO: 63245 - DNA, 201 bp, Homo sapiens
atatgttgcccaggctggtccaaagtgattctcctgcttcagcctcccaaagtgttgggattacaggcgtgagccactgcacccagtgtcacaaatcttawtttttttttttttttgagacggagtctcactttgtcacccagatggagtgcagtggtgcagtctcagctcactgcaacctctgcctccctgaatcagatt

SEQ ID NO: 63246 - DNA, 201 bp, Homo sapiens
tgtgagatgatctcagctcactgcaacctctgcctcctgggctcaagcgatctttctatcctagtctcccaagtagttgggactacaggtgtgtgccggcrcacctagctggtttttttatttttttgtggagacagagttttgccatgttgcccaggctggtctcaagtgagccacctgccttggcctctgaaagtgctg

SEQ ID NO: 63247 - DNA, 201 bp, Homo sapiens
gttctgttttctttttagagacagggtctcactctgttgcccaggctgcagtacagtggcactatcagagctgactgcagccttgaacttctgtgctcaartaatcctttcacttcagtcccttgagtagctaggactgcaggtgtgcaccaccatgcctaattaaaaaaaaatttttttttttgtagagaaaaaggtctt

SEQ ID NO: 63248 - DNA, 201 bp, Homo sapiens
ctttccaaatagctgggactacacccacgtgccaccacacccagctaatgaatttggcaactttattgtatgttgggtttgtcaacctaaataacaaatarggataggctctctaaaagaaaattatttttattttgaaataaggtgttgcaataggaatatacatgcgatagtaaactgtgtgttctttaacattgtgga

SEQ ID NO: 63249 - DNA, 201 bp, Homo sapiens
ctacatcaggaagtccaccagaggcatgctggataccaccagcagcttcacatctccattggcagtgcttggcagggcataagccttgctagacacagctyctggtctgcaccaccatggctcctgtgccgccagccacaggtccagacctagacccctctgttgcccttgaggggctgaccttattctccacagtgatgc

SEQ ID NO: 63250 - DNA, 201 bp, Homo sapiens
ctgtgaaagaatccaatactgttacaataataataataatgataatttaaacataatttcagtataattataatcgcaattttaaaaaatgtatgtgtatrtatttagagatggggtctcactctgtcacccaagctgaagtgcagtggcacaatcatagctccctgcagccttgaacttatgggctcatgtgatccttcc

SEQ ID NO: 63251 - DNA, 201 bp, Homo sapiens
gttatggagagattgtttcttttatcagttcatatttctatgcacttctcattcagtactgtgctatacttttcactgcccttcacctcagctaagatggytttcaccttaagtctcaagacaaaggcagcaaacagccaatacagaattagggcatagagctgggtgtgatacagggtgctaactactcatagtccgctt

SEQ ID NO: 63252 - DNA, 201 bp, Homo sapiens
gagactcttaattcaagcctcagctctgtctttaattctcaccttaggcaaaccatgttagctgagcatctgtgttctcctaatgtaaacaatgagagagrgagagggactgctcaggctcttaaagataattcaagtctaacattttttgaattatttgtttgtgtagtgttatttcctaaaatatttgaatcaagtttt

SEQ ID NO: 63253 - DNA, 201 bp, Homo sapiens
gcctcctgggttcaagtgattctcctgcctcaacctctcaactagctgggattacaggcgcctgccactacgcccagcttattttttgtgtttagtagagrcgggctttcaccatgttggtcaggctgatctcaaactcctgaccttgtgatttgcccaccttggcctcccaaagtgctgggattacaggcatgagccacc

SEQ ID NO: 63254 - DNA, 201 bp, Homo sapiens
aaaaaaaaaaaaaaaaaaaaaagatactgaatcatccattcaaattatgtgaccttcatttaagcctttcagtgtaaagaatggtgtaggccggccaggcrcagtggctcacacctataatcccagcactgtgagaggctgaggcaggtggattacgaggtcaggagttcaagaccagcctggccaagatggtgaaacccc

SEQ ID NO: 63255 - DNA, 201 bp, Homo sapiens
gttaaaggttaaaaaaggccgtgtgcagtcgctcacctgtagtcccagggtgaggccagggcaggtgtgtcgcttgagctcacaagtaacgagaccagccrgggtaacgtggtgaaacctcatctcgacaaaaaatacaaaattagccgggcatgatggtgtgtgcctgtagtcccaactacttgggagcctgaactgggg

SEQ ID NO: 63256 - DNA, 201 bp, Homo sapiens
taagaatataaaaaaattacccaggcatggtggtggacacctgtaatcccagctacgcgggaggctgaggcagacaattgctcgaacccaggaggcagagkttgcagtgagctgagatcgcaccactacactccagcctgggtgacagagcaagactacatctcaaaaaaagaaaagaaaagaatggtgtaggcagtgcta

SEQ ID NO: 63257 - DNA, 201 bp, Homo sapiens
ctcttgaattttctatatctacttgaaaaatatttaaaatatttattcaaaataaattccaaatgtagagtgtaaacaaactcaaacatttcttctgatttctgtcacctcttctactcaactcaaaaatatcttgtgtgaactcttaattattcaaaggttaatcaagtgcatagttacatatgcacttgcctctaccac

SEQ ID NO: 63258 - DNA, 201 bp, Homo sapiens
tcttgaattttctatatctacttgaaaaatatttaaaatatttattcaaaataaattccaaatgtagagtgtaaacaaactcaaacatttcttctgatttctgtcacctcttctactcaactcaaaaatatcttgtgtgaactcttaattattcaaaggttaatcaagtgcatagttacatatgcacttgcctctaccacc

SEQ ID NO: 63259 - DNA, 201 bp, Homo sapiens
atatttccagtacacagcacagtgaaatggctccataaacgttacctgagtaagtgaagtaattctctgtaaggtctggctgaagaccttcatgtctccarataagtagcctacaagtatctctctattctgattttacttttaggccagttccagcttttctgttgtagtgagtagaatggagatataagctcagtttct

SEQ ID NO: 63260 - DNA, 201 bp, Homo sapiens
ttacctgagtaagtgaagtaattctctgtaaggtctggctgaagaccttcatgtctccaaataagtagcctacaagtatctctctattctgattttacttytaggccagttccagcttttctgttgtagtgagtagaatggagatataagctcagtttctgctgggcggatcaaggaagttgcagggtccgtcagtattta

SEQ ID NO: 63261 - DNA, 201 bp, Homo sapiens
tatagtaaaatgttttgaaccttctttctagaaaaatgtttgcatattcaaaatattgtatacagtgtttcacttttcacaaataatcctgaaactgattmatatattgtttttatttttatttttttcgagatggagtcttgctctgtcacccaggctggagtgcaatggcacgatcttggctcactgcaacctccacct

SEQ ID NO: 63262 - DNA, 201 bp, Homo sapiens
aaggggcacaaggcctgtgaaaacatggactgcaagcaagtggtcttactgcatatggagtgatgataaggaatgaggcagacaagggccaaatcatgaaragcctcatgtgccttgctgaggcctgtcttaaatattaaaataacttcttttatacattcatcactttgagtatcaattataaaaagactttcctaaaat

SEQ ID NO: 63263 - DNA, 201 bp, Homo sapiens
ttggccagagattccaaaaatttttgatatgggactgtctttccccattactcttctctcttctctcttctctcctccctccctccctccctccttccttmcttcctcccttcctccctctctcccttccctcccctcccctccccttccctctttctctcactctttctctctttctccttttctttctcagaatctcgc

SEQ ID NO: 63264 - DNA, 201 bp, Homo sapiens
ctggccaacatagtgaaaccccgtctctacaaaaatacaaaaattagccaggcatggtggtgtgcacctgtaatcccagctgctggggaggctgaggcagragaaccacttgaactcaggaggcggaggttgcagtgagccaagttcatgccactgcactccagcctgggcaacagagcgagattccatctcaaaaataaa

SEQ ID NO: 63265 - DNA, 201 bp, Homo sapiens
ctttttaaatgatacagtcaagagtttattccagagttgagaacctaataaatgttcttttatattgtataccatgctttttttagaaggcaaaaaaaaamtccaaaagcttccattatcacacttcctcttttattttttatttttatttttttttattgagacggagtcttgctctgtcacccaggctggagtgcagtg

SEQ ID NO: 63266 - DNA, 201 bp, Homo sapiens
atgaatttaggactgcagagtacagcaaattttagttcctgatatggccatgctttcctaagaagtttccaaaggttattgactctcagcttagccttttytactgcacaatgtgatagatgctgtaaatcagcgtttagaggtgtttatctaactctccctagtgggagatggggaaattttcactgagaatgtaactct

SEQ ID NO: 63267 - DNA, 201 bp, Homo sapiens
cagagcgagattccatctcaaaaataaaaaataatcagtcacagcatccaggatcataggtgtataatcctccagctacatcaggaagtccaccagaggcrtgctggataccaccagcagcttcacatctccattggcagtgcttggcagggcataagccttgctagacacagctcctggtctgcaccaccatggctcctg

SEQ ID NO: 63268 - DNA, 201 bp, Homo sapiens
agatggttagaggcagaaattgaatcagatctcaacattatcagtcagtagtaggactataaaataaatagaaaactatgacatgcttttggaaaagttcwagatattaactatgtattatttgttgtaggcgaaaattttgaccagagtcctttgagaagaacattcaaatccaaagttctcgcccactatcctcagaat

SEQ ID NO: 63269 - DNA, 201 bp, Homo sapiens
cgtggtggcacatgcctgtaatatcccagttactctggaggctgaggcaggagaatcgcttgaacccaggaggtggaggttgcagtgagctgagatcgtgycactgcactccagcctgggcaacagagggagactctgtctcaaaaaaaaaaaaaaaaaaaaaaaaaaaaaggtatttgtggtgagagaagttgttggctt

SEQ ID NO: 63270 - DNA, 201 bp, Homo sapiens
atcttcacagtaactggtagacaaaaagttaagagaaaaactgaaacagagctgcttttgcaactttgttcttgtcatatcttgccctgagattctgaggraataatttattttattttttagacagggtctcactctgtcacccaggcaggaatgtggtggcacagctcactgcagccttgacctcctgagctcaggaga

SEQ ID NO: 63271 - DNA, 201 bp, Homo sapiens
gggagtcttggaaccaatcccacacagatactgagggataactataccacatgaggagcgattaagtaattagaaaatcagccaccaggaaagggagaaamtcaattagtttatacagttccctttccagaaaagctactttttttttttttttttttgagacagagtttccctgttgttgcccaggctggagggcaatgg

SEQ ID NO: 63272 - DNA, 201 bp, Homo sapiens
actccagcctgggcaacagagggagactctgtctcaaaaaaaaaaaaaaaaaaaaaaaaaaaaaggtatttgtggtgagagaagttgttggcttggtgaascagcaggaaggactcagattctagatagatgttgaaggtaggcccaacgagatttgctgatgatttatatgaatatgtatgaattctatgaatatggtag

SEQ ID NO: 63273 - DNA, 201 bp, Homo sapiens
ttcgtctacccatgattttaagaagcaaagagtgtgatgtttcccacctacccacacccccttaaaactattcaaatgaaaccatttaattctttaattayagtggaatagaactgacctattttctgtatgatcataaagaaatatttacttttaacgcagaaatttttttcttaagatccacattttccagcttaatga

SEQ ID NO: 63274 - DNA, 201 bp, Homo sapiens
ccactgtcctataagaatctatgatgaaatagtaaaatagctaacatttatagagtgctttccacatgccagacactgtgctaaattcttgttgttgttgttgtttgtttttgtttttgtttttgttttttcccagacacagtcttgctctgttgcccgggctggagtgcagtagcgtgatctcggctcactgcaacctct

SEQ ID NO: 63275 - DNA, 201 bp, Homo sapiens
aactagctattatattttggattatttaatgttaaatgcttacagtgtgtcagattctggagtacatacgtaagtggtggccactgtcctataagaatctrtgatgaaatagtaaaatagctaacatttatagagtgctttccacatgccagacactgtgctaaattcttgttgttgttgttgtttgtttttgtttttgtt

SEQ ID NO: 63276 - DNA, 201 bp, Homo sapiens
caaaaattagcctggtgtggtggtgggcgcctgtaatctcagctacttgggaggctgaggcaggagaatcgcttgaatccgagatgtggaggttgcagtgygccaagatcgcaccattgcactccagcttgggcaacaaagcgagactccatctcaaaaataataacaatgttacactgtatcttgtacatttttagtggg

SEQ ID NO: 63277 - DNA, 201 bp, Homo sapiens
tgtgaagggggatgtaaagaaatttgagtaagttttttactagcctgggttctaatataggtaatatataactaacagactgtaataacaactggtttgayagcacagaggaaattattaatgttaactgggtgaggtgagaaatagggagaagatcacatttaaacttgcccttaaagtattaatagaattttttaaaaa

SEQ ID NO: 63278 - DNA, 201 bp, Homo sapiens
ctgtcctataagaatctatgatgaaatagtaaaatagctaacatttatagagtgctttccacatgccagacactgtgctaaattcttgttgttgttgttgtttgtttttgtttttgtttttgttttttcccagacacagtcttgctctgttgcccgggctggagtgcagtagcgtgatctcggctcactgcaacctctgcc

SEQ ID NO: 63279 - DNA, 201 bp, Homo sapiens
ctaaattttgtttttggtaaaaccataactagctattatattttggattatttaatgttaaatgcttacagtgtgtcagattctggagtacatacgtaagyggtggccactgtcctataagaatctatgatgaaatagtaaaatagctaacatttatagagtgctttccacatgccagacactgtgctaaattcttgttgt

SEQ ID NO: 63280 - DNA, 201 bp, Homo sapiens
agatcaccctggccaacatggagaatccccatctctacgaaaaatacaaaaattagcctggtgtggtggtgggcgcctgtaatctcagctacttgggaggytgaggcaggagaatcgcttgaatccgagatgtggaggttgcagtgcgccaagatcgcaccattgcactccagcttgggcaacaaagcgagactccatctc

SEQ ID NO: 63281 - DNA, 201 bp, Homo sapiens
gctttatgaattctctctttacctgtgtttaatctacaattagccctttctttgacattttttggtcacagtgaagcttgttacagacaaacatgtttagrttgggtggcttaggtggtgtggtggctccacattgatgtcatactgaggacaggggtcaagtactccatgattagtctttgctcttacttcaggagctgc

SEQ ID NO: 63282 - DNA, 201 bp, Homo sapiens
gaattcctgtttacccttcacccagtttctccaaatgttaacgtttcacataaccatggtacattcatcaaaactaagaaattaacattggaataatactrttaactaaactccaggcttcatttggatttcgtgaatttttccactaataccctttttctgttccactgtccaatccaggataccacattgcatttagtt

SEQ ID NO: 63283 - DNA, 201 bp, Homo sapiens
cccaaagtgcttacaggcgtgagccaccacacccagcctcattccaattttctgtgtgtctctgtgctgcattctgggtaatttctccacatctgtctccwgctttatgaattctctctttacctgtgtttaatctacaattagccctttctttgacattttttggtcacagtgaagcttgttacagacaaacatgtttag

SEQ ID NO: 63284 - DNA, 201 bp, Homo sapiens
tctgatttttttttttctttctttcacagttgtgcatgcctaaagggctatctttcaggacacaaacggacaataaagacccccagtttcactcatttatmattaccagggaagatggttctcgcacctatggttttgttctcactttttatgaagaagttacaagtaagcaaatctgcacagcaatgcagacactttacc

SEQ ID NO: 63285 - DNA, 201 bp, Homo sapiens
tgagggaggagagaaagggaaagaaaaggggacagggagagagaaaggaggctggaggagtacaagttctgtttgctgctaaggtgttaagacagactgtyctaaaattcctgtgcacatccttttgcttgtatttccactgttggtcacagatactctcagagtaataaaagtaaatatctagaatacaatgcattgtta

SEQ ID NO: 63286 - DNA, 201 bp, Homo sapiens
tccctcatatgatctggccgcccgtaacctctggagctttctctcctcttcactcattatattgcttttgtcttgctcttttccagacaatctgagcatgytcctgtcttatgatctttgctttagctgttctggttgcctggaaagctcttccccccaaggatcttttggctcactgtctcacctccttcatgtctgcct

SEQ ID NO: 63287 - DNA, 201 bp, Homo sapiens
tactgcctcagcctcctgatagctgggactacaggcacacgccaccatgctgggctaatttttttcttactttttttttttctttttgtagagatgggggwctcactgtcttgtccaggctggtcgtgaagtcctgggctcaagcagtcctctgcctcagcctcccaaagtgctgggattataggtgtgagccactgcacc

SEQ ID NO: 63288 - DNA, 201 bp, Homo sapiens
ccacaggcatgtgccaccatgcctggctaatttttgtattttttgtagagatggggttttgccatctctacaaagatgttgcctaagctgatctcaaactmctgagctcaagcagtccacccatccttggcctcccaaagtgctgggattacaggcagtgagccaccatgcctggctgcgccatttctttatagactaccc

SEQ ID NO: 63289 - DNA, 201 bp, Homo sapiens
agggtttcaccatgttggccaggctggtctcgaactcctgacctcatgatccgcccgcctcggcctcccaaagtgctgggattataggcatgagccaccaygcccagcctggagtgattctttcaaagcgcagcattcctctgtttgaaagtctccagtgacttcccatttgttcagaggaaaagccagatccctcatatg

SEQ ID NO: 63290 - DNA, 201 bp, Homo sapiens
ggctggagtgcagtgatgcgactgaactcctgggctcaagcaatcctactgcctcagcctcctgatagctgggactacaggcacacgccaccatgctgggmtaatttttttcttactttttttttttctttttgtagagatgggggtctcactgtcttgtccaggctggtcgtgaagtcctgggctcaagcagtcctctgc

SEQ ID NO: 63291 - DNA, 201 bp, Homo sapiens
atgttggaggtggggcttattgggagatatttgggttatgggggcagatccctcgttaatggcttggtgccctcctagaggtaatgggtgagttctccctytatgagttcccacaagagctagttgttaaaaagagtctggcaccactcccctaccctcttcgttcctctctcttgctatgtgatctctaattggctagcc

SEQ ID NO: 63292 - DNA, 201 bp, Homo sapiens
gcctaggctggagtgcagtgatgcgactgaactcctgggctcaagcaatcctactgcctcagcctcctgatagctgggactacaggcacacgccaccatgmtgggctaatttttttcttactttttttttttctttttgtagagatgggggtctcactgtcttgtccaggctggtcgtgaagtcctgggctcaagcagtcc

SEQ ID NO: 63293 - DNA, 201 bp, Homo sapiens
gtggttttcaaaagagcgtagagacggtggagaccatgatctgaattcaaataagcagaacatttagtcaagactgacagaatatcatgtcacgttagttmttgaagggaccttagacatatttatggtaaagagactgaggctcagagattaagggccctctcagattacatttgatcagcagtagacacctgactagtg

SEQ ID NO: 63294 - DNA, 201 bp, Homo sapiens
gtcacgcaggctagagtgtagtggcatgatctcagctcactgcaacctccacctcccgggttcaagcagttctcctgcctcagcctcccgagtagctgggrttacaggtgtgggccaccatgcctagctaatttttgtatttttagtagagacagggtttcaccatgttggccaggctggtctcgaactcctgacctcatg

SEQ ID NO: 63295 - DNA, 201 bp, Homo sapiens
caggaggctgaggtaggagaatcgcttgaacccaggaggcagaggttgcagtgagctgagcactgcactccaacctaggcaatagagcgagactccgtcamaaaaaaaaaaaaaaaaaaaaaagggcagtggaggggatgtttttatttcttaaattatattttagtttatatatagtcaaggctttgaaatgaatcattt

SEQ ID NO: 63296 - DNA, 201 bp, Homo sapiens
aatttcccttctttgtttagtataattatttttaaagagcgtgaaaatgtgtattctatttttaaaatttaatattttttcagtgctgacatattcaactrtgatttattttgattttcaggtctttagcaatgttaattcaaacctgagagttttaaactatgttggaataatggataccattgagaatatagtaaaatg

SEQ ID NO: 63297 - DNA, 201 bp, Homo sapiens
ttagccttccagagtgctgggattacaggtgtgagccaccgcacctggccaaaataaaaactttattcccactaaatatgtattactcagggaggagttgraaagaaatataatggagaaagaatttaagagagctttgttttggtaaagatttggggaaatgttcagaaaatggttatagaacgacaccgtgcttaataa

SEQ ID NO: 63298 - DNA, 201 bp, Homo sapiens
ataaaattttaggatcataagacatatgattagcttaatgtaagacttttcttttctgaagtaaatgttttcatatagtttattattaccacacactgaawtgtggaccataattaggttacagcaatgattatattaccatattttgatttttagtatcagttgagtagccaggattttaaaattcagattctgaagttt

SEQ ID NO: 63299 - DNA, 201 bp, Homo sapiens
ccagagattccaaaaatttttgatatgggactgtctttccccattactcttctctcttctctcttctctcctccctccctccctccctccttccttccttmctcccttcctccctctctcccttccctcccctcccctccccttccctctttctctcactctttctctctttctccttttctttctcagaatctcgctgtg

SEQ ID NO: 63300 - DNA, 201 bp, Homo sapiens
ttttgtatttttagtagagacggagtttcaccatgttggtcaggctggtctcgggctcccgacctcaggtgatctgcccgcctcggcctcccaaagtgctrggattacaggccactgtgcctggccgaaagctacaatttttaagaagcattttgaaatcttaatgtcaattaatggactcccaattattatctacatgga

SEQ ID NO: 63301 - DNA, 201 bp, Homo sapiens
cttagccctataatcccagcactttgggtggccgagacgggtggatcacttgaagtcaggagtttgtgagcatgctcaccaacatggcggaactctgtctstactagaaatacaaaaattagctgggcgtggtggtgtttgcctgtaatcccagctactcgggaggctgaggcacgagaatcgcttgaacccaggatgtca

SEQ ID NO: 63302 - DNA, 201 bp, Homo sapiens
agagtatttataaattacaataaaaaatgatccaaaaggtgatctgagctaaagacgaacaaacaaaaatgtgatggagttaataatgttagggttgtagttttttttttttttttttttttttgagacagcgtcccactttgtcccccaggctggagtgcagtggcatgatcttggctcacttcagtctccactttctgg

SEQ ID NO: 63303 - DNA, 201 bp, Homo sapiens
accacgcctggctaatttttgtattttttgtagagatggggtttcactatgttgccgaagctggtctcgaactccagagctcaagctatcagtctgcctcrgcctcctaaagtgcttaggtttacaggcgtgagccactgcactggaccctgtagaattttttcattcagttctgctgtgaagactgaagtgctgaatcct

SEQ ID NO: 63304 - DNA, 201 bp, Homo sapiens
tgaatccttaaatatagtttgtggacctctagattttaaactgtgaaacccagtttaaagattttttttttttttttttttttttttgagacagagtctckttctgtcgcccaggctggagtacagtggcgcaatctcagctcactgcaagctctgcctcccaggttcacgccgttctcctgtctcagcctcctgagtagc

SEQ ID NO: 63305 - DNA, 201 bp, Homo sapiens
aatccctcaaattagacatttttattctatacacttggttttgtttaaatttactcatagtgaccttattttgtttttctttgaaataaggtctcactctrttgcctaggctggagtgcagtgatgcgactgaactcctgggctcaagcaatcctactgcctcagcctcctgatagctgggactacaggcacacgccacca

SEQ ID NO: 63306 - DNA, 201 bp, Homo sapiens
tgcactccagcctggacgagagagtgagaccctgtctccaaaaataaataaataaaaagaaaaatacatatattgctctctaggagatgatggggtattgrggaagagagaccatgaagagagaattatgatagaattgtaatgtttcagtgagatgaataattcctgggatggaaataaagatagggtactgttgaagca

SEQ ID NO: 63307 - DNA, 201 bp, Homo sapiens
tcttgcttttctctctctctctgtttttgatgttttgaattgatttaaatttttttctcattgcagttttttctgtttagatgttatatgctctttttctkaatgataaattttgagatttcaacatgaacagttactcttatgttatagaatcttcacagataactataaaatgctttaactccatgcccattgtggctt

SEQ ID NO: 63308 - DNA, 201 bp, Homo sapiens
tttaaaaaaaatgcttaaagaagaaaactctgccttttatttcttgattcagttaaaaagaattgtcttatttctgctgagtaattgcattattaaaaagygtgtgggctgggcacagtggctcacgcctgtaatcttagcactttgggaggcaaaggcgtgtggatcacctgaggtcaggagttcgagaccagcccggcc

SEQ ID NO: 63309 - DNA, 201 bp, Homo sapiens
gccatttgtcttgcttttctctctctctctgtttttgatgttttgaattgatttaaatttttttctcattgcagttttttctgtttagatgttatatgctmtttttcttaatgataaattttgagatttcaacatgaacagttactcttatgttatagaatcttcacagataactataaaatgctttaactccatgcccat

SEQ ID NO: 63310 - DNA, 201 bp, Homo sapiens
tcttggaaatgtctgtctgaatcttccatttaccttcatttctagcagaaactgggaaatttctttttttcttttttcttttctttctctcttttctctgkctctttcttatctttcattattattacttttttttgagatggtgtgttgctctgtctcccaggctggagtgcagtggcatgatcacggctcactgcaaca

SEQ ID NO: 63311 - DNA, 201 bp, Homo sapiens
gcttttgttgcttttaaaattcccagtttgtgttgctgtaagggaggtaacatttctcaccctttctgtaaatgagtttcctgccaaaacctacctgtgartttcaaatgtttagaccaatcaaccaaccaaagaccttgagataacctaagaaggtataacctaagaagggacagttacacagtaattgggaaaacttct

SEQ ID NO: 63312 - DNA, 201 bp, Homo sapiens
taaccattcactaaaatcactctatgttaggaattgtgctacaaaaaggcattgtatattttggatcttttccctacatttaatcctctcaacagcagtgrgttagtgctgttgtgcattttttgttgaggaggagattgaggcttggggaaactaagtaatctgcccaagatgatacagctagtaagtaatgtagtacta

SEQ ID NO: 63313 - DNA, 201 bp, Homo sapiens
tggtctggaactcctgacctcaaatgatccactcaccttggcctcttaaaatgctgggattacaggtgtgagcccctgtgcgcgcggcctcattcttcttytttttttttttttttttggagacagagccttgctctgtcacacgggctggagtgcagtggcacagtcatagctcactgtaacctcaacctcccaggctca

SEQ ID NO: 63314 - DNA, 201 bp, Homo sapiens
aacttgacacaagttgaacagaaactgattatttttggtgctgatccaagagaaatgtatttttaaatactgtacatcctggatctttgttgagtatttartatattgatatatatttttataaggtgaggtaactcaaaatttaagtcttaaatattgatgcagtcatctgtcttctctacattaccatagccagttact

SEQ ID NO: 63315 - DNA, 201 bp, Homo sapiens
ttgaagaatcatggagtcattataagagtctcttgcacaagtgttgagcctacttaatgaatattgaacgaaattacattcacttttccctggaatgaaayctctaagcaagagtaaaaatttagctttttctgaatgtgaacataaggccatgaagtagacataccttgttgaatcattatggggcagaggcccagatat

SEQ ID NO: 63316 - DNA, 201 bp, Homo sapiens
aggatctgagtagattatttttcaaaaaccagccacatgttccagtctgtgtttattgaataaacattccctttctgttttctaattttccttttattacrtgctaagtaattacatatactagtgtctgtgggctttctctttttttcctagcaacttgtttgtatgctgctatacttttgatgattgtcataacgttat

SEQ ID NO: 63317 - DNA, 201 bp, Homo sapiens
tctcttttctctgtctctttcttatctttcattattattacttttttttgagatggtgtgttgctctgtctcccaggctggagtgcagtggcatgatcacrgctcactgcaacacactctgtctcccgggttcaagcgattctgatgcctcagcctcccgattagctgggattacaggcgtctgccactacgcttggctaa

SEQ ID NO: 63318 - DNA, 201 bp, Homo sapiens
acattccctttctgttttctaattttccttttattacatgctaagtaattacatatactagtgtctgtgggctttctctttttttcctagcaacttgtttrtatgctgctatacttttgatgattgtcataacgttataagagaatttctaataggactaacctttttctaatttctcaccttttttcaaaatggtagcac

SEQ ID NO: 63319 - DNA, 201 bp, Homo sapiens
attttttttttgtagagatgggttcttgctttattgctcaagctggtctcgaactcctgacttcaagtaatcctccctcctcatcctacaaaagtgctggrattataggtgtgagccaccacgcctgacctgaaaaaactcttggaaatgtctgtctgaatcttccatttaccttcatttctagcagaaactgggaaattt

SEQ ID NO: 63320 - DNA, 201 bp, Homo sapiens
ttcttttcttttttttttggtgggggggttggggggcgggacagagtctgactgtgtcgcccaggctggagtgcagtggcacagtcttggctcactacaayctctgcctcccaggttcaagcgattcttgtgcctcagcctcctgagtagctaggattacaggtagtcgccacctcacctggctaatttttgtatttttag

SEQ ID NO: 63321 - DNA, 201 bp, Homo sapiens
cggcctcctaaagtgcttaggtttacaggcgtgagccactgcactggaccctgtagaattttttcattcagttctgctgtgaagactgaagtgctgaatcyttaaatatagtttgtggacctctagattttaaactgtgaaacccagtttaaagattttttttttttttttttttttttttgagacagagtctcgttctgt

SEQ ID NO: 63322 - DNA, 201 bp, Homo sapiens
aataaaattaaccatttttaccaggtatatgcaagcaagcatgcaggtaccaacaaggctttgatttttttttaagcaaacatgtcttatttatttataarctagtgccaagtgatgagcatgtaaatgatgggcagtatttatgaaatttcagaaagtggttgtactaaagagcacttgtagcttcagttgtggttttaa

SEQ ID NO: 63323 - DNA, 201 bp, Homo sapiens
ttcttccaccttggcctcccactgttgggatttcaggcatgagccactgtgcctttttttttttttttaagagataaagagtctccctttgttgcccagartggagcacagtggctattaacaggccatcatagctcactacagcctcaacctcctgggctcaagggatcttcctgcctcagcctcctgggatagctggga

SEQ ID NO: 63324 - DNA, 201 bp, Homo sapiens
tgagatgggaaagtattggaaggttttgagcagagtaatgacaagatctgatgtgccttctaaaatgactgttgtggctgccatgttgggtagactatatyagggcaggggtagaggcaagagaccagttagggagctctttcagtatttgaggtgagaggctggatgctgtggctcacgcctataatcctagcactttgg

SEQ ID NO: 63325 - DNA, 201 bp, Homo sapiens
ataactagaataaccaatgcagagaagtccttaaaggacctgatggagctgaaaaccaaggcacgagagctacgtgacgaatgcagaagcctcagtagccratgtgatcaactggcagaaagggtatcagtgatggaagacgaaatgaatgaagtgaagcgagaagagaagtttagagcaaaaagaataaaaagaagtgaa

SEQ ID NO: 63326 - DNA, 201 bp, Homo sapiens
gctggagtacagtggtgcagtcacagctcattgcagtctggaactccagggctcaagagatcctcctgcctcagcctcctgagtagctgggactacaggckcatgccaccatgcctggctaattttttaaaaaaaatttttttgcagagatggggtctcactgtgttggccaggctggtctcaaactcctgggctcaagtt

SEQ ID NO: 63327 - DNA, 201 bp, Homo sapiens
acagcttttatctgaacatcagtctttgagggacagttgaagcactggtatatgtgtgagcgagagattggtgtttttttcaaatgtagaagaggtaactkcttacattttttgctcttaaaagtatattatttcataatattcaaatttgccttgggatttaaagtataaattgtcattttagtaacacaattgaatatt

SEQ ID NO: 63328 - DNA, 201 bp, Homo sapiens
tgttctcctcctgatatatgtgatgtgtgattttcagtctgtgcagaaccttaatactattttaaaatctgggtcttctaacaccaaacatagtaggggagggccttgaaggcctttagatgaaaggccacacactaacgcagagagactcagataactgcttttgtttagcacaaatcacatcaactgaaccattttaag

SEQ ID NO: 63329 - DNA, 201 bp, Homo sapiens
tatgaaaggtggagaacatgcattaaaaatgggcaaattctggcctgggcatggtggcttatgcctgtaatcccagcacttgggaggctgaagcgggcagrtcatctgaggtcaggagtttgagaccagcctggccaaaataatgaaatcctgtctctactaaaactacaaaaattagctgggcatggtagcacacctgta

SEQ ID NO: 63330 - DNA, 201 bp, Homo sapiens
gaaccagaaataccatttgacccaacaatcccattactgggtatatacccaaaggaatataaatcatcctgttacaaagatgcatgcatgcgtatgttcaytgaagcactatctgcagtagcaaagacgtggaatcaacccaaatgcccatcaatgatagactgggacctgggagccattatcctcagcaaactaacacag

SEQ ID NO: 63331 - DNA, 201 bp, Homo sapiens
gaaaggtggagaacatgcattaaaaatgggcaaattctggcctgggcatggtggcttatgcctgtaatcccagcacttgggaggctgaagcgggcagatcrtctgaggtcaggagtttgagaccagcctggccaaaataatgaaatcctgtctctactaaaactacaaaaattagctgggcatggtagcacacctgtagtc

SEQ ID NO: 63332 - DNA, 201 bp, Homo sapiens
cgggtgggatgatcgcttgaacctgggaggcggaggctgcagtgagccgagatcacgccactgcactccagcctgggcgacagaatgaggctttttctttaaaaaaaaaaaaaaaggaaaaaaaaaggcacatttatctcaccttccctcctattctgggaatgctaacatcctcagggaatctcccatattggtccccta

SEQ ID NO: 63333 - DNA, 201 bp, Homo sapiens
ctactttgcatctcattttgtggaagtgattttcagtgtcaattgtttgtttagacacagagtttggccctgttgcccaggctggaatggatcacagctcrttgcaacctccacctcctgggttcaagccatcctcccacctcagcctcctgagtagctgggactacaagcacctgccaccacgcccagctaatttttata

SEQ ID NO: 63334 - DNA, 201 bp, Homo sapiens
tattgctaactaaagtctacactctatttagatttcttttttctttcttttttttttttttgagatggagttttgctcttgttgcccaggctggagtgcartggcgcgttctcagctcactgcagcctccacctcccgggttcaggcaattcttctgcctcagcctcccaagtagctgggactacaggcatgcaccaccat

SEQ ID NO: 63335 - DNA, 201 bp, Homo sapiens
gaatgagaattactgtcacttcctatccttgtcaatatttggtatagtcagcttttgggacttaagccattctaatcaatatgcagtggttgggatgtaatttttttttttttttttttttttttgtgacagtctcactttgtcatccaggctgaagtgcagtggcatgatctcagatcactacaacctccacctcttggg

SEQ ID NO: 63336 - DNA, 201 bp, Homo sapiens
aatgagaattactgtcacttcctatccttgtcaatatttggtatagtcagcttttgggacttaagccattctaatcaatatgcagtggttgggatgtaatttttttttttttttttttttttttgtgacagtctcactttgtcatccaggctgaagtgcagtggcatgatctcagatcactacaacctccacctcttgggt

SEQ ID NO: 63337 - DNA, 201 bp, Homo sapiens
tgggctgggcacagtggctcacgcctgtaatcttagcactttgggaggcaaaggcgtgtggatcacctgaggtcaggagttcgagaccagcccggccaacrtggtgaaaccccatctctactaaaaatccaaaaaaattagccaggtgtggtggcgtgtgcctgtaatcccagctactcaggaggctgagtgaggcaggag

SEQ ID NO: 63338 - DNA, 201 bp, Homo sapiens
ttgagccattgcgctccagcctgggcagcaagagtgaaaactcgatctcaaaaaaaaaattaataatgtgtgtggtacttcaaccagtcttgaagagaatrcagaactggaaagaagaatagacatagaacactcacaacacatggatggaataaaatctaagcatgtctttttaagttatagatatctagcaaaattata

SEQ ID NO: 63339 - DNA, 201 bp, Homo sapiens
tagcctcccaagtaactgggattacaggtgcctgccaccatgccctgctaatttttgtatttttagtagaaatggggtttcaccatgttggccagactggyctctaacttctgacctcaggtaatccacccacctcggtctcccaaagtactgggatcacaggcataagccactgtgcctgcccggcctttttttgtattt

SEQ ID NO: 63340 - DNA, 201 bp, Homo sapiens
agaaagtggatgccactctgtccttaggaaacccacagagaggagagacagtacgggggccaagtgccataatggagtcctgtgatagtgcagaacttcarttagttctgattagggcacagtttctacttctaggggccatccagccgacctcaggggtttcaggtcagcttttcatcctcaccccgcccccgcccctgg

SEQ ID NO: 63341 - DNA, 201 bp, Homo sapiens
gtatggctaggggagagcctgagctatagaatgcagactcttgatgatgactactacatagtcattaaacctggtttaaaacaagacagtggctgattttyacaactataaatttctgaagatggagcagtggtagcatgatctcattgctttattctagtaacatattttttttctttattcacgttataaattttgttt

SEQ ID NO: 63342 - DNA, 201 bp, Homo sapiens
aaaagtaacatgttgcagcaaactagggataatggaaatatcaaacacttcagtattctctgttttcagatacaaggccagttatttgttctaaatgtcarcttggcttggtggttgagataaaaattctaacacctagtttttatgccaccttaaagttatactttctgtgtgttgtactttcaaatgtttaaaaaaata

SEQ ID NO: 63343 - DNA, 201 bp, Homo sapiens
tttcttaatattgttctgcaaagcctctgaaattcccagatgtcataaagttctcttttgaaaattaagaatggccttttagctgggcatggtggctcacrcctgtaatcccagcactttgggaggccgaggcaagtgaatcagctgaggtcgggagttcaagaccagcctgaccaacaatgtgaaaccctatctctacta

SEQ ID NO: 63344 - DNA, 201 bp, Homo sapiens
aggtgcctggagtcccagctacttgggaggctgagacagaactgtttgaacccaggaggcggaggttgcagtgagccgaggtcatgctgctccactccagyctgggtgacagagtgagactgcatcttaaaaaaagaaaaaaaaggggggaggagccaagatggccaaataggaacagctccggtctacagctcccattgt

SEQ ID NO: 63345 - DNA, 201 bp, Homo sapiens
catgctgctccactccagcctgggtgacagagtgagactgcatcttaaaaaaagaaaaaaaaggggggaggagccaagatggccaaataggaacagctccrgtctacagctcccattgtgagcaacgcagaagacgggtgatttctgtatttccaactgaggtaccgggttcatctcactggggagtgccagacagtaggt

SEQ ID NO: 63346 - DNA, 201 bp, Homo sapiens
gccttgaaggacatgaggaagcaggccagatggatcacctgggggcacagcattgcacgcagaagaaacagcaagtgcgaagaccctgagtgggacagtcmctagtttgtgctggtaacagcaaggagtccagtatggctggagctgagggagagggagagtagtaggtaagatcaaagagaaagggcaggggagattgta

SEQ ID NO: 63347 - DNA, 201 bp, Homo sapiens
cagaagacgggtgatttctgtatttccaactgaggtaccgggttcatctcactggggagtgccagacagtaggtgcaggacagtgggtgcagcgcaccacrcgcaagccgaagcagggcgaggcatcacctcacccgggaagcgcaaggggtcagggaattccctttcctagtcaaagaaagcagtgacagagggcacctg

SEQ ID NO: 63348 - DNA, 201 bp, Homo sapiens
cccccgaccgccgtgcctgcctcccacccgccagccacccggccccggccgcgaagtttcggccccgcacgtgacgcggctttcgggcctcttcgggagasggggagtcggactcagctcggctcccgccggggtagcgtccgcggaggagccggtggccgtgcggagcgagcgcggggcggggaccggtcggactctgcc

SEQ ID NO: 63349 - DNA, 201 bp, Homo sapiens
cgaactgggtggagcccaccacagctcaaggaggcctgcctgcatctgtaggcgccacctctgggggcagggcacagacaaaaagacagcagtaacctctrcagacttaaatgtccctctctgacagctttgaagagagtagtggttctcccagcatgcagcttgagatctgagaacgggcagactgcctcctcaagtggg

SEQ ID NO: 63350 - DNA, 201 bp, Homo sapiens
tgtaatttttttttttttttttttttttttgtgacagtctcactttgtcatccaggctgaagtgcagtggcatgatctcagatcactacaacctccacctyttgggttccagtaattctcctgcctggccttcctgagtaactgggattatgggcacccaccaccatgcccagctaatttttgtatttttagtagagatga

SEQ ID NO: 63351 - DNA, 201 bp, Homo sapiens
tttttttttttttttttttttgtgacagtctcactttgtcatccaggctgaagtgcagtggcatgatctcagatcactacaacctccacctcttgggttcmagtaattctcctgcctggccttcctgagtaactgggattatgggcacccaccaccatgcccagctaatttttgtatttttagtagagatgaggtttcacc

SEQ ID NO: 63352 - DNA, 201 bp, Homo sapiens
ataatatttaaaaggtaaattttaagtacaggatgcttatgtaatttttcatttcctgggaatccaaattcttagacttggttattttcctgttttttttycccagcagtaaattctaagttagaggtaaaacttgtgtttaaaatgagaagtataggttgttcccccatctctcatccccaaaagtcatcaccaagattc

SEQ ID NO: 63353 - DNA, 201 bp, Homo sapiens
agtcctttgagaagaacattcaaatccaaagttctcgcccactatcctcagaatatagaatggaacccttttgatcaagatgcggtgaacatggtatgtgttttttttcccctcatttactctttagccttgttttcactttattaatatgaaggtagtgactgtattttgaatgtctaccttatttcatttcatttattc

SEQ ID NO: 63354 - DNA, 201 bp, Homo sapiens
taaggtgattttaagttagtttgagaagggaaggtaatatacagtactaaaagcttgattaaaagctgcttgaagatatttgcttgctaactatcttagtaaaaaaaaaaaaaggtatatttgaatagtgcctcaaagctcacagattacatgtagaaaagtctgttggcccatttttattgagtatgtgcctcatgctta

SEQ ID NO: 63355 - DNA, 201 bp, Homo sapiens
gggcaccatagcaagaccctgtctcaaaataggtaggtaggtaggtaggtaggtaggtaggtagaggtaggtaggtaggtaggtggatggatggatggatrgatagatagatagatagatagatagatagatagatagatagatagaagatagagagatagtcaaccttgagagggtcttagaaataaagtaggtcatagt

SEQ ID NO: 63356 - DNA, 201 bp, Homo sapiens
agacttcactgtaaacatttatatagagaagctgctcctgaccatcaccttccaccgtcttcccagcactcaggtcaccttaggttctcttagtaccttgtatacctttttgtagcacctatctcagttgcagttaaccaattacttagctagtagtcaactgtgtatctcgtgcttaatgtaagcaccatgagaacagga

SEQ ID NO: 63357 - DNA, 201 bp, Homo sapiens
gacttcactgtaaacatttatatagagaagctgctcctgaccatcaccttccaccgtcttcccagcactcaggtcaccttaggttctcttagtaccttgtatacctttttgtagcacctatctcagttgcagttaaccaattacttagctagtagtcaactgtgtatctcgtgcttaatgtaagcaccatgagaacaggag

SEQ ID NO: 63358 - DNA, 201 bp, Homo sapiens
agctccagctgagggaattttcatttatctaaagtttttatttctgtttttttttccccagccgaatttaagattcatatttctgttttaaaaagttgtgmaatgaatatagcaaagtgttaacatttgttgaattcaggagggaaggtatctacacacagtgttaattatttctgttttacttctctatatgctctaatt

SEQ ID NO: 63359 - DNA, 201 bp, Homo sapiens
tgtaacgtaaaatatccgtgctttgggatttgatgaactcttggaaagcattttctgcatcctgctggttgtggaagcgttttccctgcaaaaaattgtcsagatgcttgaagaagtggtcagttggcaagaggtcaggtgaacatggtggatgaggcatgactgcatagcccaattcgttaaacttttgaagtatttgtt

SEQ ID NO: 63360 - DNA, 201 bp, Homo sapiens
tcaggtgaacatggtggatgaggcatgactgcatagcccaattcgttaaacttttgaagtatttgttgtgtgatgtgcggtcaggcattgttgtggaaaakaattgggccctttctgttgaccagtgcccgctgcaggctttgcagtttttgatgcatctcatcgatttgctgagcatacttcttggatgtaatgatttcg

SEQ ID NO: 63361 - DNA, 201 bp, Homo sapiens
cttaggagcactagaatatatagctacagggcattgttgaactttagacaagatcataggatttgacatgttttctgggtcaaatgcagagtttatctagygtcttctcttctgccatcagagcttcccaatcctttcatgttgtcatttgaagaggtgaatcctagcctaaccattaactgtttgtgacattttaatggg

SEQ ID NO: 63362 - DNA, 201 bp, Homo sapiens
ggacgtagtggcatgcgcctgtaatcccagctacttgggaggctgaggcaggagaatggcttgaacccaggaggcggagattgcagtgagccgagactgcrccattgcactccagcctgggtgacagagcgagactccgtctcaaagtaaaaaggaaaaaaaaaaaaagttagttctaagaacagttattaactcgtagta

SEQ ID NO: 63363 - DNA, 201 bp, Homo sapiens
tggctgggcacggtggctcacgcctgtaatcccagcactttgggaggctgaggcagatcccttgaggtcaggagttcgagaccagcctggccaacatggcraaacactgtctctactgaaagtacgaaacttagcgggacgtagtggcatgcgcctgtaatcccagctacttgggaggctgaggcaggagaatggcttgaa

SEQ ID NO: 63364 - DNA, 201 bp, Homo sapiens
cttttgcacatgtcctctctgcctggaatcttctttatccactaagacctatactcgtcctgaggtttcagttgggcttcattttttcctggtagctcctycttttctaatgtgtgtcttcctactattatatgtttttcccatagcaacccttatttaccctatcatagcacttcccttactttatagtttatgattttt

SEQ ID NO: 63365 - DNA, 201 bp, Homo sapiens
aaaggtgatctgagctaaagacgaacaaacaaaaatgtgatggagttaataatgttagggttgtagttttttttttttttttttttttttgagacagcgtmccactttgtcccccaggctggagtgcagtggcatgatcttggctcacttcagtctccactttctgggcttacgcagtactcctgcctcagtcccccaaat

SEQ ID NO: 63366 - DNA, 201 bp, Homo sapiens
taaacttcaagtgtataattgctaaacagatattaataagtgctgtcagattcttacatttccattacactttaattaagctaaacagtataggcaaaacwttcctaatgttaataaaaattaaagatgtaaattctgaaaatcatcagcggttgaacataataggattttaacatttttcttgtgtttttactctttgtc

SEQ ID NO: 63367 - DNA, 201 bp, Homo sapiens
actttggtttttactctaagagaatggggggagccattgcctgatttgaacagggtagagagacctctgacttagttttaaaaggatcatcctggcagctrgctgtattaagactaaattgtgtgtgtgtatgcagggaggttcaagggtagaagcaggaagatctgttgggaagcctgcagtaatttaagtaagggatga

SEQ ID NO: 63368 - DNA, 201 bp, Homo sapiens
tatttactaatagactgcattgactaatgtgatattttacattagtagaacaaatgtacccccttctctaccttgtaatttatatctttcttttagagaastttgttgatttctaatgtaggaggaagaaagtggtatttttgtgtaagcttaactgagttccttgtgtttttgacttcttataaaaatttttttggtgat

SEQ ID NO: 63369 - DNA, 201 bp, Homo sapiens
atatgattagcttaatgtaagacttttcttttctgaagtaaatgttttcatatagtttattattaccacacactgaaatgtggaccataattaggttacarcaatgattatattaccatattttgatttttagtatcagttgagtagccaggattttaaaattcagattctgaagttttaaatgctgctctgttgttaaca

SEQ ID NO: 63370 - DNA, 201 bp, Homo sapiens
aagctgtagtggatcaaaccagcagcaggccaccaaacagtgaccgtgacctttttttggtgcaagtttggctttgggaagtactttagagcttcttcttrgttcagccactaagctggtcatcgccggttgtctaatgaaatccactttttgttgcacatgacaatttgattgagaaatggttcgttgttgctgtgtaga

SEQ ID NO: 63371 - DNA, 201 bp, Homo sapiens
cccattaaaatgatggtccaggctcagtggctcaagcctgtaatcccagcactttgagaggacgaagcaggcggatcatgaggtcaggagtttgagaccakcctggccaacatagtgaaacccatctctactaaaaatacagaaattagccaggtgcagtggcagacgcctgtaatcccagctacttgggaggctgaggca

SEQ ID NO: 63372 - DNA, 201 bp, Homo sapiens
aataaattttagtaattgcaagtgtatttaggcaggtccgagtgcagtggtgttgataactaattcattacaatcagttacagatttctttgttccttctccactcccactgcttcacttgactggcctttaaaaaaataaataaataataaattaaaaagagaaactatatttagtgttaggtaaatataacatggctct

SEQ ID NO: 63373 - DNA, 201 bp, Homo sapiens
ttctgtttttttttccccagccgaatttaagattcatatttctgttttaaaaagttgtgaaatgaatatagcaaagtgttaacatttgttgaattcaggagggaaggtatctacacacagtgttaattatttctgttttacttctctatatgctctaatttcttctttttaatttttttgagatagggtctcactctgttg

SEQ ID NO: 63374 - DNA, 201 bp, Homo sapiens
ttgggaggccgaggtgtgtggatcatgaggtcaggagatcgagaccatcctggctaacacagtgaaaccctgtctctattaaaaataccaaaaattagccrggcatggtggcacacacctgtagtcccagctagtcgggaggctgaggcaggagaatcgcttgaacccaggaggtggaggttgcagtgagctgagatcaca

SEQ ID NO: 63375 - DNA, 201 bp, Homo sapiens
tttttattgagacggagtcttgctctgtcacccaggctggagtgcagtggcgcaatctcagcatattgcaacctccacctcctgggttcaagcgattctcrtgcctcagcctcccaagtccctgggactacaggcgcgcaccaccatgcctggctaatttctttgtatttttagtagagatgaggttttgccatgctggct

SEQ ID NO: 63376 - DNA, 201 bp, Homo sapiens
gggcataagccttgctagacacagctcctggtctgcaccaccatggctcctgtgccgccagccacaggtccagacctagacccctctgttgcccttgaggrgctgaccttattctccacagtgatgctggtggacagcatggcaggggctgaggcagcagaggccattgccaccttgggatctgtgccagagccatcacta

SEQ ID NO: 63377 - DNA, 201 bp, Homo sapiens
tttgtatttttagtagagatgaggttttgccatgctggctaggctggtctcgaactcctgaccctaggtgatctgcctgccttggcctcccaaagtgctgrgattacaggtgtaagccaccgcacccggcccacacctcctcttttaagtagcaggttatgtctcaccgtttgtggtctgtcctgagctctcctatttctg

SEQ ID NO: 63378 - DNA, 201 bp, Homo sapiens
gctcccaactactgtgtttccatggggtatattattagaaccgaataatgatcacagtcttttctgttttgtgtaaagggagcaggtatggtgggaccagyggctgagatgagactgctgtttctctttgaggtggcagtcagtgactgcagagagaaataggaaggaacacaagtgttaacttggctgatttgggtatat

SEQ ID NO: 63379 - DNA, 201 bp, Homo sapiens
gttttgccatgctggctaggctggtctcgaactcctgaccctaggtgatctgcctgccttggcctcccaaagtgctgggattacaggtgtaagccaccgcrcccggcccacacctcctcttttaagtagcaggttatgtctcaccgtttgtggtctgtcctgagctctcctatttctgctctttttttgtttgtttgtttt

SEQ ID NO: 63380 - DNA, 201 bp, Homo sapiens
gcacaatgtgatagatgctgtaaatcagcgtttagaggtgtttatctaactctccctagtgggagatggggaaattttcactgagaatgtaactctgcacyatgagcagatgtttgctaagtgggcaaggattgagtgggggatgtcttaaactgagggaaaacatttgtaaaagcagaaaggggtgaggatatgacagca

SEQ ID NO: 63381 - DNA, 201 bp, Homo sapiens
ttgtggagtctgttcaggagttttagctcattaatatctaccaatttatttcagtttcaaatgaagaagaataagcatttatggatatggttttatactcdatttttttgtaatctgtatgccgagaacaacagagtgaatcctgagattatagagctagatttttaaaaaatttaaagtgacataccccaaaaaattgcc

SEQ ID NO: 63382 - DNA, 201 bp, Homo sapiens
tcctttactcttcttaactgtgttaagggggttttaataacatgtgatacttcatttcttactcactgataaagctatgccataaatttaaaaacattgcrtgtgctgaagagttaccatgaaaacccaaagtgaatcaaagtaggtggatttcagtgatgaaaatgtccttctagactgatttgaaattctgatccacag

SEQ ID NO: 63383 - DNA, 201 bp, Homo sapiens
cagcacagtatgaaaatcagagtatgattcttttttcaaagaactagtggaagaataaaaggggaatttaaacaccattgtctaacttttgataccaataattgaagtctaagaaacatttttgggccttgcttacctcctttggttcttcatagtggaaataaaccactacccacaccacactgcatgcctgtgtgcctt

SEQ ID NO: 63384 - DNA, 201 bp, Homo sapiens
taaacaaactcaaacatttcttctgatttctgtcacctcttctactcaactcaaaaatatcttgtgtgaactcttaattattcaaaggttaatcaagtgcrtagttacatatgcacttgcctctaccacctctctctgcctcctgcattaggtataatgacttctgaaatggttttgctctaggaggtttagtgaattttg

SEQ ID NO: 63385 - DNA, 201 bp, Homo sapiens
ttccccttactttgccgtctaggatcagagagcagtgtgaattttccccttggtgcctgggggtgggggagccagggagaaacacatagtgaagcttcctrttttgtttattaacttccaccccatgtcttatgttcaaccattgatgtaatcaatattatttttatgtgatgggctacacttttggcactccacccccca

SEQ ID NO: 63386 - DNA, 201 bp, Homo sapiens
agttgcctgaagaatttccacagttccccaataaagtggattttatccaagaactctctgaggttcttgttcaatttgggatccctcctgagggcagcctrcattgcagtgagagtaccagcaaactgaagaatatggttctgaaagacttggtcaatgacaaaaagaacggcaatgtctgtactaataacatcagcatgt

SEQ ID NO: 63387 - DNA, 201 bp, Homo sapiens
tttgttaaaaaaaaaaaaaaaggaaaaaggaaagcagtttatagatgaatacttaaatagtttcattttgtacaagtcacctggttttgttcccatgtgtkaggaagaaatgagttggacagaattagaagtcttgtcactgaagtaattaaagttattacagagcagcttttttagattagaaaggaagaagctagaaat

SEQ ID NO: 63388 - DNA, 201 bp, Homo sapiens
taaattttaagtacaggatgcttatgtaatttttcatttcctgggaatccaaattcttagacttggttattttcctgtttttttttcccagcagtaaattytaagttagaggtaaaacttgtgtttaaaatgagaagtataggttgttcccccatctctcatccccaaaagtcatcaccaagattctcttcttttggccag

SEQ ID NO: 63389 - DNA, 201 bp, Homo sapiens
ggttgttcccccatctctcatccccaaaagtcatcaccaagattctcttcttttggccagtgctagtaggaatagctgcatccagtcatttctaaattctyttttttttttttttttttgagacggagccttactctgtcacccaggctagagtgcggtggtgtgatcttggctcactgcaacccccacctcccgggttca

SEQ ID NO: 63390 - DNA, 201 bp, Homo sapiens
gataaactctccttaaggatgtctgacaatttctcttctagaaatgaatgctctcaactcttagaagatggaagtatggagtagaaaaatacagagatgamatgtttgcctaaataagtcagaggaatctaaagaaaataatgatcattagccaaggacttcagttagaaatagtagtttagttgcctaagcaaatatatt

SEQ ID NO: 63391 - DNA, 201 bp, Homo sapiens
atgaaatgtttgcctaaataagtcagaggaatctaaagaaaataatgatcattagccaaggacttcagttagaaatagtagtttagttgcctaagcaaatrtatttaaattatgtgtccttgttcaaaaaaattcctatgtattttatattgttgtctccagcaagatttttgagtgtgactttttcgtccttctgcgatc

SEQ ID NO: 63392 - DNA, 201 bp, Homo sapiens
tataaaataaatagaaaactatgacatgcttttggaaaagttctagatattaactatgtattatttgttgtaggcgaaaattttgaccagagtcctttgaraagaacattcaaatccaaagttctcgcccactatcctcagaatatagaatggaacccttttgatcaagatgcggtgaacatggtatgtgttttttttccc

SEQ ID NO: 63393 - DNA, 201 bp, Homo sapiens
cccaggctggagtgcagtggcacaatcttggctcactgcaacctccacctcctgggttcaggcaatcctcctgcctcagcctcccgagtagctgagattayaggcgcacaccactatgcccagctaatcttttgtatttttagtagagacagggtttcaccatattggccaggctggtgttgaactcctgacctcaagtga

SEQ ID NO: 63394 - DNA, 201 bp, Homo sapiens
gaggtaatctgcttattggcatccatgactatgtaatattctagttgatagatcttatctttaagcctgtgttgtacctaagaattcataggaagaaaacrtggtcaataacttttaagcaaactgtatgaaaatataaggattctattttttatgtctgtcctaatgaaacatcataaatatattttaggtaacaaaaga

SEQ ID NO: 63395 - DNA, 201 bp, Homo sapiens
tgcctagccatatctcacagtaaaattataggaatggggctttcattgctggaggaccattgctggaagacccttttgcccccgccacccccatcctctcscccgtttccttaacattgcagctagaatatttcactggcatctcaaatgcaacatatccaaaactgaattcattattcgtcccaccagtcttttgtcagt

SEQ ID NO: 63396 - DNA, 201 bp, Homo sapiens
ccccgccacccccatcctctcccccgtttccttaacattgcagctagaatatttcactggcatctcaaatgcaacatatccaaaactgaattcattattcrtcccaccagtcttttgtcagtgaatggtacaaccatccacctacttgccaagtccaacaatgtacacatcaccctgaaagttctcacttactcaccctct

SEQ ID NO: 63397 - DNA, 201 bp, Homo sapiens
agtttaagaccagcctgaccaacatagtgaaaccccgtctctactaaaaatacaaaaattggccaggtgtggtggcacatgcctgtaatcccagctactcrggaggctgaggcaggagaatcacttgaacccaggaggcggaggttgtggtgagccgtgatcacgccactgcactccagcctgggcaacagagcgagactc

SEQ ID NO: 63398 - DNA, 201 bp, Homo sapiens
taaacagtgatattactttattggcctgagaggagcctgatggaaagagcctgattacagttctcatgtttcaaggaatattgtatggtaggcctataatytgtcatttttacagacaatgtaaagatgaaaagcaacttaattgcgttatttaggtacagtagaaatctgaatttgtattattgttaccggtggatggag

SEQ ID NO: 63399 - DNA, 201 bp, Homo sapiens
tgtactagaatgtaaaatcttgtatattcttcatagtgaaggactgacaggacccgtttacagtgaaccacttgtaaatcatcttgtttctggtggatggrgccaatggggaaataattaaagtattgagtgtatggagaggatagaagttggtagaaaacaaaaacttaagaaccatactggtgattccaaaattccccc

SEQ ID NO: 63400 - DNA, 201 bp, Homo sapiens
atttgaaatggataatcccaaattacattcataggtttgacattagaatgaagataagccctcattttgagccaagtttaggttcaagctcacaataaaattttttttttttcttgagacaggttctgactctgtcatccagactggagtgcactggtgcaatcttggctcactgcagccttgacctcccatgctctagcg

SEQ ID NO: 63401 - DNA, 201 bp, Homo sapiens
catcctctcccccgtttccttaacattgcagctagaatatttcactggcatctcaaatgcaacatatccaaaactgaattcattattcgtcccaccagtcttttgtcagtgaatggtacaaccatccacctacttgccaagtccaacaatgtacacatcaccctgaaagttctcacttactcaccctctcccatatataat

SEQ ID NO: 63402 - DNA, 201 bp, Homo sapiens
cacagtggctcatgcctgtaatctcagcactttgggaggcggaggcaggcaggcagatcacttgaggtcaggagttcaagaccagcctggccaacatggcraaacccctttctacaaaaaacacaaaaaattagccaggcgtggtggtgcacagctgtaatccaagctactcgggaggctgaggcatgagaatcacttgaa

SEQ ID NO: 63403 - DNA, 201 bp, Homo sapiens
gtccactcggaaggatcacctgaagccaggaattcagaaacagcgtgtacaacaaagcgagacttcgtgtctctaaaaaaatttttaaagaattagccagrtatagtggcaggtgcctgtaccccgagctacccaggaggctaaggcaggaggatcacttgagctcaggggttcaaggctgctgtgagctatgatcgtacc

SEQ ID NO: 63404 - DNA, 201 bp, Homo sapiens
taaactcttgatctctatcttactggtccgatttgtgtgttgtcacgtagaatgaaaatatgtttagacggtataagaaacctctgatggaaaaatctggktgtctccctgcaggttgctaagaaagagtgatgtttcagggaggctgagtcttgaagcagcagcagcagatctgacacttgtccttcacagctcctttcc

SEQ ID NO: 63405 - DNA, 201 bp, Homo sapiens
ttatcctgatttttcactaaacatttgaaatatgtacttttcattattatatatccttttcattactacatacattttagaggctgtataatattacattytgggtatgccttaatttgcttaacattcttttgtcatttataatttttcactgttaaaaccatgctgtcaaataccacatgttcacatttgtaagtggaa

SEQ ID NO: 63406 - DNA, 201 bp, Homo sapiens
tcattaacttgttatgatgaaatcagccttaatgtgaacgtagaattattaaaagattctgccatagcctttccttatacagttattcctaagactaggartaagtggcttttaccccctaccaaatccaggtattcataggttttacctaagtctatatctcattctatccaaatatacatagtaatttaatatgtaaaa

SEQ ID NO: 63407 - DNA, 201 bp, Homo sapiens
ttttgggggcatgtgttcagggtgtaatttgaacgtggctccagcttcatttcactgcagctgtttaggcgcaacctttatgcactgttgacttctcttcwggtggcttccctcagagttattaagtggcagcagaagttaagagtttgtattcgcacatcacaccttccttagaagagatttaactttcctcctctagcc

SEQ ID NO: 63408 - DNA, 201 bp, Homo sapiens
tctagagaaatataagaacatttgctgactcaaactgggaaagttacacacttgtcattataagcctgctttggctaaagtaatctggttactagtagtartctgatcatcagtgacacctctaatttttagttgttttattgtgggatggtgagggggtattgttagtagatagcaaagttaagggttaattagaaatgt

SEQ ID NO: 63409 - DNA, 201 bp, Homo sapiens
ttcaggttttctgagatttcttgtagttcctgacagtttaacaattctgatgaaactcaggttttctgagaaagtatcttgtagttcctgatataaaacartactgtatatcttttaaaaatggaaaaataatagcattttgcagttcatgtttcccgattagatatatagttcttactttttttgatttgttggaagagc

SEQ ID NO: 63410 - DNA, 201 bp, Homo sapiens
tggcaatttttttcatgaagaaccaaataataagtagttgaggtattgtgggcatacagtttctgccacagtcacccagctctgctgttgtagtgtgaagrcatccatagacagtgcataagtggatggttgtgactgaatcccagtgaaactatttacagatcaggtggcagattgtatttgacctaagggtttttctta

SEQ ID NO: 63411 - DNA, 201 bp, Homo sapiens
gttgcattttacttgactaggccaggggtgggcatacatggcccccaggccaaatctgtccagctgactgtttttataaataaaattgtgttggaacaaarccatacttacgtgtttaaaggttggtacaaaagtaattgtggttttggacagaattttaaatcataactaggctcaagcacatccttattaatcaaaata

SEQ ID NO: 63412 - DNA, 201 bp, Homo sapiens
attgatgtaatcaatattatttttatgtgatgggctacacttttggcactccaccccccaatctagaagcacaaccttctttttaactaacaaccttgtcstgattaagagagtatggacagtagaggttaaatactgtttgaagtctactacagatacctgagggataatcagaactttatacatatgcttggcctcttg

SEQ ID NO: 63413 - DNA, 201 bp, Homo sapiens
ccatacttacgtgtttaaaggttggtacaaaagtaattgtggttttggacagaattttaaatcataactaggctcaagcacatccttattaatcaaaatargaaccattacaatcaacacatttttgccaatgagaaataagtttgtttattcctgtaacgtaaaatatccgtgctttgggatttgatgaactcttggaaa

SEQ ID NO: 63414 - DNA, 201 bp, Homo sapiens
ttgtggaagcgttttccctgcaaaaaattgtcgagatgcttgaagaagtggtcagttggcaagaggtcaggtgaacatggtggatgaggcatgactgcatrgcccaattcgttaaacttttgaagtatttgttgtgtgatgtgcggtcaggcattgttgtggaaaagaattgggccctttctgttgaccagtgcccgctgc

SEQ ID NO: 63415 - DNA, 201 bp, Homo sapiens
cttcagccttccaaagtgctaggataacaggcatgagccaccgcacctggctccaagatgacgattttttaaaatttccactcagctcatgaggcacccasttaccgagtttttccacctttccaatttgcttcacatgtcaaacggccatagaatggtcgacgttgagttcttcagcaacttttcatgttgctgaagagg

SEQ ID NO: 63416 - DNA, 201 bp, Homo sapiens
gttgagttcttcagcaacttttcatgttgctgaagagggtcagcttcagtgattactctcaattgatcattgtcaacttctgatggccagccactatgctyctcatctccaaggctgccatctccttttcaaaacttcttgaaccaccactgcactgtgcgttagttagcagtccctgggccaaatgcattgtcgatgttg

SEQ ID NO: 63417 - DNA, 201 bp, Homo sapiens
tccaacaaatgtttttcactcctccctgggtcttttagatgtggggttataatgttgcttttaaatgcagaataattttatactcttggaaataaaaattktttgagatggagtctcgctctgtctcccaggctggagtgcagtggcgtgatctcggctcactacaacatctgcctcctggttcaagcgattctcctgcct

SEQ ID NO: 63418 - DNA, 201 bp, Homo sapiens
ctgaagttttaaatgctgctctgttgttaacagttttttagttgtccatcgggattttacaatacagatggttagaggcagaaattgaatcagatctcaayattatcagtcagtagtaggactataaaataaatagaaaactatgacatgcttttggaaaagttctagatattaactatgtattatttgttgtaggcgaaa

SEQ ID NO: 63419 - DNA, 201 bp, Homo sapiens
caggagtttgagaccagaatgggcaccatagcaagaccctgtctcaaaataggtaggtaggtaggtaggtaggtaggtaggtagaggtaggtaggtaggtrggtggatggatggatggatggatagatagatagatagatagatagatagatagatagatagatagaagatagagagatagtcaaccttgagagggtctta

SEQ ID NO: 63420 - DNA, 201 bp, Homo sapiens
cagacaagaaaagagggtgacttagattagagtggtaagcgtaaagatcaaaacaattactttctgactcaggaggctgaggcgggaggattgcttttacycaggagtttgaggctgcagtaaactgtgattgtaccactgcacttcatcctgagtgatagagcaagacctcacctctaaaaaagaaaaaaaaaaagaagc

SEQ ID NO: 63421 - DNA, 201 bp, Homo sapiens
catattttgatttttagtatcagttgagtagccaggattttaaaattcagattctgaagttttaaatgctgctctgttgttaacagttttttagttgtccrtcgggattttacaatacagatggttagaggcagaaattgaatcagatctcaacattatcagtcagtagtaggactataaaataaatagaaaactatgaca

SEQ ID NO: 63422 - DNA, 201 bp, Homo sapiens
cggagaatgcttgcagtttcccttttcatgcagcagaatgataacagggacaatcttttgattgtcttattatgttttggcttttgttgcttttaaaattyccagtttgtgttgctgtaagggaggtaacatttctcaccctttctgtaaatgagtttcctgccaaaacctacctgtgagtttcaaatgtttagaccaatc

SEQ ID NO: 63423 - DNA, 201 bp, Homo sapiens
ttatataaaactaggtagcatagcctactacaaaccttgactatatgatacagcctgttgctcttattgttataaaagatttaaacattttatttataaamtggtattaccaaccttcccctatttctgaatatttaggtaagaagcaaaaataagttatcctggctttgtgtagtggctcatacctgtaatcacagcact

SEQ ID NO: 63424 - DNA, 201 bp, Homo sapiens
taatgagatcaacactgcttaataaatacgtatactcatctgttcatagagtagaataatatgaaataacctgaattagctgtgaaaatagcagtgcttcrgctgggcgtggtggctcacgcctgtaatcccagcactttgggaggctgaggcgggcggatcacgaggtgaggagatcgagaccatcctggataacacggt

SEQ ID NO: 63425 - DNA, 201 bp, Homo sapiens
agtgggagcaagacgtctcacatgattagaagcaggaggaagaggggcggagagctgctacacacttctaaacaaccagatcttgcgataactcactatcrggaggaacagtaccgaggggatggctctaaaccattcatcaaggaccaccctcatgatccagtcgcctcccaccaggccccacctccaacattggagatt

SEQ ID NO: 63426 - DNA, 201 bp, Homo sapiens
tttttaaatgatacagtcaagagtttattccagagttgagaacctaataaatgttcttttatattgtataccatgctttttttagaaggcaaaaaaaaacyccaaaagcttccattatcacacttcctcttttattttttatttttatttttttttattgagacggagtcttgctctgtcacccaggctggagtgcagtgg

SEQ ID NO: 63427 - DNA, 201 bp, Homo sapiens
tacattcatcaaaactaagaaattaacattggaataatactattaactaaactccaggcttcatttggatttcgtgaatttttccactaataccctttttstgttccactgtccaatccaggataccacattgcatttagttatgtctctttagtctcccctaatctctgcagagactacttcttaaaggattcttgtgga

SEQ ID NO: 63428 - DNA, 201 bp, Homo sapiens
caccatggctcctgtgccgccagccacaggtccagacctagacccctctgttgcccttgaggggctgaccttattctccacagtgatgctggtggacagcrtggcaggggctgaggcagcagaggccattgccaccttgggatctgtgccagagccatcactaggcacatttttgacagtatgtttttattgtataatata

SEQ ID NO: 63429 - DNA, 201 bp, Homo sapiens
tatatacatgtgtatgaggaatttataatatatttctaatttaaggctattgcgaatattaaatctggataaaacctgtctttttgaatcctgttatgttaaaaaaacaacatttatttctggcttgaagttatttgtgtactgcattctgatttttttttttctttctttcacagttgtgcatgcctaaagggctatctt

SEQ ID NO: 63430 - DNA, 201 bp, Homo sapiens
tgtgattcaggatcttgagatgcggagattatcctggttggctctaaatgctatcacatgcacccttctagagagaggcaaagggaagtttgacacacgcwggaggaagtgatgtgaagacaggcagagtttggagtgatgcagctgtaagccaaagaatgcgcatagcaaccagaacttggaagaaacaagaaatgaatt

SEQ ID NO: 63431 - DNA, 201 bp, Homo sapiens
ggtaacatggtgaaaccccgtctctacaaaaaaattaaaaataaggccgggcacagtgtatcacgcctgtaatcccagcactttgggaggccgaggtgggyggatcacctgaggttgtgagttcgagaccagcctgaccaacatggagaaacctcatctctactaaaaatacagagttacccaggcgtggtggtgcatgcc

SEQ ID NO: 63432 - DNA, 201 bp, Homo sapiens
atgctatgtcttaatggatagtgaattgaaggaaattataaaatagtacctgtacactgatagattcttcaaaaaaggttacacaaatatttggattcacttttttttttagacaagttctcactccgtcacccaggctggagtgcagtagtgcaatcatgggtcactgcaaccttgacatcccgtgctcaagctgtcttc

SEQ ID NO: 63433 - DNA, 201 bp, Homo sapiens
attcctttgattaatgtcagtcttctccccaaactggaaattccatgagagcaggcatttgttattttttgtcccctggtgtatttttttattttctattwtatttccagtacacagcacagtgaaatggctccataaacgttacctgagtaagtgaagtaattctctgtaaggtctggctgaagaccttcatgtctccaa

SEQ ID NO: 63434 - DNA, 201 bp, Homo sapiens
gcatttccttatatatccagtgaatcccactccctgggaggtggattcatctctaaattccattagttacttttaccttcagtaaatggtctcagcacagstactgctccatcccatgagtggccacccaggaattaaaggttcctaattccccaccctctcattgtccctcttcccaaaccacaggtttccatgagcctg

SEQ ID NO: 63435 - DNA, 201 bp, Homo sapiens
tctcttctacaccacttaaagccacctcagtgatttttccattgctgttatattgaggtctatgagcctaaatatgttagcaagccctgcccaccctcttktcttaaacctcccctctcttcctgtatctttgccctccagacacattgggcttattttgattttggaatgcttcttacctactccccctatcccccagtc

SEQ ID NO: 63436 - DNA, 201 bp, Homo sapiens
ctagctaggacttctagtaccgtgttgaataacagtggtgaaagtggatatccttgttgtattccagatctcagaggaaaggtttttttttttcctcatcrgtatgatactagctgagagtctgtcatatatggtgtaattatattaagatatgtttcttctataccaagtttttttaaggtttttattatgaagggatgt

SEQ ID NO: 63437 - DNA, 201 bp, Homo sapiens
  misc_feature (1)...(201): n = A,T,C or G, or insertion/deletion polymorphism (see Tables 1-2)
tcagttgcatatttcaactccagaatttctgcgtagttcttttttaattatttaaatctctttgttaaatttttctgatagaattctgaactccttctccntgttatcttgaattttgttgagttttctcaaaacagctatttgaattctctgtctgaaaggtcactgtattagtccattctcgcattgctataaatatct

SEQ ID NO: 63438 - DNA, 201 bp, Homo sapiens
ttgcagtctagactttttttttacccactcttcttaggaaggctttccaggtatttgaacttgggtattgagatctaagccgtgtctgccttagggggcaycccaagcccagtaacctgtggttcttgcggatttgtagagttaccaccttggtagtttcggataagacctggatgaattctctggattaccaggcagaga

SEQ ID NO: 63439 - DNA, 201 bp, Homo sapiens
catttatttcaagaaaattttcaataattccacttattattgatctctagttttattctattgtggtcagagaagatgctttatattatttcagttttttwaaatgttttaagacttgttttgtgacataacatatggtccatccttgagaatgatccatgtgctgaggaaaaagaatgtgtactctgcagctttgggatg

SEQ ID NO: 63440 - DNA, 201 bp, Homo sapiens
actgcgcctggcctgatttttattatttcttctactaatttggggtttggtttgctcttgcttttctagttctttaatatacatcattaaatagttgtttrtttgaggtttttttcttttttgatgtaggcacttatagctataaacttgcctctcagtactgcttttgttgtatcccatagcttttcgtatgttgtgttt

SEQ ID NO: 63441 - DNA, 201 bp, Homo sapiens
gggatcttcctgcctcagcctcctgggatagctgggactaatggcgtgcaccacggtgcctggccagaattctctttatctctttgatacctctatcaccytctctgccacttagaacacaaaatttgtggttagagtagaagtggtagagggatagccagcaaatgccctagaccccagagcttctgtagatttaattgt

SEQ ID NO: 63442 - DNA, 201 bp, Homo sapiens
actaatggcgtgcaccacggtgcctggccagaattctctttatctctttgatacctctatcaccctctctgccacttagaacacaaaatttgtggttagartagaagtggtagagggatagccagcaaatgccctagaccccagagcttctgtagatttaattgtccattgaagaatcatggagtcattataagagtctct

SEQ ID NO: 63443 - DNA, 201 bp, Homo sapiens
cgtcctcccgagtagctgggattacaggcatgcaccaccacgcccagctaattttgtatttttagtagagacgggttttcttcatgttggtcaggctggtstcaaactcccatcttcaggtgatctgcccgccccggcctcccaaaatgctgggattacaggcatgagccaccgtgcctggcctaattgttacttattgtt

SEQ ID NO: 63444 - DNA, 201 bp, Homo sapiens
aagtgctttttaagcatccattgaaatgatcatatggtttttgttcttcattttgttgatatgatgatatatcagattgattgatttgcatatgttgaacyatccttgcatccctgggataaatcctatttagtcatgatgaatgatctttttaatgtgttgttgaatttggtttgctagtattttgttgaggatttttgc

SEQ ID NO: 63445 - DNA, 201 bp, Homo sapiens
gtgggtgcagaactgctatgctttccttggacttacccagcaccttaatgtatttgccagtccagaagctcctctatatttcttcttcttcttcttcttcttttttttttttttttgagatggagtctgtctctgtcacccaggctggagtgcagtggcgtgatcttggctcactgcaacctttgcctccaggttcaggtg

SEQ ID NO: 63446 - DNA, 201 bp, Homo sapiens
gaatgttatcaagtgctttttaagcatccattgaaatgatcatatggtttttgttcttcattttgttgatatgatgatatatcagattgattgatttgcayatgttgaactatccttgcatccctgggataaatcctatttagtcatgatgaatgatctttttaatgtgttgttgaatttggtttgctagtattttgttga

SEQ ID NO: 63447 - DNA, 201 bp, Homo sapiens
cttgagaatgatccatgtgctgaggaaaaagaatgtgtactctgcagctttgggatgaaatgttatgtatgtatctattaggtccatttggtctgattagktccatttggtacagattaagtctgatgttcattgattttctctctggaagatctgtccaacgctgaaaatgggatgttgaagttaccagctattattata

SEQ ID NO: 63448 - DNA, 201 bp, Homo sapiens
  misc_feature (1)...(201): n = A,T,C or G, or insertion/deletion polymorphism (see Tables 1-2)
ctttcctgagatagctttctctattagatcttattttgtccttgtttttgaaaaatagttcattggatgttaaattctatgttaaaagttttttttttttncttagtactctgaggataatattctatcatcttaaatagttcattggatgttaaattatatgttaaaagtttttttctcttagaactctgaggataatat

SEQ ID NO: 63449 - DNA, 201 bp, Homo sapiens
tttttctacttttgtgaagaacattattggtatttttatagggattgcatgaaatctgtagattgctttggggagaatgggcattttaacaatattgagtyttccaacccatgaatatggaatgtctttccagttttttgtgtccttttcaatttcttgctccagtgttttagttttcattgtagggacttttcacttatt

SEQ ID NO: 63450 - DNA, 201 bp, Homo sapiens
gcaccattgactgaagagactgtcctttctccattgtatgttctcggcacctttgtctaaagtgagttcactgtaaatgtgtggatttatttctgcattcyttattagactgtttcactggtctaatgtgtctgtttttatgccagtatcatcctgttttggttactctaactgtagtataatttgaagtcaggtaataaa

SEQ ID NO: 63451 - DNA, 201 bp, Homo sapiens
tcacctaggaaattgggatcagcccagctttcaaagggaggtacatgaatttaggactgcagagtacagcaaattttagttcctgatatggccatgctttyctaagaagtttccaaaggttattgactctcagcttagccttttctactgcacaatgtgatagatgctgtaaatcagcgtttagaggtgtttatctaactc

SEQ ID NO: 63452 - DNA, 201 bp, Homo sapiens
agtcttgaagcagcagcagcagatctgacacttgtccttcacagctcctttcctgtctcccatagtaagggctatgtaaacatttcatgatcagtgctggyacttgcagccgagaatgcggagaatgcttgcagtttcccttttcatgcagcagaatgataacagggacaatcttttgattgtcttattatgttttggctt

SEQ ID NO: 63453 - DNA, 201 bp, Homo sapiens
catagcccgcttgcaggctctggccaagcgtactggtgtggctgtggaaaaaatggacctctctgcttctctgggtgaaaaagacaaggatttaaaactgmattgtgaagaggcagaactaagggactaccagctcaatgtacagctccgagaggtctttgctaaccgttttacacagatgtttgcagattacgaagcatt

SEQ ID NO: 63454 - DNA, 201 bp, Homo sapiens
attaacttccaccccatgtcttatgttcaaccattgatgtaatcaatattatttttatgtgatgggctacacttttggcactccaccccccaatctagaarcacaaccttctttttaactaacaaccttgtcctgattaagagagtatggacagtagaggttaaatactgtttgaagtctactacagatacctgagggata

SEQ ID NO: 63455 - DNA, 201 bp, Homo sapiens
ttgggtggcttaggtggtgtggtggctccacattgatgtcatactgaggacaggggtcaagtactccatgattagtctttgctcttacttcaggagctgcsagaggctgtgcctttcattttctagtgccgtaggtcattgttggcaatacctgagatgaatttctgtgaaactagggagataagccaaattatgcatgtg

SEQ ID NO: 63456 - DNA, 201 bp, Homo sapiens
cacctttttgtacttttttattctggtaacaatatgcagtttctgaggattctgtggatctccgtcatatttttcatgatctgcaagtgaaggctgaaacsctttatatggaattcttgacctggtaaatttgtgatgaatccaatctatgtaaacgagagacttcacaccttttgtcccagtctgtagttcattttgcct

SEQ ID NO: 63457 - DNA, 201 bp, Homo sapiens
agtacagtgtttgtacgatagtggttcatttaaaaattaagctatggaatttttaaaatattggaccataaaaatctgttctaatttgtagattttgtagygttatggaagaaactcctctcttctggacaggtcaagaaaggtttccccaggaggtctcttctgaatagaatctttgtttttttttgagacagggtctcc

SEQ ID NO: 63458 - DNA, 201 bp, Homo sapiens
tttgttctgcttgtggttcattatgtttcctgaaatttaagaattaatgtcctttacccattttggaaaattctcaactatctttgtaaatattgcattcrtgtatctttttttaatcctcctgaaattctagtgaaacttttttttgttgttgttgttgttttgtttttgagacagagtctcactttattgcccaggatg

SEQ ID NO: 63459 - DNA, 201 bp, Homo sapiens
atatctgtagttttgtcctccttttcattcctaatactgtttgtgcattctctttttcccccaattatttttacctgaagtttgtcaattatattacttcyttttgtttgtttggttttttgagacagggcctcaccctgtcgctcatcctggagtgcagtagcacgatctaggctcactgcagtcttgacctccctgggc

SEQ ID NO: 63460 - DNA, 201 bp, Homo sapiens
cacctctatttttttcttgaataaatttttgttccttgctattttctctaagaaaatttttattaagctttcaatatattagcaaaaagtcttaatatttycttgttttcttgacccctgttatatctgtagttttgtcctccttttcattcctaatactgtttgtgcattctctttttcccccaattatttttacctgaa

SEQ ID NO: 63461 - DNA, 201 bp, Homo sapiens
tggtggttgagataaaaattctaacacctagtttttatgccaccttaaagttatactttctgtgtgttgtactttcaaatgtttaaaaaaataggccaggmgtggtgggattacaagcgcttgtaatcccagcactttgggaggccaaggtgggcggatcacaaggtcaagagatccagaccatcctggctaacatgatga

SEQ ID NO: 63462 - DNA, 201 bp, Homo sapiens
ggaggcaaccgaggagattaaggagtgtggatagtgacatggcaggaaaacaggagaatgtcatatcatgttctcaactaagaattttcttgactatttcygtagagcaacatttggggatcatgaaactgtgttaggcaaattagccagaaggtagtttctgttttgctgcattaatttcaaagttaatgatagtcaagt

SEQ ID NO: 63463 - DNA, 201 bp, Homo sapiens
aaggttttgagcagagtaatgacaagatctgatgtgccttctaaaatgactgttgtggctgccatgttgggtagactatatcagggcaggggtagaggcargagaccagttagggagctctttcagtatttgaggtgagaggctggatgctgtggctcacgcctataatcctagcactttggaaggccgaggcaggtggat

SEQ ID NO: 63464 - DNA, 201 bp, Homo sapiens
aggcactggggacagctgtgaagaaagcagtcagaaatccctgccatcatggagcatacgttctagtgtaaagagataatgaaaatacaatcatctctccrtaaccatgggggatggattctagagtgtcccccacaccaaaatcctcggatgctgaagtctcttataataaaatgttgtagcatttgtatataacctatg

SEQ ID NO: 63465 - DNA, 201 bp, Homo sapiens
  misc_feature (1)...(201): n = A,T,C or G, or insertion/deletion polymorphism (see Tables 1-2)
aacagttttgaaagcatctatctgtagtcggttttttaggcactggggacagctgtgaagaaagcagtcagaaatccctgccatcatggagcatacgttcnagtgtaaagagataatgaaaatacaatcatctctccgtaaccatgggggatggattctagagtgtcccccacaccaaaatcctcggatgctgaagtctct

SEQ ID NO: 63466 - DNA, 201 bp, Homo sapiens
gtaaatttttcgcttttcctttggtgggggtggggagactgggaagaatatattaaataataaacaatagtaaacaaaactgttcagccttaaaatacagyccccatcaacccacgtcttggctatcttcttcttaactcagcttcagagcaaaacattttctttttttcatattcttcggaggtagaaacacaaaacatt

SEQ ID NO: 63467 - DNA, 201 bp, Homo sapiens
caggcgcgggggtggccccaagggcacggaccccgcctggcgcgccggccccttcgcttgcagccgcactcggaggcggccggtgagtcaccgggcgcgcrggctgccccccgaccgccgtgcctgcctcccacccgccagccacccggccccggccgcgaagtttcggccccgcacgtgacgcggctttcgggcctcttc

SEQ ID NO: 63468 - DNA, 201 bp, Homo sapiens
ggtgatctgcccgccccggcctcccaaaatgctgggattacaggcatgagccaccgtgcctggcctaattgttacttattgttaatggtactgaggattamcatgtaaggtctttgaaatgaaatatggataagagtgtgccacagccttttacaaaacataagatgattaattacattatatcactagctatttaattca

SEQ ID NO: 63469 - DNA, 201 bp, Homo sapiens
cgcccaccggggctttcgcctccaggcgctgggttattaataacaggcgcgggggtggccccaagggcacggaccccgcctggcgcgccggccccttcgcytgcagccgcactcggaggcggccggtgagtcaccgggcgcgcgggctgccccccgaccgccgtgcctgcctcccacccgccagccacccggccccggccg

SEQ ID NO: 63470 - DNA, 201 bp, Homo sapiens
  misc_feature (1)...(201): n = A,T,C or G, or insertion/deletion polymorphism (see Tables 1-2)
tttcatggaaagtaagagtgaaaaactactcactcacaaccatgagaatggcacaaagccattcatgagagatccacccccaggacccaaacacctcaccnccaacattggggccaacaaaccatgtccaaaccgtagcaccaggccacatacattttttcttggatgactacaaaatcaggggttccccaacaccatccc

SEQ ID NO: 63471 - DNA, 201 bp, Homo sapiens
cagactccacaggtttaagagttcattctcacaagactgtcctcacttctgatgccagccacaaatgaggtatcaggtgtcttggtttatttgtgttactrtaaaatacctgaggctggttaatttataaagaaaagaagtttggcctggtgcagtggcttacacctgtaatcccagcactctgggaagctgagacaggca

SEQ ID NO: 63472 - DNA, 201 bp, Homo sapiens
acaggtttccatgagcctgggctgttataacaaatctcagtttttctgacaccaagtgagagagtctttcctccccaacacctgtcaatttgtgataccarctggatgcccaacagttcaattcattcctaactgaatgtcagactccacaggtttaagagttcattctcacaagactgtcctcacttctgatgccagcca

SEQ ID NO: 63473 - DNA, 201 bp, Homo sapiens
tttatttcttaaattatattttagtttatatatagtcaaggctttgaaatgaatcattttcaaagctaccaatattttaaataagtgtcttaaaaattttrgagtatataattcagacctaagagtacagtttttattcatctatccatttactcaacgaacatttttattgccaggcacaatattaagtaggtgttgagg

SEQ ID NO: 63474 - DNA, 201 bp, Homo sapiens
tggggtgttccacttggaatttatagggggaattgggcagtctcccttctcaaggtaaacagacttcgagtagcttttatccagtccttgagactggctgktccctcaaggattggataaaacagttcaattcatttctgactgaatcatcacctttgtgtctggatcacatatagccatctgtgattgttccatagtgag

SEQ ID NO: 63475 - DNA, 201 bp, Homo sapiens
tctcagctcactgcaacctctgcctccctgaatcagattcaagtgattctcctgccctagcctcccgagtagctgggattacaggcacgcgccaccacacytggcaaattttttgtatttttagtagagatgggtttttaccatgttggccaggctggtctcaaactcctaatgtcaagtgatccacccaccttggcctcc

SEQ ID NO: 63476 - DNA, 201 bp, Homo sapiens
gccactgcactccagggtgacagagcgagattccgtctcaaaaataaataaataaacaagaattattgaaagcatatttctgatctataaagtaagaatartaacacctcctaggtgttgtttttacttttttttttcttttcttttgagatggagtttcgctcttgttgcccaggctggagtgcaatggcgggatcttgg

SEQ ID NO: 63477 - DNA, 201 bp, Homo sapiens
tcagtccaagggaaaaagaggctccctatatgtgagaatctcttccttgcattcctctggtaacaagatccagtataaaccatttctttttcaatagggawctcttttgggcactgtcctctcccattagagtgtttttccaaaatcgccttagataccgtggatatttcaagtttcagcattgttttatgtccttcagtc

SEQ ID NO: 63478 - DNA, 201 bp, Homo sapiens
taattatttctgttttacttctctatatgctctaatttcttctttttaatttttttgagatagggtctcactctgttgcccaggctggagtgcagtggcaygatcagggctcactgcagcctcaacatcctggactcaagcagccctcccacttcagtctcccaaagtgctgggattagaaggtgtgagccacagggccca

SEQ ID NO: 63479 - DNA, 201 bp, Homo sapiens
aactaagggactaccagctcaatgtacagctccgagaggtctttgctaaccgttttacacagatgtttgcagattacgaagcatttgtcattcagactgcscaggacatggaatcctggctgaccaaccgggaacagatgcagaactttgacaaagtaaaaagaaccatagttttccttttgtggttattagtggctttat

SEQ ID NO: 63480 - DNA, 201 bp, Homo sapiens
attttgcctcttgagctactgacagcaaagtccctgccataagtgtggtggctgttctctttagagagagcgcctgctaaatattcagcatgaaccttccsaccagcagaagctgaggactcactgcttccattattacttacagatcacctttttgtatctgaaaaattttaccttaagtaattctctcttcctttcttc

SEQ ID NO: 63481 - DNA, 201 bp, Homo sapiens
ttaatctcagaaggaagttatctttgtggtatctttcattcaaagttcttccaacacatattaagaaaataacaaactatggattttattttaccagtacrtttgtgaagactaatgctgagcctagactaggatactagttgtcatctgaatatgaatgtgtagagaaaatagagatgctatgtcttaatggatagtgaa

SEQ ID NO: 63482 - DNA, 201 bp, Homo sapiens
ctgagacattcctgctgcctctttggaacccctttgaaaaccactccccttagtgttccaagatggatgtgctaagaggcacgtctaattctgtccctctyctaaaaacccttcagaggtttcccattgtcctccccacagttctaacatggcctaccaaggcccttcatgggctagcccctgattatttctcttgctttc

SEQ ID NO: 63483 - DNA, 201 bp, Homo sapiens
tcactcccttccaaggccctgagacattcctgctgcctctttggaacccctttgaaaaccactccccttagtgttccaagatggatgtgctaagaggcacrtctaattctgtccctctcctaaaaacccttcagaggtttcccattgtcctccccacagttctaacatggcctaccaaggcccttcatgggctagcccctg

SEQ ID NO: 63484 - DNA, 201 bp, Homo sapiens
tgagggcagagaggttgttgggggctgagtcatgcagggcttccctgcaggccattataaggacatcagcttttagtgagataagagtccattggagaatkttggcaagagtgacaagatctaacatattttttaaggattgctttggctcttataagggaaatagattatgggggacaagggcagaaacaggctgttaca

SEQ ID NO: 63485 - DNA, 201 bp, Homo sapiens
tgctctaatttgcttttttgtctaacattttcagtctaaaatctaaaataaacagcaagtaataagtcattagcaaaaaaacataaagcgagaaatgcccmttaaaatgatggtccaggctcagtggctcaagcctgtaatcccagcactttgagaggacgaagcaggcggatcatgaggtcaggagtttgagaccagcct

SEQ ID NO: 63486 - DNA, 201 bp, Homo sapiens
tggtggtcactatgtttctgtattgcctacttgatggaaaaagaattacaagctgaagtccaggcactgtggctcacactgtaatcccagcactttgggargctgaggcgagtggatcacttgagaccagaagttcaagaccagcctggccaacatggtgaaacctcgtctctactaaaagtacaaaaaaaaaaaaaaaat

SEQ ID NO: 63487 - DNA, 201 bp, Homo sapiens
cttatattttcaaaggttaagtaatttgcccaaagttaggcagtaagactcagaaattaaatccagatcatttttactctctagctcactttttttctcawctgccttgctgccttcccaaaagaaaaactgtgtaactgagttttgatctacactggaaatgttatgggtcacactggaccctttgtgatatttttgtat

SEQ ID NO: 63488 - DNA, 201 bp, Homo sapiens
ctgctggggaggctgaggcaggagaaccacttgaactcaggaggcggaggttgcagtgagccaagttcatgccactgcactccagcctgggcaacagagcragattccatctcaaaaataaaaaataatcagtcacagcatccaggatcataggtgtataatcctccagctacatcaggaagtccaccagaggcatgctgg

SEQ ID NO: 63489 - DNA, 201 bp, Homo sapiens
cagcggctgagatgagactgctgtttctctttgaggtggcagtcagtgactgcagagagaaataggaaggaacacaagtgttaacttggctgatttgggtrtatttatttattaatggaaatagcccttttttcctgataatatataatcgtcattaagaaaacattttttcttcatcataatgagagtgagagaactctg

SEQ ID NO: 63490 - DNA, 201 bp, Homo sapiens
gtctgtactaataacatcagcatgtatgagttactgaagggcaatgaaaccatagcccgcttgcaggctctggccaagcgtactggtgtggctgtggaaaraatggacctctctgcttctctgggtgaaaaagacaaggatttaaaactgcattgtgaagaggcagaactaagggactaccagctcaatgtacagctccga

SEQ ID NO: 63491 - DNA, 201 bp, Homo sapiens
agatctgagaacgggcagactgcctcctcaagtgggtccctgacccccgagtagcctaactgggaggcaccccccagtaggggtggactgacacctcacayggccaggtactcctctgagacaaaacttccagaagaacgatcaggcagcagcatctgcggttcaccaatatccgctgttctgcagccactgctgctgata

SEQ ID NO: 63492 - DNA, 201 bp, Homo sapiens
actgggaggcaccccccagtaggggtggactgacacctcacacggccaggtactcctctgagacaaaacttccagaagaacgatcaggcagcagcatctgyggttcaccaatatccgctgttctgcagccactgctgctgatacccaggcaaacagggtctggagtggacctccagcaaactccaacagacctgcagctga

SEQ ID NO: 63493 - DNA, 201 bp, Homo sapiens
ccgctgttctgcagccactgctgctgatacccaggcaaacagggtctggagtggacctccagcaaactccaacagacctgcagctgagggtcctgtctgtwagaaggaaaactagcaaacagaaaggacatccacaccaaaaacccatctgtacgtcaccatcatcaaagtccaaaggtagataaaaccacaaagatggga

SEQ ID NO: 63494 - DNA, 201 bp, Homo sapiens
tagcaaacagaaaggacatccacaccaaaaacccatctgtacgtcaccatcatcaaagtccaaaggtagataaaaccacaaagatgggaaaaaaacagcasaaaaactggaaactctaaaaatcagagtgcctctcctcctccaaaggaacgcagctcctcaccagcaacggaacaaagctggacaaagaatgactgacga

SEQ ID NO: 63495 - DNA, 201 bp, Homo sapiens
gatcaactggcagaaagggtatcagtgatggaagacgaaatgaatgaagtgaagcgagaagagaagtttagagcaaaaagaataaaaagaagtgaacaaarcctccaagaaatatgggactatgtgaaaagaccaaatctacatctgattggtgtacctgaaagtgacggggagaatggaaccaagttggaaaacactctg

SEQ ID NO: 63496 - DNA, 201 bp, Homo sapiens
ctctcataattaagcaatttgaacagaaagattagcaagggattggtctttgtatgtttaattactctgaagttataatggaaaacctctcatgggacaayatgtatttacatgtttgcaaataatgctttgctttacattatgtagaaaatattttattccagagtattgtgaactttcaaacatctattctgtagatga

SEQ ID NO: 63497 - DNA, 201 bp, Homo sapiens
aataatagaatttacaatgaataatataatttactataatataacaaccgaccaaagtgtgctgttttattaccaatttctctctctctctctctctctctttcttttgtgacagagtctcgctctgttgcccaagctggggtgcagtggtgaggtctcggctgactgcaacgtccgcctcccaggttcaagcgattctaa

SEQ ID NO: 63498 - DNA, 201 bp, Homo sapiens
gaataatagaatttacaatgaataatataatttactataatataacaaccgaccaaagtgtgctgttttattaccaatttctctctctctctctctctctctttcttttgtgacagagtctcgctctgttgcccaagctggggtgcagtggtgaggtctcggctgactgcaacgtccgcctcccaggttcaagcgattcta

SEQ ID NO: 63499 - DNA, 201 bp, Homo sapiens
tatgcaggtgataaaatacaaaacggctattttaaggaagaaccatactgatctgatggagctgaaaaagtcacctaaataattccagaatataattacartattaacagagaattgacaaacttgaggaaagatctcagagcttaagacttgttcttcgaaatatctcagataaaaatgaagaaaaaaattaaacaataa

SEQ ID NO: 63500 - DNA, 201 bp, Homo sapiens
gataaaattatgcaggtgataaaatacaaaacggctattttaaggaagaaccatactgatctgatggagctgaaaaagtcacctaaataattccagaatayaattacagtattaacagagaattgacaaacttgaggaaagatctcagagcttaagacttgttcttcgaaatatctcagataaaaatgaagaaaaaaatta

SEQ ID NO: 63501 - DNA, 201 bp, Homo sapiens
cagccgggcagaagcgctcctcatttcccagacggggcagccgggtagaagcgctcctcacttcccagacggggtgtatcagtctttaaaatcagcaatartgttacactgctagaactttagaacatacagacatgaaataatatcctcaccagaaaagtactaaccaactctgttactgagaagcttgagaaaacattt

SEQ ID NO: 63502 - DNA, 201 bp, Homo sapiens
cataccatcagagagctccaaaagagcagcctgtgccgacgtgcaccaacccacccacaccctcccctgactgcagcctccttcgcgtcactttgcctgcrctcatttgcccacgtccactccacactgcttagccagcatggtgcctgccctccttctctgacatgggtgtgcacatgtaccccaccatgccactgttgc

SEQ ID NO: 63503 - DNA, 201 bp, Homo sapiens
agggtgcgttttgtgaatccatatcatagatcctttgttgtcataccatcagagagctccaaaagagcagcctgtgccgacgtgcaccaacccacccacamcctcccctgactgcagcctccttcgcgtcactttgcctgcgctcatttgcccacgtccactccacactgcttagccagcatggtgcctgccctccttctc

SEQ ID NO: 63504 - DNA, 201 bp, Homo sapiens
catgagtgttctagtgcacaaggctggattgccaagcttcattatcatgtccacagtggtctgttggttgaaacagtcacaagcctgcccatagtcaagasgtgtggccatagacacttcctcctccacctctccatgaagagtataaaaaaagttaggaccctgtttaaaaactgctacttactttatccagccctctca

SEQ ID NO: 63505 - DNA, 201 bp, Homo sapiens
tgtgtcaggggcaagtcctttaccttggcaagataaacttactttctttcttttttttttattatttaagttctagggtacgtgtgcacaaagtgcaggtytgttacatatgtatacatgtgccatactggtgttctgcacccattaactcttcatttacattaggtatatctcctaatgctgtccctcccccctccgccc

SEQ ID NO: 63506 - DNA, 201 bp, Homo sapiens
atgagtgttctagtgcacaaggctggattgccaagcttcattatcatgtccacagtggtctgttggttgaaacagtcacaagcctgcccatagtcaagagktgtggccatagacacttcctcctccacctctccatgaagagtataaaaaaagttaggaccctgtttaaaaactgctacttactttatccagccctctcat

SEQ ID NO: 63507 - DNA, 201 bp, Homo sapiens
gacagagtctcattctgtcatccaggctggaatgcagtggagtgatcttggctcactgcaatctctgcctcctggcttcaagcgattctcctgcctcagcytccagagtggctgggattataggcatgcatcaccacacccagctaattttttgtatttttagtagatacagggttttgccatgttgaccagactggtctc

SEQ ID NO: 63508 - DNA, 201 bp, Homo sapiens
cctttgtctacaatatgcgttgtaaacaatattgccagtttaccaattgtctttgattttgttcattattattttttgttgcatagaaatttaaaaatctytacagctaaatttattaatattcttcatgcttctatgttttgtgtcattctttaaaaagtcttcttcattctaagattatgaataaatacacccagtttt

SEQ ID NO: 63509 - DNA, 201 bp, Homo sapiens
gatttcattctcttgtatggatgaatagcattccattgagtatatatacaccacattttctttatcccttcatttgtcatgggtacttagattgtttccayattttgcctattgtaaatagtgctgtgaaaaatgagagaatgcagatatctctttgacttaactgatgttttttcatttggttatgtaaacagatgacct

SEQ ID NO: 63510 - DNA, 201 bp, Homo sapiens
tgttgcaggttgttggatctttccagatcaccacaccacatcacccagccactctgcccaatgggagggcagacagtgttccagtgtaggaggaaggggtrtaaggtgcgggcagtttgtgaggagggcaccaacgagagctactgtgagaaagtctgcatggtcaaaaagtggattaccaagaacaaagcatcataatgt

SEQ ID NO: 63511 - DNA, 201 bp, Homo sapiens
gtgtgttctaacacgcaaacactatggaacccacctgagtcccacttggatcatttcaaatggctccatatttttctgttcccaattaaacttcctagaaygtctcacaggaagctcacattgataaactttttgagtaatccaggaactcttagaacctgataaagtgaaaggatttggcaggaacgtttcagatatgag

SEQ ID NO: 63512 - DNA, 201 bp, Homo sapiens
ggtgggaggaaagtaatagcttgtggactgttagttttgtcatcataacaaactagataccctgaaaaacctctcaatacaaaacacctagaaatgatgarttaaatataatacatagtctttaaaatattgagctcaaaggaaacagaagaaactctcatacaccagaagtggtgagatgatgcttatactagtccccaa

SEQ ID NO: 63513 - DNA, 201 bp, Homo sapiens
tccccaatcctgtttgagggtatttggtgatcttggcgatcaagaggtttgggtttctgacatgctagtacaataggcaaggccttggcctatgcaaggtrgggaggcagaatcaaggctctgcataatggctagggccctcaaaaggctatgctgccagaaaaaagatgctcaggcaaagggaaatgtcaagcaaagttg

SEQ ID NO: 63514 - DNA, 201 bp, Homo sapiens
gtgatcttggcgatcaagaggtttgggtttctgacatgctagtacaataggcaaggccttggcctatgcaaggtggggaggcagaatcaaggctctgcatratggctagggccctcaaaaggctatgctgccagaaaaaagatgctcaggcaaagggaaatgtcaagcaaagttgtctgtttcccctggcctctgggtaga

SEQ ID NO: 63515 - DNA, 201 bp, Homo sapiens
agcccagtgaagtctagggtgtggtgatcccatgttgttgatggggaaaaagggagtgatggggtgcttgagggcttcttaagccatagttcaagcatagygagtgccccctcttcttctgaaagggccagatacctggcctcatcctctccacaaagaactctcttgggatcctcaggggatccaggttagggcagagcc

SEQ ID NO: 63516 - DNA, 201 bp, Homo sapiens
cttctgaaagggccagatacctggcctcatcctctccacaaagaactctcttgggatcctcaggggatccaggttagggcagagccctagggctcagagargggggtcagtaattaacctgggccctagcactgtaaaagtgacagtttgatctccccactgtccttcttcccctgcccaccagggacaaggcttccagaa

SEQ ID NO: 63517 - DNA, 201 bp, Homo sapiens
gggacctcgaccttccaataaatcacatcatagcacacctaccatgacaatatttcacattttcaaaacaattttggtgtaagtatcttgtgcattttttwaaattttttttgagacagagtcttctccatcacacagactggagtgcaatggcatgatcttgcctcactgcaacttccaactcccgggttctggtgattc

SEQ ID NO: 63518 - DNA, 201 bp, Homo sapiens
gtaaaaaacaacatggcttggtaaatttagctctttttcttgacattggcaatgataatacaatgcctgtggtgtataattgtcatggctgacttataaatccctacagatatgtggttacttctctactttccctttctttggcttgggcaactgccacgttgatgcactggagccattcttctgcattcttctcatcct

SEQ ID NO: 63519 - DNA, 201 bp, Homo sapiens
atcaaaatagctctcacagcataaatcttatagataaacctcaccaacatgaacttacaaaccaaaattatgaacacatgaaaaaataagctactaagagwaagaaattaaaactaataaggagcaaatgtggctgggcgcagtagctgatgtctgtaatcctagcactttgggaggctgaggtgggtgggtcacttgagg

SEQ ID NO: 63520 - DNA, 201 bp, Homo sapiens
tccttcttcccctgcccaccagggacaaggcttccagaaagaggggaccactgggaaattctgcctcttgttcagataaagttcttcccgctgcaaggctycgagcttcattcttcatcctcagatctagaatgggatggagggcagttaatttacaaaaaaaattatataaaataattgtatgtaatatatattatcaaa

SEQ ID NO: 63521 - DNA, 201 bp, Homo sapiens
gagatgtaagttgcagtgagccaagaacatgccattgcacccagcctgggcgacagagtgatattccatctcaaaaaaaaaaaaaaaaaaaaaagcgcaaygtgattagtgctccccaaaagttcagaaaatgaacatattaaatgtaagatattttaagtaattaaaacggtaaaatatggattaaacaataagagaaag

SEQ ID NO: 63522 - DNA, 201 bp, Homo sapiens
agaggagaattttaatggccttttcagatagttgtggcaattcttctttgatactctacccaaaactaacaagtggtagtttcttaaatgttaatttgaamccatatcaatgaatttttcatactctgttaaattaaaatgcatagtttatattataccgtgagtggattttttacccatgcataattttgtaacattttg

SEQ ID NO: 63523 - DNA, 201 bp, Homo sapiens
aatattaaatagatgactatgtaacagttgaaatttagtaaaattaatattcttcagtgattttttttaaaaccacaagtgcatggtggtgaagaatacamtgattactagtattgctggatgctgctgccttgattcctgctaaggtgccagcagcatcagtgcaaatgttaacacggtgaaaaagataaatggtattat

SEQ ID NO: 63524 - DNA, 201 bp, Homo sapiens
gtattattttcttcttctcatgaaaatggttttgacctcatgatttgcttgaaagagtcttgggcccatgaggggtctgtggaccatactttgagaattgytgaccaaataaccatttgactttgcacacaaagaaccagtatttccatagcaacatttttttttttttgccattgcaaagattagaaataatcatcccct

SEQ ID NO: 63525 - DNA, 201 bp, Homo sapiens
gagaccaatcctaaagagccttgggcaccatgcagagtggaatgtaatgctttgtagtgtaacataatgaaaaaaagcttgtatagtcatagacctctttyatttcaagagcacaagagttcaataattcactctctacctggttttaagatttgttgcaattctgaatgtctttaaccaattataatttatttaaccagt

SEQ ID NO: 63526 - DNA, 201 bp, Homo sapiens
gtgatcctgagtcttggcatatgtcatttctcttttttgactgtgagagtgtgaaaggcgaggtctaaaatataagaaaattatattcttccttcaacatscagcatatcatcaactcttcagtggaggtttagttgactccccaggcagagccagcagccccctcctctgtctccatcatgcccccacatcacagtgttg

SEQ ID NO: 63527 - DNA, 201 bp, Homo sapiens
gtatatatatgtgtatatatgtatatatgtgtatatatgtatatatgtgtatatatgtatatatgtgtatatatgtatatatgtgtatatatgtgtgtgtrtatatatatatattttttttttcttgagacaggatctcactctgttgcccaggatggagtgcagtggtgcaatcatagctcgctgcagtctcgaactcct

SEQ ID NO: 63528 - DNA, 201 bp, Homo sapiens
ccatgatttcagcttagaattcttactaaccataatgtggaagaattgcagggccttaatgcaagctgtgattctggaattgcctcataaatttacagataaaaaaaaaaagtgggatgttttgcgcttagtaatgtaaagaaagcatttgaagaagttatcacaatcaagtacatctgcaaaattcagaatccaggaagt

SEQ ID NO: 63529 - DNA, 201 bp, Homo sapiens
ctctgtgcctttctctgctcttccctgcttctccaacttccgacttgactctaggccttgcctttctactcctgtctttggtatggttgactttgaaggtstcatctgaaaatgctcctcctacttgatctggaattcctcctcagacaccattctaagttcacctctagggtccccaatctgtgatagtgggtaaaagac

SEQ ID NO: 63530 - DNA, 201 bp, Homo sapiens
actgtttaaatgaaatgatgctcccaaggcatccattctcaattacagaaagcatctctcaatacccctctcaaggttgtaggtctgagattattgtgttstgcctccacagtgttccagatcatcaatttagcctctggatattttcagctttctctgccgacagagctctgtgtgcatctgctattttatttatttatt

SEQ ID NO: 63531 - DNA, 201 bp, Homo sapiens
aggtctgagattattgtgttgtgcctccacagtgttccagatcatcaatttagcctctggatattttcagctttctctgccgacagagctctgtgtgcatytgctattttatttatttattatttttgagacaaagtctcactctgttgcccaggctggagtgatcaagtggcatgatctcggctcactgcaacctctacc

SEQ ID NO: 63532 - DNA, 201 bp, Homo sapiens
tatgaatcttgtggcataaataatacatttggaagaatacttgttgagaagagaaactagaaaaaacctgaataaatggagaatattctgagtttgactgrgtttatcctgaatcaatgaacactgctttttttgctctcaagtgaaatgggatccagcactcaagcaataaattaattaaaacataaggaaataaagaaa

SEQ ID NO: 63533 - DNA, 201 bp, Homo sapiens
cagaatcctctgtcttagttcggctctattgccgcgagcttgactcttcctgggtctgaggaaaagtaaaagtaattttgtcatttcctgaaacttcaagytaaacctttaagctgttcatttcctaaaagggtgaaaacgcgggcacccctcgagctagttcatcgccttttaacctgtgagttctgttaaaaggaagta

SEQ ID NO: 63534 - DNA, 201 bp, Homo sapiens
tacatttggaagaatacttgttgagaagagaaactagaaaaaacctgaataaatggagaatattctgagtttgactgagtttatcctgaatcaatgaacaytgctttttttgctctcaagtgaaatgggatccagcactcaagcaataaattaattaaaacataaggaaataaagaaaattatattatttgtatgtttgaa

SEQ ID NO: 63535 - DNA, 201 bp, Homo sapiens
aggtctaaaatataagaaaattatattcttccttcaacatccagcatatcatcaactcttcagtggaggtttagttgactccccaggcagagccagcagcyccctcctctgtctccatcatgcccccacatcacagtgttgtgatctccacacatctgtttctttcatgggcaagatgtccctcaaacctgatcccttttg

SEQ ID NO: 63536 - DNA, 201 bp, Homo sapiens
tgatctccacacatctgtttctttcatgggcaagatgtccctcaaacctgatcccttttgaatgctccttttatcatgaatggagctaccgccaacccacrggtgccgggattctggagacaattcccgtcaatcaccaagtcctgcaatttgcatttctaaagtctctctctaaccctctatttctctccatttccagtg

SEQ ID NO: 63537 - DNA, 201 bp, Homo sapiens
tacacagcaggtagaaccatcttacggaattgcagatctaatcataccatccctgttttaaacccaacagtagctctcccacagccttcatgacttgcccrcctcccagcctcaccactctcatccaccacactagcctgttttggttcctctaatgtgctacatgccttttctctccaaggtcttctcacattcagttct

SEQ ID NO: 63538 - DNA, 201 bp, Homo sapiens
tttcacaatctcatatcagttgtgcttctttgtaggataggtcgcatggcaatttcataattaagataatactttaacatttttctcttctactaggataygtatcccacaaagtttgagacatcttggtcacctcagcatttctaatgcccagcacaggtcctgcacataggagatgttttatgtatggatttacttatt

SEQ ID NO: 63539 - DNA, 201 bp, Homo sapiens
tctcatatcagttgtgcttctttgtaggataggtcgcatggcaatttcataattaagataatactttaacatttttctcttctactaggatacgtatcccrcaaagtttgagacatcttggtcacctcagcatttctaatgcccagcacaggtcctgcacataggagatgttttatgtatggatttacttattaaataaaa

SEQ ID NO: 63540 - DNA, 201 bp, Homo sapiens
tttacatataagataaatggatccaatggagccagagaatggaaataccacaaagatggcaccagtggagttggtaattttttgaggaggatagaaagackgggatctaaagtccaggggaagggatcagctctggagggagaagagcaactgcttgcttcaagaccagaggggaagaccagctatattttaaactagaga

SEQ ID NO: 63541 - DNA, 201 bp, Homo sapiens
gaaagacggggatctaaagtccaggggaagggatcagctctggagggagaagagcaactgcttgcttcaagaccagaggggaagaccagctatattttaarctagagatactctggcatctcttgaatttactggatttgtggaagttcctttcaccacattgataccagtgaaagccaattttaacttagattagctcag

SEQ ID NO: 63542 - DNA, 201 bp, Homo sapiens
gaaagccaattttaacttagattagctcagaattaaaatttccagttactaaaatatgtatgtgaaaatgtgagattgttttttaaacttatagataaaarttggttttataagaaaaaattattataattctttcaagttacatcactgagtccttagtactttgttttagaaaacaactacctgttcacctgctgagct

SEQ ID NO: 63543 - DNA, 201 bp, Homo sapiens
ttcacagtaatgatgtaattctccttaataacacacacacacacacacacacacacacacacacacacacaaattctgctataaaggtctcttcattttcrttacgtgcaatgcctactaaaactcactgtttaaatgaaatgatgctcccaaggcatccattctcaattacagaaagcatctctcaatacccctctcaag

SEQ ID NO: 63544 - DNA, 201 bp, Homo sapiens
ggaaagaccctgtccctttccttcccactcttcctgactaaaatactcgagcagggcataggagagggaggaggaggggtatctcagagcccgcactcccsctcacccatcttacttcaaacagccggggtcctgactcaagcgttctttggagtgggaggagatggaatttaaatggagtttgaaattgaagttttagtt

SEQ ID NO: 63545 - DNA, 201 bp, Homo sapiens
ttatgcatattttaaaaaacactctttatgaaaaacatctttgcatcttaagtttatttgctttgaaagctttaagtcttttttttttttttttttttttyttttttttttttttttttttgagatggagtctcgctctgttgcccagactggagtgcagtagtgtgatcctggctcatggcaccatccacctcccgggtt

SEQ ID NO: 63546 - DNA, 201 bp, Homo sapiens
atataaagtcagtgaataacttcacagtaatgatgtaattctccttaataacacacacacacacacacacacacacacacacacacacacaaattctgctmtaaaggtctcttcattttcgttacgtgcaatgcctactaaaactcactgtttaaatgaaatgatgctcccaaggcatccattctcaattacagaaagcat

SEQ ID NO: 63547 - DNA, 201 bp, Homo sapiens
acagacacttttcgaaagaagacatacacatggccaacaagcatatgaaaaaatgctcaatattactagtgattagaaaaatgcaaatcaaaaccacaatragataccatctcacaccagttagaatacaccatgggatactatgcagccataaaaagcaatgagatcaagtcctttgcagggaaatggatggagctggaa

SEQ ID NO: 63548 - DNA, 201 bp, Homo sapiens
tcactctgttgcccaggctggagggcagtagcacgatcttggttcactgcaacctctgcctcctgggttcaagcgattctcctgcctcagcctcccgagtrgctgggattacaggcatgtgccactgcacccagttaatttttgtatttttagtagagacaaggtttcaccatgttggccaggctggtctcgaactcctga

SEQ ID NO: 63549 - DNA, 201 bp, Homo sapiens
accaaacaaaaaacccaaatagcacccatagttataatttactattttgccattgaaaaattaaagcatatatgtaatgttaggaagctaatataggaccstattttaatcattgatagacagaggatttaaaggatcaggcttcagtcttagcaaatgaagtagctgtgagagagacatatcatttgtccataagtaagt

SEQ ID NO: 63550 - DNA, 201 bp, Homo sapiens
gactgataggagtttaagaattttcactgaggtcaaatagctactaaacaatgatgccaggtctgcttgacaacaaaatgttgtcattttgttcttaaccrttgcggttaaactcaaatgatccaagttttagatgaaccagcttgttattgaggaggggctggccaacagggtcatacgctataaattcaaaagaaatga

SEQ ID NO: 63551 - DNA, 201 bp, Homo sapiens
taaacatggcttgtatgtggacatcagccatccttagtcctgtcaaaagagagggtaagcaactataggcaaagctgacctcacacctttgaggatgggcrcactgggggcattttaatcattatgttttaaaatttgttacatttgcaatatgctctactgttcacaaaaatgttaacatacagttttgattactgtgaa

SEQ ID NO: 63552 - DNA, 201 bp, Homo sapiens
tgttacatttgcaatatgctctactgttcacaaaaatgttaacatacagttttgattactgtgaaacaaacctgtgtggaactcttaatacttccttctgstaactgctttacattttcttcccccacatttaaatatctctgaaattagtacatgttttacaatcactatgcagtgggaatggctgtgatggggtttctg

SEQ ID NO: 63553 - DNA, 201 bp, Homo sapiens
tgtggaactcttaatacttccttctgctaactgctttacattttcttcccccacatttaaatatctctgaaattagtacatgttttacaatcactatgcartgggaatggctgtgatggggtttctgttgttgcctattgatgtgcaaatactatcttagctctttgtgttgtcacatccattcagatatgtggatagttg

SEQ ID NO: 63554 - DNA, 201 bp, Homo sapiens
gtctagtctttgattctttatggattattgttttgatgtatgtcttagtctgtttatgctgctataacaaaataccttaggctgggtaatttataaagaasagaagtatatttctcacagttatggaggttggaaagtccaagatcaagatgctgacaggttttgtgtctggtgaagatatttctgcttccaagatggcat

SEQ ID NO: 63555 - DNA, 201 bp, Homo sapiens
ctgagattcctagtgtgattctgaacccaggagaatttacttgcattggaattattgcatcatggaatgaaaccaaaaagttcattatttacacttcacasatttactttttttaagatctggctcaaaggcactgagaattatgttgtagattagaggcatccagttaattaaatcacaaggactttgtagcaagtagta

SEQ ID NO: 63556 - DNA, 201 bp, Homo sapiens
ccacatttaaatatctctgaaattagtacatgttttacaatcactatgcagtgggaatggctgtgatggggtttctgttgttgcctattgatgtgcaaatrctatcttagctctttgtgttgtcacatccattcagatatgtggatagttgacagcacacgggctaattgctgtttactatgtcttaaacaggttacaatt

SEQ ID NO: 63557 - DNA, 201 bp, Homo sapiens
tgcccagagcctgtgcccctttccctaccttggtagacgtcttctggattttccaacccctttgtctttcaggagcatctttgggaaggatttgttccaarggatctatactctggtgctattctgaaacaagatgacagtttgtttttttcttggtttctcttctaaaaatttagattttgggaactggaaatccttatt

SEQ ID NO: 63558 - DNA, 201 bp, Homo sapiens
gatacaccagctgcctttacttaaatgctggtgtctcaaggaacccttattaattcttttgtcttcttattctctctgggtaatttcatctaattttgcayctttggtgactacctatatatccagtgatcctgaattttgacctccagaactctatttccaatgtgtaataaattctgtgactcacaataccctcaaact

SEQ ID NO: 63559 - DNA, 201 bp, Homo sapiens
taattacatgattaaacatttagtgactcccaaaaacttagtgaaataaaatgcatagaaattgttgactcagtattctaaataaatctaatctttaggawtgtccatggctttggcaggattcgaggaacatgaatattatggggaaatttttttatgagacttaaaaaggaacaagaacacaacaatataaaacataag

SEQ ID NO: 63560 - DNA, 201 bp, Homo sapiens
atatatctatgtagtgaaaaaaatagatgtttgtaatttggaggtattaaaaagttgaatacaaagaaaaaattatagaactttaaagtcttaattttaayggagatggcacattattttgaagatagagaaaatggctttctatccttttcctatattacacttagtgccttgggcaggatatatgtccaagtatctaaa

SEQ ID NO: 63561 - DNA, 201 bp, Homo sapiens
acacagctgccagagttgttttctaaaatacaaatttaataataataatcttttgctgaaaaaccattggcttctgcagcagagtctggctgcagcctcattttctggctacactgtttctgcacccctttccgccccccgtgtaatacatgtgtgctctatcctgtacatccagcacaccataaactttcatggccccat

SEQ ID NO: 63562 - DNA, 201 bp, Homo sapiens
ttcatgttgttttctcacagttttaaatgacatatctacagaagttcttttatcagtgacttttcccttcctggccccacactatctgagggcatactctstagctccttttattttattttatttttgtgggcatcagatatattctgaagtcaatactaaagctgttagagtatgacatttactaagaatcctgccatt

SEQ ID NO: 63563 - DNA, 201 bp, Homo sapiens
gtttaatttatacaatctgagtggtcagaaactccaagtcaagatattaacatgaaattgttccagtttgatagcacgtccgccatctggcagaacaattaaaaaaaaaaaaaatcctttcctggcagccatgcggactcaccaagggctcctggccatgccctctcccaagattctccataaaattagttggttgcttct

SEQ ID NO: 63564 - DNA, 201 bp, Homo sapiens
ttatcaaaatagctctcacagcataaatcttatagataaacctcaccaacatgaacttacaaaccaaaattatgaacacatgaaaaaataagctactaagagtaagaaattaaaactaataaggagcaaatgtggctgggcgcagtagctgatgtctgtaatcctagcactttgggaggctgaggtgggtgggtcacttga

SEQ ID NO: 63565 - DNA, 201 bp, Homo sapiens
tatcaaaatagctctcacagcataaatcttatagataaacctcaccaacatgaacttacaaaccaaaattatgaacacatgaaaaaataagctactaagagtaagaaattaaaactaataaggagcaaatgtggctgggcgcagtagctgatgtctgtaatcctagcactttgggaggctgaggtgggtgggtcacttgag

SEQ ID NO: 63566 - DNA, 201 bp, Homo sapiens
tcaaaatagctctcacagcataaatcttatagataaacctcaccaacatgaacttacaaaccaaaattatgaacacatgaaaaaataagctactaagagtaagaaattaaaactaataaggagcaaatgtggctgggcgcagtagctgatgtctgtaatcctagcactttgggaggctgaggtgggtgggtcacttgaggt

SEQ ID NO: 63567 - DNA, 201 bp, Homo sapiens
ccgaggcaagagaatcacttgaacttaggagatgtaagttgcagtgagccaagaacatgccattgcacccagcctgggcgacagagtgatattccatctcaaaaaaaaaaaaaaaaaaaaaagcgcaatgtgattagtgctccccaaaagttcagaaaatgaacatattaaatgtaagatattttaagtaattaaaacggt

SEQ ID NO: 63568 - DNA, 201 bp, Homo sapiens
cgaggcaagagaatcacttgaacttaggagatgtaagttgcagtgagccaagaacatgccattgcacccagcctgggcgacagagtgatattccatctcaaaaaaaaaaaaaaaaaaaaaagcgcaatgtgattagtgctccccaaaagttcagaaaatgaacatattaaatgtaagatattttaagtaattaaaacggta

SEQ ID NO: 63569 - DNA, 201 bp, Homo sapiens
gtcttgggcccatgaggggtctgtggaccatactttgagaattgctgaccaaataaccatttgactttgcacacaaagaaccagtatttccatagcaacatttttttttttttgccattgcaaagattagaaataatcatcccctagaaagtggataaaaaattgaatgatatttgaacctgaatccgaatacctaaaaac

SEQ ID NO: 63570 - DNA, 201 bp, Homo sapiens
aggtccttcagtgagggatgttggtgatgcatcagtgcccaccatacttactttaaaaaatctagtatatatttctacaagaatttggaacaaaaacaccrataaaataagtaattaaagttaagtgactcttgttctcatccttgcccatttatgttgtctcatcttaagtgtgatcctgagtcttggcatatgtcattt

SEQ ID NO: 63571 - DNA, 201 bp, Homo sapiens
ttaatctcacaactcaatcacacaaatgctttttcttgagatgaccattgcactttggcatgtaacagagtactttgtgctgacttcttattttaatatamaaaatattaaatagatgactatgtaacagttgaaatttagtaaaattaatattcttcagtgattttttttaaaaccacaagtgcatggtggtgaagaata

SEQ ID NO: 63572 - DNA, 201 bp, Homo sapiens
agtaagagagggactcctgcagtctttgaacttggacctttaataaaaatggaggtatgaaaggcaattccaagtgtctcaaatggaaggtgaactctctstctctctgtctgcatgtgtgtgtgttttaaagacagggtctcttttgttgctcaggctggaatacagtggcttgatcatagcttactggaaccttgaact

SEQ ID NO: 63573 - DNA, 201 bp, Homo sapiens
gtatagaattctaggtgtaaatgtaacttactcttaacattttgcaggtactgttctgttgacttctagttcagtgtggattagacatccaatacattcttttttttttttttttttttgagacaaagtctcactctgttgcccaggctggagggcagtagcacgatcttggttcactgcaacctctgcctcctgggttca

SEQ ID NO: 63574 - DNA, 201 bp, Homo sapiens
ataaagaagagcggatatcattcctattgaaaccattccaaaaaattgaggagggtcttctctctaactcactctataaggctagcattatcctgatactraaacaaagcaaagacacaagaagaaaagaaaacttcaggccaacatccttgatgagcatagatgccaaaatcctcaacaaaatacagcagactgaatcta

SEQ ID NO: 63575 - DNA, 201 bp, Homo sapiens
atgcaaatcaataagcatgattcatcacattgtgaaaggaaaataaatctcagggccccaaaatcactaagccaaagggaagagtcaagctgggaagggcktagggaaaacctgcctcctattctattcctaaataagatagctacaaagataaaaaagctgcaaatctccctcaaaatttgcccacagggaaattccttg

SEQ ID NO: 63576 - DNA, 201 bp, Homo sapiens
tctggaggctgtgtcaggggcaagtcctttaccttggcaagataaacttactttctttcttttttttttattatttaagttctagggtacgtgtgcacaamgtgcaggtctgttacatatgtatacatgtgccatactggtgttctgcacccattaactcttcatttacattaggtatatctcctaatgctgtccctcccc

SEQ ID NO: 63577 - DNA, 201 bp, Homo sapiens
gcaagataaacttactttctttcttttttttttattatttaagttctagggtacgtgtgcacaaagtgcaggtctgttacatatgtatacatgtgccataytggtgttctgcacccattaactcttcatttacattaggtatatctcctaatgctgtccctcccccctccgcccaccccacgacaggcaccagtgtgtgat

SEQ ID NO: 63578 - DNA, 201 bp, Homo sapiens
acagtaagagaagaaatatttaatgatgttacatttgccttttattaaagcaaaaatttaaggacctctacaataccaaagtcatcacactgggctaagaygaataattttaaggggccagatatttctttgaagtaatttcaggtctttcacatgaatacattttgtctactagagaaagtacctgtggttgagaatctt

SEQ ID NO: 63579 - DNA, 201 bp, Homo sapiens
aaaagcatcctcttcactcatcccatactttctatgatgttttgtccaatgtaaacaaatctcagaagcaccaaacaaaaaagcaattccaactattgacrtcagggaagtatccatcagccaaggcaatgtaatcactcctcatctatttcattatgagatacattttcaataatatttcaatttttaatgtttaataat

SEQ ID NO: 63580 - DNA, 201 bp, Homo sapiens
tttataattttagtagtttttggtattttctgcaataaacgttttcataaacagaaaaaatttattttaaaaagatgtgaactgatgataaattaatgagytctctatccctagaagggtttgcgcggttgggaatgccacctgccaatgatgacaagaaagggacttctccatggggtggagaggtttggcctggcaagt

SEQ ID NO: 63581 - DNA, 201 bp, Homo sapiens
ttgatacgaaaataaaaagttaccatagtaatttaaagatggacagtgaatcaactgagacaggaatagatagaaagtcaaaggacactattgcctagctrgtttgtggagatcaaggtcttaaaaatgcaaaagtgaaagattagagtcttccactagagtctttcaacctcagctctaattttaaaatgcacatttctt

SEQ ID NO: 63582 - DNA, 201 bp, Homo sapiens
ttcagaggagaggccaggccaggaccgcatatatagatctggaagttgttgcatagaggtgattactgtagtaagagcgttactccaacaatgactagctrggtaaagaaaggtgggataagaaggagtgtccagagagtaggaaggaagctagaggagtgttgtgtcacagaaactgaagaagaagaatgctttaaggag

SEQ ID NO: 63583 - DNA, 201 bp, Homo sapiens
tacgaaaataaaaagttaccatagtaatttaaagatggacagtgaatcaactgagacaggaatagatagaaagtcaaaggacactattgcctagctagttkgtggagatcaaggtcttaaaaatgcaaaagtgaaagattagagtcttccactagagtctttcaacctcagctctaattttaaaatgcacatttctttcat

SEQ ID NO: 63584 - DNA, 201 bp, Homo sapiens
cataaacagacacttctcaaaagaagacatacatgtggccaacactcatgaaataaagctcagtatcattgatcattagagaaatgcaattcaaaaccacwatgagataccatctcacgccagtcagagtggctattattaaaaagtcaaaaaacaacagatgctggtgaggttgtggagaaaaaggcacacttttacact

SEQ ID NO: 63585 - DNA, 201 bp, Homo sapiens
aaagccatgaatcagaaagtataaaggtcattatttgagttcagaaaaacattctcatagattaactctgctttgtcttaagggatctggaaaattactaygtcttcatttctattcttgatttcttgaataaaaacagaaaattcaggtagtcattttaaacactttaaacatgctttagtgtgaacctatgctaaaaaa

SEQ ID NO: 63586 - DNA, 201 bp, Homo sapiens
aaattcacatgatatatggctatagaagtaagactagaacctaggcatttcattgaatatgctaaacacacatatacacactcatttttctaggtatatastattaatatgtgcatatgtataaatgacaatgacaattgagtatttaaacatttcaagatgtgaacatgaaaattatgctaattctatttttttaaaaat

SEQ ID NO: 63587 - DNA, 201 bp, Homo sapiens
atagctgtctaaattgaactgccctttcaaaaagatgttcagctacagaaaagtccatctgtatatgttataacacacacagatgaagaaagtagcatgastacacagtaggtatcacaaaaaatattctttttcattcaaaaagttaacagaagtcttattaattaaaagagcactggtcagaatacacgatacttgatt

SEQ ID NO: 63588 - DNA, 201 bp, Homo sapiens
caaggataatgaattagttttaatcatctagctaaattcataaatgggacttgctgtttcttttgatgtttttattgaatcataggatctttagaaagaamcttgaaatttcctgtggcatatttcagtgattgctggtcagaactcatttcatctatcacggaaaatgagagtctatctgctttcagaggattaggaaga

SEQ ID NO: 63589 - DNA, 201 bp, Homo sapiens
tcttgcactgagacatgcattctctcctgcctgtggatatcagagctcctggttttggggccttcagactctgggacttacatccctccccccagctcacygccatacccaggttctcaggcctttggccttggactgggagttatatcattgactcccttaattttctggccttaggacacagactgaattacaccacca

SEQ ID NO: 63590 - DNA, 201 bp, Homo sapiens
acagaacactcccaaaggaaatctggtgtatagaagtggatctccgttaagaatagtggaacacacataagagtttcttctgattacatgaagtgccagcrgagagagagagagaggagagggggagagggagagagagagagagagagagagagagagagagagagagagagagagagagaggacagatataaatagaat

SEQ ID NO: 63591 - DNA, 201 bp, Homo sapiens
agtcaactaaaacaagcttccataataaactggaaggggacagtgaatcaactaacataggaataaacagactagacacagaaatgtgtgataaaacaatkctgtaagatggtgaaatggagatggaaaaattattagagtttaaacccaagacaaaacgtttagctattggtggagatcaaaaccttaaaaatgcaagtg

SEQ ID NO: 63592 - DNA, 201 bp, Homo sapiens
aagtggatctccgttaagaatagtggaacacacataagagtttcttctgattacatgaagtgccagcagagagagagagagaggagagggggagagggagagagagagagagagagagagagagagagagagagagagagagagagagaggacagatataaatagaatataagataatgaagtaataggattgatttctac

SEQ ID NO: 63593 - DNA, 201 bp, Homo sapiens
aatgtgtgataaaacaatgctgtaagatggtgaaatggagatggaaaaattattagagtttaaacccaagacaaaacgtttagctattggtggagatcaaraccttaaaaatgcaagtgtaaaagatgatggaggaacttacagactttcctttttgaaacagaagttgatttccagccagtgtaaaatagcgtgttttcc

SEQ ID NO: 63594 - DNA, 201 bp, Homo sapiens
gtggatctccgttaagaatagtggaacacacataagagtttcttctgattacatgaagtgccagcagagagagagagagaggagagggggagagggagagagagagagagagagagagagagagagagagagagagagagagagagaggacagatataaatagaatataagataatgaagtaataggattgatttctacaa

SEQ ID NO: 63595 - DNA, 201 bp, Homo sapiens
tgtatatatatgtgtatatatgtatatatgtgtatatatgtatatatgtgtatatatgtatatatgtgtatatatgtatatatgtgtatatatgtgtgtgwatatatatatatattttttttttcttgagacaggatctcactctgttgcccaggatggagtgcagtggtgcaatcatagctcgctgcagtctcgaactcc

SEQ ID NO: 63596 - DNA, 201 bp, Homo sapiens
  misc_feature (1)...(201): n = A,T,C or G, or insertion/deletion polymorphism (see Tables 1-2)
tttatgtctgagaataagtcatcaccacaaacaggtctgtgggtacctatggaaagtaggtgagttggagatgacccagtaaatgccccttgacatcaccngctaaggattttctagaaagctcagtattagaaaagtattgaacatttgtttttaccaaactccaggttctcaagaagtagctagataagcttctcatac

SEQ ID NO: 63597 - DNA, 201 bp, Homo sapiens
atgatatttgacaatagtataaaacacttcaatactcatgatctcaggcacaacctgtagatgtatttaaagggatttcttgatgctatattgattttttktggacaaataaaagctattttgacacatcaagtacattaatttattttgaccaaaaggatagaaagtaaagccatgcctaagaatgtgttagaagtacaa

SEQ ID NO: 63598 - DNA, 201 bp, Homo sapiens
gtgtatatatgtatatatgtgtatatatgtatatatgtgtatatatgtatatatgtgtatatatgtatatatgtgtatatatgtgtgtgtatatatatatatattttttttttcttgagacaggatctcactctgttgcccaggatggagtgcagtggtgcaatcatagctcgctgcagtctcgaactcctgggttccaga

SEQ ID NO: 63599 - DNA, 201 bp, Homo sapiens
ttatgtctgagaataagtcatcaccacaaacaggtctgtgggtacctatggaaagtaggtgagttggagatgacccagtaaatgccccttgacatcaccagctaaggattttctagaaagctcagtattagaaaagtattgaacatttgtttttaccaaactccaggttctcaagaagtagctagataagcttctcataca

SEQ ID NO: 63600 - DNA, 201 bp, Homo sapiens
atgctgccaaatcccttgggcaatactcctttttcttgaaatattctcttcacttagtttcccattcatcgtcctctcccagtttcttccttttactggaygtatcttctgcatttcctctgctggctgtatctgatctcctgaacttctaaatgttggaatgctataggacagtgtccttgactctctttggctgtctat

SEQ ID NO: 63601 - DNA, 201 bp, Homo sapiens
gtatatatgtatatatgtgtatatatgtatatatgtgtatatatgtatatatgtgtatatatgtatatatgtgtatatatgtgtgtgtatatatatatatattttttttttcttgagacaggatctcactctgttgcccaggatggagtgcagtggtgcaatcatagctcgctgcagtctcgaactcctgggttccagaga

SEQ ID NO: 63602 - DNA, 201 bp, Homo sapiens
tgtctgagaataagtcatcaccacaaacaggtctgtgggtacctatggaaagtaggtgagttggagatgacccagtaaatgccccttgacatcaccagctraggattttctagaaagctcagtattagaaaagtattgaacatttgtttttaccaaactccaggttctcaagaagtagctagataagcttctcatacataa

SEQ ID NO: 63603 - DNA, 201 bp, Homo sapiens
cattgattctcccattcttctattcaaaatgcctttatggttaccatgcactaggcacatgccaggtaaaggggatataaacacaaatatgacagtctcarttattgagatgcagagaaatgcagtaagcaagtgagtacagagtgggataagtaccaggctagatctgtgcacagggtctaactggaacacactgagagg

SEQ ID NO: 63604 - DNA, 201 bp, Homo sapiens
aaatattcgcgggaagctgatgattctgagattcctagtgtgattctgaacccaggagaatttacttgcattggaattattgcatcatggaatgaaaccaraaagttcattatttacacttcacacatttactttttttaagatctggctcaaaggcactgagaattatgttgtagattagaggcatccagttaattaaat

SEQ ID NO: 63605 - DNA, 201 bp, Homo sapiens
ttcattgattctcccattcttctattcaaaatgcctttatggttaccatgcactaggcacatgccaggtaaaggggatataaacacaaatatgacagtctyaattattgagatgcagagaaatgcagtaagcaagtgagtacagagtgggataagtaccaggctagatctgtgcacagggtctaactggaacacactgaga

SEQ ID NO: 63606 - DNA, 201 bp, Homo sapiens
ctctttaaacctgatcttatgaatgttgtagaaccaaatttgtgaatttcagacaggctactgccttttccagagatatttacagtttaagcctttttttwaaaaaaaaaaaaaacaaaagaaagataagctttatcagtaaatggaatttcaaagtcaaaagaggctgagcaagagcctttttatttggaagcagagggt

SEQ ID NO: 63607 - DNA, 201 bp, Homo sapiens
tcttactcatcttaaaaagagcaagaaaacacttgctccatcttagccccttcatcgtagccccattttgttgaaagaatagtccaattattgctttaaastccaaacctcccattgacacttcagcctactaaaatttgatgtttactccctcactcaaatggaattgttcttcccaatgacaccaattgcttcctgatt

SEQ ID NO: 63608 - DNA, 201 bp, Homo sapiens
actcatcttaaaaagagcaagaaaacacttgctccatcttagccccttcatcgtagccccattttgttgaaagaatagtccaattattgctttaaagtccwaacctcccattgacacttcagcctactaaaatttgatgtttactccctcactcaaatggaattgttcttcccaatgacaccaattgcttcctgattgtgg

SEQ ID NO: 63609 - DNA, 201 bp, Homo sapiens
tttctctttcttttctttctttctttctttctttctttctttctttctttctttctttctttctttctttctttccttctctctctctctttcttctcccyttctttttttttttcagggtctcactctgtcacccaggctggagtgcagtgacacaatcatgactcactgcagcctccagatcctgggctcaagtgattc

SEQ ID NO: 63610 - DNA, 201 bp, Homo sapiens
atttgaaataatgattgacttaggtaatatttaagtacatggatccttttggatctgacatagaggattaactactttattttttctcaaggcagatccaratgtttcacttgaagagtaatgtgtgacaaaagtttacaatgaacactgggcaaaattgttggagtccttaaagacatgggtgaatgggatataataact

SEQ ID NO: 63611 - DNA, 201 bp, Homo sapiens
gtgttttccaccttttgatgaacttccatctgacttgcttctctttaagttttccttctatgagaggctggccatcttgatttacaactgttgaaggtagmagaataatcatgccatgtattttccaatatttactaggtaggtgatcaaaagtcagaactgtacagtgtaccagaacccagttagcacacctggaaagta

SEQ ID NO: 63612 - DNA, 201 bp, Homo sapiens
attttttaatatttttttgtatagacaaggtttcatcatgttgctcaggatgataccatggttttaatgacaagatgatttaatgtaatgctatttaatartgatacatttttcctgtctcagtctttcatatttactcaaagaaacatttgaaatagttatgatatctgagatgatttgaaataatgattgacttaggta

SEQ ID NO: 63613 - DNA, 201 bp, Homo sapiens
aatgtttaataattattaagcttggcattatacttatggattttcatgaaggatataactttttaaaaagataactaaatcagaaaaaataacacttggaracggatggtcacaaggaatttaaacaattaaatttcaatttatacatatagttttactcagtgaaaaatgaaatgccattcaggataaaatgctgtgata

SEQ ID NO: 63614 - DNA, 201 bp, Homo sapiens
gtatcttaaaaaactgtttgtttgtttgttttttgtttttgtttttgttgttttttttttttttttttgctattacatctaacatatgcatggctggggamgtgtcattttaaaggtctattgcccatagtacgtccttttaagcaggtgattcagatatgttatcacagcctcttcacagctaaaacaagaaactatttt

SEQ ID NO: 63615 - DNA, 201 bp, Homo sapiens
cagactttcctttttgaaacagaagttgatttccagccagtgtaaaatagcgtgttttccaccttttgatgaacttccatctgacttgcttctctttaagytttccttctatgagaggctggccatcttgatttacaactgttgaaggtagcagaataatcatgccatgtattttccaatatttactaggtaggtgatcaa

SEQ ID NO: 63616 - DNA, 201 bp, Homo sapiens
aaaactgttgaaagccctcattgccattttcaaaagaaattggttcacacaaagagcatctgttagcagtatttaaagtttatctggatatttagctttcygtgcttggtttctttgtttcatagtgttctgtttctaatgttggaataaccaaattaatttggaacagtttgaaatgttggcacaaagtatctagtatgc

SEQ ID NO: 63617 - DNA, 201 bp, Homo sapiens
tcttcacctagtcaacaactgatcacttcacatttcaacttaaatgttgcttcctttggaaagccctctccaaatccagatgagggtggctttcccccatrtgttctcatggcacatggcatgtttcttatatatcagggattatcatttgtagatagatattagtgcttatctgattaatatctttctgtctcattcagt

SEQ ID NO: 63618 - DNA, 201 bp, Homo sapiens
aattttcatagcaccttgaaagtaataaaatttgttccatcagtttggaaaaattctggactgtgcctgtttgaccctatgaacacaacctgccttttgtrcactaccatttcttttttctaatataggtctaataattgcctcacaggattgtccactttcacagagcattttcaggataaaaataataaaatgtatagt

SEQ ID NO: 63619 - DNA, 201 bp, Homo sapiens
gaaatataaacttacaattaatatcaagaaaataatttcagagttctgctttgctttgataggaattgtctgatgtggagcattcttaaagctagtaatgmtctttgcaaatttaaattttccataaacatggtgatttcctttgtgcaaccacatctacagagacttcagttaaagtgcttagggcactgtgtctcccca

SEQ ID NO: 63620 - DNA, 201 bp, Homo sapiens
attcagatatgttatcacagcctcttcacagctaaaacaagaaactatttttctaagatcatcatattccatttgaaaaataacatgtggaatgatctacragggtatgatcatgtatcatctaaaataaattgtttgcatgtagaacatagaggatattcaatcattttctcactttccaattaacacattatttcattt

SEQ ID NO: 63621 - DNA, 201 bp, Homo sapiens
cattttctcactttccaattaacacattatttcatttaaagcaccacaatttggccaggtgtggtggctcatgcctgtaatcccagtgctttgggaggccragacagagggatcatttgaggccaggagttgagaccaggagtttgtgaccaggctgagcaacatagcgagaccctgtctctacagaaaaataaaataaaa

SEQ ID NO: 63622 - DNA, 201 bp, Homo sapiens
tcaccctcacagggagctttaatttatcatctagggaagatatggcattttacaaattctactgctcagtgtagggtttggcaagtgccaccgagaagtayaagccacatgttacagcatttgaagagcagaaattccacttctagttgagacaaggtgacatgagagctgggaccctcatgaagaagagagaattttcca

SEQ ID NO: 63623 - DNA, 201 bp, Homo sapiens
gttttctcacagttttaaatgacatatctacagaagttcttttatcagtgacttttcccttcctggccccacactatctgagggcatactctgtagctccttttattttattttatttttgtgggcatcagatatattctgaagtcaatactaaagctgttagagtatgacatttactaagaatcctgccattttaggccc

SEQ ID NO: 63624 - DNA, 201 bp, Homo sapiens
acagggagctttaatttatcatctagggaagatatggcattttacaaattctactgctcagtgtagggtttggcaagtgccaccgagaagtacaagccacrtgttacagcatttgaagagcagaaattccacttctagttgagacaaggtgacatgagagctgggaccctcatgaagaagagagaattttccagatagagt

SEQ ID NO: 63625 - DNA, 201 bp, Homo sapiens
ttttctcacagttttaaatgacatatctacagaagttcttttatcagtgacttttcccttcctggccccacactatctgagggcatactctgtagctccttttattttattttatttttgtgggcatcagatatattctgaagtcaatactaaagctgttagagtatgacatttactaagaatcctgccattttaggccct

SEQ ID NO: 63626 - DNA, 201 bp, Homo sapiens
tttctcacagttttaaatgacatatctacagaagttcttttatcagtgacttttcccttcctggccccacactatctgagggcatactctgtagctccttttattttattttatttttgtgggcatcagatatattctgaagtcaatactaaagctgttagagtatgacatttactaagaatcctgccattttaggccctt

SEQ ID NO: 63627 - DNA, 201 bp, Homo sapiens
ttctcacagttttaaatgacatatctacagaagttcttttatcagtgacttttcccttcctggccccacactatctgagggcatactctgtagctccttttattttattttatttttgtgggcatcagatatattctgaagtcaatactaaagctgttagagtatgacatttactaagaatcctgccattttaggcccttc

SEQ ID NO: 63628 - DNA, 201 bp, Homo sapiens
tctcacagttttaaatgacatatctacagaagttcttttatcagtgacttttcccttcctggccccacactatctgagggcatactctgtagctccttttattttattttatttttgtgggcatcagatatattctgaagtcaatactaaagctgttagagtatgacatttactaagaatcctgccattttaggcccttct

SEQ ID NO: 63629 - DNA, 201 bp, Homo sapiens
attgcctcacaggattgtccactttcacagagcattttcaggataaaaataataaaatgtatagttttcttttcttttcttttctttttcttttttttcttttttttttttttttgacagtttactctgtcaccgaggctggagtgcagtggcacgatctcagctcattgcaacctccacctctcgggctcaagtgattcc

SEQ ID NO: 63630 - DNA, 201 bp, Homo sapiens
gcaacctctgcctcccaggctcaggtgatcctcccacctcagcctcccgagtagctgggaccacaggtgcacaccaccacacttggctaattttttaatatttttttgtatagacaaggtttcatcatgttgctcaggatgataccatggttttaatgacaagatgatttaatgtaatgctatttaatagtgatacatttt

SEQ ID NO: 63631 - DNA, 201 bp, Homo sapiens
cttcttccttccttccttccttccttccttccttccttccttccttccttccttccttcccttcctctctctctctctccctctctctctctctttctttytttctctttttctctctctttctttctttctctttcttttctttctttctttctttctttctttctttctttctttctttctttctttctttctttcttt

SEQ ID NO: 63632 - DNA, 201 bp, Homo sapiens
taaacagaaaaaatttattttaaaaagatgtgaactgatgataaattaatgagttctctatccctagaagggtttgcgcggttgggaatgccacctgccartgatgacaagaaagggacttctccatggggtggagaggtttggcctggcaagtgttaagattcttccaactccaatagcctgtgatactgttaactgaat

SEQ ID NO: 63633 - DNA, 201 bp, Homo sapiens
ctttctcaaaacactctcataataagcagatgttgtcattctttggccctttagaaagacaacaagcaaaatccctcaagcatcctgaaacacttgccatsacctttcttcttgacagatctgcttttgactagaccaaagtacgcctacaacttgccaatttgcaggtagtttgtactacagacatggtggtgattccct

SEQ ID NO: 63634 - DNA, 201 bp, Homo sapiens
tggggctgaggagacagattatgctgcctaccttccatgggactctgttgggctcactttgtagttctgccattcagggctggcttccccagctcactccrcttgtggctttggacactgctttttctccacactctctcttcgttctccagcttctttgctgactcctcttccttgacccagccctgaaatgcaaagatt

SEQ ID NO: 63635 - DNA, 201 bp, Homo sapiens
tgaacctgggaggcggaggttgcagtgagccaagattgtgccattgcataccagtctggtggcacagggacactccatttcaaaaaaaaccaacaaaaaawatatatatataatgattgacatgtatagatatatatcaatatatagatatgtagatattgattagatattgaaatataaattaactccaaattcttagtt

SEQ ID NO: 63636 - DNA, 201 bp, Homo sapiens
gattaattacatgattaaacatttagtgactcccaaaaacttagtgaaataaaatgcatagaaattgttgactcagtattctaaataaatctaatctttargaatgtccatggctttggcaggattcgaggaacatgaatattatggggaaatttttttatgagacttaaaaaggaacaagaacacaacaatataaaacat

SEQ ID NO: 63637 - DNA, 201 bp, Homo sapiens
tgtttcataagtgtaaggctttgacttggttttaagaatctgatattttaatgacctatccagatcctttcaaaagaagtcattccttgactatttcaaakactttacttctctatttctgctagccttggaaatattcactgttgatttttttcctttggtcacaaccttccacctcctgcttttatcaagcccttcaaa

SEQ ID NO: 63638 - DNA, 201 bp, Homo sapiens
ctcctgagtagctgagactagaggtgcatgccaccatgtccagctaattaagttttatttatttatttatttatttattattattattattattattattwtttttttttatagagacaggatctctatgttgcccaagctggtctcaaatttctgtgctcaagcgatcctcccaccttggcttcccaaagtgctgggatt

SEQ ID NO: 63639 - DNA, 201 bp, Homo sapiens
acttgcatctgattttctttttcaaaaactggaagtagttacatgtctttgtagggtcagagagttagaattatatcacagttattctctctccctgtttkcctcctcttccttctttctctttccccaccttcaactttggaaacaaaccattagtgcttttatagttagagagtaccttgagggaggaaatatttctgt

SEQ ID NO: 63640 - DNA, 201 bp, Homo sapiens
gtaaacaaaacttttcttaatttcactgagttattattattattaattttgctgactgtcatttgatgttgtttatttgaatatgacttctataatttctrctgtgtgtctgaagaaaagggcagaatttgagagtgtttttaaaaaaattcttacatgtttcctgtaagaattttacatgtttgccttagactctttaac

SEQ ID NO: 63641 - DNA, 201 bp, Homo sapiens
tatactaacttattggtttcttatataaattccaaggcatgtctaatagtctgtcattgcaatctgaatcagctttttttttcctgagcaaacacaattaraagggctttaggattaattacatgattaaacatttagtgactcccaaaaacttagtgaaataaaatgcatagaaattgttgactcagtattctaaataaa

SEQ ID NO: 63642 - DNA, 201 bp, Homo sapiens
ctcattttaggagatttggaaaacacaagaacacacaaatgacctaaaatctcatcatttataaataactttggcatgttatatagtatatgtctttatgygtatagtgtatgcagtggcttaatttcttaattttatgagggttactacatggttccacagccatagaaactagctttatagtttctctacttatgatta

SEQ ID NO: 63643 - DNA, 201 bp, Homo sapiens
cttaattttatgagggttactacatggttccacagccatagaaactagctttatagtttctctacttatgattaagtaaaactattgatttcctatctgcktgaacacacagaactatcctaagatactgtggaattgggagcaaaacacaaaacccaaaactttgagtttaagaccagagacttgagagaaagtctgaca

SEQ ID NO: 63644 - DNA, 201 bp, Homo sapiens
gttggatagtggagacaaaagatgatactctctgtgatcttcaatctaaacatttatgttaggacaaattattcccatatctgtataatgctatatttctkccctgacctctacaaatcacagaagcaccgttattcgatcttgttctctttttcaaaaaattctaccttccaaggtggtggttctttaagtttataagtg

SEQ ID NO: 63645 - DNA, 201 bp, Homo sapiens
ttattttcttttgtaaaatgtagtaataacatcaggttaaatcaaggtaaataacctaaagttaaaagattacaaatgtccacaatcccatccctttcttyttcttttaaaatgtaaggtgcctagtaattttcttaaataataatatagaataatagatagcttgtctgtctctgactggcttgaccttgacttgttcca

SEQ ID NO: 63646 - DNA, 201 bp, Homo sapiens
cttccagagggctagcttgtgttaaattcagttcagaaatataaaacttttgggcccatttgacaacaattcaacaacagtttaggagattaaaaaaggartgggtagagattcagaccactgactaatcattctgaacccggaagtctagagagtttctgaggttttagattgcatcatgtataatgtcaaattctcata

SEQ ID NO: 63647 - DNA, 201 bp, Homo sapiens
tttcttccatagctgtcctgtgaaagtaggagtgtgtgtgaatggtgaagcaaagagagggagacatggggtcaggagaagagggagcacagcgtgtgtarggagttaattagaaccagagggcctgggtctgtggctcatgcctgtaattccagcactttgggaggctgaggcggaggaccctttgcaccactgcactcc

SEQ ID NO: 63648 - DNA, 201 bp, Homo sapiens
cgtccagggcctcttttcttgtcttccactctcacttgtcttttctcccctttccatgtttttggttcctttcctgagtttcccttgtctccactcccctscccctttgcttcctctatctctttaacttctgttttcttgatggtggagccaactttagtttcccttaaaaggccataaaaggaaatagaataattttaa

SEQ ID NO: 63649 - DNA, 201 bp, Homo sapiens
ggtatgaaaggcaattccaagtgtctcaaatggaaggtgaactctctgtctctctgtctgcatgtgtgtgtgttttaaagacagggtctcttttgttgctyaggctggaatacagtggcttgatcatagcttactggaaccttgaactcctgggctcaagcgattctcctgcctcagccccccaagtaactaggactacaa

SEQ ID NO: 63650 - DNA, 201 bp, Homo sapiens
tttgggattataagcatgagccactgcacctggccctcttctgtttttgagtaactcatccacgtattcattgaaacttccatttacaagacagtaaactkccatttacaagactgtaaacttccatttacaagacagtaaatcaatctacaacccagtaatagattgagctgctttgggagaatttcctgttatctgtgg

SEQ ID NO: 63651 - DNA, 201 bp, Homo sapiens
tacaacccagtaatagattgagctgctttgggagaatttcctgttatctgtggttgcttccttctcttcctagactttctgcttgtttctgcttgttctcrtgacagtctggaaggaatgacaatagacaataacctccacataactactgttcacatggcacactgactttcatccagactcagaaattactcatactgt

SEQ ID NO: 63652 - DNA, 201 bp, Homo sapiens
agaatcagaattatctgccagcttgttagaatgcacatttccaggaaccaccctaaactcactgaatcaaaattttgggatagggtgagaagccttgcatkttaaacaaggtccacaggtgattcttatgttgctcaaaaacttctaggaaataattagtatcttcgtggtagatgacagtaataggttatatgatatacg

SEQ ID NO: 63653 - DNA, 201 bp, Homo sapiens
gcaacgtctggctcccaggttcaaatgattctctcatctcagccctgcaagtagctgggactacaggcatgcgccaccacaggctaatttttgtatttttygtagatatggggttatgccatattgcttaagctgatctccaactcctgggatcaagtgatccacccacctgggcctcccaaaatgctgggattacagatg

SEQ ID NO: 63654 - DNA, 201 bp, Homo sapiens
tctggctcccaggttcaaatgattctctcatctcagccctgcaagtagctgggactacaggcatgcgccaccacaggctaatttttgtatttttcgtagakatggggttatgccatattgcttaagctgatctccaactcctgggatcaagtgatccacccacctgggcctcccaaaatgctgggattacagatgtgagcc

SEQ ID NO: 63655 - DNA, 201 bp, Homo sapiens
tgcttctgggaattatgaatcctatacagtctatggggaatttctttgtatgtatttaaagtttcaaatttacttcaatctccttccatggttttactgatttttttttctttggtgtgtgtgccagttctaataaagcaaactataattccagaggatatgcaaaaagagggctagaagcattaaatgaaggggtcgtag

SEQ ID NO: 63656 - DNA, 201 bp, Homo sapiens
tccaactcctgggatcaagtgatccacccacctgggcctcccaaaatgctgggattacagatgtgagcccctgtgcctggctgataattgtctaattgtargattaacttttaataagaaagggtttcacacatatccgatgttggtcctactgagtctcattaataagatcgcgtggatagatattactgatgggatctg

SEQ ID NO: 63657 - DNA, 201 bp, Homo sapiens
ttatgagaaactcatcaaagaagatttgcctgggactgctgtgcaatgactgatagagaccaataggaaaagatcaggagagtggcaatgaagaagataatttttttttttttttttgagataggatctcactctgtcacccaggttggaatgcagtggcatgttctcagctcactgcaacgtctggctcccaggttcaaa

SEQ ID NO: 63658 - DNA, 201 bp, Homo sapiens
aagagtgttcttctaggcaaagcaaagagagcagagggaatgtgggacaggataaagctggagaagctgggagagaccattccatgtgaaaccgtgaaggrtatgttatgaagtttggtctttaagagctatgggaagctacctaagatttcatgcaaggggtggcacaacagatttgtgttttgaagagttcactctggc

SEQ ID NO: 63659 - DNA, 201 bp, Homo sapiens
atttctcactggtcaccattttgaaaacacaactgtacaacattatgtgttggtgttgagaacaagtattttttttaagatcagaaaaaatatcatttatrtatgcctttcccctcaatttattttccaacccatcttttatgtttttttcaaaaatgtcttgacattacataaccaaaccaaaatttattaatagtccct

SEQ ID NO: 63660 - DNA, 201 bp, Homo sapiens
caaagataaatttgtttttaacctggaagattttggttggaagataaaattggaaaggttgattactgtctggatgtggaggatcttaaattaaagactgrgccattttaattcatcttgtagacaatgggagggaaaagtaggtgtctatgggttttgagcaagggagaagtactattaaattgacattttaggaaaatt

SEQ ID NO: 63661 - DNA, 201 bp, Homo sapiens
catgctgcccaggctggacttgaacttttgacctcaagtgatcctcccatttctgcctcccaaagttttgggattataagcatgagccactgcacctggcyctcttctgtttttgagtaactcatccacgtattcattgaaacttccatttacaagacagtaaactgccatttacaagactgtaaacttccatttacaaga

SEQ ID NO: 63662 - DNA, 201 bp, Homo sapiens
tctgtgatgccactggtggaggttgggaggatatagaagatgatgagttctttttgttgtgtgttgaatttgaggaatgacagctcattcatacagaaatrtccttaaggttagtttgtgaagtaggattggatggagcttggcagagaagttgatgccaaaactagattatagtgtagtgatcatactggaaacagtaag

SEQ ID NO: 63663 - DNA, 201 bp, Homo sapiens
tagtcctcaggttctccaaggttgaaatgaatgaaaaagtgttaaaggacctagagaggaggggcaggtcacctacaaagggaaccccatcaggctaacarcagacctttcagcagaaaccctataagccagaagagattgggggtctgtattcagcattctaaaaaaaattccagctaaaaacttcatatcagccaaact

SEQ ID NO: 63664 - DNA, 201 bp, Homo sapiens
tattatctaattctcacagcctcccctaggaggaagagttattccattttatggatgaacaaactgagactgataggagtttaagaattttcactgaggtyaaatagctactaaacaatgatgccaggtctgcttgacaacaaaatgttgtcattttgttcttaaccgttgcggttaaactcaaatgatccaagttttaga

SEQ ID NO: 63665 - DNA, 201 bp, Homo sapiens
ttttgttcttaaccgttgcggttaaactcaaatgatccaagttttagatgaaccagcttgttattgaggaggggctggccaacagggtcatacgctataarttcaaaagaaatgatgtttgagaacaggccattgatttgatgaacaggaagtgatggttttgagtagaagtgggggtagtgagcaggagcatcactacag

SEQ ID NO: 63666 - DNA, 201 bp, Homo sapiens
gtgttgattaaaagcttcaccttctcatagtcaacaaaactagaaatatgttcattttccttgcctctcacatctgatcaactatgtgttgttaatactayctcaaatgatttaatctccttcatttcccacatcttataagtagccacattctgtttatattatctctaaaatgttcgcagtgtctctctcttgtccatt

SEQ ID NO: 63667 - DNA, 201 bp, Homo sapiens
aggtccagctctattgaaaagatataatagactatctttagaatatagtaggactctaataaatattttttggtaagttagttataaagaaaatacaaaarccttatggtaccagtaaaggatgagggattattttgttagctgagaaatataactgtgtcaagtctatactgtccaagatccctacctgccatttgcatg

SEQ ID NO: 63668 - DNA, 201 bp, Homo sapiens
tgagaaatataactgtgtcaagtctatactgtccaagatccctacctgccatttgcatggtctgcctcaggcaatgcttccttagttcccttattaaagakaattttagtttaaaaatatatatatatatatttttaatgaaaaatgatactgtaatgaacatattttatggaatacttttgcaagtatatctgtagtgtg

SEQ ID NO: 63669 - DNA, 201 bp, Homo sapiens
ggtaaaaaaacatccttcagtagcttcttgcaggagggtgcattggaggtaaattttttgagaacgtgcatgcctcaaaatatgctaccctcacattcagytgggagtttatttgggtatagaattctaggtgtaaatgtaacttactcttaacattttgcaggtactgttctgttgacttctagttcagtgtggattaga

SEQ ID NO: 63670 - DNA, 201 bp, Homo sapiens
gggtttcaccatgttggccaggatggtctcgatttcctgaccttgtgatccgcctgcctcggcctcccaaagtgctgggattacaggcgtgagccactacrcccggccaaaattgagttttcttttatcacttttaaagttctatgaaagttgacattgaaatttaatggaaaagcttcatattcatagactcacaaggct

SEQ ID NO: 63671 - DNA, 201 bp, Homo sapiens
accggtggatgcggctgaacttcgacctgattcaggagctgagtcatgaagcgcggcgcatgatcgagggcgtggtgtacgagatgcgcgtctacgcggtyaacgccatcggcatgtccaggcccagccctgcctcccagcccttcatgcctatcggtgagcctgcctggcctggtcctgccccccgccccctccccagtt

SEQ ID NO: 63672 - DNA, 201 bp, Homo sapiens
ggcactgttggttcttctgaaggctggggtcttgaggggtcctcatgatagctcatctgagaggacaggtggttgccccaggtcccgtgacaaagctagarcccgagcccctgccctcagtcggtgccacagagatgattttgaactagatgctgacgtggatgcagtcttcccacaggctgtgttccccccatggacccc

SEQ ID NO: 63673 - DNA, 201 bp, Homo sapiens
ataaggtttggccgggggtgggggggcgcccagggtggtcaggaagcctggaggacactgtgaagcatgggggcaccagctagtggggttgtaaagcccckggatgggtgagtatcagggctaagggctcaagggactctcagggattaaccagaacaattcctcattatacagacacggaaaccaaagcttgagaggtta

SEQ ID NO: 63674 - DNA, 201 bp, Homo sapiens
ctcaagacccagctctgccacacacctgctgggctggtggcattgggccagtcgcctctctgagccctatttcccccactgcagcagcatggggaccaccrcactggccctgggggctgagatgggagtgagagtgctgggcacagagggctgctaggtgggagcgcctgggaagagtacacaactcaggggttgctgaga

SEQ ID NO: 63675 - DNA, 201 bp, Homo sapiens
ggcgcatgatcgagggcgtggtgtacgagatgcgcgtctacgcggtcaacgccatcggcatgtccaggcccagccctgcctcccagcccttcatgcctatyggtgagcctgcctggcctggtcctgccccccgccccctccccagttaaaaacctccaataatagcaggtgctctgcaggcagccatgctagacactcaca

SEQ ID NO: 63676 - DNA, 201 bp, Homo sapiens
caccacggtctccctcaagtggcggcccccagagcgcgtgggagcaggaggcctggatggctacagcgtggagtactgcccagagggctgtgagtgtcccygcccccaacccccctccccaaaggaagaacatgctcaccttgccattgagcagattcacctgtagtcaagttttttaggcccacttttgccgaaagttga

SEQ ID NO: 63677 - DNA, 201 bp, Homo sapiens
tcagttcttagtcaactcacctaatcatacgtgccaggaaattcccatgttttctgtagttttagttttagttttttttttttttttttttttttgagatrgagtctcgctctgtcacccagactggagtgcagtcctggcgcgatctggggtcactgtaaccttcacctcccaggttcaagcaattctcccacctcagcc

SEQ ID NO: 63678 - DNA, 201 bp, Homo sapiens
aggagatccagatgagcggcaggtgcagcctggggtggggaggggggctcgggtggaggtggggacccccatagccttgcctcctgcccctctccacatgmgtatctctgactcggtgtggctctcagccccatctctctgggcctaatttcccatccttttgctcctgccggtccctctctctctctccttttgtctcgg

SEQ ID NO: 63679 - DNA, 201 bp, Homo sapiens
ttgaactagatgctgacgtggatgcagtcttcccacaggctgtgttccccccatggacccccgggacatctggctgttggcggaggctgcaagggcctctkgggtctgacttggatctcaccccaactctgcacccccccagctgctgtgtgagaccgagggccgggtccgcgtggagaccaccaaggaccgcagcatctt

SEQ ID NO: 63680 - DNA, 201 bp, Homo sapiens
ccaggtccccatcccccagcgccctcccaggccagctttatctcagttgctgatacccagcctgaggtccttggaggacaaatttggccacattccaagtrggcagacttccccgccccctgccaagggcccgaaatggttgggggaaagggagctgggttcatcacgggtgtctccaagcagggaaagtggacacatgca

SEQ ID NO: 63681 - DNA, 201 bp, Homo sapiens
ccatccagacatgagtgctggccacgtgcccagtgctgcacacacagggtgtgagagaaaccccaaggcttgcagggtaggcgtgggggcttagggctgartccgggtctcatctgggtgggactctgttttatcatcttggtgtcacggctcctggcccacggcctggcactgtctgaatgtttgggcgatgggtgaagg

SEQ ID NO: 63682 - DNA, 201 bp, Homo sapiens
tggtcggcggatcaggtacccctgccccaggccctacctgcaccatccgcagacccccaggggtctgagacgggtgggagcccaatctggctagtgtcccyttctccctccccactccactcccatcctgctcctaatccctttccagtccctcactgcagcctcactgggggtccctctccatagtgatagccatgagga

SEQ ID NO: 63683 - DNA, 201 bp, Homo sapiens
gtaagtcttggggcccctgagtcttggttctgctcactttcccgcaacccacccacgcaggcctcccctccactcacagagggaagagcaaggatcaaaaktgggggtcctggggcccagctccagctttgccactcatgaccatgggtcaattataatctctgtgagcctcagtttcctcttctctaaaatgggaaccct

SEQ ID NO: 63684 - DNA, 201 bp, Homo sapiens
cttggttctgctcactttcccgcaacccacccacgcaggcctcccctccactcacagagggaagagcaaggatcaaaagtgggggtcctggggcccagctycagctttgccactcatgaccatgggtcaattataatctctgtgagcctcagtttcctcttctctaaaatgggaaccctgatagtgccacctcataggata

SEQ ID NO: 63685 - DNA, 201 bp, Homo sapiens
atctcatgatctgcctgcctcggcctcccaaagtgctgggattacaggcgtgagccactgcgtccagactgctttgctttgtttaactgagggcagattcytgatttatttggccagggaacctttttaatgtgtgcatgtgtgcgtgcatgtgtgcgcgcgtgtgtgtgtgtgcatgtgtctgtgtgtgtatgtatatat

SEQ ID NO: 63686 - DNA, 201 bp, Homo sapiens
ataaacaaataaaaatttaaaaaaacatatttaaatcctggagattcctatcagaggagtgggcagtgggagtggggtgtcagtggtgacacagcctgtgsccttgcctccccctccccacccccaggctcagagtgggtggctgccctgcaggggctgacagagcacacatcgatactggtgaaggacctgcccacgggg

SEQ ID NO: 63687 - DNA, 201 bp, Homo sapiens
aaggtgagttgagagatgggtgggaattggggacaataaaccgtcccacctgcctggtaccttgaccctgggaaaggctgggaaggtgagatcctggggcrgatgcccagcctcatggggtcatgaatgggcaagtctgtgaatactcagaggccgcccccagggcagggcttctcaaacggccccctctgaagccccttc

SEQ ID NO: 63688 - DNA, 201 bp, Homo sapiens
caaatggtgagttccagaagcacggggcatgggtgttgggggcatctgcccagaagaggccacagcacttgccacccacccacccggctaggctgaaggayggggtggagctgacccgggaggagaccttcaaataccggttcaagaaggacgggcagagacaccacctgatcatcaacgaggccatgctggaggacgcgg

SEQ ID NO: 63689 - DNA, 201 bp, Homo sapiens
acctctcctctgcccaggtccccccagcgaacccacccacctggcagtagaggacgtctctgacaccacggtctccctcaagtggcggcccccagagcgcrtgggagcaggaggcctggatggctacagcgtggagtactgcccagagggctgtgagtgtccccgcccccaacccccctccccaaaggaagaacatgctca

SEQ ID NO: 63690 - DNA, 201 bp, Homo sapiens
gaggcctggatggctacagcgtggagtactgcccagagggctgtgagtgtccccgcccccaacccccctccccaaaggaagaacatgctcaccttgccatygagcagattcacctgtagtcaagttttttaggcccacttttgccgaaagttgaggacacccagagaaatatctgtcctgttttcagaagtaaaaaagctt

SEQ ID NO: 63691 - DNA, 201 bp, Homo sapiens
gcctcaggtgacctggaccaaagaggggcagcccctggcaggcgaggaggtgagcatccgcaacagccccacagacaccatcctgttcatccgggccgctygccgcgtgcattcaggcacttaccaggtgacggtgcgcattgagaacatggaggacaaggccacgctggtgctgcaggttgttggtgcgtggccaaggcc

SEQ ID NO: 63692 - DNA, 201 bp, Homo sapiens
tccagtccactgccccagcaggcctggccctggttggcaggggtggggtggtccctggagccagtgaccccctgctcactgtcaggaggcgtggtgacccractgggtctgtctcccgcagacaagccaagtcctccccaggatctccgggtgactgacgcctggggtcttaatgtggctctggagtggaagccaccccag

SEQ ID NO: 63693 - DNA, 201 bp, Homo sapiens
ggaggcagaagttgcggtgagccaagatcatgccattgcactccagcctgggagacaagagcgaaactccatctcaaaaataaataaacaaataaaaattwaaaaaaacatatttaaatcctggagattcctatcagaggagtgggcagtgggagtggggtgtcagtggtgacacagcctgtggccttgcctccccctccc

SEQ ID NO: 63694 - DNA, 201 bp, Homo sapiens
tttagggactgattcctggtttgttcagttcttagtcaactcacctaatcatacgtgccaggaaattcccatgttttctgtagttttagttttagtttttkttttttttttttttttttgagatggagtctcgctctgtcacccagactggagtgcagtcctggcgcgatctggggtcactgtaaccttcacctcccaggt

SEQ ID NO: 63695 - DNA, 201 bp, Homo sapiens
tgcgatgaggctcatgggagcactgtcggggacctgggagacttggtggacatgatcacctcaagggggcacctaataaggtttggccgggggtggggggkcgcccagggtggtcaggaagcctggaggacactgtgaagcatgggggcaccagctagtggggttgtaaagcccctggatgggtgagtatcagggctaagg

SEQ ID NO: 63696 - DNA, 201 bp, Homo sapiens
catgtgcacgccctgctgttggctaccccatgggagagactggtcagggggcaggcaaggtgggcagtgtgggtcagggggtggaagaagcagcagagggscgcttccaggctgagtcagctcctctgctccctacttccctcctgccctgttcccaggggaataaggccccagccaggccagccccagatgccccagagg

SEQ ID NO: 63697 - DNA, 201 bp, Homo sapiens
cagactgctttgctttgtttaactgagggcagattcctgatttatttggccagggaacctttttaatgtgtgcatgtgtgcgtgcatgtgtgcgcgcgtgygtgtgtgtgcatgtgtctgtgtgtgtatgtatatatgtgtgtctgtgtctgtgtgtgtgcgtgtatgtatgtgtatttgtgtctgtgtgcatgtgtgtgt

SEQ ID NO: 63698 - DNA, 201 bp, Homo sapiens
gatgaggggagtgcagcccagtctgaggggctgctctaaggctggggcagagcagggatggacctggagctgttcagggcagatgcagaggacatgggaastgatggcctgggacggggaggagaatgtgagaggcaggctggctctccagctcagcatgagctgcctctgaggggcccaggcagcgggaggacagccatg

SEQ ID NO: 63699 - DNA, 201 bp, Homo sapiens
tttcctcttctctaaaatgggaaccctgatagtgccacctcataggatagttataaagatgaggtgacatgatgtatcagacctgtcaagtgctgtcacaygtgtgactgttattattacatcttttcttcttcttcctttttttttatttttattttttttgagacggagtctccctctgtcgcccacgctggagagaag

SEQ ID NO: 63700 - DNA, 201 bp, Homo sapiens
tcctggggatggccaggtatgtaccacccgacacccagggcacaagtcagtggctgagccctggcccttggtcctggggcagccatcagtaaatgggaggmtgtaggggccctccattcactcgtaagataacctgtgttgcaggtacaaccggatgccagccccgtgccaggagcctggagggaagttggggaaacccct

SEQ ID NO: 63701 - DNA, 201 bp, Homo sapiens
ccctcttctgaaaagaaatgaagcccggttaaccctctccacacccaaaagaaaagggaagaggcccgctaagcctggagagccacacacaggcaaagaamagagcctggctaatctttctctcaggcaaacaaagcaggagggcttgggttaactaccctcacccccaggcagatggaaagaggagagcccaggaatagc

SEQ ID NO: 63702 - DNA, 201 bp, Homo sapiens
ctcacttcctcccgtcgggaacacttcaacggccccttctgttctacagcaagtaagttcccctctggatggcttggggtggggggcacagggattatcayggggcgcactgggcccggaggggtgtccgcagctttcctgccacttccctgcggcccccacccaggtacatctttgagtccatcggtgccaagcgtaccc

SEQ ID NO: 63703 - DNA, 201 bp, Homo sapiens
cttccccacaggggagaggagagggcacaggttagccccccacctcgtccacatacatggaaagagcggagtccggcttagcacagagactcacaggaaasaagagcccaggttaacccctccttgtgtagaaaaagccaagaatgcccaggttagccccttaccacagagatagaagagaagagcaaaagttaggccagg

SEQ ID NO: 63704 - DNA, 201 bp, Homo sapiens
cccaaggcttgcagggtaggcgtgggggcttagggctgagtccgggtctcatctgggtgggactctgttttatcatcttggtgtcacggctcctggcccayggcctggcactgtctgaatgtttgggcgatgggtgaaggtgagttgagagatgggtgggaattggggacaataaaccgtcccacctgcctggtaccttga

SEQ ID NO: 63705 - DNA, 201 bp, Homo sapiens
gagaaacagacagacccaaaaagacaaagagacagaaagacagaaatagttctatagagacagaaagatatgcacagggaggcacacacataggagagttygtcagagacagagaagaacagagggacagagacaaagaggcagcagggagagacacggacggggtcgagagctccccagcaccctcccccagcttgtgac

SEQ ID NO: 63706 - DNA, 201 bp, Homo sapiens
gctttgtgcccgagggcttcgcctgcaacctgtcagccaagctccacttcatgggtgagcctgctccagggtagggtgggtcggggcagtggggccaggarcccctgtcactgggccctgcctttgcccccgtgctacttgctcttccttctcttgcagaggtcaagattgacttcgtacccaggcagggtaagtcttggg

SEQ ID NO: 63707 - DNA, 201 bp, Homo sapiens
cacccaaaagaaaagggaagaggcccgctaagcctggagagccacacacaggcaaagaaaagagcctggctaatctttctctcaggcaaacaaagcaggakggcttgggttaactaccctcacccccaggcagatggaaagaggagagcccaggaatagcccttctccactgaggggttgacaagggcgggtgtgagccgg

SEQ ID NO: 63708 - DNA, 201 bp, Homo sapiens
gcttccctccctctctttaccttatttatagcccaagatttcctggttcaagaatggcctggacctgggagaagacgcccgcttccgcatgttcagcaagyagggagtgttgactctggagattagaaagccctgcccctttgacgggggcatctatgtctgcagggccaccaacttacagggcgaggcacggtgtgagtg

SEQ ID NO: 63709 - DNA, 201 bp, Homo sapiens
gagtgggtggctgccctgcaggggctgacagagcacacatcgatactggtgaaggacctgcccacgggggcccggctgcttttccgagtgcgggcacacamtatggcagggcctggagcccctgttaccaccacggagccggtgacagtgcaggagatcctgcgtgagtgcccctttgtgcagtcacaagacccgccattg

SEQ ID NO: 63710 - DNA, 201 bp, Homo sapiens
cctcccaaagtgctgggattacaggcgtgagccactgcgtccagactgctttgctttgtttaactgagggcagattcctgatttatttggccagggaaccyttttaatgtgtgcatgtgtgcgtgcatgtgtgcgcgcgtgtgtgtgtgtgcatgtgtctgtgtgtgtatgtatatatgtgtgtctgtgtctgtgtgtgtg

SEQ ID NO: 63711 - DNA, 201 bp, Homo sapiens
tacccaggcagggtaagtcttggggcccctgagtcttggttctgctcactttcccgcaacccacccacgcaggcctcccctccactcacagagggaagagsaaggatcaaaagtgggggtcctggggcccagctccagctttgccactcatgaccatgggtcaattataatctctgtgagcctcagtttcctcttctctaa

SEQ ID NO: 63712 - DNA, 201 bp, Homo sapiens
caccatcctgttcatccgggccgctcgccgcgtgcattcaggcacttaccaggtgacggtgcgcattgagaacatggaggacaaggccacgctggtgctgyaggttgttggtgcgtggccaaggcctccttgagcccccttgtttcccttccctgggctgggctgctggggccaagggtggggccaggggacccaacccac

SEQ ID NO: 63713 - DNA, 201 bp, Homo sapiens
caccccacccacatgtgcacgccctgctgttggctaccccatgggagagactggtcagggggcaggcaaggtgggcagtgtgggtcagggggtggaagaakcagcagaggggcgcttccaggctgagtcagctcctctgctccctacttccctcctgccctgttcccaggggaataaggccccagccaggccagccccaga

SEQ ID NO: 63714 - DNA, 201 bp, Homo sapiens
gcccagctccagctttgccactcatgaccatgggtcaattataatctctgtgagcctcagtttcctcttctctaaaatgggaaccctgatagtgccacctyataggatagttataaagatgaggtgacatgatgtatcagacctgtcaagtgctgtcacacgtgtgactgttattattacatcttttcttcttcttccttt

SEQ ID NO: 63715 - DNA, 201 bp, Homo sapiens
gagtggccatcctcagggcctgggggaggccagtgctggagtctgaggcccttcagggtctcgactgggggtcagggctggggatgatttgcggggcggarctgaagtcagtgggggctgcaggggagagcaagcttcccaggcaggtgaggatactgagtctaacccccacaggagcctggctggaggtggtcggcggat

SEQ ID NO: 63716 - DNA, 201 bp, Homo sapiens
caggtcccgtgacaaagctagaacccgagcccctgccctcagtcggtgccacagagatgattttgaactagatgctgacgtggatgcagtcttcccacagrctgtgttccccccatggacccccgggacatctggctgttggcggaggctgcaagggcctctggggtctgacttggatctcaccccaactctgcacccccc

SEQ ID NO: 63717 - DNA, 201 bp, Homo sapiens
tcttcttcctttttttttatttttattttttttgagacggagtctccctctgtcgcccacgctggagagaagtggcgcgatctcggctcactgcaagctcygcctcccaggttcacaccactctcctgcctcagcctcctgagtagctgggactacaggcgcccgccaccatgcccagctaattattttttgtatttttag

SEQ ID NO: 63718 - DNA, 201 bp, Homo sapiens
atgattttgaactagatgctgacgtggatgcagtcttcccacaggctgtgttccccccatggacccccgggacatctggctgttggcggaggctgcaaggrcctctggggtctgacttggatctcaccccaactctgcacccccccagctgctgtgtgagaccgagggccgggtccgcgtggagaccaccaaggaccgcag

SEQ ID NO: 63719 - DNA, 201 bp, Homo sapiens
tccaagctggagaacacagaggggcagccccaaggagggcccatccgttcgctcattcagccactcgacaaacatcacgggcatgctccctgagccgagcrgcaacaggacaggtttttctgcccaaaaggagccccgctctgggggagatggaggcagatgcatccagcagatttcctgcgacactgctgtacatgagcc

SEQ ID NO: 63720 - DNA, 201 bp, Homo sapiens
cagacaagccaagtcctccccaggatctccgggtgactgacgcctggggtcttaatgtggctctggagtggaagccaccccaggatgtcggcaacacggarctctgggggtacacagtgcagaaagccgacaagaagaccatggtgagcccagggtctggggtccccacgtgcaccctgcctaggcccggcagacccaggc

SEQ ID NO: 63721 - DNA, 201 bp, Homo sapiens
tgacctcaggtgatcctcccacctcggcctcccaaagtgctgggattacaggcgtgagccaccgtgcctggctgctgttgctgtttgtttttaagccaatytacagacatgtcttgtaacagggacaaaatattccttaaagtggccaaaagccagctgaacaggaagtgccccctatgtgaccagtgggcagttcagagt

SEQ ID NO: 63722 - DNA, 201 bp, Homo sapiens
gacaggaagcacccggggtcaacccattctgagaatgcaaagggaccccttccctgtcccattgccttcaccttccacagcaaggttccccgcggacagarcccacgtttagtatggagctgagccaggctcacggcatgccttcagaccagtctctacccactatgggtctcagtctcccaacctggggtgccgggggtg

SEQ ID NO: 63723 - DNA, 201 bp, Homo sapiens
catgcacacaggtctatctgttcgagctgcacatcaccgatgcccagcctgccttcactggcagctaccgctgtgaggtgtccaccaaggacaaatttgamtgctccaacttcaatctcactgtccacggtgagggggccctggtgtctgtcctgggctcgggctccccatgggtcctggtctcctacctccttttcccaa

SEQ ID NO: 63724 - DNA, 201 bp, Homo sapiens
taaacaaataaaaatttaaaaaaacatatttaaatcctggagattcctatcagaggagtgggcagtgggagtggggtgtcagtggtgacacagcctgtggscttgcctccccctccccacccccaggctcagagtgggtggctgccctgcaggggctgacagagcacacatcgatactggtgaaggacctgcccacggggg

SEQ ID NO: 63725 - DNA, 201 bp, Homo sapiens
gatcaggtacccctgccccaggccctacctgcaccatccgcagacccccaggggtctgagacgggtgggagcccaatctggctagtgtccctttctccctscccactccactcccatcctgctcctaatccctttccagtccctcactgcagcctcactgggggtccctctccatagtgatagccatgaggacactgggat

SEQ ID NO: 63726 - DNA, 201 bp, Homo sapiens
accagggcagggcaggaggccaccaaggaggccggctctggccagaggccctcactgcctctcccgccctcttgctcatccctggagcaactgggctggcygtgctgggcccaagttcacagagattaatgagacccagcccctgcccagtctccaagggcccagccaaggagatgctttgatgtagaaatcacttttacg

SEQ ID NO: 63727 - DNA, 201 bp, Homo sapiens
cagcaccctcatcacccctaattctgccaggagcccctccagatccccagcccctcttcagctcccttggcccccagtcctgcctggcctgggacccagascagctccagctgccccaccagaagggaaggggcagagggacaggggtggctacagctccttggtcctgggcccaggaagccccgcccagggggctgcagt

SEQ ID NO: 63728 - DNA, 201 bp, Homo sapiens
agcttttttcttagctgcagctctctgggccttgtctcaagggaggttggagctgtggagcccctcagagctgtggcgggccctcacttagctacccactytatacccacagaacggccacggcttcagctgcccaggcacctgcgccagaccattcagaagaaggtcggggagcctgtgaaccttctcatccctttccag

SEQ ID NO: 63729 - DNA, 201 bp, Homo sapiens
cccacgcaggcctcccctccactcacagagggaagagcaaggatcaaaagtgggggtcctggggcccagctccagctttgccactcatgaccatgggtcarttataatctctgtgagcctcagtttcctcttctctaaaatgggaaccctgatagtgccacctcataggatagttataaagatgaggtgacatgatgtatc

SEQ ID NO: 63730 - DNA, 201 bp, Homo sapiens
gaagtatcggaggagggggcgcaagtcaaatggtgagttccagaagcacggggcatgggtgttgggggcatctgcccagaagaggccacagcacttgccayccacccacccggctaggctgaaggacggggtggagctgacccgggaggagaccttcaaataccggttcaagaaggacgggcagagacaccacctgatcat

SEQ ID NO: 63731 - DNA, 201 bp, Homo sapiens
ccagtcctgggctaggcaagggggcctctagcaagagaggccaacatgttctgctgtgcggggctgtgcattgcacaaaagcctgtatttcaccacaaccrtgtgccagcagatggcaatcatgggtttcgagatagtcccctttctctgtacaaaaactctgtatgggttaactaaagcctgagggtgcgaagatcgatg

SEQ ID NO: 63732 - DNA, 201 bp, Homo sapiens
cccgccccagtgacctgtgctcctcctggctctcccgtttctctgaactacattgtgtcttctgcagaacctcccaagatccacctggactgcccaggccrcataccagacaccattgtggttgtagctggaaataagctacgtctggacgtccctatctctggggaccctgctcccactgtgatctggcagaaggctatc

SEQ ID NO: 63733 - DNA, 201 bp, Homo sapiens
ggggtccctctccatagtgatagccatgaggacactgggattctggacttcagctcactgctgaaaaagaggtgagtcctgggtggcagttcctggggcakctggtgaggcctggctccaaatcccagcactgtggtttgccagctgtgtgaccctgagcacaacactgcacctctctgagttggtttccttgtctgtcga

SEQ ID NO: 63734 - DNA, 201 bp, Homo sapiens
ataccagacaccattgtggttgtagctggaaataagctacgtctggacgtccctatctctggggaccctgctcccactgtgatctggcagaaggctatcamgcaggtactgtgggtccctcctcagtctccccatctataagatgggtgtgtggaaccagccaagtgctaggacctgctgcacaccccacccacatgtgca

SEQ ID NO: 63735 - DNA, 201 bp, Homo sapiens
catcgcgggctacactgctatgctctgctgtgctgtccggggtagccccaaggtagggaactttaggcgctggtccaggccgaccaggaggcagggctcayaggccccgacgttgagcagtcctctccccagcctgtctcccctgctttctctccaccttggggtgtatggaccgggttcctccccctgggcagggccatg

SEQ ID NO: 63736 - DNA, 201 bp, Homo sapiens
ctgggagatgggaagagcgggcggcagtggggaccctgggctttgctccgttgtcctcggccaagcacctgccctggctgcaagggcacggaccctgccaygcccagatgggcaatagcttccagaaggctgggaggacacagtgacatggcctcctcttctgcagtgcctcagtgaccaggctggctcctggggatggcc

SEQ ID NO: 63737 - DNA, 201 bp, Homo sapiens
tgcacagtacagtgggagccgcctgcctacgatggcgggcagcccatcctgggtgagtgcaagggcaccggatggaggtgtgagggcgccaaacagatcckagggaaggtggtgtggggatgcctgggttccagaccagagctgccacctcccctgagccaggctacatcctggagcgcaagaagaagaagagctaccggt

SEQ ID NO: 63738 - DNA, 201 bp, Homo sapiens
ggaccgggttcctccccctgggcagggccatggtactcactcttggttccatgtttgtttccagccttgggcatagtcagggactctcgtgggaccccccragtagaaacacagatgtgtctccctgggtccctgccaggtcccctctcagcctggatggcttccctccctctctttaccttatttatagcccaagatttc

SEQ ID NO: 63739 - DNA, 201 bp, Homo sapiens
cagggggctgcagtcttgcccccggccacagcctagactgcgggacacagggactcgaagctggaggcaccagcagaggaggacgtgtgggagatcctacrgcaggcacccccatctgagtacgagcgcatcgccttccagtacggcgtcactgacctgcgcggcatgctaaagaggctcaagggcatgaggcgcgatgag

SEQ ID NO: 63740 - DNA, 201 bp, Homo sapiens
gaaagtgctagcacagtatttactgagaggggctgcaggggcggggtgcacgctccaaccaggggccgctgtagcctccacctggcccttcagtctcagcytttagcaagaagccacggtcagtggaagtggccgcaggcagccctgccgtgttcgaggccgagacagagcgggcaggagtgaaggtgcgctggcagcgcg

SEQ ID NO: 63741 - DNA, 201 bp, Homo sapiens
tcagtctccccatctataagatgggtgtgtggaaccagccaagtgctaggacctgctgcacaccccacccacatgtgcacgccctgctgttggctaccccrtgggagagactggtcagggggcaggcaaggtgggcagtgtgggtcagggggtggaagaagcagcagaggggcgcttccaggctgagtcagctcctctgct

SEQ ID NO: 63742 - DNA, 201 bp, Homo sapiens
tctcccggcccctggtgtcccctgacgccccgtccctccatgcacacaggtctatctgttcgagctgcacatcaccgatgcccagcctgccttcactggcrgctaccgctgtgaggtgtccaccaaggacaaatttgactgctccaacttcaatctcactgtccacggtgagggggccctggtgtctgtcctgggctcggg

SEQ ID NO: 63743 - DNA, 201 bp, Homo sapiens
ttgcctagtgaaaaacaaatgcagagtaaagctgactgtaacacttctttgagcagtgcgaaatcagcaactacattttaaaaacatatttaaggccaggygcgatggcttacgcctgtaatcccagcactttgggaggccaaggtgggcggatcacctgaggtcgggagttcgagaccagtctgaccaacgtggagaaac

SEQ ID NO: 63744 - DNA, 201 bp, Homo sapiens
gcacatcaccgatgcccagcctgccttcactggcagctaccgctgtgaggtgtccaccaaggacaaatttgactgctccaacttcaatctcactgtccacrgtgagggggccctggtgtctgtcctgggctcgggctccccatgggtcctggtctcctacctccttttcccaacactaaggaggatgcctcgtcccatcca

SEQ ID NO: 63745 - DNA, 201 bp, Homo sapiens
ccctgccgtgttcgaggccgagacagagcgggcaggagtgaaggtgcgctggcagcgcggaggcagtgacatcagcgccagcaacaagtacggcctggccrcagagggcacacggcatacgctgacagtgcgggaagtgggccctgccgaccagggatcttacgcagtcattgctggctcctccaaggtcaagttcgacct

SEQ ID NO: 63746 - DNA, 201 bp, Homo sapiens
ggtggtgtggggatgcctgggttccagaccagagctgccacctcccctgagccaggctacatcctggagcgcaagaagaagaagagctaccggtggatgcrgctgaacttcgacctgattcaggagctgagtcatgaagcgcggcgcatgatcgagggcgtggtgtacgagatgcgcgtctacgcggtcaacgccatcggc

SEQ ID NO: 63747 - DNA, 201 bp, Homo sapiens
cgtgccagacgcacctgcggcccccaagatcagcaacgtgggagaggactcctgcacagtacagtgggagccgcctgcctacgatggcgggcagcccatcmtgggtgagtgcaagggcaccggatggaggtgtgagggcgccaaacagatccgagggaaggtggtgtggggatgcctgggttccagaccagagctgccacc

SEQ ID NO: 63748 - DNA, 201 bp, Homo sapiens
ggcccggaggggtgtccgcagctttcctgccacttccctgcggcccccacccaggtacatctttgagtccatcggtgccaagcgtaccctgaccatcagcyagtgctcattggcggacgacgcagcctaccagtgcgtggtgggtggcgagaagtgtagcacggagctctttgtgaaaggtgggcctgggacctgaggatg

SEQ ID NO: 63749 - DNA, 201 bp, Homo sapiens
caagcgtaccctgaccatcagccagtgctcattggcggacgacgcagcctaccagtgcgtggtgggtggcgagaagtgtagcacggagctctttgtgaaasgtgggcctgggacctgaggatgtgggaacctggggaggagatggcctcaggggagccaaccctcatgctcaccctgcctggacagagccccctgtgctca

SEQ ID NO: 63750 - DNA, 201 bp, Homo sapiens
gagacaccacctgatcatcaacgaggccatgctggaggacgcggggcactatgcactgtgcactagcgggggccaggcgctggctgagctcattgtgcagsgtgagcctggctgggggggcacatgaggctttagggcttggacccctcagcccccaccccacctagccctgtaggggagcaggcaaacctgggctcaagg

SEQ ID NO: 63751 - DNA, 201 bp, Homo sapiens
cacgggggcccggctgcttttccgagtgcgggcacacaatatggcagggcctggagcccctgttaccaccacggagccggtgacagtgcaggagatcctgygtgagtgcccctttgtgcagtcacaagacccgccattgacaccccaggcccttggtgtccagtggaggtggggacagttggggaggcccagaatgctctg

SEQ ID NO: 63752 - DNA, 201 bp, Homo sapiens
gggctggcctgatctgaggtaccagaggctggggtggcggccggcccttggagtgatccaggttcagggttaagcttttcctcccctcagggcaagccccrgcctcaggtgacctggaccaaagaggggcagcccctggcaggcgaggaggtgagcatccgcaacagccccacagacaccatcctgttcatccgggccgct

SEQ ID NO: 63753 - DNA, 201 bp, Homo sapiens
ggtggagatgccaagggcacccaggagaggctctcggcatcaggaagggcctggcccagagatgcctcccctccctccctgcccccaggagtggttcaccrtcttggagcattaccgccgcacccactgcgtggtgccagagctcatcattggcaatggctactacttccgcgtcttcagccagaatatggttggctttag

SEQ ID NO: 63754 - DNA, 201 bp, Homo sapiens
cttacgcagtcattgctggctcctccaaggtcaagttcgacctcaaggtcatagaggcaggtaagatcctgatcagccttccctgaggtttgggctgctgsgggaggggcagcccagcgactctccatccatccagggaacaggaggtgctttcacactttcttgcctttgctgtggctgtgccccccgccaggaacgccc

SEQ ID NO: 63755 - DNA, 201 bp, Homo sapiens
cccctttgtgcagtcacaagacccgccattgacaccccaggcccttggtgtccagtggaggtggggacagttggggaggcccagaatgctctgcccagaaygctgggcagagacaggaggggttggagccatcgtccatgcgctaggcctagggaaaaagtgcagagagggtggccaggcacagtggctcaagcctgtaat

SEQ ID NO: 63756 - DNA, 201 bp, Homo sapiens
gtcccgtgacaaagctagaacccgagcccctgccctcagtcggtgccacagagatgattttgaactagatgctgacgtggatgcagtcttcccacaggctrtgttccccccatggacccccgggacatctggctgttggcggaggctgcaagggcctctggggtctgacttggatctcaccccaactctgcacccccccag

SEQ ID NO: 63757 - DNA, 201 bp, Homo sapiens
gaaggaagatgagggcgtctacacggtcacagtgaagaaccctgtgggcgaggaccaggtcaacctcacagtcaaggtcatcggtgaggccggccggggtscaagctggagaacacagaggggcagccccaaggagggcccatccgttcgctcattcagccactcgacaaacatcacgggcatgctccctgagccgagcgg

SEQ ID NO: 63758 - DNA, 201 bp, Homo sapiens
gagctcaatggctctgccctgccctgcagaaaagaagctggaggtgtaccagagcatcgcagacctgatggtgggcgcaaaggaccaggcggtgttcaaaygtgaggtctcagatgagaatgttcggggtgtgtggctgaagaatgggaaggagctggtgcccgacagccgcataaaggtgtcccacatcgggcggtgagt

SEQ ID NO: 63759 - DNA, 201 bp, Homo sapiens
gtcttgctcctgcctggcactgttggttcttctgaaggctggggtcttgaggggtcctcatgatagctcatctgagaggacaggtggttgccccaggtccygtgacaaagctagaacccgagcccctgccctcagtcggtgccacagagatgattttgaactagatgctgacgtggatgcagtcttcccacaggctgtgtt

SEQ ID NO: 63760 - DNA, 201 bp, Homo sapiens
acctcccctgagccaggctacatcctggagcgcaagaagaagaagagctaccggtggatgcggctgaacttcgacctgattcaggagctgagtcatgaagygcggcgcatgatcgagggcgtggtgtacgagatgcgcgtctacgcggtcaacgccatcggcatgtccaggcccagccctgcctcccagcccttcatgcct

SEQ ID NO: 63761 - DNA, 201 bp, Homo sapiens
ggggcatctgcccagaagaggccacagcacttgccacccacccacccggctaggctgaaggacggggtggagctgacccgggaggagaccttcaaataccrgttcaagaaggacgggcagagacaccacctgatcatcaacgaggccatgctggaggacgcggggcactatgcactgtgcactagcgggggccaggcgctg

SEQ ID NO: 63762 - DNA, 201 bp, Homo sapiens
agggctggcctgatctgaggtaccagaggctggggtggcggccggcccttggagtgatccaggttcagggttaagcttttcctcccctcagggcaagcccyggcctcaggtgacctggaccaaagaggggcagcccctggcaggcgaggaggtgagcatccgcaacagccccacagacaccatcctgttcatccgggccgc

SEQ ID NO: 63763 - DNA, 201 bp, Homo sapiens
agggccgggtccgcgtggagaccaccaaggaccgcagcatcttcacggtcgagggggcagagaaggaagatgagggcgtctacacggtcacagtgaagaamcctgtgggcgaggaccaggtcaacctcacagtcaaggtcatcggtgaggccggccggggtccaagctggagaacacagaggggcagccccaaggagggcc

SEQ ID NO: 63764 - DNA, 201 bp, Homo sapiens
ctggtgctgcaggttgttggtgcgtggccaaggcctccttgagcccccttgtttcccttccctgggctgggctgctggggccaagggtggggccaggggayccaacccacagctcacattttccagtccactgccccagcaggcctggccctggttggcaggggtggggtggtccctggagccagtgaccccctgctcact

SEQ ID NO: 63765 - DNA, 201 bp, Homo sapiens
gaagaggccacagcacttgccacccacccacccggctaggctgaaggacggggtggagctgacccgggaggagaccttcaaataccggttcaagaaggacrggcagagacaccacctgatcatcaacgaggccatgctggaggacgcggggcactatgcactgtgcactagcgggggccaggcgctggctgagctcattgt

SEQ ID NO: 63766 - DNA, 201 bp, Homo sapiens
ggacggggtggagctgacccgggaggagaccttcaaataccggttcaagaaggacgggcagagacaccacctgatcatcaacgaggccatgctggaggacrcggggcactatgcactgtgcactagcgggggccaggcgctggctgagctcattgtgcagggtgagcctggctgggggggcacatgaggctttagggcttg

SEQ ID NO: 63767 - DNA, 201 bp, Homo sapiens
cgcagacaagccaagtcctccccaggatctccgggtgactgacgcctggggtcttaatgtggctctggagtggaagccaccccaggatgtcggcaacacgkagctctgggggtacacagtgcagaaagccgacaagaagaccatggtgagcccagggtctggggtccccacgtgcaccctgcctaggcccggcagacccag

SEQ ID NO: 63768 - DNA, 201 bp, Homo sapiens
aatactcagaggccgcccccagggcagggcttctcaaacggccccctctgaagccccttcccccatctctccaccctttgaacccagaggccatgggcacyggagacctggacctcctatcagccttccgccgcacgtgagtggccatcctcagggcctgggggaggccagtgctggagtctgaggcccttcagggtctcg

SEQ ID NO: 63769 - DNA, 201 bp, Homo sapiens
aaccgtcccacctgcctggtaccttgaccctgggaaaggctgggaaggtgagatcctggggcagatgcccagcctcatggggtcatgaatgggcaagtctstgaatactcagaggccgcccccagggcagggcttctcaaacggccccctctgaagccccttcccccatctctccaccctttgaacccagaggccatgggc

SEQ ID NO: 63770 - DNA, 201 bp, Homo sapiens
gaagcggggcggcacagaggggattggagggggggacctgggccccagccacagccacagtagcttggcctgggggagcagggtgcgggcggtggggtggycggggctgaggggtggtgctcagcctttcagaagaagctggagccggcctaccaggtgagcaaaggccacaagatccggctgaccgtggaactggctgac

SEQ ID NO: 63771 - DNA, 201 bp, Homo sapiens
ggtggccatacctctcatgtgccacctaccctttctcccacccccacccctggagcagcagtttccggaccccgaggtgagtgcccaacatagcacagcamcctcatcacccctaattctgccaggagcccctccagatccccagcccctcttcagctcccttggcccccagtcctgcctggcctgggacccagagcagct

SEQ ID NO: 63772 - DNA, 201 bp, Homo sapiens
tgcacagggaggcacacacataggagagttcgtcagagacagagaagaacagagggacagagacaaagaggcagcagggagagacacggacggggtcgagmgctccccagcaccctcccccagcttgtgaccagggcagggcaggaggccaccaaggaggccggctctggccagaggccctcactgcctctcccgccctct

SEQ ID NO: 63773 - DNA, 201 bp, Homo sapiens
tcgtacccaggcagggtaagtcttggggcccctgagtcttggttctgctcactttcccgcaacccacccacgcaggcctcccctccactcacagagggaaragcaaggatcaaaagtgggggtcctggggcccagctccagctttgccactcatgaccatgggtcaattataatctctgtgagcctcagtttcctcttctc

SEQ ID NO: 63774 - DNA, 201 bp, Homo sapiens
agcctttgctcacagggtcaagctcagcagctctcaatggtcctacccctggagcccccgatgaccccattggcctcttcgtgatgcggccacaggatggygaggtgaccgtgggtgagtgtgagctgctgtgcccagcattggggtgggaagggggggcagcaggacactccccaagccgggcctgtcgccctgcctttg

SEQ ID NO: 63775 - DNA, 201 bp, Homo sapiens
accccatctctactaaaaatacaaaattagctgggcatggtggtgcatgcctgtaatcccagctactcaggaggctgaggcaggagaatcgcttgagcccyggaagcggaggttgcggtgagccaagatcaagccattgcactccagcctgggcaacaagagtaaaactctgtctcaaaaaaaaaaaagagacaggcatcc

SEQ ID NO: 63776 - DNA, 201 bp, Homo sapiens
ggccctctaggatctcattgccctttcctccgtctcctcccagcctccctgcacttgctgtcctccagccattccttgccatttcttttcaaaggcacgcycctgcctcagggcctttgcacttactgtcttcccccacaaatagccctgttgctcactcccctcatatcctctggtctctgctcagatgctgccctatca

SEQ ID NO: 63777 - DNA, 201 bp, Homo sapiens
atcagaacaggacagtgggaagggcccggagaagcatctgcacctgactccccaggggcaaggtgggctggaggtaggtgacaaggtttggctcccaaacrggcactggccaaaaacaaatggaccagcagggccaagtgacatggcagaagaccaggtgggtgactcggtcaacactttcaaacatccccaaagttatag

SEQ ID NO: 63778 - DNA, 201 bp, Homo sapiens
cgcaagcacatgggagaatgggaggaattacagaaaacaggaaggcaagctcactgcctcacaaaagattccttggtggaagactttcccagttcccttcygcagaaacaatgaaggtctgaggacatggggttatcatcaatctcttcattacagtcactcatctcagagaccagcattgcaactggagggcagctgctc

SEQ ID NO: 63779 - DNA, 201 bp, Homo sapiens
taaccagttgaaggctttaagagcaaaaattgaggttttagagggaaggaattctgccgcgactttagcatcaattcttgcacatttcctgcctgtcctgyacatttcagacttgccagtccccacaatcacacaggccaattccttgaaatgaatcttttctatatcttacatacaaatgcatatgtttctctagagaac

SEQ ID NO: 63780 - DNA, 201 bp, Homo sapiens
cactgcccactcccagcctcctttccacgttgagagcccagggagggcatctaacctactccccaatctgcaaatctaatctccacccccagaagcacccracgtctctcctactcgacctcacaggtgcgccccatgcacagtcctgcccagcacaagcacatggcctcactcccacgtctccttatttccctgacacag

SEQ ID NO: 63781 - DNA, 201 bp, Homo sapiens
tgatacaaccttgcagaaagctggagtgggaatgccatttctccattggccttctcgttcttctctgtcatcccacctccagctgctaacgccccaggccycactgcccactcccagcctcctttccacgttgagagcccagggagggcatctaacctactccccaatctgcaaatctaatctccacccccagaagcaccc

SEQ ID NO: 63782 - DNA, 201 bp, Homo sapiens
ctgacatgcacgacttcaatgatacaaccttgcagaaagctggagtgggaatgccatttctccattggccttctcgttcttctctgtcatcccacctccarctgctaacgccccaggccccactgcccactcccagcctcctttccacgttgagagcccagggagggcatctaacctactccccaatctgcaaatctaatc

SEQ ID NO: 63783 - DNA, 201 bp, Homo sapiens
ctttaatactaatttcatttggtgtcacccaagtcctacccagccttgactcggccctgctcctccagtcttacccctctacccacacatctagaaggctsacatgcacgacttcaatgatacaaccttgcagaaagctggagtgggaatgccatttctccattggccttctcgttcttctctgtcatcccacctccagct

SEQ ID NO: 63784 - DNA, 201 bp, Homo sapiens
cacaaccactctcccctttccttttctttcagggaatgggccactcctggcaccctgcacattttagcatttgtttcctgtctctccccactagaatgcawgctgcagaggaattgtatccgtagcacctggtaagtgctcaatgaccactttttcaaggaccacatttccataatattaaaatgtattatgagagggaag

SEQ ID NO: 63785 - DNA, 201 bp, Homo sapiens
cggtttcaccatgttggccaggctgggcttgaactcctggcctcaagtgatccacctgcctcagcctcctaaagttctgggattacaggcatgagccaccrtgcccggcctctgtcctccagaatttttattttgctgcataaatgtaatgatattagggatctgttaggtattccatacatctacttatctgaataactt

SEQ ID NO: 63786 - DNA, 201 bp, Homo sapiens
gacccccataagggatccaccacagtgaaaccagttgaactgccctttcctgagcctctctgtgctccaggcactgccccatccctcccacgagacctgaygggaagcgggttaaggtggtttcatgttgaccatgtgtccacaggcttcgcagaccaagagcaagtcggcacaccaggacaggcatttgcatgggtgccc

SEQ ID NO: 63787 - DNA, 201 bp, Homo sapiens
ataaaatacgagaaaaacaagagcttcccatgagctcttgactatcccaggatcacacccagtttgggctagaaagacccccataagggatccaccacagygaaaccagttgaactgccctttcctgagcctctctgtgctccaggcactgccccatccctcccacgagacctgatgggaagcgggttaaggtggtttcat

SEQ ID NO: 63788 - DNA, 201 bp, Homo sapiens
aaaactccacgttcctataaaatacgagaaaaacaagagcttcccatgagctcttgactatcccaggatcacacccagtttgggctagaaagacccccatragggatccaccacagtgaaaccagttgaactgccctttcctgagcctctctgtgctccaggcactgccccatccctcccacgagacctgatgggaagcgg

SEQ ID NO: 63789 - DNA, 201 bp, Homo sapiens
tcaccaggggtgaagggaactggcaacaagtcaggtggccaagactcaaagcctgccaagaccactgggcacttttttggacttcctgaaaactccacgtkcctataaaatacgagaaaaacaagagcttcccatgagctcttgactatcccaggatcacacccagtttgggctagaaagacccccataagggatccacca

SEQ ID NO: 63790 - DNA, 201 bp, Homo sapiens
ggtcaccaggggtgaagggaactggcaacaagtcaggtggccaagactcaaagcctgccaagaccactgggcacttttttggacttcctgaaaactccacrttcctataaaatacgagaaaaacaagagcttcccatgagctcttgactatcccaggatcacacccagtttgggctagaaagacccccataagggatccac

SEQ ID NO: 63791 - DNA, 201 bp, Homo sapiens
tgtattggcacaaatccatcctgggttagtcgttgactactccaacacccacttcaggctttatagccaagggcaactttaaataaacatttaaacatccyaagtggtcaattcaatgacacccctcacaggtccaatgtatgacaatgctgttgaatgtgcctcttcatttcagcacactgccttcaggcaggtaagtgt

SEQ ID NO: 63792 - DNA, 201 bp, Homo sapiens
ttaaaataattacgggtttttatttcattcaaaagcactaagaggccaggagcggtggctcacgcctataattccagaacttttggaggctgaggcgggcrggtcacttgaggccaggagtttgagaccagcccagccaacatggcaaaaccccgtctctactaaaaatacaaaaattagccaggcgtggtggtgcacacc

SEQ ID NO: 63793 - DNA, 201 bp, Homo sapiens
tcaggcagtgggatgggtgataggaatgggtttattgacttcatagagtataaaataaacaattcaaatacacccaaatgcactctttcataaaagaaackgaagtaacaaattctgaccccatgatgagaccccagataaacgttaggggtcaccaggggtgaagggaactggcaacaagtcaggtggccaagactcaaa

SEQ ID NO: 63794 - DNA, 201 bp, Homo sapiens
cttcaggcaggtaagtgttttattagatctttttccagaactgcaaccactcctgctctctcatcaccctttaacacaatcctcacgtcctcctctcgccrcaagcacatgggagaatgggaggaattacagaaaacaggaaggcaagctcactgcctcacaaaagattccttggtggaagactttcccagttcccttccg

SEQ ID NO: 63795 - DNA, 201 bp, Homo sapiens
aatcgcttgagccccggaagcggaggttgcggtgagccaagatcaagccattgcactccagcctgggcaacaagagtaaaactctgtctcaaaaaaaaaaaagagacaggcatcccacatcaatgcttccaaggtgtgtacccttttgatctggcaattctgcctagaaggtcatctgaggaagtggccaggagagcacaa

SEQ ID NO: 63796 - DNA, 201 bp, Homo sapiens
ccccatctctactaaaaatacaaaattagctgggcatggtggtgcatgcctgtaatcccagctactcaggaggctgaggcaggagaatcgcttgagccccrgaagcggaggttgcggtgagccaagatcaagccattgcactccagcctgggcaacaagagtaaaactctgtctcaaaaaaaaaaaagagacaggcatccc

SEQ ID NO: 63797 - DNA, 201 bp, Homo sapiens
tcactttccttgacaactagaagttattttatttaccatataaatacttttccaatgctgtctaaaaccatgcttgtaattaatatatctggaaacaacaattaataaatgatgtgtgtattactttaaaataaaaataaaggtttctatgtaatttccgtaattaaggagattaatatcttacttaacagacttacatcc

SEQ ID NO: 63798 - DNA, 201 bp, Homo sapiens
cttttgatctggcaattctgcctagaaggtcatctgaggaagtggccaggagagcacaaacacacacatttacagatgctcatcacagtgtcactttgagracttaaacagaaactctgtgagttataagatcattgaagagctgtgactttaacctctccaccttacttcctccctagattcctctaggaacagaaaaat

SEQ ID NO: 63799 - DNA, 201 bp, Homo sapiens
ttcactttccttgacaactagaagttattttatttaccatataaatacttttccaatgctgtctaaaaccatgcttgtaattaatatatctggaaacaacaattaataaatgatgtgtgtattactttaaaataaaaataaaggtttctatgtaatttccgtaattaaggagattaatatcttacttaacagacttacatc

SEQ ID NO: 63800 - DNA, 201 bp, Homo sapiens
tttcactttccttgacaactagaagttattttatttaccatataaatacttttccaatgctgtctaaaaccatgcttgtaattaatatatctggaaacaacaattaataaatgatgtgtgtattactttaaaataaaaataaaggtttctatgtaatttccgtaattaaggagattaatatcttacttaacagacttacat

SEQ ID NO: 63801 - DNA, 201 bp, Homo sapiens
ttacaaaaactgtgcctgggaaaggagcccagtgatcacttgttcactgtgtgtgtctgggaaaaagtacatagataatatataagtactatataaataawtttttttttttttttgagatggaatatcgctctgtcacccaggctggagtgcagtggcgcgatcttggctcactgcaagttctgcctccctggttcatgc

SEQ ID NO: 63802 - DNA, 201 bp, Homo sapiens
ccacccaccttggcctcccaaagtgctgggattacaagtgtgagccaccacacccagccaataaatgctttcttaaagcaatttacagaattctattttayagtaaaaatgaattttcagcagtacagtgttcacagtgagattggattttattaaattatatatgatagaaaaaatgttacttatatgtataaagtaaaa

SEQ ID NO: 63803 - DNA, 201 bp, Homo sapiens
ctccctctgagtctaccagtctatgttggacagacaagaacacctgtttagttctaattttttctttctttctttctttcttttttttttttttttgagaygaagtttcactcttgttgcccaggctggagtgcaatggcgatcttggctcactgcaacctccaccttccaggtacaaacaattctcctgactcagcctcc

SEQ ID NO: 63804 - DNA, 201 bp, Homo sapiens
gaattctattttatagtaaaaatgaattttcagcagtacagtgttcacagtgagattggattttattaaattatatatgatagaaaaaatgttacttatakgtataaagtaaaataaacgtgattggcatttttaaacaaaatttttaaaataaaggtatacaatatgcccagattacataattcaaaaagtgcatgccac

SEQ ID NO: 63805 - DNA, 201 bp, Homo sapiens
cagtttccgaacattggaatactccctctgagtctaccagtctatgttggacagacaagaacacctgtttagttctaattttttctttctttctttctttyttttttttttttttttgagacgaagtttcactcttgttgcccaggctggagtgcaatggcgatcttggctcactgcaacctccaccttccaggtacaaac

SEQ ID NO: 63806 - DNA, 201 bp, Homo sapiens
atggggccaggtatggtggctcacgcctgtaatcccagcactttgggaagccaaggcaggtagatcacaaagtcaggagttcgagaccagcctggccaacrtggtgaaaccctgtcactactaaaaatacaaaaattagccaggcatggtggcaggtgcctgtaatcccagctacttgggaggctgagggaggagaatcgc

SEQ ID NO: 63807 - DNA, 201 bp, Homo sapiens
ttagacccctagtggaggaaaatttagatcaacagggacaggacccacctcagtgtggagttaggtttaaccacaaagtcttagacatttattattcatttcactttactttgaggaaggactcgttattggttgctctgtacatgttaaaagtcaaggatggggccaggtatggtggctcacgcctgtaatcccagcact

SEQ ID NO: 63808 - DNA, 201 bp, Homo sapiens
aatcatacattttgtaaaagagatccaaactcaattaatttcttttctaaattctccctgagtccacaaccagtctgtttcacatcaaaggagcctgttcrtctttgaaaatggataaaagagaatttaattgtttgaatttgagctcaaatcacaagtctggctttaatactaatttcatttggtgtcacccaagtccta

SEQ ID NO: 63809 - DNA, 201 bp, Homo sapiens
ttttctttcagggaatgggccactcctggcaccctgcacattttagcatttgtttcctgtctctccccactagaatgcaagctgcagaggaattgtatccrtagcacctggtaagtgctcaatgaccactttttcaaggaccacatttccataatattaaaatgtattatgagagggaagagcagtgaattttcctgttat

SEQ ID NO: 63810 - DNA, 201 bp, Homo sapiens
gaactgttgtcctgtcttaaatgaaaacaaaggtcaggaaatgcacacactgaataaagagtagaaatgatttattttaaaaatcatacattttgtaaaasagatccaaactcaattaatttcttttctaaattctccctgagtccacaaccagtctgtttcacatcaaaggagcctgttcgtctttgaaaatggataaaa

SEQ ID NO: 63811 - DNA, 201 bp, Homo sapiens
ggaagagcagtgaattttcctgttatctgcactggccacgtgttgcctgagcatgtgcctctatgtgtgtaattgagtctctctgtgcctcactttccttrtctgttaaatgggagttacaatattatcacctccacaaagttatggaaattaaatcacaggtggggattgtgcctggcaggcagcaagcactcggtaagt

SEQ ID NO: 63812 - DNA, 201 bp, Homo sapiens
aaggaccacatttccataatattaaaatgtattatgagagggaagagcagtgaattttcctgttatctgcactggccacgtgttgcctgagcatgtgcctytatgtgtgtaattgagtctctctgtgcctcactttccttgtctgttaaatgggagttacaatattatcacctccacaaagttatggaaattaaatcacag

SEQ ID NO: 63813 - DNA, 201 bp, Homo sapiens
tcctctggtctctgctcagatgctgccctatcagagagaatctcctgacacaaccactctcccctttccttttctttcagggaatgggccactcctggcaycctgcacattttagcatttgtttcctgtctctccccactagaatgcaagctgcagaggaattgtatccgtagcacctggtaagtgctcaatgaccacttt

SEQ ID NO: 63814 - DNA, 201 bp, Homo sapiens
aatatgaagctaaattggtgttccaggcattgtatgggttgcatacatattggcatgcacacacatacacacaatgcacacactattaaacttctggcaarcaatgacttttgacccaagcagagagaatttggaaactgaaaggaggcaagagagggtgagtcacagttaacatcaatcaaaggtccagtgtcaagccag

SEQ ID NO: 63815 - DNA, 201 bp, Homo sapiens
actttgcacagaatcaagggcccataatggcacactgtttctttgtttaaaatatcaggacccagaggagaaagagagctcatgtaccatttggcatgggmtacacagtgatccatagtaccttctaatgtggatgcagaacttttaacatataagactttgacatgatgttggaatcatggtctgttaaaatatgaagct

SEQ ID NO: 63816 - DNA, 201 bp, Homo sapiens
ctaggtaagtaaggcaaagtggtatggccaaaagctagtgccaggtgagtaaggcctaattgctaaggccaggagatcaaaaccaggtggataataccagrtgggtaagcacaatgggtaagaccatgaggttaagaccaggtgagtaacaccagaaggttaatagaaacaggctggtaaggcaaggaggttaaggccagg

SEQ ID NO: 63817 - DNA, 201 bp, Homo sapiens
ggctgagacttcgcgtcttaacaagctgctctcagttgatgctgatcctcatggtaccttggttcccagaccccattttaagcagcaaggctgcagaaaayagatgccctaggttaaatatgggggagtcctctccatggccaggcctggtaccagcgcccacaccaattctggatagctctttcccatctgttatcttct

SEQ ID NO: 63818 - DNA, 201 bp, Homo sapiens
cacgagacctgatgggaagcgggttaaggtggtttcatgttgaccatgtgtccacaggcttcgcagaccaagagcaagtcggcacaccaggacaggcattygcatgggtgcccagaagtttcaagatctgaccttggagagaccaggtccgggaggctgccgggaagtctccatcacaccggcctcagccgagtcacagga

SEQ ID NO: 63819 - DNA, 201 bp, Homo sapiens
ctcttccacggatccacaacctaagaggaagcctcagaggcacaggctctgggagtaccaggtggcagcttcaacccagaagcgcactcgagtgcagtgcrcttgaactctccaggtcaactgtggaaggccccttagctcaggcagtgggatgggtgataggaatgggtttattgacttcatagagtataaaataaacaa

SEQ ID NO: 63820 - DNA, 201 bp, Homo sapiens
gtaggtgacaaggtttggctcccaaacgggcactggccaaaaacaaatggaccagcagggccaagtgacatggcagaagaccaggtgggtgactcggtcamcactttcaaacatccccaaagttatagtaagcatcaagagaccacttactagagtctcactgttaagagtaaaaagagattgtgtatgcaaacaattaga

SEQ ID NO: 63821 - DNA, 201 bp, Homo sapiens
gtgggctggaggtaggtgacaaggtttggctcccaaacgggcactggccaaaaacaaatggaccagcagggccaagtgacatggcagaagaccaggtgggkgactcggtcaacactttcaaacatccccaaagttatagtaagcatcaagagaccacttactagagtctcactgttaagagtaaaaagagattgtgtatgc

SEQ ID NO: 63822 - DNA, 201 bp, Homo sapiens
tctgtaaatgctgagtcatttccagattggagaatgatttaagcaaagatggtgaggaggttagaaagctcttaggaaacggttgtcaacggtaaactcaygtcccagtttgaaacatgaaacactgtgaaactatgagagggcagaaaaataagacttcggaaaaatggaggtgagggtctagaagcctcaatgaagtag

SEQ ID NO: 63823 - DNA, 201 bp, Homo sapiens
tatgccagcactagtgcccagaaagtgcaggcagttccagctgttgccacaactgctgcctagacaattggcctatcagggcagtgttgggggaccagggrttgcaagagaaccagcttttaaaaacagcattgaagataaaatggcaaataaagactaaaagttttcagaatccttgtctcagaaggttctaggctgatc

SEQ ID NO: 63824 - DNA, 201 bp, Homo sapiens
actcgttattggttgctctgtacatgttaaaagtcaaggatggggccaggtatggtggctcacgcctgtaatcccagcactttgggaagccaaggcaggtrgatcacaaagtcaggagttcgagaccagcctggccaacatggtgaaaccctgtcactactaaaaatacaaaaattagccaggcatggtggcaggtgcctg

SEQ ID NO: 63825 - DNA, 201 bp, Homo sapiens
catttcactttactttgaggaaggactcgttattggttgctctgtacatgttaaaagtcaaggatggggccaggtatggtggctcacgcctgtaatcccarcactttgggaagccaaggcaggtagatcacaaagtcaggagttcgagaccagcctggccaacatggtgaaaccctgtcactactaaaaatacaaaaatta

SEQ ID NO: 63826 - DNA, 201 bp, Homo sapiens
ttgtgtatgcaaacaattagaaaaatcagaaataactaatgtttaaacaaaacctaacaccgtaatacttcaagacctttgggctcatagtctgcctgacwcataggaagtggacaggatggctcagagcactgtcaaggacctcacttgacctcctgcaagtcagttcttctcaggacaaagtggacttttccacaagtt

SEQ ID NO: 63827 - DNA, 201 bp, Homo sapiens
cctgccaccacgcccagctaattttttgtatttttagtagagacggggtttcaccgtgttagccaggatggtctccatctcctgacctcatgatccacccrccttggcctcccaaagtgctgggattacaagtgtgagccaccacacccagccaataaatgctttcttaaagcaatttacagaattctattttatagtaaa

SEQ ID NO: 63828 - DNA, 201 bp, Homo sapiens
actgacacctggtttcaggtgactttaaaagggacctattctgagagactccgtttcacaggagcttctttcagtgtggccagggccctctaggatctcaytgccctttcctccgtctcctcccagcctccctgcacttgctgtcctccagccattccttgccatttcttttcaaaggcacgctcctgcctcagggccttt

SEQ ID NO: 63829 - DNA, 201 bp, Homo sapiens
ctctaggatctcattgccctttcctccgtctcctcccagcctccctgcacttgctgtcctccagccattccttgccatttcttttcaaaggcacgctcctrcctcagggcctttgcacttactgtcttcccccacaaatagccctgttgctcactcccctcatatcctctggtctctgctcagatgctgccctatcagaga

SEQ ID NO: 63830 - DNA, 201 bp, Homo sapiens
tgcagaaagcggagatcgcaacattggactccagcctggtcaagaagagcaaaactccatctcaaataataataataataataataaaataataaataaamagcattactgtggctggccacacaggagcctcctagaagagtctacagcattgtgaggtgttcattatctttgggcagaaggaatacatgtgatctttat

SEQ ID NO: 63831 - DNA, 201 bp, Homo sapiens
cccgtatttactaaaatacaaaaaattagcgggtgtggtggtgggcgcctgtagtcccagctactcgggaggctgaggcaggagaatggcatgaatccggraagcagagcctgcagtgagccaagatcccgccactgcactccagcctgggggacagagcaagactctgtctcaaaaaaaacaaaacaacaacaacaaaaa

SEQ ID NO: 63832 - DNA, 201 bp, Homo sapiens
gaaaccccgtatttactaaaatacaaaaaattagcgggtgtggtggtgggcgcctgtagtcccagctactcgggaggctgaggcaggagaatggcatgaayccgggaagcagagcctgcagtgagccaagatcccgccactgcactccagcctgggggacagagcaagactctgtctcaaaaaaaacaaaacaacaacaac

SEQ ID NO: 63833 - DNA, 201 bp, Homo sapiens
tacataaaacttactgacacggaagatgcccacttcatatgcggtgtgcgtcatggccccattgtagagccttctttcattttaaacagcattactggccrggcacggtggctcatgcctgtaatcccagaactttgggaggccaaggcaggtaaatcacctgaggtcaggagttcaagaccagcctgaccaacatggtga

SEQ ID NO: 63834 - DNA, 201 bp, Homo sapiens
attccttgccatttcttttcaaaggcacgctcctgcctcagggcctttgcacttactgtcttcccccacaaatagccctgttgctcactcccctcatatcstctggtctctgctcagatgctgccctatcagagagaatctcctgacacaaccactctcccctttccttttctttcagggaatgggccactcctggcaccc

SEQ ID NO: 63835 - DNA, 201 bp, Homo sapiens
atcgcttgagccccggaagcggaggttgcggtgagccaagatcaagccattgcactccagcctgggcaacaagagtaaaactctgtctcaaaaaaaaaaaagagacaggcatcccacatcaatgcttccaaggtgtgtacccttttgatctggcaattctgcctagaaggtcatctgaggaagtggccaggagagcacaaa

SEQ ID NO: 63836 - DNA, 201 bp, Homo sapiens
ttataagccctaagattacccataagggtaattgagagtactgagaggcttcaatatcatcaaattcataattacatcaaacaatatatttatgaatagaygtatttccaaaacaggccccctcaccttttctagagctaagattttgatccataaagacttacttctccattgccttcaattagaccaacctgcagaaaa

SEQ ID NO: 63837 - DNA, 201 bp, Homo sapiens
gagaaagaaagaagaaggaaagaaagaaagaaagaaaggaaagaaggagggaaggcaggcaggcaggcactgacacctggtttcaggtgactttaaaaggracctattctgagagactccgtttcacaggagcttctttcagtgtggccagggccctctaggatctcattgccctttcctccgtctcctcccagcctccct

SEQ ID NO: 63838 - DNA, 201 bp, Homo sapiens
ctccatcacaccggcctcagccgagtcacaggaacgcaggctctgccatgcccagaagcctgagatgcaacttcaaggacaacgggagccagaacgcttgrcctcacacggaaggtgactcctaaccaccaccacacttgacgtagcaccagcacacggagattaggtgagagtgggctctggtgcaaagataacagtgct

SEQ ID NO: 63839 - DNA, 201 bp, Homo sapiens
cccacgagacctgatgggaagcgggttaaggtggtttcatgttgaccatgtgtccacaggcttcgcagaccaagagcaagtcggcacaccaggacaggcayttgcatgggtgcccagaagtttcaagatctgaccttggagagaccaggtccgggaggctgccgggaagtctccatcacaccggcctcagccgagtcacag

SEQ ID NO: 63840 - DNA, 201 bp, Homo sapiens
tccatcacaccggcctcagccgagtcacaggaacgcaggctctgccatgcccagaagcctgagatgcaacttcaaggacaacgggagccagaacgcttgayctcacacggaaggtgactcctaaccaccaccacacttgacgtagcaccagcacacggagattaggtgagagtgggctctggtgcaaagataacagtgctg

SEQ ID NO: 63841 - DNA, 201 bp, Homo sapiens; identical to SEQ ID NO: 39254

SEQ ID NO: 63842 - DNA, 201 bp, Homo sapiens; identical to SEQ ID NO: 41606

SEQ ID NO: 63843 - DNA, 201 bp, Homo sapiens; identical to SEQ ID NO: 42221

SEQ ID NO: 63844 - DNA, 201 bp, Homo sapiens; identical to SEQ ID NO: 38785

SEQ ID NO: 63845 - DNA, 201 bp, Homo sapiens; identical to SEQ ID NO: 38787

SEQ ID NO: 63846 - DNA, 201 bp, Homo sapiens; identical to SEQ ID NO: 42059

SEQ ID NO: 63847 - DNA, 201 bp, Homo sapiens; identical to SEQ ID NO: 41665

SEQ ID NO: 63848 - DNA, 201 bp, Homo sapiens; identical to SEQ ID NO: 42855

SEQ ID NO: 63849 - DNA, 201 bp, Homo sapiens; identical to SEQ ID NO: 39633

SEQ ID NO: 63850 - DNA, 201 bp, Homo sapiens; identical to SEQ ID NO: 39635

SEQ ID NO: 63851 - DNA, 201 bp, Homo sapiens; identical to SEQ ID NO: 39203

SEQ ID NO: 63852 - DNA, 201 bp, Homo sapiens; identical to SEQ ID NO: 41751

SEQ ID NO: 63853 - DNA, 201 bp, Homo sapiens; identical to SEQ ID NO: 39768

SEQ ID NO: 63854 - DNA, 201 bp, Homo sapiens; identical to SEQ ID NO: 41254

SEQ ID NO: 63855 - DNA, 201 bp, Homo sapiens; identical to SEQ ID NO: 38962

SEQ ID NO: 63856 - DNA, 201 bp, Homo sapiens; identical to SEQ ID NO: 38963

SEQ ID NO: 63857 - DNA, 201 bp, Homo sapiens; identical to SEQ ID NO: 39777

SEQ ID NO: 63858 - DNA, 201 bp, Homo sapiens; identical to SEQ ID NO: 39778

SEQ ID NO: 63859 - DNA, 201 bp, Homo sapiens; identical to SEQ ID NO: 39779

SEQ ID NO: 63860 - DNA, 201 bp, Homo sapiens; identical to SEQ ID NO: 39780

SEQ ID NO: 63861 - DNA, 201 bp, Homo sapiens; identical to SEQ ID NO: 42625

SEQ ID NO: 63862 - DNA, 201 bp, Homo sapiens; identical to SEQ ID NO: 38087

SEQ ID NO: 63863 - DNA, 201 bp, Homo sapiens; identical to SEQ ID NO: 38088

SEQ ID NO: 63864 - DNA, 201 bp, Homo sapiens; identical to SEQ ID NO: 38089

SEQ ID NO: 63865 - DNA, 201 bp, Homo sapiens; identical to SEQ ID NO: 38090

SEQ ID NO: 63866 - DNA, 201 bp, Homo sapiens; identical to SEQ ID NO: 41621

SEQ ID NO: 63867 - DNA, 201 bp, Homo sapiens; identical to SEQ ID NO: 42741

SEQ ID NO: 63868 - DNA, 201 bp, Homo sapiens; identical to SEQ ID NO: 39659

SEQ ID NO: 63869 - DNA, 201 bp, Homo sapiens; identical to SEQ ID NO: 39662

SEQ ID NO: 63870 - DNA, 201 bp, Homo sapiens; identical to SEQ ID NO: 39665

SEQ ID NO: 63871 - DNA, 201 bp, Homo sapiens; identical to SEQ ID NO: 39668

SEQ ID NO: 63872 - DNA, 201 bp, Homo sapiens; identical to SEQ ID NO: 38527

SEQ ID NO: 63873 - DNA, 201 bp, Homo sapiens; identical to SEQ ID NO: 39671

SEQ ID NO: 63874 - DNA, 201 bp, Homo sapiens; identical to SEQ ID NO: 38332

SEQ ID NO: 63875 - DNA, 201 bp, Homo sapiens; identical to SEQ ID NO: 39674

SEQ ID NO: 63876 - DNA, 201 bp, Homo sapiens; identical to SEQ ID NO: 39676

SEQ ID NO: 63877 - DNA, 201 bp, Homo sapiens; identical to SEQ ID NO: 42113

SEQ ID NO: 63878 - DNA, 201 bp, Homo sapiens; identical to SEQ ID NO: 39678

SEQ ID NO: 63879 - DNA, 201 bp, Homo sapiens; identical to SEQ ID NO: 40138

SEQ ID NO: 63880 - DNA, 201 bp, Homo sapiens; identical to SEQ ID NO: 39679

SEQ ID NO: 63881 - DNA, 201 bp, Homo sapiens; identical to SEQ ID NO: 39680

SEQ ID NO: 63882 - DNA, 201 bp, Homo sapiens; identical to SEQ ID NO: 39504

SEQ ID NO: 63883 - DNA, 201 bp, Homo sapiens; identical to SEQ ID NO: 42548

SEQ ID NO: 63884 - DNA, 201 bp, Homo sapiens; identical to SEQ ID NO: 39505

SEQ ID NO: 63885 - DNA, 201 bp, Homo sapiens; identical to SEQ ID NO: 38835

SEQ ID NO: 63886 - DNA, 201 bp, Homo sapiens; identical to SEQ ID NO: 41040

SEQ ID NO: 63887 - DNA, 201 bp, Homo sapiens; identical to SEQ ID NO: 38839

SEQ ID NO: 63888 - DNA, 201 bp, Homo sapiens; identical to SEQ ID NO: 40388

SEQ ID NO: 63889 - DNA, 201 bp, Homo sapiens; identical to SEQ ID NO: 38844

SEQ ID NO: 63890 - DNA, 201 bp, Homo sapiens; identical to SEQ ID NO: 38847

SEQ ID NO: 63891 - DNA, 201 bp, Homo sapiens; identical to SEQ ID NO: 39144

SEQ ID NO: 63892 - DNA, 201 bp, Homo sapiens; identical to SEQ ID NO: 38850

SEQ ID NO: 63893 - DNA, 201 bp, Homo sapiens; identical to SEQ ID NO: 38010

SEQ ID NO: 63894 - DNA, 201 bp, Homo sapiens; identical to SEQ ID NO: 38854

SEQ ID NO: 63895 - DNA, 201 bp, Homo sapiens; identical to SEQ ID NO: 38011

SEQ ID NO: 63896 - DNA, 201 bp, Homo sapiens; identical to SEQ ID NO: 38012

SEQ ID NO: 63897 - DNA, 201 bp, Homo sapiens; identical to SEQ ID NO: 42030

SEQ ID NO: 63898 - DNA, 201 bp, Homo sapiens; identical to SEQ ID NO: 39035

SEQ ID NO: 63899 - DNA, 201 bp, Homo sapiens; identical to SEQ ID NO: 38976

SEQ ID NO: 63900 - DNA, 201 bp, Homo sapiens; identical to SEQ ID NO: 39264

SEQ ID NO: 63901 - DNA, 201 bp, Homo sapiens; identical to SEQ ID NO: 38978

SEQ ID NO: 63902 - DNA, 201 bp, Homo sapiens; identical to SEQ ID NO: 42499

SEQ ID NO: 63903 - DNA, 201 bp, Homo sapiens; identical to SEQ ID NO: 39692

SEQ ID NO: 63904 - DNA, 201 bp, Homo sapiens; identical to SEQ ID NO: 41027

SEQ ID NO: 63905 - DNA, 201 bp, Homo sapiens; identical to SEQ ID NO: 39695

SEQ ID NO: 63906 - DNA, 201 bp, Homo sapiens; identical to SEQ ID NO: 39698

SEQ ID NO: 63907 - DNA, 201 bp, Homo sapiens; identical to SEQ ID NO: 40156

SEQ ID NO: 63908 - DNA, 201 bp, Homo sapiens; identical to SEQ ID NO: 40157

SEQ ID NO: 63909 - DNA, 201 bp, Homo sapiens; identical to SEQ ID NO: 40649

SEQ ID NO: 63910 - DNA, 201 bp, Homo sapiens; identical to SEQ ID NO: 41645

SEQ ID NO: 63911 - DNA, 201 bp, Homo sapiens; identical to SEQ ID NO: 42902

SEQ ID NO: 63912 - DNA, 201 bp, Homo sapiens; identical to SEQ ID NO: 42182

SEQ ID NO: 63913 - DNA, 201 bp, Homo sapiens; identical to SEQ ID NO: 40019

SEQ ID NO: 63914 - DNA, 201 bp, Homo sapiens; identical to SEQ ID NO: 39244

SEQ ID NO: 63915 - DNA, 201 bp, Homo sapiens; identical to SEQ ID NO: 40159

SEQ ID NO: 63916 - DNA, 201 bp, Homo sapiens; identical to SEQ ID NO: 38039

SEQ ID NO: 63917 - DNA, 201 bp, Homo sapiens; identical to SEQ ID NO: 42183

SEQ ID NO: 63918 - DNA, 201 bp, Homo sapiens; identical to SEQ ID NO: 38870

SEQ ID NO: 63919 - DNA, 201 bp, Homo sapiens; identical to SEQ ID NO: 42205

SEQ ID NO: 63920 - DNA, 201 bp, Homo sapiens; identical to SEQ ID NO: 38566

SEQ ID NO: 63921 - DNA, 201 bp, Homo sapiens; identical to SEQ ID NO: 42184

SEQ ID NO: 63922 - DNA, 201 bp, Homo sapiens; identical to SEQ ID NO: 38874

SEQ ID NO: 63923 - DNA, 201 bp, Homo sapiens; identical to SEQ ID NO: 38878

SEQ ID NO: 63924 - DNA, 201 bp, Homo sapiens; identical to SEQ ID NO: 38881

SEQ ID NO: 63925 - DNA, 201 bp, Homo sapiens; identical to SEQ ID NO: 38885

SEQ ID NO: 63926 - DNA, 201 bp, Homo sapiens; identical to SEQ ID NO: 38889

SEQ ID NO: 63927 - DNA, 201 bp, Homo sapiens; identical to SEQ ID NO: 38893

SEQ ID NO: 63928 - DNA, 201 bp, Homo sapiens; identical to SEQ ID NO: 38570

SEQ ID NO: 63929 - DNA, 201 bp, Homo sapiens; identical to SEQ ID NO: 41588

SEQ ID NO: 63930 - DNA, 201 bp, Homo sapiens; identical to SEQ ID NO: 38573

SEQ ID NO: 63931 - DNA, 201 bp, Homo sapiens; identical to SEQ ID NO: 38983

SEQ ID NO: 63932 - DNA, 201 bp, Homo sapiens; identical to SEQ ID NO: 38043

SEQ ID NO: 63933 - DNA, 201 bp, Homo sapiens; identical to SEQ ID NO: 41593

SEQ ID NO: 63934 - DNA, 201 bp, Homo sapiens; identical to SEQ ID NO: 42433

SEQ ID NO: 63935 - DNA, 201 bp, Homo sapiens; identical to SEQ ID NO: 41594

SEQ ID NO: 63936 - DNA, 201 bp, Homo sapiens; identical to SEQ ID NO: 38745

SEQ ID NO: 63937 - DNA, 201 bp, Homo sapiens; identical to SEQ ID NO: 38748

SEQ ID NO: 63938 - DNA, 201 bp, Homo sapiens; identical to SEQ ID NO: 40797

SEQ ID NO: 63939 - DNA, 201 bp, Homo sapiens; identical to SEQ ID NO: 38750

SEQ ID NO: 63940 - DNA, 201 bp, Homo sapiens; identical to SEQ ID NO: 39429

SEQ ID NO: 63941 - DNA, 201 bp, Homo sapiens; identical to SEQ ID NO: 42141

SEQ ID NO: 63942 - DNA, 201 bp, Homo sapiens; identical to SEQ ID NO: 39993

SEQ ID NO: 63943 - DNA, 201 bp, Homo sapiens; identical to SEQ ID NO: 42811

SEQ ID NO: 63944 - DNA, 201 bp, Homo sapiens; identical to SEQ ID NO: 42273

SEQ ID NO: 63945 - DNA, 201 bp, Homo sapiens; identical to SEQ ID NO: 42275

SEQ ID NO: 63946 - DNA, 201 bp, Homo sapiens; identical to SEQ ID NO: 39080

SEQ ID NO: 63947 - DNA, 201 bp, Homo sapiens; identical to SEQ ID NO: 38606

SEQ ID NO: 63948 - DNA, 201 bp, Homo sapiens; identical to SEQ ID NO: 41202

SEQ ID NO: 63949 - DNA, 201 bp, Homo sapiens; identical to SEQ ID NO: 42189

SEQ ID NO: 63950 - DNA, 201 bp, Homo sapiens; identical to SEQ ID NO: 42949

SEQ ID NO: 63951 - DNA, 201 bp, Homo sapiens; identical to SEQ ID NO: 39738

SEQ ID NO: 63952 - DNA, 201 bp, Homo sapiens; identical to SEQ ID NO: 42190

SEQ ID NO: 63953 - DNA, 201 bp, Homo sapiens; identical to SEQ ID NO: 42911

SEQ ID NO: 63954 - DNA, 201 bp, Homo sapiens; identical to SEQ ID NO: 39100

SEQ ID NO: 63955 - DNA, 201 bp, Homo sapiens; identical to SEQ ID NO: 41812

SEQ ID NO: 63956 - DNA, 201 bp, Homo sapiens; identical to SEQ ID NO: 41743

SEQ ID NO: 63957 - DNA, 201 bp, Homo sapiens; identical to SEQ ID NO: 43025

SEQ ID NO: 63958 - DNA, 201 bp, Homo sapiens; identical to SEQ ID NO: 41603

SEQ ID NO: 63959 - DNA, 201 bp, Homo sapiens; identical to SEQ ID NO: 42449

SEQ ID NO: 63960 - DNA, 201 bp, Homo sapiens; identical to SEQ ID NO: 39882

SEQ ID NO: 63961 - DNA, 201 bp, Homo sapiens; identical to SEQ ID NO: 42534

SEQ ID NO: 63962 - DNA, 201 bp, Homo sapiens; identical to SEQ ID NO: 38778

SEQ ID NO: 63963 - DNA, 201 bp, Homo sapiens; identical to SEQ ID NO: 38780

SEQ ID NO: 63964 - DNA, 201 bp, Homo sapiens; identical to SEQ ID NO: 38782

SEQ ID NO: 63965 - DNA, 201 bp, Homo sapiens; identical to SEQ ID NO: 38783

SEQ ID NO: 63966 - DNA, 201 bp, Homo sapiens; identical to SEQ ID NO: 38989

SEQ ID NO: 63967 - DNA, 201 bp, Homo sapiens; identical to SEQ ID NO: 39105

SEQ ID NO: 63968 - DNA, 201 bp, Homo sapiens; identical to SEQ ID NO: 45142

SEQ ID NO: 63969 - DNA, 201 bp, Homo sapiens
gctggactcttggctcccttgaagcacttgagtctagctgtcagtgtctgggatgtctgtctcccaaggggcagaggttgcaaagcatctgcctgggtccyctgacgcttggttcttccccccttccccagcgagccatccagcaggctgtgggaagctccctgcagggggacctgcccaatgataaaggtatggcggctt

SEQ ID NO: 63970 - DNA, 201 bp, Homo sapiens
agtggggaagcaggatttgccagtcttcatgtgaccagggacggcgtagagcctctctggcctcttccaggtgttggacatggccacggacagcttcctckcagggctggtgagtgtcctggatcccccggatacctgggttcccagccgcctggacctgcggcctggcgagtgagtagctgggcagctggagtgggagag

SEQ ID NO: 63971 - DNA, 201 bp, Homo sapiens
ggcatttcaccacgttggccaggctggtcttgactcctgacctcaggtgatctgccagcctcggcctcccaaagtgcagggattacaggtgtgagccaccrtgcccggccttggttggttggtttttgagacagggtctcgctttgtcacccaagctggcatgcagtggcacagtcacagctcactgtagcctcagccttg

SEQ ID NO: 63972 - DNA, 201 bp, Homo sapiens
cggccgccgctgctggtccgcccacgcgcaagaagtccaggcgggaacgcaagcgcagcggcgaggccaaggaggccgcctcgtcctcgtcgggcacccakccagcgccgcccgccccggcctcgccctgggactccaagaagcaccgctcgcgggaccgcaagcccggctcccacgcctcgtcgtccgcccgccgccgct

SEQ ID NO: 63973 - DNA, 201 bp, Homo sapiens; identical to SEQ ID NO: 45146

SEQ ID NO: 63974 - DNA, 201 bp, Homo sapiens
gtgatccgcccgcctcagcctcccacagtgctgggattacaggcgtgagccactgtgccctgctaccttgtttgttttttttgagacagggtctcactgcrtcccccaggctagagtgcagtggcacagtcacagctcactgcagcctcaaattccccggttcaagttatcctgttgtctcagtctctggagtagctggga

SEQ ID NO: 63975 - DNA, 201 bp, Homo sapiens
ggacgaatggctgagcgtcgcagcctctgaagtgggtgctgggaagtcctcctgggaggtggcgcatggaggcctggagagcatgcgggaggctggttccrctgtcaggaactagatcaagctcctctttcctctaccccgcaagtctctgcagcaagtcccctgtgtccaatcccccatgcaaatctctcaccagatggc

SEQ ID NO: 63976 - DNA, 201 bp, Homo sapiens; identical to SEQ ID NO: 45148

SEQ ID NO: 63977 - DNA, 201 bp, Homo sapiens
tgaagtttggataggttgttggggaagctgcgggaattgaggagtgagatgttaaaagcggaggccagggaggcctccctttgacataagaggcacctgaracccagaaaaaaggaagagaattgctcctagtccctggggtgtctgtgctgggtccagcgcccacccaagcacagggtggagtgggaggaggtggaggag

SEQ ID NO: 63978 - DNA, 201 bp, Homo sapiens
aatgataaaggtatggcggcttccggttccttttagcccctgccccctctctgcattctttatcctaatgtcattcatacaagcttttctgaagcctcctrggtgccacccttgtgctggcatggggagccaaaaatgggcagacaccctgtagctgccttggaagggcctagtgtgcagtggaagggagacaggcacagt

SEQ ID NO: 63979 - DNA, 201 bp, Homo sapiens
gggcagacacaggccggggagagaacgagctggagggacagatgtgtgcagacagatggacgcggatgggagacggggaggaggtcagtctgggaggtgakgagggtgacaggattttctcaaggccacctgggcctgttccgctggccctggggcacccatcgtctagggggacagagggactttggcctggttattggg

SEQ ID NO: 63980 - DNA, 201 bp, Homo sapiens
tgccagaggggatgctgagggagatagtgtggggcccttgaggtcttcatgtctatcctctacttccatcctttctcccgggacctccactccaaactctmccccctggacccccaggtgaccatggaggaagaagatgagtctcgagggaagacagaggagtcgggggaggatcggggcgatggtccgccagacagagac

SEQ ID NO: 63981 - DNA, 201 bp, Homo sapiens
aaacatcctgtgtgagccgcagaggcggggctgcagtttagtcggtcacttgtccgtagcttgtgccttgcgctgcaggactcggacggtgaggaccccctggtctacagtggcccttgctctgccctggtctgtgctctgccctttgccccgctttgcccatccgagatgggtgttggggagcagcgtctctctagagac

SEQ ID NO: 63982 - DNA, 201 bp, Homo sapiens
ctttcaactgcctgactggggaatcatatcaaagaatttccatgacattgcaaaggctttgtgcagatggcgataggtaaatgcctcctgtgaagttttcmttcggcatgtctttctgaagtttagcgttttcattttaaaaatggcatactggttttgcagatcactcaatgaagtttccaacttaggtgtataaataca

SEQ ID NO: 63983 - DNA, 201 bp, Homo sapiens
ttatggctccacctccccacctccctcccccgtcagtgggatgactgggggagggttgctgcagggaagaggagagccccctgccctgccctgccccgtgyccacctcccttgcccccaagcctgtccccagtgcccctcccttctgtttgtgcccctctccccaatttcattaaagatttcatgaaacattacccctgag

SEQ ID NO: 63984 - DNA, 201 bp, Homo sapiens
cttcccccgctgtcgccaccccaccagtatctgaagaagctgcacacgcaggagcgggcggtggaggaggtgaagctggccatcaagccatactatcagargaaggacatcaccaaggaggagtacaaggacatcctgaggaaggccgtccacaaggtgggcacccggagagaggggcagacacaggccggggagagaacg

SEQ ID NO: 63985 - DNA, 201 bp, Homo sapiens
tagggttgtgagcataaggtccagatccacctagttatttttcaccagagttttaaaagacgaaatcgttgaagctgccggcatttagtctagggctttcygcattctcttgacctgcttctcttgtcttgttaatttaggcatgaaacggtgtcgcagtactctggcgtctttattccaggagaggcttcttacaagata

SEQ ID NO: 63986 - DNA, 201 bp, Homo sapiens
tttttttttttttttttttttttttttgagacagagtctcactctgtcgcccaggttggagtgcagtggtgcgatcttagctcactgcaacctctgcctcytgggttcaagcgattctcccgtctcagcctcctgagtagctgggaccacaggtacgtgccatcacgcctggctaattttttaattttagtagagacaggg

SEQ ID NO: 63987 - DNA, 201 bp, Homo sapiens
ccaccagtcccttcccgtgtgatgtggaatgaatcatttgggaaaatatctgagtgcttgaggtcaaagcctctggaatcagactccctggacttaaaccycatcttcagtacttagaaccttgggcaagttacttaatctcagttaagtataaggacatcagtattcatctataaaatcagtacctactacatagttaca

SEQ ID NO: 63988 - DNA, 201 bp, Homo sapiens
cactagaatataagcctcactaggacaggggtttttttttttttttttttttttttttttgagacagagtctcactctgtcgcccaggttggagtgcagtsgtgcgatcttagctcactgcaacctctgcctcttgggttcaagcgattctcccgtctcagcctcctgagtagctgggaccacaggtacgtgccatcacgc

SEQ ID NO: 63989 - DNA, 201 bp, Homo sapiens
acaatggttttccattggctaccgagtcgaacattcttaaagaactcataaagcctcctaccatccttcgaacggttgtcaacaccatcacaggtacggcrgagggggaaactgatagatagtggccatcctacagcctgagtggcttagtcgagtgtcgcacattgttttgagtgtttgtctttggggatctcaggtgtc

SEQ ID NO: 63990 - DNA, 201 bp, Homo sapiens
gttctaggcccagagctgagagtgggggtgagtggtggaggggtgtggcaagagattcaactggagagatcgagaggacagataagtgttaaaggtagtcrggtgtggtggcatgcctgtagtcccatttactcaggaggctgaagcgggagtattgcttgagtccaggagttcaaggctgcaatgagttatgatcacatc

SEQ ID NO: 63991 - DNA, 201 bp, Homo sapiens
gcatgccagaccttacactttccttcatggtaaaatcctgggccagagattaagttcttgggatgagaaattaaatgctgctggaaagacagagtagtggsaatggaatagaacaagaagaaataattaggacagccacgaagcttgtctcaggcttgaattttctagaagtcactacatgatttctgtgtgtgtgtgtgt

SEQ ID NO: 63992 - DNA, 201 bp, Homo sapiens
gctgagggaatagtcttgcacattttttcatttcttacttgtctaaaagtaaaaaaaaatatcagcctgtctcctaggtcagtcccctcctggacccaccygctcccttttttccttagccttcagtgccatggaactaatcaagggaggaaaaggtcaccagggagaactggacagaactgaaacacagcaacaccagtt

SEQ ID NO: 63993 - DNA, 201 bp, Homo sapiens
agtcctcgaaaagaaaggagctgatcattggctggatgtgggcgggagaagtggacgttgtcagggatgcatctgtgtttctggcttaggcagcaggataratggtgccatcacacagatttggaaatgggagcaccgggttcagggcatgagagaatggactcatttctgacatgtgcctcagtgtcatccaagtggaga

SEQ ID NO: 63994 - DNA, 201 bp, Homo sapiens
gtagatttagacaaggtgcttaatggaagactccctgagaaggtaccataaaggaagacttaaaggaagaacaggagcttccaagcagaggaaagagcatrttctaggcccagagctgagagtgggggtgagtggtggaggggtgtggcaagagattcaactggagagatcgagaggacagataagtgttaaaggtagtcg

SEQ ID NO: 63995 - DNA, 201 bp, Homo sapiens
ttcccctcatcttagcagacatccctggctaattctgtcagcaggacaagctgcaccccatgcagttctcaacctaatgagcttcaccttcctattagccygcgaaataattcaaacaaaccaatcacatgctccaatgggaaccaagggccatcctgccctcttgtctctaccaaggctgcctctctgggggtttgctct

SEQ ID NO: 63996 - DNA, 201 bp, Homo sapiens
tctcctgaggaacctacaggattctaaggtttcctaggtcactgaacaactaatcttggtccctgaatatttctaggtttgtaagtgcagcagttttattkcctctagaactcatcctgtttcaagggaagtacctaagaagatatagagtgtttctagggtaagggacctgcaggtgtaagcatagatgaaataactgtc

SEQ ID NO: 63997 - DNA, 201 bp, Homo sapiens
tctttggtggccatgtgtctgggatgtggggttcacctatcatctgccccagggatcctaagaggggaacagatggtgttttcaaaacctatctggaaatwaaaaaggttacggtgctgagaggaagagcagagtccaagaggagggggctgtgagagagaaacgcagagagaggataaagctaggacttccagttattct

SEQ ID NO: 63998 - DNA, 201 bp, Homo sapiens
tcacagctttgctgttcgaccttgggcagttatttaagctgtctttgcagcttcctcatctacgaaaaggggatcacaacggtaattcattttagagtagytggggggattaaatgatttcagatcctcctctcttatgtgaactcttaaatttggagtgtccctggaatctggttctcttatctctccacactccttccc

SEQ ID NO: 63999 - DNA, 201 bp, Homo sapiens
tggtggctcacatctgtaatcccagcactttgggaggccgagttgggtggatcattaggtcaggagttcaagaccagcctggccaacatagtgaaaccccrtctctactaaaaatacaaaaattagccggatgtggtggcacgcgcctgtagtcccagctactcgggaggctgaggcaggagaattgtttgaacccggaag

SEQ ID NO: 64000 - DNA, 201 bp, Homo sapiens
gcgtctgggcccaggcgggcgcgcgtcgcgctcggatttcgggcggatagtgcgtgggaggcggcgctgccctccgtatgcagcgcgcgtgcagccaaggyggcgctgcgatctgcggcctggggccctggtgtgaaactcccgcggagacgctcccagccccgggccgcagctcgcccctgcacggagggaggtgtctaa

SEQ ID NO: 64001 - DNA, 201 bp, Homo sapiens
ggttgcagtaagccctgatcatgacactgcactccagcctgggcaacagcaagaccctgtctcaaaaaaaaaaaaaaaaaaaaaaaaaaaagtaacaaatwaatttcttattgattaaattaccttctcgaaagtatttggctcccagttctgatggcagaactaaagttgtaatcacaaaattcagggagctgccttttc

SEQ ID NO: 64002 - DNA, 201 bp, Homo sapiens
gaggaactttctcccaaaagaaccaatcaacttctaactgttgtggttatttgcataactcaaatgagaagcgagggccttttggtttaacttctgtgtcrtatgaggtctggaatgagtcatatgaacactggaattgtggaattggagaagagaatgaggacccacacactatgataaaagttaaaaagcaagtcaaag

SEQ ID NO: 64003 - DNA, 201 bp, Homo sapiens
ctacatggttcttttttttttttttgagatggcgtcttgctctgttgcccaggatggagtgcagtggtgcgatctcaactcactgcaacctccgcctcccrggctcaagcgattctcctacctcagcctcccgagtagctgggattacaggcacacgccaccatgcccagctaatttttgtattttttaggagagatgggg

SEQ ID NO: 64004 - DNA, 201 bp, Homo sapiens
ctacatttttagttgcatgttactctttctgctcacttcctttctgttatcttcaagtctttttttttttttttttgagactgagtctcgttctatcaccsaggctggagtgcaatggcacgatcttggctcactgcaaactctgccttccaggttcaagccattctcatgcctcggcctcccgagtagctgggattacag

SEQ ID NO: 64005 - DNA, 201 bp, Homo sapiens
tttagttcaatcctctcattttacgacccatgagacccaaggacctccctaggtaacctcctgaggtcacaccgccagtttgtggtgaccctgtcaccacrcagatgaccctgtgattgcttatcatccccacaatgctttcagacatgactcttaccctgacatcacgtactgtaccttgttttcacaacggacatgttt

SEQ ID NO: 64006 - DNA, 201 bp, Homo sapiens
tggttgattggttggttggttggttggctggttttgtcttcagagatagagtcttgctatgttgcccagaatggtcttgaactcctggggtcaatcgatcygcccgcagcttcctgagtagttgagaatacaggtgtgtgctgtctcacccagctcttcatctgttttctatgaaaccttccatttgtctaaaatatttca

SEQ ID NO: 64007 - DNA, 201 bp, Homo sapiens
agatactaagttcaggttactttcaaaaccaaaatatgatatctgtttctcaggtaactttttcttaaacctttattctgtttgaaaaggcagaccagatrgcaacaaggggttttaaaaatagactaggttaccccatatagaagttgggaaaaacctcatcttctgtttgaaaaattcttcaattgagtgcatgaatag

SEQ ID NO: 64008 - DNA, 201 bp, Homo sapiens
gtggctatcgtattaagctgcgcatttcttgtgtatgtgtgagctgttgccaaaacatgacatcaaattcagtgttcttggaagccctcttcaaagaacastgattgtgttgcagtcaggcaacgcaaaacatgaggcacggcccttttcttcaaggagtttgcggttcggttgagaaaatagacacccacagataagtag

SEQ ID NO: 64009 - DNA, 201 bp, Homo sapiens
gacgagggaaacaataggacctgtatgttttacacacagttctcattcgaaatgtatcatgatcatatttttaaagatgcgtgttacctttcataaatacytaaataaaacttactttctgttgtctgcggaggaacttgataaacattaaaaaagcaagaatatctttggtggccatgtgtctgggatgtggggttcacc

SEQ ID NO: 64010 - DNA, 201 bp, Homo sapiens
aatgggattgctggattgcatggtagtgctatattaagttctttgagagatccccaaactgcttttcacagggcaacaaacatttactgaaacctcctgartgccagatattgtgctaggcaatggctacaaaggtgagcaggacagacacagtgcctgacctcagggggcacatactctagtggggaagactgacaaaga

SEQ ID NO: 64011 - DNA, 201 bp, Homo sapiens
ttgcttggctttaattatctaaagccaatgaaagacttctttgttgattttttaagatagaaagattaaaaagaaagaaagatgggaagaaaatgaatgtyagtcaaggaaaggccacttaaggatctgctctatgaaggagaagaaagaggaaaaagaagtaaaggagttaggaggagacacttaaatgaaagattggca

SEQ ID NO: 64012 - DNA, 201 bp, Homo sapiens
ggacagacacagtgcctgacctcagggggcacatactctagtggggaagactgacaaagaagaaaagaccacagataaataaacacagtaattacaagctkcgatgggtattataaagaatagagacagaatacttagggtggtagaggaagacaaagatggggggtagatttagacaaggtgcttaatggaagactccct

SEQ ID NO: 64013 - DNA, 201 bp, Homo sapiens
gagatacatcgagagctgtcatcattaaaagggtattacactcatgaagccatctagggagagtgcagagaaagaaccgcggagcgtctactaacaagccrcagaataatgccatgcccctgaggtgagggtgtggcctcatgattggatattcttgtggctaatcatctggggaagggaccatttggtgcaataattatg

SEQ ID NO: 64014 - DNA, 201 bp, Homo sapiens
gaaaaagaagtaaaggagttaggaggagacacttaaatgaaagattggcaagaaaagcagtcggactctaccttaaggagggatgggaaggaaagagttgwgttggtttctttctgattcctctactcatgtagaaaacacttgtacttctggaaatggactggagactttttaaatttgagtccactattgacatggaaa

SEQ ID NO: 64015 - DNA, 201 bp, Homo sapiens
gattgtggcctggactaaagtgatgacattgcattggagagattctgaattcctgatgtacattgaagatagaatccacagggtatgcttctgattacatraggggatgagggtaatggaggacttgaggatgactcatgggtttgagtagctggatggatggtggtattgtttactaagctggggaaaacagttgaggtt

SEQ ID NO: 64016 - DNA, 201 bp, Homo sapiens
tcaccggccattttcctgttacctgatccttctacaggatttttaaaaagtaagagagtttcagagaagccgatcccataatccccagtgcagccagggtytgtgtgtcatcgtactggagtagagggccgactcttcccatgaaggtgagcacagctgtgagtgagtgagctcatatctccatttgtcagtgctggactg

SEQ ID NO: 64017 - DNA, 201 bp, Homo sapiens
gagcacagctgtgagtgagtgagctcatatctccatttgtcagtgctggactggtaccagatcgtaaccttcccgttggtcggaaacttttccatctgtcrccctagaaaaagagaaagcttaccatcgagggtgtggttgatccttgaagctgcttggtaaagttatcatttcctcagtcttttcttttgtactcctatc

SEQ ID NO: 64018 - DNA, 201 bp, Homo sapiens
ttaccatcgagggtgtggttgatccttgaagctgcttggtaaagttatcatttcctcagtcttttcttttgtactcctatcatgtattcattaatatctaycagtcccttttcattctaagacaaaacatttctcctaaatctctgaataaaatcagtgctgtaggaagatggactgtgttgatcatgggtgtaagcaacc

SEQ ID NO: 64019 - DNA, 201 bp, Homo sapiens
taatttagcacctaacgttagccttttaaataaaaggacaaagagttcttggaatgctagcgtcttaaagatagtccaaaggaattttcaggtgtgctagyttgtccccttcatttcatttttttcccctcaactcttattcactgcatgaatgttaagaaatagcacagcagtaggggtaaagattttcatgtactgttc

SEQ ID NO: 64020 - DNA, 201 bp, Homo sapiens
atactttacttatgtatattgattattatctgtcttttccccactagaatataagcctcactaggacaggggtttttttttttttttttttttttttttttgagacagagtctcactctgtcgcccaggttggagtgcagtggtgcgatcttagctcactgcaacctctgcctcttgggttcaagcgattctcccgtctca

SEQ ID NO: 64021 - DNA, 201 bp, Homo sapiens
acagtcgcactggtgaaactgacagccgctatatggccatactaatgtaacttattacaagacaggaagtgagaagagttgtttgatctagttgaaaccaygggggaatttgggaaagcagagtaaatttgctaatttggaagtctgagacttcagagcttgttattcttgaagcagttgttaaaagtcagtggacatcct

SEQ ID NO: 64022 - DNA, 201 bp, Homo sapiens
tatactttacttatgtatattgattattatctgtcttttccccactagaatataagcctcactaggacaggggtttttttttttttttttttttttttttttgagacagagtctcactctgtcgcccaggttggagtgcagtggtgcgatcttagctcactgcaacctctgcctcttgggttcaagcgattctcccgtctc

SEQ ID NO: 64023 - DNA, 201 bp, Homo sapiens
tgaaaacacccaaatttatatctcaagctcagcccactctcctgaaccctggacttatatgtccagctgccttctcaacatctccacttggatagttaatrgagctcacagatatattgatatactttggatgtttgtcccctccaaatctcatgttgaaatgtgatccccagttttggaggtgggtctagcaggtgtcat

SEQ ID NO: 64024 - DNA, 201 bp, Homo sapiens
gaactcgtgagctccagcggtctgcccgcggaggcctccctaagtactgggatcacaggcgggagccccaagggatctttttaaatgtcttactgcattarcaagtgcctaaggagtgctcagagaatagctctgattggatgaataaagacccccaagggcagctttccattcctcccaccaattctggtgggcagaaat

SEQ ID NO: 64025 - DNA, 201 bp, Homo sapiens
tgggttcctgggcttagaggtaggaagtgtggaatctgagccattctgctcagatcttccaacgtccttgaatcacagctttgctgttcgaccttgggcagttatttaagctgtctttgcagcttcctcatctacgaaaaggggatcacaacggtaattcattttagagtagttggggggattaaatgatttcagatcctc

SEQ ID NO: 64026 - DNA, 201 bp, Homo sapiens
gcccggattggatcacatttgtgagctacatttttagttgcatgttactctttctgctcacttcctttctgttatcttcaagtctttttttttttttttttgagactgagtctcgttctatcacccaggctggagtgcaatggcacgatcttggctcactgcaaactctgccttccaggttcaagccattctcatgcctcg

SEQ ID NO: 64027 - DNA, 201 bp, Homo sapiens
actcatcctgtttcaagggaagtacctaagaagatatagagtgtttctagggtaagggacctgcaggtgtaagcatagatgaaataactgtcctgtcacaygtgcagcaggccatggagtgtagcgggcatcgctgccgccattcctgcagcatcaccataagcagtgcagggtgtctccatcgagctgtttggttccatg

SEQ ID NO: 64028 - DNA, 201 bp, Homo sapiens
ctctagaactcatcctgtttcaagggaagtacctaagaagatatagagtgtttctagggtaagggacctgcaggtgtaagcatagatgaaataactgtccwgtcacacgtgcagcaggccatggagtgtagcgggcatcgctgccgccattcctgcagcatcaccataagcagtgcagggtgtctccatcgagctgtttgg

SEQ ID NO: 64029 - DNA, 201 bp, Homo sapiens
gtgtctgttactatttaaatatttatacaaaagggtttttgtttatagcttaaggaatgatactgtgctctgcttggtgcatggagaaaaaggaagacccrtactctccacaccctagagcttttctctaaatattgtgcaaagtttttgctagttttatcttctgactttgggactagtttttgctgcagagttgtgttg

SEQ ID NO: 64030 - DNA, 201 bp, Homo sapiens
gttggagcctttttttgctgtcagtatctgtcccaagactggagaatccatctgctctgcataagtggttccctgtcacagcaatgtcggtcccactgacytcagtgtattgaacagaaacagttaggcgacctgctccttttgaataatactcatgtctattttccctctctccctcctttctaggactcaaggtgaatc

SEQ ID NO: 64031 - DNA, 201 bp, Homo sapiens
ttctattttggaaccactgggcctttccaggtcagttcactatagtctgtgccgaccttagcacggtagtcatcagttaccactttgggggcatttaccaygttccaggcactgttttaagctcttttcatgtgttttcttttttaatccttagaaactctgtgatgtggaaaggagatgactttagctttatatgaagtt

SEQ ID NO: 64032 - DNA, 201 bp, Homo sapiens; identical to SEQ ID NO: 32146

SEQ ID NO: 64033 - DNA, 201 bp, Homo sapiens; identical to SEQ ID NO: 32147

SEQ ID NO: 64034 - DNA, 201 bp, Homo sapiens; identical to SEQ ID NO: 32118

SEQ ID NO: 64035 - DNA, 201 bp, Homo sapiens; identical to SEQ ID NO: 32284

SEQ ID NO: 64036 - DNA, 201 bp, Homo sapiens; identical to SEQ ID NO: 32119

SEQ ID NO: 64037 - DNA, 201 bp, Homo sapiens; identical to SEQ ID NO: 31931

SEQ ID NO: 64038 - DNA, 201 bp, Homo sapiens; identical to SEQ ID NO: 31932

SEQ ID NO: 64039 - DNA, 201 bp, Homo sapiens; identical to SEQ ID NO: 32142

SEQ ID NO: 64040 - DNA, 201 bp, Homo sapiens; identical to SEQ ID NO: 32143

SEQ ID NO: 64041 - DNA, 201 bp, Homo sapiens; identical to SEQ ID NO: 32145

SEQ ID NO: 64042 - DNA, 201 bp, Homo sapiens; identical to SEQ ID NO: 32278

SEQ ID NO: 64043 - DNA, 201 bp, Homo sapiens; identical to SEQ ID NO: 38236

SEQ ID NO: 64044 - DNA, 201 bp, Homo sapiens; identical to SEQ ID NO: 40718

SEQ ID NO: 64045 - DNA, 201 bp, Homo sapiens; identical to SEQ ID NO: 38239

SEQ ID NO: 64046 - DNA, 201 bp, Homo sapiens; identical to SEQ ID NO: 42278

SEQ ID NO: 64047 - DNA, 201 bp, Homo sapiens; identical to SEQ ID NO: 42573

SEQ ID NO: 64048 - DNA, 201 bp, Homo sapiens; identical to SEQ ID NO: 40722

SEQ ID NO: 64049 - DNA, 201 bp, Homo sapiens; identical to SEQ ID NO: 42575

SEQ ID NO: 64050 - DNA, 201 bp, Homo sapiens; identical to SEQ ID NO: 42577

SEQ ID NO: 64051 - DNA, 201 bp, Homo sapiens
atggcggcaggcacctgtagtcccagctactccggaggctgagacaggagaatggcttgaacccgggacgcggaagttgcggtgagccgagatcacgccaytgcactccagcctgggtgacagagcgagattctgtctccaaaaaataaaaaatattataaaagaataaattcagatacatgctacaacgtgatggacctt

SEQ ID NO: 64052 - DNA, 201 bp, Homo sapiens
gtgctcctggcatgtggtcggtcgaagccaaggacactgctcagcattctgcagtgcacaggacggccccgcccaggcggagaatgatccggtgacacatrtaggtgggaaggatgcacgaatgatggcgtttaggaagaatattatcacttctttcccgtaagagcaacttagagcaagaaaatggtattcttagggcct

SEQ ID NO: 64053 - DNA, 201 bp, Homo sapiens
gtgatttggcctcccaaagtgctgggaatacaggcatgagccaccgcgcccggccagtgccgttgacttgtatgtgcacttacaggtggttaaaatgagamctatcagggtgttgatatctaaaaacctccctgccatcatcttccctacatctctcattcagtgaccatggttgaatgcctgccacctttcaaatattat

SEQ ID NO: 64054 - DNA, 201 bp, Homo sapiens
tagggccttctctcttatggaggctccaagccagggttgccatggcagaagatgctgggcttgctttttccttgagagaactgtactcaagatgatgtaamtgtcaccccgggtgccacttgggtgctttggagaagcgctcagacgcgacacgccgtgacgactccgcggcaggcagccggacctgtcctctggcgtgcg

SEQ ID NO: 64055 - DNA, 201 bp, Homo sapiens
caaagtctgggggatccatagtggtgatggttacacaacactgtaaatgtatttatatttaatgccattgactgttttttgttttttggttttttgagacrgagtctcactctgtcgccgaggctggagtgcagtggcgcgatcttggctcaccgcaacctccgcctcccgggttcaagcgattctcctgcctcagcctcc

SEQ ID NO: 64056 - DNA, 201 bp, Homo sapiens
cccagtaagaaatacctactacacacacacagtctccggtcggcatgcttagggtagtcttccaattccccctcctggtatttacaccctggagtggtccrctcctcttgggctgaacctgtaacttgctcccaagcaagagcacacagcaagctcacgcacgtggttgttggtgtgattctgtttctccagattgtctcc

SEQ ID NO: 64057 - DNA, 201 bp, Homo sapiens
ggagtgcagtggcgcgatcttggctcaccgcaacctccgcctcccgggttcaagcgattctcctgcctcagcctcctgagtagctgggactacaggtgcgygccaccatgcctagttgattttttgtatttttagtagagacggggtttcaccgtgttagccaggatggtctcgatctcctgaccttgtgatttggcctcc

SEQ ID NO: 64058 - DNA, 201 bp, Homo sapiens
taaaaaccacttcctttgctcatttatcaaactcaaacgctaggagggccacctaacatcctccgtcccacgcaatggggtgtttctggagcactccggtktatcagggaccctgtcagttgccatcgcacatgtatatggggccagcccctgtgccaccgaagaggggggatattgaaaacatgttacagccaggagcgg

SEQ ID NO: 64059 - DNA, 201 bp, Homo sapiens
tcctctggcgtgcggttcacgggctgtgtttatccccctggttccttcacagccaccttgggaaatacgttgcctctgaatcacgccaggcaggctctcastgtgtgtgctgcggggctggaaatcagggtgacactccgctaccgaacagcctgactaggaagccagaaagacgctgccggctttagtttgtcctttgac

SEQ ID NO: 64060 - DNA, 201 bp, Homo sapiens
atagtggtgatggttacacaacactgtaaatgtatttatatttaatgccattgactgttttttgttttttggttttttgagacggagtctcactctgtcgmcgaggctggagtgcagtggcgcgatcttggctcaccgcaacctccgcctcccgggttcaagcgattctcctgcctcagcctcctgagtagctgggactac

SEQ ID NO: 64061 - DNA, 201 bp, Homo sapiens
aggcaggcagattgcctgagctcagcagttcaagaccagcctgggcaacacagtaaaacccccaaaaaatacaaaaaaaaaatagccgggcatggcggcasgcacctgtagtcccagctactccggaggctgagacaggagaatggcttgaacccgggacgcggaagttgcggtgagccgagatcacgccactgcactcca

SEQ ID NO: 64062 - DNA, 201 bp, Homo sapiens
ttataaatctttaatacataagctggctttaaaattattggtaaaataagattagaaatgtcttaagaattgttggcgtttttgtttgcacttattgaacragtggtttcatgcttatccctgcagaatactatgagatttgtcataagggttataaaactataaacccggctaggcgtggtggctcacgcctgtaatccc

SEQ ID NO: 64063 - DNA, 201 bp, Homo sapiens
tacaaataattagccaagtgtggtggcatgcacctgtagtcccagatactcaggaggctgaggcaggagaatcacaggtcgaggttgtagtgagctgtgayggcactgcactccagccttggcaacacagtaagacctcgtctctaaaaaagcaaaaagggctgggtgcactggctcacacctataatcccagcactttgg

SEQ ID NO: 64064 - DNA, 201 bp, Homo sapiens
tccggtgacacatgtaggtgggaaggatgcacgaatgatggcgtttaggaagaatattatcacttctttcccgtaagagcaacttagagcaagaaaatggwattcttagggccttctctcttatggaggctccaagccagggttgccatggcagaagatgctgggcttgctttttccttgagagaactgtactcaagatga

SEQ ID NO: 64065 - DNA, 201 bp, Homo sapiens
tgggattacaggcgtgcaccatcacgcctggccactgttatgtagtttttaccacaatttaaaaaaggaaagagtgcctgggtgagtcctacgcacctatwcggagaaccaaaggctttgaggttatcctcggcccacccatctgatgggagtgtttctcaaacttgcttttccgtgatctcccagtaagaaatacctact

SEQ ID NO: 64066 - DNA, 201 bp, Homo sapiens
tatttttagtagagacggggtttcaccgtgttagccaggatggtctcgatctcctgaccttgtgatttggcctcccaaagtgctgggaatacaggcatgasccaccgcgcccggccagtgccgttgacttgtatgtgcacttacaggtggttaaaatgagaactatcagggtgttgatatctaaaaacctccctgccatca

SEQ ID NO: 64067 - DNA, 201 bp, Homo sapiens
tttgtatttttagtagagacggggtttcaccgtgttagccaggatggtctcgatctcctgaccttgtgatttggcctcccaaagtgctgggaatacaggcrtgagccaccgcgcccggccagtgccgttgacttgtatgtgcacttacaggtggttaaaatgagaactatcagggtgttgatatctaaaaacctccctgcc

SEQ ID NO: 64068 - DNA, 201 bp, Homo sapiens
cctctagccatttggtgtggcatcggaaagaaaactaaggccaggtacggtggctcatgcctgtaatcccaacaatttgggaggccatggcggaagggtcmcttgagcccaggagtttgagaccagcctgggcaacatagcaaatgttatgttgccacctctacaaataattagccaagtgtggtggcatgcacctgtagt

SEQ ID NO: 64069 - DNA, 201 bp, Homo sapiens
taacctaaccacaagactaacctactgtcacttctgccctatcctactgctagaagccagtcgctacatctcccccacactcaaagggaggtggtcgcacygtggggtccactggaagttgcctaccagactcaggtcatcccaaacacaccctctagccatttggtgtggcatcggaaagaaaactaaggccaggtacgg

SEQ ID NO: 64070 - DNA, 201 bp, Homo sapiens
acgcacgtggttgttggtgtgattctgtttctccagattgtctccattcctccctggcttctccacagggccgctcaccatggcagccggctccatcaccrccagccagcgagagggcaagacaagagggctgacgagggacgctaccatcacagaggtcagttttgtaacctaaccacaagactaacctactgtcacttc

SEQ ID NO: 64071 - DNA, 201 bp, Homo sapiens
ccgggcatggcggcaggcacctgtagtcccagctactccggaggctgagacaggagaatggcttgaacccgggacgcggaagttgcggtgagccgagatcrcgccactgcactccagcctgggtgacagagcgagattctgtctccaaaaaataaaaaatattataaaagaataaattcagatacatgctacaacgtgatg

SEQ ID NO: 64072 - DNA, 201 bp, Homo sapiens
gttcctgtttggggtttgctggctggaaaaaaaaaaaaaaaaaaaggaaagctggctttctagtaaaaaccacttcctttgctcatttatcaaactcaaaygctaggagggccacctaacatcctccgtcccacgcaatggggtgtttctggagcactccggtgtatcagggaccctgtcagttgccatcgcacatgtata

SEQ ID NO: 64073 - DNA, 201 bp, Homo sapiens
gacctgtcctctggcgtgcggttcacgggctgtgtttatccccctggttccttcacagccaccttgggaaatacgttgcctctgaatcacgccaggcaggvtctcactgtgtgtgctgcggggctggaaatcagggtgacactccgctaccgaacagcctgactaggaagccagaaagacgctgccggctttagtttgtcc

SEQ ID NO: 64074 - DNA, 201 bp, Homo sapiens
ttgagacggagtctcactctgtcgccgaggctggagtgcagtggcgcgatcttggctcaccgcaacctccgcctcccgggttcaagcgattctcctgcctyagcctcctgagtagctgggactacaggtgcgtgccaccatgcctagttgattttttgtatttttagtagagacggggtttcaccgtgttagccaggatgg

SEQ ID NO: 64075 - DNA, 201 bp, Homo sapiens
tgtcgccgaggctggagtgcagtggcgcgatcttggctcaccgcaacctccgcctcccgggttcaagcgattctcctgcctcagcctcctgagtagctggractacaggtgcgtgccaccatgcctagttgattttttgtatttttagtagagacggggtttcaccgtgttagccaggatggtctcgatctcctgaccttg

SEQ ID NO: 64076 - DNA, 201 bp, Homo sapiens
gtagagacggggtttcaccgtgttagccaggatggtctcgatctcctgaccttgtgatttggcctcccaaagtgctgggaatacaggcatgagccaccgckcccggccagtgccgttgacttgtatgtgcacttacaggtggttaaaatgagaactatcagggtgttgatatctaaaaacctccctgccatcatcttccct

SEQ ID NO: 64077 - DNA, 201 bp, Homo sapiens
tggctgatgaccccctcacctctgactccccctccctccctgctttctgaacgcacatccatcaccaaccataggttcctgtttggggtttgctggctggaaaaaaaaaaaaaaaaaaaggaaagctggctttctagtaaaaaccacttcctttgctcatttatcaaactcaaacgctaggagggccacctaacatcctcc

SEQ ID NO: 64078 - DNA, 201 bp, Homo sapiens
caattccccctcctggtatttacaccctggagtggtccgctcctcttgggctgaacctgtaacttgctcccaagcaagagcacacagcaagctcacgcacrtggttgttggtgtgattctgtttctccagattgtctccattcctccctggcttctccacagggccgctcaccatggcagccggctccatcaccgccagcc

SEQ ID NO: 64079 - DNA, 201 bp, Homo sapiens
actgttttttgttttttggttttttgagacggagtctcactctgtcgccgaggctggagtgcagtggcgcgatcttggctcaccgcaacctccgcctcccrggttcaagcgattctcctgcctcagcctcctgagtagctgggactacaggtgcgtgccaccatgcctagttgattttttgtatttttagtagagacgggg

SEQ ID NO: 64080 - DNA, 201 bp, Homo sapiens
ggctgatgaccccctcacctctgactccccctccctccctgctttctgaacgcacatccatcaccaaccataggttcctgtttggggtttgctggctggaaaaaaaaaaaaaaaaaaaggaaagctggctttctagtaaaaaccacttcctttgctcatttatcaaactcaaacgctaggagggccacctaacatcctccg

SEQ ID NO: 64081 - DNA, 201 bp, Homo sapiens
gtggcgcgatcttggctcaccgcaacctccgcctcccgggttcaagcgattctcctgcctcagcctcctgagtagctgggactacaggtgcgtgccaccaygcctagttgattttttgtatttttagtagagacggggtttcaccgtgttagccaggatggtctcgatctcctgaccttgtgatttggcctcccaaagtgc

SEQ ID NO: 64082 - DNA, 201 bp, Homo sapiens
tggagtgcagtggcgcgatcttggctcaccgcaacctccgcctcccgggttcaagcgattctcctgcctcagcctcctgagtagctgggactacaggtgcstgccaccatgcctagttgattttttgtatttttagtagagacggggtttcaccgtgttagccaggatggtctcgatctcctgaccttgtgatttggcctc

SEQ ID NO: 64083 - DNA, 201 bp, Homo sapiens
tgagactgtctcaaaaataaaaataaggccgggcgtggtggcccatgcctgtaatcctagtactttaggaggctgaggcaggcagattgcctgagctcagsagttcaagaccagcctgggcaacacagtaaaacccccaaaaaatacaaaaaaaaaatagccgggcatggcggcaggcacctgtagtcccagctactccgg

SEQ ID NO: 64084 - DNA, 201 bp, Homo sapiens
caaaggcctggggtccccaggatggccctcaaaccgactggtgcccttgcaggctgccaccctccaagtcctgcttctctccagagatgggcagaagcacmagccctcgcctggcaccagcagtgagtctcataattgccatttaccattttgctagggggcttctggggatcctaggaaaagcagcagatgcctgggtgc

SEQ ID NO: 64085 - DNA, 201 bp, Homo sapiens
ggcctccatctccctctgtagaaattgcagctagttagatagtctgcctcttattccagctctactgggggaacataatatggtctaagaagaaatttttscagcaagaggccatctctgcaaatcacctgtgaggcagacctgtggcaattttatgactcagctggccaccaggaagcgattgtagctgggttctgcccc

SEQ ID NO: 64086 - DNA, 201 bp, Homo sapiens
taagaattgtctcatctcctcctgcatcctcagtgcccgatctttggcttctatgaaggaaggtgggtagtgcttatggcagggccagttctacctttctyagtatgttctggcctgggtatgtagccccattttctagtggttaccttgacatcatgaagagtttatgtctcttttgccctagatttgggcaatagtcat

SEQ ID NO: 64087 - DNA, 201 bp, Homo sapiens
acaatttctattgaggactcattgttctaagaattgtctcatctcctcctgcatcctcagtgcccgatctttggcttctatgaaggaaggtgggtagtgcbtatggcagggccagttctacctttctcagtatgttctggcctgggtatgtagccccattttctagtggttaccttgacatcatgaagagtttatgtctct

SEQ ID NO: 64088 - DNA, 201 bp, Homo sapiens
tgggttctgccccttattgaaacctactcaatgttctccttcactaagtaggacaagaccgtaccctgcctttaaggtttatagaatagaaagtgaaaacwctttggggaagaaaatcttcctgaacagatagcccagggcattttgaaaatcccttaggaagttctctgtttcacttgggtacctctgtccttggacttt

SEQ ID NO: 64089 - DNA, 201 bp, Homo sapiens
atatggacaatttctattgaggactcattgttctaagaattgtctcatctcctcctgcatcctcagtgcccgatctttggcttctatgaaggaaggtgggyagtgcttatggcagggccagttctacctttctcagtatgttctggcctgggtatgtagccccattttctagtggttaccttgacatcatgaagagtttat

SEQ ID NO: 64090 - DNA, 201 bp, Homo sapiens
aagagaagcaaagaggactcatgagataccacagggccgctgagtccagccttgcctggagctagggccacctcgatgccctatagtcttggagccacaasgtgcatttactcaaagcctctttgagtttggtttgcttgtttgctttctgcctggaaactgccagcatcctgagagatacgagatctgcatctgtgcaga

SEQ ID NO: 64091 - DNA, 201 bp, Homo sapiens
agcgattgtagctgggttctgccccttattgaaacctactcaatgttctccttcactaagtaggacaagaccgtaccctgcctttaaggtttatagaataraaagtgaaaacactttggggaagaaaatcttcctgaacagatagcccagggcattttgaaaatcccttaggaagttctctgtttcacttgggtacctctg

SEQ ID NO: 64092 - DNA, 201 bp, Homo sapiens
gtgaggcagacctgtggcaattttatgactcagctggccaccaggaagcgattgtagctgggttctgccccttattgaaacctactcaatgttctccttcmctaagtaggacaagaccgtaccctgcctttaaggtttatagaatagaaagtgaaaacactttggggaagaaaatcttcctgaacagatagcccagggcat

SEQ ID NO: 64093 - DNA, 201 bp, Homo sapiens
gaaatgtttaccacacacaaagtattagtgccttttatatcatcaagacaaaaataacaggaaaaagacaaacacattatagtgaaaacttgtttttcctraccagcatctattctgcatgttccctgatgccagaaactcacatttcttcagggcaaacccccttccccaccattctcaggctttaagtttatgtaaaat

SEQ ID NO: 64094 - DNA, 201 bp, Homo sapiens
agtggttaccttgacatcatgaagagtttatgtctcttttgccctagatttgggcaatagtcattcattgggcaacaggaaataacacaagtcagcatctyattaaaaataaagtcattcaggaaagtggacgactaatagtttctaatctagagagcataggagaagaaatgtttaccacacacaaagtattagtgcctt

SEQ ID NO: 64095 - DNA, 201 bp, Homo sapiens
gtcattcaggaaagtggacgactaatagtttctaatctagagagcataggagaagaaatgtttaccacacacaaagtattagtgccttttatatcatcaaracaaaaataacaggaaaaagacaaacacattatagtgaaaacttgtttttcctgaccagcatctattctgcatgttccctgatgccagaaactcacattt

SEQ ID NO: 64096 - DNA, 201 bp, Homo sapiens
aaagtcattcaggaaagtggacgactaatagtttctaatctagagagcataggagaagaaatgtttaccacacacaaagtattagtgccttttatatcatsaagacaaaaataacaggaaaaagacaaacacattatagtgaaaacttgtttttcctgaccagcatctattctgcatgttccctgatgccagaaactcaca

SEQ ID NO: 64097 - DNA, 201 bp, Homo sapiens
tccttaatatggacaatttctattgaggactcattgttctaagaattgtctcatctcctcctgcatcctcagtgcccgatctttggcttctatgaaggaargtgggtagtgcttatggcagggccagttctacctttctcagtatgttctggcctgggtatgtagccccattttctagtggttaccttgacatcatgaaga

SEQ ID NO: 64098 - DNA, 201 bp, Homo sapiens
taaagtcattcaggaaagtggacgactaatagtttctaatctagagagcataggagaagaaatgtttaccacacacaaagtattagtgccttttatatcaycaagacaaaaataacaggaaaaagacaaacacattatagtgaaaacttgtttttcctgaccagcatctattctgcatgttccctgatgccagaaactcac

SEQ ID NO: 64099 - DNA, 201 bp, Homo sapiens
tgtatttggtccccagcatatttatagcaacttaaaattggacccaatttaaattgcctatgatatggaaatggctaagaaaattatgggctcttcccttrattggctattaggcagcctttacaaacaatgcagtgacatgagaaatgcttatgttatggtaagcttaaaaaactcaagatgcaaatcagcttattttaa

SEQ ID NO: 64100 - DNA, 201 bp, Homo sapiens
aatgcataagtgtatttggtccccagcatatttatagcaacttaaaattggacccaatttaaattgcctatgatatggaaatggctaagaaaattatgggmtcttcccttaattggctattaggcagcctttacaaacaatgcagtgacatgagaaatgcttatgttatggtaagcttaaaaaactcaagatgcaaatcag

SEQ ID NO: 64101 - DNA, 201 bp, Homo sapiens
caagatgcaaatcagcttattttaatcaggagccacctagcatttgggatgtggtcaatcccacataatgtatttttgtgggtgcagttcccaggaaagargaggaataaaaacggcaagtatgaagtgtctccttcgcttgcagtctccttgtctacccctttgtccatccactatgaaaggactcccttctgttcctta

SEQ ID NO: 64102 - DNA, 201 bp, Homo sapiens
ctctgtccttggactttggcgatgtggtttgaccccagccagagagtgcagggaacaacagcaaaaggcaggacaaagactgactcgtgagaggaggcccrggaacaggggggcatcgtgagagaggaggacgtgagggcccaagagtgtgagcagaagaggataggacttgggcactcagtcaccagctgtggggtctga

SEQ ID NO: 64103 - DNA, 201 bp, Homo sapiens
tggaaaaaatgaacaatgcataagtgtatttggtccccagcatatttatagcaacttaaaattggacccaatttaaattgcctatgatatggaaatggctragaaaattatgggctcttcccttaattggctattaggcagcctttacaaacaatgcagtgacatgagaaatgcttatgttatggtaagcttaaaaaactc

SEQ ID NO: 64104 - DNA, 201 bp, Homo sapiens
cctactcaatgttctccttcactaagtaggacaagaccgtaccctgcctttaaggtttatagaatagaaagtgaaaacactttggggaagaaaatcttccygaacagatagcccagggcattttgaaaatcccttaggaagttctctgtttcacttgggtacctctgtccttggactttggcgatgtggtttgaccccagc

SEQ ID NO: 64105 - DNA, 201 bp, Homo sapiens
aatatggaaaaaatgaacaatgcataagtgtatttggtccccagcatatttatagcaacttaaaattggacccaatttaaattgcctatgatatggaaatkgctaagaaaattatgggctcttcccttaattggctattaggcagcctttacaaacaatgcagtgacatgagaaatgcttatgttatggtaagcttaaaaa

SEQ ID NO: 64106 - DNA, 201 bp, Homo sapiens
gggctcagggtatttgcaggaacagttcaagtgctcacttgtcttggggctgtttgtggggaagtggtttccacagcaacaggaggtgagatattggtgtyaccccagaccacacttagctacttccttctcactaaagctctgtagtcatattttccctggcagagcagaaacttctctgttatcccacagctgttctaa

SEQ ID NO: 64107 - DNA, 201 bp, Homo sapiens
cctgggcattctgagggaaggagcagcgtgaccctgagtcatttttcactggggacaagtgagccaactccttctacccagtgataaaatcagaaggaagyagatggagacagcactgttcaggggatgatttggggatgagaagaactggcaggaagttggagatttgggggtgagaagaaccagcaggaagttggggat

SEQ ID NO: 64108 - DNA, 201 bp, Homo sapiens
cacagggctcagggtatttgcaggaacagttcaagtgctcacttgtcttggggctgtttgtggggaagtggtttccacagcaacaggaggtgagatattgktgttaccccagaccacacttagctacttccttctcactaaagctctgtagtcatattttccctggcagagcagaaacttctctgttatcccacagctgtt

SEQ ID NO: 64109 - DNA, 201 bp, Homo sapiens
gtgtcttgttgacttgcacatgcaagggggtcttgggtaaccacagggctcagggtatttgcaggaacagttcaagtgctcacttgtcttggggctgtttrtggggaagtggtttccacagcaacaggaggtgagatattggtgttaccccagaccacacttagctacttccttctcactaaagctctgtagtcatatttt

SEQ ID NO: 64110 - DNA, 201 bp, Homo sapiens
agcctgagctactgagcgatgagagtacagccaggctttcagacatctgttcattcaagagagatatgcgctaagccaaggacctaaagatgtgtttaatrtgggtgctaatatgcataaggaaccttgaaataaatgttcttagcctttggccaagagggtccatgtctaggaatctattctccatagaaataaattcaa

SEQ ID NO: 64111 - DNA, 201 bp, Homo sapiens
tccttctcactaaagctctgtagtcatattttccctggcagagcagaaacttctctgttatcccacagctgttctaacggtgtagacttgacttatgcaaygatgccaggagtcctgagcagcacagcccaacttcaatcacacacagatggacagagctgtattagcaaagcctgagctactgagcgatgagagtacagc

SEQ ID NO: 64112 - DNA, 201 bp, Homo sapiens
ccagaccacacttagctacttccttctcactaaagctctgtagtcatattttccctggcagagcagaaacttctctgttatcccacagctgttctaacggygtagacttgacttatgcaatgatgccaggagtcctgagcagcacagcccaacttcaatcacacacagatggacagagctgtattagcaaagcctgagcta

SEQ ID NO: 64113 - DNA, 201 bp, Homo sapiens
tttatgactcagctggccaccaggaagcgattgtagctgggttctgccccttattgaaacctactcaatgttctccttcactaagtaggacaagaccgtaycctgcctttaaggtttatagaatagaaagtgaaaacactttggggaagaaaatcttcctgaacagatagcccagggcattttgaaaatcccttaggaagt

SEQ ID NO: 64114 - DNA, 201 bp, Homo sapiens
atgttctggcctgggtatgtagccccattttctagtggttaccttgacatcatgaagagtttatgtctcttttgccctagatttgggcaatagtcattcaytgggcaacaggaaataacacaagtcagcatctcattaaaaataaagtcattcaggaaagtggacgactaatagtttctaatctagagagcataggagaag

SEQ ID NO: 64115 - DNA, 201 bp, Homo sapiens
attgtagctgggttctgccccttattgaaacctactcaatgttctccttcactaagtaggacaagaccgtaccctgcctttaaggtttatagaatagaaastgaaaacactttggggaagaaaatcttcctgaacagatagcccagggcattttgaaaatcccttaggaagttctctgtttcacttgggtacctctgtcct

SEQ ID NO: 64116 - DNA, 201 bp, Homo sapiens
tgtacactggcaggtactggcagccacccagggcctctcacaggaaagggagatcagaaagagaagcaaagaggactcatgagataccacagggccgctgmgtccagccttgcctggagctagggccacctcgatgccctatagtcttggagccacaaggtgcatttactcaaagcctctttgagtttggtttgcttgttt

SEQ ID NO: 64117 - DNA, 201 bp, Homo sapiens
cctgggtatgtagccccattttctagtggttaccttgacatcatgaagagtttatgtctcttttgccctagatttgggcaatagtcattcattgggcaacwggaaataacacaagtcagcatctcattaaaaataaagtcattcaggaaagtggacgactaatagtttctaatctagagagcataggagaagaaatgttta

SEQ ID NO: 64118 - DNA, 201 bp, Homo sapiens
tctcctcctgcatcctcagtgcccgatctttggcttctatgaaggaaggtgggtagtgcttatggcagggccagttctacctttctcagtatgttctggcstgggtatgtagccccattttctagtggttaccttgacatcatgaagagtttatgtctcttttgccctagatttgggcaatagtcattcattgggcaacag

SEQ ID NO: 64119 - DNA, 201 bp, Homo sapiens
ttctggcctgggtatgtagccccattttctagtggttaccttgacatcatgaagagtttatgtctcttttgccctagatttgggcaatagtcattcattgkgcaacaggaaataacacaagtcagcatctcattaaaaataaagtcattcaggaaagtggacgactaatagtttctaatctagagagcataggagaagaaa

SEQ ID NO: 64120 - DNA, 201 bp, Homo sapiens
ttgaggactcattgttctaagaattgtctcatctcctcctgcatcctcagtgcccgatctttggcttctatgaaggaaggtgggtagtgcttatggcaggkccagttctacctttctcagtatgttctggcctgggtatgtagccccattttctagtggttaccttgacatcatgaagagtttatgtctcttttgccctag

SEQ ID NO: 64121 - DNA, 201 bp, Homo sapiens
ctgcttctctccagagatgggcagaagcaccagccctcgcctggcaccagcagtgagtctcataattgccatttaccattttgctagggggcttctggggrtcctaggaaaagcagcagatgcctgggtgcttggggacctgggcattctgagggaaggagcagcgtgaccctgagtcatttttcactggggacaagtgag

SEQ ID NO: 64122 - DNA, 201 bp, Homo sapiens
ctggggtccccaggatggccctcaaaccgactggtgcccttgcaggctgccaccctccaagtcctgcttctctccagagatgggcagaagcaccagccctygcctggcaccagcagtgagtctcataattgccatttaccattttgctagggggcttctggggatcctaggaaaagcagcagatgcctgggtgcttgggga

SEQ ID NO: 64123 - DNA, 201 bp, Homo sapiens
agggtatttgcaggaacagttcaagtgctcacttgtcttggggctgtttgtggggaagtggtttccacagcaacaggaggtgagatattggtgttaccccrgaccacacttagctacttccttctcactaaagctctgtagtcatattttccctggcagagcagaaacttctctgttatcccacagctgttctaacggtgt

SEQ ID NO: 64124 - DNA, 201 bp, Homo sapiens
acaggaggtgagatattggtgttaccccagaccacacttagctacttccttctcactaaagctctgtagtcatattttccctggcagagcagaaacttctmtgttatcccacagctgttctaacggtgtagacttgacttatgcaatgatgccaggagtcctgagcagcacagcccaacttcaatcacacacagatggaca

SEQ ID NO: 64125 - DNA, 201 bp, Homo sapiens
tctaaagaggtaagccctgagtcatgggaagatggaaaccggggctcatgagacaggatgttttttaagcaccgtggtgtcttgttgacttgcacatgcamgggggtcttgggtaaccacagggctcagggtatttgcaggaacagttcaagtgctcacttgtcttggggctgtttgtggggaagtggtttccacagcaac

SEQ ID NO: 64126 - DNA, 201 bp, Homo sapiens
tcctggacctgccctgtgagtacctttgacccagcatggtagagaacagcgtgaccatctgagaggccttgcccgcctcagctccaaagctccaccatccstgagtgcctttgagtattccgtcctcctcacatcctctggtgaacaaattgtccccaaagctttgtggtcagggtatccagagctgctcaccacacaact

SEQ ID NO: 64127 - DNA, 201 bp, Homo sapiens
atgcccaggtcatcagcctgcatttctctgggctctcctccctgcagctggactggtactcctggatccctaatggcccatgcaccatgcagaagcccccrcccatctctaaggatgtgacagagaaggatatagtggacttactgcccaatctccaccaggcacgtatgcaaaagaccttcacaaagttccttggcagac

SEQ ID NO: 64128 - DNA, 201 bp, Homo sapiens
ccagggatggaagacttgaagacccagctggagaaagaactccaggtgctgctgggctttctgcccatccaccatcccagccattacccccacctcccttytcctcccatctccagccccttctctcatctcctccatctacacccaaggtttctcaacgttggcactattaacattctgcaccacataattctctgttgg

SEQ ID NO: 64129 - DNA, 201 bp, Homo sapiens
aagacttgaagacccagctggagaaagaactccaggtgctgctgggctttctgcccatccaccatcccagccattacccccacctcccttctcctcccatytccagccccttctctcatctcctccatctacacccaaggtttctcaacgttggcactattaacattctgcaccacataattctctgttggctggcggggg

SEQ ID NO: 64130 - DNA, 201 bp, Homo sapiens
accaagccatgaaggatgatctagagctgcaggcctggtgcagagagatgactgagactggactgcagagggcccaagaccaggggtgagacatggatccytccccactgaaccctgtcaacacccactcctctgcaaacaatctgcttcttctcacatcatcatgagacaccccacctgcccaaggaagctgagaattct

SEQ ID NO: 64131 - DNA, 201 bp, Homo sapiens
ggcacagagaggcaatgaacggaggggcgggggactgtaggtccagaaggtcctgcattggcccctgagactgagtgtcttcttcccagggaataggtacrtggaggggatggttgggcttttctacaatagtgaccaagccatgaaggatgatctagagctgcaggcctggtgcagagagatgactgagactggactgca

SEQ ID NO: 64132 - DNA, 201 bp, Homo sapiens
cagccattacccccacctcccttctcctcccatctccagccccttctctcatctcctccatctacacccaaggtttctcaacgttggcactattaacattytgcaccacataattctctgttggctggcggggggggggggggggggctttcctgtggatcgtagggtgtttagtagcattcctggcctctacccattgat

SEQ ID NO: 64133 - DNA, 201 bp, Homo sapiens
cctcccttctcctcccatctccagccccttctctcatctcctccatctacacccaaggtttctcaacgttggcactattaacattctgcaccacataattytctgttggctggcggggggggggggggggggctttcctgtggatcgtagggtgtttagtagcattcctggcctctacccattgatgccagcagcatcccc

SEQ ID NO: 64134 - DNA, 201 bp, Homo sapiens
cacattcctctcttccttcttcattgaacatatatcagccttagggaaaagcgcaagcttctggagagaaatagcaagaaaaactaaacaaagccttggaragctaaaagctgaatctgtttttggggggagatgggtagctaaaggaaatatttttgctacattggctaaagctggcagaagaggggatacgtgaagaat

SEQ ID NO: 64135 - DNA, 201 bp, Homo sapiens
agggtgagtaccaggtagaggctgggcacttgcttcctagggcacaaggtgggatgcttccttgatcttcttgcactccattctttccacaggttgaaggrcttggccattaaggggacactggatttcataaattgtgtgaaaaggctggaagatttcaaaaaaatattcccacatggaaagactgtcctggctggtcag

SEQ ID NO: 64136 - DNA, 201 bp, Homo sapiens
catctccagccccttctctcatctcctccatctacacccaaggtttctcaacgttggcactattaacattctgcaccacataattctctgttggctggcggggggggggggggggggctttcctgtggatcgtagggtgtttagtagcattcctggcctctacccattgatgccagcagcatccccccggttgtgacaacc

SEQ ID NO: 64137 - DNA, 201 bp, Homo sapiens
gggcgcctcctgatggtgaagctgcgcaaacacaacgtgctgttgagtctcgactggttctgcaagtggatctcagtgcagggcccggggacccaaggcgmggcctttttcccctgctaccgctgggtgcagggccacggaattatctgcctgcctgagggtactggtgagctcggtggagaaggggcacagcccctggca

SEQ ID NO: 64138 - DNA, 201 bp, Homo sapiens
ccaggtcatcagcctgcatttctctgggctctcctccctgcagctggactggtactcctggatccctaatggcccatgcaccatgcagaagcccccgcccrtctctaaggatgtgacagagaaggatatagtggacttactgcccaatctccaccaggcacgtatgcaaaagaccttcacaaagttccttggcagacgcca

SEQ ID NO: 64139 - DNA, 201 bp, Homo sapiens
gctgcaggcctggtgcagagagatgactgagactggactgcagagggcccaagaccaggggtgagacatggatccttccccactgaaccctgtcaacaccyactcctctgcaaacaatctgcttcttctcacatcatcatgagacaccccacctgcccaaggaagctgagaattctccagagtgtgtccagaaatgctaac

SEQ ID NO: 64140 - DNA, 201 bp, Homo sapiens
ggcctggtgcagagagatgactgagactggactgcagagggcccaagaccaggggtgagacatggatccttccccactgaaccctgtcaacacccactccyctgcaaacaatctgcttcttctcacatcatcatgagacaccccacctgcccaaggaagctgagaattctccagagtgtgtccagaaatgctaacaagcac

SEQ ID NO: 64141 - DNA, 201 bp, Homo sapiens
attcctcgaggataaggatttagactttaatgtctccctagcaaaagggtgagtaccaggtagaggctgggcacttgcttcctagggcacaaggtgggatkcttccttgatcttcttgcactccattctttccacaggttgaaggacttggccattaaggggacactggatttcataaattgtgtgaaaaggctggaagat

SEQ ID NO: 64142 - DNA, 201 bp, Homo sapiens
catcccacaagggctcctgggatggagaagtgggggatcaaatgcccaggtcatcagcctgcatttctctgggctctcctccctgcagctggactggtacycctggatccctaatggcccatgcaccatgcagaagcccccgcccatctctaaggatgtgacagagaaggatatagtggacttactgcccaatctccacca

SEQ ID NO: 64143 - DNA, 201 bp, Homo sapiens
ttgagtctcgactggttctgcaagtggatctcagtgcagggcccggggacccaaggcgaggcctttttcccctgctaccgctgggtgcagggccacggaaytatctgcctgcctgagggtactggtgagctcggtggagaaggggcacagcccctggcaggctggaggaagaagcgggtggggggaggctactgtaaaaga

SEQ ID NO: 64144 - DNA, 201 bp, Homo sapiens
catatttcagactcctacaaagagtctaaccttgtacatttcagtctagcagcaatcaatttatatgtggagacacatacacagatacatacacacacgcrtacacatacacagtaatatggaaacacccaggacacacacttactatgagttggggggagaagtgagaataggttttgcaaaggagttgaaattttggct

SEQ ID NO: 64145 - DNA, 201 bp, Homo sapiens
accagctgctcctcctcacctccacctctccccggctgtgctgtggaggggaaacggagccaggattctctgaaggttcaccgaccccgccgtcctccctraagaccccaaaacctgagctgtgtactgtcgcgcaggaggcagagtttgagatcgacgtccccctgcacctggggcgcctcctgatggtgaagctgcgca

SEQ ID NO: 64146 - DNA, 201 bp, Homo sapiens
agctggcagaagaggggatacgtgaagaatgcagtggccttatgtggtggaaaaccagaaacttcgctgcagggagctccaagtctgaaggaagacatcastcatgaaaactttgcattcagttttttggttctgcagaaagtgattggtgtttaaagtaaaaaagacttgggtgggtagaggaaggatccaccctggaaa

SEQ ID NO: 64147 - DNA, 201 bp, Homo sapiens
tggctaaagctggcagaagaggggatacgtgaagaatgcagtggccttatgtggtggaaaaccagaaacttcgctgcagggagctccaagtctgaaggaaracatcagtcatgaaaactttgcattcagttttttggttctgcagaaagtgattggtgtttaaagtaaaaaagacttgggtgggtagaggaaggatccacc

SEQ ID NO: 64148 - DNA, 201 bp, Homo sapiens
ttgatgccagcagcatccccccggttgtgacaaccaaaaatgtgtctagatagtgctgaatgtcctggggttggggagaggaggaattgcccctgattgaraacattgatctacaacatctcctcctgtatcttcttttctttctccacattcctctcttccttcttcattgaacatatatcagccttagggaaaagcgca

SEQ ID NO: 64149 - DNA, 201 bp, Homo sapiens
gtagcattcctggcctctacccattgatgccagcagcatccccccggttgtgacaaccaaaaatgtgtctagatagtgctgaatgtcctggggttggggaraggaggaattgcccctgattgagaacattgatctacaacatctcctcctgtatcttcttttctttctccacattcctctcttccttcttcattgaacata

SEQ ID NO: 64150 - DNA, 201 bp, Homo sapiens
tctgcactaagagcttcctctggaactagatacaaaacttctcttaggtattttccctcactcttccctcccctctccccatagctcaaggttcatcccamgtgcattaacctttgagcacacacaaggtgggagtcctagggtgtgcaggccagaaccacagaaaagttcttttctgtatctccacatagctttccctgc

SEQ ID NO: 64151 - DNA, 201 bp, Homo sapiens
aggggatggttgggcttttctacaatagtgaccaagccatgaaggatgatctagagctgcaggcctggtgcagagagatgactgagactggactgcagagrgcccaagaccaggggtgagacatggatccttccccactgaaccctgtcaacacccactcctctgcaaacaatctgcttcttctcacatcatcatgagaca

SEQ ID NO: 64152 - DNA, 201 bp, Homo sapiens
ccaaggtttctcaacgttggcactattaacattctgcaccacataattctctgttggctggcggggggggggggggggggctttcctgtggatcgtagggkgtttagtagcattcctggcctctacccattgatgccagcagcatccccccggttgtgacaaccaaaaatgtgtctagatagtgctgaatgtcctggggtt

SEQ ID NO: 64153 - DNA, 201 bp, Homo sapiens
ccatctccagccccttctctcatctcctccatctacacccaaggtttctcaacgttggcactattaacattctgcaccacataattctctgttggctggcggggggggggggggggggctttcctgtggatcgtagggtgtttagtagcattcctggcctctacccattgatgccagcagcatccccccggttgtgacaac

SEQ ID NO: 64154 - DNA, 201 bp, Homo sapiens
gggctttctgcccatccaccatcccagccattacccccacctcccttctcctcccatctccagccccttctctcatctcctccatctacacccaaggtttytcaacgttggcactattaacattctgcaccacataattctctgttggctggcggggggggggggggggggctttcctgtggatcgtagggtgtttagtag

SEQ ID NO: 64155 - DNA, 201 bp, Homo sapiens
tcccttctcctcccatctccagccccttctctcatctcctccatctacacccaaggtttctcaacgttggcactattaacattctgcaccacataattctytgttggctggcggggggggggggggggggctttcctgtggatcgtagggtgtttagtagcattcctggcctctacccattgatgccagcagcatcccccc

SEQ ID NO: 64156 - DNA, 201 bp, Homo sapiens
gaggtgttcttcaaggctcccagcctgcctggtgctgcctccagggatggaagacttgaagacccagctggagaaagaactccaggtgctgctgggctttytgcccatccaccatcccagccattacccccacctcccttctcctcccatctccagccccttctctcatctcctccatctacacccaaggtttctcaacgt

SEQ ID NO: 64157 - DNA, 201 bp, Homo sapiens
cttttaaagctgatttctccccggatctccgggcaagatgggcaagtacacggtccgcgtagccaccggggatttgctcctggcgggctctcccaacctgstgcagctatggctggtgggcgagcacggggaggcagacctagggaagcagctgccaccggtgtggggaaaggtgagcgcggactgcggtgagagctgggg

SEQ ID NO: 64158 - DNA, 201 bp, Homo sapiens
caattgatgttcctagagcgggtttatgattcttggaagaatgatgccttctttgggtaccagtttctcaatggtgcaaaccccatgctcctgaggtgttyttcaaggctcccagcctgcctggtgctgcctccagggatggaagacttgaagacccagctggagaaagaactccaggtgctgctgggctttctgcccatc

SEQ ID NO: 64159 - DNA, 201 bp, Homo sapiens
ggctcagctctgccactttgtcaccatgtgcatcttcacatgcacaggtcagcatgcttctaaccacctgggccaggtaacctatgtgatcatcccacaasggctcctgggatggagaagtgggggatcaaatgcccaggtcatcagcctgcatttctctgggctctcctccctgcagctggactggtactcctggatccc

SEQ ID NO: 64160 - DNA, 201 bp, Homo sapiens
gtcctggggttggggagaggaggaattgcccctgattgagaacattgatctacaacatctcctcctgtatcttcttttctttctccacattcctctcttcyttcttcattgaacatatatcagccttagggaaaagcgcaagcttctggagagaaatagcaagaaaaactaaacaaagccttggagagctaaaagctgaat

SEQ ID NO: 64161 - DNA, 201 bp, Homo sapiens
catctccttagagtcccgggctcagctctgccactttgtcaccatgtgcatcttcacatgcacaggtcagcatgcttctaaccacctgggccaggtaaccyatgtgatcatcccacaagggctcctgggatggagaagtgggggatcaaatgcccaggtcatcagcctgcatttctctgggctctcctccctgcagctgga

SEQ ID NO: 64162 - DNA, 201 bp, Homo sapiens
gtgcattaacctttgagcacacacaaggtgggagtcctagggtgtgcaggccagaaccacagaaaagttcttttctgtatctccacatagctttccctgcstgagacctatttcgtgttctggtttcgagatctctgattctcatttcaccaggattctcatttcaccaggttcctcatctccttagagtcccgggctcag

SEQ ID NO: 64163 - DNA, 201 bp, Homo sapiens
gagactgagtgtcttcttcccagggaataggtacgtggaggggatggttgggcttttctacaatagtgaccaagccatgaaggatgatctagagctgcagrcctggtgcagagagatgactgagactggactgcagagggcccaagaccaggggtgagacatggatccttccccactgaaccctgtcaacacccactcctc

SEQ ID NO: 64164 - DNA, 201 bp, Homo sapiens
gttctctagggtttgtagagaatttgaccgagatataactctagggtgaaccaacatttacagactgagagaagggagcagagtgagaaaagaaacaagaraaggaacctcattgaggtaggaggaaaatcaaaaagtgcaatccatggcagccaggaaaagaaagcgtttcaagagggacgcgtgattatctgtctcaag

SEQ ID NO: 64165 - DNA, 201 bp, Homo sapiens
gctctcctccctgcagctggactggtactcctggatccctaatggcccatgcaccatgcagaagcccccgcccatctctaaggatgtgacagagaaggatmtagtggacttactgcccaatctccaccaggcacgtatgcaaaagaccttcacaaagttccttggcagacgccagcctgtcatggtgagaagcaaatgcct

SEQ ID NO: 64166 - DNA, 201 bp, Homo sapiens
aagaccttcacaaagttccttggcagacgccagcctgtcatggtgagaagcaaatgcctgggtcctgggaaggaggcagctcaaaggaggggaagtattcygggctgagagtcccaaggggctgagccaacttgtcttctgcctctcagcatgaggagaaatatttctctggtcctgagccccaagctgtgctgagacaat

SEQ ID NO: 64167 - DNA, 201 bp, Homo sapiens
acaacctcccaaaaccaatatacagacttccaacccagggatttgaaaaaggagggggatggaggattagatcagtgggattaggagttcggagctcagarctcacagggtgctccccaattgatgttcctagagcgggtttatgattcttggaagaatgatgccttctttgggtaccagtttctcaatggtgcaaacccc

SEQ ID NO: 64168 - DNA, 201 bp, Homo sapiens
aatgtcccaagattgtttatatatacaaaatggcaaaattactgtttttcgaattgataattcaagcaaaaggcttctctttaccatcactggtttttttygtttttgttttgtttccttgtttctatttccttgaagctttgaagggaggagaagcagaaaattttgtttttgttttttaaaaatcagaactacttaatg

SEQ ID NO: 64169 - DNA, 201 bp, Homo sapiens
tcaaagacctgtggccaggtattttaaaaagtcatctgtttctttctagttgcatcaacttgcacactggtgtctacctatatgtggtattcggaacttawaattcttattgagcagccattgcctatattttctcagctcctcactgacttctttatatgagctcagctgacaagcgaatacagctatttggttgccctc

SEQ ID NO: 64170 - DNA, 201 bp, Homo sapiens
ttgagcagccattgcctatattttctcagctcctcactgacttctttatatgagctcagctgacaagcgaatacagctatttggttgccctctcttcataytggaccatcaacaacagtgttctaactcatccatgatggtctgtgagatgcagactattacacaagattcaagttactcgtaagcaacttttagatagag

SEQ ID NO: 64171 - DNA, 201 bp, Homo sapiens
gaccctcaggcatctcctttcccttcctgccttcctctcccttctcctctgctgcagcatgattttcttaatcttcagacactcactattttcatgaacarttaccctccggccccacaaccaaagacaactcatggcctcctttggcccttgtgtaacactgcaaacctgtggctttgcaaaatgtacccaggtcacaag

SEQ ID NO: 64172 - DNA, 201 bp, Homo sapiens
gattttcttaatcttcagacactcactattttcatgaacagttaccctccggccccacaaccaaagacaactcatggcctcctttggcccttgtgtaacaytgcaaacctgtggctttgcaaaatgtacccaggtcacaaggggatttttttttttagcaatgatatccctttctgggtcactttttaagcttataaccag

SEQ ID NO: 64173 - DNA, 201 bp, Homo sapiens
tattttcatgaacagttaccctccggccccacaaccaaagacaactcatggcctcctttggcccttgtgtaacactgcaaacctgtggctttgcaaaatgyacccaggtcacaaggggatttttttttttagcaatgatatccctttctgggtcactttttaagcttataaccagacttataatcttaaatgtatttttcc

SEQ ID NO: 64174 - DNA, 201 bp, Homo sapiens
caacattctagaaagatatagctaagaatgttgcttctacaattagaaaataaagtatcagactatattaaaaattaatagtacttcgttactactaaacragctagtacttcgttttcattggatacattttcagcatcatgagttgtcacagcctctgagcccctgatcttaagccacaagggctgagtgtattgtaaa

SEQ ID NO: 64175 - DNA, 201 bp, Homo sapiens
attcttgcatgttgctgtctgggaatagaccacactacagctggtagttctgggggcggtactgccgaaaggcctgaacacatgtattttggctgcaattraggaacttgggatgctgactattaattttgtatttcagcaactgccccttctcctatcccaaagaaccaattactgccctctgcctcagcagtaccagta

SEQ ID NO: 64176 - DNA, 201 bp, Homo sapiens
tattttctcttagaatggtttacattatgatgggggatggggagctgggggagggctgtacattcccaaaagaaagtagtgttataggaaatccaaatgcrcttcagtgattcactcctgaaaagcagcctgggtatgttggcagattttgtttgcatttgtcttgcgtatttaaagtctcaggaaatctagtcttggtcc

SEQ ID NO: 64177 - DNA, 201 bp, Homo sapiens
tcaaactcctgggctcaagtggtcctcctgcttcagcttcccaagtagctgggactacaggcatgtgccaccacccccagccaaaacatccatattttctmttagaatggtttacattatgatgggggatggggagctgggggagggctgtacattcccaaaagaaagtagtgttataggaaatccaaatgcacttcagtg

SEQ ID NO: 64178 - DNA, 201 bp, Homo sapiens
cacactgcaatcacatggcattaaaaaatatattgtgtatggaacttggcgaggtcagtcaggacctggagctgtaatcatagccttattgccacttcttkcgttgtgtatacattgaatggctcatagattttaagagatttttttattgtaagtatttctactaaatgcacttatccttctatatgtttatatattttg

SEQ ID NO: 64179 - DNA, 201 bp, Homo sapiens
caaatttactttttattaaggatgtacctgtgcactattctaaagctaagcatttaaggataaagtccagaaataaaatgtccatattttcttttcttttytttttttttttttttttctgtcatctgtcacccagactggactgcagtggtgccatcatgtcttactgcagcctcaaactcctgggctcaagtggtcctc

SEQ ID NO: 64180 - DNA, 201 bp, Homo sapiens
atatgttgtagccccatcattacactgagatatttccatttgagtaactaaaggtactcctgacagagctggagatgaggggcattttggtgggcagtggycactagggttcacgtcacctacttaatgcaaagaccttagtggtctcagaatgaaaaggtaaaatggaagagaaaagcacagtcctttcctgtcttttca

SEQ ID NO: 64181 - DNA, 201 bp, Homo sapiens
agattgttcaaaaagtttcaaatgacattccttactctttggttttcagaggcattcaagcaaaatatcacagtggtcttttgttttctgaccaatctaamaatacctgtgattaaatttaatttgttagtgtaaataaatttcttgccaatgagtattattgttgttagacaacgaatgcaataaaaagaaatactgagg

SEQ ID NO: 64182 - DNA, 201 bp, Homo sapiens
tattcccagacctactggaatcttcttgccatccgcctggccttcgtcattgtgtttgaggtagccgaggcacctgctggttctcccatccatggcatgasgccccgaccctgtgctttgcctaattcgagcacgtggtgaggggtcggtgccgtcacttcctgctgtgtcatcttggtcaaatcagagctcttctctgca

SEQ ID NO: 64183 - DNA, 201 bp, Homo sapiens
cagagtctgtggagatcaaagtgaagcgggagtactacctggctaagcaggcactggctgagaatgaggtgaactgtacagcccagtctcggccctccccscagccctctccctatccttgtcagtggctgctctacctccggacactgagtcacatccctcttcctcttgctgcccttttttggggacaggttctttttg

SEQ ID NO: 64184 - DNA, 201 bp, Homo sapiens
ccaccagttaaaggtattgtcagagtatcctgtttgggaagaattcccatttcaggcaccctcgatgaagagccaggccaggaacatgggatgagagagcraaatggtggaaaaaggggagataggctaattccagaggcacctgcccagccaacactcagccctggctgcgcgcactgagtcctgtgtctgctgcaggta

SEQ ID NO: 64185 - DNA, 201 bp, Homo sapiens
ctcccatccatggcatgaggccccgaccctgtgctttgcctaattcgagcacgtggtgaggggtcggtgccgtcacttcctgctgtgtcatcttggtcaartcagagctcttctctgcacctgcgttttccctgcctggcctcatccctgggttgtggtgtggacattgtgggtgtctccacaggagccccagggccacga

SEQ ID NO: 64186 - DNA, 201 bp, Homo sapiens
gtggaattttccacttgtgtcataatgtgggctctcaaaaagtttcagattttggagcattttggatttcaaattttcagatcagaaatgctcaacctgtrttagacactggaagccttagaaaattctccttactgtaagccccagtttactacctaataactaccacctagttatatcttctgtgcaacaaatatggtc

SEQ ID NO: 64187 - DNA, 201 bp, Homo sapiens
agatggagctctacataagaaattacagattagtccagatttccttccagtttaaaagcattgtctttctgacagtaaaaccagagaaaggacatttcaargaatgactcaaagaattagtaatgaacctcaaacagttcatctttccttgttattatgaccttgcaaatgtgtttatattttcaagaccggtagctaagt

SEQ ID NO: 64188 - DNA, 201 bp, Homo sapiens
gtaaggctctgggtgataggaggtgggagagtgggtggaggagagaaggaacaacttagagtagaaaacaagtaggctcagatgagctgagagttatttgrcagtgaaaagagtattcctcgtagagaagttgctgtttggggactgggacttgaaaactgctaataggtttttaaaactttcaatgtgaaataagcagtc

SEQ ID NO: 64189 - DNA, 201 bp, Homo sapiens
tctaacagcaaaggaagtattgatatattcccttccaaatcacaggctttacacaatacaactaggagaagaaagccaaactaaaattcaaatgtactaartttttttcctatctctgggtgactttgggcaaatcattgaatctttcaacctcagatttattataagtaaaataaagtaacacctctcttaacctacctt

SEQ ID NO: 64190 - DNA, 201 bp, Homo sapiens
aatcactagtttcttgtattcataaactcagagatacagagggcttggtttgaagttggggtgagatgaaacctttgctctgagccaaagctctggggccytgcattccctgcattgggttgatgactgtcagcatcactgccgcaggccatgcttgactaaggtacctggttttagccacagccacctccttgtatgtta

SEQ ID NO: 64191 - DNA, 201 bp, Homo sapiens
gccttgtggaacaaggtaagctttctctttgcctacgagcctccctttagctcagacagagtttctgttcctacagctatgatcacttagacatatctcarataggcatgatagttaacccaaggggacttctgatctgagcattgtttgagcaaaggcctatctccaaataggagcttttccatcttaagaaccattatt

SEQ ID NO: 64192 - DNA, 201 bp, Homo sapiens
tgtctttctgacagtaaaaccagagaaaggacatttcaaggaatgactcaaagaattagtaatgaacctcaaacagttcatctttccttgttattatgacyttgcaaatgtgtttatattttcaagaccggtagctaagttctatgaatttacaaggtgcaaaataggactttgttttctttgctccccaaatgcctcctt

SEQ ID NO: 64193 - DNA, 201 bp, Homo sapiens
aagactgttgcaccagagtattctgatgcctttgctcttgtttgctcccacacagcacaagttgaccccggaatatctggagctcaaaaagtaccaggccrttgcttctaacagtaagatctattttggcagcaacatccctaacatgttcgtggactcctcatgtgctttgaaatattcagatattaggactggaagaga

SEQ ID NO: 64194 - DNA, 201 bp, Homo sapiens
cctctcctgcgatagtcctgggtgctccactgattggaggatagagccagctgtctgacacacaaatggtcttttcagccacagtcttatcaagtatcctrtatgtattcctttctaaactgctactcatgaatgaggaaagtctgatgctaagatactgcctgcactggaatgttaaacactaaatatataacaagctgt

SEQ ID NO: 64195 - DNA, 201 bp, Homo sapiens; identical to SEQ ID NO: 29731

SEQ ID NO: 64196 - DNA, 201 bp, Homo sapiens
aacccaaaatcccagaagccataagaagaaattttgagttaatgtgagtaatatgcatgggatcccaatatttctgtttagggctgtctgcatattaataytccagtctagaggaaacatgtgagacaatacactctggggtggagtatgtgtcttatcttctttactcttactctagtaatattgcctattcttgtgtct

SEQ ID NO: 64197 - DNA, 201 bp, Homo sapiens
ctactaaaaatacaaaaaattagccaggcatggtggtgggcgcctgtagtcccagctactcgggaggctgaggcaggagaatggcgtgaactcaggaggcraagcttgcagtgagtcgagatagtgccactgcactccagcctgggtgacagagtgagactccatctcaaaaaaaaaaaaaaaaaaagattgcttctggtg

SEQ ID NO: 64198 - DNA, 201 bp, Homo sapiens
acagggagaatggatagggtttataggcagcttgagtctgtggatagcattttcatttgtacagattaagaatagggaagttttttgaccaaagtttcagrttgtagtatgcatccttgttgttgacatgcacttagttttacctggataggtagtgccgtttatgaaagcatggcaggattgtttacagttcatttcaga

SEQ ID NO: 64199 - DNA, 201 bp, Homo sapiens
ttacagttcatttcagattacagtggcttcccttatactccaggtcactgtgtattagattgccctctttggccctcggttgatgctgaaagtttaatacrtctttaattaaataattcaattatagaggaatgtacagagaacaatataatgaaagcttaagattttgccttattcccttcagatctttttttttttttt

SEQ ID NO: 64200 - DNA, 201 bp, Homo sapiens
tttttaatttcttttttctagtactgtaatttgtttttgttatagtttacaatttattggttcctcataaattgaaatacacacacaaaaaggtaaggtayttttccacaggtggtttgagaagcactgctctagaatagctatctcaaagtagaattgatgggtcatagggtagcatgtcttcacattcaacatattgac

SEQ ID NO: 64201 - DNA, 201 bp, Homo sapiens
ttttctagtactgtaatttgtttttgttatagtttacaatttattggttcctcataaattgaaatacacacacaaaaaggtaaggtatttttccacaggtrgtttgagaagcactgctctagaatagctatctcaaagtagaattgatgggtcatagggtagcatgtcttcacattcaacatattgacaaattgctctctc

SEQ ID NO: 64202 - DNA, 201 bp, Homo sapiens
gtgttatttaatcttgtaatcttatgtctaggcttcctgctaagtgagagtttaattataaattcttaaatcccctaggttttcttcctgtccccttttasatggcttagggaaagaattgtgtctactgaagtgaaatgtattcttcccctaatcagactgatttccatatgttgttccatatttattttacccattctt

SEQ ID NO: 64203 - DNA, 201 bp, Homo sapiens
aggaagctcaccgagcaggggcggcccactggcctccgggggcggaggagttggcaaggggtcagcgggctcagccagaagggaagaatgaggggacaggkgtactggactccccggctcagcctgcgagagagcgccaagtttccggagggagagggtagaaactggagggggtggacctgtcactcacgggactgaggg

SEQ ID NO: 64204 - DNA, 201 bp, Homo sapiens
ttcaatttctagccccattgaacatagtagtttagtttttggatggtgtaatatagattgattttacattggtggagaaagagggaattatctcctggagyagttcgtaaagcatactgttttatggaaagaaaaaaatcacttggaagttttctttccattatgtactttttctaggggtcagagataagatgtcctaaa

SEQ ID NO: 64205 - DNA, 201 bp, Homo sapiens
cctatctccaaataggagcttttccatcttaagaaccattattgttcttatggtattattggaaaaaactggagttttagagcaagtagacctaactgtgyattagcactgctgcatctgctttattgactattttttaaagactttattttttacagcagttttaggttcatagtgaaattgaccaaaaagtacagacag

SEQ ID NO: 64206 - DNA, 201 bp, Homo sapiens
tccagcttttgggtttgtttgtgactgtgggtagctcagctttccttttcttccttaaattggggcttattagctaccactttattttcaggcagacaagrtatgaaaattacccataatcaatagtaaagaatatacaagataataaaccccatctctggccgggcgccgtggctcacgcctgtaatcccagcactttgg

SEQ ID NO: 64207 - DNA, 201 bp, Homo sapiens
ttgggtcactgtgttttccagattgtgggttgtaaaatcaactttagtgagtcatgaacagcattttaaataaaatggaatagaataggaaaagaaatggyatgtaataagtttaaatattctgtgacacttgtgtttcacagtgtggcggggtaggtgtttatattggacgtcagtgcaaaatgtgtttcttactgtgtc

SEQ ID NO: 64208 - DNA, 201 bp, Homo sapiens
gagatggagtcttgttctgtcacccaggctggagtgcagtggcatgatctcagctcagtgcaacctctgccttttgggttcatgcaattctcctgcctcascctccctagtagctgggactacaggtgtatgcctccacaccaggctaatttttgtatttttagtagagacagtgtttcaccatgttggccaggctggtct

SEQ ID NO: 64209 - DNA, 201 bp, Homo sapiens
ctagactcttactagtgttctctttatgtatggacatttcaggagcagtttcagtggctaaagatgcagtttgctgtaaaactattgctggaagcttaagsagctataattttatatgaatagtaccttgaattaaatatttaatagaggaaagagtcctgaagccgttagggttgaagagagtgctcatattttgtttct

SEQ ID NO: 64210 - DNA, 201 bp, Homo sapiens
tgttttattcagcaattatttgagatgctatggtgatttatagaatacctttctcaatttgactttagatctctgccaaaataaaatactcttgtagcttrctatgggtgacatttgtgaactcctagagggaactgataagctgaggctcttacaaggaagtaaaattcatatttctgccatgtatgaagcattaagata

SEQ ID NO: 64211 - DNA, 201 bp, Homo sapiens
ctgtattagacactggaagccttagaaaattctccttactgtaagccccagtttactacctaataactaccacctagttatatcttctgtgcaacaaatayggtcactgcacatgggtgcccacctgaggagggcaggggctgaaacccagcttcattctgcatgtcaaaccatgcacctgcaggactgtagaaacggctg

SEQ ID NO: 64212 - DNA, 201 bp, Homo sapiens
agacattgacatctatagagggacagaaatgctatgaaaaaggaagcgaactctttctgtgttttaagtgaatattagtatgtttcattatcagcttctcyccaggtctatctataactgtgttttatggattgcctttagtagttcacactttttttctttgtttttagtggtggggtcatgatctatattgaccgaata

SEQ ID NO: 64213 - DNA, 201 bp, Homo sapiens
cccaaattatttctagggtataatcactgcattgaattgtatcaaaagaagaatgtgaagttcaaggtattttttaaattacttattttaaatgactattwcaagtgtaaaaaagacattgacatctatagagggacagaaatgctatgaaaaaggaagcgaactctttctgtgttttaagtgaatattagtatgtttcat

SEQ ID NO: 64214 - DNA, 201 bp, Homo sapiens
tgaggcaggagaatggcgtgaactcaggaggcgaagcttgcagtgagtcgagatagtgccactgcactccagcctgggtgacagagtgagactccatctcaaaaaaaaaaaaaaaaaaagattgcttctggtgacggaaaaatgaatattgtgtgttttctgctctcaaataaatcatagtattcagactgtcatttgatg

SEQ ID NO: 64215 - DNA, 201 bp, Homo sapiens
ggaaacatggaagattataaattttcttctaaggattgctttagctatgtttcacaggttttgaaatgtactttgtatattggtgttcagttttaattctwaaccttttccttctaatttcttctttggctcatgaattattaaaagtatatgcttcaatttctggtttagtgggttttgaggggctacctttttattgtt

SEQ ID NO: 64216 - DNA, 201 bp, Homo sapiens
atccattatttcctttaagattacttccagaaggtcttccttggtttaacttatgtcactcattctttctttctcctgccacattaattgtcctgtgttgccatgcatttatgttgctctgtttttgttctgtggtactttcataaagtatctttttttcccattagcttgtggaccgttgctacagagttgcatgaagga

SEQ ID NO: 64217 - DNA, 201 bp, Homo sapiens
ccccgtctctactaaaaatacaaaaaattagccgggcgtggtggcgggcgcctgtagtcccagctacttgggaggctgaggcaggagaatggcgtgaaccygggaggcggagcttgcagtgagccgagatcccgccactgcactccagcctgggcgacagagcgagactccgtctcaaaaaataaaaaaaaaattaaaaat

SEQ ID NO: 64218 - DNA, 201 bp, Homo sapiens
cgggaggcggagcttgcagtgagccgagatcccgccactgcactccagcctgggcgacagagcgagactccgtctcaaaaaataaaaaaaaaattaaaaawaaataaaccccatcacgaccagtttcttttccacctgtccaaaaaaaaaacaaaattaattggggggaaaaacagttttcatggagggcctcacactact

SEQ ID NO: 64219 - DNA, 201 bp, Homo sapiens
tgcctgcactggaatgttaaacactaaatatataacaagctgtgttttcctaagctgagatctgttgaataatgtttacattcgtcccccggggaaatgtmtgctcagccaccattcaagagatgactgagaaggagatggtaagttcaagaagactgattgcacctgggacccaggccctttctttgggatccagtccca

SEQ ID NO: 64220 - DNA, 201 bp, Homo sapiens
atcagactgatttccatatgttgttccatatttattttacccattctttccttagttcatgccatcacttctttatctgccatctcactctccattccttytctcctgtctaaatcttgccaggcttttaaaggctcatcccagattcttcctcttctgatctatagctcttaaagtctatattgtaaattttggcccttt

SEQ ID NO: 64221 - DNA, 201 bp, Homo sapiens
ctagagagatcccaaactccccagccagcattcagggccctctgtctagtattaccatggtctcttgtcagaatttcatctttcatccaaattgtcccttstgctccaggcaagcctatctactttcgttcgcctatacacatgttgtcttcaactgtgtgtatttcagtaggatatttattgagcttaagatgttcctct

SEQ ID NO: 64222 - DNA, 201 bp, Homo sapiens
caagtagacctaactgtgtattagcactgctgcatctgctttattgactattttttaaagactttattttttacagcagttttaggttcatagtgaaattsaccaaaaagtacagacagtttttatatacctctttccccaacacattcctttattgacactttaaagcttagtttcctcctttataaaggcagtaaaatc

SEQ ID NO: 64223 - DNA, 201 bp, Homo sapiens
cactggaagccttagaaaattctccttactgtaagccccagtttactacctaataactaccacctagttatatcttctgtgcaacaaatatggtcactgcrcatgggtgcccacctgaggagggcaggggctgaaacccagcttcattctgcatgtcaaaccatgcacctgcaggactgtagaaacggctggtgccgtttt

SEQ ID NO: 64224 - DNA, 201 bp, Homo sapiens
agtagacctaactgtgtattagcactgctgcatctgctttattgactattttttaaagactttattttttacagcagttttaggttcatagtgaaattgascaaaaagtacagacagtttttatatacctctttccccaacacattcctttattgacactttaaagcttagtttcctcctttataaaggcagtaaaatcta

SEQ ID NO: 64225 - DNA, 201 bp, Homo sapiens
ctttctgtgttttaagtgaatattagtatgtttcattatcagcttctccccaggtctatctataactgtgttttatggattgcctttagtagttcacactytttttctttgtttttagtggtggggtcatgatctatattgaccgaatagaagtggttaatatgttggctccttatgcaggtatgttacccatctacctgt

SEQ ID NO: 64226 - DNA, 201 bp, Homo sapiens
acatagtgagatgttgatgttcttagctcggtcttgaagtcacttgttatatattgctgcttcctgtctgtctctgttgactgattctggatgaaatttgkgggggggctggagacaatgcagtaaatagagcttttatgtctggacttattttacttgaagcttagtacctgggtggaatgtaaggctctgggtgatagg

SEQ ID NO: 64227 - DNA, 201 bp, Homo sapiens
aagtctaataagttacccagtaaaaaagcttatccatagttaagtaatacatttagtgggtaaacttattggataaacagactatctgcttgtcatcttcrttccttaatttctttattagataattccttgcaatttttttcccacacaaaagggaagaaaaggcagtttaagctctgtaaaagaatagtactgtggaaa

SEQ ID NO: 64228 - DNA, 201 bp, Homo sapiens
ttgggaggctgaggtgggaggatgacttgaacacagcaggttgaggctgcagtgaactgtgttcatgctgtactcttgtctgggcaacagagcaaaacccwgtctataaataaataaataaatagcatttgtatatagagaacttgtttttgaaccttaccctttgagaggggtagaattcgtttttaaaaataaactttt

SEQ ID NO: 64229 - DNA, 201 bp, Homo sapiens
  misc_feature (1)...(201): n = A,T,C or G, or insertion/deletion polymorphism (see Tables 1-2)
attttaagtcaggaacgcagctgttaatgtgatagccactctccaaagtgagagagggtcattggcagttattcagacttgactcatgatactcaggagancaataggtgaaatgtatatagggagagagaagactgttgcaccagagtattctgatgcctttgctcttgtttgctcccacacagcacaagttgaccccgg

SEQ ID NO: 64230 - DNA, 201 bp, Homo sapiens
tcttcaaattttttctttgtcatttaactttgttttttccttgctgataactttgaagtgttcatgttttacatagtaatttcagtgattttgtctttatrgtgtgttgctgagctggcatgttttaagagcttttcaccaccttaaaagtatagcaattaaaattagaaattataaaaattgtatctgcttttacagttg

SEQ ID NO: 64231 - DNA, 201 bp, Homo sapiens
taatggtaacttaacagtagatcctgagtatagtaaaactaagctccttagcctgtcactcaagacagaggtctcctagccctctttctcttcttattttwtgttgtcttcgcttgttggctggttccatatcacctctccattgtgacttgttcatttgtgccttcttgtctttcttttttttgtttttgtttttgtttt

SEQ ID NO: 64232 - DNA, 201 bp, Homo sapiens
ctcaagccaatctagaagtgtaggaggcatctttgacaatcgcctcaccctcagcatctaatcagtccctatgtcctgcagattccaccaccaaaatccaygtattaataaaactgaccacacctccatcttcactgtcatctcaagccaagctaccaactctaaccttgacatgtgcagtagcagtagccgcctgtcttc

SEQ ID NO: 64233 - DNA, 201 bp, Homo sapiens
tggaggagagaaggaacaacttagagtagaaaacaagtaggctcagatgagctgagagttatttgacagtgaaaagagtattcctcgtagagaagttgctstttggggactgggacttgaaaactgctaataggtttttaaaactttcaatgtgaaataagcagtcacaatattaagcagtggggaaagggactcttaact

SEQ ID NO: 64234 - DNA, 201 bp, Homo sapiens
tgggagttcgagaccagcctggccaacatggagaaaccccatcgctactaaaaatacaaaaattagggcgtggtggtgcgtgccagtaatgcagctactcrggaggctgaggcaggagaattacttgaaccagggaggtggaggttgcggtgagcctagatcacgccattgcactccagcctgggcaacaagagcgaaact

SEQ ID NO: 64235 - DNA, 201 bp, Homo sapiens
tggcgcgatctgggctcactgcaacctctgcctgctgggttcaagcgattctcgtgcctcagcttcccaagtagctgggattacaagtgtgcgccaccagscttggccaatttttgtatttttggtagagactggttttcaccatgttggccaggcatttctcagaatgttgagtgatgcatgactgtactttctgtctct

SEQ ID NO: 64236 - DNA, 201 bp, Homo sapiens
tgcggaggccgcctggaagctggaggcaggtgaatcccaggcccacccagaggaccctctgagaggctgctggggtgtcggggaggggccctaatcccagkcccatgcagaggaccctctgagaggctgctggagttcagggaggggccctaatcccagtcccgtccagaggaccctctgagaggctgctggggtgttggg

SEQ ID NO: 64237 - DNA, 201 bp, Homo sapiens
ggaacctgggtctcaggccccattcatgctgcccacggggctggctcccggagctgcggaggccgcctggaagctggaggcaggtgaatcccaggcccacscagaggaccctctgagaggctgctggggtgtcggggaggggccctaatcccaggcccatgcagaggaccctctgagaggctgctggagttcagggagggg

SEQ ID NO: 64238 - DNA, 201 bp, Homo sapiens
gctgtcctccgtcctccgtgtcactcaggtttgctggggctttcactctgcggcagcgaatgctcaacttcgtccagaatattcaatactacatgatgttygaagtgatggaaccgacctggcacatcctggagaaaaacctgaaatccgtgagttttagctccacagataataacgtttgaaagccactttcctttcaca

SEQ ID NO: 64239 - DNA, 201 bp, Homo sapiens
ctgtgaaccctgcagccagctctcaggtcagggtgcaggtgccctcagcacactcagcatcccaggaaaggggcggcctcgccccacctccctcccacggmcacataccacaggtcccaggggtgcctccggtattgaggctgccttgcctccctttgtccgcactgtccctgtccccttgtgccacctgtgcagacttga

SEQ ID NO: 64240 - DNA, 201 bp, Homo sapiens
gtaccaccagcatcaacgtccctgccgcggcctccaagatctccatgcaggagcttgaggaactgaggaagcagcttggcagcgtggccacaggctccacrctgcagcaggtactgcgtccatggctgtccacaggctccatgctgcagcaggtcctgtgtccgtggcgtccacaggcacccacactcagtgctgtgccgg

SEQ ID NO: 64241 - DNA, 201 bp, Homo sapiens
tcacgggtaccagagtgaaaaagtaacgcagagccggccaagtgaatggagctgcggctgagcaccgcgggctctgagaaccagtgtgggcctctccggtrgaagctgggatgttactgtgtgtgccggtagctggcacagtgtcaatggcttgggcctgcacagagctccctgtgtagaccccacaggcctcacgtctgg

SEQ ID NO: 64242 - DNA, 201 bp, Homo sapiens
ccgggactgcggtgagtcctggccgaacgcgggcgcgggcgtgatgagggggttgggggactgccaggcccgggggggcccacgaggcgacggggctggcsggacgcggctcttcccgcgcgctccctctggctgtgcagcggtccccgaactctggggccgaagcccttcgggcctgcaccggccaggccagcgtcttgc

SEQ ID NO: 64243 - DNA, 201 bp, Homo sapiens
ctgcggtgagtcctggccgaacgcgggcgcgggcgtgatgagggggttgggggactgccaggcccgggggggcccacgaggcgacggggctggcgggacgsggctcttcccgcgcgctccctctggctgtgcagcggtccccgaactctggggccgaagcccttcgggcctgcaccggccaggccagcgtcttgccccgcg

SEQ ID NO: 64244 - DNA, 201 bp, Homo sapiens
aacgacaagtactgggaccagcggtacaccatcgtccagcagcagatcccgtccttcctgcagaaaatggcggacaagatcctcagcacaggtgcggcgcrgcgggcagggacttggcgtccgcggcgcagcgggcggggacttggggtgcgcagcacagctctgcctggagagtctcctgcagcccaggccctcccaccg

SEQ ID NO: 64245 - DNA, 201 bp, Homo sapiens
gacaagtactgggaccagcggtacaccatcgtccagcagcagatcccgtccttcctgcagaaaatggcggacaagatcctcagcacaggtgcggcgcagcrggcagggacttggcgtccgcggcgcagcgggcggggacttggggtgcgcagcacagctctgcctggagagtctcctgcagcccaggccctcccaccggga

SEQ ID NO: 64246 - DNA, 201 bp, Homo sapiens
ggtgaaggagcacctgattctggtgtcacagctggagcagctgcacaggcagggcctcctttcgctgcagaagctctggttctacatccagccagccatgygcaccatggacatcctggcctccctcggtgcgtgcccgcccggggggcatggggcagtggtgggtggcaggtgttgaacatggcacccagtgtgaggaga

SEQ ID NO: 64247 - DNA, 201 bp, Homo sapiens
ggacctgtccatcagggagctggtgcacaggatcctcccagtggccgccagctactccgctgtgaccaggtgggcaccgggcgcggtccctgggagcctgygctgttgtgggggaggggttaggtcccatcctgatgaccatggggacgtctgcatcgcttctaaagagagcgcccgccttggtgacaactccgtgcccaa

SEQ ID NO: 64248 - DNA, 201 bp, Homo sapiens
tcggttccgtgcgcgcgggaggaggacgcgccctcggtgctgttggggtggtgttctgcaggtgggttgaggccgtgtctttcctcactgatcgtctgtcyggcggttctctccgtggttagaagtagggcaccgagtctccctgtcactgaagaactgcttttctccttgtcattctgtctattcttgattcagatattt

SEQ ID NO: 64249 - DNA, 201 bp, Homo sapiens
tgggatggaagaaagtttctattagatgctgtatttgccaaccaacaacccaggtcataacagcacttgtgtgtctccttctcattctctttcactctggsaacatgcggaatgcagagccggccctcctgggccctggggcagctccctttccacagcctgagacctagttcctgtggggggtccccgccagccaccaac

SEQ ID NO: 64250 - DNA, 201 bp, Homo sapiens
tcagtgtggtcttcttttttctagtttcttaatttgaaaagttagtttacagctgtaaacatccctccgagtgcagccttcgctgatcccctagcgtcatmatttctgtttgtctggaggtgtttctgattccctctgatttcttgttggagccgtgggtggtttatgtttaacttccacatgtttgtgaagtttctggtt

SEQ ID NO: 64251 - DNA, 201 bp, Homo sapiens
gggaacctgggtctcaggccccattcatgctgcccacggggctggctcccggagctgcggaggccgcctggaagctggaggcaggtgaatcccaggcccayccagaggaccctctgagaggctgctggggtgtcggggaggggccctaatcccaggcccatgcagaggaccctctgagaggctgctggagttcagggaggg

SEQ ID NO: 64252 - DNA, 201 bp, Homo sapiens
acgttcctccaagaagcagccacggctagatgttcctcagagctgtgttttcagtgggacgctgtgcatttctggcgggacagctctgttgatgattagcrtcccccgcccttgccctctaagtagcgagagcacccttccatgaccgtgacaccccagagttgccctaggacttttccaaaggtcttctggggggaggga

SEQ ID NO: 64253 - DNA, 201 bp, Homo sapiens
acagttgctgggcctgtcagtttgtgtgattaatagtaagaattcaggagcatcaagaaggccaagtcagcggccatggctagacgttcctccaagaagcrgccacggctagatgttcctcagagctgtgttttcagtgggacgctgtgcatttctggcgggacagctctgttgatgattagcatcccccgcccttgccct

SEQ ID NO: 64254 - DNA, 201 bp, Homo sapiens
gtacaccatcgtccagcagcagatcccgtccttcctgcagaaaatggcggacaagatcctcagcacaggtgcggcgcagcgggcagggacttggcgtccgyggcgcagcgggcggggacttggggtgcgcagcacagctctgcctggagagtctcctgcagcccaggccctcccaccgggagcctgtgcctcaccctgtgg

SEQ ID NO: 64255 - DNA, 201 bp, Homo sapiens
gccggccccgtcctgcggcggttggaactcagcctgtggctccccagtggggtcagtcaaagccaagtgcagtggctgaccttttatacccataaacaaakatgagcaagagtgagactgacccgcagatgagggcacgtggctgtgggggcatgggagtgggggctgcagagccacagcgctgtctgtgcccgcaggcac

SEQ ID NO: 64256 - DNA, 201 bp, Homo sapiens
cacgcacctcgaagaactggtgctcccgcgggaagcgcacggggcgcgcaacgaagcgaaagggcgcggccccagccgcgggatcccgctctacaggcagyggctccgccgccccgggccccgcagcgaggcgggcgcacagcgcggggggcaactgcatcaccccgggcgcgggcgggcgcagcctgtcggccaccgtcc

SEQ ID NO: 64257 - DNA, 201 bp, Homo sapiens
agctttgtcatcaagttcatatgcgcacaaccaaccaggacaaaaggaaagccagggctgcatgatgtgtgagcacggccgacggctgcaggaggtacagrcacggccccgaggggtgtgagtgcggatgaccacggccgactgctgcaggaggtacaggcatggcccagaggggtgtgagtgcggaggcgctgcgcccgc

SEQ ID NO: 64258 - DNA, 201 bp, Homo sapiens; identical to SEQ ID NO: 29408

SEQ ID NO: 64259 - DNA, 201 bp, Homo sapiens
ccctagaaatttacacagagcatgaaattagatggcgagctgggcgggcagacgctggagcacagcaccgtcctggggctgcccgcaggggccgaggagcrggcccggaaggagctcgccaggaaggtgcgtggcctccaggtttggccagagagagacgcttcctcccggctgggcggcagcctgggcatcctgacgcag

SEQ ID NO: 64260 - DNA, 201 bp, Homo sapiens
ttaagaaatgaaaccccttcggggtgtgcccatcatttttttagtggtgtttggaagttttcccctaaaagcccaaggcccatttaagaggtagaagtgcrtaaacaggaatgcacaaagccagaactgagcacgtgcgcacgcagggcccgtctgtcagccacgtctttctgagaaggggcttggcctgttccccgcagg

SEQ ID NO: 64261 - DNA, 201 bp, Homo sapiens
tgggtgtgggtagcaccatcgggtgggcaggcgcgggtgggcagaccatgtcccgaccgtggccgcacgcagcctgctcacgttttcctgcccttgtgttygtggaggagccgctgggatctgagtgtttccagaactcctggtcttcctggccgggtgattccctcctggagcccctgccctggcagcgtgggcagggct

SEQ ID NO: 64262 - DNA, 201 bp, Homo sapiens
agctcatgtctgtgtgcgtcatgttcaccaactgcatgcaggtgcgtgggtgtgggtagcaccatcgggtgggcaggcgcgggtgggcagaccatgtcccraccgtggccgcacgcagcctgctcacgttttcctgcccttgtgttcgtggaggagccgctgggatctgagtgtttccagaactcctggtcttcctggccg

SEQ ID NO: 64263 - DNA, 201 bp, Homo sapiens
tggctcagcccttcctcagctcagtccagcacctgcccctgcccaacaccgccctggcccagtgctgtcccggctcagccttcccccagctcagcccagcrcctgcccctgcccagcactgccctggcccagtgctgccccggctcagccttcccccagctcagcccagcacctgcccctgcccagcaccgccctggctca

SEQ ID NO: 64264 - DNA, 201 bp, Homo sapiens
gcccctgcccagcaccgccctggctcagcccttcctcagctcagtccagcacctgcccctgcccaacaccgccctggcccagtgctgtcccggctcagccktcccccagctcagcccagcgcctgcccctgcccagcactgccctggcccagtgctgccccggctcagccttcccccagctcagcccagcacctgcccctg

SEQ ID NO: 64265 - DNA, 201 bp, Homo sapiens
agcttctatgcatgtctttagttgagtgtttgcgctaaagtgtatctttctggttttgttttttaaaatgtccttgctagtctctggaacttaaaagaaaratgcttcgagacaagcagaacaaaaaaaattcaggccagcacctccccatcttcccagcatgggtgtatgagagacctgccctgatcggggatttcctga

SEQ ID NO: 64266 - DNA, 201 bp, Homo sapiens
catttcatttctatgtggttgaccctttgtgggtgttgaattgagtaatcatctttgccgtagatgctagcttctatgcatgtctttagttgagtgtttgygctaaagtgtatctttctggttttgttttttaaaatgtccttgctagtctctggaacttaaaagaaagatgcttcgagacaagcagaacaaaaaaaattc

SEQ ID NO: 64267 - DNA, 201 bp, Homo sapiens
gcatttcatttctatgtggttgaccctttgtgggtgttgaattgagtaatcatctttgccgtagatgctagcttctatgcatgtctttagttgagtgtttscgctaaagtgtatctttctggttttgttttttaaaatgtccttgctagtctctggaacttaaaagaaagatgcttcgagacaagcagaacaaaaaaaatt

SEQ ID NO: 64268 - DNA, 201 bp, Homo sapiens
atgagactcagaatatcggacattgtatgtgcctgcagcttgcctttttgaggaagtctgacagcttttcttccaggttcattgaagagaagtcttccttygagtacgggcaggtgaaccacgccctggcggccgccatgcgcaccctggtgaaggagcacctgattctggtgtcacagctggagcagctgcacaggcagg

SEQ ID NO: 64269 - DNA, 201 bp, Homo sapiens
cagtggctgaccttttatacccataaacaaagatgagcaagagtgagactgacccgcagatgagggcacgtggctgtgggggcatgggagtgggggctgcrgagccacagcgctgtctgtgcccgcaggcacgttgcccctggcctcgcaggagtcggccgtggtggaggacctgctgtacgtgctggtgggcgtggacgg

SEQ ID NO: 64270 - DNA, 201 bp, Homo sapiens
ccctactctccccctatggccaaagaggtgctggcccagtgtgaacacacagttttacatgttttcagactctgcagtacttacaacagaatgcaaaagaragagctgagcttgcagccgctgctgtgggcagcagtaccaccagcatcaacgtccctgccgcggcctccaagatctccatgcaggagcttgaggaactga

SEQ ID NO: 64271 - DNA, 201 bp, Homo sapiens
tgggtccctcacagcttctgatgacagctgctaatgccatttgctgaggaacaaggatggggaggatggcgagggcctggcccccagggcggccacaccaraaggtcggagaaaggcccaaggcggatgccacgcccagcagtggtgactgccccccactccttttctgagtctatcagcattgtttggttttcttcttgt

SEQ ID NO: 64272 - DNA, 201 bp, Homo sapiens
ttgacgtaagtcatctcccagtctctctcattagagctgccacgttcctgcctttgtgacctttaaactccctttggagctgtgtccctgaggcgtcctakcctcctgggtgcgtgttgagtgcagcggctcccaaggacccagccggttcttgctgggcacgttctgtgctggacatggtgctaggcctctgtccacgtc

SEQ ID NO: 64273 - DNA, 201 bp, Homo sapiens
tccagcgcctgcccctgcccagcaccgccctggctcagcccttcctcagctcagtccagcacctgcccctgcccaacaccgccctggcccagtgctgtccyggctcagccttcccccagctcagcccagcgcctgcccctgcccagcactgccctggcccagtgctgccccggctcagccttcccccagctcagcccagca

SEQ ID NO: 64274 - DNA, 201 bp, Homo sapiens
attattccttctgtatttgctacttgctcttggttttgattttatgccctaccctggtcttttgacgtaagtcatctcccagtctctctcattagagctgmcacgttcctgcctttgtgacctttaaactccctttggagctgtgtccctgaggcgtcctagcctcctgggtgcgtgttgagtgcagcggctcccaaggac

SEQ ID NO: 64275 - DNA, 201 bp, Homo sapiens
ctcgggcacctgccagatcttcactcaggtttggcagaagcgagaactgtgccacgcggtggccacctcgtcccacagaggacccaaggcggctctccccrgccttcagtgtccgggagattcacgggctgtccgggggccacggtgcggactgtggagtacagacgccgtgtccacgacgccgccggtcacggaggccca

SEQ ID NO: 64276 - DNA, 201 bp, Homo sapiens
cgtgactctgagcctacccaatcctgactccccatttccctcctccaatttttgacaattttgagggaatgctttcagatcattatattttcaagattctygaaaatacagtaatttttattattccttctgtatttgctacttgctcttggttttgattttatgccctaccctggtcttttgacgtaagtcatctcccag

SEQ ID NO: 64277 - DNA, 201 bp, Homo sapiens
tttcagttttgtgaaatgtattgatttgtgtagtggccccacatccatcctggagagtgttccgtgcgcgcgggaggaggatgtgccctcggttccgtgcrcgcgggaggaggacgcgccctcggtgctgttggggtggtgttctgcaggtgggttgaggccgtgtctttcctcactgatcgtctgtctggcggttctctc

SEQ ID NO: 64278 - DNA, 201 bp, Homo sapiens
gggcgtgcgggagaggcagggagtgcagggagacacggagtgcaggagaggcagggcaaggggagaggaagggatcccccagggcggggctgcacccacaytgctggccacacacgggaccccttgctgcctgccgtcctagggggactctgagccgtctttgccccgaggttgtctctcccacattgcgcatctgaggct

SEQ ID NO: 64279 - DNA, 201 bp, Homo sapiens
tatgtggagcagatcgagaaggcgtttaactacgccagcaaggtgctgctggacttcctgatggaggagaaggagctggtggctcacctcaggtgattccrtgccctgtccctgtgcgggcactcacctccctctgaaaccggaacctgtgggacgtggggctgagatcgctgggtttcttctggcagctccgccttgtct

SEQ ID NO: 64280 - DNA, 201 bp, Homo sapiens
tgcctgtacctaaccaaggcggccagtgctccctacttcgaggttctggagaagtggatctacaggggcatcatccacgacccatacaggtagggctcccygggacacgggggacacggagggacatgggggacacggagggcgcgtgctgccctctcccgtacaggtagggctccccgggacacggggacacagagggac

SEQ ID NO: 64281 - DNA, 201 bp, Homo sapiens
caggcccacccagaggaccctctgagaggctgctggggtgtcggggaggggccctaatcccaggcccatgcagaggaccctctgagaggctgctggagttyagggaggggccctaatcccagtcccgtccagaggaccctctgagaggctgctggggtgttgggcaggggccctaatcccaggcccatgcagaggaccctc

SEQ ID NO: 64282 - DNA, 201 bp, Homo sapiens
cctaaccaaggcggccagtgctccctacttcgaggttctggagaagtggatctacaggggcatcatccacgacccatacaggtagggctccctgggacacrggggacacggagggacatgggggacacggagggcgcgtgctgccctctcccgtacaggtagggctccccgggacacggggacacagagggacacggaggg

SEQ ID NO: 64283 - DNA, 201 bp, Homo sapiens
tgagcttcccgcatgtgtcacgctcagttcctgcctgtcgcacgcgtcgctttgctattaatgggtgcctgtcagggttggggagccgtcctggtggtgtygtccctactctccccctatggccaaagaggtgctggcccagtgtgaacacacagttttacatgttttcagactctgcagtacttacaacagaatgcaaaa

SEQ ID NO: 64284 - DNA, 201 bp, Homo sapiens
cccggctcctgcacccagggtcgcagtcaccgcacagtgagccctggctgtgacaggaaggaagggtgtggggtcagcagggactggtgcaaatgggtccrgaattttcaaatcgaatgctctgtgttctgtctttgcagtttaaatataaagcaggaatgattgactcagctcactttgtttctcaaggcgctgggtttc

SEQ ID NO: 64285 - DNA, 201 bp, Homo sapiens
aaggtgcgtggcctccaggtttggccagagagagacgcttcctcccggctgggcggcagcctgggcatcctgacgcagggagaacaaacctccccccttttacttccatctcccctcagattgaagaaaagacttaaaattagcttccaagcacaagcacaagagcctctcacaatcttctcagctctctggtccccactt

SEQ ID NO: 64286 - DNA, 201 bp, Homo sapiens
ctttagatccataatgcttcattgcttcattttcctgtcttggggctgcacggcgctgccgtccaccccacaggggatgctggctctgtccctcagccctytctggagccttgtggtgactgcacgggcatggagactgcccaggtcggtgtgcaggacactagctcctcccgagagcggacagccacatcttgctgggac

SEQ ID NO: 64287 - DNA, 201 bp, Homo sapiens
ccacgacgccgccggtcacggaggcccacctgaggtgccgccacgtctcttgcaggaaagccctcactcgctaccagatgctcttcaggcacatgttctaytgcaagcacgtggagcggcagctctgcagcgtctggatcagcaacaaaaccgccaagcagcactcgctgcactccgcccagtggtgcgttcttcctctgc

SEQ ID NO: 64288 - DNA, 201 bp, Homo sapiens
tttgtgtgcaggacattaaattgcctccaattaggtccttcaacctctttggtgcttggatttcctgatctggtggggtctgtcggcttctcttcagtgcratatatttaaatgcataaaaatatgttagttcccaaagaattgtattatgtctattacgtcaagataccgttgttgaaatattttcaaaaaatacattag

SEQ ID NO: 64289 - DNA, 201 bp, Homo sapiens
ccgattttcttacccagcgttacctttctgaattcagtatgagaagagctgcggcccaggtgcagcccagaatcctcagcaccgaacacatgttgagaacrggtttcagaaagagctcagacactgacctatgtctgtagatccgcctctcacctgccggtgcaggggaggctgccacaggctcagagcagatttccatgg

SEQ ID NO: 64290 - DNA, 201 bp, Homo sapiens
tccagtccccgcagctcccgtgaaacacaggacctgtgctaggtgctcagggcgtgtgggggaaggcatcacaggagggcgcggcagccttgtaggagagrcagacgtcagagtaaagagtcacctaattaaaatggtgaatgacaacacacgcgggaagcagtggacgcttcagatctactgcagagaatgggcccagtg

SEQ ID NO: 64291 - DNA, 201 bp, Homo sapiens
ccggctcagccttcccccagctcagcccagcacctgcccctgcccagcaccgccctggctcagcccttcctcagctcagtccagcacctgcccctgcccarcaccgccctggcccagtgctgtcccggctcagccttcccccagctcagcccagcgcctgcccctgcccagcaccgccctggcccagtgctgccccggctc

SEQ ID NO: 64292 - DNA, 201 bp, Homo sapiens
ccagcgcctgcccctgcccagcaccgccctggctcagcccttcctcagctcagtccagcacctgcccctgcccaacaccgccctggcccagtgctgtccckgctcagccttcccccagctcagcccagcgcctgcccctgcccagcactgccctggcccagtgctgccccggctcagccttcccccagctcagcccagcac

SEQ ID NO: 64293 - DNA, 201 bp, Homo sapiens
ggaatgcagagccggccctcctgggccctggggcagctccctttccacagcctgagacctagttcctgtggggggtccccgccagccaccaacgcacaccygctgggaagaactccgcagagagggcggctcctgccaagccctctggggctgagacttcctgctaccccatgtccattccatgaaaacccctactgtccc

SEQ ID NO: 64294 - DNA, 201 bp, Homo sapiens
ctgcttatcttgccccatccccgttagtccaaactcaagaggcagcatggagcgtggtctgcttccccactactcacggctctgcaatgtgggcaccaagrggccaacccttgcctttgccggaaaccctggagaacggtgacgtgaaatccacctgttttcctcatccccaagcaaacagaaccctgctgtaagttaatg

SEQ ID NO: 64295 - DNA, 201 bp, Homo sapiens
accctgcggctgtgtgtgtcctgtggggctgatcaggcctgggtcagcttccctcatgctgcactaacacctagcctgggggaaagggccaggtggccaarctgccagcctggaaggggtggtgcccttgggggtgctgtccttgggaaggtgcctatttgtgcttttggaccaccctgtgccctgtgccccccacaaatg

SEQ ID NO: 64296 - DNA, 201 bp, Homo sapiens
aacccccacagatcttcagagcgagcgctgtgcagggcgcctgggcgagggcaggggccacacccgctgtccctgctgagctcggtcctgagttagaaccrtcaggctctcagcaggcacggacaggctgcatgtcctcggaggcatggccctgcggcgccggctccggggtggcatggtggggtgggcagtcccgtgttc

SEQ ID NO: 64297 - DNA, 201 bp, Homo sapiens
actccgtccaaaagaaaaagcataacccctagggttgcacataataacaaattccagagggaacatagtgaggtgtatacaatgaacgcataaactactgsggggaatacagtgagatgcagacaatgaacgcataaactactggggggaaaaggtaagtcgctactctccagtacaaacctgaagaagcataaaagggaa

SEQ ID NO: 64298 - DNA, 201 bp, Homo sapiens
ggattacaggtgtgagccaccatacccggcctaaagcaacccttgaggtccctccacagccaggcggctggatccacactaacccccaccccacggcaccyccaccccaccgtgaggcttctccccacaagggcattggccgaggcttcgtggctgtggatgaatgaggccaacatggtggaaagtaagtgatgcagagtc

SEQ ID NO: 64299 - DNA, 201 bp, Homo sapiens
aagacttagggagagagagctgctcccttagcgggtactcagcaggcagccggggagtggtgggcacctgagagctcctgatggtacccaggcagacttcrgagaaggaagcgcggggccctgctgcctgggatcccagcagtggagccggctttttggagcaggaggcactgagggggtgttcaggctttccccccatgt

SEQ ID NO: 64300 - DNA, 201 bp, Homo sapiens
gctgctggggtgtcggggaggggccctaatcccaggcccatgcagaggaccctctgagaggctgctggagttcagggaggggccctaatcccagtcccgtscagaggaccctctgagaggctgctggggtgttgggcaggggccctaatcccaggcccatgcagaggaccctctgagaggctgctgggctgttgggggagg

SEQ ID NO: 64301 - DNA, 201 bp, Homo sapiens
gcgtgttgagtgcagcggctcccaaggacccagccggttcttgctgggcacgttctgtgctggacatggtgctaggcctctgtccacgtctccctcagccstggcagaagactgggtcttactgccacgtgcagagacagtttgcatctgcccgtgtccctgaccagccctgagtgggagtcagtgcttccgaaagctggg

SEQ ID NO: 64302 - DNA, 201 bp, Homo sapiens
ccaaagaggtgctggcccagtgtgaacacacagttttacatgttttcagactctgcagtacttacaacagaatgcaaaagaaagagctgagcttgcagccrctgctgtgggcagcagtaccaccagcatcaacgtccctgccgcggcctccaagatctccatgcaggagcttgaggaactgaggaagcagcttggcagcgt

SEQ ID NO: 64303 - DNA, 201 bp, Homo sapiens
cgggatcgggggtctttgtgcctgtgctctggaggggcgcgggtctcgggttttcctgcagtgccctcgtccgggcctggctttcaggtcatgctggcctygtggaattgttttcacgtgtccctccatctgtcttttgaaagggtttcaggtcttttgaaagggtttcaggagtggtgttaattctttttgtttttgcct

SEQ ID NO: 64304 - DNA, 201 bp, Homo sapiens
ggtacaccatcgtccagcagcagatcccgtccttcctgcagaaaatggcggacaagatcctcagcacaggtgcggcgcagcgggcagggacttggcgtcckcggcgcagcgggcggggacttggggtgcgcagcacagctctgcctggagagtctcctgcagcccaggccctcccaccgggagcctgtgcctcaccctgtg

SEQ ID NO: 64305 - DNA, 201 bp, Homo sapiens
tagtggtgtttggaagttttcccctaaaagcccaaggcccatttaagaggtagaagtgcgtaaacaggaatgcacaaagccagaactgagcacgtgcgcaygcagggcccgtctgtcagccacgtctttctgagaaggggcttggcctgttccccgcaggcctccaacattgacgacgtccttggccaccacacaggcttc

SEQ ID NO: 64306 - DNA, 201 bp, Homo sapiens
caggcagacttcggagaaggaagcgcggggccctgctgcctgggatcccagcagtggagccggctttttggagcaggaggcactgagggggtgttcaggckttccccccatgtttccccattcagggaaggggttgtacaaaagaggaacgcactgtccagtaacgctgcggcgccgtgggcagctctgagcgtggcggtg

SEQ ID NO: 64307 - DNA, 201 bp, Homo sapiens
aagacagctggggcctcagactgaccgtgtggagagcccattcaatgtccattccactgcctcctgtgtagacaaagacagctggggcctgagatcgaccrtgtggagaataaaattttgaatttctgtgttttcaggaaaatatctaaatgtggtcagagagtgtggccatgacgtcacctgcccggtggctaaagagat

SEQ ID NO: 64308 - DNA, 201 bp, Homo sapiens
ccagcggtacaccatcgtccagcagcagatcccgtccttcctgcagaaaatggcggacaagatcctcagcacaggtgcggcgcagcgggcagggacttggsgtccgcggcgcagcgggcggggacttggggtgcgcagcacagctctgcctggagagtctcctgcagcccaggccctcccaccgggagcctgtgcctcacc

SEQ ID NO: 64309 - DNA, 201 bp, Homo sapiens
gggaccagcggtacaccatcgtccagcagcagatcccgtccttcctgcagaaaatggcggacaagatcctcagcacaggtgcggcgcagcgggcagggacytggcgtccgcggcgcagcgggcggggacttggggtgcgcagcacagctctgcctggagagtctcctgcagcccaggccctcccaccgggagcctgtgcct

SEQ ID NO: 64310 - DNA, 201 bp, Homo sapiens
ttttagtagagatggggtttcaccatgttagccaggatggtctcgatctcctgacctcatgatccgcccaccttggcttcccaaagtgctgagattacagscgtgagccaccgtgcccagcatgtagtttttaaataaatactcagatgatttttcttcataggtagctttctctcctgacttgtgtctggtgggggagtg

SEQ ID NO: 64311 - DNA, 201 bp, Homo sapiens
agtggtcctgctgcctcagcgttccaaagagctgtaactgcaggcgtgagccaccatgcctgcccctgtactttttccatgtttagatacacaaatatctstgtgttacagttgtctagtgttcagcaccgccacctgctgggcaggtttgtagcccacgagcaagaggctcctctaggtggtttaggtgcattgtaggcc

SEQ ID NO: 64312 - DNA, 201 bp, Homo sapiens
aaaacatcatggaacccatgttttctatttaagaaaaggggaagggaaaggacaccggcctgctgggaacagtgtggagccaagaaggcccacggtggggrtgggcatggctcacgcaccccggctttctttccagcacctggctgagcacgcagacactgtgcagctggtgtccggcttcgaggccaccatcaacaagtt

SEQ ID NO: 64313 - DNA, 201 bp, Homo sapiens
gatcttcactcaggtttggcagaagcgagaactgtgccacgcggtggccacctcgtcccacagaggacccaaggcggctctccccagccttcagtgtccgrgagattcacgggctgtccgggggccacggtgcggactgtggagtacagacgccgtgtccacgacgccgccggtcacggaggcccacctgaggtgccgcca

SEQ ID NO: 64314 - DNA, 201 bp, Homo sapiens
gcaggaaagccctcactcgctaccagatgctcttcaggcacatgttctattgcaagcacgtggagcggcagctctgcagcgtctggatcagcaacaaaacygccaagcagcactcgctgcactccgcccagtggtgcgttcttcctctgcccccgcatgccctcctgaagcagcgctcgctgcactctgcccagtggtgca

SEQ ID NO: 64315 - DNA, 201 bp, Homo sapiens
tgcccttcatttcctgtcctgtcgttgtgcgatggttttgtaggaactctgttgcgggtggttggaacttagcaaatacttgagtgattaacgtgaggacrgtattacttgcttataataactattatgtccctcgtcaaatatgcttcatttttcaacctgggcctggtgcttatcatggtacaaaggttttcgtcctaa

SEQ ID NO: 64316 - DNA, 201 bp, Homo sapiens
ccaagcagcactcgctgcactccgcccagtggtgcgttcttcctctgcccccgcatgccctcctgaagcagcgctcgctgcactctgcccagtggtgcagygccccccttgtgccctcctggtagacagctttctaggcttctggaagtgtcatctggaagcgcacgttggtggctttagatccataatgcttcattgctt

SEQ ID NO: 64317 - DNA, 201 bp, Homo sapiens
tttcttcttgctttatcccctgcccttcatttcctgtcctgtcgttgtgcgatggttttgtaggaactctgttgcgggtggttggaacttagcaaatactygagtgattaacgtgaggacggtattacttgcttataataactattatgtccctcgtcaaatatgcttcatttttcaacctgggcctggtgcttatcatgg

SEQ ID NO: 64318 - DNA, 201 bp, Homo sapiens
tgatgtcttttttaccttgaatctcctgaaaacatcatggaacccatgttttctatttaagaaaaggggaagggaaaggacaccggcctgctgggaacagygtggagccaagaaggcccacggtgggggtgggcatggctcacgcaccccggctttctttccagcacctggctgagcacgcagacactgtgcagctggtgt

SEQ ID NO: 64319 - DNA, 201 bp, Homo sapiens
ctttttgtttttgcctttttgttgtcgttgttttttgtttttttttttgagacggagttttgctcttgtcacccaggctggagtgcagtggcatgatctcrgctcactgcagcctccacctcctgggttcaagtgatgctcctacctcagcctcccgagtagctgggattacaggtgcgcgccaccacgcccagctaattt

SEQ ID NO: 64320 - DNA, 201 bp, Homo sapiens
ccaggctggagtgcaatggtgcgatcatagctgatagatcgctgcggcctcaaattcttgggctcaagtggtcctgctgcctcagcgttccaaagagctgkaactgcaggcgtgagccaccatgcctgcccctgtactttttccatgtttagatacacaaatatctctgtgttacagttgtctagtgttcagcaccgccac

SEQ ID NO: 64321 - DNA, 201 bp, Homo sapiens
tcacgtgtccctccatctgtcttttgaaagggtttcaggtcttttgaaagggtttcaggagtggtgttaattctttttgtttttgcctttttgttgtcgtygttttttgtttttttttttgagacggagttttgctcttgtcacccaggctggagtgcagtggcatgatctcggctcactgcagcctccacctcctgggtt

SEQ ID NO: 64322 - DNA, 201 bp, Homo sapiens
atcagtttcccacctatctctgcggaccgtacattctccctgagcccaggttaaatactccgttccagagcgaggtttgtaggtttgttggttttcttttytttttttttctttttttttttgaggcagagtctcgctccattgccaggctggagtgcagtggcatgatctcggctcgctgcaacccccacctcccaggtt

SEQ ID NO: 64323 - DNA, 201 bp, Homo sapiens
tttgtagaaatggggttttgttattttggccaggctggtcttgaactcctggactcaagcagtctaccagcctcggcctcccaaagtgctgggattacagkcatgagccactgcctagctcaaaacatggataagtttaacacaatatggagatgagttttgttagtttatttcagagggataattatttaacctacccaa

SEQ ID NO: 64324 - DNA, 201 bp, Homo sapiens
tttagtagagatgaggtttcactgtgttaaccaggatggtctcgagctcctgaccttgtgatccgctcgccttggcctcccaaagtgctgggattacaggygtaagccaccgcacctggccatagcatgctaaatattatacataaaccagtaacatagttgtttattatcattatcaaatattgtatactgtacataact

SEQ ID NO: 64325 - DNA, 201 bp, Homo sapiens
cgttattggctggagggcgctgacgtctgattgttgcgcggtcgcatttttccggggaacgcggattcgcattcccaattttaggtggcagtcgcaacccrtactattcggacagatggcacagaaaccgctgcgcctgtgagtgaccgtgaatggaagcctctctccctgtgtctctttcgtgtgtgtaggtgacgacac

SEQ ID NO: 64326 - DNA, 201 bp, Homo sapiens
acaaggatgtggaggaattggaatcctcacacattgctggtgagagtgtaaaatggtgcagccgctttggaaaactgtttagcagttcttgaaaggttaartgtaagagtcagcagcatggtaacggcaattttattcctgtcccaagataagggaaaacatatgtccacacaaaaacttgtacacagatgatcataatag

SEQ ID NO: 64327 - DNA, 201 bp, Homo sapiens
ctgagccacctgtttggcttccactgcttctgtgaactccttcccgaaggtcagatgtgtcaaggacacgtcatccaggatgagcccaaaggtggctgctygctctgtaaggtcgttgctcatctgcctggagaccagctctctttaggtgattagttctccagcatcaaagtgagccaccactgacttgaggatctcagt

SEQ ID NO: 64328 - DNA, 201 bp, Homo sapiens
cacctgtttggcttccactgcttctgtgaactccttcccgaaggtcagatgtgtcaaggacacgtcatccaggatgagcccaaaggtggctgcttgctctrtaaggtcgttgctcatctgcctggagaccagctctctttaggtgattagttctccagcatcaaagtgagccaccactgacttgaggatctcagtagtgat

SEQ ID NO: 64329 - DNA, 201 bp, Homo sapiens
ttatactttcgtcaaaaggtgtgcacattataaaatttggcaagcattgttaaattcatctaaaaactttgttccaatttatacccctaccccagcagtgkttttttttttccccctccatatttctcactggatcaagtcaaagtttttgtttgtttgtttaagatggagtctctgtctattgcccaggctggagtgtag

SEQ ID NO: 64330 - DNA, 201 bp, Homo sapiens
gtggctgaggcaggagaatcgcttgaacccgggaggcggaggttgctgtgagccgagatcgcgccactgcactccagcctgggcgacagaacgagactctcaaaacaaaacaaaacaaaacaaaacaaacaaaaaacaatacaaataatggccgggcgcggtggctcacgcctgtaatcctagcactttgggaggctgagg

SEQ ID NO: 64331 - DNA, 201 bp, Homo sapiens
ctccatgttggtcgggctggtctctatctcctgacctcaggtgattcgcccgcctcagcctcccaaagtgctgggattgcaggcatgagccgccacccccrgcccacgtcaaagttttattaaagtttttgccaatgtgataaatgatatataattgttacttagttgcatttccctaatcagtagtaagtttaaacatct

SEQ ID NO: 64332 - DNA, 201 bp, Homo sapiens
tggctgaggcaggagaatcgcttgaacccgggaggcggaggttgctgtgagccgagatcgcgccactgcactccagcctgggcgacagaacgagactctcaaaacaaaacaaaacaaaacaaaacaaacaaaaaacaatacaaataatggccgggcgcggtggctcacgcctgtaatcctagcactttgggaggctgaggc

SEQ ID NO: 64333 - DNA, 201 bp, Homo sapiens
ggctgaggcaggagaatcgcttgaacccgggaggcggaggttgctgtgagccgagatcgcgccactgcactccagcctgggcgacagaacgagactctcaaaacaaaacaaaacaaaacaaaacaaacaaaaaacaatacaaataatggccgggcgcggtggctcacgcctgtaatcctagcactttgggaggctgaggcg

SEQ ID NO: 64334 - DNA, 201 bp, Homo sapiens
cccctaatgtcattatgttctttttctctaaagtatctttacgcgttcagtattgttcccatgaagctaatggatgcagcagaactggtaaaacagcctcyggatgtcactgaaaacccttacagaaaatctgggcaggaagcatccataggaaagcaaattcttgcccctgtggtatgttctgattgagggttggcattt

SEQ ID NO: 64335 - DNA, 201 bp, Homo sapiens
ttagtcgagacggggtttcaccatattggccaggctggtctcgaactcctgaccttgtgatctgcctgccttggcctcccgaaggtattacaggcatgagycacccacgcctggcaagatctggtttttgacatgttgagcctaaggtttttgacatgttgagctatcaaggcattccaaaaatgttattaaataggcaat

SEQ ID NO: 64336 - DNA, 201 bp, Homo sapiens
tatagtttagtacataagacaagtttaatcgttagaatctaaatcttttttttccccttgggaaatcatgatgatgtttagaaaatcttagtagatttcarctaagcttagtgttttttattgtagtttggggttaacagtttgatacattaggtctttctttgtccaaactggattcagacgtttggggttacagtttta

SEQ ID NO: 64337 - DNA, 201 bp, Homo sapiens
tgaggagcacaggctcagcccattgtggcagtgttgtataccagtcttttcaggatataaaaatcagacaaagctgagttctgtggggtgattatatgctstagtgcttggaccatagtaacacctggctttcttttacatgaagctcagcctccaggaccctgctggttttgccttgctagccctgaagtggaaaaacat

SEQ ID NO: 64338 - DNA, 201 bp, Homo sapiens
ctgttggaaatcccagagcactctgacatcaagcaggtgaaacaggggatggtgatattcagggaagagtaaatatctgttttttttgttgttgtttgttstttgtttgtttgtttgagacagagtcttgctctgttgcctaggttggagtgcagtggcatgatcttggctcactgcaacctccgccttccgggttcaagt

SEQ ID NO: 64339 - DNA, 201 bp, Homo sapiens
tgagacaaagtctcgctctgtcacccaagcaggattgcagtggcataactgtggctcactgtagcctcaacctcctgggctctagagttcctcccacctcrgcctcatgagtagctgggaccacaggcgcatgctaccatgcctggcaaacttttttgattttttatagagacaggagggtctccctgtgttgcccaggct

SEQ ID NO: 64340 - DNA, 201 bp, Homo sapiens
ctgcactccagcctgggcgacagaacgagactctcaaaacaaaacaaaacaaaacaaaacaaacaaaaaacaatacaaataatggccgggcgcggtggctsacgcctgtaatcctagcactttgggaggctgaggcgggcggatcacttgcggtcaggagttcgagaccagcctggccaacgtggtgacaccccgtctcta

SEQ ID NO: 64341 - DNA, 201 bp, Homo sapiens
gctgaggcaggagaatcgcttgaacccgggaggcggaggttgctgtgagccgagatcgcgccactgcactccagcctgggcgacagaacgagactctcaaaacaaaacaaaacaaaacaaaacaaacaaaaaacaatacaaataatggccgggcgcggtggctcacgcctgtaatcctagcactttgggaggctgaggcgg

SEQ ID NO: 64342 - DNA, 201 bp, Homo sapiens
ctgaggcaggagaatcgcttgaacccgggaggcggaggttgctgtgagccgagatcgcgccactgcactccagcctgggcgacagaacgagactctcaaaacaaaacaaaacaaaacaaaacaaacaaaaaacaatacaaataatggccgggcgcggtggctcacgcctgtaatcctagcactttgggaggctgaggcggg

SEQ ID NO: 64343 - DNA, 201 bp, Homo sapiens
gcacaaggatatagcaaagctagggaagatcgagagaagggctgctaaagtgatgaaggaagagagaaagacacatatgatgctctgtaaggaaggatgakaaaatgaggcccctttgttttgcggggagctaaaaattgattttgatcaaggcttataaataaccatacagtatatttatggaggagaaaagtatagttc

SEQ ID NO: 64344 - DNA, 201 bp, Homo sapiens
taatcctagcactttgggaggctgaggcgggcggatcacttgcggtcaggagttcgagaccagcctggccaacgtggtgacaccccgtctctactaatacaaaaaaaaaaaattagccaggcgtggtggcgcgtgcctgtaatcccagctacttgggaggctgaggcaggagaatcgcttgaacccggaggcggaggttgc

SEQ ID NO: 64345 - DNA, 201 bp, Homo sapiens
gggttatgttctgagaaatgagttggtaggcgatttcgtcattgtgcgaacatctttgagtgtacttccagagacctagatggtatggcttcctgtacacytaggctaaatggtatagctgtacgtcaagttactgtactgaatactgtaggcaattgtaacacaatggtaagcatttttgtatttaaatatagaaagggt

SEQ ID NO: 64346 - DNA, 201 bp, Homo sapiens
gaagcaggtggaccacctgagcctggggaggtcgatgctgcagtgagctgtgatcgtgctgctgatctccaggctgggtgacagattgaaaccctgtctcaaaaaaaaaaaaaaaaaattgcaatagtggtaacttttgggaagaaaatattcgtgaatctgggagagtgcataagaggggtatttggcttaatgatagga

SEQ ID NO: 64347 - DNA, 201 bp, Homo sapiens
tgtacgtcaagttactgtactgaatactgtaggcaattgtaacacaatggtaagcatttttgtatttaaatatagaaagggtacagtgaaaacacctggcygggtgtggtggcttatgcctgtaatcccaacactttgggaggccgaggtgggtggatcacctgaggtcagaagttcaagaccagcctggccaacatggtg

SEQ ID NO: 64348 - DNA, 201 bp, Homo sapiens
aagcaggtggaccacctgagcctggggaggtcgatgctgcagtgagctgtgatcgtgctgctgatctccaggctgggtgacagattgaaaccctgtctcaaaaaaaaaaaaaaaaaattgcaatagtggtaacttttgggaagaaaatattcgtgaatctgggagagtgcataagaggggtatttggcttaatgataggag

SEQ ID NO: 64349 - DNA, 201 bp, Homo sapiens
ttcagtagtaataacatgcatgaagctgtcatctcctatgataacagtgccctctggaatacttcctgaaggacctgcctgaggcttttttacagtcaactttttttttttttttttgaatacgtaggagtgtactctaaacagtaaagagcataccatactgaatatatttttttttttttgagatggagtcttgctctg

SEQ ID NO: 64350 - DNA, 201 bp, Homo sapiens
tctaaaggttagttgaataacatttaatcttctgcttttggccattccaggaagaatcagcctgtcagtttttctttgatttaaatgaaaagcagggaagraagcgttcatccacaggtagagatagcaaatcttctcctcatccaaagcagcctcgcaaacctcgtaagtacctttattccagaggtttcttctatgaac

SEQ ID NO: 64351 - DNA, 201 bp, Homo sapiens
tctcctatgataacagtgccctctggaatacttcctgaaggacctgcctgaggcttttttacagtcaactttttttttttttttttgaatacgtaggagtrtactctaaacagtaaagagcataccatactgaatatatttttttttttttgagatggagtcttgctctgttgcccaggctggagtgcagtgccgcgatct

SEQ ID NO: 64352 - DNA, 201 bp, Homo sapiens
tttatagcttcagattcagaaactagagccttatgaaatttttttttttttttttttgagatggagtctcgctctgttgcccaggttggagtgcaatggcrtgatctcagttcactgcaacctctgcctcccgggttcaagtgattctcctgcctaagcttcccaagtagctgggattacaggcacctgccatcacatctg

SEQ ID NO: 64353 - DNA, 201 bp, Homo sapiens
aggacctgcctgaggcttttttacagtcaactttttttttttttttttgaatacgtaggagtgtactctaaacagtaaagagcataccatactgaatatatttttttttttttgagatggagtcttgctctgttgcccaggctggagtgcagtgccgcgatctcagctcactgcaagctctgcctcgtgggttcatgctat

SEQ ID NO: 64354 - DNA, 201 bp, Homo sapiens
tctgcccgcctcagcctcccaaagtgctgggattacaggcgtgagccaccacccccggcctatgaatttttatctggaattatgtaatgctggaagctgaktcacactaactgatcacatcaaagataaaatttcagttttgcttagtagtggagggtgtagcttactaatgacaggaatacccatattcacactcctggt

SEQ ID NO: 64355 - DNA, 201 bp, Homo sapiens
gggtgaggtggggtggagtggagtggaggttgcagtgagccaaggtcgtgccactgcactttagcctgggtgacagagtgagaccctgtctcagaaaaagaaaaaaaaaaagtttggcgaggtgtacaataaaagcacgccagaaagagacactcacaaaacaataaaattttaatatttcaagatgagttaaaagacatt

SEQ ID NO: 64356 - DNA, 201 bp, Homo sapiens
tggtaggtgtccagtacctgtttatcaaatgaatgactgaagccctgtactaagataggaggagtcgtactaagataggaggagtcaaaataagaaggatagaatgaatgtgaaagatgtttggaaaaagggattgatgggacttggtgactggatgggggatttttgacttttgttgaccatgtcagccatagacatgtc

SEQ ID NO: 64357 - DNA, 201 bp, Homo sapiens
aatgtgtgtgtctcatgggaaagtcattctatttcacatttccccagatacttttgcttgggtagggctggattagacattaaataataccagtgtttgastctgatttccctgggttttctgtagaccattgttctttttcattcatttagaatgaagaaaacttaatttttaacactatagtcaccagtgactagaatt

SEQ ID NO: 64358 - DNA, 201 bp, Homo sapiens
atttaagtgagcaagaagagaataccccccttaccataatcccacagcctaatgcagaatcataggtaatacaggtttttctgttaaatctccatatactyattctagaagaatgtcttgttctctaaaaatatactgcgaaaacagaagttttgggaacaagccactcaaaacttacacagttcttaagaatcggaatac

SEQ ID NO: 64359 - DNA, 201 bp, Homo sapiens
atggactaagacaattccttaagtgtgtagtgcttctgaagacaggtgccttcatccatttctcattgatttgttctacttttggtttctggggttgatcstttcaacttatcctaacaatctgaggaccgttttttgtgtcttccttcctgtagactgactagagtctcaatttcatcttacactttaaggagttacact

SEQ ID NO: 64360 - DNA, 201 bp, Homo sapiens
ttctcatctaggcctgaaactagaggggaaaaaggtcttgtttgtggcccaacccaacatcccaagtaggccacatgagtatttcagcctagagtctacaytgtccttaggtagaaacctcttacaaacctgtaatgacctttgggtgtctgtggaagagtttgggatctcctccctgcaattattctttttgattgcctt

SEQ ID NO: 64361 - DNA, 201 bp, Homo sapiens
aactattcacaaaaattgcaagtacaggattagagatggtgcagaggagctctttagtttagacatcattacctaaagaatgcacatcataatagagaagytgatgtttatggcagtgaccttctgacaaaaatagctagacgactcaggcttctagagtaaccttttaaacaaatacaatataaagtggttattatacaa

SEQ ID NO: 64362 - DNA, 201 bp, Homo sapiens
gtggatcacctgaggtgaggagtttgagaccagcctggccaacatggtgaaaccccgtctttactaaagctacaaaaattagctgggcgtggtgccaggcrcttgtaatcccagctactcaggaggctgaggcaggagaattgcttgagcctgggaggtggaggttgcagtgagccaagatcgctccattgcactccagcc

SEQ ID NO: 64363 - DNA, 201 bp, Homo sapiens
tcttgaactcctgacctcgcgatccatttgccttggcctcccaaagtgctgggattacagtcatgagccaacgcacccggtctggataattgttttctaamgtatctatatttgcctgtactggtactcattgggcccttctgtgctcactcatggcatcttcccatcagagaatatctgagtggtagaccattcttgcat

SEQ ID NO: 64364 - DNA, 201 bp, Homo sapiens
gaggagtttgagaccagcctggccaacatggtgaaaccccgtctttactaaagctacaaaaattagctgggcgtggtgccaggcacttgtaatcccagctrctcaggaggctgaggcaggagaattgcttgagcctgggaggtggaggttgcagtgagccaagatcgctccattgcactccagcctgggtgacagtgaaac

SEQ ID NO: 64365 - DNA, 201 bp, Homo sapiens
ctggctcgccgcttccggaaagactttgagccctatgactttactctggatgactaaaacaaagggaagaactttttatgaactccacaggaagtagtaargcttttttttttttttaattaaaagaattttttttgagacaaagtctcgctctgtcacccaagcaggattgcagtggcataactgtggctcactgtagcc

SEQ ID NO: 64366 - DNA, 201 bp, Homo sapiens
cttttctgcctctttggatgcatctgagtttgaggttttactttccttctaccccattaggttgtatgtttgcttttgttttgtagaatttagtcagcagsttaaggcttaggaacattagatgctaatcatgccatcttagctttttttgtgagcccaaggagtatattcgggggtgggggtgggaatgaaagttactgg

SEQ ID NO: 64367 - DNA, 201 bp, Homo sapiens
ggattagtttatgctatttttctctcccacacaatttgtatagtaagttaggctttgaattgccttctgtttgggaagcttcaataggttcaagatcacaygcaggagataagagatttggaatgtgtgacatagctcagtgctgctctaggcctcagtgagaagtgacttttcttttccattcatctttctattgtccag

SEQ ID NO: 64368 - DNA, 201 bp, Homo sapiens
aggagtgtactctaaacagtaaagagcataccatactgaatatatttttttttttttgagatggagtcttgctctgttgcccaggctggagtgcagtgccrcgatctcagctcactgcaagctctgcctcgtgggttcatgctattctcccgcctcagcctcctgagtagctgggactacaggcgcccgccaccacgcccg

SEQ ID NO: 64369 - DNA, 201 bp, Homo sapiens
acatcactaggcgataggaattttttagttccattataatcttatgggaccaccattacatatgtggtcccttgttgaccgaaacattgttatgtggcacrtaactgtattcttgtctttaacctaaaaaggttattgaaatgcttaagaacgctttggcatgatcaaattttcattttggaaagcagttctgtctgcaat

SEQ ID NO: 64370 - DNA, 201 bp, Homo sapiens
catttttatatgtgttcttttcctagttatagtttagtacataagacaagtttaatcgttagaatctaaatcttttttttccccttgggaaatcatgatgrtgtttagaaaatcttagtagatttcagctaagcttagtgttttttattgtagtttggggttaacagtttgatacattaggtctttctttgtccaaactgg

SEQ ID NO: 64371 - DNA, 201 bp, Homo sapiens
ggtaggtgtccagtacctgtttatcaaatgaatgactgaagccctgtactaagataggaggagtcgtactaagataggaggagtcaaaataagaaggatagaatgaatgtgaaagatgtttggaaaaagggattgatgggacttggtgactggatgggggatttttgacttttgttgaccatgtcagccatagacatgtcc

SEQ ID NO: 64372 - DNA, 201 bp, Homo sapiens
tttctgtgaaatcttcacagtaaaataggttgattacagttgggtaaatagtatttcccctaatgtcattatgttctttttctctaaagtatctttacgcrttcagtattgttcccatgaagctaatggatgcagcagaactggtaaaacagcctccggatgtcactgaaaacccttacagaaaatctgggcaggaagcat

SEQ ID NO: 64373 - DNA, 201 bp, Homo sapiens
gtaggtgtccagtacctgtttatcaaatgaatgactgaagccctgtactaagataggaggagtcgtactaagataggaggagtcaaaataagaaggatagaatgaatgtgaaagatgtttggaaaaagggattgatgggacttggtgactggatgggggatttttgacttttgttgaccatgtcagccatagacatgtcca

SEQ ID NO: 64374 - DNA, 201 bp, Homo sapiens
ggattgcagtggcataactgtggctcactgtagcctcaacctcctgggctctagagttcctcccacctcagcctcatgagtagctgggaccacaggcgcawgctaccatgcctggcaaacttttttgattttttatagagacaggagggtctccctgtgttgcccaggctggtctgtaatgcctaggctcaagggatcctc

SEQ ID NO: 64375 - DNA, 201 bp, Homo sapiens
aggtgtccagtacctgtttatcaaatgaatgactgaagccctgtactaagataggaggagtcgtactaagataggaggagtcaaaataagaaggatagaatgaatgtgaaagatgtttggaaaaagggattgatgggacttggtgactggatgggggatttttgacttttgttgaccatgtcagccatagacatgtccaca

SEQ ID NO: 64376 - DNA, 201 bp, Homo sapiens
ggcatgtggatcacctgaggtcaggggttcaagaccagcctggccaacatggtgaaaccgtgtgtctactaaaaatataaaaattagcagggcatggtggygcatgcctgtaatcccagctcctcgggagactgaggcaggagaattgcttgaacctgggaggcggagattgcagtgagccgagattgcaccactgcactt

SEQ ID NO: 64377 - DNA, 201 bp, Homo sapiens; identical to SEQ ID NO: 29775

SEQ ID NO: 64378 - DNA, 201 bp, Homo sapiens
gcagggcatggtggcgcatgcctgtaatcccagctcctcgggagactgaggcaggagaattgcttgaacctgggaggcggagattgcagtgagccgagatygcaccactgcacttcaccctgggcgacagagcaaggctctgtctcaaaaaaaaaaaaataaaataaataaaatagccaagctacaaggttgggtgtagta

SEQ ID NO: 64379 - DNA, 201 bp, Homo sapiens
ataatgtatatgttaattagcttgatttagccatcccacagtatatacacatttcaaaacagcatgttgtatacaataaaaaatacaaattttagttatcaattaaaaataaatgagagggaaaatttaaaaaatttttttttgtcttttttttttttttgagacggagtctcgctctgtcacctggctggagtgcagtgg

SEQ ID NO: 64380 - DNA, 201 bp, Homo sapiens
cacctcccgggttcaagtgattctcctgcctcagcctcctgagtagcttggattacaggcgtgtgtgaccatacccggctaattttttttatatttttagyagagacagggtttcaccgtgttagtcaggatcatctcgatctccttacctcgtgatccgcccacctcggcctcccagagtgctgggattacaggcgtgag

SEQ ID NO: 64381 - DNA, 201 bp, Homo sapiens
taatgtatatgttaattagcttgatttagccatcccacagtatatacacatttcaaaacagcatgttgtatacaataaaaaatacaaattttagttatcaattaaaaataaatgagagggaaaatttaaaaaatttttttttgtcttttttttttttttgagacggagtctcgctctgtcacctggctggagtgcagtggc

SEQ ID NO: 64382 - DNA, 201 bp, Homo sapiens
aggtttcaccatattggtcagcctagtctggaacttctgacctcaggcggtccacctgcctcggcctctcaaagttttgggattacaagcgtgagccactrtcccagccgaaagtggtcattttgaaatcagaagttgtatctttttgtggttgagggtgataaaaactgaaaaactgttttcaagtttggagcatgggag

SEQ ID NO: 64383 - DNA, 201 bp, Homo sapiens
tttactatatgaatttagtgccaggaaaggaaagagcagctaaggtacttgggttatttctgtgaaatagattttttggatccagtaggaggatcaagcartgaacttggtagtgaacatgtgatagtgagcttgaaatactggtaggacatccaacatatagttggaagtgagagttattattattattttttgagatgg

SEQ ID NO: 64384 - DNA, 201 bp, Homo sapiens
aatgtatatgttaattagcttgatttagccatcccacagtatatacacatttcaaaacagcatgttgtatacaataaaaaatacaaattttagttatcaattaaaaataaatgagagggaaaatttaaaaaatttttttttgtcttttttttttttttgagacggagtctcgctctgtcacctggctggagtgcagtggca

SEQ ID NO: 64385 - DNA, 201 bp, Homo sapiens
gttgctacaatctctaaaatcagattttttcaagaaagaatttttattaataacctcaagtacttttcgcctacaccctcaggctcactttttgtataggyttttctccctggagaatcctacatgctgtattgatgtctcaattctgtgtgctgcttcttcagtgctaccttgccctggccaaaggaggcttatctgatg

SEQ ID NO: 64386 - DNA, 201 bp, Homo sapiens
atagtcttggctcactgcaacctctgcctcccggattcaagcgattcttctgcctcagcctcctgagtagctggggttacgggtgtgtgccaccatgcccrgctaattttgtattttttagtagagacagggtttcaccatgttggtcaggctggtctcgaaatcctgacctgaggtgatccagctgcctcagcctcccaa

SEQ ID NO: 64387 - DNA, 201 bp, Homo sapiens
atgtatatgttaattagcttgatttagccatcccacagtatatacacatttcaaaacagcatgttgtatacaataaaaaatacaaattttagttatcaattaaaaataaatgagagggaaaatttaaaaaatttttttttgtcttttttttttttttgagacggagtctcgctctgtcacctggctggagtgcagtggcat

SEQ ID NO: 64388 - DNA, 201 bp, Homo sapiens
gggcaacagagtgagactccgtctcaaaaaaaaaaaaaaaaaaaaaaaaggccaatagacatataaaaagatgctcttatcattagccattatggtaatgyaaatcaaaagcacaatgatacaccacttcatacccactaggatggcagtagtcaaaaaggcaaatacataataacaagtgttgacaaggatgtggaggaa

SEQ ID NO: 64389 - DNA, 201 bp, Homo sapiens
ccgccttccgggttcaagtgattctcctgcctcagcctccccagtagctgggactacaggcatgcgccaccatacctggctactttttgtatttttagtcragacggggtttcaccatattggccaggctggtctcgaactcctgaccttgtgatctgcctgccttggcctcccgaaggtattacaggcatgagccaccca

SEQ ID NO: 64390 - DNA, 201 bp, Homo sapiens
ccaggcgtggtggcagacgcccgtagtcccagctacttaggaggctgaggcaggagaatggcatgaacctgggaggcggagcttgcagtgagccgagatcrcgccactgtactccaccctaggcgacagagcgagactccgtctcaaaaaaaataaaataagaatggcctgacttcgaggctgttctgaggcgcttcctgt

SEQ ID NO: 64391 - DNA, 201 bp, Homo sapiens
gctactcaggaggctgagagtcaggaggatcacttaagcctaggagtttgaggatgcagtgaggtatgattgcaccactgtacttcagcctgggcaacatygcaagaccctgtctctaaaaaaaaaaaaaaaaaaaagaggcagtggacaatttggaactagagcactgggtattgactagactggagatgaacagggcat

SEQ ID NO: 64392 - DNA, 201 bp, Homo sapiens
taaagaattgtatattgaaatctgcaaattgattaagaattaaaaactgatttgaaactattaaataactagttgaatattactatcaattatgtactgtwtgatattttaaaatctcatatatctgtttaaaaaactcattttagctgctgttgtgtgtaggaaatttctttggctccacccaagatgctgaatgggagg

SEQ ID NO: 64393 - DNA, 201 bp, Homo sapiens
ccgtagtcccagctacttaggaggctgaggcaggagaatggcatgaacctgggaggcggagcttgcagtgagccgagatcgcgccactgtactccaccctrggcgacagagcgagactccgtctcaaaaaaaataaaataagaatggcctgacttcgaggctgttctgaggcgcttcctgtactatggaaaaagcaccttt

SEQ ID NO: 64394 - DNA, 201 bp, Homo sapiens
tgctatgaacagagtggtgggctacatgggacaattgataaaaagctaaattgtaaacagtccttgccccagaggacccatggtcttagggcagatgtttwcatatatgacagtaatgtaatgtagaatgtgaagagtaccatgacagagttttggagaacaatgtgctgtagaaattcagaaaagggacagctcatttct

SEQ ID NO: 64395 - DNA, 201 bp, Homo sapiens
aaatgaggctctagagcagtgcccggtagacttttcacaacgatggaaatgctcaaatatctgcactgtccaatacagttgtgactagccacttgtggccmctgagtgctgaaatgtggctaatgtgactgaggaactaaatttttgattttatttaattaattagaatttaaatttaaatagccatacctggctaatggt

SEQ ID NO: 64396 - DNA, 201 bp, Homo sapiens
gaaatgtggctaatgtgactgaggaactaaatttttgattttatttaattaattagaatttaaatttaaatagccatacctggctaatggttaccccactrgatagcaggctgtagagagcttaggtagcttgtcctagtcacacagtggtaggttcaaacccaggcctgttggacctcaaaacttgaggtcttaacctca

SEQ ID NO: 64397 - DNA, 201 bp, Homo sapiens
acctgaggtgaggagtttgagaccagcctggccaacatggtgaaaccccgtctttactaaagctacaaaaattagctgggcgtggtgccaggcacttgtartcccagctactcaggaggctgaggcaggagaattgcttgagcctgggaggtggaggttgcagtgagccaagatcgctccattgcactccagcctgggtga

SEQ ID NO: 64398 - DNA, 201 bp, Homo sapiens
caaaaccatagagggagtaacataacttaagcaaagattgaagatgggaagttgctggcaagaagatacagtttgaaggggagtggaaaatgtgtagaacrgagtatctgatgctggtgtctgtgatttgcagctgttttttctcccctagttaaaaatgggctttgagtgagccttgaacctgtcttggactaattcaga

SEQ ID NO: 64399 - DNA, 201 bp, Homo sapiens
aggtgaggagtttgagaccagcctggccaacatggtgaaaccccgtctttactaaagctacaaaaattagctgggcgtggtgccaggcacttgtaatcccrgctactcaggaggctgaggcaggagaattgcttgagcctgggaggtggaggttgcagtgagccaagatcgctccattgcactccagcctgggtgacagtg

SEQ ID NO: 64400 - DNA, 201 bp, Homo sapiens
gtgtgtgagtgtgtctgtatgtagttattctttagtcctaagagccaagatagttgttttgttgacattgggcttgtgctgctgttacgtgggcctgagtyccctagaaggagaggcagaggaattttaaatcagagtgggtatgactaggctcctgactctgcaaactcatgtctagttgaggtgacaaaactacagttt

SEQ ID NO: 64401 - DNA, 201 bp, Homo sapiens
ctaaaaaggcagtcttctgttgcttatatacctgtattgggttaaaaatgttgatattctttttatagcttcagattcagaaactagagccttatgaaatttttttttttttttttttgagatggagtctcgctctgttgcccaggttggagtgcaatggcgtgatctcagttcactgcaacctctgcctcccgggttcaa

SEQ ID NO: 64402 - DNA, 201 bp, Homo sapiens
gactttcttattatagatgagaagtgattccttccttcagccttaactttgagcccaccacactaagagcatagttggaataattttttattttttttccygagacagtcttgttctgtcgcccaggctggagtgcagtggcacgatctcggctcactgtaacctccgccttccaggttcaagcaattcacctgcttcagt

SEQ ID NO: 64403 - DNA, 201 bp, Homo sapiens
cttagctactcaggaggctgagagtcaggaggatcacttaagcctaggagtttgaggatgcagtgaggtatgattgcaccactgtacttcagcctgggcarcatcgcaagaccctgtctctaaaaaaaaaaaaaaaaaaaagaggcagtggacaatttggaactagagcactgggtattgactagactggagatgaacagg

SEQ ID NO: 64404 - DNA, 201 bp, Homo sapiens
attttttgtattttagtagggatggggtttcactatgtgcatcttttctagactgtagcttccttagaactgtatttttcttcgcattgccttttcctgtstccagatgtctgcatttaagtccatgtagaatcttctctagaacgcagaaagccttttccctaatcttctcttcccaactttttccagtaatatttgtaa

SEQ ID NO: 64405 - DNA, 201 bp, Homo sapiens
ttcccaccagcagtgtatgaaggtttctgcttttccacatccctgtcaacatttgttatagcaatagccagttttacaagatagctctcttttcctctctyataaataggtatggttctctaggggtgatgcttttatatacttcttggactctctgtattttttagcccgtctaattgagagtgatgagttccttttgct

SEQ ID NO: 64406 - DNA, 201 bp, Homo sapiens
agctgctggagagtttacacttcagacatgtaaaatggcagggacataggagagtcatgggagattcatccccctattgatggcttttcattctgcaattytgactaaaatttgttcatttttctttgaacccaggtcgtaaaggtatcttcactggaagctcggggctgcagattgtgtacctcagtgggacagaatcct

SEQ ID NO: 64407 - DNA, 201 bp, Homo sapiens
gtttgggttgtttctactttatggctattagaaataatgctcccataaaatatctgcatgcaagtctttgtgtggatatagacctaggaatggtctatatkttggatagacctaggaatggatttgctaggttatatagtaaatttatgtttaacttttaagaaactgctaaactgttttccaaaatgactgcaccatctt

SEQ ID NO: 64408 - DNA, 201 bp, Homo sapiens
cactggtggaagtaagcctaaggaagattttgaaaaggttatgtgtgagggcagaaaacactgggtgagcttcattgaagggaaatgtaagaatgcatttsggaacaaatctccatggttggattcaggattatcagtgatgatccagaagtggagcctgtataccaccccttgccagtttcagcaccatgtgtccatgac

SEQ ID NO: 64409 - DNA, 201 bp, Homo sapiens
acaggcgtgagccaccatacctggccagattttaatattttatgagtaatcttgaaaaggatggtacaccaggagtgacaactatcatggggagtgaaacrctacactggtggaagtaagcctaaggaagattttgaaaaggttatgtgtgagggcagaaaacactgggtgagcttcattgaagggaaatgtaagaatgca

SEQ ID NO: 64410 - DNA, 201 bp, Homo sapiens
gtttttactgaatttaattttacctttgtagtcacacataaaaataaagtttgcactcctttaagtcttgattgaacacataccatttttgttaaattgarttcccttcatgagcataggaacttagtagctgctgagtggctgggggagggagacctatttactgtttactattgatctttatattttttgaatttgaat

SEQ ID NO: 64411 - DNA, 201 bp, Homo sapiens
aattttttaccacaaataaatatgagataatgtatatgttaattagcttgatttagccatcccacagtatatacacatttcaaaacagcatgttgtatacmataaaaaatacaaattttagttatcaattaaaaataaatgagagggaaaatttaaaaaatttttttttgtcttttttttttttttgagacggagtctcgc

SEQ ID NO: 64412 - DNA, 201 bp, Homo sapiens
atgggttcataaaataatagaatgatcaaactcgaaggaaggactttaagagtgtttcattgagattctctttcttcatctttttgtttcacacaagaagstgaccttgggagggtaaattttccagggtcatggctaatggcatagctggggctttaattggggctcctgacacccagttcagtgttcttttgttgtagc

SEQ ID NO: 64413 - DNA, 201 bp, Homo sapiens
tgatattttattcaatagagttcaagcaattcagaagaaaagtggaaactttgatgtaagatgtttgtttttactgaatttaattttacctttgtagtcayacataaaaataaagtttgcactcctttaagtcttgattgaacacataccatttttgttaaattgagttcccttcatgagcataggaacttagtagctgct

SEQ ID NO: 64414 - DNA, 201 bp, Homo sapiens
cctggccaacatggtgaaaccccgtctttactaaagctacaaaaattagctgggcgtggtgccaggcacttgtaatcccagctactcaggaggctgaggcrggagaattgcttgagcctgggaggtggaggttgcagtgagccaagatcgctccattgcactccagcctgggtgacagtgaaactccatctcaaaaataaa

SEQ ID NO: 64415 - DNA, 201 bp, Homo sapiens
tgagaccctcagtggatctgcccagtggtttacgtgcactgaaccttgcaaggtaactgcagagagactagatcatgtatctatctaatccaaaagaccartatataccaaacccggcaggcccatttgtttcctgaattgctataatgtttatctctttgtttgcagcttggcttgtggagatgttgaaggaaagtttga

SEQ ID NO: 64416 - DNA, 201 bp, Homo sapiens
gctctgtcgcccaggctggagtgcaatggcatgatctcggctcactgcaacctccgtctcccaggttcatgccattctcctgcctcagcctcctgagtagytgggactacaggcgaccgccaccacacctggctaattctttgtatttttagtagagacagggtttcaccgtgttagccaggatggtctcgatctcctgat

SEQ ID NO: 64417 - DNA, 201 bp, Homo sapiens; identical to SEQ ID NO: 29789

SEQ ID NO: 64418 - DNA, 201 bp, Homo sapiens
cactgcaacctccgtctcccaggttcatgccattctcctgcctcagcctcctgagtagctgggactacaggcgaccgccaccacacctggctaattctttrtatttttagtagagacagggtttcaccgtgttagccaggatggtctcgatctcctgatatagaggtcaagttcttaaagaatatactgccaagaaaacca

SEQ ID NO: 64419 - DNA, 201 bp, Homo sapiens
agttttagtcccaaggatgtgtcttctctgagaatgatgctgtgtacaacctcccagtttaagggtgttgatatcttgctcacatccccatggcccaagtrtgtggggaactttgggaattcttctgtgagtagtgtttgtttagttggaatttctaaaagcaaattgcactggcttgagttgggacttttttcttttcct

SEQ ID NO: 64420 - DNA, 201 bp, Homo sapiens
cctggctactttttgtatttttagtcgagacggggtttcaccatattggccaggctggtctcgaactcctgaccttgtgatctgcctgccttggcctcccraaggtattacaggcatgagccacccacgcctggcaagatctggtttttgacatgttgagcctaaggtttttgacatgttgagctatcaaggcattccaaa

SEQ ID NO: 64421 - DNA, 201 bp, Homo sapiens
gccaccatacctggctactttttgtatttttagtcgagacggggtttcaccatattggccaggctggtctcgaactcctgaccttgtgatctgcctgcctyggcctcccgaaggtattacaggcatgagccacccacgcctggcaagatctggtttttgacatgttgagcctaaggtttttgacatgttgagctatcaagg

SEQ ID NO: 64422 - DNA, 201 bp, Homo sapiens
cattctacaggaaaatgcacagcatgccacccggtttatagctctggcaaatgttggaaatccagaaaagaaaaaggtaaagatttacctatttggtggarggttgatattcatggtctgcctgataaatgtatctcttgtccagtttagcattcagatcttctcttctccctgactgcaaggtctcagcagtttcggaga

SEQ ID NO: 64423 - DNA, 201 bp, Homo sapiens
tgtatttttagtcgagacggggtttcaccatattggccaggctggtctcgaactcctgaccttgtgatctgcctgccttggcctcccgaaggtattacagkcatgagccacccacgcctggcaagatctggtttttgacatgttgagcctaaggtttttgacatgttgagctatcaaggcattccaaaaatgttattaaat

SEQ ID NO: 64424 - DNA, 201 bp, Homo sapiens
ccttacagacaggctgacacaggcttgtctggcctgaggatattctgtgctgaggggtgtttctccacccctgtgatggatttgctacttctcagagactrtgcaggcacaacttctctgggacctgcacaaggaatttctcctgtctccccaacccccaggtcattcctgtcccaatcagctgctctactactgatgaca

SEQ ID NO: 64425 - DNA, 201 bp, Homo sapiens
aggaggctgaggcaggagaattgcttgagcctgggaggtggaggttgcagtgagccaagatcgctccattgcactccagcctgggtgacagtgaaactccrtctcaaaaataaaagaataaaagtatgtctgtcatccagctcctatgtctgttatccagctccaagtacagcttgtgtatatcaacattttcaaaaacct

SEQ ID NO: 64426 - DNA, 201 bp, Homo sapiens
ggggcggggggtggattctggttcttttttttcccattatcctgagagccttaaggtactcagtgtgttggtgagactcagccctgtcatctagcagaagygtgttccttttcattgctgtatagtattccattgcatgactgtcctgtgctctgattttaatgcactttattgtgggtggatatttgagttgcttccttt

SEQ ID NO: 64427 - DNA, 201 bp, Homo sapiens
cgttgactgccgtgtgtgactccagtcggcgtctcagcagtctccagtgtccacgcgttgactgccgtgtgtgactccagtcggcgtctcagcagtctccrgtgtccacgcgttgactgccgtgtgtgactccagtcggcgtctcagcagtctccggtgtccacgcgttgactgccgtgtgtgactccagtcggcgtctca

SEQ ID NO: 64428 - DNA, 201 bp, Homo sapiens
gttttgtggtgtctaattgcggagtagcgtgtcttactgtataatggcctcttttgtatgtgggagaccatggtgttgaggggaggcagttacacaaaaarcccagataccgagtgttagttccatgggtgtggctggtcatggtgcgcactcacgaaggatgtaggtgatgccctccactccgcagagccagtcccacag

SEQ ID NO: 64429 - DNA, 201 bp, Homo sapiens
gtgtccacgcgttgactgccgtgtgtgactccagtcggcgtctcagcagtctccggtgtccacgcgttgactgccgtgtgtgactccagtcggcgtctcarcagtctccggtgtccacgcgttgactgccgtgtgtgactccagtcggcgtctcaacagtctccggtgtccacgcgttgactgccgtgtgtgactccagtc

SEQ ID NO: 64430 - DNA, 201 bp, Homo sapiens
tgtccacgcgttgactgccgtgtgtgactccagtcggcgtctcaacagtctccggtgtccacgcgttgactgccgtgtgtgactccagtcggcgtctcaayagtctccggtgtccatgcgttgactgccatgtatgactccaggtattgagttcatcttcaacttctcccaacaatgaactggagttttctgtgcatgtgt

SEQ ID NO: 64431 - DNA, 201 bp, Homo sapiens
gtgtccacgcgttgactgccgtgtgtgactccagtcggcgtctcagcagtctccggtgtccacgcgttgactgccgtgtgtgactccagtcggcgtctcarcagtctccggtgtccacgcgttgactgccgtgtgtgactccagtcggcgtctcagcagtctccggtgtccacgcgttgactgccgtgtgtgactccagtc

SEQ ID NO: 64432 - DNA, 201 bp, Homo sapiens
ggtgtggctggtcatggtgcgcactcacgaaggatgtaggtgatgccctccactccgcagagccagtcccacaggggtacccattctgactcctaccaccrcagctccctacctcccgcctgccatgggttccacgtgcatggctctgggcagtctgtgtctttgcgtgcgtctgtgtatgtctgcgtgtatctgcttaca

SEQ ID NO: 64433 - DNA, 201 bp, Homo sapiens
gtgtccacgcgttgactgccgtgtgtgactccagtcggcgtctcaacagtctccggtgtccacgcgttgactgccgtgtgtgactccagtcggcgtctcarcagtctccggtgtccacgcgttgactgccgtgtgtgactccagtcggcgtctcaacagtctccggtgtccacgcgttgactgccgtgtgtgactccagtc

SEQ ID NO: 64434 - DNA, 201 bp, Homo sapiens
agccctggcctcccagggagatgctgccagcacccacactttgaccagccggggtgtgaaaagcttcagtgggacaggcttgctcttctcacaggtcagcrgccggcagagctgcttctggctttccatttcggtcagtgtgctctgacacagctcctgaaaaacacgaaatccccgactctgcgatgactcacctgctgc

SEQ ID NO: 64435 - DNA, 201 bp, Homo sapiens
ctcaagcagtcctcctgcttcagcctcccgagtagttgggactacaggtgcgtgccaccacacttggctaatttttatgtttttttggtagagacggggtyttcctgtgttgcccaggctggtctcgaactcctgggctgaagcaatcttcctgccttggcctcccagagggttggaattgcagatgtgaggtaatgtcca

SEQ ID NO: 64436 - DNA, 201 bp, Homo sapiens
cctgagagcactctctgaaaggaggggacttggggagttggaggtcaccatagcctgtgctcctcacagccagaaacgtcaacagaacccctctttcccagacaaacttggcacgaaaggccgtgagccacttgcttcgtgagaaggctcacaggagaacccctttctgccgcggggggccgtgtgcatgctagagcccag

SEQ ID NO: 64437 - DNA, 201 bp, Homo sapiens
gtcaccttcctcacctccccagtcgtagtctggttaatccttacatctcaccacggtcaccgtggctagatgtgacctccgcgatgcttcaggcacgtacyagggcagcctgggcagggctggtcactgtgatctcatgaggtgtgaacttgaccccggccttctttcctgggatgccggctaaggacacaagttcagtgt

SEQ ID NO: 64438 - DNA, 201 bp, Homo sapiens
cctaaccagatacacatggggaaaggaatcaggtggcacacataccgcctttactccatagagaacttccaattgtgggtaagaacaaagccccacctctkcctaatagatgcagttttccacctgcagccaaaaagacaacctgttattagcttttttcccagaggacaggcatctctatgaaactgccattgcaaaatt

SEQ ID NO: 64439 - DNA, 201 bp, Homo sapiens
agtgcagtggctcaatcacggctcactgtaaccttggactcagctcaagcagtcctcctgcttcagcctcccgagtagttgggactacaggtgcgtgccascacacttggctaatttttatgtttttttggtagagacggggtcttcctgtgttgcccaggctggtctcgaactcctgggctgaagcaatcttcctgcctt

SEQ ID NO: 64440 - DNA, 201 bp, Homo sapiens
ggtgtgaacttgaccccggccttctttcctgggatgccggctaaggacacaagttcagtgtttgccctggcttgtagcccagcgggggctccgtcatcccctggggaatgcctcggcctgcaagaccgcataccgcattggaacagggaaaccacctacttcagcacctccctcagcaaggtggcaggtcccaacaagcct

SEQ ID NO: 64441 - DNA, 201 bp, Homo sapiens
ggcttgctcttctcacaggtcagcggccggcagagctgcttctggctttccatttcggtcagtgtgctctgacacagctcctgaaaaacacgaaatccccractctgcgatgactcacctgctgcgtgccctgagctccacgcacgggttctgtggtgtcaaggcagcgtgaggacagtgctgcgagctccctgcagcagg

SEQ ID NO: 64442 - DNA, 201 bp, Homo sapiens
cacagtcttgcactgtggccgaggctggagtgcagtggctcaatcacggctcactgtaaccttggactcagctcaagcagtcctcctgcttcagcctcccragtagttgggactacaggtgcgtgccaccacacttggctaatttttatgtttttttggtagagacggggtcttcctgtgttgcccaggctggtctcgaac

SEQ ID NO: 64443 - DNA, 201 bp, Homo sapiens
ctgagagcactctctgaaaggaggggacttggggagttggaggtcaccatagcctgtgctcctcacagccagaaacgtcaacagaacccctctttcccagacaaacttggcacgaaaggccgtgagccacttgcttcgtgagaaggctcacaggagaacccctttctgccgcggggggccgtgtgcatgctagagcccagt

SEQ ID NO: 64444 - DNA, 201 bp, Homo sapiens
ggacagccaggtgcctggtccggtcccacttttttttctgtcctgttctcgtttcctctttgcttggccaaagagggttgggccagggtcctgagtgcaarggcttggcttggtgaattaaagtggcagtagccgtgtggcagagaaaatttgtagatgggtgaaatcctgggcctacacagtgacaaagtgtatatagac

SEQ ID NO: 64445 - DNA, 201 bp, Homo sapiens
ttccgctttctttccgcatccctaaaagaaacaaaaggcaaatgcccatttttggattagttcttggagagcatcttgccctctctctcccacatcagaaycacattagccaccgtggccacgttcagttcaaacagggggaagtgaacctgcctggctccaacccccagccagagccaaggctgtgggatgccaggtgcc

SEQ ID NO: 64446 - DNA, 201 bp, Homo sapiens
gccggcagagctgcttctggctttccatttcggtcagtgtgctctgacacagctcctgaaaaacacgaaatccccgactctgcgatgactcacctgctgcrtgccctgagctccacgcacgggttctgtggtgtcaaggcagcgtgaggacagtgctgcgagctccctgcagcaggatggtgcccttgctgtgcgcctacc

SEQ ID NO: 64447 - DNA, 201 bp, Homo sapiens
agagtgcagtgtcctgaatggagaaccccagcacccagaagcatccactgaaggacgtaagtaggacaaggccaactgtggctgttccagcagagggactrtgggtgatgtttcccttctctgatttctaaaatatctgcaaacttgtttcatttataattgaaaatataatttgcataacaacagtaaattctacacatg

SEQ ID NO: 64448 - DNA, 201 bp, Homo sapiens
agactcttctagatttgtggatccgtgcacctgccagacctgtctctgagccatctggggaggctgggtaagatttcccccgtcagggcctgagcctcatmtccaagctgctggcttcagcccagctgccaccagcgctgtctctgtcttgcgctttccagagagagactgactcattttgagctccaggcctaccaggca

SEQ ID NO: 64449 - DNA, 201 bp, Homo sapiens
agcaccacagacaaaacgcagggagcacggcacagtgtgggccagggaaggcctggcttcccaagggtgtgggcgcgagcagcatggctgtggggagttcyaggtgcagagaactactccagagacgaagccaggcctgcgaggaggccggagcgcatgaggggaaggcacgaggcaaggctgccagggctgtgctggtgg

SEQ ID NO: 64450 - DNA, 201 bp, Homo sapiens
gtcctgaatggagaaccccagcacccagaagcatccactgaaggacgtaagtaggacaaggccaactgtggctgttccagcagagggactgtgggtgatgkttcccttctctgatttctaaaatatctgcaaacttgtttcatttataattgaaaatataatttgcataacaacagtaaattctacacatgaaggcaaacg

SEQ ID NO: 64451 - DNA, 201 bp, Homo sapiens
ggtagctgcggagatggcactgatgccttcggctccagcagcatcctgggctggtgcgggccaataaggggcagggttggggcaggatgaaaggcacaagycacagccatgtcaagcaggaagtggatgcagggtacagcctgtcagggtcagggtgaaaggcagggaggcgggtaggccataggtgaatttggagcagcc

SEQ ID NO: 64452 - DNA, 201 bp, Homo sapiens
gcctcgtctccatggagaccaaactcaagggcctgactggcccagtctaccgagaccatgagacctgctgtgcccctcggccaggccaacccaaattcttktaaataaaaggcacaagccacagccacaccagcaggaagtggatacaggataaggggcagggctcacatctcatcctcatcagcctttgaccaggcgacg

SEQ ID NO: 64453 - DNA, 201 bp, Homo sapiens
attttcaagccaacagaaccagatggttaagacccattttcaccaagaccttggcttccagaagagttggctggtggcttctgaggaatctcccgaaaggyagttcactgaggttggtcctacccgctttctcctgcacaggtgtgtcctggaaccctggctgcacccacagatacagccactcctgggcccatgtggatg

SEQ ID NO: 64454 - DNA, 201 bp, Homo sapiens
gaatctcccgaaaggcagttcactgaggttggtcctacccgctttctcctgcacaggtgtgtcctggaaccctggctgcacccacagatacagccactccygggcccatgtggatgtaaccttcgagtgccggaatgcctcgtctccatggagaccaaactcaagggcctgactggcccagtctaccgagaccatgagacc

SEQ ID NO: 64455 - DNA, 201 bp, Homo sapiens
ccagaaagccactgttaaggaagcaagagtctgtccccacctctcagccagagcctgcttgggagtgtggcttcactccgtagtcatctgctcaactgcasaactggcagacgccccccgtcagctcccactgagcccacagccctggcctcccagggagatgctgccagcacccacactttgaccagccggggtgtgaaa

SEQ ID NO: 64456 - DNA, 201 bp, Homo sapiens
acaaagacataaaaagtaaatgcaacagtgtgttacaatggagaaagaatcccgtgtggggtattatgggggcacaaagcagggagggataggttcacctygaggagatagaaaaggcttctcagggaggcaacttgagctgagtctttaaatctgtgtagatatctaccgggttgatgggaatgaaggacagttggggag

SEQ ID NO: 64457 - DNA, 201 bp, Homo sapiens
agagcagggtcagtttctcactatgggtgtgtgtgtgtgtgtgtgttgatctggaaaatacagagaggatcaggcagttagcaataggaacaaagacggaragaagccagaggggccaagatggccatggggaacagaagttacaaagaagtagaacctcatggtagagaaaagacatgctgagcagagggagaagccgtg

SEQ ID NO: 64458 - DNA, 201 bp, Homo sapiens
agccagaggggccaagatggccatggggaacagaagttacaaagaagtagaacctcatggtagagaaaagacatgctgagcagagggagaagccgtggttrtttttttggctgagagcagatgaactcagatggtcagcccattaatcacatctgtgtatattaaaaatcttttagtcatgttaaaatatttgcttctaac

SEQ ID NO: 64459 - DNA, 201 bp, Homo sapiens
ggggccaagatggccatggggaacagaagttacaaagaagtagaacctcatggtagagaaaagacatgctgagcagagggagaagccgtggttattttttyggctgagagcagatgaactcagatggtcagcccattaatcacatctgtgtatattaaaaatcttttagtcatgttaaaatatttgcttctaaccatcaaa

SEQ ID NO: 64460 - DNA, 201 bp, Homo sapiens
cgattattatatgctttggggtggtcttatttggatctgaatctatttggtgatatttgaacttcctgtacctgtatatttatttctttctctaggtttaraaagttttctgctattatttcttggaataactttctacaccttgctatttctcaactccctctcaaattccaatgactcctacatttgctctttggaggc

SEQ ID NO: 64461 - DNA, 201 bp, Homo sapiens
agtatggaatcaggcaattctctggagcagtaaccaaagccagagatacaagcaacgaattgagccatacgggcatcagacttacccagaatgggatcaaytcctccagataccataaaagttgatgtgatattaaactgacaaatagaatcatcaaatataatcctttccgtatatttactgacatttggatgtccccat

SEQ ID NO: 64462 - DNA, 201 bp, Homo sapiens
gcaactgcactccagcctggcgacagagccagactctgtctcaaaaaaaaaaaaaagaaagaaacctgcatatgtatccccaaatctaaaataaaaattgaaaaaaaaaaaaagggctgggtgcagtgggtgcagtagttcactcctgtaatcccagtacttttggaggccaaggcttgtgcatcacctgaggtcaggagt

SEQ ID NO: 64463 - DNA, 201 bp, Homo sapiens
agttgtgtggtgagcagctctggataccctgaccacaaagctttggggacaatttgttcaccagaggatgtgaggaggacggaatactcaaaggcactcasggatggtggagctttggagctgaggcgggcaaggcctctcagatggtcacgctgttctctaccatgctgggtcaaaggtactcacagggcaggtccagga

SEQ ID NO: 64464 - DNA, 201 bp, Homo sapiens
caactgcactccagcctggcgacagagccagactctgtctcaaaaaaaaaaaaaagaaagaaacctgcatatgtatccccaaatctaaaataaaaattgaaaaaaaaaaaaagggctgggtgcagtgggtgcagtagttcactcctgtaatcccagtacttttggaggccaaggcttgtgcatcacctgaggtcaggagtt

SEQ ID NO: 64465 - DNA, 201 bp, Homo sapiens
tgttttgaatacctgggctcaagtgatcctcctgccttgacctcctaaagcactgggattacaggaatgagccaccatgtctgggcccctgtttatttttwtttatttatttatttatttagacagagtcttgctctgttgctcaggctggagtgcaatggtgtgatctcggctcactgcaacctcctcctcctggggtca

SEQ ID NO: 64466 - DNA, 201 bp, Homo sapiens
gtctgccaaggaactttgtgaaggtcttttgcatacgtgcctggtggagattgggcagtaagtccactatatccttctctgtcacatccttagagatgggygggggcttctgcatggtgcatgggccattagggatccaggagtaccagtccagctgcagggaggagagcccagagaaatgcaggctgatgacctgggcat

SEQ ID NO: 64467 - DNA, 201 bp, Homo sapiens
ggaaggtctccgcttttctgggctgggacccggggaaggcagtgggccggcttctggaaggtcggcctgggaggccgtgctggggtctggggatgtcccgyggctagacccggcgcggcccatgtgtcctccagtacctgagctctgccgcccttgaacgctgtgcttccgtcaacgaccaggggttccccagggtaccta

SEQ ID NO: 64468 - DNA, 201 bp, Homo sapiens
gaacaaggggggaaagactgcctcttctccaagatccttcccatgcaccaaagctgtctgactgttgcgatagagctgaaggctttccccgctgagcctakcacttcagctgcgcctctgctcaaggaagctttccaccagcggaaggatctgatgctcaaggcctgccatcccgattctttggtcccacagggtcttccc

SEQ ID NO: 64469 - DNA, 201 bp, Homo sapiens
agaattctcagcttccttgggcaggtggggtgtctcatgatgatgtgagaagaagcagattgtttgcagaggagtgggtgttgacagggttcagtggggarggatccatgtctcacccctggtcttgggccctctgcagtccagtctcagtcatctctctgcaccaggcctgcagctctagatcatccttcatggcttggt

SEQ ID NO: 64470 - DNA, 201 bp, Homo sapiens
tttcaaactctagtaccagatactgttctctggttggttcttatgggcatcacttgtttttctggctaaatactagatctaaggtaggaatatggcttttkttttactagcagtgttcaagccctactgtgagcgcactgctagactgtcagatctctgagaatttcagaggattcctatataatgttaagtgactaaact

SEQ ID NO: 64471 - DNA, 201 bp, Homo sapiens
ggcttgtgcatcacctgaggtcaggagttcaagaccagcctggccaacatggtgaaactctgtctctactaaaaatacaaaaatgagctgggtgtggtggmgggcgcctgtaatcccagctatctgggaggctgaggcaggagaatcacttgaccctgggaggcagaggttgtggtgagccgagattgtgccactgtactc

SEQ ID NO: 64472 - DNA, 201 bp, Homo sapiens
gagcctccttcttcctgggtgcaatgttattctaccaggagatgctgtaatggactgtgctggttggcctccagccaggaggtggtgcttgcaaatgaacmccggctgcggtaggtgggtgtgtggggggggggggggggaggggcgtggtggtgggggcgtggagggaggaatactctggtttcacaggcaatagtcagg

SEQ ID NO: 64473 - DNA, 201 bp, Homo sapiens
tgcagtccagtctcagtcatctctctgcaccaggcctgcagctctagatcatccttcatggcttggtcactattgtagaaaagcccaaccatcccctccaygtacctattccctgggaagaagacactcagtctcaggggccaatgcaggaccttctggacctacagtcccccgcccctccgttcattgcctctctgtgcc

SEQ ID NO: 64474 - DNA, 201 bp, Homo sapiens
tgccaggctagagtgcaggggcgcgatctcggctcactgcaacctccatctcctgagttcaagcagttctcctgcctcagctgggattacaggcatgtgcyaccacgcccagctaattttgtatttttagtagagacggggtttcaccatggtggccaggctggtctcgaactcctgacctcaaatgatccacccgcctca

SEQ ID NO: 64475 - DNA, 201 bp, Homo sapiens
ccttcattttcctgttataagatggtgatagtgataccaacctcacagagaagttgtgaggataaatttttttttttttgagaccgagtttcactctttgytgtataggctggagtgcaatggtgcaatctcggctcactgcaacctctgcctcctgggttcaagtgattctcctgcctcagcctcccaagtagctgggat

SEQ ID NO: 64476 - DNA, 201 bp, Homo sapiens
taggcctagtaagagattaagaacattaggaataaacaaatataaatgcaaattaaaaataaagaaaaaactataaaaataattagctgggcatggtggcrggcacctgtagtcccagctacctgggaggctgaggctggagaatcgcttgaaccctggaggtggaggttgcagtgagcgagatcatgccattgcactcca

SEQ ID NO: 64477 - DNA, 201 bp, Homo sapiens
tcagattgggcaatttctattctgtcttgcatttcgttaatttttcctctgtttcccccattcgctagtaagcccatatattgagctttttatcttggttwttctatttttcagttctaaaatttccatttggttctttttaaattttttatttctcagctgatatttttcattttctatttgtttcaagtgtgtttataa

SEQ ID NO: 64478 - DNA, 201 bp, Homo sapiens
ctctttattctcaatgtatatggaattctttgggcttaatggatctgagtgttttttttttctctttacagatttggaaagttttctgtcattatattttwtttatttatttatttatttatttattattattatactttaagttttagggtacatgtgcacaatgtgcgggttagttacatatgtatacatgtgccatgc

SEQ ID NO: 64479 - DNA, 201 bp, Homo sapiens
ctgtagtcccagctacctgggaggctgaggctggagaatcgcttgaaccctggaggtggaggttgcagtgagcgagatcatgccattgcactccagcctgrgtgacagagcgagactccatctcaaaaaaaaaaaaaaaaaaaaaaaaagaagcaaaaaagaaaactgaaaaaagaggggagcaacaacaactaatataaa

SEQ ID NO: 64480 - DNA, 201 bp, Homo sapiens
tggaattctttgggcttaatggatctgagtgttttttttttctctttacagatttggaaagttttctgtcattatattttatttatttatttatttatttwtttattattattatactttaagttttagggtacatgtgcacaatgtgcgggttagttacatatgtatacatgtgccatgctggtgcgctgcacccactaa

SEQ ID NO: 64481 - DNA, 201 bp, Homo sapiens
agtgagcgagatcatgccattgcactccagcctgggtgacagagcgagactccatctcaaaaaaaaaaaaaaaaaaaaaaaaagaagcaaaaaagaaaackgaaaaaagaggggagcaacaacaactaatataaaatagaataaaatagaatataatagaacaattgtgacaatctaactataataaaagttgggtgaatg

SEQ ID NO: 64482 - DNA, 201 bp, Homo sapiens
gggatatgtgatttaatagattaataagtaccttgaagatggggtgcagtcctgggaggcaccgcatggtggcgacagcgatgacctcagccaccaggtgmgtgttcagcaagtgatactggatctcgtgcagttggaaatctgaatttcggacccaggactttgccaggagccaggcaagtggggggtctgagggcagga

SEQ ID NO: 64483 - DNA, 201 bp, Homo sapiens
tctccgtggatgcatctggtggcctgggctaggccagtgtaagttaaatctgctttcttgagccagtcctcagaaatgacttggtggcctagttgttggtrgaggtaagtgagtgggagttttagccccgccttccagcctccagatcagactctatctcaaaaataaataaataaataaataaaaataaaaaaataaagt

SEQ ID NO: 64484 - DNA, 201 bp, Homo sapiens
tgagtgagaatatgcggtgtttggttttttgttcttgcgatagtttactgagaatgatgatttccaatttcatccatgtccctacaaaggacatgaactcrtcattttttatggctgcatagtattccgtggtgtatatgtgccattttcttaatccagtctatcattgttggacatttgggttggttccaagtctttgct

SEQ ID NO: 64485 - DNA, 201 bp, Homo sapiens
cttcatcaatactatactgttataggctgtcccttgtgatttcaaactctagtaccagatactgttctctggttggttcttatgggcatcacttgtttttytggctaaatactagatctaaggtaggaatatggcttttgttttactagcagtgttcaagccctactgtgagcgcactgctagactgtcagatctctgaga

SEQ ID NO: 64486 - DNA, 201 bp, Homo sapiens
tggcgtctgccaaggaactttgtgaaggtcttttgcatacgtgcctggtggagattgggcagtaagtccactatatccttctctgtcacatccttagagaygggcgggggcttctgcatggtgcatgggccattagggatccaggagtaccagtccagctgcagggaggagagcccagagaaatgcaggctgatgacctgg

SEQ ID NO: 64487 - DNA, 201 bp, Homo sapiens
gttagcatttctggacacactctggagaattctcagcttccttgggcaggtggggtgtctcatgatgatgtgagaagaagcagattgtttgcagaggagtrggtgttgacagggttcagtggggaaggatccatgtctcacccctggtcttgggccctctgcagtccagtctcagtcatctctctgcaccaggcctgcagc

SEQ ID NO: 64488 - DNA, 201 bp, Homo sapiens
attaacctgaagcttttcagaagattcatgaaagatgccaaatgtcacggaaaggccaaagtccacatgaggagaaaggatgcctaaggataaacagtccytaataataataattgcaagaactagctgggtgtggcggcatgtgcctgcaatccaggttacttgggaggctgaggcaggaggatcgcttgagcccaggaa

SEQ ID NO: 64489 - DNA, 201 bp, Homo sapiens
ctcctgtgttggggaaatggtaagtaagacagattttcaccaacagagagcgtttctatctcttctctactcctcccttttaaaattgagattctgacagygtaaaggagttaggacccccttttggggatcgggcatggttttgtggctttaaaatgctttaaaattgctgaagtttcttggtattggaactgtttctcc

SEQ ID NO: 64490 - DNA, 201 bp, Homo sapiens
gatacagtactagattttttcctatatcgtacatacatctctatgacaaggtttaatatatcaattaggcctagtaagagattaagaacattaggaataamcaaatataaatgcaaattaaaaataaagaaaaaactataaaaataattagctgggcatggtggcgggcacctgtagtcccagctacctgggaggctgagg

SEQ ID NO: 64491 - DNA, 201 bp, Homo sapiens
attttcaccaacagagagcgtttctatctcttctctactcctcccttttaaaattgagattctgacagtgtaaaggagttaggacccccttttggggatcsggcatggttttgtggctttaaaatgctttaaaattgctgaagtttcttggtattggaactgtttctcctaagtaacattttatcatcgcacgtgaaatac

SEQ ID NO: 64492 - DNA, 201 bp, Homo sapiens
gaataaggtaggatataagatttaaaaatataaataggtcatcccctccaaaaaagccgtttgtatgtttaactggtgagtgacagatctgtaataattayttagaaataggaatgtcgaggcgggcggatcacctgaggtcgggagttcgagaccagccaggtcaacatggcgaaaccctgtctctactaaaaattacaa

SEQ ID NO: 64493 - DNA, 201 bp, Homo sapiens
tggtggagattgggcagtaagtccactatatccttctctgtcacatccttagagatgggcgggggcttctgcatggtgcatgggccattagggatccaggrgtaccagtccagctgcagggaggagagcccagagaaatgcaggctgatgacctgggcatttgatcccccacttctccatcccaggagcccttgtgggatg

SEQ ID NO: 64494 - DNA, 201 bp, Homo sapiens
cggtggctcacgcctgtagtcccagcacttggggaggccaagatgggcggatcacgaggtcaggagatcgagaccatcctggctaacacggtgaaaccccstctctactaaaaatacgaaaagttagccaggtgtggtggcgggcacctgtagtcccaggtactcgggaggctgaggcaggagaatggcgtgaacccggga

SEQ ID NO: 64495 - DNA, 201 bp, Homo sapiens
agctgggattacaggtgcgtgccacgacgcctggctaatttttgtatttttagtagagacgggtttcactatgttggccaggctggtctcgaactcctgasctcgtgatccacccacctcagcctcccaaagtgctgggattacaagcgtgagccactgtgcccagctagtgttttgttgtagtagcccaaactgctagga

SEQ ID NO: 64496 - DNA, 201 bp, Homo sapiens
ctgggtgtggcggcatgtgcctgcaatccaggttacttgggaggctgaggcaggaggatcgcttgagcccaggaatttgagactagcttgggccacatagygaaaccctgtctctacaaaaaataaaaaaaattagccaggcatggtggtgcacacctgtagtcccagctactctgaaggctgaggttagaggatcgcttc

SEQ ID NO: 64497 - DNA, 201 bp, Homo sapiens
tactatgcagccataaaaaggaacaagatcatgtcctttgcagggacacagatgaagctggaaaccattatcctcagcaaactaactcaggaagagaaaaycaaacatcgcatgttgtcacttgtaagtggaagctcaatagtgagaacatgtggacacagggacgggaacaacacacattggggcctgtcaggagagggc

SEQ ID NO: 64498 - DNA, 201 bp, Homo sapiens
tggaacatgtgaggacatctggaaattattgaggccggggttcaggactaagaccccagcaatccaaagtcagagcctgcataggccactgttaagacatstgcaggcttgacccttgtgtgcatctgccagcaactcagctgtccgctggggcatggcattactgtggtgagtggagacacggagaggactgaactagga

SEQ ID NO: 64499 - DNA, 201 bp, Homo sapiens
cctgagtagctgggactacaggtgcctgccaccacgcctggctaattttttgtattttttagtagagacgaggtttcaccatgttagccaggatggtctcsatccctgacctcgtgatctgccctccttggccccacaaagtgctgggattacaggcgtgagccaccgcgcccggccgataggtatttgttttccctgaaa

SEQ ID NO: 64500 - DNA, 201 bp, Homo sapiens
tcctgcaggtactgtaggctacagttcccctttccatctaacctagtattgatgaagggcaggatcttggctttgctcgggaaagaattcaagagcaagcyagtgctggaagaaagcaactttactgaggaggcggctgtgtcacagctctgtgaccgctcccggggagcaggactacagcggaggcaatccgagaggaca

SEQ ID NO: 64501 - DNA, 201 bp, Homo sapiens
aggctacagttcccctttccatctaacctagtattgatgaagggcaggatcttggctttgctcgggaaagaattcaagagcaagccagtgctggaagaaarcaactttactgaggaggcggctgtgtcacagctctgtgaccgctcccggggagcaggactacagcggaggcaatccgagaggacagtgcagggtggtgtg

SEQ ID NO: 64502 - DNA, 201 bp, Homo sapiens
taggttacactccttttaatatttaaacaattctgtgcctccaccctgactactagaatatgttcttttccattctccaggatccttcttccgtgatgttygctaacagctctacagtacttactttgggccagacatttttctaagtgctttttacatataataactcataacaactccggactccttagagaggcttgt

SEQ ID NO: 64503 - DNA, 201 bp, Homo sapiens
ttgtgaggcaggtctttctttagaagtaaattttctcattaaaaaatgattgaaaccattttttttagagttctgctgagttcacatttcttggttgaccrataatttttttcaatacaccgaagacctgattctgttattttctggcttccgttgttgttgggagttttgttgttgtgctaattctggttcctttgtagg

SEQ ID NO: 64504 - DNA, 201 bp, Homo sapiens
atgttggaaggcaaagggagagcaggcatgtcatatggcaagagagcaagcaagagagagtgagcaagaaggtatcacaagctttgaaacaaccagatctygtatgaactcattaccactcattacttcaaggatggcaccaagccattcactagggatctgcgcctatgacccaaacacctcccagtaggcccacctcca

SEQ ID NO: 64505 - DNA, 201 bp, Homo sapiens
ttttcctcatctctccccaggattgagttctctgcttctcctttctggaccttcttgcttttgccccatgctggcctcaggccagagcccccccccccccsgccccaccatttctcagctcctccttactcacctggcaatgatctcccagagccgtaaagcatcatgggcatagagagcacctgggagtcccagcaggcc

SEQ ID NO: 64506 - DNA, 201 bp, Homo sapiens
gataatcttccaaatttctctatcattatgtagagatcaccctaccactggccagctagtttgtgttaatgtttttttttgaaatggagtctcgctctgtygctcaggctggagtacaatggcgtgatctcggctcactgcaacctccgccttccaggttcaagtgattctcctgcctcagcctcctgagtagccgggatt

SEQ ID NO: 64507 - DNA, 201 bp, Homo sapiens
ccattctattttccccttcctgctgggagctcctcatagtttcttcccctacatattttatttctgtatttttccagcacaggactgcaccaaggggcaaygcagtactgcagccttcctctgactcagtttggattctctctgtccgttctcaccacactactaaggagagaacagtgccaggcaggggaaggagaggta

SEQ ID NO: 64508 - DNA, 201 bp, Homo sapiens
gttatcatgggagtggcttagctgtcgtgggagttaggtctccattttctgtctctgttttgtgtgcttgcttgcccttctgccatgggttgatgcagcargaaggtccttgccagattctgacaccatgttcttaggctttctagcctccagaactgtgagtcaaataaattgctattctttttaaattaaattaaattt

SEQ ID NO: 64509 - DNA, 201 bp, Homo sapiens
gcttccaccctacgtataatccaatataatctggtacaaaatgtcttgaagagtcaaaagaaggtagtttcctaggtgtttaactgtttcaatggctcccrtcagtaagtcatagctagcaatggacttctgacttaaacctgctcatacctgctgctatggtttgaatgtctcctccaaaacccttattgaaatttaatt

SEQ ID NO: 64510 - DNA, 201 bp, Homo sapiens
cgcacctagagcccagcccctcactctgatgtttcctttccaactgtcatttccctctcccgagagtcccctctcaccatgtctggctggcggcgactcaratgccatgagatggccatttgaagacaggcctgccggacatcaggtagtgaccccatcactgtggccatcgtcacatcttccttggtggtgggtgggggc

SEQ ID NO: 64511 - DNA, 201 bp, Homo sapiens
atgggatttcaccgtgttggccaggatggtctcgatctcctgacctcgtgatccacctgccttggcttcccaaagtgctgggattacaggcgtgagccacygcacctggccttcaaatttttttattttaaaattatcatacagtaaaattagctttttggtatacagttctacacattttaacacctgtatagattcatg

SEQ ID NO: 64512 - DNA, 201 bp, Homo sapiens
ttttctaggaggagaacaagtttctgggtactcttaaatattacttgtgagctttaagttactcagtgatttgacttacggtggtggttatctttaaataygtcatgctttttttcttaaccatttttagtgtggactgtatagaatacacaaaaggccaccatatttatatacaatttaaaaaataatttaaagcaaatt

SEQ ID NO: 64513 - DNA, 201 bp, Homo sapiens
cttcctggacctcccgggaaggcgggatcgaggtgggcctgagcccccgggttggagcgaacatagatgagaacacttcccgaggtctccaggtcttctgkggagccaggaggaagtaggggatgagtccatcttccaaacggaggggaaggtctccgcttttctgggctgggacccggggaaggcagtgggccggcttct

SEQ ID NO: 64514 - DNA, 201 bp, Homo sapiens
tgcagtggcgcaatgcgcgatcttgactcactgcaatctccgcctcccgggttcaagtgattctcctgcctcagcctctgagtagctgggattacaggcgsgcaccaccacgcctggctacattttgtatttttagtagagacggggtttcagcatgttagtcaggttggtctcgagctcctgacctcgtgatcttcccgc

SEQ ID NO: 64515 - DNA, 201 bp, Homo sapiens
tagctgcaggatgataaaggggcccgagccagggtgaggccaacggggtgggtgcggcgggaccttcctggacctcccgggaaggcgggatcgaggtgggyctgagcccccgggttggagcgaacatagatgagaacacttcccgaggtctccaggtcttctggggagccaggaggaagtaggggatgagtccatcttcca

SEQ ID NO: 64516 - DNA, 201 bp, Homo sapiens
tttcagttctaaaatttccatttggttctttttaaattttttatttctcagctgatatttttcattttctatttgtttcaagtgtgtttataattgctcaytgaaacctttttttttttttttttttttttttgagacaaagtttcggcctgtcacccagactggagtgcaatagtgtaatctcagctcactgaaaccttc

SEQ ID NO: 64517 - DNA, 201 bp, Homo sapiens
cttttctctctcttgcacccaggcacgctgcagctaccatttcctcccttcactacgttttagattctttccttttcattcctgtcattaccatgctaacrtacatctctatccaccttactgttgggcaggtatgagcggcttgctggctgttcttccttgccttttggtctgtttctacttagctgactcctcaattgg

SEQ ID NO: 64518 - DNA, 201 bp, Homo sapiens
tcttgcccacctcgtcccagcttcgtggaagtcccagtccgcgaggtcgcgctgtcacctcgcccccagcctcccgccctcccgccgcgagcccagctcgrcccgggcctgggcccggggtccccgctgccctagctcccctcgctccccgcgctgacctcgccccgcgccggccgcagctgcagctccagctccgcctcc

SEQ ID NO: 64519 - DNA, 201 bp, Homo sapiens
caggcacgctgcagctaccatttcctcccttcactacgttttagattctttccttttcattcctgtcattaccatgctaacatacatctctatccaccttrctgttgggcaggtatgagcggcttgctggctgttcttccttgccttttggtctgtttctacttagctgactcctcaattgggtagaaacattcttcatca

SEQ ID NO: 64520 - DNA, 201 bp, Homo sapiens
gaaagcatgaaattcaagatagaaatgtcagtcctaaagctgatgtgaaatcttgcaggtagagtcactctagggctcagatggtgacactgttctctatrcagctgggcttcagatattcatagggccagtcaagttgctcattccgggctgtaatctccttttccagcttttccaaatctgttcggaattggtttagca

SEQ ID NO: 64521 - DNA, 201 bp, Homo sapiens
gtgactaaacttaataaacttaattaaaatcaacatctcaagatattgagacagtctcctcttcactcacaaattgctacaaagagtttttgctgctgcartatcttttgatatggggctgttcctctctctggggtctgagggatatgtgatttaatagattaataagtaccttgaagatggggtgcagtcctgggaggc

SEQ ID NO: 64522 - DNA, 201 bp, Homo sapiens
gtgcagttggaaatctgaatttcggacccaggactttgccaggagccaggcaagtggggggtctgagggcaggaacagtgttggggttggagagctggggytgggaggctgaatctgggagaaagagaaattattgaactcccattccgtatatgacattatagtcagcattcttggggaaacagagatgactaagtaaga

SEQ ID NO: 64523 - DNA, 201 bp, Homo sapiens
ggtggaatgtgaaggagaagtaggaggtgtaagattattgacagttcttgtcacctgactgttaagaatagtgagagaaggccaggtgcagtggctcacasctgtaatcccagcactttgggaggccgaggcaggcagattacttgagcccagaagttcaagaccagcctgggcaatatggcgaaaccccatctctacaaa

SEQ ID NO: 64524 - DNA, 201 bp, Homo sapiens
cctctcttagcctgtgtaaaactttgggaattcataactccttcccgttttctgtccagcaccctgggatccctacatttcacctgccctgggcccatacmtcctctaagtctgctccgaccgtccttaactctgccctcctagccccgcagcagttcccgggaccttgtgcctccttccccgacgccgcctgctcaccgg

SEQ ID NO: 64525 - DNA, 201 bp, Homo sapiens
tggaatgtgaaggagaagtaggaggtgtaagattattgacagttcttgtcacctgactgttaagaatagtgagagaaggccaggtgcagtggctcacagcygtaatcccagcactttgggaggccgaggcaggcagattacttgagcccagaagttcaagaccagcctgggcaatatggcgaaaccccatctctacaaaaa

SEQ ID NO: 64526 - DNA, 201 bp, Homo sapiens
aacccaggaggcgcaggttgcagtgagccaagatcacacaactgtattccagcctgagtgacacagtgagattctgtctcaaaaaaaaaaaagaaattgcragaaaagatattcaagagatggcgagggttcagagccagaggccactgagagatgagatagtgattctgaaagtgtagtcctgaactggtagtgtcagca

SEQ ID NO: 64527 - DNA, 201 bp, Homo sapiens
cacctcgacctcccaaagtgctgggattacaggcgtgagccaccacgcttggctctagtttgtgttaattttatagtaatatttattatcttttcagtggyttctggtatctggaggtgtttttgcaagcagcagcaatactttttttgggagtgcgtcttgggtggggtttttaaagtctccctttcataaatctacttt

SEQ ID NO: 64528 - DNA, 201 bp, Homo sapiens
atggctgcatactattccatggtgtatatgtgccacattttctttatccagtctatcattgatggacatttgggttggttccaagtcattactattgtgamtagtgctgcaatagacataggtgtgcatgtgtctttatagtagaatgatttataatcctttggggtatatacccagtaatgggattgctgagtcaaatgg

SEQ ID NO: 64529 - DNA, 201 bp, Homo sapiens
tgcacactgaagtgtgaggaccattggatacaggatgagaactccaagaggccattttgactcttgaaaaagtaattctagttggatgaggcaggggagaygagggtacaggcaaatagtgacatgaagacaagtctcactgagtgaggatggggtttgggagccaagagctgggggttgggtccctgggagcagaggttg

SEQ ID NO: 64530 - DNA, 201 bp, Homo sapiens
tttaaagtctccctttcataaatctactttacagcattaatctgtgaggacttgcagtctccacctaacctcaaaaagtaacatgtaaaatcggtgacatsaagattccactgatgtgtgattcagaaatgtcacaccacccgctcatgccatggtgttatcaacattaaaaaatattctgtgatttattttataaaacaa

SEQ ID NO: 64531 - DNA, 201 bp, Homo sapiens
gtatccatttttagagttcaaagtctacccccagggggccggggcaaagggcaagagatttagtctagcttcttgccattctcctgcatcagtaccggagycctgttgggagaactagagcccctggtccagttcctctcatcttaaagtgaagaaacagtctggtgagggtagatgtcttgtgtgtggatgtggtggcag

SEQ ID NO: 64532 - DNA, 201 bp, Homo sapiens
ttttgaaatttgtttaaaaatgtttaggtttggggttctctttggggttatttgtggtgaccctgtactcttgtataacggctaagtaaaatatttcaagyagtagctggatctcagtctcctgtaatctgagtacactatatcaagaaactcctctattgaagcagcatttccctcttattatatctatacaactgtggt

SEQ ID NO: 64533 - DNA, 201 bp, Homo sapiens
agtgtaatctcagctcactgaaaccttcgcctccctagttcaagcgattctgctgcctcagcctcctgtgtagctgggattacaagcgtgcaccatcatgstcggctaatttttttgtacttttagtagagatggggcttcaccatgttggccaggctggtcttgaactcctgacctcaagtgatctgcccccttcagcct

SEQ ID NO: 64534 - DNA, 201 bp, Homo sapiens
gcaggaggattgctggtagtcaggtgacagagcaagagcctgtctctatttaaaaattaaaaaataaataaataatttaggaatgcgtaatcctattcccrgacagaattacaagtgtctgcgttataatgtggggaataagtcatggatttccagtgtcacagctgagaggggctcccacaaaggttatctcagtccact

SEQ ID NO: 64535 - DNA, 201 bp, Homo sapiens
aatgttttgtaaagggattttaaatcaagtgtatttgaggtagagctcatgtacaatacaatgtattcatttcaaatgtgcgtttccaagtttcagcaaaygtacacacccatgtatccatcactagggaacattttcattaccttaaatgttcttttgtgctcataccagtcagtctccctggctccaggaaacagctgg

SEQ ID NO: 64536 - DNA, 201 bp, Homo sapiens
tatggcctggggggccccaggatatggcagttcaggggcatctgtgactggggtgtagtgggactaggggttgatggccagggtctctgaggaggacagtycttgggtctctagaattgtcctgagtcggaggaggtgggaatgggatacacatgctttcccgtgtggagggaggaagggaggcgtgatgagaggctgggg

SEQ ID NO: 64537 - DNA, 201 bp, Homo sapiens
tagagctcatgtacaatacaatgtattcatttcaaatgtgcgtttccaagtttcagcaaatgtacacacccatgtatccatcactagggaacattttcatyaccttaaatgttcttttgtgctcataccagtcagtctccctggctccaggaaacagctggtctgctttctgtcactacagatttgtcttttctaaagttg

SEQ ID NO: 64538 - DNA, 201 bp, Homo sapiens
aggagaaaggatgcctaaggataaacagtccttaataataataattgcaagaactagctgggtgtggcggcatgtgcctgcaatccaggttacttgggagrctgaggcaggaggatcgcttgagcccaggaatttgagactagcttgggccacatagtgaaaccctgtctctacaaaaaataaaaaaaattagccaggcat

SEQ ID NO: 64539 - DNA, 201 bp, Homo sapiens
atgttcttttgtgctcataccagtcagtctccctggctccaggaaacagctggtctgctttctgtcactacagatttgtcttttctaaagttgtatataartagaattatatataatatactcttctgtatctggctttatccactcagcatcatgtctttgtaatttattcacttttttgtggctatcagtaattcatta

SEQ ID NO: 64540 - DNA, 201 bp, Homo sapiens
aaaaaaaagacatgggtataaaagggacaggttcataggttaagagtgaggacattcacacatagttgatcttggatcctgaaagtggcagatcatggagrgatggatgaggcagtcccatgccccgtaccctcctcaccttatcaaaaattcctccatctgagatgagttgggtccgggcccgggtgttgatttccatgg

SEQ ID NO: 64541 - DNA, 201 bp, Homo sapiens
tgtgctcataccagtcagtctccctggctccaggaaacagctggtctgctttctgtcactacagatttgtcttttctaaagttgtatataagtagaattayatataatatactcttctgtatctggctttatccactcagcatcatgtctttgtaatttattcacttttttgtggctatcagtaattcattacctaaaaca

SEQ ID NO: 64542 - DNA, 201 bp, Homo sapiens
caggcttgacccttgtgtgcatctgccagcaactcagctgtccgctggggcatggcattactgtggtgagtggagacacggagaggactgaactaggaaamggaattgtaagtgtgaatagaggcttcacttgttcgtgtggagcagaggatggggaagcaggagacagcatgagatgaatgaaatccaagattccattca

SEQ ID NO: 64543 - DNA, 201 bp, Homo sapiens
ttatttctggtctaaattttattattccttttgctaactttgggctttgttcttatttttgtatttctttggggtgtaactttaggttgtttatgtgagawcttttcttttattaacgtaatcatttgttgctataaacttccctccaataactgcttttgctgcatcccatacatcccattttggtttttgtttgtttgt

SEQ ID NO: 64544 - DNA, 201 bp, Homo sapiens
tctctcttttactcattacccatggttaaaaattcactatttgggccgggcgtggtggctcaagcctgtaatcccagcactttgagaggccaaggagggcrgatcacgaggtcaggagatcgagaccatcctggctaatacggtgaaactccatctctactaaaaaaaatataaaaaattagccgggtgtggtggggggtg

SEQ ID NO: 64545 - DNA, 201 bp, Homo sapiens
tagttctagatccctgaggaatcgccacactgacttccacagtggttgaaatagtttacagtcccaccaacagtgtaaaagtgttcctatttctccacatyctctccagcacctgttgtttcctgactttttaatgattgccattctaactgatgtgagatggtatctcattgtggttttgatttgcatttctctgatggc

SEQ ID NO: 64546 - DNA, 201 bp, Homo sapiens
gccgggtgtggtggggggtgcctgtagtcccagctactcgggaggctgaggcaggagaatggcgtgaacccaggaggtggaggttgcagtgagccaagatsgcgccactgcactccagcctgggcaacaaagcaagactccatctcaaaaaaaaaaaaaaaaaaattcactatttgccatcctcattcctcctcgtctcct

SEQ ID NO: 64547 - DNA, 201 bp, Homo sapiens
gggtgtggtggggggtgcctgtagtcccagctactcgggaggctgaggcaggagaatggcgtgaacccaggaggtggaggttgcagtgagccaagatcgcrccactgcactccagcctgggcaacaaagcaagactccatctcaaaaaaaaaaaaaaaaaaattcactatttgccatcctcattcctcctcgtctcctgcg

SEQ ID NO: 64548 - DNA, 201 bp, Homo sapiens
ccagctactcgggaggctgaggcaggagaatggcgtgaacccaggaggtggaggttgcagtgagccaagatcgcgccactgcactccagcctgggcaacaragcaagactccatctcaaaaaaaaaaaaaaaaaaattcactatttgccatcctcattcctcctcgtctcctgcgggccagtgtgcttcttgtctttcacg

SEQ ID NO: 64549 - DNA, 201 bp, Homo sapiens
aggtcgagcgtctcaacagcatggggttggcaccattgaggaactggtagctgaacaactcatcatcctgccagcactggcgaaccttctctttggtgggyggtgaaaggaggatatatgtaccacagcctgcatatcccttctccaaaatctaccccaggggttcaggtatataaccctccctgaacccagcttctgcgt

SEQ ID NO: 64550 - DNA, 201 bp, Homo sapiens
gcgttttcattctcaaggcctctctgagttgaccagatatgataaggtctcttcttgcaaagagttacgggggactgtggagtgtgatgagtcatccagasgggccattaagggattatggagacctcggggaaccactgaccagccagggcactcttctggccccagaagatctgatcaaagtcttctaggcagttccag

SEQ ID NO: 64551 - DNA, 201 bp, Homo sapiens
cctgccctgggcccatacatcctctaagtctgctccgaccgtccttaactctgccctcctagccccgcagcagttcccgggaccttgtgcctccttccccracgccgcctgctcaccggtgccctcgggcaggctcaggatgtcctcgccctgcacccagcggtagcacgggaaggccacctccgcgcaggctccagggcc

SEQ ID NO: 64552 - DNA, 201 bp, Homo sapiens
acatgtgatgaacaatcttgaggccaggggcggtggctcacgcctgtaatcctagcactttgggaggcccaggcgggtggactgcctgagctcaggagttygagaccagcctgggcaacatagtgaaaccccctctctactaaaatacaaaaaattagccaggtgtggtggcgggtgcctgtaatcccagctactctgggg

SEQ ID NO: 64553 - DNA, 201 bp, Homo sapiens
agagattaagactggcgtgttcaggccgggtgcggtggctcacgcctgtaatcccagcactttggaaggccgagacgggcggatcacgaggttaggagatygagaccatcctggctaacacggtgaaaccctgtctctactaaaaatacaaaaaaaattagctgggcgtggtggcgggcacctgtggtcccagctactcgg

SEQ ID NO: 64554 - DNA, 201 bp, Homo sapiens
attactctcctatgttttttgtctaaaagttttatagctttgggaagccgaggtgggcagatcacgaggttgggagtttgagaccagcctggccaacatgrtgaaacccccgtctctactaaaaatacaaaaattagctgggcatgatggcgggtgcctgtaatcctagctactcgggaggctgaggcaggagaatcactt

SEQ ID NO: 64555 - DNA, 201 bp, Homo sapiens
gtcacagtttgtgagacaggcaataagaggagttcattcaactaattcattcaactaatatttgctaagtatctaccacaaactcccaaacttctagaaaytgaagacacagcagtaaacaaagagacaaaaatcccactcttattctgttacacaccatatatttactatatatatatatattctggagtatttaaaagc

SEQ ID NO: 64556 - DNA, 201 bp, Homo sapiens
actggcatctgcatcaggtgagggcctcaggctgcttctactaatggtggaaagtgaaggggagccagcgtgtgtggagatcacatggcgagagaggaagyaaggtgtggaggcggtgccaggctctttttaacaatcagttctcccggtaatgaacagaggaagaacttacccttgagcgaaggcactaatttattgatg

SEQ ID NO: 64557 - DNA, 201 bp, Homo sapiens
gcagggaaagctatgtggagatacagaaaagaacttttctgtggttctggcctgcacaccctaggactcccaccttgtgtgtgctcaaaggttaatgcacktgggatgaaccttgagctatggggagaggggagggaagagtgagggaaaatacctaagagaagttttgtatctagttccagaggaagctcttagtgcaga

SEQ ID NO: 64558 - DNA, 201 bp, Homo sapiens
tgacagttatgcactaggtgcagaaggaaacaagtccagcctgaagaagtgggacaccaggactccagggagagacacactgagggcttccatcaccaccrtccccactgccatcatgctaacttttaaatcaaggactcaatacccagagtctggcccagatttttcctttgtactttctttattttgaccacatgctga

SEQ ID NO: 64559 - DNA, 201 bp, Homo sapiens
tttatcttctcctcctgcgccttcctcaaacagtggtaacatcaccctttccttattcttctagattggtgcttgctgctcagtgtttcaaaactaagtcrtgttgtttagggatgtatatattggtggaaaactgtaaaggaaacaggagaatgattaacataagtcatcatcgtggttatcactgcggatggagaagag

SEQ ID NO: 64560 - DNA, 201 bp, Homo sapiens
atacaaaaaattagccaggcgtggtagaggatgcctgtaatcccacctacttgggaggctgaggcaggagaattgcttgaacccgggaggcggaggttgcsgtgagctgagattgtgccactgtactccagcctgggcaacaagagtgagactttgtctcaaaaaaaaaaaaaaaattttacaagttttctaaagcaaatt

SEQ ID NO: 64561 - DNA, 201 bp, Homo sapiens
tacaggcacgcaccaccatgcctggctaatttttgtatttttggtagagatggggttttaccatgttggccaggctggtctcgaactcctgacctcaggtrattcccgccccccttggcctcccaaagttctgagattacaggcgtgagccaccgcgcctggccagtgttttgttatagtagcccaaactgactagcagcc

SEQ ID NO: 64562 - DNA, 201 bp, Homo sapiens
actctagggctcagatggtgacactgttctctatgcagctgggcttcagatattcatagggccagtcaagttgctcattccgggctgtaatctccttttcyagcttttccaaatctgttcggaattggtttagcacagctttgggcttggggcctgagaaatatttttctttgtggtgccccagaggcacctgagacagaa

SEQ ID NO: 64563 - DNA, 201 bp, Homo sapiens
tacggaaaaattaagcagaaagtgagaatctattttttgagcagaaatttttgagagctcacaaaatttcagggtctgttgtaatagttgggtttctgttycaatgagcttgtggatacaccaatagcttatagccaagtgcatatcagtacccatcaaatccatgagtgagatatttttctttaaatcacatggctctaa

SEQ ID NO: 64564 - DNA, 201 bp, Homo sapiens
ctggatactgagggatacagtactagattttttcctatatcgtacatacatctctatgacaaggtttaatatatcaattaggcctagtaagagattaagamcattaggaataaacaaatataaatgcaaattaaaaataaagaaaaaactataaaaataattagctgggcatggtggcgggcacctgtagtcccagctacc

SEQ ID NO: 64565 - DNA, 201 bp, Homo sapiens
atcacggctcactgcagccttgatctcccaggttcaggtgattgattatactgcctcagcctccccagtagctgggactacaggcccgtgccaacatgccygactaatttttgtattttttgtagagatggggttttgccatgttgcccaagctggtctcaaactcttgggctcaagtgatccgctggccttggcctccct

SEQ ID NO: 64566 - DNA, 201 bp, Homo sapiens
gatcaggaaacatcagaagcttgggtcagcttactgcccatagctctcttaaaaatctgtaatacccctagagcaaaatttaatataagcctatacgaagsctattagtttgtttttatgtgtgtgtgtgtgtgtttttttttttttttttgagacggagtctctctctatcgcctaggctggagtgcagtggcacgatct

SEQ ID NO: 64567 - DNA, 201 bp, Homo sapiens
gtaaatcttctttcaaactcccgattccctgctgtctgtgccagtagccaagccaactcccacattcccattacctctctttgcagaacaatttaccttckgtgtgtgttttttttttttgagatagaatcatgatcttggctcactgcaatctctacctcccaggttcaagtgattctcctgcctcagcctcctgagtag

SEQ ID NO: 64568 - DNA, 201 bp, Homo sapiens
cctcacttttcctcatctctccccaggattgagttctctgcttctcctttctggaccttcttgcttttgccccatgctggcctcaggccagagcccccccscccccggccccaccatttctcagctcctccttactcacctggcaatgatctcccagagccgtaaagcatcatgggcatagagagcacctgggagtcccag

SEQ ID NO: 64569 - DNA, 201 bp, Homo sapiens
agtttggattctctctgtccgttctcaccacactactaaggagagaacagtgccaggcaggggaaggagaggtacctgaagttctttctccagttgagccygaagctcttccatccccgagggcagcactagcctggagggcagagaggtcgagcgtctcaacagcatggggttggcaccattgaggaactggtagctgaa

SEQ ID NO: 64570 - DNA, 201 bp, Homo sapiens
ggaggcggagctggcagtgagccgagatcgcgccactgcactctagcctgggcgacagagggagactctgtctcaaaaaaaaaaaaaaacaaaaaaaaacyggtgtgttcaatatttgaataattggtgctcaagagagaaaaagaatatgtaggagaggcagtcatcaataaaaccatacagaaaagtttactcaaaact

SEQ ID NO: 64571 - DNA, 201 bp, Homo sapiens
tttcctcatctctccccaggattgagttctctgcttctcctttctggaccttcttgcttttgccccatgctggcctcaggccagagcccccccccccccgrccccaccatttctcagctcctccttactcacctggcaatgatctcccagagccgtaaagcatcatgggcatagagagcacctgggagtcccagcaggccc

SEQ ID NO: 64572 - DNA, 201 bp, Homo sapiens
tccgttctcaccacactactaaggagagaacagtgccaggcaggggaaggagaggtacctgaagttctttctccagttgagcctgaagctcttccatcccygagggcagcactagcctggagggcagagaggtcgagcgtctcaacagcatggggttggcaccattgaggaactggtagctgaacaactcatcatcctgcc

SEQ ID NO: 64573 - DNA, 201 bp, Homo sapiens
tatcctgataaacccattgtaagttgaaaatatcgttaagtcaaaaatgcatgtaatacacctaacctagtctaaggtagcttagcctagcctaccttaartgtgctcagaacacttacattagcctcaagttggcaaaatgatctaacgcacagcccattttataataaagtgttgcctatctcatgtaatttattgaat

SEQ ID NO: 64574 - DNA, 201 bp, Homo sapiens
cagcaactcagctgtccgctggggcatggcattactgtggtgagtggagacacggagaggactgaactaggaaaaggaattgtaagtgtgaatagaggctkcacttgttcgtgtggagcagaggatggggaagcaggagacagcatgagatgaatgaaatccaagattccattcatcagactggtctccatcttgtctatg

SEQ ID NO: 64575 - DNA, 201 bp, Homo sapiens
tcttgtcctcatctccctgtggttagccgtattccatgttttcagccatgcactgttgcttttatctctggctttgcctcatttgattatccaccagacaygtttatcccatctttgccaactttgcactcctgctttctcttatttcagccctcatcctttgcctgtagataaaaacctcctgtttgccaccatttcttg

SEQ ID NO: 64576 - DNA, 201 bp, Homo sapiens
ccatgtgttctcattgttcagctccccgttatgagtgagaacatgcggtgtttggttttctgttcctgtgttactttgctgagaatgatggtttctagctycatccatgtccctgcaaaggacatgaaatcatccttttttatggctgcatactattccatggtgtatatgtgccacattttctttatccagtctatcatt

SEQ ID NO: 64577 - DNA, 201 bp, Homo sapiens
tctggtcatgggatccagaaatctgcatttcaacaggcattcaggtgattctgatgcacactgaagtgtgaggaccattggatacaggatgagaactccargaggccattttgactcttgaaaaagtaattctagttggatgaggcaggggagacgagggtacaggcaaatagtgacatgaagacaagtctcactgagtga

SEQ ID NO: 64578 - DNA, 201 bp, Homo sapiens
agtagcaaattctttttgtttaggtttaaattcctaagaacagttggtttaattcatctctttacctcgtgtcagtggtcggaggtcagaggccatcctattttttttttttcctgagtttttattttgaaaagccttagggtctgggcccagtggctcatgcctgtaatcccaacactttgggaggccaaggcgggtgga

SEQ ID NO: 64579 - DNA, 201 bp, Homo sapiens
atggccaggcccctttctgatcattcccgaatggtctgcgctctggttttggctcctatcagctcagcaaatgctctttcattccctattcaaatctcacrtcctctgccaaatattccagagagcttcccctactacccctgccaccgcatacagcacacacatgcatacgcacacattttgcctaggcttgtcctcagt

SEQ ID NO: 64580 - DNA, 201 bp, Homo sapiens
gcaggttagttacatatgtatacatgtgccatgctggtgcgctgcacccactaactcgtcatctagcattaggtatatctcccagtgctatccctcccccstccccccaccccacaacagtccccagagtgtgatgttccccttcctgtgtccatgtgatctcattgttcagttcccacctatgagcgagaatatgtggtg

SEQ ID NO: 64581 - DNA, 201 bp, Homo sapiens
ccccctccccccaccccacaacagtccccagagtgtgatgttccccttcctgtgtccatgtgatctcattgttcagttcccacctatgagcgagaatatgyggtgtttggttttttgttcttgtgatagtttactgagaatgatgatttccaatttcatccatgtccctacaaaggacatgaactcatcattttttatggc

SEQ ID NO: 64582 - DNA, 201 bp, Homo sapiens
tcctctgcaacgtcatgatcaaactcctcctcctgtgcaggccggacccaggccagacttagtaggagggacccgactgaggccgtttcgaggacagagcygcgctcctgtgcaacctcagtttctcagggcctccaaagacagcatcgcctcgttcccgcccccgcacaacctgctctttgggtctcagacgcccggagt

SEQ ID NO: 64583 - DNA, 201 bp, Homo sapiens
tgaaaattggtgatcatgaatttaccgcctgaacgcatgcacctgaacgtcttccattcacttattctggagctggctctactcgacatttcctttttttwatttttttttttttgagacagggtctcactgtgtcacccacactggagtgcagtggtgcgatctcggctcaccgcaacctccgcctcccaggctcaagcg

SEQ ID NO: 64584 - DNA, 201 bp, Homo sapiens
ccgccctcctcgcaagttttaggcgctcccaagtccccgccccagactagcccaaacctgcgagcagagcggtagagccggctgtggggactggctgtgcytcctggtcggagcgtagctgcaggatgataaaggggcccgagccagggtgaggccaacggggtgggtgcggcgggaccttcctggacctcccgggaaggc

SEQ ID NO: 64585 - DNA, 201 bp, Homo sapiens
tgtacagaagctctttaatttaattagatcccatttgtcaattttgtcttttgttgccattgcttttggtgttttagacatgaagtccttgcccatgcctrtgtcctgaatggtattgcctaggttttcttctagggtttttatggttttaagtctaacgtttaagtctttaatccatcttgaattgatttttgtatgagg

SEQ ID NO: 64586 - DNA, 201 bp, Homo sapiens
ctggtcggagcgtagctgcaggatgataaaggggcccgagccagggtgaggccaacggggtgggtgcggcgggaccttcctggacctcccgggaaggcggratcgaggtgggcctgagcccccgggttggagcgaacatagatgagaacacttcccgaggtctccaggtcttctggggagccaggaggaagtaggggatga

SEQ ID NO: 64587 - DNA, 201 bp, Homo sapiens
agagagagagagtgagagagagagagagagagagagagagagagagaaaatggctcaacagcaaatgcaggcatttatgtccaggataaacttatagaggkgggggaccagcttagtgtcagtgcccactgcttacaggctggggtatttataggtatgggcgggaggggcctgggcagtatggcttgctgcctgatagga

SEQ ID NO: 64588 - DNA, 201 bp, Homo sapiens
ttttgtcaatttttttctgcttctgatgagataatcatatgatttttgtcatttattctgttaatgtggcatatcatttattgacttgcatatgttgaacmctccttgcattccagagataaagacatttctcaaaagaatacatataaatggctaacagatataatgaaaaatactcgatattgctaatcattagggaaa

SEQ ID NO: 64589 - DNA, 201 bp, Homo sapiens
gcttgggtcagcttactgcccatagctctcttaaaaatctgtaatacccctagagcaaaatttaatataagcctatacgaaggctattagtttgtttttakgtgtgtgtgtgtgtgtttttttttttttttttgagacggagtctctctctatcgcctaggctggagtgcagtggcacgatcttggctcactgcaagctcc

SEQ ID NO: 64590 - DNA, 201 bp, Homo sapiens
attgtctcagcacagcttggggctcaggaccagagaaatatttctcctcatgctgagaggcagaagacaagttggctcagccccttgggactctcagcccrgaatacttcccctcctttgagctgcctccttcccaggacccaggcatttgcttctcaccatgacaggctggcgtctgccaaggaactttgtgaaggtctt

SEQ ID NO: 64591 - DNA, 201 bp, Homo sapiens
actgggccactcagtgagactctgtctcaggaaaaaaaaagacggggtttcaccatgttggccaagctggtctcgaactcctgacctcaggtgatccgccygcctcagcctcccaaagtgctaggattacaggcatgagccacagtgcctggcctcaatcatgaattttcttaatggcatctaaatggtgactcctttcta

SEQ ID NO: 64592 - DNA, 201 bp, Homo sapiens
tttttttgagatggactctctccgtcgctccgactggagtgtagtggtgcggtcttggcccactgcaacctccgcctcttggattcaagtgattctcctcsctcagcctcctgagtagctcggattacaggcatgaaccaccacgcctgtctcatttttgtatttttagtagacacagggtttcaccatattggccaggct

SEQ ID NO: 64593 - DNA, 201 bp, Homo sapiens
tgttgtttgtgtggttagaatttggtgtagaagggtagactgcagtatctattagttcatcatcttataaccagtattggatattttgttcttcttctccttttttttttttttttgagacagggtctcactctgtcacctaggctggagtgtggtgatgtgatcatagctcactgcagcctcaatctcctggcctcaagt

SEQ ID NO: 64594 - DNA, 201 bp, Homo sapiens
gttgtttgtgtggttagaatttggtgtagaagggtagactgcagtatctattagttcatcatcttataaccagtattggatattttgttcttcttctccttttttttttttttttgagacagggtctcactctgtcacctaggctggagtgtggtgatgtgatcatagctcactgcagcctcaatctcctggcctcaagtg

SEQ ID NO: 64595 - DNA, 201 bp, Homo sapiens
tgtatttttagttaaagatggggtttcaccatgttggtcaggttggtcctgaactcctgacctcatgatccacccaccttggcctcccaaagtgctgggaytacaggtgtgagccaccgcgcctggccatttctttgttcttgacccttgagagtgcgattattatatgctttggggtggtcttatttggatctgaatcta

SEQ ID NO: 64596 - DNA, 201 bp, Homo sapiens
accagtaccatgctgttttggttactgtaaactacttttccattcagatcattttagtttggttaattatgtaaaagcaaatatttgtttagagtaatgcygctgctccattaatgaattattgcctggttccctcgttattgtacatctcagtcactttcaattatgctcaaaaggcgcatctctcaaaggaatcttttt

SEQ ID NO: 64597 - DNA, 201 bp, Homo sapiens
gctgaggcaggagaatcacttgaacctgggaggcggaggttgtggtgagctgagattgctccattgcactccagcctgggcaacaagagcaaaactctatytcaaaaaaaaaaaaaaaaaaaaaaaaaaaaagaatcctgactgaagcctaggagcacagagattggaagagtcaggggagttttcaatgagaagttaata

SEQ ID NO: 64598 - DNA, 201 bp, Homo sapiens
actctcccatttcatcatcttttttggcattagaaatccctacaagcttcaggatttttctcttaaagcaaatactgaagataaaaaaattagcttcattsaggctatcttttatcaaatagcacataatttatacagacttggtgggaaattctgccagtgaacaactttgttgtttcaaatcatcaagccccatttgaa

SEQ ID NO: 64599 - DNA, 201 bp, Homo sapiens
attttcctgtcttacactcaggtgaaaaatcatttggatatatatctgatggctttacaaaaattatttacaaaaagtaattgcatataatacagtgtttwtgccaaagtatgtttatgtcttaaaaactttagtggaaatgtgtattcaggtcccttgctcattttctaattgggtttcttgttttcttaatattgagtt

SEQ ID NO: 64600 - DNA, 201 bp, Homo sapiens
ccagagccctaggacaggtattgaggcttaactcatcagctgatccctcagtccctcaccgtctatcatcattcttggccctcccagcccttatttcactycgaggtctagcctttttctcaccctgccttcagtgtccattcaaagtccagcctcttctcctcatggaatctcatatttggaggtagatcatccttacgg

SEQ ID NO: 64601 - DNA, 201 bp, Homo sapiens
gcctcacgaactgcaggagccccaagtcctctgcaacgtcatgatcaaactcctcctcctgtgcaggccggacccaggccagacttagtaggagggacccractgaggccgtttcgaggacagagccgcgctcctgtgcaacctcagtttctcagggcctccaaagacagcatcgcctcgttcccgcccccgcacaacctg

SEQ ID NO: 64602 - DNA, 201 bp, Homo sapiens
gacccatgaggagacgtctttggtgtgctggggagagataataaaggcctgcagcaagcaggggaagcaggaatggagacgggcagggtggaagacatgcraaggaagtggagcggtcaggactccattgtttaattggtgatgacaggaagagaaagagaaagagtagactgtgtgagagagagcagaagagaaggaaag

SEQ ID NO: 64603 - DNA, 201 bp, Homo sapiens
ctcctgcgggccagtgtgcttcttgtctttcacgggtgtcttccgtgttattccaaccaaaccagctctccagcatcctatgttttcttcccttagctgtstgctctcacgggtcacccaccccctcctgttccatgtggtcccctcacctgacttctgagtcacctttacatctccttcctactttcactttgcttctct

SEQ ID NO: 64604 - DNA, 201 bp, Homo sapiens
ccctgggatccctacatttcacctgccctgggcccatacatcctctaagtctgctccgaccgtccttaactctgccctcctagccccgcagcagttcccgrgaccttgtgcctccttccccgacgccgcctgctcaccggtgccctcgggcaggctcaggatgtcctcgccctgcacccagcggtagcacgggaaggccac

SEQ ID NO: 64605 - DNA, 201 bp, Homo sapiens
gacctcggggaaccactgaccagccagggcactcttctggccccagaagatctgatcaaagtcttctaggcagttccaggagctcaggagggtgtaaacaygtttgagggccatctccagagccctaggacaggtattgaggcttaactcatcagctgatccctcagtccctcaccgtctatcatcattcttggccctccc

SEQ ID NO: 64606 - DNA, 201 bp, Homo sapiens
tttatttatttattttcccccagtattttatttactggtttgatggttcaggtttcaggccagtagaagaggtgtccctgagtaggaatcggttgtgggtraagcaagtgggtaaatgaagacccaggcttgacagaggtggctggaggagccctcggtgagtcacagtgaggtcttatcagggagaagggttggagccac

SEQ ID NO: 64607 - DNA, 201 bp, Homo sapiens
aatgggatacacatgctttcccgtgtggagggaggaagggaggcgtgatgagaggctggggtcctgtccccagaagggcagggctgggaaggcgccctggsagagtctcccaggagcttcttctgtctctagaatggatcttacctcggtcctgggcctggcacagccccacctccgtgatctcccgacaccaggcctgca

SEQ ID NO: 64608 - DNA, 201 bp, Homo sapiens
ctgatgtgtctagttatagatttatgttcattttttctgcttgggatgtaccagtctgtggggtttgatgtgaagcctgcagaactgtgtaccagttaacyctcttttcttcataaattatccagcctcaagtatttctctatagcaatgcaaaaatggcctaatccaccttctttgtgtctttttacagtttttgacttg

SEQ ID NO: 64609 - DNA, 201 bp, Homo sapiens
gggtcactgggagaaggagctgggggctgccgggaccaggggcgggaaagggagatggggttgagcccagcccgggatcccagctgcggaccctgtccctratcttgcccacctcgtcccagcttcgtggaagtcccagtccgcgaggtcgcgctgtcacctcgcccccagcctcccgccctcccgccgcgagcccagctc

SEQ ID NO: 64610 - DNA, 201 bp, Homo sapiens
aaagggttccgtgtggaagcgcctgatcaccaccacccggtttgggtgagggacctgagtccttttcttttcagtcttgcagcagctgtttcctggcaggrcaaatggtcagaaataccatatgtacaggccttcacggccctacgccaaaacctaatcatctccgcaaagaaagtccaaagacaggactagatagtatag

SEQ ID NO: 64611 - DNA, 201 bp, Homo sapiens
ctgcaacctctgcttcctgggttcaagcgattttcctgcctcagcctcccgagcagctgggattataggcacacatcaccatgcccagctaattattattwttttttttttggtagggacggggttttaccatgttggccaggatgatctcgatctcctgacctcatgatctgcctgcctcggcctcccaaagtgctggga

SEQ ID NO: 64612 - DNA, 201 bp, Homo sapiens
ctcccgccctcccgccgcgagcccagctcggcccgggcctgggcccggggtccccgctgccctagctcccctcgctccccgcgctgacctcgccccgcgcsggccgcagctgcagctccagctccgcctccccgcgcgtcccgaccagccaaagctgcacgcggttgtacgacccggagaagagccaggccccggtggcca

SEQ ID NO: 64613 - DNA, 201 bp, Homo sapiens
ccctgagctgatccctatttggcagctatcattaacacagagctggtccatgtcacagacttttcctgaaggtttagaagggcagggaccagggtgaaacyagcgaggcactttccttgagtgccacatttaagggggcaccaaaaactcagtgctcaaaataaataacgatttaatgcaatatttaaaacaccaaaatga

SEQ ID NO: 64614 - DNA, 201 bp, Homo sapiens
gtgagccagccaggaggtaagcccaacgtttgggatttattttcctttttgtcctctttctctctcttttcctttccaactcgggactctcggtggacagygcctaggcatggaggcaaccgcaggtttgtggttggggccactctccagggaaactgaaagggttccgtgtggaagcgcctgatcaccaccacccggttt

SEQ ID NO: 64615 - DNA, 201 bp, Homo sapiens
tggggacacttgctgaggaaacacacgaggatggggagtagattggggaggaaaatgggagtgaggtgacacatctagaaaatgggagagccgctgggtgyggtggctcacacctgtatgtaatcccagcactgtgggaggccgaggcgggtgggtcacctgaggtcaggagtttgagaccagcctgaccaatatgatgaa

SEQ ID NO: 64616 - DNA, 201 bp, Homo sapiens
ccttcttccgtgatgttcgctaacagctctacagtacttactttgggccagacatttttctaagtgctttttacatataataactcataacaactccggaytccttagagaggcttgttaagttttatgggttagcacttcttattatctttggaagaacaaagcctgaaaacctgctcagtcagccagagattcctgttc

SEQ ID NO: 64617 - DNA, 201 bp, Homo sapiens
aggcagaggtacggtctctaggctggagcacctgggcagctgtagactgtggctaaaaaactactgacttcaaacaatgtaccagcctgtgagtggcgttyttcctggcagtccaggatttgtgcaagtgagtttgcatgtggagtgaatttcttgctatcctcatacctgggttttttttgtttttttttttttgagaca

SEQ ID NO: 64618 - DNA, 201 bp, Homo sapiens
atttatttatttagacagagtcttgctctgttgctcaggctggagtgcaatggtgtgatctcggctcactgcaacctcctcctcctggggtcaagtgattytcctgcctcagcctccccagtagctgggattacaggcacctgccatcacgcccagctaagttttgtatttttagtagagacggggtttcaccatgatggc

SEQ ID NO: 64619 - DNA, 201 bp, Homo sapiens
tgttttcttctaacatttttatgatttcaggtcttacatttaagtctttaatccattttgagttgacttttgtgtatgttataaataaggtctaatttcatttttttaatgtttatgttcagctcttttgtttttgctcacaatttctttagatattagaagtcttttgtagctcaatacaagttttaggatttctttttt

SEQ ID NO: 64620 - DNA, 201 bp, Homo sapiens
gtgcttgttagcatttctggacacactctggagaattctcagcttccttgggcaggtggggtgtctcatgatgatgtgagaagaagcagattgtttgcagrggagtgggtgttgacagggttcagtggggaaggatccatgtctcacccctggtcttgggccctctgcagtccagtctcagtcatctctctgcaccaggcc

SEQ ID NO: 64621 - DNA, 201 bp, Homo sapiens
ccatgtttttttttttttttttttttttgcagattaattaccttctttcaaacagttggaatcacttccttcatagtaattaagtagaatcttttaattcwtttctataacaaacattcctgacagcataggtgtccacctcctgaagttcccatgaaatcttttaaccattcatttcctcttgcctggagatgattgtgc

SEQ ID NO: 64622 - DNA, 201 bp, Homo sapiens
tgcccatagctctcttaaaaatctgtaatacccctagagcaaaatttaatataagcctatacgaaggctattagtttgtttttatgtgtgtgtgtgtgtgtttttttttttttttttgagacggagtctctctctatcgcctaggctggagtgcagtggcacgatcttggctcactgcaagctccgcctcccgggttcacg

SEQ ID NO: 64623 - DNA, 201 bp, Homo sapiens
acgaaggctattagtttgtttttatgtgtgtgtgtgtgtgtttttttttttttttttgagacggagtctctctctatcgcctaggctggagtgcagtggcrcgatcttggctcactgcaagctccgcctcccgggttcacgccattctcctgcctcagcctcccgagtagctgggactacaggcgcccgccagcacgccca

SEQ ID NO: 64624 - DNA, 201 bp, Homo sapiens
agcgccactacgcccagctaatttttgtatttttagtagataccatgtttcaccatattggccagggtggtctcgatctcttcacctcgtgatccgcccamcttggcctcccaaagtgctgggattacaggcatgagccactgcgcctggccagtgaaggcttttgtgatgagttaaaacatggtggaaaaggtcaaaggg

SEQ ID NO: 64625 - DNA, 201 bp, Homo sapiens
ccagcctgtgagtggcgttcttcctggcagtccaggatttgtgcaagtgagtttgcatgtggagtgaatttcttgctatcctcatacctgggttttttttktttttttttttttgagacagagttatgctcttgttgcccaggctagagtgcaatggtggcatctcagctcactgcaacttccacctcccaggttcaaatg

SEQ ID NO: 64626 - DNA, 201 bp, Homo sapiens
aggcctgagccactgtgcccggccttgtttttttggacatggaattttcgctcttgttgcccaggctggagtacaatgccttgatcttggctcactgcaayctctgccttccgggttcaagcgattctcctgcctcggcctcccgagtagctggaattacaggcatgaaccaccatgcccggctaattttgtatttttagt

SEQ ID NO: 64627 - DNA, 201 bp, Homo sapiens
gctagagtgcaatggtggcatctcagctcactgcaacttccacctcccaggttcaaatgattctcctgcctcagcctcccgagtagctgggattacaggcrtgcaccaccatgcctggctaattttttttttttgtatttttagtagagatggggtttctccatgttggtcaggctggtttgaactcccgacctcaggtga

SEQ ID NO: 64628 - DNA, 201 bp, Homo sapiens
ccgttgtttagtgttgccaccttcttcagtgatcttagctggatcttctggataacttgctgcagcttctccatcagcacttgctgcttcaccttgcactyttatgttatggagatggctactttccttaaacctcatgagccaactctgctagcttcctgcagcttccttatctctctcacccttaacagatttgaagaa

SEQ ID NO: 64629 - DNA, 201 bp, Homo sapiens
ccttccgggttcaagcgattctcctgcctcggcctcccgagtagctggaattacaggcatgaaccaccatgcccggctaattttgtatttttagtagagayggggtttctccacgttggtcaggctggtcttgaactcctaacctcaggtgatctgcccgccttggcctcccaaagtgctgggattacagaaggctattct

SEQ ID NO: 64630 - DNA, 201 bp, Homo sapiens
gcggtcaaagtactgggattagatagttggatacacctttcaaggatcaagtctgtgatacctgaagccccggacctggaacctgaagttcccatcagccmctgcacctgtgaacctgtggcagccctgaagtacctgtttagaagacagccaaaagagaaatgcctaccaacgttccttggtgtttttgttgcatagtta

SEQ ID NO: 64631 - DNA, 201 bp, Homo sapiens
gatacctgaagccccggacctggaacctgaagttcccatcagccactgcacctgtgaacctgtggcagccctgaagtacctgtttagaagacagccaaaaragaaatgcctaccaacgttccttggtgtttttgttgcatagttactgtaggctggataatagtagccatgtttttttttttttttttttttttgcagatt

SEQ ID NO: 64632 - DNA, 201 bp, Homo sapiens
ctagtgatggccttatagtttcatgttgactcactatttaatatttcttttaaaatttttcatgtagttggaagtagtcatcccctttttttctggagaattattattattattattattattattttattattattatcttggttcctgcctattaatcttaggagggatagaagacagttgtgttagcattagtctgct

SEQ ID NO: 64633 - DNA, 201 bp, Homo sapiens
tacctgaagccccggacctggaacctgaagttcccatcagccactgcacctgtgaacctgtggcagccctgaagtacctgtttagaagacagccaaaagaraaatgcctaccaacgttccttggtgtttttgttgcatagttactgtaggctggataatagtagccatgtttttttttttttttttttttttgcagattaa

SEQ ID NO: 64634 - DNA, 201 bp, Homo sapiens
agtgatggccttatagtttcatgttgactcactatttaatatttcttttaaaatttttcatgtagttggaagtagtcatcccctttttttctggagaattattattattattattattattattttattattattatcttggttcctgcctattaatcttaggagggatagaagacagttgtgttagcattagtctgcttt

SEQ ID NO: 64635 - DNA, 201 bp, Homo sapiens
actgcaaccctgagctccttggttcgagtgggcctcctggctcagccttgtgagtagctaggactgcaggtgcacaccactgcattggctaatttttaaattttttgtagagagatgaggttgcactatgttattatgttattcagcttgttttgaatacctgggctcaagtgatcctcctgccttgacctcctaaagcac

SEQ ID NO: 64636 - DNA, 201 bp, Homo sapiens
tgtgaacctgtggcagccctgaagtacctgtttagaagacagccaaaagagaaatgcctaccaacgttccttggtgtttttgttgcatagttactgtaggstggataatagtagccatgtttttttttttttttttttttttgcagattaattaccttctttcaaacagttggaatcacttccttcatagtaattaagtag

SEQ ID NO: 64637 - DNA, 201 bp, Homo sapiens
tgtctcatgatgatgtgagaagaagcagattgtttgcagaggagtgggtgttgacagggttcagtggggaaggatccatgtctcacccctggtcttgggcyctctgcagtccagtctcagtcatctctctgcaccaggcctgcagctctagatcatccttcatggcttggtcactattgtagaaaagcccaaccatcccct

SEQ ID NO: 64638 - DNA, 201 bp, Homo sapiens
tgaagtacctgtttagaagacagccaaaagagaaatgcctaccaacgttccttggtgtttttgttgcatagttactgtaggctggataatagtagccatgtttttttttttttttttttttttgcagattaattaccttctttcaaacagttggaatcacttccttcatagtaattaagtagaatcttttaattcatttct

SEQ ID NO: 64639 - DNA, 201 bp, Homo sapiens
agtacctgtttagaagacagccaaaagagaaatgcctaccaacgttccttggtgtttttgttgcatagttactgtaggctggataatagtagccatgtttktttttttttttttttttttgcagattaattaccttctttcaaacagttggaatcacttccttcatagtaattaagtagaatcttttaattcatttctata

SEQ ID NO: 64640 - DNA, 201 bp, Homo sapiens
gggatccaggagtaccagtccagctgcagggaggagagcccagagaaatgcaggctgatgacctgggcatttgatcccccacttctccatcccaggagccsttgtgggatgatcacataggttacctggcccaggtggttagaagcatgctgacctgtgcatgtgaagatgcacatggtgacaaagtggcagagctgagcc

SEQ ID NO: 64641 - DNA, 201 bp, Homo sapiens
tccttatttaagtgtattcctaagtattttattcttcctgatgttattgtagatggaattgttatcttaatttcttttttggatagttcgttgtcagggtrtagaaatgctactgatactgtaggttggtttttgtatcctgcaactttactgaattcatttattagttttagcagtttttttggtggaatctttagggtt

SEQ ID NO: 64642 - DNA, 201 bp, Homo sapiens
taaaaatgcctatttttaaaagccactttgaattcactttctgttacacgtagacaaaagagtcctgagtaaggccagaggtgaggcagaggtacggtctytaggctggagcacctgggcagctgtagactgtggctaaaaaactactgacttcaaacaatgtaccagcctgtgagtggcgttcttcctggcagtccagga

SEQ ID NO: 64643 - DNA, 201 bp, Homo sapiens
tgcctagtgatggccttatagtttcatgttgactcactatttaatatttcttttaaaatttttcatgtagttggaagtagtcatcccctttttttctggakaattattattattattattattattattttattattattatcttggttcctgcctattaatcttaggagggatagaagacagttgtgttagcattagtct

SEQ ID NO: 64644 - DNA, 201 bp, Homo sapiens
tccagctgcagggaggagagcccagagaaatgcaggctgatgacctgggcatttgatcccccacttctccatcccaggagcccttgtgggatgatcacatrggttacctggcccaggtggttagaagcatgctgacctgtgcatgtgaagatgcacatggtgacaaagtggcagagctgagcccgggactctaaggagatg

SEQ ID NO: 64645 - DNA, 201 bp, Homo sapiens
ctgagcccgggactctaaggagatgaggaacctggtgaaatgagaatcctggtgaaatgagaatcagagatctcgaaaccagaacacgaaataggtctcasgcagggaaagctatgtggagatacagaaaagaacttttctgtggttctggcctgcacaccctaggactcccaccttgtgtgtgctcaaaggttaatgcac

SEQ ID NO: 64646 - DNA, 201 bp, Homo sapiens
gaggagtgggtgttgacagggttcagtggggaaggatccatgtctcacccctggtcttgggccctctgcagtccagtctcagtcatctctctgcaccaggyctgcagctctagatcatccttcatggcttggtcactattgtagaaaagcccaaccatcccctccacgtacctattccctgggaagaagacactcagtctc

SEQ ID NO: 64647 - DNA, 201 bp, Homo sapiens
tatttcattgtatagaaatgtcacaatttgatcatccgtttcatcaacctgttgacaaacatttggattgtttccagcttttggctttaggaaacagtgckgctttgaacgtaatttaatgctgttatgaatatatgttgtcgggtctttgtgtggactgttttcacttctcttgggtaaacacctaggagtggaattgct

SEQ ID NO: 64648 - DNA, 201 bp, Homo sapiens
aatggatcttacctcggtcctgggcctggcacagccccacctccgtgatctcccgacaccaggcctgcagctcagggtcccccttcactatgtcatccctytggtagaagaggtggacgatcccctccacatacctgcccagggggaaaaggcacttgagggcagaaagcccccgcctctgacctctattcctctttctgt

SEQ ID NO: 64649 - DNA, 201 bp, Homo sapiens
caaacacctcatttttgctgactctggtttcttctaactttactgtttctgacaattactctggtttgtaagcttgtatcatttttgtgctccctctgccaagttccctgtatataaagtatcatcaagattttaagaacattttcttaagcaagcacaggtcttattttgccttctcccagcaatatatatggaactcac

SEQ ID NO: 64650 - DNA, 201 bp, Homo sapiens
cccaggggttcaggtatataaccctccctgaacccagcttctgcgttttcattctcaaggcctctctgagttgaccagatatgataaggtctcttcttgcraagagttacgggggactgtggagtgtgatgagtcatccagaggggccattaagggattatggagacctcggggaaccactgaccagccagggcactcttc

SEQ ID NO: 64651 - DNA, 201 bp, Homo sapiens
agccaccgcgcctggcctttatgtagactttcaatcaattctactgtgttcagcctcatgtgtacccctaccttcagtagttattggtacagtagcccccyttttctagtggggagaccttctaacttccaagatccccagtggatgcctgaagccatagacataccaaatctatagatacagtcagccctccttatccat

SEQ ID NO: 64652 - DNA, 201 bp, Homo sapiens
ggtgcactttcagagaactccttagctgagtcctccaattcacaagttggctcttcagctctgtccatcctgccattgagttttaatttcaacagttatcttttttttttttttttgagacggagtcttgttctgttgcccaggctggagtgcagtggtgtgatctcggctcactgcaagctctgccttccagttcacgcc

SEQ ID NO: 64653 - DNA, 201 bp, Homo sapiens
tgaaaccccatctctactaaaaatacaaaaaaaattagctgggcgtggtggcgggcgcctgtagtcccagctactcgggaggctgaggcaggagaatggcrtgaacctgagagtcagagtttgcagtgagccaagatcgcgccactgcactccagcctgggcgacacagcgagactctgtctcaaacaacaacaacaacaa

SEQ ID NO: 64654 - DNA, 201 bp, Homo sapiens
aattagctgggcgtggtggcgggcgcctgtagtcccagctactcgggaggctgaggcaggagaatggcgtgaacctgagagtcagagtttgcagtgagccragatcgcgccactgcactccagcctgggcgacacagcgagactctgtctcaaacaacaacaacaacaacaacaacaacaacaacaaacatgctggtgaga

SEQ ID NO: 64655 - DNA, 201 bp, Homo sapiens
gcgggcgcctgtagtcccagctactcgggaggctgaggcaggagaatggcgtgaacctgagagtcagagtttgcagtgagccaagatcgcgccactgcacyccagcctgggcgacacagcgagactctgtctcaaacaacaacaacaacaacaacaacaacaacaacaaacatgctggtgagattgcagagaaaagggaat

SEQ ID NO: 64656 - DNA, 201 bp, Homo sapiens
attagcttctcatgagagtcagcttgccctctgaagtttttttttgtgttgtttttgagacagagtctcgctttgtcacccaggctggagtgcagtggcaygattttggctgactgcaacctccgcctcccaggttcaagtgattctcctgcctcagccccccgagcagctgggactacaggcatgtgccaccatgcctgg

SEQ ID NO: 64657 - DNA, 201 bp, Homo sapiens
ggcagcaagcaagagagtgtgtataggggaactgccctttataaaaccatcatatcttgtgagacttattcactatcatgagaacagcttgggaagaaccygcccccatgattcaattacctttcactgggttcctcccatgatacatggggattatgagagctacaattcaagatgagatttgggtggagacacagccaa

SEQ ID NO: 64658 - DNA, 201 bp, Homo sapiens
tgatactgtaggttggtttttgtatcctgcaactttactgaattcatttattagttttagcagtttttttggtggaatctttagggttttctacatataasatcatgttagcaaatgagacaatttaacttcttccttttctatttggatgccatttcattctttttcttgcctaattgctctggctaggccttctagtac

SEQ ID NO: 64659 - DNA, 201 bp, Homo sapiens
tgggtggagacacagccaaaccataccaatacccaaaggaaaataaattgttctaccataaagacacacgcactcatatgttcattgcagcactactcacmatagcaaagacacggaatcaacctaaatgcccatcatcaatacaccagataaagaaaaggtggcacatatacatcgtggaatactgtgcatccataaaaa

SEQ ID NO: 64660 - DNA, 201 bp, Homo sapiens
tgctaactaagcagtcactctccatttctctctcttctcagcacttggcaaccactaatctgctttctgtctctatggatttgcctattctggacatttcwtataaatggaatcattcaatatgtggtcttcggtgtctggcttcctttatttagcataattttgtttgtttgtttgtttgtttgtttttgagacagatcc

SEQ ID NO: 64661 - DNA, 201 bp, Homo sapiens
caacctccgcctcctgggttcaagtgattctcctgcctcagcctcccaagtagctgggactacaggcgtgcgccaccatgcccaggtaatttttgtatttytagtagagatgaggttccaccatgttggtcaggctggtctcgaactcctgacctcatgatctgcccacctcatcctcccaaagtgctgggattacaggca

SEQ ID NO: 64662 - DNA, 201 bp, Homo sapiens
acttgatcatggtgtattattcttttaatggattgttgaattttgtttgctagtattttgttgaggattcttgcatttgtgtttatcagggatattgtctygtatttttcttttcttgtagtgttcttatctggctttgggatcagggtaatgctggtcttgtagaaacagtttagaagtgttccctcctctttaattttt

SEQ ID NO: 64663 - DNA, 201 bp, Homo sapiens
gtgcagcaaaccaccatgggacgtgtatacctatgttaacaaacctgcacgttctccacatatatcccagaacttaatgtataataaaaaattacttttawatttatttatttatttagagacagggtcttgctctgttgcccaggctggagtatagtggtgcaatcacagctcaccacagccttgaccacccaggctcaa

SEQ ID NO: 64664 - DNA, 201 bp, Homo sapiens
cagtatttgaagaggactggggagtcaccattcagtgtgttgcttttgttacattttcttttgttccacagggcacatttacctgatgtccgaagtccagygtccccctctgctctagcagacgataaacttctagtcttctgctggagaggagggagaattgcctgacttagtggatgataaaggaatatgggggccatt

SEQ ID NO: 64665 - DNA, 201 bp, Homo sapiens
aggtgatcctcccacctcggcctcccgaagtgctgagattccaggtgtaagccaccatgtccagccccatatgaagttttggattttttttttatttctaygaaaagtgatgttgggatattcatagggattgcattgaatttgtagatcactttgggtagtataacattttagtaatattagttcttctgaaccatgaac

SEQ ID NO: 64666 - DNA, 201 bp, Homo sapiens
tggggagtcaccattcagtgtgttgcttttgttacattttcttttgttccacagggcacatttacctgatgtccgaagtccagcgtccccctctgctctakcagacgataaacttctagtcttctgctggagaggagggagaattgcctgacttagtggatgataaaggaatatgggggccatttgctttttatatggact

SEQ ID NO: 64667 - DNA, 201 bp, Homo sapiens
aacctccaggtgggctctctattctttccccttccttctctctttttttttttttctgattgagacaaagtctcactctgtcaccagactggagtgcagtkgtgtgatctcggctcactgcaacctctgcctcccaggttcaagcgattcttgtgcttcagcctccgagtagctgggactacaggcgtgcaccaccacacc

SEQ ID NO: 64668 - DNA, 201 bp, Homo sapiens
cgagacaagctggctcaagcatttgaagatgcttttgaggtactgaggcaacattcaactggagatcttcaaaacttacctggttttcatcagtgattgtmcccatgtcagaggagattccaactgctatggaatgttgcttacagaggaatctatttataattggagaactttaataaataatgctgcagacttctattt

SEQ ID NO: 64669 - DNA, 201 bp, Homo sapiens
ttacaggataccaggcaacaccaacctcctaagcctcgaacctctctctgccactggctgcttcgtccctgtgctggttctcctcctaacctccaggtggkctctctattctttccccttccttctctctttttttttttttctgattgagacaaagtctcactctgtcaccagactggagtgcagtggtgtgatctcggc

SEQ ID NO: 64670 - DNA, 201 bp, Homo sapiens
aatggtacattgtcatggtgctgataggagtgtcttacggtgatgggcagtgagaggttctttcagcccctctactggtttcggtcagttttgttttgtcttttttttttttttttttgagatggactctctccgtcgctccgactggagtgtagtggtgcggtcttggcccactgcaacctccgcctcttggattcaagt

SEQ ID NO: 64671 - DNA, 201 bp, Homo sapiens
ttacaggcatgagccacggcgcctggcccccttcctcctcctgaaaaggcggatctcaaggctcagtcctgctcttccctccacatcctttgctcttgcargtctcctcttccacgcaggtggctccctcatctcctcttcaatatctgacttctctcaaaagttccaagtctggatttgccattacttgctggacatctc

SEQ ID NO: 64672 - DNA, 201 bp, Homo sapiens
ccttgaattccttgggtcaagggatcctccagccccagtctcccaggtagctaggactacaggtgcaggccaccacacctggctaccattttttttttttwacttttcatagagatgggggtctggctatgttgcccaagctggtcttgaacttctggccccaagcattcctcctgctttgtcctcccaaagtgctaggat

SEQ ID NO: 64673 - DNA, 201 bp, Homo sapiens
caagatcgcgccactgcactccagcctgggcaacaaagcaagactccatctcaaaaaaaaaaaaaaaaaaattcactatttgccatcctcattcctcctcrtctcctgcgggccagtgtgcttcttgtctttcacgggtgtcttccgtgttattccaaccaaaccagctctccagcatcctatgttttcttcccttagctg

SEQ ID NO: 64674 - DNA, 201 bp, Homo sapiens
taaggacatatgcaagactgggtaatttataaagaaaaagaggtttaatggactcacagttccacatggccagggaggcctcacaatcatggcggaaggtrgagaggagcaaaggcacatcttacatggcagcaagcaagagagtgtgtataggggaactgccctttataaaaccatcatatcttgtgagacttattcact

SEQ ID NO: 64675 - DNA, 201 bp, Homo sapiens
tgcctcccgggttcaagcaattctcctgcctcagcctcctgagtaggtgggattacaggcacccgccaccacgcccagctaatttttttgtattttcagtrgagatggggtttcaccatgttggtcaggctggtctcaaacccctaacctcatgatccacctgccttggcctcccaaagtgctgggattataggcgtgagc

SEQ ID NO: 64676 - DNA, 201 bp, Homo sapiens
cctcccaaagtgctgggattataggcgtgagccaccgtgcccagccaatttttgtatttttagtagagatggagtttcaccatgttggccaggctggtctygaactcctgacctcaggtgatccatccgcctcggcctcccaaagtgctgggattacaggcatgagccacggcgcctggcccccttcctcctcctgaaaag

SEQ ID NO: 64677 - DNA, 201 bp, Homo sapiens
tctactaaaaactacaaaaattagccaggcgcggtggtgggcccccgtaatcccagctacttgggaggctgaggcaggagaatcgcttgaacccgggaggyggaggttgcagtgagctgagatggtgccactgcactcctgcctgggctacagaaagagactccattaaaaaaaaaaagacttcctatattgtcattgtct

SEQ ID NO: 64678 - DNA, 201 bp, Homo sapiens
ccatccccttataaggaaatctgccccatccacagtcagaggtgtacttggatgggaccactccccagacaaaagagcagggtcagtttctcactatgggkgtgtgtgtgtgtgtgtgttgatctggaaaatacagagaggatcaggcagttagcaataggaacaaagacggagagaagccagaggggccaagatggccat

SEQ ID NO: 64679 - DNA, 201 bp, Homo sapiens
tagaataactttgtagttcttgtccatttattttgtgcatgttgttcttaaaaggcttgtgaaagataacttggaatgtgggaaacacatagatcccagartattaaaggggctggaaaagtagccttaagacatgaattatgtgcctttcatctgggactgtttggagaaagaagccattttggggcagtggtttgtatt

SEQ ID NO: 64680 - DNA, 201 bp, Homo sapiens
ccactgcactcctgcctgggctacagaaagagactccattaaaaaaaaaaagacttcctatattgtcattgtctctaataatctccacctctctctctctytctcttttttttttttaccactttcttggaaatttccacctcttctattgaattaaaacttttttttgctattgaacattttctgtcttgttctgtgatt

SEQ ID NO: 64681 - DNA, 201 bp, Homo sapiens
actgcactcctgcctgggctacagaaagagactccattaaaaaaaaaaagacttcctatattgtcattgtctctaataatctccacctctctctctctctctcttttttttttttaccactttcttggaaatttccacctcttctattgaattaaaacttttttttgctattgaacattttctgtcttgttctgtgattgt

SEQ ID NO: 64682 - DNA, 201 bp, Homo sapiens
tcaggccgggtgcggtggctcacgcctgtaatcccagcactttggaaggccgagacgggcggatcacgaggttaggagatcgagaccatcctggctaacayggtgaaaccctgtctctactaaaaatacaaaaaaaattagctgggcgtggtggcgggcacctgtggtcccagctactcgggaggctgaggcaggagaatg

SEQ ID NO: 64683 - DNA, 201 bp, Homo sapiens
aaaaaaaaaaaaaaagaagcaaaaaagaaaactgaaaaaagaggggagcaacaacaactaatataaaatagaataaaatagaatataatagaacaattgtracaatctaactataataaaagttgggtgaatgtggcctttctcaaaatatctgattgtgctgtgctcacctatttttgggctgtggctgactgcaggaaa

SEQ ID NO: 64684 - DNA, 201 bp, Homo sapiens
ctgcactcctgcctgggctacagaaagagactccattaaaaaaaaaaagacttcctatattgtcattgtctctaataatctccacctctctctctctctctcttttttttttttaccactttcttggaaatttccacctcttctattgaattaaaacttttttttgctattgaacattttctgtcttgttctgtgattgtt

SEQ ID NO: 64685 - DNA, 201 bp, Homo sapiens
agcagaatcgattgaacccgggaggcagaggttgcattgagctgaggctgagatcgggcaactgcactccagcctggcgacagagccagactctgtctcaaaaaaaaaaaaaagaaagaaacctgcatatgtatccccaaatctaaaataaaaattgaaaaaaaaaaaaagggctgggtgcagtgggtgcagtagttcact

SEQ ID NO: 64686 - DNA, 201 bp, Homo sapiens
tgcaagcatttgacttttaactttccctggtctgctgaattgattaccccttgtttatctgctttcagcttccaaaatatagatgccatttctttctttctttctttttttttttttttcttgagacggagtttcgctcttgttgcccaggctgggatgcaatggtgtgatctcggctcattgtaacctccgcctcctggg

SEQ ID NO: 64687 - DNA, 201 bp, Homo sapiens
tgcactcctgcctgggctacagaaagagactccattaaaaaaaaaaagacttcctatattgtcattgtctctaataatctccacctctctctctctctctyttttttttttttaccactttcttggaaatttccacctcttctattgaattaaaacttttttttgctattgaacattttctgtcttgttctgtgattgttg

SEQ ID NO: 64688 - DNA, 201 bp, Homo sapiens
aagcatttgacttttaactttccctggtctgctgaattgattaccccttgtttatctgctttcagcttccaaaatatagatgccatttctttctttctttytttttttttttttttcttgagacggagtttcgctcttgttgcccaggctgggatgcaatggtgtgatctcggctcattgtaacctccgcctcctgggttc

SEQ ID NO: 64689 - DNA, 201 bp, Homo sapiens
tgtatatgcatatcacagtttctttatccacttgttgattgatgggcattttggttggttccacagtttcgcaattgcgaattgtgctgctataaacatgygtgtgcaagtaccttttttgtataatgacttcttttcctctgggtagatgcccagtagtgggattgctggatcgaatggtagttctacttttagttctct

SEQ ID NO: 64690 - DNA, 201 bp, Homo sapiens
ggaaatttccacctcttctattgaattaaaacttttttttgctattgaacattttctgtcttgttctgtgattgttgctttcagaaaacatcctgcttttrtttcaaagatgctaatcttctctagtatttctgaacatagtaaatatagtttaaaaaatctgtttcttcattattcctattttctctgagtccctctttt

SEQ ID NO: 64691 - DNA, 201 bp, Homo sapiens
ctgaggcagagaattgcttgaacctgggaggtggaggttgcagtgagctgagatcaggccactgcactccagcctgggtgagacagcgagactccatctcaaaaaaaaaaaaaaaaaaaattccgtttatccactgtatgcctcttaatgagagaatttagtctatatacatttaaagtaataattgataggtaaggactt

SEQ ID NO: 64692 - DNA, 201 bp, Homo sapiens
tgaggcagagaattgcttgaacctgggaggtggaggttgcagtgagctgagatcaggccactgcactccagcctgggtgagacagcgagactccatctcaaaaaaaaaaaaaaaaaaaattccgtttatccactgtatgcctcttaatgagagaatttagtctatatacatttaaagtaataattgataggtaaggactta

SEQ ID NO: 64693 - DNA, 201 bp, Homo sapiens
aacatagcatgtattacaagaaaaatattttcatattagattacaaagaaaaacccaactgtctactatacacaaaaggtacatttaaaataaactaattctggaagttgaaaataaaaggatgggcaaatgtataacagacaaaaaaagtatcactcataatcttaaaattagatattataggccaggcaccgtggctga

SEQ ID NO: 64694 - DNA, 201 bp, Homo sapiens
cccattctgtaatatccaaataaaatggctcaaattcccatcctgcctaatagtaggatctggcctttccacacacattttcgtgggttacttttgcctagaaaagagtttgtctcatacctacttccaaaagcactgtttctttgctgttttgtgacttattttctgcccactctagtgtactctacggccacgtgcaga

SEQ ID NO: 64695 - DNA, 201 bp, Homo sapiens
aggcatttgcttctcaccatgacaggctggcgtctgccaaggaactttgtgaaggtcttttgcatacgtgcctggtggagattgggcagtaagtccactakatccttctctgtcacatccttagagatgggcgggggcttctgcatggtgcatgggccattagggatccaggagtaccagtccagctgcagggaggagagc

SEQ ID NO: 64696 - DNA, 201 bp, Homo sapiens
atttaatgttcacctgcagtctacagccctcctcccccaagagagtctctgggccaggtcctcccctgaggacctgtcctgttaactgtcctgaccctccygcctcctaactcagtgctctctccatgcagtccctgtccgagtgctggagctaagtgagagccaccctgacagtggggaacagacagtccgctgtcgtgg

SEQ ID NO: 64697 - DNA, 201 bp, Homo sapiens
agtagtagcctaacgctacttcacaattcttacgccatcacctcacttcctcttatcacgtaggcaccgtgtcattccacgtcttcacaagaagagtgaamgatacagtaagatattttaagagagagaacacagtcacatgacttttattacagtatatttttatcattgttctattttattattattgttgttcatctc

SEQ ID NO: 64698 - DNA, 201 bp, Homo sapiens
agcaatgctctgcccgttgggctccccctgcccaggtaccaggagggaggccagggactgaatctttgggatacctgaggagcaccgctccttcccctccttttgtccaggaggggaagctgaggctgtgacagggcaggggacagaatcactcctggagctagggctgttccacaagatggtccaccccagatgagggaa

SEQ ID NO: 64699 - DNA, 201 bp, Homo sapiens
ggggaggccacaggaaggcgcctctgaacacacccgtcttgtgacctttgccctggggtgctgtaatcgcctctgggtgtgagctctctgggttctaactrtcattttggtagcctcagtgcccagcttggcccagcaggttggttgaaaagtcttgatccacaggctttcctactgggatagactgaaggaagatgagtg

SEQ ID NO: 64700 - DNA, 201 bp, Homo sapiens
ctggggtgctgtaatcgcctctgggtgtgagctctctgggttctaactgtcattttggtagcctcagtgcccagcttggcccagcaggttggttgaaaagkcttgatccacaggctttcctactgggatagactgaaggaagatgagtgagtgtgtgagtgagagaagaaattcatgagtggcaaggggcaggaggggagg

SEQ ID NO: 64701 - DNA, 201 bp, Homo sapiens; identical to SEQ ID NO: 56367

SEQ ID NO: 64702 - DNA, 201 bp, Homo sapiens
caggactgaagagctgaccctacagagccatttaatctctcatatcgtgtaagcgtttactgagcacctactgtaggcctaattccatattaggaagttgragagagtccagatcgttgttaggtaggtatcctgatttgtgggaagtcatattaaaggactaagacaaaagttcaggaaagaagtaattgacagacagtg

SEQ ID NO: 64703 - DNA, 201 bp, Homo sapiens
ggacaggggctgccttgtccccagctagtgagaaaggaaacagcctctggtcctctgaccagccctgggatggacatgggaactgtgctgcgcagagaccrgggccctcacagggaatgggacggagaagtggttgtgggtgggagctgccagataccctcctcccatcccaggtgcagagtggggctgaggtccttcctt

SEQ ID NO: 64704 - DNA, 201 bp, Homo sapiens
cctgagctctgctttgctctgtgtggcctcattttcaggccagcattgcccaaatggctaccagcagtgccagtctcatgtcctactgcttgctccatagwgccagcaaaagtcccagagctgaccttcaagggctcaggtggggtcacatgccatcaagaaccaaccgtggaagctgcagggctgaaaactgttggcgaa

SEQ ID NO: 64705 - DNA, 201 bp, Homo sapiens
tggcctgccctgacagcagtgatgggctgtgcctgcccagctatgtgtgcagggacaggatggggagccgcccaggagtgcatggagcaagtatagcggcrgggagggctggctataatgggtccagggtgggggaagggggaacaggccgaatgtgttgttccagtggtggtgggcagaggaagaagcccaggtgacagg

SEQ ID NO: 64706 - DNA, 201 bp, Homo sapiens
acctcccaggttcaagcaattctcctgcctcagcctcccgagtagctggaattacaggcatgcagcaccacgcctggctaattttgtatttttagtagagwtggggtttctccatgttgagactggtctcaacctcctgacctcaggtgatccgcctgcctcggcctcccaaagtgctgggattacagatgtgagccacca

SEQ ID NO: 64707 - DNA, 201 bp, Homo sapiens
ttctagtctagtggaggaaacagtcgccggtcagatgatcacccagatgtttagttgtccttgtgatgggtggggccagcagtagcagccaagaagtaaaygggcagatgactggggaagagggtgccaggcaggccactcatggcctgtggtatccctgaggctggagatttgctggctgacagagactgtggtaggtta

SEQ ID NO: 64708 - DNA, 201 bp, Homo sapiens
agggaacccatcggttttcacactgattcctggtatttaatgttcacctgcagtctacagccctcctcccccaagagagtctctgggccaggtcctcccckgaggacctgtcctgttaactgtcctgaccctcccgcctcctaactcagtgctctctccatgcagtccctgtccgagtgctggagctaagtgagagccacc

SEQ ID NO: 64709 - DNA, 201 bp, Homo sapiens
gcccctgtttcctgatgtctgatacctcctctcccaaaggcgagctgctgttgctgtctctcctgttacttctggaaccacagatctctcagggcctggtygtcacacccccggggccagagcttgtcctcaatgtctccagcaccttcgttctgacctgctcgggttcagctccggtggtgtgggaacggatgtcccagg

SEQ ID NO: 64710 - DNA, 201 bp, Homo sapiens
aggccatcaacatcaccgtggttggtgtgtgccttgggctcagcccaatccccaattccttcaacgctccccaccctcacccactttgctgggtgcagagygatggtgagagttgcatttttgatacagtgatcagggctgagctggacccagtgcctgtcacagccccggggtatagtcagccacactccagtgcagccc

SEQ ID NO: 64711 - DNA, 201 bp, Homo sapiens
agagactgtggtaggttaggatggagcagtgtccacctttctgaaggggagagaaataggactttccttcaatgctccccacccccacccacagttcatcycaaccctccctcttggcctaggggaactgcctgtgggtgaggatttacgagacctggtttgagtcccggctctgctaccaatgccgagatgaccttggca

SEQ ID NO: 64712 - DNA, 201 bp, Homo sapiens
caggggcaaacaggagcattgtgaaaccctgttgtgtacatgcataggaacacattctggcaaacacaatatgggtacacacgtgtacaaacacaagtctrtaagccatggatatgaatatccttcagtgtggtgtacatatactatatgtatgtcgtaagccatgtacatgagcatgcctgttccttgaacataggtgca

SEQ ID NO: 64713 - DNA, 201 bp, Homo sapiens
cgggaagaagagctgggacttataattgcccacacatgtggggcaggcagtggaaagcaccgtggatccagagtcaggagacccagtgcttgccctggctygatttaaatccaccgtgtggccaacctcagaccccccacatcccatctctgggctccttccgcagctgggaggcagtgagcgctgtgggtaaccagcacc

SEQ ID NO: 64714 - DNA, 201 bp, Homo sapiens
tgggctgtcctttttgcggggctccttatctttgcctcctgccacagaggggctgtctcatgggcattgggctgtgtgctctggagcctgtctgcccagtrttaaacactggagacaccactggcaagcttttgggcaaacaatgtaaacagtctgtgcctcagtttccacatctgtaaaatgaggaagcagtactgatgt

SEQ ID NO: 64715 - DNA, 201 bp, Homo sapiens
gctggtggcagggcgtgaagcaccaggcacactgccctgcccttcagctttagttttcaggatttccagtgggctctgtggaggcctccagctgccagccyttcagctcagaaagcgtcagtgggcccctgcttgtccagaaccatcagctcaaatcctttgattggccctccagaccccatcccaccttctggcccacac

SEQ ID NO: 64716 - DNA, 201 bp, Homo sapiens
ccaaaaaactcaagaaaccctggaggcctagctcaaggccacctccctcaggaagccatacccgctctccccactggagtaatcatatactgttgttagtyaccatttactgggcacctatgatgtgccaagtgctgtgcgtcatcatctctggccctcccagaaatggaaaaggaggtctcccatgccatttcccaggaa

SEQ ID NO: 64717 - DNA, 201 bp, Homo sapiens
cttaattgtatagatggggaaactgaggcccagagagggaaacaacttgtcaaagcccgcacagcaagtctgtggctgaatagtcatggaaattcctttcrtggaatgagatggctggtggattcttatgtgactctagcctcaggaatgtagccccctcctgcttactagcccccacctcctcaaaacaccccggtaaga

SEQ ID NO: 64718 - DNA, 201 bp, Homo sapiens
  misc_feature (1)...(201): n = A,T,C or G, or insertion/deletion polymorphism (see Tables 1-2)
gacctcaagtgatccgcctgcctcagactcccaaagtgctgggattacaggcgtgagccaccgcacccagctaaactctccccattttacaggtgagaaantgcgcagagtcagttgcctaaagtcccacagctcggaagtggcggagctgggatttgcacctgggtgtttctgactccagatccccttgatgagaggctg

SEQ ID NO: 64719 - DNA, 201 bp, Homo sapiens
gcttgttctgtgccaggtactgggctgtcctttttgcggggctccttatctttgcctcctgccacagaggggctgtctcatgggcattgggctgtgtgctytggagcctgtctgcccagtgttaaacactggagacaccactggcaagcttttgggcaaacaatgtaaacagtctgtgcctcagtttccacatctgtaaaa

SEQ ID NO: 64720 - DNA, 201 bp, Homo sapiens
ctttctgtgtctacttcaattgtgctttacatctgttacctcaaagttgctgctgtattcctcagcacttggaacatgctgggcattcaggacattcttartaaatatttactggattaatttaaccatcgaggctgggcacggtggctcacacatgttatcccagcactttgggaggccgaggcgggtggatcacccgag

SEQ ID NO: 64721 - DNA, 201 bp, Homo sapiens
tctaggctaaaggagggtgctctgggcattggctcagaacaggctgctgctgaatgcagtgggaagggagaaagggatgaaaaggtcttctgaaatgcccrcccatttcttgcatttgattcagaacccagtgggcagtgggttcttggaatgggaatctttttggtgccccctgtcttctgacccagagcgttaggaggg

SEQ ID NO: 64722 - DNA, 201 bp, Homo sapiens
ctgggagatggagtaaggtcatcaccacttcacagcaaaggaaactgaggccctgaagaaggacgctgaggcagcatgagagcctgtgcctgtctgctctraagtgggggaagagttagagtcctgggtgctggtctgataactgcccctccctgggtggtcctgagctcaccatgccttgtaagattctatgtgaggtag

SEQ ID NO: 64723 - DNA, 201 bp, Homo sapiens
agccacacagctagtaagtggcacagcctggagaggttggaatctccccgtgccccattactccaaacttgggccttttgttcccgccagtcagatcccaraattcccagaaggaatgcgcaccatcctgcttgtgggcatttgccctccctcttccccctttctggaatgcccttcctcatcacttttctttcagggata

SEQ ID NO: 64724 - DNA, 201 bp, Homo sapiens
gccagtagggccctgaaaccctgccccgtccaacaacacgggtccaagtgaggaggaaatacacatggcctttgacacagaggcagctccttctttgggtycatttctcacccccactgccccccggggatggtcccagggacctgggagatggagtaaggtcatcaccacttcacagcaaaggaaactgaggccctgaag

SEQ ID NO: 64725 - DNA, 201 bp, Homo sapiens
tatgagactgatctcatgtaatgctcaccagcaaccccagaggcagtgactgtttttacctccgttttatacatgaggaaattgaggctcacgcagccacmtaactgtagccacacagctagtaagtggcacagcctggagaggttggaatctccccgtgccccattactccaaacttgggccttttgttcccgccagtca

SEQ ID NO: 64726 - DNA, 201 bp, Homo sapiens
gtcaagatgcttaaatgtgagtagtccttggagccctccacatctgggccttcacctctccctgcccctccccacacacttagcctctcccagggtggccygatgctgatttgcaggcactagaggggccatcacactgcagcaggcgctgctcccgagtctgggtctggtttgggaaagagcgttcctctccctggcctc

SEQ ID NO: 64727 - DNA, 201 bp, Homo sapiens
tagtcccagcatcagccacagtactgacccagaacagagaactgttagtacaactctgttcccaacctgggagctggccccagcatccatattagccccarattcggccccttctccaggccctgtccccagcccaatttcaacctcagctccggaaactccatggctggcacggtccccaggcctgaagccccaccccac

SEQ ID NO: 64728 - DNA, 201 bp, Homo sapiens
cgcaactgtgctgagtgctttatgagactgatctcatgtaatgctcaccagcaaccccagaggcagtgactgtttttacctccgttttatacatgaggaamttgaggctcacgcagccacctaactgtagccacacagctagtaagtggcacagcctggagaggttggaatctccccgtgccccattactccaaacttggg

SEQ ID NO: 64729 - DNA, 201 bp, Homo sapiens
cagggtggcctgatgctgatttgcaggcactagaggggccatcacactgcagcaggcgctgctcccgagtctgggtctggtttgggaaagagcgttcctcwccctggcctcctcggcctgcttccccctaccctggcctcttcccctcctcagagtgtgggtgctcacccccgccaggctgcctgggtcttgcagcacagg

SEQ ID NO: 64730 - DNA, 201 bp, Homo sapiens
acagggatcctggttcaggtcccagctctgctaccttctccctgctgtgtgatgttagcaaattctttgccctctctgggtctctttatctccctgtctgrgcattgacaggtttgaacagtgacatcagaaagcctgcttggctctcacattctggctgtctatcctggggagggttgtggtctctgttcagagcccatg

SEQ ID NO: 64731 - DNA, 201 bp, Homo sapiens
gccttcacctctccctgcccctccccacacacttagcctctcccagggtggcctgatgctgatttgcaggcactagaggggccatcacactgcagcaggcrctgctcccgagtctgggtctggtttgggaaagagcgttcctctccctggcctcctcggcctgcttccccctaccctggcctcttcccctcctcagagtgt

SEQ ID NO: 64732 - DNA, 201 bp, Homo sapiens
ggttctcatgagccaggccctcagctgccagttgctcctcagtctgccaagtcctgaagcctcctctggggccccttggtccctgttccctccgagcccaygaagaccttggctcagttgagcacttgctgtgtgacttcaaatatgcccctgcccctctctgggcctcagggtctcctgccccatgtgtcctagacggac

SEQ ID NO: 64733 - DNA, 201 bp, Homo sapiens
gtcctgtggttccaacaccttaagatgtcaacattctaagcttacatctttctgacttgcccagcactggggagggccatccgcatccagccgagtacccyacctggtgtcactttctggggtcacctgctctactacttccatctgaggagcagcgaaggctgggagagaagctagagaggaggttctcatgagccaggc

SEQ ID NO: 64734 - DNA, 201 bp, Homo sapiens
ctaccagtgtcttgatgcttttgtgtatctagctgcccgtccttatgcatacatgcacctgtatgagtgtgcttcatttattcacctttcttcttcattcrataaatatgaggacccaacttctcattgaagtataaaggtcaaagggctcagccctgcctggacctcctagtacccatagtccagagagagaaggcagac

SEQ ID NO: 64735 - DNA, 201 bp, Homo sapiens
tgcgcaacgctgtgggccaggacacgcaggaggtcatcgtggtgccacactgtgagtccccagcctcagtggcccctgacgatcccaatccctaccttaaycctgcctaattggtaatgtgcccatgtacccacagcaggccaaaggagttagcatgcccaggggcaaacaggagcattgtgaaaccctgttgtgtacatg

SEQ ID NO: 64736 - DNA, 201 bp, Homo sapiens
tggagtaaggtcatcaccacttcacagcaaaggaaactgaggccctgaagaaggacgctgaggcagcatgagagcctgtgcctgtctgctctgaagtgggrgaagagttagagtcctgggtgctggtctgataactgcccctccctgggtggtcctgagctcaccatgccttgtaagattctatgtgaggtaggagggcag

SEQ ID NO: 64737 - DNA, 201 bp, Homo sapiens
agtgcctggagttacagcattgccctgccaagccagcagctactacccgccatcactatcaacaccttgaaaagttggtggtccagagaaaatcctcacayagcaccgcagacctttcctgaagtctccctgcctccttccctggcctcctgctgcctccttcccaggccatcacctacctgtttgctgaagagccccagt

SEQ ID NO: 64738 - DNA, 201 bp, Homo sapiens
gccagcagccagcagtgactgcccgccctatctgggacccaggatcgctctgtgagcaacttggagccagagaggagatcaacaaggaggaggagagagcyggcccctcagccctgctgcccagcagcagcctgtgctcgccctgcccaacgcagacagccagacccagggcggcccctctggcggctctgctcctcccga

SEQ ID NO: 64739 - DNA, 201 bp, Homo sapiens
tgggagagaagctagagaggaggttctcatgagccaggccctcagctgccagttgctcctcagtctgccaagtcctgaagcctcctctggggccccttggyccctgttccctccgagcccacgaagaccttggctcagttgagcacttgctgtgtgacttcaaatatgcccctgcccctctctgggcctcagggtctcctg

SEQ ID NO: 64740 - DNA, 201 bp, Homo sapiens
ctctaccccttctccatgccattctaaagcataaatccaatcacaccacctccctgcccaggatccgcctatggctccccagtgcctggagaaagtcccarctcctaacagaggctgccactgcttgacacttactgcacgccgcaactgtgctgagtgctttatgagactgatctcatgtaatgctcaccagcaacccca

SEQ ID NO: 64741 - DNA, 201 bp, Homo sapiens
caacttggagccagagaggagatcaacaaggaggaggagagagccggcccctcagccctgctgcccagcagcagcctgtgctcgccctgcccaacgcagayagccagacccagggcggcccctctggcggctctgctcctcccgaaggatgcttggggagtgaggcgaagctgggccgctcctctcccctacagcagcccc

SEQ ID NO: 64742 - DNA, 201 bp, Homo sapiens
caaggctaagtccgggatggagaggagacagcctgtggtcatgagtgccctttcaggcttgggacgtggtggcttttgacttcagcccctcggacatgaakgctgggtggcccaagctggggctcattctgcaggagccaggtggtgagatagcccctgtcgctgcctccacctgccctgggccctgactcctgtttaact

SEQ ID NO: 64743 - DNA, 201 bp, Homo sapiens; identical to SEQ ID NO: 56408

SEQ ID NO: 64744 - DNA, 201 bp, Homo sapiens
cttctggctctgtgttcctagcccagttattaaatgctctctgcctcagtttccccactgtaaaatggaaatgatcactgtatctacctcatagagttgayggagaatcaagtgagccaatacgtgccaaatgctcagaatggttcctggtgcagtaacacgggctttctggcttgtctgttcatgcatatggctgtgtgt

SEQ ID NO: 64745 - DNA, 201 bp, Homo sapiens; identical to SEQ ID NO: 56410

SEQ ID NO: 64746 - DNA, 201 bp, Homo sapiens
acatctcattgtccccagcccagtgggcattggaggtgccaggggagtcagggttgtagccaagacgcccccgcacggggagggttgggaagggggtgcakgaagctcaacccctctgggcaccaaccctgcattgcaggttggcaccttacttccctgggatccccagagttggtccaaggagggagagtgggttctcaa

SEQ ID NO: 64747 - DNA, 201 bp, Homo sapiens
gccctcaggggctccagggctaatgggaggtccaggcaatggacaggaactcagaacaggatttgcaccccgtccagagctctggcagcaaggccagactsactggcagggctgaagggacgtggaggccagcagtgatctgagtgggggtagttactgaggggatggagtatttacaggacagtctgaacgtgtggccta

SEQ ID NO: 64748 - DNA, 201 bp, Homo sapiens
gacatgaaggctgggtggcccaagctggggctcattctgcaggagccaggtggtgagatagcccctgtcgctgcctccacctgccctgggccctgactccygtttaactctgcaggacaccatgcggcttccgggtgcgatgccagctctggccctcaaaggtgggtagatgggagataaggtaggggacccggggggctg

SEQ ID NO: 64749 - DNA, 201 bp, Homo sapiens
ccgtccaacaacacgggtccaagtgaggaggaaatacacatggcctttgacacagaggcagctccttctttgggtccatttctcacccccactgccccccrgggatggtcccagggacctgggagatggagtaaggtcatcaccacttcacagcaaaggaaactgaggccctgaagaaggacgctgaggcagcatgagagc

SEQ ID NO: 64750 - DNA, 201 bp, Homo sapiens
tgatataacaggaaccaactcgttcttagcactttctgtgtctacttcaattgtgctttacatctgttacctcaaagttgctgctgtattcctcagcactyggaacatgctgggcattcaggacattcttaataaatatttactggattaatttaaccatcgaggctgggcacggtggctcacacatgttatcccagcact

SEQ ID NO: 64751 - DNA, 201 bp, Homo sapiens
tcctgtttaactctgcaggacaccatgcggcttccgggtgcgatgccagctctggccctcaaaggtgggtagatgggagataaggtaggggacccgggggkctgcggagtggaaccctggagctggcaggggtgatgtgtgctggtggcagggcgtgaagcaccaggcacactgccctgcccttcagctttagttttcagg

SEQ ID NO: 64752 - DNA, 201 bp, Homo sapiens
aacagtaaaagtacttctattaggcggtcattgcaaggattaaatgagatagcatacacctttaggagtgcagaggagggagatgctggtgggtgagaaaygagctttggagccagctgaccctgctccgaagttccagctcctgcacttccctgctgtgtgaagtggggcagtgatataacctctctgagccacactttc

SEQ ID NO: 64753 - DNA, 201 bp, Homo sapiens
cctgaagccccaccccacaggctggcctcctttgggattcagttggtgccctgcccccagggccccgcccctgacggtcaccccttgcagagagcggctaygtgcggctcctgggagaggtgggcacactacaatttgctgagctgcatcggagccggacactgcaggtagtgttcgaggcctacccaccgcccactgtcc

SEQ ID NO: 64754 - DNA, 201 bp, Homo sapiens; identical to SEQ ID NO: 56495

SEQ ID NO: 64755 - DNA, 201 bp, Homo sapiens
gactagctatgagacctagggctggtgtcttgccttctctggccctccatctcctactatgtacaatgagagcaagaccatcccccaggaactgcctagcrttgaggttctatgatcctgtgaccctgtgagacgggatccctatgtggcaaaagtggaaggattgaggacaggctgagtagcaggcctggtctggctggg

SEQ ID NO: 64756 - DNA, 201 bp, Homo sapiens
ggtgactgacttcctcttggatatgccttaccacatccgctccatcctgcacatccccagtgccgagttagaagactcggggacctacacctgcaatgtgmcggagagtgtgaatgaccatcaggatgaaaaggccatcaacatcaccgtggttggtgtgtgccttgggctcagcccaatccccaattccttcaacgctcc

SEQ ID NO: 64757 - DNA, 201 bp, Homo sapiens
gggaagtccagagagtgctttagtttattgtgaaatgcagccatcctagaaaagcagacaatcatggaaccagcctggctcagtcggggagtgtgttcgcmcccactccttggtctgggtgatctgcctgctccctgccagtcaccctattcctgcctcccaagaactctatattctcagctgcttccaatctgctccctc

SEQ ID NO: 64758 - DNA, 201 bp, Homo sapiens
tgagcggaaacggctctacatctttgtgccaggtaagggctcccagcctgtgtgcccactccttacccctcttgtcaactggaggcatcaggggaagtccrgagagtgctttagtttattgtgaaatgcagccatcctagaaaagcagacaatcatggaaccagcctggctcagtcggggagtgtgttcgcccccactcct

SEQ ID NO: 64759 - DNA, 201 bp, Homo sapiens
atgactcccgtggactggagaccgatgagcggaaacggctctacatctttgtgccaggtaagggctcccagcctgtgtgcccactccttacccctcttgtyaactggaggcatcaggggaagtccagagagtgctttagtttattgtgaaatgcagccatcctagaaaagcagacaatcatggaaccagcctggctcagtc

SEQ ID NO: 64760 - DNA, 201 bp, Homo sapiens
ggagggggaccaatcacttgacacacacacacccccaaccccagttccctccagcccaaaagggcctcagcatcttttctggcccccctctgagctacctragcccctccctcccatctctctcccacccagagccacctctgggccttgggcagaacctgggcagtcgggggagggggcagagagctgtagggaagaggc

SEQ ID NO: 64761 - DNA, 201 bp, Homo sapiens
cacccactcctctcccctggacttggggtccttactctgctcctttgacttggggtccccactctgcttccttttgacttggagttcccagtctgctcccytggacttggggtccttactccgctcccctagacttggggccccccactcctctcccctgaacttggggttccactctgtgccccggacttggggtcctca

SEQ ID NO: 64762 - DNA, 201 bp, Homo sapiens
ccatatgtgccaggagtgcacaccggccttagaaggctccgaaggccctcattgctctaactgttgaagaggccaaccatccaagagtcccagtggatggygcagaggagtgaagtgcagcgctcacacagcttgaggtgtgaatgctcaccctgttttgtgccctcagacaagctgcttcactgtctaaacattggtgtc

SEQ ID NO: 64763 - DNA, 201 bp, Homo sapiens
ccgccatcactatcaacaccttgaaaagttggtggtccagagaaaatcctcacacagcaccgcagacctttcctgaagtctccctgcctccttccctggcmtcctgctgcctccttcccaggccatcacctacctgtttgctgaagagccccagtttctagcccaacagatctctccctgccatttctcccagatgccttt

SEQ ID NO: 64764 - DNA, 201 bp, Homo sapiens
ttgcccctcacccaccagctgccccatccctgaggcagcgctccatgggggtatggttttgtcactgcccagacctagcagtgacatctcattgtccccakcccagtgggcattggaggtgccaggggagtcagggttgtagccaagacgcccccgcacggggagggttgggaagggggtgcaggaagctcaacccctctg

SEQ ID NO: 64765 - DNA, 201 bp, Homo sapiens
tggcatgtagtaggtattcagtaaatatttgttgaatgaatgaatcttctacatcagtcatcctttccctctctagccccctaccctatccccaagctgamgtgctagtggctggtggtgacttccccagacctaagccaatctctctctaccagtgtcatccatcaacgtctctgtgaacgcagtgcagactgtggtccg

SEQ ID NO: 64766 - DNA, 201 bp, Homo sapiens
actcaggaaccatgccccttccccaggcccccagcaagtctcaagaacacagctgcacaggccttgacttagagtgacagccggtgtcctggaaagccccmagcagctgccccagggacatgggaagaccacgggacctctttcactacccacgatgacctccgggggtatcctgggcaaaagggacaaagagggcaaatg

SEQ ID NO: 64767 - DNA, 201 bp, Homo sapiens
gcctgtgtccctgtccttcaggcccatcagtcctggggctttttctttatcaccctcagtcttaatccatccaccagagtctagaaggccagacgggcccygcatctgtgatgagaatgtaaatgtgccagtgtggagtggccacgtgtgtgtgccagtatatggccctggctctgcattggacctgctatgaggctttgg

SEQ ID NO: 64768 - DNA, 201 bp, Homo sapiens; identical to SEQ ID NO: 56426

SEQ ID NO: 64769 - DNA, 201 bp, Homo sapiens
caagaaaactgcaggggccgtgaccagccctctgcctccagggaggccaactgactctgagccagggttcccccagggaactcagttttcccatatgtaaratgggaaagttaggcttgatgacccagaatctaggattctctccctggctgacaggtggggagaccgaatccctccctgggaagattcttggagttactg

SEQ ID NO: 64770 - DNA, 201 bp, Homo sapiens
ggacttgatgtccacgcaggatctccccttaactggagagaagggctccccatgaggccacgcccacctccaaagcgagatccagcccaaggtgaagtggytggagccccaggctggggtactgtcccaactctgccactagccgctgagacctgggaaggcttctcctctgcgagcctcagtttctccatatgtgccagg

SEQ ID NO: 64771 - DNA, 201 bp, Homo sapiens; identical to SEQ ID NO: 56427

SEQ ID NO: 64772 - DNA, 201 bp, Homo sapiens
atgtgcattgtgatcgggaatgaggtggtcaacttcgagtggacatacccccgcaaagaagtaatgtggggccaggcaggggtcggaggaggggccaggarcgggtggatatctggcttgcaggctgatttctccccggcccctcctgatttggggggcctgcccaacctgttgctgcagagtgggcggctggtggagccg

SEQ ID NO: 64773 - DNA, 201 bp, Homo sapiens
gtcgtgggagcctcaggaccctgagggagggaagctgttgctggcggatgtggccaagatgggctggatttatttagattaaggcggtgggaaaggagtgragaattgtacgtgctgggaggagggaagtctggggctctgagaatgactccccaagcatgcttgctctcctggacttggggcacccactcctctcccctg

SEQ ID NO: 64774 - DNA, 201 bp, Homo sapiens
tcgggggctgcatgccatgaaggcccagcccacatagccagcccagccttccagagccaggccagccccgctgcagtgacctcccttctcctggccagccrgccaaattcctcctttagaataataaacagtgtggccagccagggagactgggagaggaggggcagggaagctgaagtgaccccctcccccagcctctgc

SEQ ID NO: 64775 - DNA, 201 bp, Homo sapiens
gccctcaaaggtgggtagatgggagataaggtaggggacccggggggctgcggagtggaaccctggagctggcaggggtgatgtgtgctggtggcagggcrtgaagcaccaggcacactgccctgcccttcagctttagttttcaggatttccagtgggctctgtggaggcctccagctgccagcccttcagctcagaaag

SEQ ID NO: 64776 - DNA, 201 bp, Homo sapiens
gagactcgctcagtctcacagtgggtcccagggtgcttatgaggggagctgattgctctattcatagtaaagccagtccgagatccctggggtgcctacamcctccctacggcatccacactgcctgcctgtcctctccccacagcttgaatctgcctttttgctgtgtgactggggcatgcttctgtccttctctgggcc

SEQ ID NO: 64777 - DNA, 201 bp, Homo sapiens
tcctttgggattcagttggtgccctgcccccagggccccgcccctgacggtcaccccttgcagagagcggctacgtgcggctcctgggagaggtgggcacrctacaatttgctgagctgcatcggagccggacactgcaggtagtgttcgaggcctacccaccgcccactgtcctgtggttcaaagacaaccgcaccctgg

SEQ ID NO: 64778 - DNA, 201 bp, Homo sapiens
atgttggctaggttggtctcgatctctcaacctcgtgatccgcctggctcggcctcccaaagtgctgggattacaggcatgagccaccatgcccagccttkgtctaactcttaattgtatagatggggaaactgaggcccagagagggaaacaacttgtcaaagcccgcacagcaagtctgtggctgaatagtcatggaaa

SEQ ID NO: 64779 - DNA, 201 bp, Homo sapiens
cgagtacaaggctctgcgtgatgggctggcatttaggggaccaccctttgtcctctctgggcctcagtttccctgctggttctaggaggggatgggctggygctgtgagtttattttagcagcagagagctttatgaaatggaatcctacatggaagctgatcgattagatgcagggagggggcctagagcactgtctgtc

SEQ ID NO: 64780 - DNA, 201 bp, Homo sapiens
gactgttgggcgaaggttacaaaaaggtatgttgaggcagggtaggggtggagcacggagagctctggtgcagaagtcagacaccgagtacaaggctctgygtgatgggctggcatttaggggaccaccctttgtcctctctgggcctcagtttccctgctggttctaggaggggatgggctggcgctgtgagtttatttt

SEQ ID NO: 64781 - DNA, 201 bp, Homo sapiens
caccaggctggagtgtagtggcgtgatctcagctcactgcaacctccgcctcctgggttcaagcgattctcctgcctcggcctcctgagtagctgggactrcaggcacttgccaccatgtccagctaatttttgtatttttagtagagacggggtttcaccatgttggctaggttggtctcgatctctcaacctcgtgatc

SEQ ID NO: 64782 - DNA, 201 bp, Homo sapiens
ctgccagataccctcctcccatcccaggtgcagagtggggctgaggtccttccttgcactcagcacctgtcctgacctccctacagacctttttgcctttraagtggatggctccggagagcatcttcaacagcctctacaccaccctgagcgacgtgtggtccttcgggatcctgctctgggagatcttcaccttgggta

SEQ ID NO: 64783 - DNA, 201 bp, Homo sapiens
caccaggacgcaccctcggctctggggcctttgggcaggtggtggaggccacggctcatggcctgagccattctcaggccacgatgaaagtggccgtcaaratgcttaaatgtgagtagtccttggagccctccacatctgggccttcacctctccctgcccctccccacacacttagcctctcccagggtggcctgatgc

SEQ ID NO: 64784 - DNA, 201 bp, Homo sapiens
ccctggcctgcctgtgtcgtgggagcctcaggaccctgagggagggaagctgttgctggcggatgtggccaagatgggctggatttatttagattaaggcrgtgggaaaggagtggagaattgtacgtgctgggaggagggaagtctggggctctgagaatgactccccaagcatgcttgctctcctggacttggggcacc

SEQ ID NO: 64785 - DNA, 201 bp, Homo sapiens
ccaccaaggccaggccccgcctacccccccctcaggccttgcacaacagcacactcctgctggagggtccgtgcccacccgctccagcgccctcactgcgyggtcccagagggcggtggggtttagaaactcacaaaatcacaacaccttcaaggctgaaggattagtcaggtcaccagtcccagcagcttccagaccatg

SEQ ID NO: 64786 - DNA, 201 bp, Homo sapiens
tgaaatgcattctgatcctattagtctgtaatttcagtgttctgctttgagattttaccattctgtgattccaacattttaagcttcctgaatcaggattrcagcacctcatgatcccatctttctaaaattccagtcctgtggttccaacaccttaagatgtcaacattctaagcttacatctttctgacttgcccagca

SEQ ID NO: 64787 - DNA, 201 bp, Homo sapiens
gcatacgtatgtgtttcagaggagtgtgcgaggaagtgcgtaggcaggcatctgtgcatctgtgctgtgtgtatgtgctgaccatgtgcaggctccccccrtcaacccccgcagcaatgcagggccccctccctggcctgcctgtgtcgtgggagcctcaggaccctgagggagggaagctgttgctggcggatgtggcca

SEQ ID NO: 64788 - DNA, 201 bp, Homo sapiens
gggcagagaagccagcctttgcctgagggggatggagagcagaggagggccggagaggtcacataggtatttcagaaaggtccctctggctggggtgtgaraacaggtggaggggacagattggaggtgaggagattggcggtgggatagccagaggcagccgagcctgtgctggaggagggggtgcagggggcttagcag

SEQ ID NO: 64789 - DNA, 201 bp, Homo sapiens
ttcaatgctccccacccccacccacagttcatctcaaccctccctcttggcctaggggaactgcctgtgggtgaggatttacgagacctggtttgagtccyggctctgctaccaatgccgagatgaccttggcaagcccttcccctccctgggccttgttcctctttataccaggagggtggggagaactgtaagagtcct

SEQ ID NO: 64790 - DNA, 201 bp, Homo sapiens
gccagccgcatcgctgcccccacccccaagcacacgcactctgacgggtgagggggtgtttgctgcaggagagcggggctcgggctggggagatcagcccrttctttatcagcctggccccattccagacagatgtttcatcttattttggacttccagaaaataggtcatttctttccattgtgttccctggggaggcct

SEQ ID NO: 64791 - DNA, 201 bp, Homo sapiens
cctcccttgggcccccagcagccgtgaggcacacactgagcgctttcccacgcactgttccaagtagccagccgcatcgctgcccccacccccaagcacasgcactctgacgggtgagggggtgtttgctgcaggagagcggggctcgggctggggagatcagcccgttctttatcagcctggccccattccagacagatg

SEQ ID NO: 64792 - DNA, 201 bp, Homo sapiens
aggaggctgggagactgtgggtgatgtcagggatggaggagccagttttctcctttcccctgctctggggtgagtggcctccacctcatcatccctgctgytcctgccttcatcaaacaatcctcaggggtttctgggtgctgactgggggcctccaaagcacagcacagtcaatggggagtggggagagctgggaagagc

SEQ ID NO: 64793 - DNA, 201 bp, Homo sapiens
acttggggttccactctgtgccccggacttggggtcctcactctgctcccctaaggggtccctctgagtcacgtgaggagctgggcatgatctccactttrggcctctgagcctacaacctggccagaataggaggaatcaggaggggttcctggcacatagcactctcttcatgggcaaaagggggacacctaggggtgc

SEQ ID NO: 64794 - DNA, 201 bp, Homo sapiens
acttggggtccccactctgcttccttttgacttggagttcccagtctgctcccctggacttggggtccttactccgctcccctagacttggggccccccamtcctctcccctgaacttggggttccactctgtgccccggacttggggtcctcactctgctcccctaaggggtccctctgagtcacgtgaggagctgggca

SEQ ID NO: 64795 - DNA, 201 bp, Homo sapiens
cctgctgtacaatgtacatctgttagcaggtacacatacacgtgtaatttctgtgcgtatgaacaatgcctaccagtgtcttgatgcttttgtgtatctasctgcccgtccttatgcatacatgcacctgtatgagtgtgcttcatttattcacctttcttcttcattcgataaatatgaggacccaacttctcattgaag

SEQ ID NO: 64796 - DNA, 201 bp, Homo sapiens
gggaacagttccgaagaggagagccagctggagactaacgtgacgtactgggaggaggagcaggagtttgaggtggtgagcacactgcgtctgcagcacgkggatcggccactgtcggtgcgctgcacgctgcgcaacgctgtgggccaggacacgcaggaggtcatcgtggtgccacactgtgagtccccagcctcagtg

SEQ ID NO: 64797 - DNA, 201 bp, Homo sapiens
taaccgcattaaaatcccctcctctcctcaattcagatcagggctatttgatgtctcaggtgcctgaaaccttttatctgccagaggtaccagcttctccrccctgtgatggagagggctgtcccttgggagggtcagggggtctgaaagttcctgaatgtcagagatgaaaaggacttttgggggtcacctgatccaact

SEQ ID NO: 64798 - DNA, 201 bp, Homo sapiens
aaagaaaacactgaaaaacatcagctaagagattattttgaacagcatggaaaaatggaagtgattgaaatcatgactgaggcagtggcaagaaaaggggmtttgcctttgtaacctttgacgaccatgactccatggataagattgtcattccgaaataccatactgtgaatggccacaactgtgaagttaggaaagccc

SEQ ID NO: 64799 - DNA, 201 bp, Homo sapiens
taaaattaaaatatataatttacaacctcatgaaaacatataaagttcttagaagtggatataacaggctgggcacggtggctcatgcctgtaatcccagyactttgggaggccgaggcaggcggatcacgaggtgaggaggtcgagaccatcctggctagcacagtgaaaccccgtctctactaaaaaatagaaaaaatt

SEQ ID NO: 64800 - DNA, 201 bp, Homo sapiens
tgggcgcctgtagtcccagctactcgggaggctgaggcaggagaatcgcttgaacccgggaggcagacgttgcagtaagccattgcactccagcctgggcracaagagggaaactccgtctcaaaaaaaaaaaaaagaattagaaaaaagaaataaaactgtgtttagagcgaaaaatgtgactgtgtttatagacaatgt

SEQ ID NO: 64801 - DNA, 201 bp, Homo sapiens; identical to SEQ ID NO: 24788

SEQ ID NO: 64802 - DNA, 201 bp, Homo sapiens; identical to SEQ ID NO: 24821

SEQ ID NO: 64803 - DNA, 201 bp, Homo sapiens; identical to SEQ ID NO: 24823

SEQ ID NO: 64804 - DNA, 201 bp, Homo sapiens; identical to SEQ ID NO: 24824

SEQ ID NO: 64805 - DNA, 201 bp, Homo sapiens; identical to SEQ ID NO: 24825

SEQ ID NO: 64806 - DNA, 201 bp, Homo sapiens; identical to SEQ ID NO: 24826

SEQ ID NO: 64807 - DNA, 201 bp, Homo sapiens; identical to SEQ ID NO: 24828

SEQ ID NO: 64808 - DNA, 201 bp, Homo sapiens; identical to SEQ ID NO: 24827

SEQ ID NO: 64809 - DNA, 201 bp, Homo sapiens; identical to SEQ ID NO: 24830

SEQ ID NO: 64810 - DNA, 201 bp, Homo sapiens; identical to SEQ ID NO: 24798

SEQ ID NO: 64811 - DNA, 201 bp, Homo sapiens; identical to SEQ ID NO: 24832

SEQ ID NO: 64812 - DNA, 201 bp, Homo sapiens; identical to SEQ ID NO: 24799

SEQ ID NO: 64813 - DNA, 201 bp, Homo sapiens; identical to SEQ ID NO: 24834

SEQ ID NO: 64814 - DNA, 201 bp, Homo sapiens; identical to SEQ ID NO: 24800

SEQ ID NO: 64815 - DNA, 201 bp, Homo sapiens; identical to SEQ ID NO: 24836

SEQ ID NO: 64816 - DNA, 201 bp, Homo sapiens; identical to SEQ ID NO: 24801

SEQ ID NO: 64817 - DNA, 201 bp, Homo sapiens
aagaaaaagaaataaaagttataagaattagaaaaaagaaggctgggcacggtggctcacgcctgtaatcccagcattttgggaggccgaggcaggcgtaycacctgaggtcaggtgtttcagacctacctggccaacatggtaaaacccagtctctactaaaaatagaaaaattagccgagcatggtggtgggcgcctgt

SEQ ID NO: 64818 - DNA, 201 bp, Homo sapiens; identical to SEQ ID NO: 24838

SEQ ID NO: 64819 - DNA, 201 bp, Homo sapiens
tacctcaataaatctgttaattgtgctgtgctttcttttctgttttaaataaatatttgcttttgtgcctaaagtaaagtaaaataaaaatatgtagcagkatatctacaaaacctatacaaaacattctacttaagggtgaaatggaagaatcccctttgagattgggaattaggcaaggggatcactacttctaccttt

SEQ ID NO: 64820 - DNA, 201 bp, Homo sapiens
gccaccatgcccaacctaaagtgtgttactttagagcctctattccttggttgactccttgggtcacatacaaaacaatctaaatcttcttaaaaaaaatrtagataaactcatgtccccgataaacctctttccaggccaaattccctacactctttaaatcctcctaatataggatgctttcaactcattacatcatct

SEQ ID NO: 64821 - DNA, 201 bp, Homo sapiens
gcgtatcacctgaggtcaggtgtttcagacctacctggccaacatggtaaaacccagtctctactaaaaatagaaaaattagccgagcatggtggtgggcrcctgtagtcccagctactcgggaggctgaggcaggagaatcgcttgaacccgggaggcagacgttgcagtaagccattgcactccagcctgggcaacaag

SEQ ID NO: 64822 - DNA, 201 bp, Homo sapiens
gagccaccatgcccaacctaaagtgtgttactttagagcctctattccttggttgactccttgggtcacatacaaaacaatctaaatcttcttaaaaaaaatgtagataaactcatgtccccgataaacctctttccaggccaaattccctacactctttaaatcctcctaatataggatgctttcaactcattacatcat

SEQ ID NO: 64823 - DNA, 201 bp, Homo sapiens
gggttggttccaagtctttgctattgtaaatagtgctgcagtaaacacacacgtgcatgtgtctttatagtagaatgatttctaatcctttgggtatatamccagtaatgggattgctgggtcaaatggtatttctggttctagatccttgaggaatcaccgcactgtctttcacaatggttgaactaatttacactccca

SEQ ID NO: 64824 - DNA, 201 bp, Homo sapiens
catccatgtccctgcaaaggacatgaactcattcttttttatgactgcatactattccatggtatatatgtgccacattttctttatccagtctattattkatgggcatttgggttggttccaagtctttgctattgtaaatagtgctgcagtaaacacacacgtgcatgtgtctttatagtagaatgatttctaatcctt

SEQ ID NO: 64825 - DNA, 201 bp, Homo sapiens
aactcccacttatgagtgagaacatgcagtgtttggttttctgttcctgtgttagtttgctgaggatgatggtttccagcttcatccatgtccctgcaaakgacatgaactcattcttttttatgactgcatactattccatggtatatatgtgccacattttctttatccagtctattattaatgggcatttgggttggt

SEQ ID NO: 64826 - DNA, 201 bp, Homo sapiens
aattctgggagaatttacaaaaaagggaggttgatggtgagaagttttgtttatttattttaacttatttttattttactttaagttctgggatacatgtrctgaacgtgcaggtttgttacataggtatacatgtgccatggtggtttgctgcacctatcaacccataatctagtttttaagccctgcatgcattaggta

SEQ ID NO: 64827 - DNA, 201 bp, Homo sapiens
gggcgcggtggcgggcgcctgtagtcccagctactggggaggctgaggcagcagaatggcgtgaacccgggaagcggagcttgcagtgagccgagatcgcrccactgcactccagcctgggcaacagagcaagactccgtcttaaaaaaaataaaattaaaataagtaaataaataaataaataaacgaatgtcctcccaa

SEQ ID NO: 64828 - DNA, 201 bp, Homo sapiens
ccagcactttgggaggccgaggcgggtggatcacgaggtcaggagatcgacaccacagtgaaaccccgtctccactaaaaatgcaaaaaaaattagccggkcgcggtggcgggcgcctgtagtcccagctactggggaggctgaggcagcagaatggcgtgaacccgggaagcggagcttgcagtgagccgagatcgcgcc

SEQ ID NO: 64829 - DNA, 201 bp, Homo sapiens
gacgctgtaatcaagaccaaattaatacctttaaaggctctaagatttaaaagaaacaaatgggccaggcgcggtggcttacgcctgtaatcccagcactktgggaggccgaggcgggtggatcacgaggtcaggagatcgacaccacagtgaaaccccgtctccactaaaaatgcaaaaaaaattagccgggcgcggtgg

SEQ ID NO: 64830 - DNA, 201 bp, Homo sapiens
tttggacgctgtaatcaagaccaaattaatacctttaaaggctctaagatttaaaagaaacaaatgggccaggcgcggtggcttacgcctgtaatcccagmactttgggaggccgaggcgggtggatcacgaggtcaggagatcgacaccacagtgaaaccccgtctccactaaaaatgcaaaaaaaattagccgggcgcg

SEQ ID NO: 64831 - DNA, 201 bp, Homo sapiens; identical to SEQ ID NO: 24807

SEQ ID NO: 64832 - DNA, 201 bp, Homo sapiens; identical to SEQ ID NO: 24810

SEQ ID NO: 64833 - DNA, 201 bp, Homo sapiens; identical to SEQ ID NO: 24813

SEQ ID NO: 64834 - DNA, 201 bp, Homo sapiens; identical to SEQ ID NO: 24814

SEQ ID NO: 64835 - DNA, 201 bp, Homo sapiens; identical to SEQ ID NO: 24815

SEQ ID NO: 64836 - DNA, 201 bp, Homo sapiens; identical to SEQ ID NO: 24816

SEQ ID NO: 64837 - DNA, 201 bp, Homo sapiens; identical to SEQ ID NO: 24817

SEQ ID NO: 64838 - DNA, 201 bp, Homo sapiens; identical to SEQ ID NO: 24851

SEQ ID NO: 64839 - DNA, 201 bp, Homo sapiens; identical to SEQ ID NO: 24852

SEQ ID NO: 64840 - DNA, 201 bp, Homo sapiens
caaaagactgcagtctatggtaaaactgtgaataagttactgatgacatttaagtactccctagagatctccaggaagcaacctcaaatttagtcaatgcygcataatccataaacctgggaaatgcaaacattaagacaggtgaagcaatacagggtggaggggactattataatgtctagagccaacagaaggaaagca

SEQ ID NO: 64841 - DNA, 201 bp, Homo sapiens
ggtagcaaaaatcagagtgaagagaggttagttccaagacagaaacacattgtcaatctttactcaaagattgtccatcacctgctctctctccagcctarctagctcttttcaggcccgataggcacacattaatgggcctggctggaccacctatgagacagaaaagggtgatcccttccattagattaacaggctcag

SEQ ID NO: 64842 - DNA, 201 bp, Homo sapiens; identical to SEQ ID NO: 24853

SEQ ID NO: 64843 - DNA, 201 bp, Homo sapiens; identical to SEQ ID NO: 24854

SEQ ID NO: 64844 - DNA, 201 bp, Homo sapiens; identical to SEQ ID NO: 24855

SEQ ID NO: 64845 - DNA, 201 bp, Homo sapiens; identical to SEQ ID NO: 24856

SEQ ID NO: 64846 - DNA, 201 bp, Homo sapiens
tctatttggcccttcttttcacttgtccttccagccagtcaagttctccccaaagccatcatcatatatgtcaaccacagatcatcctccaggggaactgktatgctaaagtttctgagctagccaggctgaaatccaaatggcagccggcagatgtggcaacagtttgaaaagtgcactttgaaacagcttccttaccac

SEQ ID NO: 64847 - DNA, 201 bp, Homo sapiens; identical to SEQ ID NO: 24857

SEQ ID NO: 64848 - DNA, 201 bp, Homo sapiens
atctcagctcactgcaacctccgcctccagggctcaagcaattctcctgcctcagtctcccaggtagttagctgggattacaggtgcccgccaccatgccyggctaattttttgtgtttttagtagagatggggtttcaccacgttggccaggctggtctcaaactcctgagctcaagtgactcgcccgcctcggcctccc

SEQ ID NO: 64849 - DNA, 201 bp, Homo sapiens
tttttttttttttttgagacggagtcttgttctgtcacgcaggctggagtgcaatggcataatctcggcttactgcaacctccaccccctgggttcaagcrattctcctgcctcagcctcctgagtagctgagatcacaggcgtgccaccaccatgcccagctaatttttatatttttagtagaggcggggtttcaccatg

SEQ ID NO: 64850 - DNA, 201 bp, Homo sapiens; identical to SEQ ID NO: 24859

SEQ ID NO: 64851 - DNA, 201 bp, Homo sapiens
gtaattgaattgatagttactgttgtgacctgaagttcaccattaaaagggactacccaagcaaaatcatggaattattggttataaaaatgattgttggyacatcctatgcaatatatctaaattgaataatggtaccagataaaattatagatgggaatgaagcttgtgtatcatccattatcatgtgtaatcaataaa

SEQ ID NO: 64852 - DNA, 201 bp, Homo sapiens
aaatagaaaaaattagccaggcgtggtggcgggcgcctgtggtcccagctactcgggaggctgaggcaggagaatggcgtgaacccgggaggtggagcttscagtgagccgagattgcaccactgcactccagcctgggcgacagagcgagactccgtctcaaagaaaaaaaaaaaagaagaagaagtgaatataacaaag

SEQ ID NO: 64853 - DNA, 201 bp, Homo sapiens
acaggctgggcacggtggctcatgcctgtaatcccagcactttgggaggccgaggcaggcggatcacgaggtgaggaggtcgagaccatcctggctagcayagtgaaaccccgtctctactaaaaaatagaaaaaattagccaggcgtggtggcgggcgcctgtggtcccagctactcgggaggctgaggcaggagaatgg

SEQ ID NO: 64854 - DNA, 201 bp, Homo sapiens
tggaggaaacgtcagtggtcgtggtggctttggtggcagccatggtggtggtggatatggtggcagtggggatggctataatggatttggtaatgatggargcaatttggaggtggtggaagctacaatgattttggcaattacaacagtcagtcttcaaattttggacccgtgaagggaggaaactttggggcagaagct

SEQ ID NO: 64855 - DNA, 201 bp, Homo sapiens
gagaggtcgggaagtggaaaatcagtagggatgcaccataggaggtggtgattggaggcaggggaagtgcaggtttaggagtcagagggagccgcattcaytcaacaaatatagaagagaagggagaagagtgcaaagaccctgaggtgagaaccagcttgtcattttcagggaatagactgaaggtcaggagctatagtg

SEQ ID NO: 64856 - DNA, 201 bp, Homo sapiens
tgaggcaggagaatggcatgaacccagaaggcggagcttgcagtgagcccagatcgcgccactgcactccagcctgggcgacagagctaggctccgtttcaaaaaaaaaaaaaaaaaaaccttaggagagtcggagaaacagagagcagggagagaaatagagggaattcagtccacggaaaagtgtgatctatggcagca

SEQ ID NO: 64857 - DNA, 201 bp, Homo sapiens
agccctaagtcggtacctgactcagcccaggaagtcagggaggacttcttggaggaggagctgtgtgagctgagctctgaaggaagagctgggtgggcatrtcgggaagcggacattagtggcagggaaatggcatgcgcagaggcctgaggtgagggtaaggggggatggaacattggaggaacaggatgagagtcagca

SEQ ID NO: 64858 - DNA, 201 bp, Homo sapiens
aggagaatcacttgcatccggggggcaaaggttgcagtgagccaagatcacgccactgcacttcagcctgggcgacagagcaaaactccatctcaatcagtctcaatcaatcaatcaatcaatcaataaaagacatgtagggccgggcacagtggctcacgcctgtaatcccaacactttgggaggccaaggtgggcggat

SEQ ID NO: 64859 - DNA, 201 bp, Homo sapiens
aagggtcaggaaaggaatggggcaggcccaggcagaagggtcaggggtgggatggggacccaggcagagggttggggccaggatgaggaagcacaagcagwggggtcagggccaggatagggggccacaagaagctgtgggagccctaagtcggtacctgactcagcccaggaagtcagggaggacttcttggaggaggag

SEQ ID NO: 64860 - DNA, 201 bp, Homo sapiens
ggagaatcacttgcatccggggggcaaaggttgcagtgagccaagatcacgccactgcacttcagcctgggcgacagagcaaaactccatctcaatcagtctcaatcaatcaatcaatcaatcaataaaagacatgtagggccgggcacagtggctcacgcctgtaatcccaacactttgggaggccaaggtgggcggatc

SEQ ID NO: 64861 - DNA, 201 bp, Homo sapiens; identical to SEQ ID NO: 44381

SEQ ID NO: 64862 - DNA, 201 bp, Homo sapiens
gaggttgcagtggttgcagtgagccgagatcatgccactgcaccccagcctgggagacaagagtgagattcctactcaaaaaaaaaaaaaaaaaaaaaaawagaaaaaggaaaaagacacataggttaaggcaggagaatcacttgagcccaggagttggagaccagcctcggcaacctagcaaagccccatctttacaaa

SEQ ID NO: 64863 - DNA, 201 bp, Homo sapiens
caaagtgctgggattacaggcctgagccactgtgccctgccaatcctgtctccttttgatgcagccactgggtctttctaacacacatatctgctcctgtygctccctttttcaaaaccatccatgcatctcagggccccaggacacaaatgaactcctcagcctggtgtttgaccctctgcagggactggcccctgccag

SEQ ID NO: 64864 - DNA, 201 bp, Homo sapiens
tgagggtggtggacgaagctggggtcctgggtctgggcccagggaggatgcggcctgtgggaatgggcggggctttgtagatcagggggcggggtctggtrtgatggaggcaggacctaagtggatgctgggaggggtttagtgggtctgaggctgagcttaatcgatttaggtggagcctgagggtctggtgcgtgggtt

SEQ ID NO: 64865 - DNA, 201 bp, Homo sapiens
caggtgatccacccgcctcggtctcccaaagtgctgggattacaggtgtgagccactgcgcccggcctcagaacgttttcattactctcagaggtgccatrcttatactgctttgtaccttatacctttgtacccatatttattaagcagtcactctccatttcccccaacccctagcaaccaccaatttgttttctgtct

SEQ ID NO: 64866 - DNA, 201 bp, Homo sapiens
gggagatgcaggtaccctcagcacaagccccaaattacctgcaggggagaggcggaaaatcagacaatgtagaaaccgggagaagaaaggtatggacagaycgatgcagataggaggggaaggaaatacctggaaatgagatagagaccggctggacagaccccggggaccctgcaggtcaccacacccttctctttcagc

SEQ ID NO: 64867 - DNA, 201 bp, Homo sapiens
tgagtcagagggtggtaggaggtgaagaggaacaagggctatatcgtagtccttgtttaaatagctttcaagagactttagcgacaaaatagctaagatcygggactctggagcccttggcctaggtttgaatctcacttctgcccagctgtgtcactttgggcaagtcagttaacctttctggcctgttacctcatccgg

SEQ ID NO: 64868 - DNA, 201 bp, Homo sapiens
ctccttttgatgcagccactgggtctttctaacacacatatctgctcctgtcgctccctttttcaaaaccatccatgcatctcagggccccaggacacaamtgaactcctcagcctggtgtttgaccctctgcagggactggcccctgccagcccagccttaccggcctcagccacttgtcggtctccctacctctcaggc

SEQ ID NO: 64869 - DNA, 201 bp, Homo sapiens
tctccttttgatgcagccactgggtctttctaacacacatatctgctcctgtcgctccctttttcaaaaccatccatgcatctcagggccccaggacacaratgaactcctcagcctggtgtttgaccctctgcagggactggcccctgccagcccagccttaccggcctcagccacttgtcggtctccctacctctcagg

SEQ ID NO: 64870 - DNA, 201 bp, Homo sapiens; identical to SEQ ID NO: 44384

SEQ ID NO: 64871 - DNA, 201 bp, Homo sapiens
tttttcagaaatgggatttctactgccagtgagctcagcctaccgctggccctgccgtttcccctccttgggtttatgcaaatacaatcagcccagtgcaracggctcgtctccgtggtctttggggtggggtagggtagggtggggactgtacaaatgaaatgtttctctaggttgctgaatctaaccaattaacccgct

SEQ ID NO: 64872 - DNA, 201 bp, Homo sapiens
aaggcacatttttgaatacaggagatgggatggggtagatccttgagtaacaggtactggtgttaaggggagtgcagcatactgacaacccacaccaaaargtttgcaagggccaaccacaatggctcacacctgtaatcccagcattttgggaggccaaggtaggagcatcacttgagatcaggagttttagaccagcct

SEQ ID NO: 64873 - DNA, 201 bp, Homo sapiens
tagcttttaactcctcttccccaggttcagggagattactatggagatctggctgctcgcctgggctatttccccagtagcattgtccgagaggaccagaycctgaaacctggcaaagtcgatgtgaagacagacgtgagtgtcatgggggctggcaagaaatgtggggggaggacccttaggttgtggggatgggcaaaa

SEQ ID NO: 64874 - DNA, 201 bp, Homo sapiens
agtggtgtatgtcttctccaagctgaagggccgtgggcggctcttctggggaggcagcgtgagtcttgggagagtgaaagagggaagggtacagagctggrgtagactcattatccccatgaagggaagatttgaggggggtgaactgaaatagacattgtggggggatattgttacttactttattttatttgcttatta

SEQ ID NO: 64875 - DNA, 201 bp, Homo sapiens
ccaagttgggaggatagcttgagcccaggagttcgagaccagcctgggcaacatagcaagacccccatctctataaaaaaaaatttaaaattaactgggcwtcatggcatgtgtctgtggtcccggctactcgggaggctgaggtgggaggattgcttgatcccagaagttgaggctgcagtgagccgtgatcatgctact

SEQ ID NO: 64876 - DNA, 201 bp, Homo sapiens
gaaaacctaagcagcccaactaggggattgtagtgtcctctctagaccagtgggagggagccaatcggactacgcggaggatataaatcgcacagtaaagrttttcttggaagattatctggaaagggaggtgggaagtaacctgcgcctatctgcccagttttcctccttttcgcctttgagaacagtaatcgctcccgc

SEQ ID NO: 64877 - DNA, 201 bp, Homo sapiens
aacacactgtaggtcttcaggaaatgcctgcagagcagaaaagttgatagacacatagaaaccttaggagaggccgggcgtggtggctcatgcctgtaatyccagcattttgggaggccgaggcgggcggatcacgaggtcaggagatcgagaccatcctggctaacatggtgaaaccccgtctctactaaaaatacaaaa

SEQ ID NO: 64878 - DNA, 201 bp, Homo sapiens
cgactctgccccccgtactccagactaaatccgttcctcggctcagctaagcagctctgcacgtcccttcccacttgctcagccaatcgctgggctcggcyccgcccctttgggcttggtccttctcacgccaccaatccgcgcctcttgtcccgccccctgcccgcgagtccgccaatcccgcccttcggaaagcgtcgc

SEQ ID NO: 64879 - DNA, 201 bp, Homo sapiens
aacagaaagagagacagtgagaaatagggaactgaagacacacacgccaaggcaggagaaccgcttgagtccaggagtttgagaccagcctgggcaacatygtgaaatcccatctttccaaaagagagatggagaaatggacgtgttgtgggagagagagagagagaaatgcgtagggctcaacacactgtaggtcttcag

SEQ ID NO: 64880 - DNA, 201 bp, Homo sapiens; identical to SEQ ID NO: 44388

SEQ ID NO: 64881 - DNA, 201 bp, Homo sapiens
aggcaggcggatcacctgaggtcgggagtttgagaccagcctgaccaacatggagaaaccccgtctctactaaaaatacagaattagctgagtgtggtggygcatgcctgtaatcccagctactcgggaggctgaggcaggagaattgcttgaacctgggaggtggaggttgcggtgagccgagatcgcgccattgcactc

SEQ ID NO: 64882 - DNA, 201 bp, Homo sapiens
ctgggcccagggaggatgcggcctgtgggaatgggcggggctttgtagatcagggggcggggtctggtgtgatggaggcaggacctaagtggatgctgggwggggtttagtgggtctgaggctgagcttaatcgatttaggtggagcctgagggtctggtgcgtgggttaaatagatctggggcgggatttgagggagctg

SEQ ID NO: 64883 - DNA, 201 bp, Homo sapiens
ccctatccttgaaatggttctggtttcatagcaacttctaggtggtgtgggcgaagtttgggactggtttagggcggggacaagaccaagaacacaagttyccttgtactacgggagagagggaggggaggaaattggagaccccagcacccccttgctcactctcttgctcacagtccacgatggcccggtccctggtgt

SEQ ID NO: 64884 - DNA, 201 bp, Homo sapiens
aggaagagctgggtgggcatatcgggaagcggacattagtggcagggaaatggcatgcgcagaggcctgaggtgagggtaaggggggatggaacattggargaacaggatgagagtcagcaggtgagagctcagtggagggtggggactaactggggccctgacctcagagtgtgtgcccctgcagagctgatgttcctgg

SEQ ID NO: 64885 - DNA, 201 bp, Homo sapiens
ggaggcttctgaacagaggaaggacaggatcagattcaggggtgcagagagttcctctggctgcataaagggaaggggctgtgagggacagaggaggtcascaggacaccagagaggaagctgctgcaaagtccagggaagatggtggaggacaggacaagggggcgggaagaggagtggctgagaagggaatagggttca

SEQ ID NO: 64886 - DNA, 201 bp, Homo sapiens
gtcatcatggaggacctgtgtgtgttttgtgggtacagcatgagatggggtcaggggttggaggaagcagatcagttagggcctgtgggccctggggaggsctctggcttataccctgtgtgggagccatgggaggcttctgaacagaggaaggacaggatcagattcaggggtgcagagagttcctctggctgcataaag

SEQ ID NO: 64887 - DNA, 201 bp, Homo sapiens
aaaaaaaaaagaaagaaaggtcaggaccagatggggaggcactgggggagaggggtcagagccagcaggggagaggcccaggggggtcagggccagggtcrgggcacaggcagagggatcagggtgggatagggcaggcagaggcagaggggtcaggtgggatgaggggacacaggcagaggggttgcatttgatgggggg

SEQ ID NO: 64888 - DNA, 201 bp, Homo sapiens
ggttttctttccactgtttcccctttctctttttcagaaatgggatttctactgccagtgagctcagcctaccgctggccctgccgtttcccctccttggstttatgcaaatacaatcagcccagtgcaaacggctcgtctccgtggtctttggggtggggtagggtagggtggggactgtacaaatgaaatgtttctcta

SEQ ID NO: 64889 - DNA, 201 bp, Homo sapiens
gagaggcgaagagagagggacttcaaggatgcaagaagagagaggaattgcatggtgacccgaccaaggccaggttttgggggatgggccagcagtgaagkggggggcctccgaaccaccagtctgtctctgtagaggggggcattctcggggcagaccccagccttgggggtgactgggtccccctggccccacaggtca

SEQ ID NO: 64890 - DNA, 201 bp, Homo sapiens
tctccttcatcagttcattgagaataagtgtgagtttcccgcagtggtcctgggaaccctgagctgtgtttatgcgcatggtgtgggctggtgggcagccrgtggggagggcagggctggccataggtacaagtccagtgctggctttttggtccttgctttgtcgtatgtcctttactaggttctccttgacctcaagtc

SEQ ID NO: 64891 - DNA, 201 bp, Homo sapiens
gggcttgggcgttagcctgtgtggagggtgctgcattcccttctattccttccctagaccctatctccatggctgtggcccttcaggactacatggccccygactgccgattcctgaccattcaccggggccaagtggtgtatgtcttctccaagctgaagggccgtgggcggctcttctggggaggcagcgtgagtcttg

SEQ ID NO: 64892 - DNA, 201 bp, Homo sapiens
ggttgcagtggttgcagtgagccgagatcatgccactgcaccccagcctgggagacaagagtgagattcctactcaaaaaaaaaaaaaaaaaaaaaaaaaraaaaaggaaaaagacacataggttaaggcaggagaatcacttgagcccaggagttggagaccagcctcggcaacctagcaaagccccatctttacaaaaa

SEQ ID NO: 64893 - DNA, 201 bp, Homo sapiens
catcagagaggtgtgggtgtgaattcagctctgattttctgactgtggggccttgtcatgctgctgatgggtagactctggttggcctgttcctgtcctaratggtgctagagacacagtgttggagacagccctaggcccaaccttcatggagctcacagttcagtgggtgagggtggaaggacagacccacttccagac

SEQ ID NO: 64894 - DNA, 201 bp, Homo sapiens
ggtgactgggtccccctggccccacaggtcagtgacgcggagttattaccgaggggcggctggagccctgctggtgtacgacatcaccaggtgggtgcccrgggtgggtggggtagggcatgggtggttcctctcctgcactgcctccctcccttctcccttctccacagccgggagacatacaactcactggctgcctgg

SEQ ID NO: 64895 - DNA, 201 bp, Homo sapiens
ctggtgggcagccggtggggagggcagggctggccataggtacaagtccagtgctggctttttggtccttgctttgtcgtatgtcctttactaggttctcsttgacctcaagtcactccagcaaggagaatgggtttgtagagactgagagggccttggaggatgggggatcctctgagctgtctcctctctccctgtact

SEQ ID NO: 64896 - DNA, 201 bp, Homo sapiens
ctgcgacctccgcctcccgggttcaagtgagtctcctgcctcagcctcccaagtagctgggattacaggcatgtactgccacaaccagctaatttttgtattttttttttttttttggagatggagtctcgctttgttgcccaggctggagtgcagtggtgcagtctcggctcactgcaacctccgcctcctgggttcagg

SEQ ID NO: 64897 - DNA, 201 bp, Homo sapiens
gccaagatcgtaccactgcactccagcctgggctacagagcaagaccatcaaaaaaataaaaaataagacacacatgaaagagacacagagagaaaaacasacgaatggaaagatagggacacagggagagacaaaaatggagattcataaatagagacagctggccagctaagtgagatagaagctgagagaggcgaaga

SEQ ID NO: 64898 - DNA, 201 bp, Homo sapiens
ggttttagtgagccgagatcgcaccactgcactccagcctgggcgacagagctagactccgtctcacaaaaacaaaaacaaacaaaccaaaaaaaccaaamcaaaacaaaaaaactcctggcctcaagcaatcctccacctcagcctcccaaagtgctaagattacaggcatgagccaccgagcccagccaaccaatataa

SEQ ID NO: 64899 - DNA, 201 bp, Homo sapiens
tggtccttgctttgtcgtatgtcctttactaggttctccttgacctcaagtcactccagcaaggagaatgggtttgtagagactgagagggccttggaggrtgggggatcctctgagctgtctcctctctccctgtactgccccttctgttcctcctactcccagtcaaacaggactccaaccacacaatcggcgtggagt

SEQ ID NO: 64900 - DNA, 201 bp, Homo sapiens; identical to SEQ ID NO: 44404

SEQ ID NO: 64901 - DNA, 201 bp, Homo sapiens
ccttgggcttacagcctttaccctatccttgaaatggttctggtttcatagcaacttctaggtggtgtgggcgaagtttgggactggtttagggcggggayaagaccaagaacacaagtttccttgtactacgggagagagggaggggaggaaattggagaccccagcacccccttgctcactctcttgctcacagtccac

SEQ ID NO: 64902 - DNA, 201 bp, Homo sapiens
ttcaaaaccctgcaggatttggtcccatccctccttctctgggggatgtgtatgtcttgccagttctcccttctatacttcatgctaaatcccctcccagsccttggcagctccagggtgggacaggtggggaacaagtggttagaccttggatctacttggaaggcagagccaacgtgatttcctgatggaatggatgtg

SEQ ID NO: 64903 - DNA, 201 bp, Homo sapiens
caaatgaatgggtgtgtcttcttcacctcagggcttagcagagactctgtcctagagagtttgccctcagtaggtgaaatgtaacaaggcaaggcaaggcyttttcacactttgctgactgcaatctacaggaggaaatatattttatgtgttaatcaaggactgactgtagcagatcccacccacatataaaactcaaac

SEQ ID NO: 64904 - DNA, 201 bp, Homo sapiens
gtctccttcatcagttcattgagaataagtgtgagtttcccgcagtggtcctgggaaccctgagctgtgtttatgcgcatggtgtgggctggtgggcagcyggtggggagggcagggctggccataggtacaagtccagtgctggctttttggtccttgctttgtcgtatgtcctttactaggttctccttgacctcaagt

SEQ ID NO: 64905 - DNA, 201 bp, Homo sapiens
tgttcctggagaccagcgctctcacaggcgagaacgtggaggaggcgttcctcaagtgtgcccgcactatcctcaacaagattgactcaggtgaggccccraccggcccgagtgggagcgaagggcaggcccgggggtctccaggcaaccaatgctgacctctccccttccccacaggcgagctagacccggagaggatgg

SEQ ID NO: 64906 - DNA, 201 bp, Homo sapiens
agcaggtgagagctcagtggagggtggggactaactggggccctgacctcagagtgtgtgcccctgcagagctgatgttcctggagaccagcgctctcacwggcgagaacgtggaggaggcgttcctcaagtgtgcccgcactatcctcaacaagattgactcaggtgaggccccgaccggcccgagtgggagcgaagggc

SEQ ID NO: 64907 - DNA, 201 bp, Homo sapiens
tatatgatgcactctggtatttgccgttctgtgctattctgtttgaatttaaaaattggtcaagacccaccaaactgatttccccaccaaggcagtgacayacattagaatgacctggagaattttaaaagatactgatgcccaggcctcaccctagagattctgaagtggtttcaggactttttcttaattaaaagataa

SEQ ID NO: 64908 - DNA, 201 bp, Homo sapiens
tgtgagctgttgatgtgagtaaagacctttagaactgttcctggcccacaacaacacacaattgacccatgtaacaaacctgcacatgtgggctgggcgcrgtggctcatgcctgtaatcccagcactttgggaggctgaggcaggcggatcacctgaggtcgggagtttgagaccagcctgaccaacatggagaaacccc

SEQ ID NO: 64909 - DNA, 201 bp, Homo sapiens
cccccttgctcactctcttgctcacagtccacgatggcccggtccctggtgtgccttggtgtcatcatcttgctgtctgccttctccggacctggtgtcaggggtggtcctatgcccaagctggctgaccggaagctgtgtgcggaccaggagtgcagccgtaagaatggggaggggagaattgggggcttgggcgttagc

SEQ ID NO: 64910 - DNA, 201 bp, Homo sapiens
gaattgaggggcacgcaggattctgagcaccaggggcagaggcggccagacaacctcagggaggagtgtcctggcgtccccatcctccaaagggcctgggmccgccccgagggggcagcgagaggagcttccccatccccggtcagtccaccctgccccgtccactttcccatctcctcggtataaatcatgtttataagt

SEQ ID NO: 64911 - DNA, 201 bp, Homo sapiens
tgaggcccaaggtcacggtgtcagcaaggtgtcagcaaggttccttgggtatgggacccaaagcctccggatcccagcctggagcaattagagtagtagtrgtggtggagatttatggagttctgttctggtgttcattatacgttaactcattagatccttgggacaattctgtgtggtgagggtcccatctttcagatg

SEQ ID NO: 64912 - DNA, 201 bp, Homo sapiens; identical to SEQ ID NO: 45346

SEQ ID NO: 64913 - DNA, 201 bp, Homo sapiens
tggtagtgattttttttttcttttcttcccctgccccacctcacatacctctgccctgagacgcagtctctgttgcccaggccagagtgcagtggcacagkgtcagctcacctcaacctccaccttctgggttcaagtgattctcctgtctcagcctcccaagtagctgggattacaggcacgcactgccacacccggcta

SEQ ID NO: 64914 - DNA, 201 bp, Homo sapiens
ttctggatgttgtttgaaggcagagctgccaggatttgttgagaccggatggaggcgatgactctgtagtttttggctggaactggaaggatggagtttcrgattgccagctttgtgtctttgtgcagccatccactgtgtcgtggagagcaggctcttgagcgctgagtcctgagtgaatgactcgtgcaggcggggagg

SEQ ID NO: 64915 - DNA, 201 bp, Homo sapiens
tggggctttcggaaaccaaggcatagcttctcacaggaccctgcagctggcgtagagagcagactccaaagggggtaccactgggagggagtggacggggrgaggaggttggattctggatgttgtttgaaggcagagctgccaggatttgttgagaccggatggaggcgatgactctgtagtttttggctggaactggaa

SEQ ID NO: 64916 - DNA, 201 bp, Homo sapiens
gagcaccaggggcagaggcggccagacaacctcagggaggagtgtcctggcgtccccatcctccaaagggcctgggcccgccccgagggggcagcgagagsagcttccccatccccggtcagtccaccctgccccgtccactttcccatctcctcggtataaatcatgtttataagttatggaagaaccgggacattttac

SEQ ID NO: 64917 - DNA, 201 bp, Homo sapiens
tcacccgtggggcaggggacagactgttcccagagagtaacaagccaggatgggcaaggctgacatgggggaacccaaaggtcggggagcctaactcagcytaggtggtcagagagcacttcgtggaggaggggacccccatccgaggctttctgaccctaggcttctcaccccggcccatctcacatacttgcacagtgc

SEQ ID NO: 64918 - DNA, 201 bp, Homo sapiens
gagactccatctcaaaaaaaaaaaaaaaaaattaaatttcttattttttgaaacaggatctctgttgcccacgttggagtgcagtggcgtgatcatagctyagtgtaaccttgaccttctgagctcaagtgatcctcctgcctcagcctcccaagtagctgggactataagcatgtgccatcatgcctggctacgttttta

SEQ ID NO: 64919 - DNA, 201 bp, Homo sapiens
tctcactctgtcactcaggctggagtgcagtggcactatcatggctcactgcagcctccacctcctgggcttaagcaatcctcccacgtccacccccttastacctgggactacaggtgtgcaccacctcacccaactaatttttgtattcgctatgtttcccaagctggtttcgaattcctgggctcaaatgaacccact

SEQ ID NO: 64920 - DNA, 201 bp, Homo sapiens
ttcccaagctggtttcgaattcctgggctcaaatgaacccactttggcctcccaaactgctgggattacaacaagcatgagccactgtgcctggccttgatttttttttttttttatgataatctgtagttagatgaagtttttaaattttttgtagagatggggtctcactatgtcacctaggcttgtctccaactgctg

SEQ ID NO: 64921 - DNA, 201 bp, Homo sapiens
aagctggagctttgtccatcccctcttatttttctgcacttgactctcttatttttctgagactggtctccctctgtcgcccaggctagagtgcagcagtscaactgcggctcactgcagcctccacctcccgggctcaagcagccttcccacctcagcctcctgagtagctaggaccacaggtgtatgccaccaggccca

SEQ ID NO: 64922 - DNA, 201 bp, Homo sapiens
acagagcgagactccatctcaaaaaaaaaaaaaaaaaattaaatttcttattttttgaaacaggatctctgttgcccacgttggagtgcagtggcgtgatyatagctcagtgtaaccttgaccttctgagctcaagtgatcctcctgcctcagcctcccaagtagctgggactataagcatgtgccatcatgcctggctac

SEQ ID NO: 64923 - DNA, 201 bp, Homo sapiens
tgggcaagcctatctgtccagtatcgtcacagctctcgctttccttccaggtcaaccacacagtagccctcagcacaatcggggagtccaactaccacttyggggtcacatatgtggggacaaagcagctgagtcccacagaggtgagcttcctttttcatccattcattgtatccttctaataacaaatttgtagccaaa

SEQ ID NO: 64924 - DNA, 201 bp, Homo sapiens
ccagcctgggtgacagagcaagactccatctcaaaaaaaaaaaagtaggtggacaaccctctactatgttttatgcttggaaaaaaaaagtaggtagagcrgccaggcgtggtgactcacgcctgtaatcccagcattttgggaggccaagccaggtagaatacttgaggccaggagttggagaccagcctggccaacgtg

SEQ ID NO: 64925 - DNA, 201 bp, Homo sapiens
caggggccgccgaggatggggcctgcggctgcctgcccaacccgggcacattcgaggagtgccaccggaagtgcaagggtgaggggcgaggggcccccgckgggctgcgatggcctggatctcgggggaagggggaggacactggggactctgggatttggcgcgcaccattggaattatttaacagcactaggaggtgat

SEQ ID NO: 64926 - DNA, 201 bp, Homo sapiens
ctatagtcccaactactgaggctgaggcgggaaaatggtatgaacccaggaggcggagcttgcggtgagccgagatcgtgccaccgcactccagcctgggygacagagcaagactccatctcaaaaaaaaaaaagtaggtggacaaccctctactatgttttatgcttggaaaaaaaaagtaggtagagcagccaggcgtg

SEQ ID NO: 64927 - DNA, 201 bp, Homo sapiens
cgcaacatactaccacaaagccagtgaccaggtgagtgggtgcagggactagctggtgctgccaggggctgctgggcctggaagtccaggtggggccactygctaattctcatgtgttgctccggcccctccagctgcaggtgggtgtggagtttgaggccagcacaaggatgcaggacaccagcgtctccttcgggtacc

SEQ ID NO: 64928 - DNA, 201 bp, Homo sapiens
cggtagggaacccctgggcgatgggttaggagaagggagcccttgagggaggcctgagagcaagcccaagcctccagccggggtgagcctagagggcttcytggaggtggagtctagcctggcactcagggtgggtggaaactgatcgtcattttgcccacaggaatcctcgtagcccactacctccagagcatcacgcct

SEQ ID NO: 64929 - DNA, 201 bp, Homo sapiens
ttgtgtcgaccagatgaggtccttcaggtaatgcagtcatagcagggcctgggacgctgacctcagcggtagggaacccctgggcgatgggttaggagaarggagcccttgagggaggcctgagagcaagcccaagcctccagccggggtgagcctagagggcttcctggaggtggagtctagcctggcactcagggtggg

SEQ ID NO: 64930 - DNA, 201 bp, Homo sapiens
ccagcagctgaggaggggattctggaactgaatggcgcttcgggattctgagtagcaggggcagcatgcccagtgggcctggggtcccgggagggattccrgaattgaggggcacgcaggattctgagcaccaggggcagaggcggccagacaacctcagggaggagtgtcctggcgtccccatcctccaaagggcctggg

SEQ ID NO: 64931 - DNA, 201 bp, Homo sapiens
gggaggagtgtcctggcgtccccatcctccaaagggcctgggcccgccccgagggggcagcgagaggagcttccccatccccggtcagtccaccctgcccygtccactttcccatctcctcggtataaatcatgtttataagttatggaagaaccgggacattttacagaaaaaaaacaaaaaacaacaaaaaatatacgt

SEQ ID NO: 64932 - DNA, 201 bp, Homo sapiens
gccactggagaagtggctcagcaggagtgattttgaaacatcaggcaacatactacagtgggtgagacggtcacccactgaccatgagtgggtgagtcagmgcagtcttttttttttttttttttgagatggagtcttgctttatcacccaggttggagtgccgtggcacgatcttggctcactgcaacctccatctcctg

SEQ ID NO: 64933 - DNA, 201 bp, Homo sapiens
cgggaaacaggcaggaggtgactcaactctgagtggatgtgtgggccaccacaggtgctggaggacagtgtgctgccaccctgtgggcctccacattaccrgggaacacttgttaaaaggtaggtggggccgggtgcggtggctcacgcctgtaatcccagcactttgggaggccaaggcgggccgaggtaaggagattga

SEQ ID NO: 64934 - DNA, 201 bp, Homo sapiens
ctttttgagatgaagtcttgcactgtctcccaggctggagtgcagtggcacaatcacaatctcagcttactgcaacttccgcctcccgggttcaagcgatyctcctgcctcagcctcctgagtagctgggactacaggtgtgcaccaccacactcagctaatgtttgtatttttagtagagacagggtttcaccatgttgg

SEQ ID NO: 64935 - DNA, 201 bp, Homo sapiens
ggagtttgaggccagcacaaggatgcaggacaccagcgtctccttcgggtaccagctggacctgcccaaggccaacctcctcttcaaaggtaaaggtctckgttcccctacgcgggaaacaggcaggaggtgactcaactctgagtggatgtgtgggccaccacaggtgctggaggacagtgtgctgccaccctgtgggcc

SEQ ID NO: 64936 - DNA, 201 bp, Homo sapiens
agtcccagctactcggagaggctgaggcaggagaatggcgtgaacccgggaggtggagcttgcagtgagccgagatagtgccactgcactccagcctgggygacagagcgagactccatctcaaaaaaaaaaaaaaaaaattaaatttcttattttttgaaacaggatctctgttgcccacgttggagtgcagtggcgtga

SEQ ID NO: 64937 - DNA, 201 bp, Homo sapiens
caaggtcacaactaaatccagaacctcatctcaggcacactggtcgtagtcccaatgtccagtcttaagtcttcttggatatctgtggctcacagattttrggtgtttgagcctcctgctgagcactgctggggccacagcggtgaccagccctgtcttcacgggactcagtgagaggaacagattcatccgcagagtggg

SEQ ID NO: 64938 - DNA, 201 bp, Homo sapiens
tttcctgtccccaactcacctggtgacatcaccccatcttctcatacactacagttgaaccacatgagccttttttgttggtttgtttttgtttttgagayggagtcttgctctgttgcccaggctggagtgctgtggtgcaatctcggctcactgcaacctctgcctccctggttcaagcgattctcctgcctcaggctc

SEQ ID NO: 64939 - DNA, 201 bp, Homo sapiens
tcttcgcacctgctttgctctgtgctgtctcagcttctctgtgtgccctcagtctcgtggcccccaacctcccttcccttctccacgtgtcttcctctccrgggctgcaccctaggagattgctcgatcgtggtggatttctcaactgtgaatcttcagtccctcttcccccttcatttctgtctctgcagatgtgttgtt

SEQ ID NO: 64940 - DNA, 201 bp, Homo sapiens
catggcagaaaacccaggagacagggaagctggaggtgcagcaggtgcagagaggcctcctaggtgaggctgatctgtaggggccccatgaggaagaaacmtttcctgtccccaactcacctggtgacatcaccccatcttctcatacactacagttgaaccacatgagccttttttgttggtttgtttttgtttttgaga

SEQ ID NO: 64941 - DNA, 201 bp, Homo sapiens
aaggggctaccccggctgggggacaggagcaagaagattccaggcagggagaagcaggaacaggggtgagggaagggaagggccatggcagaaaacccagsagacagggaagctggaggtgcagcaggtgcagagaggcctcctaggtgaggctgatctgtaggggccccatgaggaagaaacatttcctgtccccaactc

SEQ ID NO: 64942 - DNA, 201 bp, Homo sapiens
gcagactccaaagggggtaccactgggagggagtggacggggagaggaggttggattctggatgttgtttgaaggcagagctgccaggatttgttgagacyggatggaggcgatgactctgtagtttttggctggaactggaaggatggagtttcggattgccagctttgtgtctttgtgcagccatccactgtgtcgtgg

SEQ ID NO: 64943 - DNA, 201 bp, Homo sapiens
caatcggggagtccaactaccacttcggggtcacatatgtggggacaaagcagctgagtcccacagaggtgagcttcctttttcatccattcattgtatcyttctaataacaaatttgtagccaaatgtcaagctaagacggcctcatcaggaaaaggtcacagctaccgagagcctggagatggggattgcatctctccg

SEQ ID NO: 64944 - DNA, 201 bp, Homo sapiens
agagctgggctccctgatacttgaaaagactcggagatatagtgccagactgactactcagtttggggacctagaatccagaggtactgtctccccatagsagctaggctggagtgaaggaacaggtctgtgggcctaccggcagcacctcctttctctgagtctcttagtcaggccgtgcctcccagtcttcatcccctg

SEQ ID NO: 64945 - DNA, 201 bp, Homo sapiens
gccttgcctggccctgggtggagagctggtctaccaccggcggcctggagaggagggcactgtcatgtctctagctgggaaatacacatgtgagcctggcrcctgggtccgagggtggaggggctgggcccctggactcctcctgggtctgagggaggacgggctagggccctggacactcaggtctgagggaggaggcct

SEQ ID NO: 64946 - DNA, 201 bp, Homo sapiens
ccagagatcgtccccgccgtccccctccctgcatctgcacactcggcccaattactcctccctcaagagctgggctccctgatacttgaaaagactcggaratatagtgccagactgactactcagtttggggacctagaatccagaggtactgtctccccatagcagctaggctggagtgaaggaacaggtctgtgggcc

SEQ ID NO: 64947 - DNA, 201 bp, Homo sapiens
gttggagtggagtgtgacagcgtttctcttctccagagctgtttcccattcagatggagggtgtcaagctcacagtcaacaaagggttgagtaaccatttycaggtgagccttcctggtgtccttacccaccagagatcgtccccgccgtccccctccctgcatctgcacactcggcccaattactcctccctcaagagct

SEQ ID NO: 64948 - DNA, 201 bp, Homo sapiens
tctttacaggtggaatcctttgtgagatgttctgctgtgggtctctggagagagctgggggtggtagggaaggaagagatgagagttggtgtggggttggrgtggagtgtgacagcgtttctcttctccagagctgtttcccattcagatggagggtgtcaagctcacagtcaacaaagggttgagtaaccattttcaggt

SEQ ID NO: 64949 - DNA, 201 bp, Homo sapiens; identical to SEQ ID NO: 30850

SEQ ID NO: 64950 - DNA, 201 bp, Homo sapiens
ctgcaatctttttaaaggaaccagattctgaaatttgccaagaggcagggtcccatagtttctcatcataggtaactttctgttggaactcctcttctgcwctcctactcttcttcctgccctgagttgtagtaatcctagtgctggctccaatagaaactcatcaatttataaagcagagtctagtttagattcatatgt

SEQ ID NO: 64951 - DNA, 201 bp, Homo sapiens; identical to SEQ ID NO: 30851

SEQ ID NO: 64952 - DNA, 201 bp, Homo sapiens; identical to SEQ ID NO: 31590

SEQ ID NO: 64953 - DNA, 201 bp, Homo sapiens; identical to SEQ ID NO: 31259

SEQ ID NO: 64954 - DNA, 201 bp, Homo sapiens; identical to SEQ ID NO: 31260

SEQ ID NO: 64955 - DNA, 201 bp, Homo sapiens
tccatctctgactataaggccaccctgaggtgctgggccctgggcttctaccctgtggagatcacactgacctggcagcaggatggagaggaccagactcrggacatggagcttgtagagaccaggcctgcaggggatggaaacttccagaagtgggcagctgtggtggtgccttctggagaggaacagagatacatgtgc

SEQ ID NO: 64956 - DNA, 201 bp, Homo sapiens
ccagaagtgggcagctgtggtggtgccttctggagaggaacagagatacatgtgccatgtgcagcatgaggggttgcccaagcccctcaccctgagatggrgttaggcaggagatgagtggagggggggtcatgtctcttagggaaagcaggagcctctctggagaacttcagcagggtcggtgctgggggctgagggtca

SEQ ID NO: 64957 - DNA, 201 bp, Homo sapiens
gaagtgggcagctgtggtggtgccttctggagaggaacagagatacatgtgccatgtgcagcatgaggggttgcccaagcccctcaccctgagatggagtwaggcaggagatgagtggagggggggtcatgtctcttagggaaagcaggagcctctctggagaacttcagcagggtcggtgctgggggctgagggtcaggg

SEQ ID NO: 64958 - DNA, 201 bp, Homo sapiens
tgggcagctgtggtggtgccttctggagaggaacagagatacatgtgccatgtgcagcatgaggggttgcccaagcccctcaccctgagatggagttaggyaggagatgagtggagggggggtcatgtctcttagggaaagcaggagcctctctggagaacttcagcagggtcggtgctgggggctgagggtcagggacgc

SEQ ID NO: 64959 - DNA, 201 bp, Homo sapiens
ggcagctgtggtggtgccttctggagaggaacagagatacatgtgccatgtgcagcatgaggggttgcccaagcccctcaccctgagatggagttaggcargagatgagtggagggggggtcatgtctcttagggaaagcaggagcctctctggagaacttcagcagggtcggtgctgggggctgagggtcagggacgctc

SEQ ID NO: 64960 - DNA, 201 bp, Homo sapiens
gaacttcagcagggtcggtgctgggggctgagggtcagggacgctcaccttccccttttttcccagagcagtcttctcagcccaccatccccatcgtgggyatcgttgctggcctggttctccttggagctgtagtcactggagctgtggtttctgctgtgatgtgcaggaagaagaactcaggtaaggaatggatgagga

SEQ ID NO: 64961 - DNA, 201 bp, Homo sapiens; identical to SEQ ID NO: 30966

SEQ ID NO: 64962 - DNA, 201 bp, Homo sapiens
tgtggtggtgccttctggagaggaacagagatacatgtgccatgtgcagcatgaggggttgcccaagcccctcaccctgagatggagttaggcaggagatkagtggagggggggtcatgtctcttagggaaagcaggagcctctctggagaacttcagcagggtcggtgctgggggctgagggtcagggacgctcaccttc

SEQ ID NO: 64963 - DNA, 201 bp, Homo sapiens
agcagggtcggtgctgggggctgagggtcagggacgctcaccttccccttttttcccagagcagtcttctcagcccaccatccccatcgtgggtatcgttrctggcctggttctccttggagctgtagtcactggagctgtggtttctgctgtgatgtgcaggaagaagaactcaggtaaggaatggatgaggagtggggt

SEQ ID NO: 64964 - DNA, 201 bp, Homo sapiens; identical to SEQ ID NO: 30968

SEQ ID NO: 64965 - DNA, 201 bp, Homo sapiens; identical to SEQ ID NO: 30969

SEQ ID NO: 64966 - DNA, 201 bp, Homo sapiens
gagatttcttgtcccactgagggtttcaagccccagttagaagtgtgtcctgcctggttactgggaagcaccatccacactcatgggcctacccagcctgsgccctgtgtgccagcacttactcttttgtaaagcacctgtgacaatgaaggacagatttatcaccttgatgattatgatgatggggacctgatcccagca

SEQ ID NO: 64967 - DNA, 201 bp, Homo sapiens; identical to SEQ ID NO: 30970

SEQ ID NO: 64968 - DNA, 201 bp, Homo sapiens
tcttgtcccactgagggtttcaagccccagttagaagtgtgtcctgcctggttactgggaagcaccatccacactcatgggcctacccagcctgggccctstgtgccagcacttactcttttgtaaagcacctgtgacaatgaaggacagatttatcaccttgatgattatgatgatggggacctgatcccagcagtcaca

SEQ ID NO: 64969 - DNA, 201 bp, Homo sapiens
ccctccactattgtcccatgaccctgccaaatccccctctgtgagaaacacccaagaatgatcaataaaaaaaaaaaaaagaattgaggagcaagcttcayattcagaatccagtggctgaggaagtatccatatccctaagagaaagaaccttgggacaccatgactgttacatgctgggacaattccatcagcccttct

SEQ ID NO: 64970 - DNA, 201 bp, Homo sapiens
tccagatcctgtacaagagagtgactctgagggtctgccctgctctctgatacaattaagggatgaaatctctgaggaaatgaagggaagacaatccctgraatactgatgaggggttccctttgacactggcagcagccttgggccccgttacttttcctctcaggccttgctctctgctttacactcaatgtgtgtggg

SEQ ID NO: 64971 - DNA, 201 bp, Homo sapiens
gggataagtgttaacattgggtgtgagctaacattgctgcccagattcccacagcaccattatgtccctatcacagtggggcttacagaggccagggaatwaacctggacaaattatgccccacggtggaatcactgggtccataaatcctgtcctggttatctccccattctctgtaaaaaggattctctgtaaaaagat

SEQ ID NO: 64972 - DNA, 201 bp, Homo sapiens; identical to SEQ ID NO: 30971

SEQ ID NO: 64973 - DNA, 201 bp, Homo sapiens
tgagctaacattgctgcccagattcccacagcaccattatgtccctatcacagtggggcttacagaggccagggaataaacctggacaaattatgccccayggtggaatcactgggtccataaatcctgtcctggttatctccccattctctgtaaaaaggattctctgtaaaaagattacatcgccctaaaccaggacct

SEQ ID NO: 64974 - DNA, 201 bp, Homo sapiens
atgccccacggtggaatcactgggtccataaatcctgtcctggttatctccccattctctgtaaaaaggattctctgtaaaaagattacatcgccctaaascaggacctgagctcttggactgcggcggccatggcggctcagattacccagcgcaagtgggaggcggcccatgaggcggagcagcagacagcctacctgg

SEQ ID NO: 64975 - DNA, 201 bp, Homo sapiens
atgaatattttattttatagtgtgagacagctgccttgtgtgggactgagaggcaagatttgttcacgccttccctttgtgacttcaaaaaccctgactcwctttctgcaaaggcacctgaatgtgcctgtgttcctgtaggcataatatgaggaggtggggagaccaacccacccccatgtccaccatgaccctcttccc

SEQ ID NO: 64976 - DNA, 201 bp, Homo sapiens
ctgaccgagacctgggcgggtgagtgcgggatccggagggaaatggcctctgcggggaggagctaggggcccgcgcactggggcgcaggacccggggagcmgcgcaaggaggagggtcggacgggtctcagcccctcctcgcccccaggtacccactccataaggtatttcagcaccgccgtgtcccggccgggtcgcggg

SEQ ID NO: 64977 - DNA, 201 bp, Homo sapiens; identical to SEQ ID NO: 31335

SEQ ID NO: 64978 - DNA, 201 bp, Homo sapiens
tgtcctgcctggttactgggaagcaccatccacactcatgggcctacccagcctgggccctgtgtgccagcacttactcttttgtaaagcacctgtgacamtgaaggacagatttatcaccttgatgattatgatgatggggacctgatcccagcagtcacaagtcacaggggaaggtccctgctgaggacagacctcagg

SEQ ID NO: 64979 - DNA, 201 bp, Homo sapiens; identical to SEQ ID NO: 31336

SEQ ID NO: 64980 - DNA, 201 bp, Homo sapiens
ttatcaccttgatgattatgatgatggggacctgatcccagcagtcacaagtcacaggggaaggtccctgctgaggacagacctcaggagggcagttggtycaggacccacacctgctttcctcatgtttcctgatcctgtcctagatcagcagttacactttcaggaaacttctctgggatcaaaggctagggggtttgt

SEQ ID NO: 64981 - DNA, 201 bp, Homo sapiens
atggggacctgatcccagcagtcacaagtcacaggggaaggtccctgctgaggacagacctcaggagggcagttggtccaggacccacacctgctttcctyatgtttcctgatcctgtcctagatcagcagttacactttcaggaaacttctctgggatcaaaggctagggggtttgtttagggccgtatggccctgactc

SEQ ID NO: 64982 - DNA, 201 bp, Homo sapiens
tcacaagtcacaggggaaggtccctgctgaggacagacctcaggagggcagttggtccaggacccacacctgctttcctcatgtttcctgatcctgtcctrgatcagcagttacactttcaggaaacttctctgggatcaaaggctagggggtttgtttagggccgtatggccctgactcctttctggcctctcataggac

SEQ ID NO: 64983 - DNA, 201 bp, Homo sapiens
tgccccacggtggaatcactgggtccataaatcctgtcctggttatctccccattctctgtaaaaaggattctctgtaaaaagattacatcgccctaaacsaggacctgagctcttggactgcggcggccatggcggctcagattacccagcgcaagtgggaggcggcccatgaggcggagcagcagacagcctacctgga

SEQ ID NO: 64984 - DNA, 201 bp, Homo sapiens
cagacctcaggagggcagttggtccaggacccacacctgctttcctcatgtttcctgatcctgtcctagatcagcagttacactttcaggaaacttctctrggatcaaaggctagggggtttgtttagggccgtatggccctgactcctttctggcctctcataggacattttcttcccacagatagagtgagctactctg

SEQ ID NO: 64985 - DNA, 201 bp, Homo sapiens
gggtccataaatcctgtcctggttatctccccattctctgtaaaaaggattctctgtaaaaagattacatcgccctaaaccaggacctgagctcttggacygcggcggccatggcggctcagattacccagcgcaagtgggaggcggcccatgaggcggagcagcagacagcctacctggagggcaggtgcgtggagtggc

SEQ ID NO: 64986 - DNA, 201 bp, Homo sapiens
atcgccctaaaccaggacctgagctcttggactgcggcggccatggcggctcagattacccagcgcaagtgggaggcggcccatgaggcggagcagcagasagcctacctggagggcaggtgcgtggagtggctccgcagatacctggagaacaggaaggagacactgcagcacacctgtaccagggaccacgggcgcctc

SEQ ID NO: 64987 - DNA, 201 bp, Homo sapiens
taagtatgaagtgggctgatccctgagatccttgggatattgtggtcgggagcccatgggggagctcacccaaccccagattcctcctctagccgcatctyctctgggctctgaccaagtcctgtttttgttctaccccaggcagcgaccatgcgcagggttctgatgtgtctctcacggcttgtaaaggtgagacgctgg

SEQ ID NO: 64988 - DNA, 201 bp, Homo sapiens
ctgagctcttggactgcggcggccatggcggctcagattacccagcgcaagtgggaggcggcccatgaggcggagcagcagacagcctacctggagggcasgtgcgtggagtggctccgcagatacctggagaacaggaaggagacactgcagcacacctgtaccagggaccacgggcgcctccctgatcgcctgtaatct

SEQ ID NO: 64989 - DNA, 201 bp, Homo sapiens
gtatgaagtgggctgatccctgagatccttgggatattgtggtcgggagcccatgggggagctcacccaaccccagattcctcctctagccgcatctcctstgggctctgaccaagtcctgtttttgttctaccccaggcagcgaccatgcgcagggttctgatgtgtctctcacggcttgtaaaggtgagacgctggggg

SEQ ID NO: 64990 - DNA, 201 bp, Homo sapiens
ggggctgtgcccagtgggtgctcaggccaccgtgcgctttatgtggtcactgctcagctgggtcatctttgctgctccgttgtccttggctgtatgatccrgccctacggggcttagcgggttttctccccgtgtgcggagatgagagattgtaataaataaaagcacaagacaaagagataaagagaaaacagctgggcc

SEQ ID NO: 64991 - DNA, 201 bp, Homo sapiens; identical to SEQ ID NO: 30984

SEQ ID NO: 64992 - DNA, 201 bp, Homo sapiens
cgggagcccatgggggagctcacccaaccccagattcctcctctagccgcatctcctctgggctctgaccaagtcctgtttttgttctaccccaggcagcraccatgcgcagggttctgatgtgtctctcacggcttgtaaaggtgagacgctgggggacctgatgtgtggggggtgttgggggcaatagtggatgcagct

SEQ ID NO: 64993 - DNA, 201 bp, Homo sapiens
gattacccagcgcaagtgggaggcggcccatgaggcggagcagcagacagcctacctggagggcaggtgcgtggagtggctccgcagatacctggagaacrggaaggagacactgcagcacacctgtaccagggaccacgggcgcctccctgatcgcctgtaatctcccgggctggcctcccacaaggatgggagacagat

SEQ ID NO: 64994 - DNA, 201 bp, Homo sapiens; identical to SEQ ID NO: 31466

SEQ ID NO: 64995 - DNA, 201 bp, Homo sapiens
cgcaagtgggaggcggcccatgaggcggagcagcagacagcctacctggagggcaggtgcgtggagtggctccgcagatacctggagaacaggaaggagayactgcagcacacctgtaccagggaccacgggcgcctccctgatcgcctgtaatctcccgggctggcctcccacaaggatgggagacagatgggaccaaca

SEQ ID NO: 64996 - DNA, 201 bp, Homo sapiens; identical to SEQ ID NO: 31468

SEQ ID NO: 64997 - DNA, 201 bp, Homo sapiens; identical to SEQ ID NO: 31129

SEQ ID NO: 64998 - DNA, 201 bp, Homo sapiens; identical to SEQ ID NO: 31469

SEQ ID NO: 64999 - DNA, 201 bp, Homo sapiens; identical to SEQ ID NO: 31130

SEQ ID NO: 65000 - DNA, 201 bp, Homo sapiens; identical to SEQ ID NO: 31131

SEQ ID NO: 65001 - DNA, 201 bp, Homo sapiens; identical to SEQ ID NO: 31472

SEQ ID NO: 65002 - DNA, 201 bp, Homo sapiens
aatgtgcctgtgttcctgtaggcataatatgaggaggtggggagaccaacccacccccatgtccaccatgaccctcttccctcatgctgacctgtgttccstctccaataattaatcattcctgctccatagaggtgaggctgagatgtctccatctctgtctcaactttatgtgcactgagctgtaacttcttacttccc

SEQ ID NO: 65003 - DNA, 201 bp, Homo sapiens; identical to SEQ ID NO: 31474

SEQ ID NO: 65004 - DNA, 201 bp, Homo sapiens; identical to SEQ ID NO: 31476

SEQ ID NO: 65005 - DNA, 201 bp, Homo sapiens
gaacctgcccatgccgcgccgctactaccaccagagctaggccggtgaatgaccccggcctggggcgaaggtcacgacccctcctcatcccccacggacgycccgggtcccccccgcgagtctccggctccgagatccaccccgaggctgcgggacccgccagatcctcgacccgggagaggcccaggcgcctttaccagg

SEQ ID NO: 65006 - DNA, 201 bp, Homo sapiens
agattcctcctctagccgcatctcctctgggctctgaccaagtcctgtttttgttctaccccaggcagcgaccatgcgcagggttctgatgtgtctctcayggcttgtaaaggtgagacgctgggggacctgatgtgtggggggtgttgggggcaatagtggatgcagctgtgctatggggtttctttgaattggatgtat

SEQ ID NO: 65007 - DNA, 201 bp, Homo sapiens
catctcctctgggctctgaccaagtcctgtttttgttctaccccaggcagcgaccatgcgcagggttctgatgtgtctctcacggcttgtaaaggtgagamgctgggggacctgatgtgtggggggtgttgggggcaatagtggatgcagctgtgctatggggtttctttgaattggatgtattgaacatgtgatgggctg

SEQ ID NO: 65008 - DNA, 201 bp, Homo sapiens
tttcagatctttcaagctcttgccctcttcccagggctctttcctcattgtattttccatcttttctgcaatctttttaaaggaaccagattctgaaattygccaagaggcagggtcccatagtttctcatcataggtaactttctgttggaactcctcttctgcactcctactcttcttcctgccctgagttgtagtaat

SEQ ID NO: 65009 - DNA, 201 bp, Homo sapiens
gccctacggggcttagcgggttttctccccgtgtgcggagatgagagattgtaataaataaaagcacaagacaaagagataaagagaaaacagctgggccsgggggaccactaccatcaagatgcggagaccggtagtggccccgaacagctgggctcgctgatatttattgcatacaagacaaggggcagggtaaggaag

SEQ ID NO: 65010 - DNA, 201 bp, Homo sapiens
atctcctctgggctctgaccaagtcctgtttttgttctaccccaggcagcgaccatgcgcagggttctgatgtgtctctcacggcttgtaaaggtgagacrctgggggacctgatgtgtggggggtgttgggggcaatagtggatgcagctgtgctatggggtttctttgaattggatgtattgaacatgtgatgggctgt

SEQ ID NO: 65011 - DNA, 201 bp, Homo sapiens
ggcagcgaccatgcgcagggttctgatgtgtctctcacggcttgtaaaggtgagacgctgggggacctgatgtgtggggggtgttgggggcaatagtggaygcagctgtgctatggggtttctttgaattggatgtattgaacatgtgatgggctgtttaaagtgtcatccctcactgtgacggatatgaatttgttcatg

SEQ ID NO: 65012 - DNA, 201 bp, Homo sapiens
ttgtaaaggtgagacgctgggggacctgatgtgtggggggtgttgggggcaatagtggatgcagctgtgctatggggtttctttgaattggatgtattgarcatgtgatgggctgtttaaagtgtcatccctcactgtgacggatatgaatttgttcatgaatattttattttatagtgtgagacagctgccttgtgtggg

SEQ ID NO: 65013 - DNA, 201 bp, Homo sapiens
gatgtgtggggggtgttgggggcaatagtggatgcagctgtgctatggggtttctttgaattggatgtattgaacatgtgatgggctgtttaaagtgtcayccctcactgtgacggatatgaatttgttcatgaatattttattttatagtgtgagacagctgccttgtgtgggactgagaggcaagatttgttcacgcct

SEQ ID NO: 65014 - DNA, 201 bp, Homo sapiens
tattgaacatgtgatgggctgtttaaagtgtcatccctcactgtgacggatatgaatttgttcatgaatattttattttatagtgtgagacagctgccttstgtgggactgagaggcaagatttgttcacgccttccctttgtgacttcaaaaaccctgactctctttctgcaaaggcacctgaatgtgcctgtgttcctg

SEQ ID NO: 65015 - DNA, 201 bp, Homo sapiens
ccctgactctctttctgcaaaggcacctgaatgtgcctgtgttcctgtaggcataatatgaggaggtggggagaccaacccacccccatgtccaccatgaycctcttccctcatgctgacctgtgttccgtctccaataattaatcattcctgctccatagaggtgaggctgagatgtctccatctctgtctcaactttat

SEQ ID NO: 65016 - DNA, 201 bp, Homo sapiens
agcgaagccaatcggcgtcgctggggtccctgttccagaagtccccgcgaacccattgggactcagattctccccagacgccgaggatggggtcatggcgwcccgaaccctcctcctgctgctcttgggggccctggccctgaccgagacctgggcgggtgagtgcgggatccggagggaaatggcctctgcggggaggag

SEQ ID NO: 65017 - DNA, 201 bp, Homo sapiens; identical to SEQ ID NO: 31490

SEQ ID NO: 65018 - DNA, 201 bp, Homo sapiens
gaggtggggagaccaacccacccccatgtccaccatgaccctcttccctcatgctgacctgtgttccgtctccaataattaatcattcctgctccatagasgtgaggctgagatgtctccatctctgtctcaactttatgtgcactgagctgtaacttcttacttccctattaaaattagaatctgagtataaatttactt

SEQ ID NO: 65019 - DNA, 201 bp, Homo sapiens
aagccaatcggcgtcgctggggtccctgttccagaagtccccgcgaacccattgggactcagattctccccagacgccgaggatggggtcatggcgtcccraaccctcctcctgctgctcttgggggccctggccctgaccgagacctgggcgggtgagtgcgggatccggagggaaatggcctctgcggggaggagctag

SEQ ID NO: 65020 - DNA, 201 bp, Homo sapiens; identical to SEQ ID NO: 31492

SEQ ID NO: 65021 - DNA, 201 bp, Homo sapiens
gctggggtccctgttccagaagtccccgcgaacccattgggactcagattctccccagacgccgaggatggggtcatggcgtcccgaaccctcctcctgcygctcttgggggccctggccctgaccgagacctgggcgggtgagtgcgggatccggagggaaatggcctctgcggggaggagctaggggcccgcgcactgg

SEQ ID NO: 65022 - DNA, 201 bp, Homo sapiens; identical to SEQ ID NO: 31281

SEQ ID NO: 65023 - DNA, 201 bp, Homo sapiens; identical to SEQ ID NO: 31496

SEQ ID NO: 65024 - DNA, 201 bp, Homo sapiens
ggatggggtcatggcgtcccgaaccctcctcctgctgctcttgggggccctggccctgaccgagacctgggcgggtgagtgcgggatccggagggaaatgrcctctgcggggaggagctaggggcccgcgcactggggcgcaggacccggggagcagcgcaaggaggagggtcggacgggtctcagcccctcctcgccccc

SEQ ID NO: 65025 - DNA, 201 bp, Homo sapiens; identical to SEQ ID NO: 30779

SEQ ID NO: 65026 - DNA, 201 bp, Homo sapiens; identical to SEQ ID NO: 31282

SEQ ID NO: 65027 - DNA, 201 bp, Homo sapiens; identical to SEQ ID NO: 31156

SEQ ID NO: 65028 - DNA, 201 bp, Homo sapiens; identical to SEQ ID NO: 31501

SEQ ID NO: 65029 - DNA, 201 bp, Homo sapiens; identical to SEQ ID NO: 31502

SEQ ID NO: 65030 - DNA, 201 bp, Homo sapiens
tgtccaccatgaccctcttccctcatgctgacctgtgttccgtctccaataattaatcattcctgctccatagaggtgaggctgagatgtctccatctctrtctcaactttatgtgcactgagctgtaacttcttacttccctattaaaattagaatctgagtataaatttactttttcaaattcttgccatgagaggttg

SEQ ID NO: 65031 - DNA, 201 bp, Homo sapiens
gtctccaataattaatcattcctgctccatagaggtgaggctgagatgtctccatctctgtctcaactttatgtgcactgagctgtaacttcttacttccytattaaaattagaatctgagtataaatttactttttcaaattcttgccatgagaggttgatgggttaattaaaggagaagattcctaaaatttgagagac

SEQ ID NO: 65032 - DNA, 201 bp, Homo sapiens
actttatgtgcactgagctgtaacttcttacttccctattaaaattagaatctgagtataaatttactttttcaaattcttgccatgagaggttgatgggytaattaaaggagaagattcctaaaatttgagagacaaaataaatggaagacatgagaaccttccagagtccacatgtttcttatgctgatttgttgcatg

SEQ ID NO: 65033 - DNA, 201 bp, Homo sapiens
cccgaaccctcctcctgctgctcttgggggccctggccctgaccgagacctgggcgggtgagtgcgggatccggagggaaatggcctctgcggggaggagstaggggcccgcgcactggggcgcaggacccggggagcagcgcaaggaggagggtcggacgggtctcagcccctcctcgcccccaggtacccactccataa

SEQ ID NO: 65034 - DNA, 201 bp, Homo sapiens
attcttgccatgagaggttgatgggttaattaaaggagaagattcctaaaatttgagagacaaaataaatggaagacatgagaaccttccagagtccacawgtttcttatgctgatttgttgcatgagaggagagtagatggggctgtgcccagtgggtgctcaggccaccgtgcgctttatgtggtcactgctcagctgg

SEQ ID NO: 65035 - DNA, 201 bp, Homo sapiens
accgagacctgggcgggtgagtgcgggatccggagggaaatggcctctgcggggaggagctaggggcccgcgcactggggcgcaggacccggggagcagckcaaggaggagggtcggacgggtctcagcccctcctcgcccccaggtacccactccataaggtatttcagcaccgccgtgtcccggccgggtcgcggggag

SEQ ID NO: 65036 - DNA, 201 bp, Homo sapiens
gagtgcgggatccggagggaaatggcctctgcggggaggagctaggggcccgcgcactggggcgcaggacccggggagcagcgcaaggaggagggtcggaygggtctcagcccctcctcgcccccaggtacccactccataaggtatttcagcaccgccgtgtcccggccgggtcgcggggagccccggtacatcgcagtg

SEQ ID NO: 65037 - DNA, 201 bp, Homo sapiens
acatgagaaccttccagagtccacatgtttcttatgctgatttgttgcatgagaggagagtagatggggctgtgcccagtgggtgctcaggccaccgtgcrctttatgtggtcactgctcagctgggtcatctttgctgctccgttgtccttggctgtatgatccagccctacggggcttagcgggttttctccccgtgtg

SEQ ID NO: 65038 - DNA, 201 bp, Homo sapiens
tgcggggaggagctaggggcccgcgcactggggcgcaggacccggggagcagcgcaaggaggagggtcggacgggtctcagcccctcctcgcccccaggtwcccactccataaggtatttcagcaccgccgtgtcccggccgggtcgcggggagccccggtacatcgcagtgggctacgtggacgacacgcagttcgtgcg

SEQ ID NO: 65039 - DNA, 201 bp, Homo sapiens
tgttgcatgagaggagagtagatggggctgtgcccagtgggtgctcaggccaccgtgcgctttatgtggtcactgctcagctgggtcatctttgctgctcygttgtccttggctgtatgatccagccctacggggcttagcgggttttctccccgtgtgcggagatgagagattgtaataaataaaagcacaagacaaaga

SEQ ID NO: 65040 - DNA, 201 bp, Homo sapiens
ggcccgcgcactggggcgcaggacccggggagcagcgcaaggaggagggtcggacgggtctcagcccctcctcgcccccaggtacccactccataaggtakttcagcaccgccgtgtcccggccgggtcgcggggagccccggtacatcgcagtgggctacgtggacgacacgcagttcgtgcggttcgacagcgacgcgg

SEQ ID NO: 65041 - DNA, 201 bp, Homo sapiens
gggctgtgcccagtgggtgctcaggccaccgtgcgctttatgtggtcactgctcagctgggtcatctttgctgctccgttgtccttggctgtatgatccakccctacggggcttagcgggttttctccccgtgtgcggagatgagagattgtaataaataaaagcacaagacaaagagataaagagaaaacagctgggccc

SEQ ID NO: 65042 - DNA, 201 bp, Homo sapiens
gggtcgcggggagccccggtacatcgcagtgggctacgtggacgacacgcagttcgtgcggttcgacagcgacgcggcgactccgaggatgtagccgcagkcgccgtggttggagcaggagggaccggagtattgggaccggagcacacggaacatcaggcccgcgcacagactgacaagagtgaacctgcccatgccgcg

SEQ ID NO: 65043 - DNA, 201 bp, Homo sapiens
cagtgggtgctcaggccaccgtgcgctttatgtggtcactgctcagctgggtcatctttgctgctccgttgtccttggctgtatgatccagccctacgggrcttagcgggttttctccccgtgtgcggagatgagagattgtaataaataaaagcacaagacaaagagataaagagaaaacagctgggcccgggggaccac

SEQ ID NO: 65044 - DNA, 201 bp, Homo sapiens
cgcggggagccccggtacatcgcagtgggctacgtggacgacacgcagttcgtgcggttcgacagcgacgcggcgactccgaggatgtagccgcaggcgcmgtggttggagcaggagggaccggagtattgggaccggagcacacggaacatcaggcccgcgcacagactgacaagagtgaacctgcccatgccgcgccgc

SEQ ID NO: 65045 - DNA, 201 bp, Homo sapiens
acatcgcagtgggctacgtggacgacacgcagttcgtgcggttcgacagcgacgcggcgactccgaggatgtagccgcaggcgccgtggttggagcaggakggaccggagtattgggaccggagcacacggaacatcaggcccgcgcacagactgacaagagtgaacctgcccatgccgcgccgctactaccaccagagct

SEQ ID NO: 65046 - DNA, 201 bp, Homo sapiens
cagttcgtgcggttcgacagcgacgcggcgactccgaggatgtagccgcaggcgccgtggttggagcaggagggaccggagtattgggaccggagcacacsgaacatcaggcccgcgcacagactgacaagagtgaacctgcccatgccgcgccgctactaccaccagagctaggccggtgaatgaccccggcctggggcg

SEQ ID NO: 65047 - DNA, 201 bp, Homo sapiens; identical to SEQ ID NO: 31516

SEQ ID NO: 65048 - DNA, 201 bp, Homo sapiens
cagagctaggccggtgaatgaccccggcctggggcgaaggtcacgacccctcctcatcccccacggacgtcccgggtcccccccgcgagtctccggctccragatccaccccgaggctgcgggacccgccagatcctcgacccgggagaggcccaggcgcctttaccaggtttcattttccgtttaggccaaaatccccgc

SEQ ID NO: 65049 - DNA, 201 bp, Homo sapiens; identical to SEQ ID NO: 31518

SEQ ID NO: 65050 - DNA, 201 bp, Homo sapiens; identical to SEQ ID NO: 31520

SEQ ID NO: 65051 - DNA, 201 bp, Homo sapiens; identical to SEQ ID NO: 31521

SEQ ID NO: 65052 - DNA, 201 bp, Homo sapiens; identical to SEQ ID NO: 31522

SEQ ID NO: 65053 - DNA, 201 bp, Homo sapiens; identical to SEQ ID NO: 31524

SEQ ID NO: 65054 - DNA, 201 bp, Homo sapiens; identical to SEQ ID NO: 31526

SEQ ID NO: 65055 - DNA, 201 bp, Homo sapiens
ttacagaggccagggaataaacctggacaaattatgccccacggtggaatcactgggtccataaatcctgtcctggttatctccccattctctgtaaaaasgattctctgtaaaaagattacatcgccctaaaccaggacctgagctcttggactgcggcggccatggcggctcagattacccagcgcaagtgggaggcgg

SEQ ID NO: 65056 - DNA, 201 bp, Homo sapiens; identical to SEQ ID NO: 31181

SEQ ID NO: 65057 - DNA, 201 bp, Homo sapiens
ctgtcctagatcagcagttacactttcaggaaacttctctgggatcaaaggctagggggtttgtttagggccgtatggccctgactcctttctggcctctyataggacattttcttcccacagatagagtgagctactctgaagctgcaagtaagtatgaagtgggctgatccctgagatccttgggatattgtggtcggg

SEQ ID NO: 65058 - DNA, 201 bp, Homo sapiens
aggatagggggcccttcccttttaggtagcatatgtcaccattttcttttctgcacttaagatcaaagactttaagactttcactatttcttctaccattwtctactacgaaattcaaagaggaaccaggagtacaggaggagcatgaaagtggacaaggagcatgaccactgaagcacagcaccacagggaggggtttag

SEQ ID NO: 65059 - DNA, 201 bp, Homo sapiens
gggcccttcccttttaggtagcatatgtcaccattttcttttctgcacttaagatcaaagactttaagactttcactatttcttctaccattatctactaygaaattcaaagaggaaccaggagtacaggaggagcatgaaagtggacaaggagcatgaccactgaagcacagcaccacagggaggggtttaggcctctgg

SEQ ID NO: 65060 - DNA, 201 bp, Homo sapiens; identical to SEQ ID NO: 31191

SEQ ID NO: 65061 - DNA, 201 bp, Homo sapiens
acttaagatcaaagactttaagactttcactatttcttctaccattatctactacgaaattcaaagaggaaccaggagtacaggaggagcatgaaagtggrcaaggagcatgaccactgaagcacagcaccacagggaggggtttaggcctctggatgactgcgggtagctctggataatatccagccttctacaagaagc

SEQ ID NO: 65062 - DNA, 201 bp, Homo sapiens; identical to SEQ ID NO: 31192

SEQ ID NO: 65063 - DNA, 201 bp, Homo sapiens
agaggaaccaggagtacaggaggagcatgaaagtggacaaggagcatgaccactgaagcacagcaccacagggaggggtttaggcctctggatgactgcgrgtagctctggataatatccagccttctacaagaagctggtggagcagagtgttccccgactcctccaagaaagggagactccctttcatggtctgctaag

SEQ ID NO: 65064 - DNA, 201 bp, Homo sapiens
gcacagcaccacagggaggggtttaggcctctggatgactgcgggtagctctggataatatccagccttctacaagaagctggtggagcagagtgttcccygactcctccaagaaagggagactccctttcatggtctgctaagtaacaggtgccttcccagacattggcattgccacttgaccaaggatccctcaagcgg

SEQ ID NO: 65065 - DNA, 201 bp, Homo sapiens
aggatccctcaagcggcccttatgcgggcgtgacagaaggctcatctcttgccttctaggtcacttctcacaatgtcccttcagcacctgaccctatgccygccagttattcctaggttatcttagtaatgcaacaaagagtaatattaaaagctaatgattaataatgtttataataatgattgataatttttcatgatc

SEQ ID NO: 65066 - DNA, 201 bp, Homo sapiens; identical to SEQ ID NO: 31539

SEQ ID NO: 65067 - DNA, 201 bp, Homo sapiens; identical to SEQ ID NO: 31541

SEQ ID NO: 65068 - DNA, 201 bp, Homo sapiens; identical to SEQ ID NO: 31542

SEQ ID NO: 65069 - DNA, 201 bp, Homo sapiens
gctaggccggtgaatgaccccggcctggggcgaaggtcacgacccctcctcatcccccacggacgtcccgggtcccccccgcgagtctccggctccgagayccaccccgaggctgcgggacccgccagatcctcgacccgggagaggcccaggcgcctttaccaggtttcattttccgtttaggccaaaatccccgcgggt

SEQ ID NO: 65070 - DNA, 201 bp, Homo sapiens
cccccacggacgtcccgggtcccccccgcgagtctccggctccgagatccaccccgaggctgcgggacccgccagatcctcgacccgggagaggcccaggmgcctttaccaggtttcattttccgtttaggccaaaatccccgcgggttggtcggggcgggggcggggctcggtgggcggggctgacagcgggggcggggc

SEQ ID NO: 65071 - DNA, 201 bp, Homo sapiens
ccccgcgagtctccggctccgagatccaccccgaggctgcgggacccgccagatcctcgacccgggagaggcccaggcgcctttaccaggtttcattttcmgtttaggccaaaatccccgcgggttggtcggggcgggggcggggctcggtgggcggggctgacagcgggggcggggccagggtctaacaccctccagata

SEQ ID NO: 65072 - DNA, 201 bp, Homo sapiens
ggagaggcccaggcgcctttaccaggtttcattttccgtttaggccaaaatccccgcgggttggtcggggcgggggcggggctcggtgggcggggctgacmgcgggggcggggccagggtctaacaccctccagataatgtatggctgcgacttggggctggaagggcgcctcctccgcgggtatgaacagcacgccaacg

SEQ ID NO: 65073 - DNA, 201 bp, Homo sapiens
ccgcgggttggtcggggcgggggcggggctcggtgggcggggctgacagcgggggcggggccagggtctaacaccctccagataatgtatggctgcgactyggggctggaagggcgcctcctccgcgggtatgaacagcacgccaacgatggcaaggattacatagcccggaactaggacctgcgctcctggaccgcggcg

SEQ ID NO: 65074 - DNA, 201 bp, Homo sapiens
tcggggcgggggcggggctcggtgggcggggctgacagcgggggcggggccagggtctaacaccctccagataatgtatggctgcgacttggggctggaasggcgcctcctccgcgggtatgaacagcacgccaacgatggcaaggattacatagcccggaactaggacctgcgctcctggaccgcggcggacatggcggc

SEQ ID NO: 65075 - DNA, 201 bp, Homo sapiens; identical to SEQ ID NO: 31211

SEQ ID NO: 65076 - DNA, 201 bp, Homo sapiens
gctgacagcgggggcggggccagggtctaacaccctccagataatgtatggctgcgacttggggctggaagggcgcctcctccgcgggtatgaacagcacsccaacgatggcaaggattacatagcccggaactaggacctgcgctcctggaccgcggcggacatggcggctcagatcaccaagcgcaagtgggaggcaga

SEQ ID NO: 65077 - DNA, 201 bp, Homo sapiens
gaagggcgcctcctccgcgggtatgaacagcacgccaacgatggcaaggattacatagcccggaactaggacctgcgctcctggaccgcggcggacatggmggctcagatcaccaagcgcaagtgggaggcagaagaatttgcagagcagatcagggcctacctggagggcacgtgcgtggagaggctcgcagacacctgg

SEQ ID NO: 65078 - DNA, 201 bp, Homo sapiens
tcttgcctcggcacctgagtaatcctccacccacacttggcccttcagtagaaccttgtcccaccatgacctgtgatcacagggacttggatgtcacctayggcagtccctgcataccagggtccttgtggtatcaagagacaaattttcagatctttcaagctcttgccctcttcccagggctctttcctcattgtattt

SEQ ID NO: 65079 - DNA, 201 bp, Homo sapiens
ctgagtaatcctccacccacacttggcccttcagtagaaccttgtcccaccatgacctgtgatcacagggacttggatgtcacctatggcagtccctgcayaccagggtccttgtggtatcaagagacaaattttcagatctttcaagctcttgccctcttcccagggctctttcctcattgtattttccatcttttctgc

SEQ ID NO: 65080 - DNA, 201 bp, Homo sapiens
tgagtaatcctccacccacacttggcccttcagtagaaccttgtcccaccatgacctgtgatcacagggacttggatgtcacctatggcagtccctgcatwccagggtccttgtggtatcaagagacaaattttcagatctttcaagctcttgccctcttcccagggctctttcctcattgtattttccatcttttctgca

SEQ ID NO: 65081 - DNA, 201 bp, Homo sapiens
ttgtcccaccatgacctgtgatcacagggacttggatgtcacctatggcagtccctgcataccagggtccttgtggtatcaagagacaaattttcagatckttcaagctcttgccctcttcccagggctctttcctcattgtattttccatcttttctgcaatctttttaaaggaaccagattctgaaatttgccaagagg

SEQ ID NO: 65082 - DNA, 201 bp, Homo sapiens
ctgtgatcacagggacttggatgtcacctatggcagtccctgcataccagggtccttgtggtatcaagagacaaattttcagatctttcaagctcttgccstcttcccagggctctttcctcattgtattttccatcttttctgcaatctttttaaaggaaccagattctgaaatttgccaagaggcagggtcccatagtt

SEQ ID NO: 65083 - DNA, 201 bp, Homo sapiens
tggatgactgcgggtagctctggataatatccagccttctacaagaagctggtggagcagagtgttccccgactcctccaagaaagggagactccctttcrtggtctgctaagtaacaggtgccttcccagacattggcattgccacttgaccaaggatccctcaagcggcccttatgcgggcgtgacagaaggctcatct

SEQ ID NO: 65084 - DNA, 201 bp, Homo sapiens
ttgccctcttcccagggctctttcctcattgtattttccatcttttctgcaatctttttaaaggaaccagattctgaaatttgccaagaggcagggtcccrtagtttctcatcataggtaactttctgttggaactcctcttctgcactcctactcttcttcctgccctgagttgtagtaatcctagtgctggctccaata

SEQ ID NO: 65085 - DNA, 201 bp, Homo sapiens; identical to SEQ ID NO: 31553

SEQ ID NO: 65086 - DNA, 201 bp, Homo sapiens; identical to SEQ ID NO: 31556

SEQ ID NO: 65087 - DNA, 201 bp, Homo sapiens; identical to SEQ ID NO: 31559

SEQ ID NO: 65088 - DNA, 201 bp, Homo sapiens; identical to SEQ ID NO: 31560

SEQ ID NO: 65089 - DNA, 201 bp, Homo sapiens
gcgcaagtgggaggcagaagaatttgcagagcagatcagggcctacctggagggcacgtgcgtggagaggctcgcagacacctggagaacgggaaggagaygctgcagctcacgggtaccagggaacacaagacgtctccctgatcgcctgtagatctcctgggctggcttcccacaaagagagaaggaaaatgggaccaa

SEQ ID NO: 65090 - DNA, 201 bp, Homo sapiens
tcagggcctacctggagggcacgtgcgtggagaggctcgcagacacctggagaacgggaaggagatgctgcagctcacgggtaccagggaacacaagacgyctccctgatcgcctgtagatctcctgggctggcttcccacaaagagagaaggaaaatgggaccaacactagaatgtcgtcctctctctggtcctgaggga

SEQ ID NO: 65091 - DNA, 201 bp, Homo sapiens
agggtctgccctgctctctgatacaattaagggatgaaatctctgaggaaatgaagggaagacaatccctggaatactgatgaggggttccctttgacacyggcagcagccttgggccccgttacttttcctctcaggccttgctctctgctttacactcaatgtgtgtgggggtctgagtccagctcttctgagtccctc

SEQ ID NO: 65092 - DNA, 201 bp, Homo sapiens
gggtctgccctgctctctgatacaattaagggatgaaatctctgaggaaatgaagggaagacaatccctggaatactgatgaggggttccctttgacactrgcagcagccttgggccccgttacttttcctctcaggccttgctctctgctttacactcaatgtgtgtgggggtctgagtccagctcttctgagtccctca

SEQ ID NO: 65093 - DNA, 201 bp, Homo sapiens
ggatgaaatctctgaggaaatgaagggaagacaatccctggaatactgatgaggggttccctttgacactggcagcagccttgggccccgttacttttccyctcaggccttgctctctgctttacactcaatgtgtgtgggggtctgagtccagctcttctgagtccctcagcctccactcaggtcaggaccagaagacac

SEQ ID NO: 65094 - DNA, 201 bp, Homo sapiens
tgaggaaatgaagggaagacaatccctggaatactgatgaggggttccctttgacactggcagcagccttgggccccgttacttttcctctcaggccttgytctctgctttacactcaatgtgtgtgggggtctgagtccagctcttctgagtccctcagcctccactcaggtcaggaccagaagacactgttccctcctc

SEQ ID NO: 65095 - DNA, 201 bp, Homo sapiens; identical to SEQ ID NO: 31563

SEQ ID NO: 65096 - DNA, 201 bp, Homo sapiens; identical to SEQ ID NO: 31564

SEQ ID NO: 65097 - DNA, 201 bp, Homo sapiens; identical to SEQ ID NO: 30837

SEQ ID NO: 65098 - DNA, 201 bp, Homo sapiens
catagtttctcatcataggtaactttctgttggaactcctcttctgcactcctactcttcttcctgccctgagttgtagtaatcctagtgctggctccaakagaaactcatcaatttataaagcagagtctagtttagattcatatgtggttggaaaattggacccataagcctagggttatctttcctgaagagaaaaat

SEQ ID NO: 65099 - DNA, 201 bp, Homo sapiens; identical to SEQ ID NO: 30838

SEQ ID NO: 65100 - DNA, 201 bp, Homo sapiens
gagtctagtttagattcatatgtggttggaaaattggacccataagcctagggttatctttcctgaagagaaaaatatggttgtgtgctgcagtgtgcagkagagttggtgtggggggagggagggagggagggaggacacacaagcagccctggtgagaaaagctccagtggcactgatgtcagtgtgagatgatgttgt

SEQ ID NO: 65101 - DNA, 201 bp, Homo sapiens
gtttagattcatatgtggttggaaaattggacccataagcctagggttatctttcctgaagagaaaaatatggttgtgtgctgcagtgtgcaggagagttrgtgtggggggagggagggagggagggaggacacacaagcagccctggtgagaaaagctccagtggcactgatgtcagtgtgagatgatgttgttctgtag

SEQ ID NO: 65102 - DNA, 201 bp, Homo sapiens
gaagagaaaaatatggttgtgtgctgcagtgtgcaggagagttggtgtggggggagggagggagggagggaggacacacaagcagccctggtgagaaaagmtccagtggcactgatgtcagtgtgagatgatgttgttctgtagctgccacaaaaataaagcatttgtcctgaggctacattaataaagatattgcctcta

SEQ ID NO: 65103 - DNA, 201 bp, Homo sapiens
gagaaaaatatggttgtgtgctgcagtgtgcaggagagttggtgtggggggagggagggagggagggaggacacacaagcagccctggtgagaaaagctcyagtggcactgatgtcagtgtgagatgatgttgttctgtagctgccacaaaaataaagcatttgtcctgaggctacattaataaagatattgcctctagaa

SEQ ID NO: 65104 - DNA, 201 bp, Homo sapiens
agaaaaatatggttgtgtgctgcagtgtgcaggagagttggtgtggggggagggagggagggagggaggacacacaagcagccctggtgagaaaagctccrgtggcactgatgtcagtgtgagatgatgttgttctgtagctgccacaaaaataaagcatttgtcctgaggctacattaataaagatattgcctctagaat

SEQ ID NO: 65105 - DNA, 201 bp, Homo sapiens
gcatttgtcctgaggctacattaataaagatattgcctctagaatagagtggttctctatgatcattccttcaactgacatttgtttctgctaggtatatractgtttttgcatttagaaagcatcattaaagtaaaaacagaaaaatttcgggccttgtggtgcatatgttctagatgcaagcttgtccaacccgcggct

SEQ ID NO: 65106 - DNA, 201 bp, Homo sapiens
atgatcattccttcaactgacatttgtttctgctaggtatataactgtttttgcatttagaaagcatcattaaagtaaaaacagaaaaatttcgggccttrtggtgcatatgttctagatgcaagcttgtccaacccgcggctcgtgggctgcatgtggcccaggacaattttgaatgtgaggacttttttgcttatctgt

SEQ ID NO: 65107 - DNA, 201 bp, Homo sapiens
cagccttgggccccgttacttttcctctcaggccttgctctctgctttacactcaatgtgtgtgggggtctgagtccagctcttctgagtccctcagcctscactcaggtcaggaccagaagacactgttccctcctcagggactagaattttccacggataggagattatcccaggtacctgtgtccaggttggcgtctg

SEQ ID NO: 65108 - DNA, 201 bp, Homo sapiens
tcctctcaggccttgctctctgctttacactcaatgtgtgtgggggtctgagtccagctcttctgagtccctcagcctccactcaggtcaggaccagaagwcactgttccctcctcagggactagaattttccacggataggagattatcccaggtacctgtgtccaggttggcgtctgggttctgtgctcccttccccac

SEQ ID NO: 65109 - DNA, 201 bp, Homo sapiens
tttacactcaatgtgtgtgggggtctgagtccagctcttctgagtccctcagcctccactcaggtcaggaccagaagacactgttccctcctcagggactrgaattttccacggataggagattatcccaggtacctgtgtccaggttggcgtctgggttctgtgctcccttccccaccccaggtgtcctgtccattctca

SEQ ID NO: 65110 - DNA, 201 bp, Homo sapiens
cagctcttctgagtccctcagcctccactcaggtcaggaccagaagacactgttccctcctcagggactagaattttccacggataggagattatcccagrtacctgtgtccaggttggcgtctgggttctgtgctcccttccccaccccaggtgtcctgtccattctcaggatggccacatgcgtgctgctggagtgtct

SEQ ID NO: 65111 - DNA, 201 bp, Homo sapiens
attccttcaactgacatttgtttctgctaggtatataactgtttttgcatttagaaagcatcattaaagtaaaaacagaaaaatttcgggccttgtggtgyatatgttctagatgcaagcttgtccaacccgcggctcgtgggctgcatgtggcccaggacaattttgaatgtgaggacttttttgcttatctgtggtgca

SEQ ID NO: 65112 - DNA, 201 bp, Homo sapiens
tctgctaggtatataactgtttttgcatttagaaagcatcattaaagtaaaaacagaaaaatttcgggccttgtggtgcatatgttctagatgcaagcttrtccaacccgcggctcgtgggctgcatgtggcccaggacaattttgaatgtgaggacttttttgcttatctgtggtgcacctgagtcccggagtgagtgca

SEQ ID NO: 65113 - DNA, 201 bp, Homo sapiens
cctcagcctccactcaggtcaggaccagaagacactgttccctcctcagggactagaattttccacggataggagattatcccaggtacctgtgtccaggytggcgtctgggttctgtgctcccttccccaccccaggtgtcctgtccattctcaggatggccacatgcgtgctgctggagtgtctcatgagagatgcaaa

SEQ ID NO: 65114 - DNA, 201 bp, Homo sapiens
agcctccactcaggtcaggaccagaagacactgttccctcctcagggactagaattttccacggataggagattatcccaggtacctgtgtccaggttggygtctgggttctgtgctcccttccccaccccaggtgtcctgtccattctcaggatggccacatgcgtgctgctggagtgtctcatgagagatgcaaagtgc

SEQ ID NO: 65115 - DNA, 201 bp, Homo sapiens; identical to SEQ ID NO: 30953

SEQ ID NO: 65116 - DNA, 201 bp, Homo sapiens
tataactgtttttgcatttagaaagcatcattaaagtaaaaacagaaaaatttcgggccttgtggtgcatatgttctagatgcaagcttgtccaacccgcrgctcgtgggctgcatgtggcccaggacaattttgaatgtgaggacttttttgcttatctgtggtgcacctgagtcccggagtgagtgcacccacctccct

SEQ ID NO: 65117 - DNA, 201 bp, Homo sapiens
ctcccttccccaccccaggtgtcctgtccattctcaggatggccacatgcgtgctgctggagtgtctcatgagagatgcaaagtgcctgaattttctgacwcttcctgttagacccccccaccaagacacatatgatccaccattccatctctgactataaggccaccctgaggtgctgggccctgggcttctaccctgtg

SEQ ID NO: 65118 - DNA, 201 bp, Homo sapiens; identical to SEQ ID NO: 30955

SEQ ID NO: 65119 - DNA, 201 bp, Homo sapiens
gcatcattaaagtaaaaacagaaaaatttcgggccttgtggtgcatatgttctagatgcaagcttgtccaacccgcggctcgtgggctgcatgtggcccargacaattttgaatgtgaggacttttttgcttatctgtggtgcacctgagtcccggagtgagtgcacccacctccctcagggtcaggagtgaatgctttag

SEQ ID NO: 65120 - DNA, 201 bp, Homo sapiens
tcctgtccattctcaggatggccacatgcgtgctgctggagtgtctcatgagagatgcaaagtgcctgaattttctgactcttcctgttagacccccccascaagacacatatgatccaccattccatctctgactataaggccaccctgaggtgctgggccctgggcttctaccctgtggagatcacactgacctggcag

SEQ ID NO: 65121 - DNA, 201 bp, Homo sapiens; identical to SEQ ID NO: 30956

SEQ ID NO: 65122 - DNA, 201 bp, Homo sapiens
aaagtaaaaacagaaaaatttcgggccttgtggtgcatatgttctagatgcaagcttgtccaacccgcggctcgtgggctgcatgtggcccaggacaattytgaatgtgaggacttttttgcttatctgtggtgcacctgagtcccggagtgagtgcacccacctccctcagggtcaggagtgaatgctttaggaaccctc

SEQ ID NO: 65123 - DNA, 201 bp, Homo sapiens; identical to SEQ ID NO: 30957

SEQ ID NO: 65124 - DNA, 201 bp, Homo sapiens
tgcgtgctgctggagtgtctcatgagagatgcaaagtgcctgaattttctgactcttcctgttagacccccccaccaagacacatatgatccaccattccrtctctgactataaggccaccctgaggtgctgggccctgggcttctaccctgtggagatcacactgacctggcagcaggatggagaggaccagactcggga

SEQ ID NO: 65125 - DNA, 201 bp, Homo sapiens; identical to SEQ ID NO: 30958

SEQ ID NO: 65126 - DNA, 201 bp, Homo sapiens; identical to SEQ ID NO: 23708

SEQ ID NO: 65127 - DNA, 201 bp, Homo sapiens; identical to SEQ ID NO: 23689

SEQ ID NO: 65128 - DNA, 201 bp, Homo sapiens; identical to SEQ ID NO: 23709

SEQ ID NO: 65129 - DNA, 201 bp, Homo sapiens; identical to SEQ ID NO: 23690

SEQ ID NO: 65130 - DNA, 201 bp, Homo sapiens; identical to SEQ ID NO: 23710

SEQ ID NO: 65131 - DNA, 201 bp, Homo sapiens; identical to SEQ ID NO: 23711

SEQ ID NO: 65132 - DNA, 201 bp, Homo sapiens; identical to SEQ ID NO: 23642

SEQ ID NO: 65133 - DNA, 201 bp, Homo sapiens; identical to SEQ ID NO: 22817

SEQ ID NO: 65134 - DNA, 201 bp, Homo sapiens; identical to SEQ ID NO: 23684

SEQ ID NO: 65135 - DNA, 201 bp, Homo sapiens; identical to SEQ ID NO: 23701

SEQ ID NO: 65136 - DNA, 201 bp, Homo sapiens; identical to SEQ ID NO: 23685

SEQ ID NO: 65137 - DNA, 201 bp, Homo sapiens; identical to SEQ ID NO: 23702

SEQ ID NO: 65138 - DNA, 201 bp, Homo sapiens; identical to SEQ ID NO: 23686

SEQ ID NO: 65139 - DNA, 201 bp, Homo sapiens; identical to SEQ ID NO: 23704

SEQ ID NO: 65140 - DNA, 201 bp, Homo sapiens; identical to SEQ ID NO: 23706

SEQ ID NO: 65141 - DNA, 201 bp, Homo sapiens; identical to SEQ ID NO: 23687

SEQ ID NO: 65142 - DNA, 201 bp, Homo sapiens; identical to SEQ ID NO: 23707

SEQ ID NO: 65143 - DNA, 201 bp, Homo sapiens; identical to SEQ ID NO: 23688

SEQ ID NO: 65144 - DNA, 201 bp, Homo sapiens; identical to SEQ ID NO: 22441

SEQ ID NO: 65145 - DNA, 201 bp, Homo sapiens; identical to SEQ ID NO: 22479

SEQ ID NO: 65146 - DNA, 201 bp, Homo sapiens; identical to SEQ ID NO: 22443

SEQ ID NO: 65147 - DNA, 201 bp, Homo sapiens; identical to SEQ ID NO: 22998

SEQ ID NO: 65148 - DNA, 201 bp, Homo sapiens; identical to SEQ ID NO: 24313

SEQ ID NO: 65149 - DNA, 201 bp, Homo sapiens; identical to SEQ ID NO: 23140

SEQ ID NO: 65150 - DNA, 201 bp, Homo sapiens; identical to SEQ ID NO: 24316

SEQ ID NO: 65151 - DNA, 201 bp, Homo sapiens; identical to SEQ ID NO: 23147

SEQ ID NO: 65152 - DNA, 201 bp, Homo sapiens; identical to SEQ ID NO: 24319

SEQ ID NO: 65153 - DNA, 201 bp, Homo sapiens; identical to SEQ ID NO: 22450

SEQ ID NO: 65154 - DNA, 201 bp, Homo sapiens; identical to SEQ ID NO: 24322

SEQ ID NO: 65155 - DNA, 201 bp, Homo sapiens; identical to SEQ ID NO: 22453

SEQ ID NO: 65156 - DNA, 201 bp, Homo sapiens; identical to SEQ ID NO: 22490

SEQ ID NO: 65157 - DNA, 201 bp, Homo sapiens; identical to SEQ ID NO: 24327

SEQ ID NO: 65158 - DNA, 201 bp, Homo sapiens; identical to SEQ ID NO: 24330

SEQ ID NO: 65159 - DNA, 201 bp, Homo sapiens; identical to SEQ ID NO: 24332

SEQ ID NO: 65160 - DNA, 201 bp, Homo sapiens; identical to SEQ ID NO: 24335

SEQ ID NO: 65161 - DNA, 201 bp, Homo sapiens; identical to SEQ ID NO: 24336

SEQ ID NO: 65162 - DNA, 201 bp, Homo sapiens; identical to SEQ ID NO: 22460

SEQ ID NO: 65163 - DNA, 201 bp, Homo sapiens; identical to SEQ ID NO: 23670

SEQ ID NO: 65164 - DNA, 201 bp, Homo sapiens; identical to SEQ ID NO: 23672

SEQ ID NO: 65165 - DNA, 201 bp, Homo sapiens; identical to SEQ ID NO: 22791

SEQ ID NO: 65166 - DNA, 201 bp, Homo sapiens; identical to SEQ ID NO: 23560

SEQ ID NO: 65167 - DNA, 201 bp, Homo sapiens; identical to SEQ ID NO: 23563

SEQ ID NO: 65168 - DNA, 201 bp, Homo sapiens; identical to SEQ ID NO: 23566

SEQ ID NO: 65169 - DNA, 201 bp, Homo sapiens; identical to SEQ ID NO: 23568

SEQ ID NO: 65170 - DNA, 201 bp, Homo sapiens; identical to SEQ ID NO: 23570

SEQ ID NO: 65171 - DNA, 201 bp, Homo sapiens; identical to SEQ ID NO: 23573

SEQ ID NO: 65172 - DNA, 201 bp, Homo sapiens; identical to SEQ ID NO: 23543

SEQ ID NO: 65173 - DNA, 201 bp, Homo sapiens; identical to SEQ ID NO: 23303

SEQ ID NO: 65174 - DNA, 201 bp, Homo sapiens
cagactgctcgtaaatccaccggtgggaaagccccccgcaaacagctggccacgaaagctgccaggaaaagcaccccctctacctgcggggtgaagcctcmtcgctacaggcctgggaccgtggcgcttcgagagattcgtcgttatcagaagtcgaccgagctgctcatccggaagctgcccttccagaggttggtgagg

SEQ ID NO: 65175 - DNA, 201 bp, Homo sapiens
ttggaagatactaacctgtgtgccatccacgctaagagagtcaccatcatgcccaaagacatccagttggctcgccggatacggggagagagagcttaagkgaaggcagtttttatggcattttgtagtaaattctgtaaaatactttggtttaattggtgactttttttgtaagaaattgtttatatgttgcatttgtac

SEQ ID NO: 65176 - DNA, 201 bp, Homo sapiens
gggcagcggaagcagcgcggaggtcggagaagtggcctaaaacttcggcgttgggtgaaagaaaatggcccgaaccaagcagactgctcgtaaatccaccrgtgggaaagccccccgcaaacagctggccacgaaagctgccaggaaaagcaccccctctacctgcggggtgaagcctcatcgctacaggcctgggaccgt

SEQ ID NO: 65177 - DNA, 201 bp, Homo sapiens
tttcactcaggatgaatgcgaaaagtgactgtttacagacctcagtgatgtcagcactgttgctcaggagtgacaagttgttaatatgcaaaacggatgcrtgatatttcttgcttctcatgatgcatgtttctgtatgttaatgacttgttgggtagctattaaggtactagaattgataaatgtgtacaacagggtcct

SEQ ID NO: 65178 - DNA, 201 bp, Homo sapiens
tgacttgttgggtagctattaaggtactagaattgataaatgtgtacaacagggtccttttgcaataaaactggttatgacttgatccaagtgtttaacarttggggctgttaagtctgaccatacatcactgtgatagaatgtaggctttttcaagggtgaagatacaaaccttaaccacagtgtaacttatagtttcct

SEQ ID NO: 65179 - DNA, 201 bp, Homo sapiens
atggcccgaaccaagcagactgctcgtaaatccaccggtgggaaagccccccgcaaacagctggccacgaaagctgccaggaaaagcaccccctctacctrcggggtgaagcctcatcgctacaggcctgggaccgtggcgcttcgagagattcgtcgttatcagaagtcgaccgagctgctcatccggaagctgcccttc

SEQ ID NO: 65180 - DNA, 201 bp, Homo sapiens
ggggctgttaagtctgaccatacatcactgtgatagaatgtaggctttttcaagggtgaagatacaaaccttaaccacagtgtaacttatagtttcctttaaaaaaaaaaaattaaacctggcagctatagaatacaatatgtgcatttataatagctattttatatattgtagtgtcaacattttcaaattaaatgtttt

SEQ ID NO: 65181 - DNA, 201 bp, Homo sapiens
taagaggaaacagtactgaagttctttttcttgtggcatttgtattataaaaacttggtgtaggggaggagcacaaagctctagcccactgaacctctgcyggttaagatggtgttaggttaggttacatctggttactgtcctgggaaaatcatttttatagagatggccttccaagtggttttaaaatttatcttattg

SEQ ID NO: 65182 - DNA, 201 bp, Homo sapiens
tagtgttagctcttatgtttaggcctctgatccatttggaattacatctccacctttcttaactatctgtggctccttgggaaaactacccttctttcctrattcagacactggggatgggaaaattacctcaaatgaaggttaaaaaaattgcatgtatctcctatactacctaacactgagagctcaataatattttgt

SEQ ID NO: 65183 - DNA, 201 bp, Homo sapiens
ggcctttgcagctcagtctcatagaggcagagagggggaaagaatgggaagattcccagcctcatctctttcttctcctcttccaggtgctgcacttgggkgtgcagatgctgatgctgagctgtgggctgcagcagatgcaggatggggagctcacccagggcagcctgctttcctttatgatctaccaggagagcgtgg

SEQ ID NO: 65184 - DNA, 201 bp, Homo sapiens
acaaacatctttaaaagtgtataacaacaaagccattatcacaccaaaaaattaacagtagttcttaaaatttatcaaatagtcaattgtcaaatttccayttgtggtatccatgtagtatatgtgtatgagtgtgtttattatactttgcttaaatcaggatccagaaatggtccacatattgtgactggttgatacatc

SEQ ID NO: 65185 - DNA, 201 bp, Homo sapiens
tgcttcagggccctctggggactttgcttcctcaagggctgccaggactatggctggaggggaccctgcggctgggagggctgtgggggctgctaaagctragagggctgctgggatttgtggggacactgctgctcccgctctgtctggccacccccctgactgtctccctgagagccctggtcgcgggggcctcacgtg

SEQ ID NO: 65186 - DNA, 201 bp, Homo sapiens
ctcacctgctctgtccttcttaggggagctgaactcacggctgagctcggataccaccctgatgagtaactggcttcctttaaatgccaatgtgctcttgsgaagcctggtgaaagtggtggggctgtatggcttcatgctcagcatatcgcctcgactcaccctcctttctctgctgcacatgcccttcacaatagcagc

SEQ ID NO: 65187 - DNA, 201 bp, Homo sapiens
ttttgagtatggaggaggagcagtgcagttgtgagtggagtgtgtgaggagttgggagggtggtttctggtagaagtgtgtttaattagccggctctcccrttcctgttttccagaccctggtatacatatatggggatatgctcagcaacgtgggagctgcagagaaggttttctcctacatggaccgacagccaaatct

SEQ ID NO: 65188 - DNA, 201 bp, Homo sapiens
tagaaaatttagacaatataaaaaagtacaaagaagaaaagtaaaagtacccattgtttcacttcctggagataaccatagttgctattttgctgcctgtyccatcagtcgtttatctgttgtttgagatagaaattaaccaaaaatgacataaatattcatgagattgccttcctatatccctccttgttcctaccagtg

SEQ ID NO: 65189 - DNA, 201 bp, Homo sapiens
acgggaaggcgcaccaggtgttcattctgagggaggtaggtggggaggacaaaagggcccctgccttgggggtttacacatagtcctctgcccctgtcccygctgcacaggtggtttcagttgggcaggagcctgtgctgttctccggttctgtgaggaacaacattgcttatgggctgcagagctgcgaagatgataagg

SEQ ID NO: 65190 - DNA, 201 bp, Homo sapiens
atgataaggtgatggcggctgcccaggctgcccacgcagatgacttcatccaggaaatggagcatggaatatacacaggtatcttctacaaattgtaagcytgctccttcagtaaaaaagagaaaatcagacttactcttagtggtgaaggtcgtgtccctgtagcttgatgtttgctgttcctctgccctttcctccatt

SEQ ID NO: 65191 - DNA, 201 bp, Homo sapiens
tggaatatacacaggtatcttctacaaattgtaagcttgctccttcagtaaaaaagagaaaatcagacttactcttagtggtgaaggtcgtgtccctgtarcttgatgtttgctgttcctctgccctttcctccattcctacgtctccttccccacacactgaattcttcagcctccctcttgctcaagagtctttgtttg

SEQ ID NO: 65192 - DNA, 201 bp, Homo sapiens
cagtctgtgccttcttggggttggggaatggaatccggtggtgtgagggcagccccagttccctcctgggcttccattcctccagctgtggcagtacagcygggagagaagggcagtccaggcctttatctactgccctttcctaccttcttttatttcacaccttctttaccctaaatcataagagatggtgcccaggtg

SEQ ID NO: 65193 - DNA, 201 bp, Homo sapiens
ctgtatggtaggagaagggactgtatatcctttatattgcaaattggaacactggggtattggtgccacttttaaattccgtccaaattgtacatttaaargtggagaatctcttttgagtatggaggaggagcagtgcagttgtgagtggagtgtgtgaggagttgggagggtggtttctggtagaagtgtgtttaatta

SEQ ID NO: 65194 - DNA, 201 bp, Homo sapiens
tcattcctgtctttctgaggcactgtgatcaccccttcagctgcaggactggaattcccgtggggatcgcacagtgctggtgattgctcacaggctgcagrcagttcagcgcgcccaccagatcctggtgctccaggagggcaagctgcagaagcttgcccagctctaggagggacaggacctctattcccgcctggtgca

SEQ ID NO: 65195 - DNA, 201 bp, Homo sapiens
tcgcacagtgctggtgattgctcacaggctgcagacagttcagcgcgcccaccagatcctggtgctccaggagggcaagctgcagaagcttgcccagctcyaggagggacaggacctctattcccgcctggtgcagcagcggctgatggactgaggccccagggatactgggccctcttctcaggggcgtctccaggaccc

SEQ ID NO: 65196 - DNA, 201 bp, Homo sapiens
agacagttcagcgcgcccaccagatcctggtgctccaggagggcaagctgcagaagcttgcccagctctaggagggacaggacctctattcccgcctggtkcagcagcggctgatggactgaggccccagggatactgggccctcttctcaggggcgtctccaggacccagagctgttcctgctttgagtttccctagagc

SEQ ID NO: 65197 - DNA, 201 bp, Homo sapiens
atactgggccctcttctcaggggcgtctccaggacccagagctgttcctgctttgagtttccctagagctgtgcggccagatagctgttcctgagttgcargcacgatggagatttggacactgtgtgcttttggtggggtagagaggtggggtggggtggggtgggggctgtctgtgtccaggaaacttaattccctggt

SEQ ID NO: 65198 - DNA, 201 bp, Homo sapiens
ctcaaatttcacagagggtaaaataggcatttggagagaaagaactctggcctgattcctttctctcccacaaatgtcctttattcataaaacaggaatartaattcctgtatctcccaactacatggaagctgcagccctcacagaagaagatgatctgagaaattctttgatttcctcagtacagttatacccatgcat

SEQ ID NO: 65199 - DNA, 201 bp, Homo sapiens
gcaagtataatattgatgttaaactatgacaatgcacaaatataaaaattgtagatgaatttacttattatactgacacaaaaatcctaaataaaacattscaaacagattctagcacagattaaaaaacacccattaagatcaaggggttttttttgttttttttttctagaaaaccctttggaagttcatgatattttg

SEQ ID NO: 65200 - DNA, 201 bp, Homo sapiens
aggggaccctgcggctgggagggctgtgggggctgctaaagctaagagggctgctgggatttgtggggacactgctgctcccgctctgtctggccaccccmctgactgtctccctgagagccctggtcgcgggggcctcacgtgctcccccagccagagtcgcttcagccccttggagctggctgctggtggggtacgggg

SEQ ID NO: 65201 - DNA, 201 bp, Homo sapiens
aattccaagacgtctcctttgcatatcccaatcgccctgacaggcctgtgctcaaggtgcctgaaagagggaggaaacctggacccttgctctctgctgckaatgcataattggacatcacagcctatagttcatttgcctctgagaacctggtcttgcctctgctaagaagagaaatggagggattttgagggagaaggg

SEQ ID NO: 65202 - DNA, 201 bp, Homo sapiens
agggaggaaacctggacccttgctctctgctgctaatgcataattggacatcacagcctatagttcatttgcctctgagaacctggtcttgcctctgctargaagagaaatggagggattttgagggagaaggggcaggcccttaactctttttctggttttctaggggctgacgtttaccctacgtcctggtgaggtgac

SEQ ID NO: 65203 - DNA, 201 bp, Homo sapiens
atgcataattggacatcacagcctatagttcatttgcctctgagaacctggtcttgcctctgctaagaagagaaatggagggattttgagggagaaggggyaggcccttaactctttttctggttttctaggggctgacgtttaccctacgtcctggtgaggtgacggcgctggtgggacccaatgggtctgggaagagca

SEQ ID NO: 65204 - DNA, 201 bp, Homo sapiens
atagttcatttgcctctgagaacctggtcttgcctctgctaagaagagaaatggagggattttgagggagaaggggcaggcccttaactctttttctggtyttctaggggctgacgtttaccctacgtcctggtgaggtgacggcgctggtgggacccaatgggtctgggaagagcacagtggctgccctgctgcagaatc

SEQ ID NO: 65205 - DNA, 201 bp, Homo sapiens
cctgtccccgctgcacaggtggtttcagttgggcaggagcctgtgctgttctccggttctgtgaggaacaacattgcttatgggctgcagagctgcgaagrtgataaggtgatggcggctgcccaggctgcccacgcagatgacttcatccaggaaatggagcatggaatatacacaggtatcttctacaaattgtaagct

SEQ ID NO: 65206 - DNA, 201 bp, Homo sapiens
taggtggggaggacaaaagggcccctgccttgggggtttacacatagtcctctgcccctgtccccgctgcacaggtggtttcagttgggcaggagcctgtrctgttctccggttctgtgaggaacaacattgcttatgggctgcagagctgcgaagatgataaggtgatggcggctgcccaggctgcccacgcagatgact

SEQ ID NO: 65207 - DNA, 201 bp, Homo sapiens
tgctattttgctgcctgtcccatcagtcgtttatctgttgtttgagatagaaattaaccaaaaatgacataaatattcatgagattgccttcctatatccytccttgttcctaccagtgtctgctattttgaagaagctagggtctggagggacagagaacagttccctgattaacagtattaatagtgacattggtaaca

SEQ ID NO: 65208 - DNA, 201 bp, Homo sapiens
atctggggctagaggcaatgctgtatggtaggagaagggactgtatatcctttatattgcaaattggaacactggggtattggtgccacttttaaattccrtccaaattgtacatttaaaagtggagaatctcttttgagtatggaggaggagcagtgcagttgtgagtggagtgtgtgaggagttgggagggtggtttct

SEQ ID NO: 65209 - DNA, 201 bp, Homo sapiens
attttgaagaagctagggtctggagggacagagaacagttccctgattaacagtattaatagtgacattggtaacagctaccatttatagagttttaatgkgagtaggagctatgctaagtgtttttcatgtattatcgtttttaatcattatctccaaccctatgaggttggttattatccccattttacagatgaggaa

SEQ ID NO: 65210 - DNA, 201 bp, Homo sapiens
attaatagtgacattggtaacagctaccatttatagagttttaatgtgagtaggagctatgctaagtgtttttcatgtattatcgtttttaatcattatcyccaaccctatgaggttggttattatccccattttacagatgaggaaactgaagctcaaagaggctcaatgactttcccaaggtggtcgtagtggtggagt

SEQ ID NO: 65211 - DNA, 201 bp, Homo sapiens
atggacgggttaggcggagccgggcgggtaggagggcagggacaaggattgggactccacccccatgatttctcatctcgtatccgttgacagagccatgyggctccctgacctgagaccctggacctccctgctgctggtggacgcggctttactgtggctgcttcagggccctctggggactttgcttcctcaagggct

SEQ ID NO: 65212 - DNA, 201 bp, Homo sapiens
ttccttgtccttgctgttttgggtgagtcaggagaggacgttgtgagttggaggtggtaaaagggcctgggcaccagcacattcttgtgttatttttcatkcctctttcaggtgagacattaatccctcactattctggtcgtgtgattgacatcctgggaggtgattttgacccccatgcctttgccagtgccatcttct

SEQ ID NO: 65213 - DNA, 201 bp, Homo sapiens
gttgtctctcaacattcctaggtccatgaaattccatttctttctgcctcctacctcctacccctaagtctgtctccaaagtatctctccagggtcactcyctcaggatgggtatgcttctccctctcactcttctttcccagctcatcttgctaatccctgaagatcttactctgaggcttatcacctttctttccagaa

SEQ ID NO: 65214 - DNA, 201 bp, Homo sapiens
aaagcctttggttcctcagtttccaaatggattctcactaggtgggatcatgagtttgctttggacaccccaaattctaactatttcttttgtttcttacrtcctttccctcttccccagccccttcccctcatgttacacctcttgctggtttgagacgtcaatcaccactgagaaagaattaaaccagtattttgagct

SEQ ID NO: 65215 - DNA, 201 bp, Homo sapiens
tcaaggtgcctgaaagagggaggaaacctggacccttgctctctgctgctaatgcataattggacatcacagcctatagttcatttgcctctgagaacctrgtcttgcctctgctaagaagagaaatggagggattttgagggagaaggggcaggcccttaactctttttctggttttctaggggctgacgtttaccctac

SEQ ID NO: 65216 - DNA, 201 bp, Homo sapiens
aattagactgaatctatttgctgtatgaataattataaatgggcttcttaactgaactaaataaatgaaaatatttttaaattagattaagataaaaactstattatttgcaatatgcaaaagacacctaacataaagccactcagaaagatgtattcattattttcaacaaataagatgatgggcaaagacataacaaga

SEQ ID NO: 65217 - DNA, 201 bp, Homo sapiens
atctgtaccagcccacagggggacaggtgctgctggatgaaaagcccatctcacagtatgaacactgctacctgcacagccaggtgggtgaggagggagargacaggggacaggagaggggagcatgtacagagagaggatgggagatccacgggaaggcgcaccaggtgttcattctgagggaggtaggtggggaggaca

SEQ ID NO: 65218 - DNA, 201 bp, Homo sapiens
tatttgcaatatgcaaaagacacctaacataaagccactcagaaagatgtattcattattttcaacaaataagatgatgggcaaagacataacaagagaakgcaaacaaaagggaagcagaggtcacattcgtcttaccaaacaagatgaaattcagacactcctcaccaaaaaaaaaaaaaaaaaaaaaaaattgagtgt

SEQ ID NO: 65219 - DNA, 201 bp, Homo sapiens
tgagggaggtaggtggggaggacaaaagggcccctgccttgggggtttacacatagtcctctgcccctgtccccgctgcacaggtggtttcagttgggcargagcctgtgctgttctccggttctgtgaggaacaacattgcttatgggctgcagagctgcgaagatgataaggtgatggcggctgcccaggctgcccacg

SEQ ID NO: 65220 - DNA, 201 bp, Homo sapiens
ctttgcagctcagtctcatagaggcagagagggggaaagaatgggaagattcccagcctcatctctttcttctcctcttccaggtgctgcacttgggggtrcagatgctgatgctgagctgtgggctgcagcagatgcaggatggggagctcacccagggcagcctgctttcctttatgatctaccaggagagcgtgggga

SEQ ID NO: 65221 - DNA, 201 bp, Homo sapiens
tgaatctgggaggcaaaggttgtagcgagccaagatcgcaccactgcactccagcctgggcggcacagtgagactctgcctcaaaaaaaaaaaaaaaaaaagtatgaacacagaagatagaagatattactatcaataaaaaaatagatatgctacatctatatcaaacttttaaaattgaaaatagaggccgggtgcagt

SEQ ID NO: 65222 - DNA, 201 bp, Homo sapiens
tggggccgaggagcatgaagtctgtcgctataaagaggcccttgaacaatgtcggcagctgtattggcggagagacctggaacgcgccttgtacctgctcrtaaggagggtaagataccagagtggttgtgaaaggagcccaggaaagggggagggcaagggaagaggaaactacagctggttctagaggcctttgcagct

SEQ ID NO: 65223 - DNA, 201 bp, Homo sapiens
gtcatacttaatttagagtaccctcgaaaaccatttcattgtgccttcattccatcctggctgctttctgctgaaactacagtcgtgcactgcataacgawgtttaggtcaatgatgggccacatataagatggtggacccacaagattataataccatatttttactgtaccttttctatgtttagatacacaaatactt

SEQ ID NO: 65224 - DNA, 201 bp, Homo sapiens
caagagaatgcaaacaaaagggaagcagaggtcacattcgtcttaccaaacaagatgaaattcagacactcctcaccaaaaaaaaaaaaaaaaaaaaaaaattgagtgtgacaagaagggcactttataatgtaaagtataaaattcatatgaatatatgagacatgtgtttaagttctaaataccaaataggtagctctt

SEQ ID NO: 65225 - DNA, 201 bp, Homo sapiens
ccacaagattataataccatatttttactgtaccttttctatgtttagatacacaaatacttacttctgtgttacagtcgcccacagtgttaggtgcagtyatatgttgtacagatttgtagcctaggagcaataggctaaactacatggcctaggtgtgcagtaggctatgacatctaggtttgtgtaagtacactctat

SEQ ID NO: 65226 - DNA, 201 bp, Homo sapiens
aaaataaacacacacacaaacaacaataacaaatctgtctaaaatattggaaaatcagaatgagaaatgaaatatgactgtaacgataaaaatcagtaatraaaatgactattaaatttaaaaataaggcagagcaaccacaagtgacatgagaatgaggcagacaaagttaaagcacctaaagtctttgtcttgtttgaa

SEQ ID NO: 65227 - DNA, 201 bp, Homo sapiens
tattttgtaaaatacatgcttttatgctttatattttttcctctaagtgttactgtagcatgtagttggtctaagagggattttccaactcgaaggatgamagatgggaatcacatgactctggggctccagagaattgtgggggcagggaatttattattgcagttcccatgatgaagtatctatgatgacagagaaggg

SEQ ID NO: 65228 - DNA, 201 bp, Homo sapiens
tgccttcatagaggctatattaatttatagttccagcagcaacatatgagtttatctgtttctccatatatatatatatatatatatatatatatatatawccaacagacagtgttaatttttaaaattttgacaatcttctgggtgaaagtagcattgtattgtagttatcatttgctttttaatattatcatgtaagta

SEQ ID NO: 65229 - DNA, 201 bp, Homo sapiens
ggcggaggagacgcacagagggacaagcctgagggacgctgggacagaagcaagcactgggatacttgttttcacaatatcttttcccttctattgtagtyttctattgtgtctagtacagagtgcactccataaatacttgtaaatttgtacatgttatgattttgttctcacatctagctcaccatgtctcctctttct

SEQ ID NO: 65230 - DNA, 201 bp, Homo sapiens
agatattgcaaaattgccttcatagaggctatattaatttatagttccagcagcaacatatgagtttatctgtttctccatatatatatatatatatatatatatatatatataaccaacagacagtgttaatttttaaaattttgacaatcttctgggtgaaagtagcattgtattgtagttatcatttgctttttaata

SEQ ID NO: 65231 - DNA, 201 bp, Homo sapiens
ttatattgtggtaaaacatacataacataaaatttaccatttcaaccatttgaagtgtacagttcagtgacatttaggaaacccacattgttattgggtarccatcatcaccatccatctccagaacttttttcatcttcctaaaatgaaactctgtacccactaaatagtaactgcctactacccccaacccctggccgc

SEQ ID NO: 65232 - DNA, 201 bp, Homo sapiens
tattgatagatattgcaaaattgccttcatagaggctatattaatttatagttccagcagcaacatatgagtttatctgtttctccatatatatatatatrtatatatatatatatatataaccaacagacagtgttaatttttaaaattttgacaatcttctgggtgaaagtagcattgtattgtagttatcatttgctt

SEQ ID NO: 65233 - DNA, 201 bp, Homo sapiens
tggattttgttgactgaatccctgtggtattatatgctcttctgcctctgtacttcctgtctattgatagataaacctagaagcttgtgagattgaggggktttttttggtctttttccagcaacagtactttttaggtggtgatgcattcttcctccaagaggcacacaatgtctggttctctatttgtggcaacatcag

SEQ ID NO: 65234 - DNA, 201 bp, Homo sapiens
ggacctgcctctcctcgttgccgccttcttcttccttgtccttgctgttttgggtgagtcaggagaggacgttgtgagttggaggtggtaaaagggcctgsgcaccagcacattcttgtgttatttttcatgcctctttcaggtgagacattaatccctcactattctggtcgtgtgattgacatcctgggaggtgatttt

SEQ ID NO: 65235 - DNA, 201 bp, Homo sapiens
gcccgagccctgacgcccgccctggccgagcgtagctggcggaccagagccggtagcgaggttgggagagacggagcggacctcagcgctgaagcagaagyccccggagctgcggtctccccgccgcggctggtgagttggtgcggaggggaacctggagcgccaacagggacgcagcccaagtgactacccactccacgc

SEQ ID NO: 65236 - DNA, 201 bp, Homo sapiens
catgcttccagctccccagaaggccgaaagctgtctgtcgtaggaggggtgtacggatgagcaccggttactcaggagagctctcagggttgaataggatraaatgagaagccgatggacgggttaggcggagccgggcgggtaggagggcagggacaaggattgggactccacccccatgatttctcatctcgtatccgt

SEQ ID NO: 65237 - DNA, 201 bp, Homo sapiens
attctggtcgtgtgattgacatcctgggaggtgattttgacccccatgcctttgccagtgccatcttcttcatgtgcctcttctcctttggcaggtaggtrgtgggcagctgggtccatttgctagccccaaatctttataggggtcttcacttccctaactccatttctaggccctttcaggcgcaaaacacaaaaatac

SEQ ID NO: 65238 - DNA, 201 bp, Homo sapiens
ttctggtcgtgtgattgacatcctgggaggtgattttgacccccatgcctttgccagtgccatcttcttcatgtgcctcttctcctttggcaggtaggtgrtgggcagctgggtccatttgctagccccaaatctttataggggtcttcacttccctaactccatttctaggccctttcaggcgcaaaacacaaaaatact

SEQ ID NO: 65239 - DNA, 201 bp, Homo sapiens
gttgggagggtggtttctggtagaagtgtgtttaattagccggctctcccattcctgttttccagaccctggtatacatatatggggatatgctcagcaaygtgggagctgcagagaaggttttctcctacatggaccgacagccaaatctgccttcacctggcacgcttgcccccaccactctgcagggggttgtgaaat

SEQ ID NO: 65240 - DNA, 201 bp, Homo sapiens
atgaaattccatttctttctgcctcctacctcctacccctaagtctgtctccaaagtatctctccagggtcactctctcaggatgggtatgcttctccctytcactcttctttcccagctcatcttgctaatccctgaagatcttactctgaggcttatcacctttctttccagaatcattactcttttcccttcacttgc

SEQ ID NO: 65241 - DNA, 201 bp, Homo sapiens
taattggacatcacagcctatagttcatttgcctctgagaacctggtcttgcctctgctaagaagagaaatggagggattttgagggagaaggggcaggcycttaactctttttctggttttctaggggctgacgtttaccctacgtcctggtgaggtgacggcgctggtgggacccaatgggtctgggaagagcacagtg

SEQ ID NO: 65242 - DNA, 201 bp, Homo sapiens
aaggtcgtgtccctgtagcttgatgtttgctgttcctctgccctttcctccattcctacgtctccttccccacacactgaattcttcagcctccctcttgmtcaagagtctttgtttgcagagagcaatgcagcagtggtgctccctccatgggcagccccgtcaggtccccaccccatggccctcctcccactgggccct

SEQ ID NO: 65243 - DNA, 201 bp, Homo sapiens
acacactgaattcttcagcctccctcttgctcaagagtctttgtttgcagagagcaatgcagcagtggtgctccctccatgggcagccccgtcaggtcccyaccccatggccctcctcccactgggccctccccgcactgggccctcccacctcccgaggtcctactggaagtacctgctgtgcacttgtccctccttgtg

SEQ ID NO: 65244 - DNA, 201 bp, Homo sapiens
gccggacctgcctctcctcgttgccgccttcttcttccttgtccttgctgttttgggtgagtcaggagaggacgttgtgagttggaggtggtaaaagggcmtgggcaccagcacattcttgtgttatttttcatgcctctttcaggtgagacattaatccctcactattctggtcgtgtgattgacatcctgggaggtgat

SEQ ID NO: 65245 - DNA, 201 bp, Homo sapiens
catggccctcctcccactgggccctccccgcactgggccctcccacctcccgaggtcctactggaagtacctgctgtgcacttgtccctccttgtgtgttrtctgtgtcacttgtatctgaggaagggaatttctctgatttcctcagatgtaggggagaaggggagccagctggctgcgggacagaaacaacgtctggcc

SEQ ID NO: 65246 - DNA, 201 bp, Homo sapiens
aagtacctgctgtgcacttgtccctccttgtgtgttatctgtgtcacttgtatctgaggaagggaatttctctgatttcctcagatgtaggggagaagggragccagctggctgcgggacagaaacaacgtctggccattgcccgggcccttgtacgagacccgcgggtcctcatcctggatgaggctactagtgccctag

SEQ ID NO: 65247 - DNA, 201 bp, Homo sapiens
gcccctcctggcatgctttcccctgactttgcgcttctctgcactcctggcttgctcctctgtttcacccgctggcttgctccttctctgcatctccctcycctcttattctcctaccccacagctcactgtctgcaggctgccgaggaggctgcttcacctacaccatgtctcgaatcaacttgcggatccgggagcagc

SEQ ID NO: 65248 - DNA, 201 bp, Homo sapiens
gtctggccattgcccgggcccttgtacgagacccgcgggtcctcatcctggatgaggctactagtgccctagatgtgcagtgcgagcaggccgtgagtacygtgagagggcaggggacagtggggcctgggaggggcatgctgggaggatcagcctgtgcagaattgggcagagggaggacgaaggacctactagtagaaa

SEQ ID NO: 65249 - DNA, 201 bp, Homo sapiens
ttgcccctcctggcatgctttcccctgactttgcgcttctctgcactcctggcttgctcctctgtttcacccgctggcttgctccttctctgcatctcccycccctcttattctcctaccccacagctcactgtctgcaggctgccgaggaggctgcttcacctacaccatgtctcgaatcaacttgcggatccgggagca

SEQ ID NO: 65250 - DNA, 201 bp, Homo sapiens
gaggctactagtgccctagatgtgcagtgcgagcaggccgtgagtactgtgagagggcaggggacagtggggcctgggaggggcatgctgggaggatcagmctgtgcagaattgggcagagggaggacgaaggacctactagtagaaacagtctgtgccttcttggggttggggaatggaatccggtggtgtgagggcagc

SEQ ID NO: 65251 - DNA, 201 bp, Homo sapiens
agaaacatttactaacttgcctgggtcacatagctaaggaagaggtggacttgcccagctttgcataaaactcctcaaaagagttgcctatactccctgaytccacttatcttcctactatcctctttttaaaatatattatttatttatttaaataagcaatatatgaatgtggtttgaaattcaaaagacacaaagaag

SEQ ID NO: 65252 - DNA, 201 bp, Homo sapiens
agctccccgtctaatcaagcaagacagaactgggcacaagtaataggaagcagtaactgaaaagatctggggctagaggcaatgctgtatggtaggagaakggactgtatatcctttatattgcaaattggaacactggggtattggtgccacttttaaattccgtccaaattgtacatttaaaagtggagaatctctttt

SEQ ID NO: 65253 - DNA, 201 bp, Homo sapiens
actagtgccctagatgtgcagtgcgagcaggccgtgagtactgtgagagggcaggggacagtggggcctgggaggggcatgctgggaggatcagcctgtgyagaattgggcagagggaggacgaaggacctactagtagaaacagtctgtgccttcttggggttggggaatggaatccggtggtgtgagggcagccccagt

SEQ ID NO: 65254 - DNA, 201 bp, Homo sapiens
ttggatgccaaaacacctccatagcctgtctgcccggccctatgtggaaacagcattgagtttcaagtcctttatgcctccacccagggatagccacttgkaatccacatggcaattgtgaaacaagcaggaaatgcgtaattgtcagaattttgtggggaaaggactagggaataaggaaaacaaagatcttccttgtgt

SEQ ID NO: 65255 - DNA, 201 bp, Homo sapiens
ccgtctaatcaagcaagacagaactgggcacaagtaataggaagcagtaactgaaaagatctggggctagaggcaatgctgtatggtaggagaagggactrtatatcctttatattgcaaattggaacactggggtattggtgccacttttaaattccgtccaaattgtacatttaaaagtggagaatctcttttgagtat

SEQ ID NO: 65256 - DNA, 201 bp, Homo sapiens
aaaaatgctccctgaaagtcaaaatattcgggctagacagacaaattcctgtaagtgtggtttgtctgggaaccacagatgtcactaatcctggtttgctycagagttctttttgttcactcctaccccccatcaccatttgattgatctccttaccctgtaatttccccttcttgtcgcttacctgcagtatctttccca

SEQ ID NO: 65257 - DNA, 201 bp, Homo sapiens
ttccatagcggcagcaccattttaaattcccaccagcagtgcataaggtttccaatttctccacatcctcatcaacaccactttctgttgtctttttttttaatagccattctaatggtgattaggtgattaggattatctcattgtggttttgatttgcatttccctaatgattagtaaatattgagcatcttttcgtgt

SEQ ID NO: 65258 - DNA, 201 bp, Homo sapiens
gtgtccaggaaacttaattccctggtgactagagctttgcctggtgatgaggagtattttgtggcataatacatatattttaaaatattttccttcttacrtgaactgtatacattcatatagaaaatttagacaatataaaaaagtacaaagaagaaaagtaaaagtacccattgtttcacttcctggagataaccatag

SEQ ID NO: 65259 - DNA, 201 bp, Homo sapiens
cctcctacccctaagtctgtctccaaagtatctctccagggtcactctctcaggatgggtatgcttctccctctcactcttctttcccagctcatcttgcyaatccctgaagatcttactctgaggcttatcacctttctttccagaatcattactcttttcccttcacttgctttcctttctctttctagacatactcaa

SEQ ID NO: 65260 - DNA, 201 bp, Homo sapiens
tcctacccctaagtctgtctccaaagtatctctccagggtcactctctcaggatgggtatgcttctccctctcactcttctttcccagctcatcttgctartccctgaagatcttactctgaggcttatcacctttctttccagaatcattactcttttcccttcacttgctttcctttctctttctagacatactcaaac

SEQ ID NO: 65261 - DNA, 201 bp, Homo sapiens
ttcccagctcatcttgctaatccctgaagatcttactctgaggcttatcacctttctttccagaatcattactcttttcccttcacttgctttcctttctytttctagacatactcaaacaaacaaactgtttgataaggctgggactgggatgaggtgagcgaggcacctggggtgcaaagtttaaggaggtgtgcactc

SEQ ID NO: 65262 - DNA, 201 bp, Homo sapiens
gggcctggagtccaggtctgagattcccatggacatcccttgcccctcagtgaccttccacccacagcctctcctcctgccttcacccgtatgccaggacytggggatgcttttctcttgtttgggacagggtggagaagcagcctccactgtccctctgcaagtgaaggaggatgttcagaggagggggctgtgtcagag

SEQ ID NO: 65263 - DNA, 201 bp, Homo sapiens
atgtaagggaaccccaaagggagaataaaactgacaggtgaggaggcttccacatttgtggctagaggatcccctagagagagatgttctcttctcagccrttaggggagaaggtatattgtagtatatactacattttgtttgtccagccatccaacaatggatatttgacttcagaagattcatgattctccagaactg

SEQ ID NO: 65264 - DNA, 201 bp, Homo sapiens
ccaaagggagaataaaactgacaggtgaggaggcttccacatttgtggctagaggatcccctagagagagatgttctcttctcagccattaggggagaagrtatattgtagtatatactacattttgtttgtccagccatccaacaatggatatttgacttcagaagattcatgattctccagaactgtaaacaaaaatgt

SEQ ID NO: 65265 - DNA, 201 bp, Homo sapiens
gggggtttacacatagtcctctgcccctgtccccgctgcacaggtggtttcagttgggcaggagcctgtgctgttctccggttctgtgaggaacaacattrcttatgggctgcagagctgcgaagatgataaggtgatggcggctgcccaggctgcccacgcagatgacttcatccaggaaatggagcatggaatatacac

SEQ ID NO: 65266 - DNA, 201 bp, Homo sapiens
aaactctgtacccactaaatagtaactgcctactacccccaacccctggccgctggcaacctccattgtaccttctgtctccatgaattgtgatgactccmggtgcggtacgtaagtggaaccatacagtatttgtctttttgtgactggcatattttacttagcgtaatgtcttcaggcctcatccatattgtagcatgt

SEQ ID NO: 65267 - DNA, 201 bp, Homo sapiens
catgtctcgaatcaacttgcggatccgggagcagcttttctcctccctgctgcgccaggacctcggtttcttccaggagactaagacaggtggggcctggwgtccaggtctgagattcccatggacatcccttgcccctcagtgaccttccacccacagcctctcctcctgccttcacccgtatgccaggacctggggatg

SEQ ID NO: 65268 - DNA, 201 bp, Homo sapiens
tgaggcagcagaatggcttgaacccaggaggcggagcttgcagtgagccgagatcacgccactgcactccagcctgggcgacagagcgaaactccatctcaaaaaaaaaaaaaaaaaaaaaaaaaaagatgccagggctggctgggcacagtggctcacacctgtaaccccaacactttggtttgggaggccaaggcggat

SEQ ID NO: 65269 - DNA, 201 bp, Homo sapiens
gctgaggcaggacgatcattggaacccaggagtttgaggctgcagtgagtgaaagagtgagaccccatccctaaaatacacacacacacacacacacacaccccccaagtaaaatttcagctggaatataaatcgtgggtattatactgatttatggagagaattatgctaagtctttcagatgaggaaaacatataagaa

SEQ ID NO: 65270 - DNA, 201 bp, Homo sapiens
ctgaggcaggacgatcattggaacccaggagtttgaggctgcagtgagtgaaagagtgagaccccatccctaaaatacacacacacacacacacacacaccccccaagtaaaatttcagctggaatataaatcgtgggtattatactgatttatggagagaattatgctaagtctttcagatgaggaaaacatataagaaa

SEQ ID NO: 65271 - DNA, 201 bp, Homo sapiens
atgaactctgtaggtggttctatcatgcagttagttttcagaaccattcacactgacagtaaaggctatttattcccagcagttgaaagaccactaaggacacaggaatggttagcaaagctacttaaagatgccagggctggggccgggtgcgatggctcacgcctgtaatcccagcactttgggaggccaaggtgggca

SEQ ID NO: 65272 - DNA, 201 bp, Homo sapiens
agatagctagatagataatagataaataaggtagatgacagattagatacagatgataaacagatatgctatcagtctagatctattactcacagtcagtygtatcacagtgtaattccatcaacttcatttgcagcaaaagaacagcccctgatgtacgcctgtttcctgaatatttggaaatattaatattaatataga

SEQ ID NO: 65273 - DNA, 201 bp, Homo sapiens
ttttagtctttacaatgtttttttctattatgcaatattctctcaaatactttatgtccatccacgttgtctgagacatgccactttaacattctagttaygctgtagctgtcattttaccctaagccgttagtagtactgatccacataaaattgggctgtttaggtgtttaactgtttaaatgtataatatatctgata

SEQ ID NO: 65274 - DNA, 201 bp, Homo sapiens
atgtcagggcttatgttgaaccttaactgagagcaagattcaaaagacactgaggcttatttttctttcttatatctatagttacacagggagctgtctartcttggatgtatccaagttgatatctggttttatccattgaaacccacagtgaaaatggtaaataggtgctaggtgtttggatttttttaatccaatgta

SEQ ID NO: 65275 - DNA, 201 bp, Homo sapiens
ccttttctttcactcttctgcaagacaaccccataagaaagctgaaacctgcttttgtgaaagcctatgattactataagacaggtgagcaaaacagaatmctagataaactcagttctttccagtgtggtgtctttgatggaaaaataaaataaaagccaatgtgtttggggtttttttcttttttactttatatagatt

SEQ ID NO: 65276 - DNA, 201 bp, Homo sapiens
agggctggggccgggtgcgatggctcacgcctgtaatcccagcactttgggaggccaaggtgggcagatcatgaggtcaggagatcgagaccatcctggctaacacaatgaagccccgtctctacaaacaaacaaacaaacaaacaaaatacaaaaaattagccggatgtggtggcaggcacctgtagtcccaactactcg

SEQ ID NO: 65277 - DNA, 201 bp, Homo sapiens
atgtccatgtgtacaaattatttagctcccacttataagtgagaatgtgaagtatttgacctcctgtttctgagttatttcacttgagatagtagcaacawgggtggaagtggaggccaaacctcaattcttaaaggaataaaagtgtggtaaacccttgtacatcttgttttcagtttaatctgtctccataacttattt

SEQ ID NO: 65278 - DNA, 201 bp, Homo sapiens
tcaggagatcgagaccatcctggctaacacaatgaagccccgtctctacaaacaaacaaacaaacaaacaaaatacaaaaaattagccggatgtggtggcrggcacctgtagtcccaactactcgggaggctgaggcagcagaatggcttgaacccaggaggcggagcttgcagtgagccgagatcacgccactgcactcc

SEQ ID NO: 65279 - DNA, 201 bp, Homo sapiens
aagtgagaatgtgaagtatttgacctcctgtttctgagttatttcacttgagatagtagcaacaagggtggaagtggaggccaaacctcaattcttaaagsaataaaagtgtggtaaacccttgtacatcttgttttcagtttaatctgtctccataacttattttttcttccttggcctacaaaactactgccaaaacta

SEQ ID NO: 65280 - DNA, 201 bp, Homo sapiens
cccatccctaaaatacacacacacacacacacacacaccccccaagtaaaatttcagctggaatataaatcgtgggtattatactgatttatggagagaaktatgctaagtctttcagatgaggaaaacatataagaaatatcatgcaagaaaaaagaagcaaatatggaacaagaactgaaagaacacatacccgcgtga

SEQ ID NO: 65281 - DNA, 201 bp, Homo sapiens
tgtttcagatgaagcaaatttgctgaatacagtgtcccctgcagccgataggcagtttgctctacatatcccaagccttcattttgctctcaaaagcagtyctcctaaatacaaaatcatctacatcttttattagttgatatcagatttatcatactgcaaggtaacgcagaactatacagctttggagaggaacactaa

SEQ ID NO: 65282 - DNA, 201 bp, Homo sapiens
attaaaagcaaataaatattctttctgacactttcagttttttttttcatgtactggaattcctcttaatctagaattgggagacctagttttgtttctctttttttttttttcgctctaccaaaattggaggggcctggtgttttacactatctaaagcccagagacttgaatttgtaattttatttttaacctatgcca

SEQ ID NO: 65283 - DNA, 201 bp, Homo sapiens
cctaggatttagatccctctcagatgttcaggcagaataattttgtcaggacaaaagtaaggtcacggaactatatgaaaatggattatgaatcctaagayatcagcctattctcccctatgtctaagaagaatattcctcagcttatgactggaatgtcttgctaggggtgctgggtaagttttgtggaggtccccacca

SEQ ID NO: 65284 - DNA, 201 bp, Homo sapiens
gccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctt

SEQ ID NO: 65285 - DNA, 201 bp, Homo sapiens
agatcgtgccattgcactccagcctgggcaacaagagcgaaactccgtctcagaaaaaacaaacaaacaaacaaaaaaacatttaattacacatatacacmcagatattacacatattcagtgcattcagaatcccagcaggatgtttgtggaaattaacaacttattctgaaattgttttgataatgaatagggccaaga

SEQ ID NO: 65286 - DNA, 201 bp, Homo sapiens
ccttatagttttctatcttatttttactgaggcttcctatttctttgccaagcctatgttttcatttatttcaaacatgttcataattgctcactgaagcatttttgtcgtggctgctttaaaatcttggtcagataattctaatgtctttgtcatcttagtgttggccttttcatttagtttgagatcttcctgattctt

SEQ ID NO: 65287 - DNA, 201 bp, Homo sapiens
aaaaccagaattataggtcaggtgcagtggctcacactcaatcctagcacttgggaggccaaggtgggaagactgcttgaggctaggagtttgagaccagygtgggcaatgcagtgaaaccctatcttgataaaaaaaaaaaattaacaccctccccgcccattatggtagcacaatgtagatagaattatcctgtaagcg

SEQ ID NO: 65288 - DNA, 201 bp, Homo sapiens
tgaatattaaaaaacgctttacttctgaatatataaaaaagccagaagaaggaatctagaaagtggaattggggaagttagagtaaataatgatgtccttyaaagcatgcatgccaactaaggtgaacttaacatatgttaaattcatcgtaataagaaccctctccatatccttaaatgtgagttaacacccttataaag

SEQ ID NO: 65289 - DNA, 201 bp, Homo sapiens
catggttaaggatgagattgtatggggtctgttctcagctgtaactattaatcaattagaaagcagatagtattacctttcttcctttaaaacatagtgcygagtgatatgatgcctatgagaatagaggcaaaattcacagatagtttcatagctgatggtgtcatttgaacaaataagatagattgtactggaggaatc

SEQ ID NO: 65290 - DNA, 201 bp, Homo sapiens
gtgagctagttgtgtgcttagtatcaaatagtattcatggtaaatgctcaaaacttccccagaggggaatcacgttaatgcaaatgtgcaaaataaaaagrtgtgtcttaaatttaaggatgcatccttaattgtgtacagcttcattattttacaggattgtttgtggcatttcttacttcaaaacctgattttaaaaaa

SEQ ID NO: 65291 - DNA, 201 bp, Homo sapiens
tctctatcaaccctagtcgaaggccaaattatgggccatagttaaggaatttcctgacccttatgaagatcggatttgctttaccaaagaatttgaactcmcaattaaaatctatgacccaggtcattctgacatttatcggcttgtctacatgctggtttcagctgcttaagctaaggaatagctagaaaaagcacagtg

SEQ ID NO: 65292 - DNA, 201 bp, Homo sapiens
ccaggagcttgaaaccagcctgggcaacatggggaaacccatctctacaaaaaatacaaacaaaaaactcaccagacgtggcggtacatgcctgtagtccwagctacgtcggaggctgaagtgagaggatcacctgagcctgggaggttgaggaaatgaagatactaaaataaaaataaaatttaaaaaggcatgcatggt

SEQ ID NO: 65293 - DNA, 201 bp, Homo sapiens
cccagtctaaagactacattgaaaccaaagaaagtgaaaactctatctgggaacaggataaaaagcaaccagatcagtaaactgcagaaggaatttaaacrtcatagtaagtttgatattacaacattagtacttaataattgttttgttatttttggctgggggtggtgtatggcatgtgtggatcattttttcctttat

SEQ ID NO: 65294 - DNA, 201 bp, Homo sapiens
tatagcacttgttatgtgatacatgatgtgggggtgattggtgggcgaaaatggtctgttcaataagtgttgctaggatattaagaacaacatggttattcatgtggaaaaattgggcttgggttccctacctcacaccatagacaaacaccaattacagatgcattaaagtagaaaatagattatgacttttgagtggga

SEQ ID NO: 65295 - DNA, 201 bp, Homo sapiens
cccatctttggtctgacccaccaccccacttaaaagttccacagtctttgggttaggctggctttctccagaaatgttcaagtatggagtgataaagtcaytgggagacatgaaaaattcaccatttttctcaatgcttgcatacttcaaaaatattgttataagctcagttggatctgctctctcagttaaagccacctt

SEQ ID NO: 65296 - DNA, 201 bp, Homo sapiens
tattcagtattttcttccaggtggtagatgcaagggctggacccagtctaaagactacattgaaaccaaagaaagtgaaaactctatctgggaacaggatraaaagcaaccagatcagtaaactgcagaaggaatttaaacgtcatagtaagtttgatattacaacattagtacttaataattgttttgttatttttggct
